United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 81

SEQ ID NO: 3421510 - DNA, 15 bp, Homo sapiens
taaaaatatatgttg

SEQ ID NO: 3421511 - DNA, 11 bp, Homo sapiens
taaaaggaaaa

SEQ ID NO: 3421512 - DNA, 18 bp, Homo sapiens
taaaagtttgtcctttaa

SEQ ID NO: 3421513 - DNA, 16 bp, Homo sapiens
taaaataattctaaag

SEQ ID NO: 3421514 - DNA, 23 bp, Homo sapiens
taaaatagttttgctttgttgaa

SEQ ID NO: 3421515 - DNA, 13 bp, Homo sapiens
taaaatattactg

SEQ ID NO: 3421516 - DNA, 20 bp, Homo sapiens
taaaatcataacattgattt

SEQ ID NO: 3421517 - DNA, 13 bp, Homo sapiens
taaaatctcaact

SEQ ID NO: 3421518 - DNA, 14 bp, Homo sapiens
taaaatcttcagct

SEQ ID NO: 3421519 - DNA, 16 bp, Homo sapiens
taaaatgcaatatttg

SEQ ID NO: 3421520 - DNA, 18 bp, Homo sapiens
taaaatgcaatatttgta

SEQ ID NO: 3421521 - DNA, 21 bp, Homo sapiens
taaaatgcttcactgtacgta

SEQ ID NO: 3421522 - DNA, 17 bp, Homo sapiens
taaaattgcagtttcat

SEQ ID NO: 3421523 - DNA, 18 bp, Homo sapiens
taaaattgcagtttcatg

SEQ ID NO: 3421524 - DNA, 19 bp, Homo sapiens
taaaattgcagtttcatgt

SEQ ID NO: 3421525 - DNA, 22 bp, Homo sapiens
taaaattgcagtttcatgtatg

SEQ ID NO: 3421526 - DNA, 15 bp, Homo sapiens
taaaattgtgatgtg

SEQ ID NO: 3421527 - DNA, 14 bp, Homo sapiens
taaacaaataataa

SEQ ID NO: 3421528 - DNA, 18 bp, Homo sapiens
taaacagatgtccctgaa

SEQ ID NO: 3421529 - DNA, 15 bp, Homo sapiens
taaacagtgtttatg

SEQ ID NO: 3421530 - DNA, 14 bp, Homo sapiens
taaacatctgtgtc

SEQ ID NO: 3421531 - DNA, 19 bp, Homo sapiens
taaacatctgtgtctgtgt

SEQ ID NO: 3421532 - DNA, 16 bp, Homo sapiens
taaaccttgtcaataa

SEQ ID NO: 3421533 - DNA, 19 bp, Homo sapiens
taaaccttgtttctttctg

SEQ ID NO: 3421534 - DNA, 13 bp, Homo sapiens
taaacttttcatt

SEQ ID NO: 3421535 - DNA, 23 bp, Homo sapiens
taaagaaaatgtgtctgcaacat

SEQ ID NO: 3421536 - DNA, 17 bp, Homo sapiens
taaagataagtctacat

SEQ ID NO: 3421537 - DNA, 15 bp, Homo sapiens
taaagattagggaaa

SEQ ID NO: 3421538 - DNA, 23 bp, Homo sapiens
taaagattagggaaaatggatat

SEQ ID NO: 3421539 - DNA, 20 bp, Homo sapiens
taaagcaatctgttgaaatg

SEQ ID NO: 3421540 - DNA, 15 bp, Homo sapiens
taaagctactgaatt

SEQ ID NO: 3421541 - DNA, 21 bp, Homo sapiens
taaagctactgaatttattgc

SEQ ID NO: 3421542 - DNA, 13 bp, Homo sapiens
taaagcttgattt

SEQ ID NO: 3421543 - DNA, 18 bp, Homo sapiens
taaagcttgatttgatct

SEQ ID NO: 3421544 - DNA, 12 bp, Homo sapiens
taaagctttatc

SEQ ID NO: 3421545 - DNA, 21 bp, Homo sapiens
taaagctttatctttgtgtaa

SEQ ID NO: 3421546 - DNA, 14 bp, Homo sapiens
taaaggacaaacag

SEQ ID NO: 3421547 - DNA, 22 bp, Homo sapiens
taaaggacaaacagtgaattta

SEQ ID NO: 3421548 - DNA, 13 bp, Homo sapiens
taaaggcttttgg

SEQ ID NO: 3421549 - DNA, 15 bp, Homo sapiens
taaagggagaaatgc

SEQ ID NO: 3421550 - DNA, 18 bp, Homo sapiens
taaagtgcattattttat

SEQ ID NO: 3421551 - DNA, 12 bp, Homo sapiens
taaataaagctc

SEQ ID NO: 3421552 - DNA, 15 bp, Homo sapiens
taaataaagctcaag

SEQ ID NO: 3421553 - DNA, 13 bp, Homo sapiens
taaataaatagaa

SEQ ID NO: 3421554 - DNA, 16 bp, Homo sapiens
taaataaatagaaaga

SEQ ID NO: 3421555 - DNA, 18 bp, Homo sapiens
taaataatataaaatgtt

SEQ ID NO: 3421556 - DNA, 16 bp, Homo sapiens
taatctgttgtttgaa

SEQ ID NO: 3421557 - DNA, 19 bp, Homo sapiens
taatgaaagtgatgacata

SEQ ID NO: 3421558 - DNA, 16 bp, Homo sapiens
taatgatttcctctga

SEQ ID NO: 3421559 - DNA, 13 bp, Homo sapiens
taatgatttttgt

SEQ ID NO: 3421560 - DNA, 18 bp, Homo sapiens
taatgcaatgataaataa

SEQ ID NO: 3421561 - DNA, 22 bp, Homo sapiens
taatgcaatgataaataaagtc

SEQ ID NO: 3421562 - DNA, 20 bp, Homo sapiens
taatgcttatgtgttgcata

SEQ ID NO: 3421563 - DNA, 22 bp, Homo sapiens
taatgtagggttatatttggga

SEQ ID NO: 3421564 - DNA, 22 bp, Homo sapiens
taatgttctccactgacacaaa

SEQ ID NO: 3421565 - DNA, 22 bp, Homo sapiens
taatgtttatgagccagacaaa

SEQ ID NO: 3421566 - DNA, 15 bp, Homo sapiens
taattaaaaacttta

SEQ ID NO: 3421567 - DNA, 18 bp, Homo sapiens
taattaaactagtttaag

SEQ ID NO: 3421568 - DNA, 16 bp, Homo sapiens
taattatctaaagtat

SEQ ID NO: 3421569 - DNA, 16 bp, Homo sapiens
taattctttgtttcct

SEQ ID NO: 3421570 - DNA, 22 bp, Homo sapiens
taattgaaatttaaaaataaag

SEQ ID NO: 3421571 - DNA, 22 bp, Homo sapiens
taattggcccaagtcattgttt

SEQ ID NO: 3421572 - DNA, 19 bp, Homo sapiens
taattgttgtttctttcta

SEQ ID NO: 3421573 - DNA, 22 bp, Homo sapiens
taattgttgtttctttctagtg

SEQ ID NO: 3421574 - DNA, 19 bp, Homo sapiens
taatttaaaattgtgatgt

SEQ ID NO: 3421575 - DNA, 19 bp, Homo sapiens
taatttatactggcatgct

SEQ ID NO: 3421576 - DNA, 15 bp, Homo sapiens
taatttgtcttagtt

SEQ ID NO: 3421577 - DNA, 17 bp, Homo sapiens
taatttgtcttagttga

SEQ ID NO: 3421578 - DNA, 15 bp, Homo sapiens
tacaaattcctttca

SEQ ID NO: 3421579 - DNA, 20 bp, Homo sapiens
tacaaattttttaatttcca

SEQ ID NO: 3421580 - DNA, 16 bp, Homo sapiens
tacaacaaacactgtg

SEQ ID NO: 3421581 - DNA, 14 bp, Homo sapiens
tacaaccaggtctt

SEQ ID NO: 3421582 - DNA, 15 bp, Homo sapiens
tacaaccaggtcttg

SEQ ID NO: 3421583 - DNA, 23 bp, Homo sapiens
tacaacccggttcactcttctca

SEQ ID NO: 3421584 - DNA, 20 bp, Homo sapiens
tacaagcttaaagcttgatt

SEQ ID NO: 3421585 - DNA, 17 bp, Homo sapiens
tacaagtgaacaaaata

SEQ ID NO: 3421586 - DNA, 22 bp, Homo sapiens
tacaatcgagactgcaatgtga

SEQ ID NO: 3421587 - DNA, 18 bp, Homo sapiens
tacacaccttatatttac

SEQ ID NO: 3421588 - DNA, 13 bp, Homo sapiens
tacacagttaaat

SEQ ID NO: 3421589 - DNA, 21 bp, Homo sapiens
tacacatctctgtcagtgtga

SEQ ID NO: 3421590 - DNA, 23 bp, Homo sapiens
tacagaagccaagctccctggag

SEQ ID NO: 3421591 - DNA, 19 bp, Homo sapiens
tacagagattgtagtattt

SEQ ID NO: 3421592 - DNA, 18 bp, Homo sapiens
tacagaggacagtatttg

SEQ ID NO: 3421593 - DNA, 20 bp, Homo sapiens
tacagatgtagatataaata

SEQ ID NO: 3421594 - DNA, 14 bp, Homo sapiens
tacaggcaccgaga

SEQ ID NO: 3421595 - DNA, 19 bp, Homo sapiens
tacaggcaccgagaatgtt

SEQ ID NO: 3421596 - DNA, 20 bp, Homo sapiens
tacaggcaccgagaatgttg

SEQ ID NO: 3421597 - DNA, 20 bp, Homo sapiens
tacagggcacaggccatgga

SEQ ID NO: 3421598 - DNA, 18 bp, Homo sapiens
tacagtctcaattttgta

SEQ ID NO: 3421599 - DNA, 19 bp, Homo sapiens
tacagtctcaattttgtat

SEQ ID NO: 3421600 - DNA, 21 bp, Homo sapiens
tacagtctcaattttgtattt

SEQ ID NO: 3421601 - DNA, 13 bp, Homo sapiens
tacagtgatatgg

SEQ ID NO: 3421602 - DNA, 15 bp, Homo sapiens
tacagttcataaatt

SEQ ID NO: 3421603 - DNA, 19 bp, Homo sapiens
tacatacagagattgtagt

SEQ ID NO: 3421604 - DNA, 15 bp, Homo sapiens
tacatacagtgatat

SEQ ID NO: 3421605 - DNA, 13 bp, Homo sapiens
tacattaaacaat

SEQ ID NO: 3421606 - DNA, 19 bp, Homo sapiens
tacattaaagaaatttaat

SEQ ID NO: 3421607 - DNA, 14 bp, Homo sapiens
tacatttatgattt

SEQ ID NO: 3421608 - DNA, 22 bp, Homo sapiens
tacatttatgatttaataaaat

SEQ ID NO: 3421609 - DNA, 15 bp, Homo sapiens
taccaagtatgaagt

SEQ ID NO: 3421610 - DNA, 16 bp, Homo sapiens
taccaagtatgaagta

SEQ ID NO: 3421611 - DNA, 13 bp, Homo sapiens
taccagtctgatt

SEQ ID NO: 3421612 - DNA, 14 bp, Homo sapiens
taccagtgggcatg

SEQ ID NO: 3421613 - DNA, 18 bp, Homo sapiens
taccatagagtaatgatg

SEQ ID NO: 3421614 - DNA, 15 bp, Homo sapiens
taccatgatgcatgg

SEQ ID NO: 3421615 - DNA, 12 bp, Homo sapiens
tacctcaggaaa

SEQ ID NO: 3421616 - DNA, 14 bp, Homo sapiens
tacctcaggaaaga

SEQ ID NO: 3421617 - DNA, 18 bp, Homo sapiens
tacctcaggaaagaatag

SEQ ID NO: 3421618 - DNA, 13 bp, Homo sapiens
tacctcttggctg

SEQ ID NO: 3421619 - DNA, 21 bp, Homo sapiens
taccttaattctttgtttcct

SEQ ID NO: 3421620 - DNA, 12 bp, Homo sapiens
taccttactgtg

SEQ ID NO: 3421621 - DNA, 24 bp, Homo sapiens
taccttctgttccttatgatattc

SEQ ID NO: 3421622 - DNA, 14 bp, Homo sapiens
tacctttttatatt

SEQ ID NO: 3421623 - DNA, 13 bp, Homo sapiens
tacggtgggggta

SEQ ID NO: 3421624 - DNA, 16 bp, Homo sapiens
tactaatgatgttttc

SEQ ID NO: 3421625 - DNA, 18 bp, Homo sapiens
tactgcttctctttgtgc

SEQ ID NO: 3421626 - DNA, 23 bp, Homo sapiens
tactggaaacctagccagcttca

SEQ ID NO: 3421627 - DNA, 20 bp, Homo sapiens
tactgggccatgttgtgcct

SEQ ID NO: 3421628 - DNA, 22 bp, Homo sapiens
tactgtggaggaaggattgtaa

SEQ ID NO: 3421629 - DNA, 16 bp, Homo sapiens
tacttagaatgccata

SEQ ID NO: 3421630 - DNA, 21 bp, Homo sapiens
tacttagaatgccataaaatt

SEQ ID NO: 3421631 - DNA, 16 bp, Homo sapiens
tacttgatcattctca

SEQ ID NO: 3421632 - DNA, 16 bp, Homo sapiens
tactttgtgtttagct

SEQ ID NO: 3421633 - DNA, 17 bp, Homo sapiens
tacttttaaaataaaat

SEQ ID NO: 3421634 - DNA, 13 bp, Homo sapiens
tacttttgagtat

SEQ ID NO: 3421635 - DNA, 22 bp, Homo sapiens
tacttttgagtatggctatcta

SEQ ID NO: 3421636 - DNA, 16 bp, Homo sapiens
tactttttaaaatgtt

SEQ ID NO: 3421637 - DNA, 13 bp, Homo sapiens
tactttttaaaca

SEQ ID NO: 3421638 - DNA, 12 bp, Homo sapiens
tagaaagaaagt

SEQ ID NO: 3421639 - DNA, 17 bp, Homo sapiens
tagaaagacagagctgg

SEQ ID NO: 3421640 - DNA, 17 bp, Homo sapiens
tagaaagacatctgcct

SEQ ID NO: 3421641 - DNA, 22 bp, Homo sapiens
tagaaagtatagatggccaaag

SEQ ID NO: 3421642 - DNA, 23 bp, Homo sapiens
tagaacaatgtacaaggtatgta

SEQ ID NO: 3421643 - DNA, 21 bp, Homo sapiens
tagaaccatgttggttgcact

SEQ ID NO: 3421644 - DNA, 14 bp, Homo sapiens
tagaagaagtgtgt

SEQ ID NO: 3421645 - DNA, 20 bp, Homo sapiens
tagaagcattccttctttga

SEQ ID NO: 3421646 - DNA, 14 bp, Homo sapiens
tagaataaatggtt

SEQ ID NO: 3421647 - DNA, 15 bp, Homo sapiens
tagacccatcttctt

SEQ ID NO: 3421648 - DNA, 23 bp, Homo sapiens
tagacctcttcctggaataaaca

SEQ ID NO: 3421649 - DNA, 14 bp, Homo sapiens
tagacctgtctcct

SEQ ID NO: 3421650 - DNA, 23 bp, Homo sapiens
tagagaagtaagcagagttcttt

SEQ ID NO: 3421651 - DNA, 16 bp, Homo sapiens
tagagatatttaaaag

SEQ ID NO: 3421652 - DNA, 22 bp, Homo sapiens
tagagatatttaaaagacaaac

SEQ ID NO: 3421653 - DNA, 20 bp, Homo sapiens
tagagcgtttggttaaagta

SEQ ID NO: 3421654 - DNA, 15 bp, Homo sapiens
tagagtaatgatgta

SEQ ID NO: 3421655 - DNA, 15 bp, Homo sapiens
tagagtgtttgtgag

SEQ ID NO: 3421656 - DNA, 23 bp, Homo sapiens
tagagtgtttgtgagctttttgt

SEQ ID NO: 3421657 - DNA, 17 bp, Homo sapiens
tagagttaagaagctgt

SEQ ID NO: 3421658 - DNA, 19 bp, Homo sapiens
tagagttaagaagctgttg

SEQ ID NO: 3421659 - DNA, 22 bp, Homo sapiens
tagatgtgcatttttgtgaaat

SEQ ID NO: 3421660 - DNA, 11 bp, Homo sapiens
tagatgtgtgg

SEQ ID NO: 3421661 - DNA, 17 bp, Homo sapiens
tagatttgaaaaacttt

SEQ ID NO: 3421662 - DNA, 21 bp, Homo sapiens
tagatttgaagatctgattta

SEQ ID NO: 3421663 - DNA, 13 bp, Homo sapiens
tagccaggatcat

SEQ ID NO: 3421664 - DNA, 20 bp, Homo sapiens
tagccaggatcatggtgtaa

SEQ ID NO: 3421665 - DNA, 15 bp, Homo sapiens
tagccagtcattgta

SEQ ID NO: 3421666 - DNA, 20 bp, Homo sapiens
tagctaataataaatgcata

SEQ ID NO: 3421667 - DNA, 14 bp, Homo sapiens
tatgcaaatgagat

SEQ ID NO: 3421668 - DNA, 23 bp, Homo sapiens
tatgcaaatgagatttctttgaa

SEQ ID NO: 3421669 - DNA, 23 bp, Homo sapiens
tatgcacgttaacagcgtgtcaa

SEQ ID NO: 3421670 - DNA, 15 bp, Homo sapiens
tatgccatttttagt

SEQ ID NO: 3421671 - DNA, 14 bp, Homo sapiens
tatgctgtatttct

SEQ ID NO: 3421672 - DNA, 19 bp, Homo sapiens
tatggagactttgctgtta

SEQ ID NO: 3421673 - DNA, 21 bp, Homo sapiens
tatggagactttgctgttact

SEQ ID NO: 3421674 - DNA, 13 bp, Homo sapiens
tatggcagaagac

SEQ ID NO: 3421675 - DNA, 14 bp, Homo sapiens
tatggcagaagaca

SEQ ID NO: 3421676 - DNA, 16 bp, Homo sapiens
tatggcagaagacacc

SEQ ID NO: 3421677 - DNA, 13 bp, Homo sapiens
tatggcagtgtct

SEQ ID NO: 3421678 - DNA, 13 bp, Homo sapiens
tatggcatttgca

SEQ ID NO: 3421679 - DNA, 19 bp, Homo sapiens
tatggcatttgcagatttt

SEQ ID NO: 3421680 - DNA, 22 bp, Homo sapiens
tatggctatctatacctgcctt

SEQ ID NO: 3421681 - DNA, 17 bp, Homo sapiens
tatggggatagatgtgt

SEQ ID NO: 3421682 - DNA, 20 bp, Homo sapiens
tatggggatagatgtgtgga

SEQ ID NO: 3421683 - DNA, 20 bp, Homo sapiens
tatgtaatgcttatgtgttg

SEQ ID NO: 3421684 - DNA, 18 bp, Homo sapiens
tatgtacaggatgctttg

SEQ ID NO: 3421685 - DNA, 19 bp, Homo sapiens
tatgtacagttcataaatt

SEQ ID NO: 3421686 - DNA, 17 bp, Homo sapiens
tatgtagatgtgcattt

SEQ ID NO: 3421687 - DNA, 13 bp, Homo sapiens
tatgtatacatat

SEQ ID NO: 3421688 - DNA, 21 bp, Homo sapiens
tatgtattaaacttttcatta

SEQ ID NO: 3421689 - DNA, 12 bp, Homo sapiens
tatgtggaagtg

SEQ ID NO: 3421690 - DNA, 18 bp, Homo sapiens
tatgtggatacagtcatt

SEQ ID NO: 3421691 - DNA, 14 bp, Homo sapiens
tatgtgtgtgtgtt

SEQ ID NO: 3421692 - DNA, 12 bp, Homo sapiens
tatgttacttaa

SEQ ID NO: 3421693 - DNA, 16 bp, Homo sapiens
tatgttacttaaacat

SEQ ID NO: 3421694 - DNA, 17 bp, Homo sapiens
tattaaaaatatacaag

SEQ ID NO: 3421695 - DNA, 15 bp, Homo sapiens
tattaaacttttcat

SEQ ID NO: 3421696 - DNA, 13 bp, Homo sapiens
tattaaaggcttt

SEQ ID NO: 3421697 - DNA, 19 bp, Homo sapiens
tattaaattaaattttgtg

SEQ ID NO: 3421698 - DNA, 13 bp, Homo sapiens
tattagccaggat

SEQ ID NO: 3421699 - DNA, 19 bp, Homo sapiens
tattagccaggatcatggt

SEQ ID NO: 3421700 - DNA, 18 bp, Homo sapiens
tattagccagtcattgta

SEQ ID NO: 3421701 - DNA, 22 bp, Homo sapiens
tattagcccttctccatggccc

SEQ ID NO: 3421702 - DNA, 21 bp, Homo sapiens
tattatttgtatgtattaaac

SEQ ID NO: 3421703 - DNA, 19 bp, Homo sapiens
tattcagctagaatttctg

SEQ ID NO: 3421704 - DNA, 16 bp, Homo sapiens
tattcagtgaaaaaga

SEQ ID NO: 3421705 - DNA, 18 bp, Homo sapiens
tattcatcaaataaacct

SEQ ID NO: 3421706 - DNA, 14 bp, Homo sapiens
tattctctgatgtt

SEQ ID NO: 3421707 - DNA, 18 bp, Homo sapiens
tattctgataatgtattg

SEQ ID NO: 3421708 - DNA, 18 bp, Homo sapiens
tattcttaaaatgcaata

SEQ ID NO: 3421709 - DNA, 21 bp, Homo sapiens
tattcttaaaatgcaatattt

SEQ ID NO: 3421710 - DNA, 15 bp, Homo sapiens
tattgaccatgtgat

SEQ ID NO: 3421711 - DNA, 21 bp, Homo sapiens
tattgagcaagtatccttcat

SEQ ID NO: 3421712 - DNA, 23 bp, Homo sapiens
tattgagtcttaactgtatttca

SEQ ID NO: 3421713 - DNA, 18 bp, Homo sapiens
tattgatcccttctcctg

SEQ ID NO: 3421714 - DNA, 23 bp, Homo sapiens
tattgatcccttctcctgccctt

SEQ ID NO: 3421715 - DNA, 17 bp, Homo sapiens
tatttaaaaaattaaaa

SEQ ID NO: 3421716 - DNA, 13 bp, Homo sapiens
tatttaaaagaca

SEQ ID NO: 3421717 - DNA, 18 bp, Homo sapiens
tatttaactacatctgcc

SEQ ID NO: 3421718 - DNA, 13 bp, Homo sapiens
tatttaataacat

SEQ ID NO: 3421719 - DNA, 17 bp, Homo sapiens
tatttaggcagattgaa

SEQ ID NO: 3421720 - DNA, 20 bp, Homo sapiens
tatttagtatatgaaatatt

SEQ ID NO: 3421721 - DNA, 23 bp, Homo sapiens
tatttagttacgtataatgcttt

SEQ ID NO: 3421722 - DNA, 13 bp, Homo sapiens
tatttatatcttg

SEQ ID NO: 3421723 - DNA, 18 bp, Homo sapiens
tatttatattcatcaaat

SEQ ID NO: 3421724 - DNA, 22 bp, Homo sapiens
tatttcagtattttccagcctt

SEQ ID NO: 3421725 - DNA, 14 bp, Homo sapiens
tatttcatcatgac

SEQ ID NO: 3421726 - DNA, 22 bp, Homo sapiens
tatttcctttgcgcaaacttta

SEQ ID NO: 3421727 - DNA, 16 bp, Homo sapiens
tatttctgagaaggtc

SEQ ID NO: 3421728 - DNA, 13 bp, Homo sapiens
tatttctttgtag

SEQ ID NO: 3421729 - DNA, 17 bp, Homo sapiens
tatttctttgtagaata

SEQ ID NO: 3421730 - DNA, 17 bp, Homo sapiens
tatttcttttgtgcaga

SEQ ID NO: 3421731 - DNA, 20 bp, Homo sapiens
tatttcttttgtgcagatca

SEQ ID NO: 3421732 - DNA, 13 bp, Homo sapiens
tatttgataacat

SEQ ID NO: 3421733 - DNA, 19 bp, Homo sapiens
tatttgataacattttgtt

SEQ ID NO: 3421734 - DNA, 16 bp, Homo sapiens
tatttgccatgggctt

SEQ ID NO: 3421735 - DNA, 17 bp, Homo sapiens
tatttgccatgggcttc

SEQ ID NO: 3421736 - DNA, 23 bp, Homo sapiens
tatttgtcggggaagatgaaacc

SEQ ID NO: 3421737 - DNA, 20 bp, Homo sapiens
tatttgttaatggtttgaat

SEQ ID NO: 3421738 - DNA, 22 bp, Homo sapiens
tatttgttaatggtttgaatat

SEQ ID NO: 3421739 - DNA, 16 bp, Homo sapiens
tattttatttctgatg

SEQ ID NO: 3421740 - DNA, 14 bp, Homo sapiens
tattttcattgtga

SEQ ID NO: 3421741 - DNA, 13 bp, Homo sapiens
tattttgccattt

SEQ ID NO: 3421742 - DNA, 16 bp, Homo sapiens
tattttgccatttagc

SEQ ID NO: 3421743 - DNA, 21 bp, Homo sapiens
tattttgtgcaacataacaat

SEQ ID NO: 3421744 - DNA, 20 bp, Homo sapiens
tatttttaaaatcataacat

SEQ ID NO: 3421745 - DNA, 12 bp, Homo sapiens
tatttttattat

SEQ ID NO: 3421746 - DNA, 19 bp, Homo sapiens
tattttttatatctggaat

SEQ ID NO: 3421747 - DNA, 16 bp, Homo sapiens
tcaaaaagtataaatt

SEQ ID NO: 3421748 - DNA, 11 bp, Homo sapiens
tcaaaaggaag

SEQ ID NO: 3421749 - DNA, 20 bp, Homo sapiens
tcaaaataaaaagcctcagt

SEQ ID NO: 3421750 - DNA, 16 bp, Homo sapiens
tcaaacatgaaaacat

SEQ ID NO: 3421751 - DNA, 17 bp, Homo sapiens
tcaaagcttcaaaaact

SEQ ID NO: 3421752 - DNA, 12 bp, Homo sapiens
tcaaaggccaga

SEQ ID NO: 3421753 - DNA, 19 bp, Homo sapiens
tcaaagttttgaaaagcta

SEQ ID NO: 3421754 - DNA, 20 bp, Homo sapiens
tcaaagttttgaaaagctat

SEQ ID NO: 3421755 - DNA, 22 bp, Homo sapiens
tcaaagttttgaaaagctatta

SEQ ID NO: 3421756 - DNA, 21 bp, Homo sapiens
tcaaattttttaaaagagaca

SEQ ID NO: 3421757 - DNA, 15 bp, Homo sapiens
tcaactataaccagt

SEQ ID NO: 3421758 - DNA, 15 bp, Homo sapiens
tcaactttcatttga

SEQ ID NO: 3421759 - DNA, 15 bp, Homo sapiens
tcaagaaaacaggca

SEQ ID NO: 3421760 - DNA, 13 bp, Homo sapiens
tcaagattttgaa

SEQ ID NO: 3421761 - DNA, 19 bp, Homo sapiens
tcaagcaggtttcttgctt

SEQ ID NO: 3421762 - DNA, 18 bp, Homo sapiens
tcaagtaagaagacatga

SEQ ID NO: 3421763 - DNA, 22 bp, Homo sapiens
tcaagtaagaagacatgaacca

SEQ ID NO: 3421764 - DNA, 13 bp, Homo sapiens
tcaatagtgtcct

SEQ ID NO: 3421765 - DNA, 19 bp, Homo sapiens
tcaatagtgtcctatgcaa

SEQ ID NO: 3421766 - DNA, 21 bp, Homo sapiens
tcaatagtgtcctatgcaata

SEQ ID NO: 3421767 - DNA, 17 bp, Homo sapiens
tcaatattttccatgaa

SEQ ID NO: 3421768 - DNA, 18 bp, Homo sapiens
tcaatattttccatgaaa

SEQ ID NO: 3421769 - DNA, 17 bp, Homo sapiens
tcaatgacagagccttc

SEQ ID NO: 3421770 - DNA, 18 bp, Homo sapiens
tcaatgacagagccttct

SEQ ID NO: 3421771 - DNA, 18 bp, Homo sapiens
tcaatggaagaaaccctt

SEQ ID NO: 3421772 - DNA, 19 bp, Homo sapiens
tcaatggtttgcaaggaag

SEQ ID NO: 3421773 - DNA, 22 bp, Homo sapiens
tcaatgtactaggatactgctg

SEQ ID NO: 3421774 - DNA, 13 bp, Homo sapiens
tcaattcagtgat

SEQ ID NO: 3421775 - DNA, 23 bp, Homo sapiens
tcaatttactttttaaacagtgt

SEQ ID NO: 3421776 - DNA, 13 bp, Homo sapiens
tcaatttccaaga

SEQ ID NO: 3421777 - DNA, 20 bp, Homo sapiens
tcaatttccaagagctgagg

SEQ ID NO: 3421778 - DNA, 15 bp, Homo sapiens
tccatgaaaatgcaa

SEQ ID NO: 3421779 - DNA, 14 bp, Homo sapiens
tccatggccctgcc

SEQ ID NO: 3421780 - DNA, 18 bp, Homo sapiens
tccatgggattttatctg

SEQ ID NO: 3421781 - DNA, 19 bp, Homo sapiens
tcccaagattttttcattt

SEQ ID NO: 3421782 - DNA, 22 bp, Homo sapiens
tcccagaggggcctgccacctg

SEQ ID NO: 3421783 - DNA, 21 bp, Homo sapiens
tcccaggctgccggctcccct

SEQ ID NO: 3421784 - DNA, 17 bp, Homo sapiens
tcccatttcgtgtaata

SEQ ID NO: 3421785 - DNA, 19 bp, Homo sapiens
tccccaatccatgcttcac

SEQ ID NO: 3421786 - DNA, 14 bp, Homo sapiens
tcccccaccgccca

SEQ ID NO: 3421787 - DNA, 15 bp, Homo sapiens
tcccccaccgcccac

SEQ ID NO: 3421788 - DNA, 16 bp, Homo sapiens
tcccccatgttctgtc

SEQ ID NO: 3421789 - DNA, 19 bp, Homo sapiens
tcccccatgttctgtccct

SEQ ID NO: 3421790 - DNA, 15 bp, Homo sapiens
tcccctctgccccac

SEQ ID NO: 3421791 - DNA, 21 bp, Homo sapiens
tcccctgcaatgcgtcttgtg

SEQ ID NO: 3421792 - DNA, 23 bp, Homo sapiens
tcccctgcaatgcgtcttgtgaa

SEQ ID NO: 3421793 - DNA, 13 bp, Homo sapiens
tcccctgccccca

SEQ ID NO: 3421794 - DNA, 15 bp, Homo sapiens
tcccctgcccccagg

SEQ ID NO: 3421795 - DNA, 17 bp, Homo sapiens
tcccctgccccctgcag

SEQ ID NO: 3421796 - DNA, 13 bp, Homo sapiens
tccccttctctca

SEQ ID NO: 3421797 - DNA, 15 bp, Homo sapiens
tccccttctctcatc

SEQ ID NO: 3421798 - DNA, 16 bp, Homo sapiens
tccccttctctcatct

SEQ ID NO: 3421799 - DNA, 14 bp, Homo sapiens
tcccgtaaggctgt

SEQ ID NO: 3421800 - DNA, 16 bp, Homo sapiens
tccctgaagtcttgca

SEQ ID NO: 3421801 - DNA, 17 bp, Homo sapiens
tccctgaagtcttgcat

SEQ ID NO: 3421802 - DNA, 20 bp, Homo sapiens
tccctgaagtcttgcattga

SEQ ID NO: 3421803 - DNA, 21 bp, Homo sapiens
tccctgagttgcaccattctt

SEQ ID NO: 3421804 - DNA, 20 bp, Homo sapiens
tccctgcctcaggcctctgt

SEQ ID NO: 3421805 - DNA, 17 bp, Homo sapiens
tccctgcctgtttcccg

SEQ ID NO: 3421806 - DNA, 14 bp, Homo sapiens
tccctggagccctg

SEQ ID NO: 3421807 - DNA, 19 bp, Homo sapiens
tccctggtgagagggccgg

SEQ ID NO: 3421808 - DNA, 14 bp, Homo sapiens
tcccttgcccccct

SEQ ID NO: 3421809 - DNA, 14 bp, Homo sapiens
tcctacaaccaggt

SEQ ID NO: 3421810 - DNA, 17 bp, Homo sapiens
tcctacaaccaggtctt

SEQ ID NO: 3421811 - DNA, 23 bp, Homo sapiens
tcctatctagcatttatttctct

SEQ ID NO: 3421812 - DNA, 16 bp, Homo sapiens
tcctatgcaataaaat

SEQ ID NO: 3421813 - DNA, 18 bp, Homo sapiens
tcctatttgccatgggct

SEQ ID NO: 3421814 - DNA, 23 bp, Homo sapiens
tcctcaactcacctaatgtttat

SEQ ID NO: 3421815 - DNA, 12 bp, Homo sapiens
tcctcagctccc

SEQ ID NO: 3421816 - DNA, 15 bp, Homo sapiens
tcctccatttttgtt

SEQ ID NO: 3421817 - DNA, 23 bp, Homo sapiens
tcctcccttgagaattccctgtg

SEQ ID NO: 3421818 - DNA, 13 bp, Homo sapiens
tcctcctccaggg

SEQ ID NO: 3421819 - DNA, 17 bp, Homo sapiens
tcctcctccagggacag

SEQ ID NO: 3421820 - DNA, 15 bp, Homo sapiens
tcctctgaatattaa

SEQ ID NO: 3421821 - DNA, 13 bp, Homo sapiens
tcctgcatgtgta

SEQ ID NO: 3421822 - DNA, 13 bp, Homo sapiens
tcctgccacagga

SEQ ID NO: 3421823 - DNA, 22 bp, Homo sapiens
tcctgccccagatggctttgtg

SEQ ID NO: 3421824 - DNA, 15 bp, Homo sapiens
tcctgccgcagagct

SEQ ID NO: 3421825 - DNA, 22 bp, Homo sapiens
tcctgctgtaaatttggcttct

SEQ ID NO: 3421826 - DNA, 13 bp, Homo sapiens
tcctggaataaac

SEQ ID NO: 3421827 - DNA, 22 bp, Homo sapiens
tcctggaataaacatctgtgtc

SEQ ID NO: 3421828 - DNA, 19 bp, Homo sapiens
tccttagagacatcaaaat

SEQ ID NO: 3421829 - DNA, 13 bp, Homo sapiens
tccttcagccctc

SEQ ID NO: 3421830 - DNA, 15 bp, Homo sapiens
tccttcagccctcac

SEQ ID NO: 3421831 - DNA, 19 bp, Homo sapiens
tccttcagccctcacccct

SEQ ID NO: 3421832 - DNA, 21 bp, Homo sapiens
tccttcctcacaccaggcttg

SEQ ID NO: 3421833 - DNA, 20 bp, Homo sapiens
tccttctttgataatgttaa

SEQ ID NO: 3421834 - DNA, 12 bp, Homo sapiens
tccttgaaacag

SEQ ID NO: 3421835 - DNA, 13 bp, Homo sapiens
tccttgtggccta

SEQ ID NO: 3421836 - DNA, 18 bp, Homo sapiens
tccttgtggcctatgaaa

SEQ ID NO: 3421837 - DNA, 22 bp, Homo sapiens
tcctttaaaaaaatttaagtgc

SEQ ID NO: 3421838 - DNA, 17 bp, Homo sapiens
tcctttaactatcagag

SEQ ID NO: 3421839 - DNA, 16 bp, Homo sapiens
tcctttaggtttgaaa

SEQ ID NO: 3421840 - DNA, 17 bp, Homo sapiens
tcctttaggtttgaaag

SEQ ID NO: 3421841 - DNA, 17 bp, Homo sapiens
tcctttgcgcaaacttt

SEQ ID NO: 3421842 - DNA, 20 bp, Homo sapiens
tcgaaagtgtcatcaatttg

SEQ ID NO: 3421843 - DNA, 12 bp, Homo sapiens
tcgaaataacaa

SEQ ID NO: 3421844 - DNA, 14 bp, Homo sapiens
tcgaaataacaatg

SEQ ID NO: 3421845 - DNA, 16 bp, Homo sapiens
tcgaaataacaatgtt

SEQ ID NO: 3421846 - DNA, 20 bp, Homo sapiens
tcgaaataacaatgttaagg

SEQ ID NO: 3421847 - DNA, 17 bp, Homo sapiens
tcgactcccccctggcc

SEQ ID NO: 3421848 - DNA, 14 bp, Homo sapiens
tcgagactgcaatg

SEQ ID NO: 3421849 - DNA, 22 bp, Homo sapiens
tcgaggtatgtttatatttatt

SEQ ID NO: 3421850 - DNA, 22 bp, Homo sapiens
tcgcctcactttccaccaagtg

SEQ ID NO: 3421851 - DNA, 16 bp, Homo sapiens
tcgggttaagaaatac

SEQ ID NO: 3421852 - DNA, 17 bp, Homo sapiens
tcgtaccgcttccttag

SEQ ID NO: 3421853 - DNA, 20 bp, Homo sapiens
tcgtcccaggctgccggctc

SEQ ID NO: 3421854 - DNA, 23 bp, Homo sapiens
tcgtttcttagacctcttcctgg

SEQ ID NO: 3421855 - DNA, 22 bp, Homo sapiens
tctaaacagatgtccctgaagt

SEQ ID NO: 3421856 - DNA, 21 bp, Homo sapiens
tctaaagctttatctttgtgt

SEQ ID NO: 3421857 - DNA, 16 bp, Homo sapiens
tctaaatccttgttaa

SEQ ID NO: 3421858 - DNA, 14 bp, Homo sapiens
tctaaatgcatatc

SEQ ID NO: 3421859 - DNA, 16 bp, Homo sapiens
tctaatagagaacttt

SEQ ID NO: 3421860 - DNA, 14 bp, Homo sapiens
tctaatatcagcaa

SEQ ID NO: 3421861 - DNA, 21 bp, Homo sapiens
tctaatgacatgcctatatga

SEQ ID NO: 3421862 - DNA, 24 bp, Homo sapiens
tctaattggtcattcctaatgcat

SEQ ID NO: 3421863 - DNA, 18 bp, Homo sapiens
tctacttgatatttcctt

SEQ ID NO: 3421864 - DNA, 20 bp, Homo sapiens
tctacttgatatttccttca

SEQ ID NO: 3421865 - DNA, 12 bp, Homo sapiens
tctagaatggtt

SEQ ID NO: 3421866 - DNA, 21 bp, Homo sapiens
tctagagtcatgtgagcctcg

SEQ ID NO: 3421867 - DNA, 16 bp, Homo sapiens
tctagatgatcaacat

SEQ ID NO: 3421868 - DNA, 11 bp, Homo sapiens
tctaggtcttg

SEQ ID NO: 3421869 - DNA, 21 bp, Homo sapiens
tctaggtcttggttagagaag

SEQ ID NO: 3421870 - DNA, 17 bp, Homo sapiens
tctagtggtctttgtaa

SEQ ID NO: 3421871 - DNA, 19 bp, Homo sapiens
tctagtggtctttgtaaga

SEQ ID NO: 3421872 - DNA, 15 bp, Homo sapiens
tctatacctgccttt

SEQ ID NO: 3421873 - DNA, 14 bp, Homo sapiens
tctatattaaatga

SEQ ID NO: 3421874 - DNA, 20 bp, Homo sapiens
tctatctaatagagaacttt

SEQ ID NO: 3421875 - DNA, 12 bp, Homo sapiens
tctatctaatga

SEQ ID NO: 3421876 - DNA, 20 bp, Homo sapiens
tctatggagactttgctgtt

SEQ ID NO: 3421877 - DNA, 19 bp, Homo sapiens
tctatttttaaaatcataa

SEQ ID NO: 3421878 - DNA, 23 bp, Homo sapiens
tctcaaagttttgaaaagctatt

SEQ ID NO: 3421879 - DNA, 12 bp, Homo sapiens
tctcaattttgt

SEQ ID NO: 3421880 - DNA, 16 bp, Homo sapiens
tctcagtcatgcataa

SEQ ID NO: 3421881 - DNA, 17 bp, Homo sapiens
tctcatctcttagctcc

SEQ ID NO: 3421882 - DNA, 20 bp, Homo sapiens
tctcatctcttagctcccct

SEQ ID NO: 3421883 - DNA, 12 bp, Homo sapiens
tctcatctttct

SEQ ID NO: 3421884 - DNA, 19 bp, Homo sapiens
tctcatttcacccctccct

SEQ ID NO: 3421885 - DNA, 17 bp, Homo sapiens
tctccaaccccccagca

SEQ ID NO: 3421886 - DNA, 20 bp, Homo sapiens
tctccaaccccccagcactg

SEQ ID NO: 3421887 - DNA, 21 bp, Homo sapiens
tctccaaccccccagcactga

SEQ ID NO: 3421888 - DNA, 22 bp, Homo sapiens
tctccaaccccccagcactgag

SEQ ID NO: 3421889 - DNA, 19 bp, Homo sapiens
tctccaattctgaaatact

SEQ ID NO: 3421890 - DNA, 14 bp, Homo sapiens
tctccacctcacta

SEQ ID NO: 3421891 - DNA, 16 bp, Homo sapiens
tctccatggccctgcc

SEQ ID NO: 3421892 - DNA, 15 bp, Homo sapiens
tctcccccaccccct

SEQ ID NO: 3421893 - DNA, 23 bp, Homo sapiens
tctccccgcagtcgtcccaggct

SEQ ID NO: 3421894 - DNA, 20 bp, Homo sapiens
tctcccctgcccccaggact

SEQ ID NO: 3421895 - DNA, 18 bp, Homo sapiens
tctcccctgccccctgca

SEQ ID NO: 3421896 - DNA, 21 bp, Homo sapiens
tctcccctgccccctgcagga

SEQ ID NO: 3421897 - DNA, 19 bp, Homo sapiens
tctccggggtggccacagg

SEQ ID NO: 3421898 - DNA, 24 bp, Homo sapiens
tctccggggtggccacaggctaga

SEQ ID NO: 3421899 - DNA, 14 bp, Homo sapiens
tctcctctccatct

SEQ ID NO: 3421900 - DNA, 23 bp, Homo sapiens
tctcctcttaaaaaataaaaact

SEQ ID NO: 3421901 - DNA, 19 bp, Homo sapiens
tctccttgtggcctatgaa

SEQ ID NO: 3421902 - DNA, 16 bp, Homo sapiens
tctctctaacataaca

SEQ ID NO: 3421903 - DNA, 21 bp, Homo sapiens
tctctgacaatgcgtggcaca

SEQ ID NO: 3421904 - DNA, 16 bp, Homo sapiens
tctctggacactgcca

SEQ ID NO: 3421905 - DNA, 15 bp, Homo sapiens
tctctggcaaacttt

SEQ ID NO: 3421906 - DNA, 15 bp, Homo sapiens
tctctggcttccatg

SEQ ID NO: 3421907 - DNA, 23 bp, Homo sapiens
tctctggcttccatgctccgcct

SEQ ID NO: 3421908 - DNA, 16 bp, Homo sapiens
tctcttagctcccctc

SEQ ID NO: 3421909 - DNA, 22 bp, Homo sapiens
tctcttttgaatccatgcttgg

SEQ ID NO: 3421910 - DNA, 19 bp, Homo sapiens
tctgacaatgcgtggcaca

SEQ ID NO: 3421911 - DNA, 16 bp, Homo sapiens
tctgaccctctcccca

SEQ ID NO: 3421912 - DNA, 17 bp, Homo sapiens
tctgagaaggtccttaa

SEQ ID NO: 3421913 - DNA, 21 bp, Homo sapiens
tctgagagccccaggactggc

SEQ ID NO: 3421914 - DNA, 23 bp, Homo sapiens
tctgaggcacctgcatatctcta

SEQ ID NO: 3421915 - DNA, 13 bp, Homo sapiens
tctgagtgagttt

SEQ ID NO: 3421916 - DNA, 18 bp, Homo sapiens
tctgagtgagttttactc

SEQ ID NO: 3421917 - DNA, 17 bp, Homo sapiens
tctgagtggcttcactc

SEQ ID NO: 3421918 - DNA, 22 bp, Homo sapiens
tctgagtggcttcactcctgct

SEQ ID NO: 3421919 - DNA, 17 bp, Homo sapiens
tctgataatgtattgca

SEQ ID NO: 3421920 - DNA, 14 bp, Homo sapiens
tctgatttatacca

SEQ ID NO: 3421921 - DNA, 21 bp, Homo sapiens
tctgcaatgtttttgtgtaga

SEQ ID NO: 3421922 - DNA, 13 bp, Homo sapiens
tctgcattaataa

SEQ ID NO: 3421923 - DNA, 21 bp, Homo sapiens
tctgcctggttttatttatat

SEQ ID NO: 3421924 - DNA, 14 bp, Homo sapiens
tctgctctccttcc

SEQ ID NO: 3421925 - DNA, 19 bp, Homo sapiens
tctgctctccttcctggag

SEQ ID NO: 3421926 - DNA, 14 bp, Homo sapiens
tctggacactgcca

SEQ ID NO: 3421927 - DNA, 18 bp, Homo sapiens
tctggcaaacatgtgcaa

SEQ ID NO: 3421928 - DNA, 19 bp, Homo sapiens
tctggcaaacatgtgcaac

SEQ ID NO: 3421929 - DNA, 13 bp, Homo sapiens
tctggctctgtct

SEQ ID NO: 3421930 - DNA, 15 bp, Homo sapiens
tctggctttgttctt

SEQ ID NO: 3421931 - DNA, 17 bp, Homo sapiens
tctggggttatgatggc

SEQ ID NO: 3421932 - DNA, 16 bp, Homo sapiens
tctgggtttacaacaa

SEQ ID NO: 3421933 - DNA, 14 bp, Homo sapiens
tctgtaaaagtgtc

SEQ ID NO: 3421934 - DNA, 15 bp, Homo sapiens
tctgtaaaagtgtct

SEQ ID NO: 3421935 - DNA, 14 bp, Homo sapiens
tctgtagctcctca

SEQ ID NO: 3421936 - DNA, 23 bp, Homo sapiens
tctgtagctcctcaactcaccta

SEQ ID NO: 3421937 - DNA, 20 bp, Homo sapiens
tctgtatatagctctacaca

SEQ ID NO: 3421938 - DNA, 21 bp, Homo sapiens
tctgtccccttctctcatctc

SEQ ID NO: 3421939 - DNA, 16 bp, Homo sapiens
tctgtgtctgagtggc

SEQ ID NO: 3421940 - DNA, 22 bp, Homo sapiens
tctgttccttatgatattctca

SEQ ID NO: 3421941 - DNA, 13 bp, Homo sapiens
tctgttgtttgaa

SEQ ID NO: 3421942 - DNA, 15 bp, Homo sapiens
tctgttgtttgaaga

SEQ ID NO: 3421943 - DNA, 15 bp, Homo sapiens
tcttaaaatgcaata

SEQ ID NO: 3421944 - DNA, 14 bp, Homo sapiens
tcttaaatcagttt

SEQ ID NO: 3421945 - DNA, 16 bp, Homo sapiens
tcttaaatgttttcat

SEQ ID NO: 3421946 - DNA, 17 bp, Homo sapiens
tcttaaatgttttcatt

SEQ ID NO: 3421947 - DNA, 23 bp, Homo sapiens
tcttaaatgttttcattgggaaa

SEQ ID NO: 3421948 - DNA, 15 bp, Homo sapiens
tcttaactgtatttc

SEQ ID NO: 3421949 - DNA, 16 bp, Homo sapiens
tcttaactgtatttca

SEQ ID NO: 3421950 - DNA, 23 bp, Homo sapiens
tcttaactgtatttcagtatttt

SEQ ID NO: 3421951 - DNA, 14 bp, Homo sapiens
tcttagctcccctc

SEQ ID NO: 3421952 - DNA, 16 bp, Homo sapiens
tcttagctcccctcca

SEQ ID NO: 3421953 - DNA, 17 bp, Homo sapiens
tcttagctcccctccaa

SEQ ID NO: 3421954 - DNA, 16 bp, Homo sapiens
tcttagctttttaatt

SEQ ID NO: 3421955 - DNA, 17 bp, Homo sapiens
tcttagctttttaattg

SEQ ID NO: 3421956 - DNA, 20 bp, Homo sapiens
tcttataaaccttgtcaata

SEQ ID NO: 3421957 - DNA, 12 bp, Homo sapiens
tcttatctcagt

SEQ ID NO: 3421958 - DNA, 16 bp, Homo sapiens
tcttcaagtgagtggc

SEQ ID NO: 3421959 - DNA, 14 bp, Homo sapiens
tcttcagctggtgg

SEQ ID NO: 3421960 - DNA, 14 bp, Homo sapiens
tcttcctggaataa

SEQ ID NO: 3421961 - DNA, 14 bp, Homo sapiens
tcttctcagccact

SEQ ID NO: 3421962 - DNA, 10 bp, Homo sapiens
tcttctcatt

SEQ ID NO: 3421963 - DNA, 20 bp, Homo sapiens
tcttctcatttcacccctcc

SEQ ID NO: 3421964 - DNA, 23 bp, Homo sapiens
tcttctcatttcacccctccctt

SEQ ID NO: 3421965 - DNA, 20 bp, Homo sapiens
tcttctccaattctgaaata

SEQ ID NO: 3421966 - DNA, 15 bp, Homo sapiens
tcttctttgatagtg

SEQ ID NO: 3421967 - DNA, 14 bp, Homo sapiens
tcttgacagcagga

SEQ ID NO: 3421968 - DNA, 18 bp, Homo sapiens
tcttgacctgaactctgc

SEQ ID NO: 3421969 - DNA, 20 bp, Homo sapiens
tcttgacctgaactctgcaa

SEQ ID NO: 3421970 - DNA, 17 bp, Homo sapiens
tcttgatcaacatcttt

SEQ ID NO: 3421971 - DNA, 18 bp, Homo sapiens
tcttgatcaacatctttt

SEQ ID NO: 3421972 - DNA, 22 bp, Homo sapiens
tcttgcctctgtccccttctct

SEQ ID NO: 3421973 - DNA, 13 bp, Homo sapiens
tcttggtaacaaa

SEQ ID NO: 3421974 - DNA, 14 bp, Homo sapiens
tcttggtaacaaat

SEQ ID NO: 3421975 - DNA, 12 bp, Homo sapiens
tctttatagttg

SEQ ID NO: 3421976 - DNA, 12 bp, Homo sapiens
tctttatataag

SEQ ID NO: 3421977 - DNA, 14 bp, Homo sapiens
tctttctttgctgc

SEQ ID NO: 3421978 - DNA, 20 bp, Homo sapiens
tctttctttgctgctgtgga

SEQ ID NO: 3421979 - DNA, 24 bp, Homo sapiens
tctttcttttcttttttaaagtaa

SEQ ID NO: 3421980 - DNA, 15 bp, Homo sapiens
tctttgaatgtattg

SEQ ID NO: 3421981 - DNA, 16 bp, Homo sapiens
tctttgattctccttc

SEQ ID NO: 3421982 - DNA, 23 bp, Homo sapiens
tctttgtaagagtgtagaagcat

SEQ ID NO: 3421983 - DNA, 16 bp, Homo sapiens
tctttgtagaataaat

SEQ ID NO: 3421984 - DNA, 20 bp, Homo sapiens
tctttgtagaataaatggtt

SEQ ID NO: 3421985 - DNA, 16 bp, Homo sapiens
tctttgtgaaggcctc

SEQ ID NO: 3421986 - DNA, 13 bp, Homo sapiens
tctttgtgtaatc

SEQ ID NO: 3421987 - DNA, 17 bp, Homo sapiens
tctttgtttaaatgcca

SEQ ID NO: 3421988 - DNA, 14 bp, Homo sapiens
tcttttctttgtat

SEQ ID NO: 3421989 - DNA, 23 bp, Homo sapiens
tctttttttttttttttaaagaa

SEQ ID NO: 3421990 - DNA, 13 bp, Homo sapiens
tgaaaaataaata

SEQ ID NO: 3421991 - DNA, 13 bp, Homo sapiens
tgaaaaatatctt

SEQ ID NO: 3421992 - DNA, 17 bp, Homo sapiens
tgaaaaatatctttgca

SEQ ID NO: 3421993 - DNA, 20 bp, Homo sapiens
tgaaaacattgatgaatgag

SEQ ID NO: 3421994 - DNA, 13 bp, Homo sapiens
tgaaaagctatta

SEQ ID NO: 3421995 - DNA, 20 bp, Homo sapiens
tgaaaagctattagccagga

SEQ ID NO: 3421996 - DNA, 23 bp, Homo sapiens
tgaaaatgcaacaacatgtataa

SEQ ID NO: 3421997 - DNA, 19 bp, Homo sapiens
tgaaaccttttttaagatt

SEQ ID NO: 3421998 - DNA, 18 bp, Homo sapiens
tgaaactcatctgtaaac

SEQ ID NO: 3421999 - DNA, 19 bp, Homo sapiens
tgaaactggtttataataa

SEQ ID NO: 3422000 - DNA, 14 bp, Homo sapiens
tgatgaggccctcc

SEQ ID NO: 3422001 - DNA, 17 bp, Homo sapiens
tgatgaggccctccaca

SEQ ID NO: 3422002 - DNA, 20 bp, Homo sapiens
tgatgcatggagtgtttgac

SEQ ID NO: 3422003 - DNA, 17 bp, Homo sapiens
tgattaaattatgaatg

SEQ ID NO: 3422004 - DNA, 19 bp, Homo sapiens
tgattaaattatgaatgag

SEQ ID NO: 3422005 - DNA, 15 bp, Homo sapiens
tgattataccatgtg

SEQ ID NO: 3422006 - DNA, 19 bp, Homo sapiens
tgattataccatgtgtgct

SEQ ID NO: 3422007 - DNA, 17 bp, Homo sapiens
tgattatggacatcgat

SEQ ID NO: 3422008 - DNA, 13 bp, Homo sapiens
tgattctccttca

SEQ ID NO: 3422009 - DNA, 14 bp, Homo sapiens
tgattctttgttac

SEQ ID NO: 3422010 - DNA, 17 bp, Homo sapiens
tgatttaataaaataat

SEQ ID NO: 3422011 - DNA, 20 bp, Homo sapiens
tgatttaataaaataattct

SEQ ID NO: 3422012 - DNA, 22 bp, Homo sapiens
tgatttaataaaataattctaa

SEQ ID NO: 3422013 - DNA, 23 bp, Homo sapiens
tgatttaataaaataattctaaa

SEQ ID NO: 3422014 - DNA, 12 bp, Homo sapiens
tgatttatacca

SEQ ID NO: 3422015 - DNA, 15 bp, Homo sapiens
tgatttcctctgaat

SEQ ID NO: 3422016 - DNA, 13 bp, Homo sapiens
tgatttctagaat

SEQ ID NO: 3422017 - DNA, 19 bp, Homo sapiens
tgattttaaaaatacattt

SEQ ID NO: 3422018 - DNA, 12 bp, Homo sapiens
tgatttttgtgt

SEQ ID NO: 3422019 - DNA, 14 bp, Homo sapiens
tgatttttgtgtat

SEQ ID NO: 3422020 - DNA, 14 bp, Homo sapiens
tgattttttattca

SEQ ID NO: 3422021 - DNA, 15 bp, Homo sapiens
tgattttttattcaa

SEQ ID NO: 3422022 - DNA, 12 bp, Homo sapiens
tgcaaacagtgt

SEQ ID NO: 3422023 - DNA, 13 bp, Homo sapiens
tgcaaatgagatt

SEQ ID NO: 3422024 - DNA, 17 bp, Homo sapiens
tgcaaatgagatttctt

SEQ ID NO: 3422025 - DNA, 23 bp, Homo sapiens
tgcaactaactgactctgttatt

SEQ ID NO: 3422026 - DNA, 15 bp, Homo sapiens
tgcaactcttgtatt

SEQ ID NO: 3422027 - DNA, 18 bp, Homo sapiens
tgcaactcttgtattgct

SEQ ID NO: 3422028 - DNA, 16 bp, Homo sapiens
tgcaactgaatacttg

SEQ ID NO: 3422029 - DNA, 21 bp, Homo sapiens
tgcaagattttttttttaagt

SEQ ID NO: 3422030 - DNA, 23 bp, Homo sapiens
tgcaagattttttttttaagtga

SEQ ID NO: 3422031 - DNA, 19 bp, Homo sapiens
tgcaagtgggagatgaaaa

SEQ ID NO: 3422032 - DNA, 21 bp, Homo sapiens
tgcaagtgggagatgaaaacc

SEQ ID NO: 3422033 - DNA, 21 bp, Homo sapiens
tgcaatgcgtcttgtgaaatt

SEQ ID NO: 3422034 - DNA, 12 bp, Homo sapiens
tgcaatgttttt

SEQ ID NO: 3422035 - DNA, 17 bp, Homo sapiens
tgcaatgtttttgtgta

SEQ ID NO: 3422036 - DNA, 18 bp, Homo sapiens
tgcaatgtttttgtgtag

SEQ ID NO: 3422037 - DNA, 17 bp, Homo sapiens
tgcaattaactctggac

SEQ ID NO: 3422038 - DNA, 22 bp, Homo sapiens
tgcaattgtaggggtgtgtgtg

SEQ ID NO: 3422039 - DNA, 15 bp, Homo sapiens
tgcacaaagtggcat

SEQ ID NO: 3422040 - DNA, 14 bp, Homo sapiens
tgcaccattttcaa

SEQ ID NO: 3422041 - DNA, 15 bp, Homo sapiens
tgcaccattttcaat

SEQ ID NO: 3422042 - DNA, 15 bp, Homo sapiens
tgcacccagaagaag

SEQ ID NO: 3422043 - DNA, 19 bp, Homo sapiens
tgcacgcgccctttctacc

SEQ ID NO: 3422044 - DNA, 20 bp, Homo sapiens
tgcacgcgccctttctacca

SEQ ID NO: 3422045 - DNA, 12 bp, Homo sapiens
tgcactttgtag

SEQ ID NO: 3422046 - DNA, 15 bp, Homo sapiens
tgcactttgtagtgt

SEQ ID NO: 3422047 - DNA, 17 bp, Homo sapiens
tgcagagagccattttg

SEQ ID NO: 3422048 - DNA, 18 bp, Homo sapiens
tgcagagagccattttgt

SEQ ID NO: 3422049 - DNA, 16 bp, Homo sapiens
tgcagaggaggagaaa

SEQ ID NO: 3422050 - DNA, 14 bp, Homo sapiens
tgcagcaatattct

SEQ ID NO: 3422051 - DNA, 12 bp, Homo sapiens
tgcagcctcaga

SEQ ID NO: 3422052 - DNA, 20 bp, Homo sapiens
tgcagctctgcagcaatatt

SEQ ID NO: 3422053 - DNA, 17 bp, Homo sapiens
tgcaggaaggagctgcc

SEQ ID NO: 3422054 - DNA, 23 bp, Homo sapiens
tgcaggaaggagctgcctggacc

SEQ ID NO: 3422055 - DNA, 15 bp, Homo sapiens
tgcaggtagacctgt

SEQ ID NO: 3422056 - DNA, 20 bp, Homo sapiens
tgcaggtctccatgaagaag

SEQ ID NO: 3422057 - DNA, 20 bp, Homo sapiens
tgcagtgatatggcagaaga

SEQ ID NO: 3422058 - DNA, 14 bp, Homo sapiens
tgcagtgcggctca

SEQ ID NO: 3422059 - DNA, 15 bp, Homo sapiens
tgcagtttcatgtat

SEQ ID NO: 3422060 - DNA, 18 bp, Homo sapiens
tgcagtttcatgtatgta

SEQ ID NO: 3422061 - DNA, 12 bp, Homo sapiens
tgcataaatatg

SEQ ID NO: 3422062 - DNA, 19 bp, Homo sapiens
tgcataataagctaaagag

SEQ ID NO: 3422063 - DNA, 24 bp, Homo sapiens
tgcataataagctaaagaggctga

SEQ ID NO: 3422064 - DNA, 11 bp, Homo sapiens
tgcatagagca

SEQ ID NO: 3422065 - DNA, 21 bp, Homo sapiens
tgcatagagcaattaaactgt

SEQ ID NO: 3422066 - DNA, 17 bp, Homo sapiens
tgcatatatacatatat

SEQ ID NO: 3422067 - DNA, 18 bp, Homo sapiens
tgcatatcctgagccatc

SEQ ID NO: 3422068 - DNA, 22 bp, Homo sapiens
tgcatcatagaacagaaatata

SEQ ID NO: 3422069 - DNA, 21 bp, Homo sapiens
tgcatccagcagtacaataaa

SEQ ID NO: 3422070 - DNA, 15 bp, Homo sapiens
tgcatgcaggtctcc

SEQ ID NO: 3422071 - DNA, 16 bp, Homo sapiens
tgcatggagtgtttga

SEQ ID NO: 3422072 - DNA, 17 bp, Homo sapiens
tgcatggagtgtttgac

SEQ ID NO: 3422073 - DNA, 22 bp, Homo sapiens
tgcatggcattaattgttcctt

SEQ ID NO: 3422074 - DNA, 18 bp, Homo sapiens
tgcatgtaaaatcttcag

SEQ ID NO: 3422075 - DNA, 19 bp, Homo sapiens
tgcatgtaaaatcttcagc

SEQ ID NO: 3422076 - DNA, 21 bp, Homo sapiens
tgcatgtaaaatcttcagctg

SEQ ID NO: 3422077 - DNA, 21 bp, Homo sapiens
tgcatgtgtatatatgtcaaa

SEQ ID NO: 3422078 - DNA, 19 bp, Homo sapiens
tgcattaccttctgttcct

SEQ ID NO: 3422079 - DNA, 23 bp, Homo sapiens
tgcattcgcggttaagatactca

SEQ ID NO: 3422080 - DNA, 19 bp, Homo sapiens
tgcatttctatgccatttt

SEQ ID NO: 3422081 - DNA, 13 bp, Homo sapiens
tgcatttgaggtc

SEQ ID NO: 3422082 - DNA, 16 bp, Homo sapiens
tgcatttggtcaagat

SEQ ID NO: 3422083 - DNA, 19 bp, Homo sapiens
tgccaagaaatcgccttat

SEQ ID NO: 3422084 - DNA, 21 bp, Homo sapiens
tgccaattttgtcacagctct

SEQ ID NO: 3422085 - DNA, 18 bp, Homo sapiens
tgccacctggacccctgc

SEQ ID NO: 3422086 - DNA, 20 bp, Homo sapiens
tgccacctggacccctgcat

SEQ ID NO: 3422087 - DNA, 17 bp, Homo sapiens
tgccagggaaaaagacc

SEQ ID NO: 3422088 - DNA, 17 bp, Homo sapiens
tgccataaaattgcagt

SEQ ID NO: 3422089 - DNA, 21 bp, Homo sapiens
tgccataaaattgcagtttca

SEQ ID NO: 3422090 - DNA, 24 bp, Homo sapiens
tgccatagtcaaagagagttttta

SEQ ID NO: 3422091 - DNA, 16 bp, Homo sapiens
tgccatcatgtttaca

SEQ ID NO: 3422092 - DNA, 13 bp, Homo sapiens
tgccatgcttttt

SEQ ID NO: 3422093 - DNA, 19 bp, Homo sapiens
tgccatgctttttggtgag

SEQ ID NO: 3422094 - DNA, 18 bp, Homo sapiens
tgccatggacagaagaag

SEQ ID NO: 3422095 - DNA, 23 bp, Homo sapiens
tgccatgggcttcactgtataaa

SEQ ID NO: 3422096 - DNA, 15 bp, Homo sapiens
tgccatgtgaagagg

SEQ ID NO: 3422097 - DNA, 12 bp, Homo sapiens
tgcccatataaa

SEQ ID NO: 3422098 - DNA, 13 bp, Homo sapiens
tgccccaccctca

SEQ ID NO: 3422099 - DNA, 11 bp, Homo sapiens
tgcccccagga

SEQ ID NO: 3422100 - DNA, 16 bp, Homo sapiens
tgcccccaggactggg

SEQ ID NO: 3422101 - DNA, 16 bp, Homo sapiens
tgccccctgcaggaag

SEQ ID NO: 3422102 - DNA, 23 bp, Homo sapiens
tgccccctgcaggaaggagctgc

SEQ ID NO: 3422103 - DNA, 21 bp, Homo sapiens
tgcccctgtcccacctggctc

SEQ ID NO: 3422104 - DNA, 23 bp, Homo sapiens
tgcccctgtcccacctggctccc

SEQ ID NO: 3422105 - DNA, 22 bp, Homo sapiens
tgccctggtggccctctcccct

SEQ ID NO: 3422106 - DNA, 14 bp, Homo sapiens
tgccgcagagctgg

SEQ ID NO: 3422107 - DNA, 16 bp, Homo sapiens
tgcctcaggcctctgt

SEQ ID NO: 3422108 - DNA, 15 bp, Homo sapiens
tgcctccagggctgg

SEQ ID NO: 3422109 - DNA, 14 bp, Homo sapiens
tgcctccctggtga

SEQ ID NO: 3422110 - DNA, 21 bp, Homo sapiens
tgcctcctacaaccaggtctt

SEQ ID NO: 3422111 - DNA, 21 bp, Homo sapiens
tggcctcaagatcaatgaaat

SEQ ID NO: 3422112 - DNA, 20 bp, Homo sapiens
tggccttcgattttaaatat

SEQ ID NO: 3422113 - DNA, 19 bp, Homo sapiens
tggcggcaggaagccaaag

SEQ ID NO: 3422114 - DNA, 16 bp, Homo sapiens
tggctcacactgagaa

SEQ ID NO: 3422115 - DNA, 16 bp, Homo sapiens
tggctccaaaccctcg

SEQ ID NO: 3422116 - DNA, 20 bp, Homo sapiens
tggctccaaaccctcgaggc

SEQ ID NO: 3422117 - DNA, 17 bp, Homo sapiens
tggctgagggattctat

SEQ ID NO: 3422118 - DNA, 14 bp, Homo sapiens
tggcttccatgctc

SEQ ID NO: 3422119 - DNA, 19 bp, Homo sapiens
tggcttctgttgtcacctt

SEQ ID NO: 3422120 - DNA, 22 bp, Homo sapiens
tggcttcttttctttgtatcat

SEQ ID NO: 3422121 - DNA, 16 bp, Homo sapiens
tgggaaccatgaagct

SEQ ID NO: 3422122 - DNA, 23 bp, Homo sapiens
tgggaataagtgccaggatggaa

SEQ ID NO: 3422123 - DNA, 14 bp, Homo sapiens
tgggagatgaaaac

SEQ ID NO: 3422124 - DNA, 14 bp, Homo sapiens
tgggaggaacctga

SEQ ID NO: 3422125 - DNA, 22 bp, Homo sapiens
tgggagtgaggatgtctgggcc

SEQ ID NO: 3422126 - DNA, 13 bp, Homo sapiens
tgggagtgtgtaa

SEQ ID NO: 3422127 - DNA, 14 bp, Homo sapiens
tgggatgtttctgt

SEQ ID NO: 3422128 - DNA, 19 bp, Homo sapiens
tgggattttatctgtggat

SEQ ID NO: 3422129 - DNA, 16 bp, Homo sapiens
tgggccctctggtttg

SEQ ID NO: 3422130 - DNA, 17 bp, Homo sapiens
tgggcctaggccaggag

SEQ ID NO: 3422131 - DNA, 13 bp, Homo sapiens
tgggccttgctac

SEQ ID NO: 3422132 - DNA, 17 bp, Homo sapiens
tgggcgggcaggggagg

SEQ ID NO: 3422133 - DNA, 12 bp, Homo sapiens
tgggctaacatt

SEQ ID NO: 3422134 - DNA, 17 bp, Homo sapiens
tgggcttcactgtataa

SEQ ID NO: 3422135 - DNA, 17 bp, Homo sapiens
tggggaagaggttttat

SEQ ID NO: 3422136 - DNA, 11 bp, Homo sapiens
tgggggatgta

SEQ ID NO: 3422137 - DNA, 21 bp, Homo sapiens
tgggggtagggggctggagga

SEQ ID NO: 3422138 - DNA, 14 bp, Homo sapiens
tgggggtctgtgtg

SEQ ID NO: 3422139 - DNA, 18 bp, Homo sapiens
tgggggtctgtgtgttta

SEQ ID NO: 3422140 - DNA, 21 bp, Homo sapiens
tggggtaggttgggagaatgt

SEQ ID NO: 3422141 - DNA, 13 bp, Homo sapiens
tgggtaagaaagc

SEQ ID NO: 3422142 - DNA, 13 bp, Homo sapiens
tgggtcaaggaat

SEQ ID NO: 3422143 - DNA, 13 bp, Homo sapiens
tgggtccagaaga

SEQ ID NO: 3422144 - DNA, 12 bp, Homo sapiens
tgggtctgtgtg

SEQ ID NO: 3422145 - DNA, 13 bp, Homo sapiens
tgggtctgtgtgt

SEQ ID NO: 3422146 - DNA, 16 bp, Homo sapiens
tgggtgatttctagaa

SEQ ID NO: 3422147 - DNA, 22 bp, Homo sapiens
tgggtgtaacaggtctcctctt

SEQ ID NO: 3422148 - DNA, 20 bp, Homo sapiens
tgggtttacaacaaacactg

SEQ ID NO: 3422149 - DNA, 22 bp, Homo sapiens
tgggtttacaacaaacactgtg

SEQ ID NO: 3422150 - DNA, 17 bp, Homo sapiens
tggtagatttttttcat

SEQ ID NO: 3422151 - DNA, 22 bp, Homo sapiens
tggtctccttggaaatccgtct

SEQ ID NO: 3422152 - DNA, 15 bp, Homo sapiens
tggtctttgtaagag

SEQ ID NO: 3422153 - DNA, 21 bp, Homo sapiens
tggtctttgtaagagtgtaga

SEQ ID NO: 3422154 - DNA, 22 bp, Homo sapiens
tggtctttgtaagagtgtagaa

SEQ ID NO: 3422155 - DNA, 18 bp, Homo sapiens
tggtgctcatttaaatat

SEQ ID NO: 3422156 - DNA, 23 bp, Homo sapiens
tggtggatggtgacttttgaaga

SEQ ID NO: 3422157 - DNA, 16 bp, Homo sapiens
tggtggccctctcccc

SEQ ID NO: 3422158 - DNA, 22 bp, Homo sapiens
tggtggccctctcccctgcccc

SEQ ID NO: 3422159 - DNA, 23 bp, Homo sapiens
tggtggccctctcccctgccccc

SEQ ID NO: 3422160 - DNA, 15 bp, Homo sapiens
tggtggtatctgagt

SEQ ID NO: 3422161 - DNA, 14 bp, Homo sapiens
tggttaatcagtgt

SEQ ID NO: 3422162 - DNA, 18 bp, Homo sapiens
tggttaatcagtgttgat

SEQ ID NO: 3422163 - DNA, 19 bp, Homo sapiens
tggttagagaagtaagcag

SEQ ID NO: 3422164 - DNA, 11 bp, Homo sapiens
tggttctcatc

SEQ ID NO: 3422165 - DNA, 14 bp, Homo sapiens
tggttctcatcttt

SEQ ID NO: 3422166 - DNA, 14 bp, Homo sapiens
tggtttagtctttt

SEQ ID NO: 3422167 - DNA, 17 bp, Homo sapiens
tggtttctcattaaact

SEQ ID NO: 3422168 - DNA, 13 bp, Homo sapiens
tggtttgttattc

SEQ ID NO: 3422169 - DNA, 20 bp, Homo sapiens
tggttttgttcccctcctcc

SEQ ID NO: 3422170 - DNA, 19 bp, Homo sapiens
tgtaaaaaaaaatgccttt

SEQ ID NO: 3422171 - DNA, 12 bp, Homo sapiens
tgtaaaatagtt

SEQ ID NO: 3422172 - DNA, 13 bp, Homo sapiens
tgtaaaatagttt

SEQ ID NO: 3422173 - DNA, 19 bp, Homo sapiens
tgtaaaatcttcagctggt

SEQ ID NO: 3422174 - DNA, 23 bp, Homo sapiens
tgtaaataatataaaatgtttca

SEQ ID NO: 3422175 - DNA, 22 bp, Homo sapiens
tgtaaatgaagggtcatttctc

SEQ ID NO: 3422176 - DNA, 17 bp, Homo sapiens
tgtaaatttatgtgatg

SEQ ID NO: 3422177 - DNA, 18 bp, Homo sapiens
tgtaacaggtctcctctt

SEQ ID NO: 3422178 - DNA, 20 bp, Homo sapiens
tgtaacaggtctcctcttaa

SEQ ID NO: 3422179 - DNA, 18 bp, Homo sapiens
tgtaacctcgtgtctagt

SEQ ID NO: 3422180 - DNA, 19 bp, Homo sapiens
tgtaagaactacaaacaaa

SEQ ID NO: 3422181 - DNA, 19 bp, Homo sapiens
tgtaagagtgtagaagcat

SEQ ID NO: 3422182 - DNA, 14 bp, Homo sapiens
tgtaagtttcaggt

SEQ ID NO: 3422183 - DNA, 18 bp, Homo sapiens
tgtaagtttcaggtgaca

SEQ ID NO: 3422184 - DNA, 13 bp, Homo sapiens
tgtaataagacat

SEQ ID NO: 3422185 - DNA, 17 bp, Homo sapiens
tgtaatatgagaatgta

SEQ ID NO: 3422186 - DNA, 23 bp, Homo sapiens
tgtaattccacatcatgttactt

SEQ ID NO: 3422187 - DNA, 17 bp, Homo sapiens
tgtaattttagtattaa

SEQ ID NO: 3422188 - DNA, 13 bp, Homo sapiens
tgtacaaggtatg

SEQ ID NO: 3422189 - DNA, 19 bp, Homo sapiens
tgtacaggatgctttggtt

SEQ ID NO: 3422190 - DNA, 18 bp, Homo sapiens
tgtacagtctcaattttg

SEQ ID NO: 3422191 - DNA, 14 bp, Homo sapiens
tgtacatagtcctt

SEQ ID NO: 3422192 - DNA, 13 bp, Homo sapiens
tgtacttaaatga

SEQ ID NO: 3422193 - DNA, 15 bp, Homo sapiens
tgtagaagcattcct

SEQ ID NO: 3422194 - DNA, 21 bp, Homo sapiens
tgtagaataaatggtttctca

SEQ ID NO: 3422195 - DNA, 22 bp, Homo sapiens
tgtagaataaatggtttctcat

SEQ ID NO: 3422196 - DNA, 20 bp, Homo sapiens
tgtagagtggcgattgaatg

SEQ ID NO: 3422197 - DNA, 14 bp, Homo sapiens
tgtagagttaagaa

SEQ ID NO: 3422198 - DNA, 16 bp, Homo sapiens
tgtagagttaagaagc

SEQ ID NO: 3422199 - DNA, 18 bp, Homo sapiens
tgtagagttaagaagctg

SEQ ID NO: 3422200 - DNA, 22 bp, Homo sapiens
tgtagatattgtgaagtacata

SEQ ID NO: 3422201 - DNA, 17 bp, Homo sapiens
tgtaggcacttttattt

SEQ ID NO: 3422202 - DNA, 21 bp, Homo sapiens
tgtaggcacttttattttcat

SEQ ID NO: 3422203 - DNA, 21 bp, Homo sapiens
tgtagtatttagtatatgaaa

SEQ ID NO: 3422204 - DNA, 22 bp, Homo sapiens
tgtagtttttaattaaaaactt

SEQ ID NO: 3422205 - DNA, 14 bp, Homo sapiens
tgtataaataggag

SEQ ID NO: 3422206 - DNA, 13 bp, Homo sapiens
tgtatacatatag

SEQ ID NO: 3422207 - DNA, 14 bp, Homo sapiens
tgtatacatataga

SEQ ID NO: 3422208 - DNA, 22 bp, Homo sapiens
tgtataccatgatgcatggagt

SEQ ID NO: 3422209 - DNA, 20 bp, Homo sapiens
tgtatatatgtcaaattgtc

SEQ ID NO: 3422210 - DNA, 22 bp, Homo sapiens
tgtatccatccatggggctgat

SEQ ID NO: 3422211 - DNA, 14 bp, Homo sapiens
tgtatgactaaaga

SEQ ID NO: 3422212 - DNA, 17 bp, Homo sapiens
tgtatgtggatacagtc

SEQ ID NO: 3422213 - DNA, 12 bp, Homo sapiens
tgtatgtggggg

SEQ ID NO: 3422214 - DNA, 20 bp, Homo sapiens
tgtatgtgggggtctgtgtg

SEQ ID NO: 3422215 - DNA, 17 bp, Homo sapiens
tgtattagccagtcatt

SEQ ID NO: 3422216 - DNA, 21 bp, Homo sapiens
tgtattagccagtcattgtaa

SEQ ID NO: 3422217 - DNA, 20 bp, Homo sapiens
tgtattgagtcttaactgta

SEQ ID NO: 3422218 - DNA, 22 bp, Homo sapiens
tgtattgctccattttcttgtc

SEQ ID NO: 3422219 - DNA, 14 bp, Homo sapiens
tgtattgctgtcct

SEQ ID NO: 3422220 - DNA, 16 bp, Homo sapiens
tgtatttaatgatttt

SEQ ID NO: 3422221 - DNA, 15 bp, Homo sapiens
tgtatttcagtattt

SEQ ID NO: 3422222 - DNA, 12 bp, Homo sapiens
tgtttctttctg

SEQ ID NO: 3422223 - DNA, 17 bp, Homo sapiens
tgtttctttctgaagtg

SEQ ID NO: 3422224 - DNA, 18 bp, Homo sapiens
tgtttggtgctcatttaa

SEQ ID NO: 3422225 - DNA, 20 bp, Homo sapiens
tgtttgtataccatgatgca

SEQ ID NO: 3422226 - DNA, 12 bp, Homo sapiens
tgtttttaactc

SEQ ID NO: 3422227 - DNA, 22 bp, Homo sapiens
ttaaaaaacaattggttgtata

SEQ ID NO: 3422228 - DNA, 14 bp, Homo sapiens
ttaaaaaattaaaa

SEQ ID NO: 3422229 - DNA, 12 bp, Homo sapiens
ttaaaaacttta

SEQ ID NO: 3422230 - DNA, 19 bp, Homo sapiens
ttaaaaataaagctactga

SEQ ID NO: 3422231 - DNA, 18 bp, Homo sapiens
ttaaaacatgctgtttat

SEQ ID NO: 3422232 - DNA, 12 bp, Homo sapiens
ttaaaaggaaaa

SEQ ID NO: 3422233 - DNA, 16 bp, Homo sapiens
ttaaaagtttgtcctt

SEQ ID NO: 3422234 - DNA, 21 bp, Homo sapiens
ttaaaataaaattttttactt

SEQ ID NO: 3422235 - DNA, 20 bp, Homo sapiens
ttaaaatgcaatatttgtaa

SEQ ID NO: 3422236 - DNA, 13 bp, Homo sapiens
ttaaaattgtgat

SEQ ID NO: 3422237 - DNA, 19 bp, Homo sapiens
ttaaacaaaatttcacagt

SEQ ID NO: 3422238 - DNA, 14 bp, Homo sapiens
ttaaacaatgatca

SEQ ID NO: 3422239 - DNA, 22 bp, Homo sapiens
ttaaactggtattttatctttg

SEQ ID NO: 3422240 - DNA, 18 bp, Homo sapiens
ttaaagaaaatgtgtctg

SEQ ID NO: 3422241 - DNA, 15 bp, Homo sapiens
ttaaagaaatttaat

SEQ ID NO: 3422242 - DNA, 20 bp, Homo sapiens
ttaaagaaatttaatgtttc

SEQ ID NO: 3422243 - DNA, 22 bp, Homo sapiens
ttaaagataagtctacattaaa

SEQ ID NO: 3422244 - DNA, 16 bp, Homo sapiens
ttaaaggacaaacagt

SEQ ID NO: 3422245 - DNA, 20 bp, Homo sapiens
ttaaaggacaaacagtgaat

SEQ ID NO: 3422246 - DNA, 13 bp, Homo sapiens
ttaaagtaaactt

SEQ ID NO: 3422247 - DNA, 18 bp, Homo sapiens
ttaaagtaaacttgtgta

SEQ ID NO: 3422248 - DNA, 13 bp, Homo sapiens
ttaaatgccaaaa

SEQ ID NO: 3422249 - DNA, 16 bp, Homo sapiens
ttaaatgttttcattg

SEQ ID NO: 3422250 - DNA, 24 bp, Homo sapiens
ttaaattatgaatgagttttacaa

SEQ ID NO: 3422251 - DNA, 23 bp, Homo sapiens
ttaaatttaggtaaataaagctc

SEQ ID NO: 3422252 - DNA, 14 bp, Homo sapiens
ttaaatttgtaagt

SEQ ID NO: 3422253 - DNA, 21 bp, Homo sapiens
ttaaatttgtaagtttcaggt

SEQ ID NO: 3422254 - DNA, 14 bp, Homo sapiens
ttaaattttgtgtc

SEQ ID NO: 3422255 - DNA, 19 bp, Homo sapiens
ttaacactgcttgtgtttt

SEQ ID NO: 3422256 - DNA, 20 bp, Homo sapiens
ttaacagacactgtaaaata

SEQ ID NO: 3422257 - DNA, 20 bp, Homo sapiens
ttaacaggttttcttctaat

SEQ ID NO: 3422258 - DNA, 12 bp, Homo sapiens
ttaactcaatat

SEQ ID NO: 3422259 - DNA, 19 bp, Homo sapiens
ttaactgtatttcagtatt

SEQ ID NO: 3422260 - DNA, 11 bp, Homo sapiens
ttaagaaatac

SEQ ID NO: 3422261 - DNA, 11 bp, Homo sapiens
ttaagaagctg

SEQ ID NO: 3422262 - DNA, 13 bp, Homo sapiens
ttaagaagctgtt

SEQ ID NO: 3422263 - DNA, 17 bp, Homo sapiens
ttaagaatagtctctgg

SEQ ID NO: 3422264 - DNA, 14 bp, Homo sapiens
ttaagctctgagct

SEQ ID NO: 3422265 - DNA, 14 bp, Homo sapiens
ttaaggaaactctt

SEQ ID NO: 3422266 - DNA, 18 bp, Homo sapiens
ttaagtacaagcacattt

SEQ ID NO: 3422267 - DNA, 19 bp, Homo sapiens
ttaagtgcgtgtgtagagt

SEQ ID NO: 3422268 - DNA, 21 bp, Homo sapiens
ttaagtgcgtgtgtagagtta

SEQ ID NO: 3422269 - DNA, 12 bp, Homo sapiens
ttaagtgttgaa

SEQ ID NO: 3422270 - DNA, 13 bp, Homo sapiens
ttaataacattac

SEQ ID NO: 3422271 - DNA, 16 bp, Homo sapiens
ttaataacattacctt

SEQ ID NO: 3422272 - DNA, 17 bp, Homo sapiens
ttaataacattacctta

SEQ ID NO: 3422273 - DNA, 22 bp, Homo sapiens
ttaatatggggatgcagcatta

SEQ ID NO: 3422274 - DNA, 21 bp, Homo sapiens
ttaatattacctaatgaaagt

SEQ ID NO: 3422275 - DNA, 15 bp, Homo sapiens
ttaatattagcttgc

SEQ ID NO: 3422276 - DNA, 15 bp, Homo sapiens
ttaatcacttaacat

SEQ ID NO: 3422277 - DNA, 12 bp, Homo sapiens
ttaatcagtgtt

SEQ ID NO: 3422278 - DNA, 14 bp, Homo sapiens
ttaattaaaaactt

SEQ ID NO: 3422279 - DNA, 23 bp, Homo sapiens
ttaattaaaaactttaaagataa

SEQ ID NO: 3422280 - DNA, 21 bp, Homo sapiens
ttaatttagagcgtttggtta

SEQ ID NO: 3422281 - DNA, 12 bp, Homo sapiens
ttacaaacatgt

SEQ ID NO: 3422282 - DNA, 14 bp, Homo sapiens
ttacaacaaacact

SEQ ID NO: 3422283 - DNA, 15 bp, Homo sapiens
ttacaacaaacactg

SEQ ID NO: 3422284 - DNA, 19 bp, Homo sapiens
ttacaacccggttcactct

SEQ ID NO: 3422285 - DNA, 13 bp, Homo sapiens
ttacaactccccc

SEQ ID NO: 3422286 - DNA, 18 bp, Homo sapiens
ttacaagcttaaagcttg

SEQ ID NO: 3422287 - DNA, 20 bp, Homo sapiens
ttacagatgtagatataaat

SEQ ID NO: 3422288 - DNA, 18 bp, Homo sapiens
ttacaggcaccgagaatg

SEQ ID NO: 3422289 - DNA, 19 bp, Homo sapiens
ttacctgatcaatgacaga

SEQ ID NO: 3422290 - DNA, 23 bp, Homo sapiens
ttacctgatcaatgacagagcct

SEQ ID NO: 3422291 - DNA, 14 bp, Homo sapiens
ttactacagttttt

SEQ ID NO: 3422292 - DNA, 15 bp, Homo sapiens
ttactacagttttta

SEQ ID NO: 3422293 - DNA, 16 bp, Homo sapiens
ttactcccttctgtag

SEQ ID NO: 3422294 - DNA, 17 bp, Homo sapiens
ttactcccttctgtagt

SEQ ID NO: 3422295 - DNA, 22 bp, Homo sapiens
ttactcttaaatcatttggtta

SEQ ID NO: 3422296 - DNA, 20 bp, Homo sapiens
ttactgtcttaaatcagttt

SEQ ID NO: 3422297 - DNA, 16 bp, Homo sapiens
ttactgtggaggaagg

SEQ ID NO: 3422298 - DNA, 17 bp, Homo sapiens
ttactgtggaggaagga

SEQ ID NO: 3422299 - DNA, 23 bp, Homo sapiens
ttactgtggaggaaggattgtaa

SEQ ID NO: 3422300 - DNA, 13 bp, Homo sapiens
ttacttgagaagt

SEQ ID NO: 3422301 - DNA, 14 bp, Homo sapiens
ttactttttaaaca

SEQ ID NO: 3422302 - DNA, 18 bp, Homo sapiens
ttactttttaaacagtgt

SEQ ID NO: 3422303 - DNA, 12 bp, Homo sapiens
ttagaatgccat

SEQ ID NO: 3422304 - DNA, 20 bp, Homo sapiens
ttagctacctttttatattt

SEQ ID NO: 3422305 - DNA, 18 bp, Homo sapiens
ttagctcccctccaacct

SEQ ID NO: 3422306 - DNA, 17 bp, Homo sapiens
ttagctttttaattgtt

SEQ ID NO: 3422307 - DNA, 13 bp, Homo sapiens
ttaggagaagttg

SEQ ID NO: 3422308 - DNA, 18 bp, Homo sapiens
ttaggagaagttggtctt

SEQ ID NO: 3422309 - DNA, 13 bp, Homo sapiens
ttaggtaaataaa

SEQ ID NO: 3422310 - DNA, 13 bp, Homo sapiens
ttaggttgttacc

SEQ ID NO: 3422311 - DNA, 14 bp, Homo sapiens
ttaggttgttacca

SEQ ID NO: 3422312 - DNA, 23 bp, Homo sapiens
ttagtacaaactaactaataaaa

SEQ ID NO: 3422313 - DNA, 23 bp, Homo sapiens
ttagtatatgaaatattttgaat

SEQ ID NO: 3422314 - DNA, 21 bp, Homo sapiens
ttagttgatattcaaggcttt

SEQ ID NO: 3422315 - DNA, 18 bp, Homo sapiens
ttataaaccttgtcaata

SEQ ID NO: 3422316 - DNA, 16 bp, Homo sapiens
ttataccccatttgat

SEQ ID NO: 3422317 - DNA, 14 bp, Homo sapiens
ttatactggcatgc

SEQ ID NO: 3422318 - DNA, 21 bp, Homo sapiens
ttatatattgaaagttgcttt

SEQ ID NO: 3422319 - DNA, 19 bp, Homo sapiens
ttatatttattatataagt

SEQ ID NO: 3422320 - DNA, 18 bp, Homo sapiens
ttatcaccaggatttata

SEQ ID NO: 3422321 - DNA, 19 bp, Homo sapiens
ttatccagctagtgccaaa

SEQ ID NO: 3422322 - DNA, 22 bp, Homo sapiens
ttatcgaaataacaatgttaag

SEQ ID NO: 3422323 - DNA, 14 bp, Homo sapiens
ttatctacccagtc

SEQ ID NO: 3422324 - DNA, 17 bp, Homo sapiens
ttatctcagtcatgcat

SEQ ID NO: 3422325 - DNA, 21 bp, Homo sapiens
ttatctcagtcatgcataaat

SEQ ID NO: 3422326 - DNA, 17 bp, Homo sapiens
ttatctccttgtggcct

SEQ ID NO: 3422327 - DNA, 14 bp, Homo sapiens
ttatcttgagtgtt

SEQ ID NO: 3422328 - DNA, 22 bp, Homo sapiens
ttatcttgagtgttatgtgaat

SEQ ID NO: 3422329 - DNA, 19 bp, Homo sapiens
ttatgacacaatgacacat

SEQ ID NO: 3422330 - DNA, 14 bp, Homo sapiens
ttatgagatttact

SEQ ID NO: 3422331 - DNA, 20 bp, Homo sapiens
ttatgcaaatgagatttctt

SEQ ID NO: 3422332 - DNA, 17 bp, Homo sapiens
ttatgcccatgaacaag

SEQ ID NO: 3422333 - DNA, 19 bp, Homo sapiens
ttatggacatcgatatgaa

SEQ ID NO: 3422334 - DNA, 15 bp, Homo sapiens
ttcttaaatgttttc

SEQ ID NO: 3422335 - DNA, 18 bp, Homo sapiens
ttcttaaatgttttcatt

SEQ ID NO: 3422336 - DNA, 15 bp, Homo sapiens
ttcttacaaacatgt

SEQ ID NO: 3422337 - DNA, 16 bp, Homo sapiens
ttcttacatgcatttg

SEQ ID NO: 3422338 - DNA, 12 bp, Homo sapiens
ttcttctttaat

SEQ ID NO: 3422339 - DNA, 13 bp, Homo sapiens
ttcttgcactatt

SEQ ID NO: 3422340 - DNA, 14 bp, Homo sapiens
ttcttgcttctggc

SEQ ID NO: 3422341 - DNA, 15 bp, Homo sapiens
ttcttggtgcattcg

SEQ ID NO: 3422342 - DNA, 14 bp, Homo sapiens
ttctttgaatgtat

SEQ ID NO: 3422343 - DNA, 17 bp, Homo sapiens
ttcttttccagaaagaa

SEQ ID NO: 3422344 - DNA, 15 bp, Homo sapiens
ttcttttctttgtat

SEQ ID NO: 3422345 - DNA, 13 bp, Homo sapiens
ttgaaaaactttt

SEQ ID NO: 3422346 - DNA, 17 bp, Homo sapiens
ttgaaagaaaggactct

SEQ ID NO: 3422347 - DNA, 19 bp, Homo sapiens
ttgaaatttaaaaataaag

SEQ ID NO: 3422348 - DNA, 16 bp, Homo sapiens
ttgaaggaatacaata

SEQ ID NO: 3422349 - DNA, 18 bp, Homo sapiens
ttgaaggaatacaatata

SEQ ID NO: 3422350 - DNA, 21 bp, Homo sapiens
ttgaataatacgtgtgtacct

SEQ ID NO: 3422351 - DNA, 17 bp, Homo sapiens
ttgaatccatgcttggg

SEQ ID NO: 3422352 - DNA, 19 bp, Homo sapiens
ttgaatccatgcttgggtg

SEQ ID NO: 3422353 - DNA, 13 bp, Homo sapiens
ttgaatctatttt

SEQ ID NO: 3422354 - DNA, 16 bp, Homo sapiens
ttgaatgtgatcatct

SEQ ID NO: 3422355 - DNA, 14 bp, Homo sapiens
ttgacagaacactg

SEQ ID NO: 3422356 - DNA, 18 bp, Homo sapiens
ttgacctgaactctgcaa

SEQ ID NO: 3422357 - DNA, 19 bp, Homo sapiens
ttgacttgacagaacactg

SEQ ID NO: 3422358 - DNA, 17 bp, Homo sapiens
ttgagaataagaatttg

SEQ ID NO: 3422359 - DNA, 15 bp, Homo sapiens
ttgagcgtgattctg

SEQ ID NO: 3422360 - DNA, 16 bp, Homo sapiens
ttgaggtcaagtaaga

SEQ ID NO: 3422361 - DNA, 12 bp, Homo sapiens
ttgagtctctga

SEQ ID NO: 3422362 - DNA, 18 bp, Homo sapiens
ttgagtctgttttgtaaa

SEQ ID NO: 3422363 - DNA, 20 bp, Homo sapiens
ttgagtcttaactgtatttc

SEQ ID NO: 3422364 - DNA, 12 bp, Homo sapiens
ttgatcatagaa

SEQ ID NO: 3422365 - DNA, 17 bp, Homo sapiens
ttgatccatctcagtca

SEQ ID NO: 3422366 - DNA, 21 bp, Homo sapiens
ttgatcccttctcctgccctt

SEQ ID NO: 3422367 - DNA, 12 bp, Homo sapiens
ttgatctttgtt

SEQ ID NO: 3422368 - DNA, 18 bp, Homo sapiens
ttgatctttgtttaaatg

SEQ ID NO: 3422369 - DNA, 21 bp, Homo sapiens
ttgatctttgtttaaatgcca

SEQ ID NO: 3422370 - DNA, 12 bp, Homo sapiens
ttgattctcctt

SEQ ID NO: 3422371 - DNA, 13 bp, Homo sapiens
ttgattctccttc

SEQ ID NO: 3422372 - DNA, 20 bp, Homo sapiens
ttgattctccttcagccctc

SEQ ID NO: 3422373 - DNA, 15 bp, Homo sapiens
ttgattgtcagctac

SEQ ID NO: 3422374 - DNA, 17 bp, Homo sapiens
ttgatttcgatgtacag

SEQ ID NO: 3422375 - DNA, 20 bp, Homo sapiens
ttgatttgatctttgtttaa

SEQ ID NO: 3422376 - DNA, 12 bp, Homo sapiens
ttgcaaggaagc

SEQ ID NO: 3422377 - DNA, 13 bp, Homo sapiens
ttgcaaggaagcc

SEQ ID NO: 3422378 - DNA, 21 bp, Homo sapiens
ttgcaccaattaagtgttgaa

SEQ ID NO: 3422379 - DNA, 16 bp, Homo sapiens
ttgcaccattctttct

SEQ ID NO: 3422380 - DNA, 17 bp, Homo sapiens
ttgcaccattctttctt

SEQ ID NO: 3422381 - DNA, 18 bp, Homo sapiens
ttgcaccattctttcttg

SEQ ID NO: 3422382 - DNA, 19 bp, Homo sapiens
ttgcagaagttcttagtgt

SEQ ID NO: 3422383 - DNA, 22 bp, Homo sapiens
ttgcagccctgctgctgcctgc

SEQ ID NO: 3422384 - DNA, 17 bp, Homo sapiens
ttgcagctcccattcta

SEQ ID NO: 3422385 - DNA, 23 bp, Homo sapiens
ttgcagtcgtgtaattggcccaa

SEQ ID NO: 3422386 - DNA, 17 bp, Homo sapiens
ttgcataaacaatccaa

SEQ ID NO: 3422387 - DNA, 15 bp, Homo sapiens
ttgcataataagcta

SEQ ID NO: 3422388 - DNA, 20 bp, Homo sapiens
ttgcataataagctaaagag

SEQ ID NO: 3422389 - DNA, 22 bp, Homo sapiens
ttgcatcatagaacagaaatat

SEQ ID NO: 3422390 - DNA, 15 bp, Homo sapiens
ttgcccatataaaat

SEQ ID NO: 3422391 - DNA, 20 bp, Homo sapiens
ttgcctcgaaagtgtcatca

SEQ ID NO: 3422392 - DNA, 19 bp, Homo sapiens
ttgcctttgtaatatgaga

SEQ ID NO: 3422393 - DNA, 23 bp, Homo sapiens
ttgcggggcttttaaaaggaaaa

SEQ ID NO: 3422394 - DNA, 21 bp, Homo sapiens
ttgcgtggaattgtgctgagt

SEQ ID NO: 3422395 - DNA, 13 bp, Homo sapiens
ttgctccagacct

SEQ ID NO: 3422396 - DNA, 18 bp, Homo sapiens
ttgctccagacctgcccc

SEQ ID NO: 3422397 - DNA, 21 bp, Homo sapiens
ttgctgaatgtcattatttga

SEQ ID NO: 3422398 - DNA, 13 bp, Homo sapiens
ttgctgctgtgga

SEQ ID NO: 3422399 - DNA, 16 bp, Homo sapiens
ttgctgttttaaattg

SEQ ID NO: 3422400 - DNA, 12 bp, Homo sapiens
ttgcttaaggca

SEQ ID NO: 3422401 - DNA, 19 bp, Homo sapiens
ttgcttaaggcatactttt

SEQ ID NO: 3422402 - DNA, 18 bp, Homo sapiens
ttgcttcaaattggtctg

SEQ ID NO: 3422403 - DNA, 23 bp, Homo sapiens
ttgctttgttaaaaaaaaaaaga

SEQ ID NO: 3422404 - DNA, 16 bp, Homo sapiens
ttggaaaagaaatcaa

SEQ ID NO: 3422405 - DNA, 20 bp, Homo sapiens
ttggaaaagaaatcaatttt

SEQ ID NO: 3422406 - DNA, 21 bp, Homo sapiens
ttggaaaagaaatcaattttt

SEQ ID NO: 3422407 - DNA, 13 bp, Homo sapiens
ttggaactggagg

SEQ ID NO: 3422408 - DNA, 12 bp, Homo sapiens
ttggaacttttc

SEQ ID NO: 3422409 - DNA, 22 bp, Homo sapiens
ttggaagaagttttttactttg

SEQ ID NO: 3422410 - DNA, 18 bp, Homo sapiens
ttggattatttaataaca

SEQ ID NO: 3422411 - DNA, 21 bp, Homo sapiens
ttggattatttaataacatta

SEQ ID NO: 3422412 - DNA, 15 bp, Homo sapiens
ttggatttctttata

SEQ ID NO: 3422413 - DNA, 14 bp, Homo sapiens
ttggatttgctgtg

SEQ ID NO: 3422414 - DNA, 16 bp, Homo sapiens
ttggcagctctactct

SEQ ID NO: 3422415 - DNA, 16 bp, Homo sapiens
ttggcataatttgtct

SEQ ID NO: 3422416 - DNA, 23 bp, Homo sapiens
ttggccaaaacttaaaagcaaga

SEQ ID NO: 3422417 - DNA, 16 bp, Homo sapiens
ttggctcacactgaga

SEQ ID NO: 3422418 - DNA, 13 bp, Homo sapiens
ttgggattaatat

SEQ ID NO: 3422419 - DNA, 14 bp, Homo sapiens
ttggggaagaccca

SEQ ID NO: 3422420 - DNA, 20 bp, Homo sapiens
ttgggtgtaacaggtctcct

SEQ ID NO: 3422421 - DNA, 19 bp, Homo sapiens
ttggtcatggtagattttt

SEQ ID NO: 3422422 - DNA, 21 bp, Homo sapiens
ttggttatgatggaaaggaag

SEQ ID NO: 3422423 - DNA, 15 bp, Homo sapiens
ttggttcagtttttt

SEQ ID NO: 3422424 - DNA, 19 bp, Homo sapiens
ttggttgtatataaagttt

SEQ ID NO: 3422425 - DNA, 12 bp, Homo sapiens
ttggtttgcttt

SEQ ID NO: 3422426 - DNA, 18 bp, Homo sapiens
ttggttttgttcccctcc

SEQ ID NO: 3422427 - DNA, 15 bp, Homo sapiens
ttgtaaaaaaaaatg

SEQ ID NO: 3422428 - DNA, 16 bp, Homo sapiens
ttgtaaaaaaaaatgc

SEQ ID NO: 3422429 - DNA, 22 bp, Homo sapiens
ttgtaaaaaaaaatgcctttga

SEQ ID NO: 3422430 - DNA, 15 bp, Homo sapiens
ttgtaagagtgtaga

SEQ ID NO: 3422431 - DNA, 17 bp, Homo sapiens
ttgtaagagtgtagaag

SEQ ID NO: 3422432 - DNA, 19 bp, Homo sapiens
ttgtaagagtgtagaagca

SEQ ID NO: 3422433 - DNA, 13 bp, Homo sapiens
ttgtaagtttcag

SEQ ID NO: 3422434 - DNA, 19 bp, Homo sapiens
ttgtaagtttcaggtgaca

SEQ ID NO: 3422435 - DNA, 20 bp, Homo sapiens
ttgtaatatgagaatgtatt

SEQ ID NO: 3422436 - DNA, 15 bp, Homo sapiens
ttgtaatatttcttc

SEQ ID NO: 3422437 - DNA, 22 bp, Homo sapiens
ttgtaatatttcttcaagtgag

SEQ ID NO: 3422438 - DNA, 23 bp, Homo sapiens
ttgtaattttagtattaactctg

SEQ ID NO: 3422439 - DNA, 19 bp, Homo sapiens
ttgtagaataaatggtttc

SEQ ID NO: 3422440 - DNA, 20 bp, Homo sapiens
ttgtatctcttttgaatcca

SEQ ID NO: 3422441 - DNA, 21 bp, Homo sapiens
ttgtcaataaaaataaatcta

SEQ ID NO: 3422442 - DNA, 14 bp, Homo sapiens
ttgtcacagctctt

SEQ ID NO: 3422443 - DNA, 12 bp, Homo sapiens
ttgtcagctact

SEQ ID NO: 3422444 - DNA, 12 bp, Homo sapiens
ttgtcatgtgta

SEQ ID NO: 3422445 - DNA, 15 bp, Homo sapiens
ttgtcatgtgtatga

SEQ ID NO: 3422446 - DNA, 20 bp, Homo sapiens
tttctagtggtctttgtaag

SEQ ID NO: 3422447 - DNA, 13 bp, Homo sapiens
tttctcaaagttt

SEQ ID NO: 3422448 - DNA, 14 bp, Homo sapiens
tttctcccctgccc

SEQ ID NO: 3422449 - DNA, 20 bp, Homo sapiens
tttctcccctgcccccagga

SEQ ID NO: 3422450 - DNA, 22 bp, Homo sapiens
tttctcccctgcccccaggact

SEQ ID NO: 3422451 - DNA, 20 bp, Homo sapiens
tttctcctgcatgtgtatat

SEQ ID NO: 3422452 - DNA, 22 bp, Homo sapiens
tttctcctgcatgtgtatatat

SEQ ID NO: 3422453 - DNA, 11 bp, Homo sapiens
tttctgatctg

SEQ ID NO: 3422454 - DNA, 23 bp, Homo sapiens
tttctgatctgattttttattca

SEQ ID NO: 3422455 - DNA, 14 bp, Homo sapiens
tttctgtaaatgaa

SEQ ID NO: 3422456 - DNA, 19 bp, Homo sapiens
tttcttagctttttaattg

SEQ ID NO: 3422457 - DNA, 21 bp, Homo sapiens
tttcttagctttttaattgtt

SEQ ID NO: 3422458 - DNA, 20 bp, Homo sapiens
tttcttgttcatccaaggaa

SEQ ID NO: 3422459 - DNA, 13 bp, Homo sapiens
tttctttctagtg

SEQ ID NO: 3422460 - DNA, 16 bp, Homo sapiens
tttctttgaatgtatt

SEQ ID NO: 3422461 - DNA, 13 bp, Homo sapiens
tttctttgctgct

SEQ ID NO: 3422462 - DNA, 14 bp, Homo sapiens
tttctttgctgctg

SEQ ID NO: 3422463 - DNA, 15 bp, Homo sapiens
tttgaaatcagcata

SEQ ID NO: 3422464 - DNA, 18 bp, Homo sapiens
tttgaatataaacactat

SEQ ID NO: 3422465 - DNA, 21 bp, Homo sapiens
tttgaatgtattgttctgttt

SEQ ID NO: 3422466 - DNA, 19 bp, Homo sapiens
tttgaatgtgatcatcttt

SEQ ID NO: 3422467 - DNA, 19 bp, Homo sapiens
tttgacgaagaaacaaaaa

SEQ ID NO: 3422468 - DNA, 20 bp, Homo sapiens
tttgagacagtttcttagct

SEQ ID NO: 3422469 - DNA, 20 bp, Homo sapiens
tttgaggtcaagtaagaaga

SEQ ID NO: 3422470 - DNA, 12 bp, Homo sapiens
tttgaggtcttt

SEQ ID NO: 3422471 - DNA, 23 bp, Homo sapiens
tttgataacattttgtttatgtt

SEQ ID NO: 3422472 - DNA, 16 bp, Homo sapiens
tttgatagtgcttctt

SEQ ID NO: 3422473 - DNA, 18 bp, Homo sapiens
tttgatgaggccctccac

SEQ ID NO: 3422474 - DNA, 16 bp, Homo sapiens
tttgattctccttcag

SEQ ID NO: 3422475 - DNA, 21 bp, Homo sapiens
tttgattctccttcagccctc

SEQ ID NO: 3422476 - DNA, 14 bp, Homo sapiens
tttgcaaggaagcc

SEQ ID NO: 3422477 - DNA, 21 bp, Homo sapiens
tttgcaaggaagccacagctg

SEQ ID NO: 3422478 - DNA, 11 bp, Homo sapiens
tttgcagcttt

SEQ ID NO: 3422479 - DNA, 22 bp, Homo sapiens
tttgcaggtctttaaatcattt

SEQ ID NO: 3422480 - DNA, 19 bp, Homo sapiens
tttgcataataaatgcttc

SEQ ID NO: 3422481 - DNA, 16 bp, Homo sapiens
tttgccaagctaatct

SEQ ID NO: 3422482 - DNA, 14 bp, Homo sapiens
tttgccatgggctt

SEQ ID NO: 3422483 - DNA, 16 bp, Homo sapiens
tttgcggggcttttaa

SEQ ID NO: 3422484 - DNA, 22 bp, Homo sapiens
tttgctaactagcttggaaact

SEQ ID NO: 3422485 - DNA, 21 bp, Homo sapiens
tttgctgctgtggaaaggatt

SEQ ID NO: 3422486 - DNA, 16 bp, Homo sapiens
tttgctgttactgctt

SEQ ID NO: 3422487 - DNA, 17 bp, Homo sapiens
tttgctgttactgcttc

SEQ ID NO: 3422488 - DNA, 22 bp, Homo sapiens
tttgctgttttaaattgcattt

SEQ ID NO: 3422489 - DNA, 22 bp, Homo sapiens
tttggatgtcctcaaagaagtg

SEQ ID NO: 3422490 - DNA, 16 bp, Homo sapiens
tttggcaacagaaaac

SEQ ID NO: 3422491 - DNA, 23 bp, Homo sapiens
tttggcagcaaagtgtcagtgtt

SEQ ID NO: 3422492 - DNA, 14 bp, Homo sapiens
tttgggctaacatt

SEQ ID NO: 3422493 - DNA, 16 bp, Homo sapiens
tttgggctaacattta

SEQ ID NO: 3422494 - DNA, 20 bp, Homo sapiens
tttggtgctcatttaaatat

SEQ ID NO: 3422495 - DNA, 17 bp, Homo sapiens
tttggttaatcagtgtt

SEQ ID NO: 3422496 - DNA, 14 bp, Homo sapiens
tttggttttgttcc

SEQ ID NO: 3422497 - DNA, 16 bp, Homo sapiens
tttggttttgttcccc

SEQ ID NO: 3422498 - DNA, 17 bp, Homo sapiens
tttgtaagagtgtagaa

SEQ ID NO: 3422499 - DNA, 18 bp, Homo sapiens
tttgtaagagtgtagaag

SEQ ID NO: 3422500 - DNA, 17 bp, Homo sapiens
tttgtaattttagtatt

SEQ ID NO: 3422501 - DNA, 16 bp, Homo sapiens
tttgtagaataaatgg

SEQ ID NO: 3422502 - DNA, 18 bp, Homo sapiens
tttgtagaataaatggtt

SEQ ID NO: 3422503 - DNA, 22 bp, Homo sapiens
tttgtattgcttcctgattacc

SEQ ID NO: 3422504 - DNA, 14 bp, Homo sapiens
tttgtccattattc

SEQ ID NO: 3422505 - DNA, 17 bp, Homo sapiens
tttgtctttcaaattta

SEQ ID NO: 3422506 - DNA, 19 bp, Homo sapiens
tttgtgaatggattggatt

SEQ ID NO: 3422507 - DNA, 19 bp, Homo sapiens
tttgtggcaaaatattctt

SEQ ID NO: 3422508 - DNA, 19 bp, Homo sapiens
tttgttaacagacactgta

SEQ ID NO: 3422509 - DNA, 13 bp, Homo sapiens
tttgttatagatt

SEQ ID NO: 3422510 - DNA, 15 bp, Homo sapiens
tttgttatattttat

SEQ ID NO: 3422511 - DNA, 12 bp, Homo sapiens
tttgttccctca

SEQ ID NO: 3422512 - DNA, 16 bp, Homo sapiens
tttgttgagtctctga

SEQ ID NO: 3422513 - DNA, 17 bp, Homo sapiens
tttgttgagtctctgaa

SEQ ID NO: 3422514 - DNA, 21 bp, Homo sapiens
tttgtttatgttacttaaaca

SEQ ID NO: 3422515 - DNA, 12 bp, Homo sapiens
tttgtttcttga

SEQ ID NO: 3422516 - DNA, 18 bp, Homo sapiens
tttgtttcttgatagtta

SEQ ID NO: 3422517 - DNA, 13 bp, Homo sapiens
ttttaaaaggaaa

SEQ ID NO: 3422518 - DNA, 14 bp, Homo sapiens
ttttaaaaggaaaa

SEQ ID NO: 3422519 - DNA, 19 bp, Homo sapiens
ttttaaacaaaatttcaca

SEQ ID NO: 3422520 - DNA, 21 bp, Homo sapiens
ttttaaacaaaatttcacagt

SEQ ID NO: 3422521 - DNA, 13 bp, Homo sapiens
ttttaaacagtgt

SEQ ID NO: 3422522 - DNA, 16 bp, Homo sapiens
ttttaaaggacaaaca

SEQ ID NO: 3422523 - DNA, 17 bp, Homo sapiens
ttttaaaggacaaacag

SEQ ID NO: 3422524 - DNA, 9 bp, Homo sapiens
ttttaaagt

SEQ ID NO: 3422525 - DNA, 14 bp, Homo sapiens
ttttaaagtaaact

SEQ ID NO: 3422526 - DNA, 17 bp, Homo sapiens
ttttaaagtaaacttgt

SEQ ID NO: 3422527 - DNA, 19 bp, Homo sapiens
ttttaaagtaaacttgtgt

SEQ ID NO: 3422528 - DNA, 22 bp, Homo sapiens
ttttaaagtaaacttgtgtatt

SEQ ID NO: 3422529 - DNA, 13 bp, Homo sapiens
ttttaaattgcat

SEQ ID NO: 3422530 - DNA, 12 bp, Homo sapiens
ttttaagatttt

SEQ ID NO: 3422531 - DNA, 19 bp, Homo sapiens
ttttaagatttttctcaaa

SEQ ID NO: 3422532 - DNA, 21 bp, Homo sapiens
ttttaagatttttctcaaagt

SEQ ID NO: 3422533 - DNA, 23 bp, Homo sapiens
ttttaagtgacataattgtccag

SEQ ID NO: 3422534 - DNA, 17 bp, Homo sapiens
ttttaattaaaaacttt

SEQ ID NO: 3422535 - DNA, 19 bp, Homo sapiens
ttttaattaaaaactttaa

SEQ ID NO: 3422536 - DNA, 21 bp, Homo sapiens
ttttactaagatcacacaaat

SEQ ID NO: 3422537 - DNA, 15 bp, Homo sapiens
ttttactttggttta

SEQ ID NO: 3422538 - DNA, 22 bp, Homo sapiens
ttttactttggtttagtctttt

SEQ ID NO: 3422539 - DNA, 12 bp, Homo sapiens
ttttaggaaagg

SEQ ID NO: 3422540 - DNA, 16 bp, Homo sapiens
ttttaggttgttacca

SEQ ID NO: 3422541 - DNA, 21 bp, Homo sapiens
ttttatatttaaaaaattaaa

SEQ ID NO: 3422542 - DNA, 13 bp, Homo sapiens
ttttatctgtgga

SEQ ID NO: 3422543 - DNA, 19 bp, Homo sapiens
ttttatgccttttatttct

SEQ ID NO: 3422544 - DNA, 21 bp, Homo sapiens
ttttatttttctcatgatgag

SEQ ID NO: 3422545 - DNA, 22 bp, Homo sapiens
ttttcatagatttgaaaaactt

SEQ ID NO: 3422546 - DNA, 17 bp, Homo sapiens
ttttccagaaagaaaat

SEQ ID NO: 3422547 - DNA, 20 bp, Homo sapiens
ttttccttcctttttattca

SEQ ID NO: 3422548 - DNA, 12 bp, Homo sapiens
ttttcctttaaa

SEQ ID NO: 3422549 - DNA, 15 bp, Homo sapiens
ttttctactgtttta

SEQ ID NO: 3422550 - DNA, 20 bp, Homo sapiens
ttttctcaaagttttgaaaa

SEQ ID NO: 3422551 - DNA, 23 bp, Homo sapiens
ttttctcaaagttttgaaaagct

SEQ ID NO: 3422552 - DNA, 19 bp, Homo sapiens
ttttctgcccaactttcat

SEQ ID NO: 3422553 - DNA, 20 bp, Homo sapiens
ttttcttcattttgttctga

SEQ ID NO: 3422554 - DNA, 20 bp, Homo sapiens
ttttctttgtatcattcatc

SEQ ID NO: 3422555 - DNA, 21 bp, Homo sapiens
ttttcttttagttacatgaat

SEQ ID NO: 3422556 - DNA, 15 bp, Homo sapiens
ttttgaaaagctatt

SEQ ID NO: 3422557 - DNA, 11 bp, Homo sapiens
aaaaaaaagaa

SEQ ID NO: 3422558 - DNA, 12 bp, Homo sapiens
aaaaaatttaag

SEQ ID NO: 3422559 - DNA, 14 bp, Homo sapiens
aaaaaatttaagtg

SEQ ID NO: 3422560 - DNA, 11 bp, Homo sapiens
aaaaataaagc

SEQ ID NO: 3422561 - DNA, 12 bp, Homo sapiens
aaaaataaagct

SEQ ID NO: 3422562 - DNA, 16 bp, Homo sapiens
aaaaataaagctactg

SEQ ID NO: 3422563 - DNA, 17 bp, Homo sapiens
aaaaataatatactttt

SEQ ID NO: 3422564 - DNA, 18 bp, Homo sapiens
aaaaatcaacctatcaaa

SEQ ID NO: 3422565 - DNA, 21 bp, Homo sapiens
aaaaatgcctttgagacagtt

SEQ ID NO: 3422566 - DNA, 13 bp, Homo sapiens
aaaaatttaagtg

SEQ ID NO: 3422567 - DNA, 17 bp, Homo sapiens
aaaacaggcactgccct

SEQ ID NO: 3422568 - DNA, 15 bp, Homo sapiens
aaaacatgtttctgc

SEQ ID NO: 3422569 - DNA, 15 bp, Homo sapiens
aaaagaaatcaattt

SEQ ID NO: 3422570 - DNA, 15 bp, Homo sapiens
aaaagaagaaataaa

SEQ ID NO: 3422571 - DNA, 21 bp, Homo sapiens
aaaagatattttatttctgat

SEQ ID NO: 3422572 - DNA, 14 bp, Homo sapiens
aaaagcagctacca

SEQ ID NO: 3422573 - DNA, 23 bp, Homo sapiens
aaaagcaggcttgtgctttatac

SEQ ID NO: 3422574 - DNA, 14 bp, Homo sapiens
aaaagcccaacaca

SEQ ID NO: 3422575 - DNA, 15 bp, Homo sapiens
aaaagctattagcca

SEQ ID NO: 3422576 - DNA, 21 bp, Homo sapiens
aaaagctattagccaggatca

SEQ ID NO: 3422577 - DNA, 10 bp, Homo sapiens
aaaaggaaaa

SEQ ID NO: 3422578 - DNA, 13 bp, Homo sapiens
aaaaggaagacta

SEQ ID NO: 3422579 - DNA, 14 bp, Homo sapiens
aaaaggaagattct

SEQ ID NO: 3422580 - DNA, 13 bp, Homo sapiens
aaaagtatatgtt

SEQ ID NO: 3422581 - DNA, 20 bp, Homo sapiens
aagaagaaataaataatcta

SEQ ID NO: 3422582 - DNA, 17 bp, Homo sapiens
aagaagctgttgtacat

SEQ ID NO: 3422583 - DNA, 21 bp, Homo sapiens
aagaagctgttgtacatttat

SEQ ID NO: 3422584 - DNA, 19 bp, Homo sapiens
aagaaggcagcaggtggca

SEQ ID NO: 3422585 - DNA, 20 bp, Homo sapiens
aagacaaacaccttatttgt

SEQ ID NO: 3422586 - DNA, 13 bp, Homo sapiens
aagacaccagagc

SEQ ID NO: 3422587 - DNA, 15 bp, Homo sapiens
aagacagagctggga

SEQ ID NO: 3422588 - DNA, 19 bp, Homo sapiens
aagacataacgtttttcct

SEQ ID NO: 3422589 - DNA, 21 bp, Homo sapiens
aagacataacgtttttccttt

SEQ ID NO: 3422590 - DNA, 14 bp, Homo sapiens
aagaccaaattttg

SEQ ID NO: 3422591 - DNA, 19 bp, Homo sapiens
aagacccaacacatgggac

SEQ ID NO: 3422592 - DNA, 11 bp, Homo sapiens
aagaccccact

SEQ ID NO: 3422593 - DNA, 14 bp, Homo sapiens
aagagactgggcct

SEQ ID NO: 3422594 - DNA, 11 bp, Homo sapiens
aagagagtttt

SEQ ID NO: 3422595 - DNA, 17 bp, Homo sapiens
aagagcaaaaagtgtaa

SEQ ID NO: 3422596 - DNA, 18 bp, Homo sapiens
aagagccctaagtttgta

SEQ ID NO: 3422597 - DNA, 18 bp, Homo sapiens
aagagctgaggcaattct

SEQ ID NO: 3422598 - DNA, 15 bp, Homo sapiens
aagagtgtagaagca

SEQ ID NO: 3422599 - DNA, 16 bp, Homo sapiens
aagagtgtagaagcat

SEQ ID NO: 3422600 - DNA, 22 bp, Homo sapiens
aagagtgtagaagcattccttc

SEQ ID NO: 3422601 - DNA, 22 bp, Homo sapiens
aagagtttgatgaggccctcca

SEQ ID NO: 3422602 - DNA, 19 bp, Homo sapiens
aagatattttatttctgat

SEQ ID NO: 3422603 - DNA, 21 bp, Homo sapiens
aagatattttatttctgatgt

SEQ ID NO: 3422604 - DNA, 19 bp, Homo sapiens
aagatgaaaccgtccctga

SEQ ID NO: 3422605 - DNA, 14 bp, Homo sapiens
aagatttttctcaa

SEQ ID NO: 3422606 - DNA, 15 bp, Homo sapiens
aagatttttctcaaa

SEQ ID NO: 3422607 - DNA, 23 bp, Homo sapiens
aagattttttttttaagtgacat

SEQ ID NO: 3422608 - DNA, 14 bp, Homo sapiens
aagcaagatctact

SEQ ID NO: 3422609 - DNA, 17 bp, Homo sapiens
aagcagagttctttgca

SEQ ID NO: 3422610 - DNA, 11 bp, Homo sapiens
aagcagctctt

SEQ ID NO: 3422611 - DNA, 13 bp, Homo sapiens
aagcagtaataat

SEQ ID NO: 3422612 - DNA, 19 bp, Homo sapiens
aagcatgagtggccttaat

SEQ ID NO: 3422613 - DNA, 20 bp, Homo sapiens
aagcattccttctttgataa

SEQ ID NO: 3422614 - DNA, 19 bp, Homo sapiens
aagccaagctccctggagc

SEQ ID NO: 3422615 - DNA, 14 bp, Homo sapiens
aagccacaggcctg

SEQ ID NO: 3422616 - DNA, 23 bp, Homo sapiens
aagccacaggcctgagatttcat

SEQ ID NO: 3422617 - DNA, 12 bp, Homo sapiens
aagcccaacaca

SEQ ID NO: 3422618 - DNA, 14 bp, Homo sapiens
aagcccaacacaca

SEQ ID NO: 3422619 - DNA, 14 bp, Homo sapiens
aagctacagttgtc

SEQ ID NO: 3422620 - DNA, 18 bp, Homo sapiens
aagctactgaatttattg

SEQ ID NO: 3422621 - DNA, 19 bp, Homo sapiens
aagctactgaatttattgc

SEQ ID NO: 3422622 - DNA, 12 bp, Homo sapiens
aagctccctgga

SEQ ID NO: 3422623 - DNA, 13 bp, Homo sapiens
aagctccctggag

SEQ ID NO: 3422624 - DNA, 11 bp, Homo sapiens
aagctctgagc

SEQ ID NO: 3422625 - DNA, 18 bp, Homo sapiens
aagcttagattttctgta

SEQ ID NO: 3422626 - DNA, 14 bp, Homo sapiens
aagctttatctttg

SEQ ID NO: 3422627 - DNA, 16 bp, Homo sapiens
aagctttatctttgtg

SEQ ID NO: 3422628 - DNA, 16 bp, Homo sapiens
aaggaaactcttatct

SEQ ID NO: 3422629 - DNA, 13 bp, Homo sapiens
aaggaagattctt

SEQ ID NO: 3422630 - DNA, 22 bp, Homo sapiens
aaggaagccacagctggtggta

SEQ ID NO: 3422631 - DNA, 15 bp, Homo sapiens
aaggacagcatcaaa

SEQ ID NO: 3422632 - DNA, 16 bp, Homo sapiens
aaggacagctttgata

SEQ ID NO: 3422633 - DNA, 12 bp, Homo sapiens
aaggactctggg

SEQ ID NO: 3422634 - DNA, 16 bp, Homo sapiens
aaggagcctaggccag

SEQ ID NO: 3422635 - DNA, 12 bp, Homo sapiens
aaggagctgcct

SEQ ID NO: 3422636 - DNA, 17 bp, Homo sapiens
aaggagctgcctggacc

SEQ ID NO: 3422637 - DNA, 17 bp, Homo sapiens
aaggattctaaacagat

SEQ ID NO: 3422638 - DNA, 23 bp, Homo sapiens
aaggattgtaaaaaaaaatgcct

SEQ ID NO: 3422639 - DNA, 20 bp, Homo sapiens
aaggcagggagcgagggaga

SEQ ID NO: 3422640 - DNA, 22 bp, Homo sapiens
aaggcatttgattaaattatga

SEQ ID NO: 3422641 - DNA, 19 bp, Homo sapiens
aaggctgtacatagtcctt

SEQ ID NO: 3422642 - DNA, 13 bp, Homo sapiens
aagggagaaatgc

SEQ ID NO: 3422643 - DNA, 17 bp, Homo sapiens
aaggttgtattgcatat

SEQ ID NO: 3422644 - DNA, 16 bp, Homo sapiens
aaggtttctgaaaatt

SEQ ID NO: 3422645 - DNA, 17 bp, Homo sapiens
aagtagaacaaaaacta

SEQ ID NO: 3422646 - DNA, 12 bp, Homo sapiens
aagtataacaaa

SEQ ID NO: 3422647 - DNA, 14 bp, Homo sapiens
aagtatacatgtca

SEQ ID NO: 3422648 - DNA, 19 bp, Homo sapiens
aagtatatgtgagaaatca

SEQ ID NO: 3422649 - DNA, 15 bp, Homo sapiens
aagtatccttcattg

SEQ ID NO: 3422650 - DNA, 16 bp, Homo sapiens
aagtatccttcattgt

SEQ ID NO: 3422651 - DNA, 23 bp, Homo sapiens
aagtatccttcattgtgaggttt

SEQ ID NO: 3422652 - DNA, 14 bp, Homo sapiens
aagtatgcaaaata

SEQ ID NO: 3422653 - DNA, 20 bp, Homo sapiens
aagtatgcaaaataaagaat

SEQ ID NO: 3422654 - DNA, 12 bp, Homo sapiens
aagtcattgttt

SEQ ID NO: 3422655 - DNA, 19 bp, Homo sapiens
aagtcattgtttttctcgc

SEQ ID NO: 3422656 - DNA, 13 bp, Homo sapiens
aagtcctgctttc

SEQ ID NO: 3422657 - DNA, 22 bp, Homo sapiens
aagtctatctaatgacatgcct

SEQ ID NO: 3422658 - DNA, 15 bp, Homo sapiens
aagtgagtggcatgt

SEQ ID NO: 3422659 - DNA, 17 bp, Homo sapiens
aagtgcattattttatt

SEQ ID NO: 3422660 - DNA, 23 bp, Homo sapiens
aagtgcattattttattgagcaa

SEQ ID NO: 3422661 - DNA, 15 bp, Homo sapiens
aagtgcgtgtgtaga

SEQ ID NO: 3422662 - DNA, 22 bp, Homo sapiens
aagtgcgtgtgtagagttaaga

SEQ ID NO: 3422663 - DNA, 13 bp, Homo sapiens
aagtgctgcggag

SEQ ID NO: 3422664 - DNA, 14 bp, Homo sapiens
aagtggcataaaaa

SEQ ID NO: 3422665 - DNA, 16 bp, Homo sapiens
aagtggccactggcat

SEQ ID NO: 3422666 - DNA, 20 bp, Homo sapiens
aagtgtctagagtcatgtga

SEQ ID NO: 3422667 - DNA, 15 bp, Homo sapiens
aagtgttgaaaaata

SEQ ID NO: 3422668 - DNA, 12 bp, Homo sapiens
aagtgtttataa

SEQ ID NO: 3422669 - DNA, 17 bp, Homo sapiens
aagttaccttactgaaa

SEQ ID NO: 3422670 - DNA, 12 bp, Homo sapiens
aagtttcaggtg

SEQ ID NO: 3422671 - DNA, 18 bp, Homo sapiens
aagtttgggctaacattt

SEQ ID NO: 3422672 - DNA, 15 bp, Homo sapiens
aagttttgaaaagct

SEQ ID NO: 3422673 - DNA, 16 bp, Homo sapiens
aagttttgaaaagcta

SEQ ID NO: 3422674 - DNA, 19 bp, Homo sapiens
aataaaaactgactcctta

SEQ ID NO: 3422675 - DNA, 13 bp, Homo sapiens
aataaaaataaat

SEQ ID NO: 3422676 - DNA, 19 bp, Homo sapiens
aataaaattatttgcaggt

SEQ ID NO: 3422677 - DNA, 17 bp, Homo sapiens
aataaaccttgtttctt

SEQ ID NO: 3422678 - DNA, 22 bp, Homo sapiens
aataaaccttgtttctttctga

SEQ ID NO: 3422679 - DNA, 21 bp, Homo sapiens
aataaagctactgaatttatt

SEQ ID NO: 3422680 - DNA, 19 bp, Homo sapiens
aataaatgcatagagcaat

SEQ ID NO: 3422681 - DNA, 21 bp, Homo sapiens
aataaatgcatagagcaatta

SEQ ID NO: 3422682 - DNA, 20 bp, Homo sapiens
aataaattgtaattgtaaag

SEQ ID NO: 3422683 - DNA, 18 bp, Homo sapiens
aataacctataaagtgtt

SEQ ID NO: 3422684 - DNA, 17 bp, Homo sapiens
aataagcaactaaatga

SEQ ID NO: 3422685 - DNA, 17 bp, Homo sapiens
aataagtgccaggatgg

SEQ ID NO: 3422686 - DNA, 21 bp, Homo sapiens
aataataaatgcatagagcaa

SEQ ID NO: 3422687 - DNA, 21 bp, Homo sapiens
aataatagctaataataaatg

SEQ ID NO: 3422688 - DNA, 13 bp, Homo sapiens
aataatctacatc

SEQ ID NO: 3422689 - DNA, 13 bp, Homo sapiens
aataatctatatt

SEQ ID NO: 3422690 - DNA, 19 bp, Homo sapiens
aataattggccttcgattt

SEQ ID NO: 3422691 - DNA, 15 bp, Homo sapiens
aatacacatctctgt

SEQ ID NO: 3422692 - DNA, 22 bp, Homo sapiens
aatacacatctctgtcagtgtg

SEQ ID NO: 3422693 - DNA, 22 bp, Homo sapiens
acatctaaattgatcattcata

SEQ ID NO: 3422694 - DNA, 17 bp, Homo sapiens
acatctgcctgtaatta

SEQ ID NO: 3422695 - DNA, 22 bp, Homo sapiens
acatctgcctgtaattaaacta

SEQ ID NO: 3422696 - DNA, 14 bp, Homo sapiens
acatctgtgtctgt

SEQ ID NO: 3422697 - DNA, 13 bp, Homo sapiens
acatgaattaagg

SEQ ID NO: 3422698 - DNA, 20 bp, Homo sapiens
acatggctctaaaaagtttt

SEQ ID NO: 3422699 - DNA, 17 bp, Homo sapiens
acatgtaataaaaagta

SEQ ID NO: 3422700 - DNA, 23 bp, Homo sapiens
acatgtaataaaaagtatatgtt

SEQ ID NO: 3422701 - DNA, 14 bp, Homo sapiens
acatgtatgtggat

SEQ ID NO: 3422702 - DNA, 15 bp, Homo sapiens
acatgtgcaactctt

SEQ ID NO: 3422703 - DNA, 19 bp, Homo sapiens
acatgtgcaactcttgtat

SEQ ID NO: 3422704 - DNA, 18 bp, Homo sapiens
acattaaagcaatctgtt

SEQ ID NO: 3422705 - DNA, 16 bp, Homo sapiens
acattaccttactgtg

SEQ ID NO: 3422706 - DNA, 20 bp, Homo sapiens
acattcagctgaggttcatt

SEQ ID NO: 3422707 - DNA, 14 bp, Homo sapiens
acattgatgaatga

SEQ ID NO: 3422708 - DNA, 12 bp, Homo sapiens
acattgatttta

SEQ ID NO: 3422709 - DNA, 17 bp, Homo sapiens
acatttaggagaagttg

SEQ ID NO: 3422710 - DNA, 14 bp, Homo sapiens
acatttatgattta

SEQ ID NO: 3422711 - DNA, 22 bp, Homo sapiens
acatttatgatttaataaaata

SEQ ID NO: 3422712 - DNA, 20 bp, Homo sapiens
acatttggcttacagtaaat

SEQ ID NO: 3422713 - DNA, 18 bp, Homo sapiens
acattttgacacaatgtt

SEQ ID NO: 3422714 - DNA, 16 bp, Homo sapiens
acattttggatttctt

SEQ ID NO: 3422715 - DNA, 17 bp, Homo sapiens
acattttggatttcttt

SEQ ID NO: 3422716 - DNA, 19 bp, Homo sapiens
accaaaaatcaacctatca

SEQ ID NO: 3422717 - DNA, 19 bp, Homo sapiens
accaaattttgaggtcttt

SEQ ID NO: 3422718 - DNA, 18 bp, Homo sapiens
accacaaaaaaatacctc

SEQ ID NO: 3422719 - DNA, 22 bp, Homo sapiens
accacaggaattttaaaaacaa

SEQ ID NO: 3422720 - DNA, 17 bp, Homo sapiens
accacagggttcaaaat

SEQ ID NO: 3422721 - DNA, 22 bp, Homo sapiens
accacagggttcaaaatgtctg

SEQ ID NO: 3422722 - DNA, 12 bp, Homo sapiens
accacctcatgt

SEQ ID NO: 3422723 - DNA, 13 bp, Homo sapiens
accactttttgca

SEQ ID NO: 3422724 - DNA, 14 bp, Homo sapiens
accactttttgcag

SEQ ID NO: 3422725 - DNA, 17 bp, Homo sapiens
accagctagccagtcac

SEQ ID NO: 3422726 - DNA, 18 bp, Homo sapiens
accaggcttgcctgcagg

SEQ ID NO: 3422727 - DNA, 19 bp, Homo sapiens
accagggagctgcaggggc

SEQ ID NO: 3422728 - DNA, 20 bp, Homo sapiens
accaggtgttctacactcat

SEQ ID NO: 3422729 - DNA, 16 bp, Homo sapiens
accagtgggcatgtat

SEQ ID NO: 3422730 - DNA, 19 bp, Homo sapiens
accatataactgtgatgaa

SEQ ID NO: 3422731 - DNA, 13 bp, Homo sapiens
accatgaagctgg

SEQ ID NO: 3422732 - DNA, 12 bp, Homo sapiens
acccaacagttt

SEQ ID NO: 3422733 - DNA, 13 bp, Homo sapiens
acccacttctgca

SEQ ID NO: 3422734 - DNA, 23 bp, Homo sapiens
acccattccttcccagaggggcc

SEQ ID NO: 3422735 - DNA, 12 bp, Homo sapiens
accccacttcag

SEQ ID NO: 3422736 - DNA, 17 bp, Homo sapiens
accccagggcagccagg

SEQ ID NO: 3422737 - DNA, 13 bp, Homo sapiens
acccctccctttc

SEQ ID NO: 3422738 - DNA, 18 bp, Homo sapiens
acccctccctttctcccc

SEQ ID NO: 3422739 - DNA, 23 bp, Homo sapiens
acccctccctttctcccctgccc

SEQ ID NO: 3422740 - DNA, 22 bp, Homo sapiens
acccctgcattggaactggagg

SEQ ID NO: 3422741 - DNA, 23 bp, Homo sapiens
acccctgcattggaactggaggc

SEQ ID NO: 3422742 - DNA, 17 bp, Homo sapiens
acccgttcatgggggag

SEQ ID NO: 3422743 - DNA, 14 bp, Homo sapiens
accctatacatttt

SEQ ID NO: 3422744 - DNA, 15 bp, Homo sapiens
accctatacattttg

SEQ ID NO: 3422745 - DNA, 19 bp, Homo sapiens
accctcctccagaccattc

SEQ ID NO: 3422746 - DNA, 14 bp, Homo sapiens
accctcgaggcgga

SEQ ID NO: 3422747 - DNA, 24 bp, Homo sapiens
accctggaaactaccagtgggcat

SEQ ID NO: 3422748 - DNA, 23 bp, Homo sapiens
accgcccactctccacctcacta

SEQ ID NO: 3422749 - DNA, 15 bp, Homo sapiens
accggaccagcctgg

SEQ ID NO: 3422750 - DNA, 18 bp, Homo sapiens
accggaccagcctggccc

SEQ ID NO: 3422751 - DNA, 21 bp, Homo sapiens
accgtgttggttttgactgga

SEQ ID NO: 3422752 - DNA, 14 bp, Homo sapiens
accgttttgtattg

SEQ ID NO: 3422753 - DNA, 22 bp, Homo sapiens
acctaatgaaagtgatgacata

SEQ ID NO: 3422754 - DNA, 20 bp, Homo sapiens
acctaatgtttatgagccag

SEQ ID NO: 3422755 - DNA, 20 bp, Homo sapiens
acctataaagtgtttatgac

SEQ ID NO: 3422756 - DNA, 10 bp, Homo sapiens
acctcaaggg

SEQ ID NO: 3422757 - DNA, 21 bp, Homo sapiens
acctcaagggggactgtcttt

SEQ ID NO: 3422758 - DNA, 23 bp, Homo sapiens
acctcaggaaagaatagaaagaa

SEQ ID NO: 3422759 - DNA, 18 bp, Homo sapiens
acctctccagcctcagct

SEQ ID NO: 3422760 - DNA, 16 bp, Homo sapiens
acctgatcaatgacag

SEQ ID NO: 3422761 - DNA, 17 bp, Homo sapiens
acctgcatatctctagt

SEQ ID NO: 3422762 - DNA, 15 bp, Homo sapiens
acctggacccctgca

SEQ ID NO: 3422763 - DNA, 16 bp, Homo sapiens
acctggcggcaggaag

SEQ ID NO: 3422764 - DNA, 23 bp, Homo sapiens
acctggcggcaggaagccaaaga

SEQ ID NO: 3422765 - DNA, 11 bp, Homo sapiens
acctggctccc

SEQ ID NO: 3422766 - DNA, 13 bp, Homo sapiens
acctggctccccc

SEQ ID NO: 3422767 - DNA, 15 bp, Homo sapiens
accttactgtggagg

SEQ ID NO: 3422768 - DNA, 17 bp, Homo sapiens
accttgatgagctgtgc

SEQ ID NO: 3422769 - DNA, 21 bp, Homo sapiens
accttgtcaataaaaataaat

SEQ ID NO: 3422770 - DNA, 23 bp, Homo sapiens
acctttttatatttaaaaaatta

SEQ ID NO: 3422771 - DNA, 15 bp, Homo sapiens
acgattatgactaaa

SEQ ID NO: 3422772 - DNA, 19 bp, Homo sapiens
acgctttcagcgaatgaca

SEQ ID NO: 3422773 - DNA, 15 bp, Homo sapiens
acggggctcttctca

SEQ ID NO: 3422774 - DNA, 18 bp, Homo sapiens
acgtgtactacaatttaa

SEQ ID NO: 3422775 - DNA, 19 bp, Homo sapiens
acgttttcttaaatgtttt

SEQ ID NO: 3422776 - DNA, 12 bp, Homo sapiens
actaaagagaga

SEQ ID NO: 3422777 - DNA, 21 bp, Homo sapiens
actaaagagagaatgtagata

SEQ ID NO: 3422778 - DNA, 21 bp, Homo sapiens
actaaatgctcatacacagtt

SEQ ID NO: 3422779 - DNA, 16 bp, Homo sapiens
actaacagataagcaa

SEQ ID NO: 3422780 - DNA, 18 bp, Homo sapiens
actacatcccacattagt

SEQ ID NO: 3422781 - DNA, 11 bp, Homo sapiens
actagctcccc

SEQ ID NO: 3422782 - DNA, 12 bp, Homo sapiens
actagctcccca

SEQ ID NO: 3422783 - DNA, 20 bp, Homo sapiens
actaggaatttttttcagta

SEQ ID NO: 3422784 - DNA, 20 bp, Homo sapiens
actagggaaaggtaaataca

SEQ ID NO: 3422785 - DNA, 21 bp, Homo sapiens
actataaccagtttagctttt

SEQ ID NO: 3422786 - DNA, 15 bp, Homo sapiens
actatattgtacaca

SEQ ID NO: 3422787 - DNA, 17 bp, Homo sapiens
actatggaatgtcagtg

SEQ ID NO: 3422788 - DNA, 23 bp, Homo sapiens
actattccacagggataccttaa

SEQ ID NO: 3422789 - DNA, 15 bp, Homo sapiens
actcaatattttcca

SEQ ID NO: 3422790 - DNA, 18 bp, Homo sapiens
actcaatattttccatga

SEQ ID NO: 3422791 - DNA, 23 bp, Homo sapiens
actcacctaatgtttatgagcca

SEQ ID NO: 3422792 - DNA, 18 bp, Homo sapiens
actcatcttagtgcctga

SEQ ID NO: 3422793 - DNA, 22 bp, Homo sapiens
actcatcttagtgcctgagagt

SEQ ID NO: 3422794 - DNA, 22 bp, Homo sapiens
actcatcttggccctcctcagc

SEQ ID NO: 3422795 - DNA, 18 bp, Homo sapiens
actcatgcaaactgcttt

SEQ ID NO: 3422796 - DNA, 22 bp, Homo sapiens
actcatgcaaactgctttattt

SEQ ID NO: 3422797 - DNA, 17 bp, Homo sapiens
actcattcacatttcaa

SEQ ID NO: 3422798 - DNA, 16 bp, Homo sapiens
actcccccaccgccca

SEQ ID NO: 3422799 - DNA, 17 bp, Homo sapiens
actcccccaccgcccac

SEQ ID NO: 3422800 - DNA, 19 bp, Homo sapiens
actcccccaccgcccactc

SEQ ID NO: 3422801 - DNA, 22 bp, Homo sapiens
actcctactgcttcctctgaat

SEQ ID NO: 3422802 - DNA, 17 bp, Homo sapiens
actcgagaactttcatt

SEQ ID NO: 3422803 - DNA, 17 bp, Homo sapiens
actcgggttaagaaata

SEQ ID NO: 3422804 - DNA, 21 bp, Homo sapiens
agggcagccagggagagccca

SEQ ID NO: 3422805 - DNA, 23 bp, Homo sapiens
agggcagcgggagcctccctgcc

SEQ ID NO: 3422806 - DNA, 16 bp, Homo sapiens
agggcatattaaaggc

SEQ ID NO: 3422807 - DNA, 17 bp, Homo sapiens
agggctggactgaggcc

SEQ ID NO: 3422808 - DNA, 19 bp, Homo sapiens
agggcttacggccctggcc

SEQ ID NO: 3422809 - DNA, 19 bp, Homo sapiens
aggggagggtcagccaggg

SEQ ID NO: 3422810 - DNA, 13 bp, Homo sapiens
aggggccagaaga

SEQ ID NO: 3422811 - DNA, 12 bp, Homo sapiens
agggggctggag

SEQ ID NO: 3422812 - DNA, 14 bp, Homo sapiens
agggggctggagga

SEQ ID NO: 3422813 - DNA, 18 bp, Homo sapiens
agggggctggaggagccc

SEQ ID NO: 3422814 - DNA, 19 bp, Homo sapiens
agggggctggaggagccca

SEQ ID NO: 3422815 - DNA, 14 bp, Homo sapiens
agggtataatgtgt

SEQ ID NO: 3422816 - DNA, 12 bp, Homo sapiens
agggtcatttct

SEQ ID NO: 3422817 - DNA, 16 bp, Homo sapiens
agggtcggtgccttca

SEQ ID NO: 3422818 - DNA, 14 bp, Homo sapiens
agggttatatttgg

SEQ ID NO: 3422819 - DNA, 14 bp, Homo sapiens
aggtaaataaagct

SEQ ID NO: 3422820 - DNA, 17 bp, Homo sapiens
aggtaacagaacagctt

SEQ ID NO: 3422821 - DNA, 20 bp, Homo sapiens
aggtagacctgtctcctggc

SEQ ID NO: 3422822 - DNA, 15 bp, Homo sapiens
aggtcaagtaataaa

SEQ ID NO: 3422823 - DNA, 17 bp, Homo sapiens
aggtctcctcttaaaaa

SEQ ID NO: 3422824 - DNA, 23 bp, Homo sapiens
aggtcttgacctgaactctgcaa

SEQ ID NO: 3422825 - DNA, 20 bp, Homo sapiens
aggtcttggttagagaagta

SEQ ID NO: 3422826 - DNA, 14 bp, Homo sapiens
aggtcttttacata

SEQ ID NO: 3422827 - DNA, 21 bp, Homo sapiens
aggtcttttacatacagtgat

SEQ ID NO: 3422828 - DNA, 13 bp, Homo sapiens
aggtgatgctgct

SEQ ID NO: 3422829 - DNA, 15 bp, Homo sapiens
aggtgcaaccaggga

SEQ ID NO: 3422830 - DNA, 19 bp, Homo sapiens
aggtgggccttgctacctc

SEQ ID NO: 3422831 - DNA, 14 bp, Homo sapiens
aggtttcttgcttc

SEQ ID NO: 3422832 - DNA, 22 bp, Homo sapiens
aggtttgaaaggcaatttttga

SEQ ID NO: 3422833 - DNA, 17 bp, Homo sapiens
agtaagtataacaaact

SEQ ID NO: 3422834 - DNA, 22 bp, Homo sapiens
agtaatgatgtaacagtgcaag

SEQ ID NO: 3422835 - DNA, 11 bp, Homo sapiens
agtactttgtg

SEQ ID NO: 3422836 - DNA, 21 bp, Homo sapiens
agtagaaagacagagctggga

SEQ ID NO: 3422837 - DNA, 16 bp, Homo sapiens
agtagaaagacatctg

SEQ ID NO: 3422838 - DNA, 22 bp, Homo sapiens
agtagaaagacatctgcctgta

SEQ ID NO: 3422839 - DNA, 15 bp, Homo sapiens
agtatagatggccaa

SEQ ID NO: 3422840 - DNA, 15 bp, Homo sapiens
agtatagtagaaaga

SEQ ID NO: 3422841 - DNA, 22 bp, Homo sapiens
agtatatgaaatattttgaata

SEQ ID NO: 3422842 - DNA, 21 bp, Homo sapiens
agtatgcaaaataaagaatat

SEQ ID NO: 3422843 - DNA, 14 bp, Homo sapiens
agtatgtccttcag

SEQ ID NO: 3422844 - DNA, 18 bp, Homo sapiens
agtatgtccttcagctga

SEQ ID NO: 3422845 - DNA, 17 bp, Homo sapiens
agtatgtggaagtgtgg

SEQ ID NO: 3422846 - DNA, 14 bp, Homo sapiens
agtattcccactct

SEQ ID NO: 3422847 - DNA, 22 bp, Homo sapiens
agtatttaactacatctgcctc

SEQ ID NO: 3422848 - DNA, 19 bp, Homo sapiens
agtcatgcataaatatgca

SEQ ID NO: 3422849 - DNA, 23 bp, Homo sapiens
agtcattattattactttttaaa

SEQ ID NO: 3422850 - DNA, 15 bp, Homo sapiens
agtcccttaaaaatt

SEQ ID NO: 3422851 - DNA, 13 bp, Homo sapiens
agtcctgctttcc

SEQ ID NO: 3422852 - DNA, 18 bp, Homo sapiens
agtctacccgacataagt

SEQ ID NO: 3422853 - DNA, 14 bp, Homo sapiens
agtctcaattttgt

SEQ ID NO: 3422854 - DNA, 19 bp, Homo sapiens
agtctcaattttgtattta

SEQ ID NO: 3422855 - DNA, 21 bp, Homo sapiens
agtctgattataccatgtgtg

SEQ ID NO: 3422856 - DNA, 23 bp, Homo sapiens
agtctgattataccatgtgtgct

SEQ ID NO: 3422857 - DNA, 20 bp, Homo sapiens
agtctggcaaacatgtgcaa

SEQ ID NO: 3422858 - DNA, 16 bp, Homo sapiens
agtcttaactgtattt

SEQ ID NO: 3422859 - DNA, 14 bp, Homo sapiens
agtctttttttcct

SEQ ID NO: 3422860 - DNA, 12 bp, Homo sapiens
agtgaaaaagat

SEQ ID NO: 3422861 - DNA, 20 bp, Homo sapiens
agtgacagatcctccatttt

SEQ ID NO: 3422862 - DNA, 15 bp, Homo sapiens
agtgacagatgttat

SEQ ID NO: 3422863 - DNA, 20 bp, Homo sapiens
agtgacagatgttatttttg

SEQ ID NO: 3422864 - DNA, 17 bp, Homo sapiens
agtgatatggcagaaga

SEQ ID NO: 3422865 - DNA, 14 bp, Homo sapiens
agtgccaaataatt

SEQ ID NO: 3422866 - DNA, 18 bp, Homo sapiens
agtgccaggatggaatga

SEQ ID NO: 3422867 - DNA, 12 bp, Homo sapiens
agtgccatgctt

SEQ ID NO: 3422868 - DNA, 13 bp, Homo sapiens
agtgccatgcttt

SEQ ID NO: 3422869 - DNA, 19 bp, Homo sapiens
agtgcccctgtcccacctg

SEQ ID NO: 3422870 - DNA, 20 bp, Homo sapiens
agtgcccctgtcccacctgg

SEQ ID NO: 3422871 - DNA, 21 bp, Homo sapiens
agtgcccctgtcccacctggc

SEQ ID NO: 3422872 - DNA, 22 bp, Homo sapiens
agtgcccctgtcccacctggct

SEQ ID NO: 3422873 - DNA, 23 bp, Homo sapiens
agtgcccctgtcccacctggctc

SEQ ID NO: 3422874 - DNA, 19 bp, Homo sapiens
agtgcttaaaaatcattga

SEQ ID NO: 3422875 - DNA, 18 bp, Homo sapiens
agtggaccttgagaccac

SEQ ID NO: 3422876 - DNA, 13 bp, Homo sapiens
agtggcataaaaa

SEQ ID NO: 3422877 - DNA, 23 bp, Homo sapiens
agtggcatgtgggttgtgatatt

SEQ ID NO: 3422878 - DNA, 16 bp, Homo sapiens
agtggctggatctgtg

SEQ ID NO: 3422879 - DNA, 20 bp, Homo sapiens
agtggcttcactcctgctgt

SEQ ID NO: 3422880 - DNA, 21 bp, Homo sapiens
agtggcttcactcctgctgta

SEQ ID NO: 3422881 - DNA, 16 bp, Homo sapiens
agtgggggtggggggt

SEQ ID NO: 3422882 - DNA, 14 bp, Homo sapiens
agtggtctttgtaa

SEQ ID NO: 3422883 - DNA, 17 bp, Homo sapiens
agtggtctttgtaagag

SEQ ID NO: 3422884 - DNA, 21 bp, Homo sapiens
agtggtctttgtaagagtgta

SEQ ID NO: 3422885 - DNA, 24 bp, Homo sapiens
agtggtctttgtaagagtgtagaa

SEQ ID NO: 3422886 - DNA, 14 bp, Homo sapiens
agtgtactcccagg

SEQ ID NO: 3422887 - DNA, 15 bp, Homo sapiens
agtgtactcccaggg

SEQ ID NO: 3422888 - DNA, 12 bp, Homo sapiens
agtgtagaagca

SEQ ID NO: 3422889 - DNA, 14 bp, Homo sapiens
agtgtagaagcatt

SEQ ID NO: 3422890 - DNA, 16 bp, Homo sapiens
agtgtagaagcattcc

SEQ ID NO: 3422891 - DNA, 20 bp, Homo sapiens
agtgtagaagcattccttct

SEQ ID NO: 3422892 - DNA, 16 bp, Homo sapiens
agtgtcctatgcaata

SEQ ID NO: 3422893 - DNA, 23 bp, Homo sapiens
agtgtcctatgcaataaaattat

SEQ ID NO: 3422894 - DNA, 19 bp, Homo sapiens
agtgtctgtaggtacgttt

SEQ ID NO: 3422895 - DNA, 18 bp, Homo sapiens
agtgtgaataaagtgctg

SEQ ID NO: 3422896 - DNA, 20 bp, Homo sapiens
agtgtttgtgagctttttgt

SEQ ID NO: 3422897 - DNA, 17 bp, Homo sapiens
agtgtttttttccctct

SEQ ID NO: 3422898 - DNA, 16 bp, Homo sapiens
agttaagaagctgttg

SEQ ID NO: 3422899 - DNA, 20 bp, Homo sapiens
agttaagaagctgttgtaca

SEQ ID NO: 3422900 - DNA, 21 bp, Homo sapiens
agttcgatgggcccaattctt

SEQ ID NO: 3422901 - DNA, 15 bp, Homo sapiens
agttctttgcaagct

SEQ ID NO: 3422902 - DNA, 17 bp, Homo sapiens
agttgagtgatagagct

SEQ ID NO: 3422903 - DNA, 19 bp, Homo sapiens
agttgcaccattctttctt

SEQ ID NO: 3422904 - DNA, 10 bp, Homo sapiens
agttgcagcc

SEQ ID NO: 3422905 - DNA, 21 bp, Homo sapiens
agttgtattttgtacattttg

SEQ ID NO: 3422906 - DNA, 13 bp, Homo sapiens
agttgtctttctt

SEQ ID NO: 3422907 - DNA, 14 bp, Homo sapiens
agttgtctttcttt

SEQ ID NO: 3422908 - DNA, 22 bp, Homo sapiens
agttgttgtttgccaagctaat

SEQ ID NO: 3422909 - DNA, 17 bp, Homo sapiens
agtttaaaatcttgcat

SEQ ID NO: 3422910 - DNA, 18 bp, Homo sapiens
agtttaaaatcttgcatg

SEQ ID NO: 3422911 - DNA, 15 bp, Homo sapiens
agtttcaggtgacat

SEQ ID NO: 3422912 - DNA, 20 bp, Homo sapiens
agtttcaggtgacatgtgaa

SEQ ID NO: 3422913 - DNA, 18 bp, Homo sapiens
agtttcatgtatgtatat

SEQ ID NO: 3422914 - DNA, 14 bp, Homo sapiens
agtttcttagcttt

SEQ ID NO: 3422915 - DNA, 22 bp, Homo sapiens
atgtgaaaccttttttaagatt

SEQ ID NO: 3422916 - DNA, 23 bp, Homo sapiens
atgtgaaaccttttttaagattt

SEQ ID NO: 3422917 - DNA, 21 bp, Homo sapiens
atgtgaatttgagtttgctgt

SEQ ID NO: 3422918 - DNA, 21 bp, Homo sapiens
atgtgatctatgtttcatctt

SEQ ID NO: 3422919 - DNA, 14 bp, Homo sapiens
atgtgcataatgga

SEQ ID NO: 3422920 - DNA, 21 bp, Homo sapiens
atgtgcatttttgtgaaatga

SEQ ID NO: 3422921 - DNA, 16 bp, Homo sapiens
atgtgccaattttgtc

SEQ ID NO: 3422922 - DNA, 20 bp, Homo sapiens
atgtgccaattttgtcacag

SEQ ID NO: 3422923 - DNA, 23 bp, Homo sapiens
atgtgctacaggggccagaagat

SEQ ID NO: 3422924 - DNA, 13 bp, Homo sapiens
atgtggaagtgtg

SEQ ID NO: 3422925 - DNA, 15 bp, Homo sapiens
atgtggaagtgtggg

SEQ ID NO: 3422926 - DNA, 14 bp, Homo sapiens
atgtgggttgtgat

SEQ ID NO: 3422927 - DNA, 15 bp, Homo sapiens
atgtgggttgtgata

SEQ ID NO: 3422928 - DNA, 21 bp, Homo sapiens
atgtggttacacagtgtgaat

SEQ ID NO: 3422929 - DNA, 20 bp, Homo sapiens
atgtgtatttccagtgcaat

SEQ ID NO: 3422930 - DNA, 18 bp, Homo sapiens
atgtgtcccagtgaacag

SEQ ID NO: 3422931 - DNA, 22 bp, Homo sapiens
atgtgtcccagtgaacagtttg

SEQ ID NO: 3422932 - DNA, 23 bp, Homo sapiens
atgtgtctgtgttgcttcaaatt

SEQ ID NO: 3422933 - DNA, 15 bp, Homo sapiens
atgtgttacattatt

SEQ ID NO: 3422934 - DNA, 17 bp, Homo sapiens
atgttaaatttgtaagt

SEQ ID NO: 3422935 - DNA, 23 bp, Homo sapiens
atgttaaatttgtaagtttcagg

SEQ ID NO: 3422936 - DNA, 17 bp, Homo sapiens
atgttaaggaaactctt

SEQ ID NO: 3422937 - DNA, 14 bp, Homo sapiens
atgttacttgagaa

SEQ ID NO: 3422938 - DNA, 16 bp, Homo sapiens
atgttacttgagaagt

SEQ ID NO: 3422939 - DNA, 14 bp, Homo sapiens
atgttatttttgta

SEQ ID NO: 3422940 - DNA, 14 bp, Homo sapiens
atgttctgtccctt

SEQ ID NO: 3422941 - DNA, 20 bp, Homo sapiens
atgttggttgcactttgtag

SEQ ID NO: 3422942 - DNA, 19 bp, Homo sapiens
atgttgtgtattgtggttt

SEQ ID NO: 3422943 - DNA, 15 bp, Homo sapiens
atgtttacagaggac

SEQ ID NO: 3422944 - DNA, 15 bp, Homo sapiens
atgtttatgagccag

SEQ ID NO: 3422945 - DNA, 16 bp, Homo sapiens
atgtttatgagccaga

SEQ ID NO: 3422946 - DNA, 13 bp, Homo sapiens
attaaaaacttta

SEQ ID NO: 3422947 - DNA, 14 bp, Homo sapiens
attaaaggcttttg

SEQ ID NO: 3422948 - DNA, 19 bp, Homo sapiens
attaaaggcttttggcagc

SEQ ID NO: 3422949 - DNA, 15 bp, Homo sapiens
attaaatctgaattt

SEQ ID NO: 3422950 - DNA, 12 bp, Homo sapiens
attaaattatga

SEQ ID NO: 3422951 - DNA, 13 bp, Homo sapiens
attaaattatgaa

SEQ ID NO: 3422952 - DNA, 17 bp, Homo sapiens
attaaattctctctaac

SEQ ID NO: 3422953 - DNA, 24 bp, Homo sapiens
attaaattctctctaacataacaa

SEQ ID NO: 3422954 - DNA, 18 bp, Homo sapiens
attaaattgcctttgtaa

SEQ ID NO: 3422955 - DNA, 21 bp, Homo sapiens
attaactctgtaaaagtgtct

SEQ ID NO: 3422956 - DNA, 17 bp, Homo sapiens
attaagggccagaaaaa

SEQ ID NO: 3422957 - DNA, 19 bp, Homo sapiens
attaagggccagaaaaaag

SEQ ID NO: 3422958 - DNA, 12 bp, Homo sapiens
attaataatagc

SEQ ID NO: 3422959 - DNA, 16 bp, Homo sapiens
attaataatagctaat

SEQ ID NO: 3422960 - DNA, 23 bp, Homo sapiens
attaattgttccttgcttttata

SEQ ID NO: 3422961 - DNA, 21 bp, Homo sapiens
attagccaggatcatggtgta

SEQ ID NO: 3422962 - DNA, 13 bp, Homo sapiens
attagcttgctta

SEQ ID NO: 3422963 - DNA, 18 bp, Homo sapiens
attagcttgcttaaggca

SEQ ID NO: 3422964 - DNA, 18 bp, Homo sapiens
attataatgccagaatat

SEQ ID NO: 3422965 - DNA, 14 bp, Homo sapiens
attataccatgtgt

SEQ ID NO: 3422966 - DNA, 20 bp, Homo sapiens
attataccatgtgtgctaat

SEQ ID NO: 3422967 - DNA, 15 bp, Homo sapiens
attatgactaaagta

SEQ ID NO: 3422968 - DNA, 12 bp, Homo sapiens
attattcatttt

SEQ ID NO: 3422969 - DNA, 15 bp, Homo sapiens
attatttaaagcaca

SEQ ID NO: 3422970 - DNA, 12 bp, Homo sapiens
attatttaataa

SEQ ID NO: 3422971 - DNA, 18 bp, Homo sapiens
attatttgataacatttt

SEQ ID NO: 3422972 - DNA, 20 bp, Homo sapiens
attcaaatatcaaaaggaag

SEQ ID NO: 3422973 - DNA, 17 bp, Homo sapiens
attcagctagaatttct

SEQ ID NO: 3422974 - DNA, 18 bp, Homo sapiens
attcagctagaatttctg

SEQ ID NO: 3422975 - DNA, 19 bp, Homo sapiens
attcagctagaatttctgg

SEQ ID NO: 3422976 - DNA, 16 bp, Homo sapiens
attcagtgaaaaagat

SEQ ID NO: 3422977 - DNA, 21 bp, Homo sapiens
attcagtgagggtcttcttac

SEQ ID NO: 3422978 - DNA, 18 bp, Homo sapiens
attcatcaaataaacctt

SEQ ID NO: 3422979 - DNA, 20 bp, Homo sapiens
attcatcaaataaaccttgt

SEQ ID NO: 3422980 - DNA, 17 bp, Homo sapiens
attcatctctctttaat

SEQ ID NO: 3422981 - DNA, 21 bp, Homo sapiens
attcatgttttaaaagtttgt

SEQ ID NO: 3422982 - DNA, 12 bp, Homo sapiens
attcattttgtg

SEQ ID NO: 3422983 - DNA, 14 bp, Homo sapiens
attccaagacagta

SEQ ID NO: 3422984 - DNA, 12 bp, Homo sapiens
attccctcccca

SEQ ID NO: 3422985 - DNA, 19 bp, Homo sapiens
attccgattagacctttat

SEQ ID NO: 3422986 - DNA, 20 bp, Homo sapiens
attcctgccccagatggctt

SEQ ID NO: 3422987 - DNA, 15 bp, Homo sapiens
attcctttcagagtt

SEQ ID NO: 3422988 - DNA, 21 bp, Homo sapiens
attctaaacagatgtccctga

SEQ ID NO: 3422989 - DNA, 19 bp, Homo sapiens
attctaacttttttgctat

SEQ ID NO: 3422990 - DNA, 13 bp, Homo sapiens
attctatgtgtca

SEQ ID NO: 3422991 - DNA, 14 bp, Homo sapiens
attctatgtgtcat

SEQ ID NO: 3422992 - DNA, 19 bp, Homo sapiens
attctatttggtttgcttt

SEQ ID NO: 3422993 - DNA, 15 bp, Homo sapiens
attctccttcagccc

SEQ ID NO: 3422994 - DNA, 18 bp, Homo sapiens
attctccttcagccctca

SEQ ID NO: 3422995 - DNA, 17 bp, Homo sapiens
attctctctaacataac

SEQ ID NO: 3422996 - DNA, 18 bp, Homo sapiens
attcttaaaatgcaatat

SEQ ID NO: 3422997 - DNA, 16 bp, Homo sapiens
attcttacaaacatgt

SEQ ID NO: 3422998 - DNA, 13 bp, Homo sapiens
attcttggttgtt

SEQ ID NO: 3422999 - DNA, 20 bp, Homo sapiens
attcttttccagaaagaaaa

SEQ ID NO: 3423000 - DNA, 21 bp, Homo sapiens
attcttttccagaaagaaaat

SEQ ID NO: 3423001 - DNA, 13 bp, Homo sapiens
attgaatgctgcc

SEQ ID NO: 3423002 - DNA, 16 bp, Homo sapiens
attgaatttagtcatt

SEQ ID NO: 3423003 - DNA, 15 bp, Homo sapiens
attgagcaagtatcc

SEQ ID NO: 3423004 - DNA, 18 bp, Homo sapiens
attgagtcttaactgtat

SEQ ID NO: 3423005 - DNA, 12 bp, Homo sapiens
attgattagaaa

SEQ ID NO: 3423006 - DNA, 15 bp, Homo sapiens
attgattttaaaaat

SEQ ID NO: 3423007 - DNA, 19 bp, Homo sapiens
attgcaccattttcaattt

SEQ ID NO: 3423008 - DNA, 16 bp, Homo sapiens
attgcagtttcatgta

SEQ ID NO: 3423009 - DNA, 23 bp, Homo sapiens
attgcagtttcatgtatgtatat

SEQ ID NO: 3423010 - DNA, 22 bp, Homo sapiens
attgcttcagctgctgaaggga

SEQ ID NO: 3423011 - DNA, 15 bp, Homo sapiens
attggaactggaggc

SEQ ID NO: 3423012 - DNA, 16 bp, Homo sapiens
attggattatttaata

SEQ ID NO: 3423013 - DNA, 21 bp, Homo sapiens
attggccttcgattttaaata

SEQ ID NO: 3423014 - DNA, 17 bp, Homo sapiens
attggctcacactgaga

SEQ ID NO: 3423015 - DNA, 12 bp, Homo sapiens
attggtgttgac

SEQ ID NO: 3423016 - DNA, 17 bp, Homo sapiens
attgtaaaaaaaaatgc

SEQ ID NO: 3423017 - DNA, 21 bp, Homo sapiens
attgtaaaaaaaaatgccttt

SEQ ID NO: 3423018 - DNA, 17 bp, Homo sapiens
attgtagtatttagtat

SEQ ID NO: 3423019 - DNA, 22 bp, Homo sapiens
attgtgctggtcatacatttgt

SEQ ID NO: 3423020 - DNA, 15 bp, Homo sapiens
attgttccttgcttt

SEQ ID NO: 3423021 - DNA, 19 bp, Homo sapiens
attgttgtttctttctagt

SEQ ID NO: 3423022 - DNA, 18 bp, Homo sapiens
atttaaaaaattaaaaat

SEQ ID NO: 3423023 - DNA, 20 bp, Homo sapiens
atttaaaaaattaaaaatga

SEQ ID NO: 3423024 - DNA, 16 bp, Homo sapiens
atttaaaagacaaaca

SEQ ID NO: 3423025 - DNA, 20 bp, Homo sapiens
atttaaaatgcctatgtttt

SEQ ID NO: 3423026 - DNA, 22 bp, Homo sapiens
cacccggtcccctctgccccac

SEQ ID NO: 3423027 - DNA, 14 bp, Homo sapiens
caccgccgtggagt

SEQ ID NO: 3423028 - DNA, 15 bp, Homo sapiens
cacctcactagctcc

SEQ ID NO: 3423029 - DNA, 13 bp, Homo sapiens
cacctcctgcctc

SEQ ID NO: 3423030 - DNA, 20 bp, Homo sapiens
cacctctgggccaggttgga

SEQ ID NO: 3423031 - DNA, 17 bp, Homo sapiens
cacctggacccctgcat

SEQ ID NO: 3423032 - DNA, 18 bp, Homo sapiens
cacctggacccctgcatt

SEQ ID NO: 3423033 - DNA, 19 bp, Homo sapiens
cacctggacccctgcattg

SEQ ID NO: 3423034 - DNA, 16 bp, Homo sapiens
cacctgtgagaaagga

SEQ ID NO: 3423035 - DNA, 13 bp, Homo sapiens
caccttgttacaa

SEQ ID NO: 3423036 - DNA, 14 bp, Homo sapiens
cacgtgtatgcaag

SEQ ID NO: 3423037 - DNA, 15 bp, Homo sapiens
cactaatacaccagg

SEQ ID NO: 3423038 - DNA, 13 bp, Homo sapiens
cactagctcccca

SEQ ID NO: 3423039 - DNA, 17 bp, Homo sapiens
cactagctccccaatcc

SEQ ID NO: 3423040 - DNA, 21 bp, Homo sapiens
cactaggaatttttttcagta

SEQ ID NO: 3423041 - DNA, 12 bp, Homo sapiens
cactcaaaggcc

SEQ ID NO: 3423042 - DNA, 15 bp, Homo sapiens
cactcaaaggccaga

SEQ ID NO: 3423043 - DNA, 22 bp, Homo sapiens
cactcaaaggccagacctgcag

SEQ ID NO: 3423044 - DNA, 19 bp, Homo sapiens
cactcatgcaaactgcttt

SEQ ID NO: 3423045 - DNA, 12 bp, Homo sapiens
cactcctgctgt

SEQ ID NO: 3423046 - DNA, 22 bp, Homo sapiens
cactcctttcttgcactattcc

SEQ ID NO: 3423047 - DNA, 15 bp, Homo sapiens
cactctccacctcac

SEQ ID NO: 3423048 - DNA, 23 bp, Homo sapiens
cactctgtgtctgagtggcttca

SEQ ID NO: 3423049 - DNA, 21 bp, Homo sapiens
cactcttatcttacaactccc

SEQ ID NO: 3423050 - DNA, 19 bp, Homo sapiens
cactgagaatgtaagaact

SEQ ID NO: 3423051 - DNA, 14 bp, Homo sapiens
cactgccatatact

SEQ ID NO: 3423052 - DNA, 19 bp, Homo sapiens
cactgccctggtggccctc

SEQ ID NO: 3423053 - DNA, 22 bp, Homo sapiens
cactggcatcgcagcttcctgt

SEQ ID NO: 3423054 - DNA, 16 bp, Homo sapiens
cactgtaaaatagttt

SEQ ID NO: 3423055 - DNA, 14 bp, Homo sapiens
cactgtataaatag

SEQ ID NO: 3423056 - DNA, 15 bp, Homo sapiens
cactgtataaatagg

SEQ ID NO: 3423057 - DNA, 17 bp, Homo sapiens
cactgtataaataggag

SEQ ID NO: 3423058 - DNA, 18 bp, Homo sapiens
cactgtataaataggaga

SEQ ID NO: 3423059 - DNA, 17 bp, Homo sapiens
cacttattctcaagaag

SEQ ID NO: 3423060 - DNA, 17 bp, Homo sapiens
cacttcacgctttcagc

SEQ ID NO: 3423061 - DNA, 21 bp, Homo sapiens
cacttgcaggggtccctgcta

SEQ ID NO: 3423062 - DNA, 19 bp, Homo sapiens
cactttcagtgaaagcatc

SEQ ID NO: 3423063 - DNA, 17 bp, Homo sapiens
cactttttcccctgcaa

SEQ ID NO: 3423064 - DNA, 18 bp, Homo sapiens
cagaaaacaattgttctg

SEQ ID NO: 3423065 - DNA, 15 bp, Homo sapiens
cagaaatatataaaa

SEQ ID NO: 3423066 - DNA, 17 bp, Homo sapiens
cagaagacaccagagca

SEQ ID NO: 3423067 - DNA, 20 bp, Homo sapiens
cagaagacaccagagcagat

SEQ ID NO: 3423068 - DNA, 21 bp, Homo sapiens
cagaagacaccagagcagatg

SEQ ID NO: 3423069 - DNA, 13 bp, Homo sapiens
cagaagaccccac

SEQ ID NO: 3423070 - DNA, 15 bp, Homo sapiens
cagaagatgaacaga

SEQ ID NO: 3423071 - DNA, 21 bp, Homo sapiens
cagaagccaagctccctggag

SEQ ID NO: 3423072 - DNA, 22 bp, Homo sapiens
cagaagccaagctccctggagc

SEQ ID NO: 3423073 - DNA, 20 bp, Homo sapiens
cagaagggggtggtgtctcc

SEQ ID NO: 3423074 - DNA, 18 bp, Homo sapiens
cagaatggggtgcatgaa

SEQ ID NO: 3423075 - DNA, 14 bp, Homo sapiens
cagaattggcataa

SEQ ID NO: 3423076 - DNA, 18 bp, Homo sapiens
cagaattggcataatttg

SEQ ID NO: 3423077 - DNA, 18 bp, Homo sapiens
cagacccctcccctcgtg

SEQ ID NO: 3423078 - DNA, 14 bp, Homo sapiens
cagacctgcccctc

SEQ ID NO: 3423079 - DNA, 17 bp, Homo sapiens
cagacctgcccctccct

SEQ ID NO: 3423080 - DNA, 18 bp, Homo sapiens
cagacctgcccctccctc

SEQ ID NO: 3423081 - DNA, 14 bp, Homo sapiens
cagactaagccagc

SEQ ID NO: 3423082 - DNA, 15 bp, Homo sapiens
cagactaagccagca

SEQ ID NO: 3423083 - DNA, 18 bp, Homo sapiens
cagactaagccagcaccg

SEQ ID NO: 3423084 - DNA, 15 bp, Homo sapiens
cagagaaagcgcaga

SEQ ID NO: 3423085 - DNA, 23 bp, Homo sapiens
cagagacatcagcccttgggggt

SEQ ID NO: 3423086 - DNA, 23 bp, Homo sapiens
cagagagccattttgtgaatgga

SEQ ID NO: 3423087 - DNA, 22 bp, Homo sapiens
cagagatccattgccatcagtg

SEQ ID NO: 3423088 - DNA, 20 bp, Homo sapiens
cagagcagatgcagagagcc

SEQ ID NO: 3423089 - DNA, 20 bp, Homo sapiens
cagagctgggatgtttctgt

SEQ ID NO: 3423090 - DNA, 14 bp, Homo sapiens
cagaggggcagatg

SEQ ID NO: 3423091 - DNA, 23 bp, Homo sapiens
cagaggggcctgccacctggacc

SEQ ID NO: 3423092 - DNA, 22 bp, Homo sapiens
cagaggtaacagaacagcttca

SEQ ID NO: 3423093 - DNA, 14 bp, Homo sapiens
cagagttctttgca

SEQ ID NO: 3423094 - DNA, 21 bp, Homo sapiens
cagagttgttgtttgccaagc

SEQ ID NO: 3423095 - DNA, 22 bp, Homo sapiens
cagataagcaagagagatgttt

SEQ ID NO: 3423096 - DNA, 15 bp, Homo sapiens
cagatctcatgagaa

SEQ ID NO: 3423097 - DNA, 12 bp, Homo sapiens
cagatgctgaat

SEQ ID NO: 3423098 - DNA, 22 bp, Homo sapiens
cagatgctgaattgagaataag

SEQ ID NO: 3423099 - DNA, 20 bp, Homo sapiens
cagatgtccctgaagtcttg

SEQ ID NO: 3423100 - DNA, 15 bp, Homo sapiens
cagatgttatttttg

SEQ ID NO: 3423101 - DNA, 19 bp, Homo sapiens
cagatgttatttttgtatt

SEQ ID NO: 3423102 - DNA, 21 bp, Homo sapiens
cagatgttatttttgtatttt

SEQ ID NO: 3423103 - DNA, 23 bp, Homo sapiens
cagatgttatttttgtattttta

SEQ ID NO: 3423104 - DNA, 18 bp, Homo sapiens
cagcaaagtgtcagtgtt

SEQ ID NO: 3423105 - DNA, 21 bp, Homo sapiens
cagcaactatcagactaagcc

SEQ ID NO: 3423106 - DNA, 15 bp, Homo sapiens
cagcaatattctgat

SEQ ID NO: 3423107 - DNA, 18 bp, Homo sapiens
cagcaccggaccagcctg

SEQ ID NO: 3423108 - DNA, 20 bp, Homo sapiens
cagcaccggaccagcctggc

SEQ ID NO: 3423109 - DNA, 19 bp, Homo sapiens
cagcacctattgaattacc

SEQ ID NO: 3423110 - DNA, 11 bp, Homo sapiens
cagcactgagg

SEQ ID NO: 3423111 - DNA, 13 bp, Homo sapiens
cagcactgaggaa

SEQ ID NO: 3423112 - DNA, 15 bp, Homo sapiens
cagcactgaggaaga

SEQ ID NO: 3423113 - DNA, 15 bp, Homo sapiens
cagcagtacaataaa

SEQ ID NO: 3423114 - DNA, 17 bp, Homo sapiens
cagcatcaaacatgaaa

SEQ ID NO: 3423115 - DNA, 19 bp, Homo sapiens
cagcatcaaacatgaaaac

SEQ ID NO: 3423116 - DNA, 19 bp, Homo sapiens
cagcatgacaaaagtgaca

SEQ ID NO: 3423117 - DNA, 18 bp, Homo sapiens
cagcatgtatagttgctt

SEQ ID NO: 3423118 - DNA, 16 bp, Homo sapiens
cagccaaacagtatga

SEQ ID NO: 3423119 - DNA, 17 bp, Homo sapiens
cagccaaacagtatgat

SEQ ID NO: 3423120 - DNA, 22 bp, Homo sapiens
cagccagggagagcccaggagc

SEQ ID NO: 3423121 - DNA, 23 bp, Homo sapiens
cagccagggcctgcgagggcagc

SEQ ID NO: 3423122 - DNA, 21 bp, Homo sapiens
cagccccaccccagggcagcc

SEQ ID NO: 3423123 - DNA, 15 bp, Homo sapiens
cagccctcacccctg

SEQ ID NO: 3423124 - DNA, 23 bp, Homo sapiens
cagcccttgggggtcctcctcca

SEQ ID NO: 3423125 - DNA, 22 bp, Homo sapiens
cagcctcgagtgcccctgtccc

SEQ ID NO: 3423126 - DNA, 20 bp, Homo sapiens
cagcctggcccaccccaccc

SEQ ID NO: 3423127 - DNA, 14 bp, Homo sapiens
cagcgccaagtggc

SEQ ID NO: 3423128 - DNA, 14 bp, Homo sapiens
cagctcaggcagct

SEQ ID NO: 3423129 - DNA, 17 bp, Homo sapiens
cagctcaggcagctcga

SEQ ID NO: 3423130 - DNA, 11 bp, Homo sapiens
cagctccctgc

SEQ ID NO: 3423131 - DNA, 19 bp, Homo sapiens
cagctccctgcctgtttcc

SEQ ID NO: 3423132 - DNA, 17 bp, Homo sapiens
cagctctagctttgcag

SEQ ID NO: 3423133 - DNA, 19 bp, Homo sapiens
cagctctgcagcaatattc

SEQ ID NO: 3423134 - DNA, 23 bp, Homo sapiens
cagctgctgaagggagggggctg

SEQ ID NO: 3423135 - DNA, 18 bp, Homo sapiens
cagcttctcatcctgcag

SEQ ID NO: 3423136 - DNA, 14 bp, Homo sapiens
cagcttctgttgga

SEQ ID NO: 3423137 - DNA, 16 bp, Homo sapiens
ccaacagtttattttt

SEQ ID NO: 3423138 - DNA, 18 bp, Homo sapiens
ccaaccccccagcactga

SEQ ID NO: 3423139 - DNA, 20 bp, Homo sapiens
ccaaccccccagcactgagg

SEQ ID NO: 3423140 - DNA, 17 bp, Homo sapiens
ccaagctaatctgcctg

SEQ ID NO: 3423141 - DNA, 18 bp, Homo sapiens
ccaagctccctggagccc

SEQ ID NO: 3423142 - DNA, 21 bp, Homo sapiens
ccaagctccctggagccctgt

SEQ ID NO: 3423143 - DNA, 19 bp, Homo sapiens
ccacaggcctgagatttca

SEQ ID NO: 3423144 - DNA, 22 bp, Homo sapiens
ccacaggcctgagatttcatct

SEQ ID NO: 3423145 - DNA, 17 bp, Homo sapiens
ccacccacttctgcact

SEQ ID NO: 3423146 - DNA, 15 bp, Homo sapiens
ccaccccacccactt

SEQ ID NO: 3423147 - DNA, 16 bp, Homo sapiens
ccacctcactagctcc

SEQ ID NO: 3423148 - DNA, 19 bp, Homo sapiens
ccacctgtgagaaaggaaa

SEQ ID NO: 3423149 - DNA, 15 bp, Homo sapiens
ccactcaaaggccag

SEQ ID NO: 3423150 - DNA, 19 bp, Homo sapiens
ccactctccacctcactag

SEQ ID NO: 3423151 - DNA, 20 bp, Homo sapiens
ccactggcatcgcagcttcc

SEQ ID NO: 3423152 - DNA, 13 bp, Homo sapiens
ccacttctgcact

SEQ ID NO: 3423153 - DNA, 15 bp, Homo sapiens
ccacttctgggtggg

SEQ ID NO: 3423154 - DNA, 16 bp, Homo sapiens
ccactttctttctttc

SEQ ID NO: 3423155 - DNA, 17 bp, Homo sapiens
ccactttgctgttcctt

SEQ ID NO: 3423156 - DNA, 15 bp, Homo sapiens
ccactttttgcagct

SEQ ID NO: 3423157 - DNA, 21 bp, Homo sapiens
ccagaaaaaaagcccaacaca

SEQ ID NO: 3423158 - DNA, 21 bp, Homo sapiens
ccagaaaaaagtgtttataat

SEQ ID NO: 3423159 - DNA, 14 bp, Homo sapiens
ccagaagaccccac

SEQ ID NO: 3423160 - DNA, 15 bp, Homo sapiens
ccagaagaccccact

SEQ ID NO: 3423161 - DNA, 19 bp, Homo sapiens
ccagaagatgaacagactg

SEQ ID NO: 3423162 - DNA, 23 bp, Homo sapiens
ccagaagatgaacagactgacct

SEQ ID NO: 3423163 - DNA, 20 bp, Homo sapiens
ccagacctgcagacgcccag

SEQ ID NO: 3423164 - DNA, 20 bp, Homo sapiens
ccagacctgcccctccctct

SEQ ID NO: 3423165 - DNA, 15 bp, Homo sapiens
ccagagcagatgcag

SEQ ID NO: 3423166 - DNA, 17 bp, Homo sapiens
ccagagcagatgcagag

SEQ ID NO: 3423167 - DNA, 18 bp, Homo sapiens
ccagagcagatgcagaga

SEQ ID NO: 3423168 - DNA, 20 bp, Homo sapiens
ccagagcagatgcagagagc

SEQ ID NO: 3423169 - DNA, 22 bp, Homo sapiens
ccagagcagatgcagagagcca

SEQ ID NO: 3423170 - DNA, 22 bp, Homo sapiens
ccagaggagggcagcagaaggg

SEQ ID NO: 3423171 - DNA, 15 bp, Homo sapiens
ccagaggggcctgcc

SEQ ID NO: 3423172 - DNA, 17 bp, Homo sapiens
ccagaggggcctgccac

SEQ ID NO: 3423173 - DNA, 18 bp, Homo sapiens
ccagaggggcctgccacc

SEQ ID NO: 3423174 - DNA, 19 bp, Homo sapiens
ccagaggtaacagaacagc

SEQ ID NO: 3423175 - DNA, 14 bp, Homo sapiens
ccagattataatgc

SEQ ID NO: 3423176 - DNA, 19 bp, Homo sapiens
ccagattggctcacactga

SEQ ID NO: 3423177 - DNA, 20 bp, Homo sapiens
ccagcaccggaccagcctgg

SEQ ID NO: 3423178 - DNA, 15 bp, Homo sapiens
ccagcactgaggaag

SEQ ID NO: 3423179 - DNA, 17 bp, Homo sapiens
ccagcactgaggaagaa

SEQ ID NO: 3423180 - DNA, 17 bp, Homo sapiens
ccagcagtacaataaaa

SEQ ID NO: 3423181 - DNA, 18 bp, Homo sapiens
ccagcggacagtggcagg

SEQ ID NO: 3423182 - DNA, 21 bp, Homo sapiens
ccagcggacagtggcaggaca

SEQ ID NO: 3423183 - DNA, 21 bp, Homo sapiens
ccagctgcccttccgcagtgt

SEQ ID NO: 3423184 - DNA, 12 bp, Homo sapiens
ccaggactctgc

SEQ ID NO: 3423185 - DNA, 17 bp, Homo sapiens
ccaggactctgcagcct

SEQ ID NO: 3423186 - DNA, 22 bp, Homo sapiens
ccaggagattggatttgctgtg

SEQ ID NO: 3423187 - DNA, 19 bp, Homo sapiens
ccaggagctcccctcccca

SEQ ID NO: 3423188 - DNA, 20 bp, Homo sapiens
ccaggagctcccctccccaa

SEQ ID NO: 3423189 - DNA, 14 bp, Homo sapiens
ccaggatcatggtg

SEQ ID NO: 3423190 - DNA, 13 bp, Homo sapiens
ccaggccaggact

SEQ ID NO: 3423191 - DNA, 17 bp, Homo sapiens
ccaggccaggactctgc

SEQ ID NO: 3423192 - DNA, 18 bp, Homo sapiens
ccaggccaggactctgca

SEQ ID NO: 3423193 - DNA, 19 bp, Homo sapiens
ccaggccaggactctgcag

SEQ ID NO: 3423194 - DNA, 21 bp, Homo sapiens
ccaggccaggactctgcagcc

SEQ ID NO: 3423195 - DNA, 23 bp, Homo sapiens
ccaggccaggactctgcagcctc

SEQ ID NO: 3423196 - DNA, 14 bp, Homo sapiens
ccagggagagccca

SEQ ID NO: 3423197 - DNA, 17 bp, Homo sapiens
ccagggagagcccagga

SEQ ID NO: 3423198 - DNA, 20 bp, Homo sapiens
ccagggagagcccaggagct

SEQ ID NO: 3423199 - DNA, 23 bp, Homo sapiens
ccagggagagcccaggagctccc

SEQ ID NO: 3423200 - DNA, 19 bp, Homo sapiens
ccagggcagccagggagag

SEQ ID NO: 3423201 - DNA, 19 bp, Homo sapiens
ccagggcatattaaaggct

SEQ ID NO: 3423202 - DNA, 21 bp, Homo sapiens
ccagggcattgtgttcactgt

SEQ ID NO: 3423203 - DNA, 14 bp, Homo sapiens
ccagggcctgcgag

SEQ ID NO: 3423204 - DNA, 17 bp, Homo sapiens
ccagggctggactgagg

SEQ ID NO: 3423205 - DNA, 21 bp, Homo sapiens
ccaggtcttgacctgaactct

SEQ ID NO: 3423206 - DNA, 14 bp, Homo sapiens
ccaggttggaaaag

SEQ ID NO: 3423207 - DNA, 23 bp, Homo sapiens
ccaggttggaaaagaaatcaatt

SEQ ID NO: 3423208 - DNA, 17 bp, Homo sapiens
ccagtgatctcgactcc

SEQ ID NO: 3423209 - DNA, 15 bp, Homo sapiens
ccatagatttgaaga

SEQ ID NO: 3423210 - DNA, 22 bp, Homo sapiens
ccatagatttgaagatctgatt

SEQ ID NO: 3423211 - DNA, 20 bp, Homo sapiens
ccatcatgtttacagaggac

SEQ ID NO: 3423212 - DNA, 22 bp, Homo sapiens
ccatctctaggatgtcgtcttt

SEQ ID NO: 3423213 - DNA, 22 bp, Homo sapiens
ccatgaaaatgcaacaacatgt

SEQ ID NO: 3423214 - DNA, 15 bp, Homo sapiens
ccatgcttgggtgta

SEQ ID NO: 3423215 - DNA, 19 bp, Homo sapiens
ccatgggcttcactgtata

SEQ ID NO: 3423216 - DNA, 20 bp, Homo sapiens
ccatgggcttcactgtataa

SEQ ID NO: 3423217 - DNA, 21 bp, Homo sapiens
ccatgggcttcactgtataaa

SEQ ID NO: 3423218 - DNA, 14 bp, Homo sapiens
ccatgtgtgctaat

SEQ ID NO: 3423219 - DNA, 17 bp, Homo sapiens
ccatgttgtgcctccct

SEQ ID NO: 3423220 - DNA, 22 bp, Homo sapiens
ccatgttgtgcctccctggtga

SEQ ID NO: 3423221 - DNA, 12 bp, Homo sapiens
ccattctatgtg

SEQ ID NO: 3423222 - DNA, 12 bp, Homo sapiens
ccattctttctt

SEQ ID NO: 3423223 - DNA, 17 bp, Homo sapiens
ccattgccatcagtgat

SEQ ID NO: 3423224 - DNA, 21 bp, Homo sapiens
ccatttgatttcgatgtacag

SEQ ID NO: 3423225 - DNA, 12 bp, Homo sapiens
ccattttgtgaa

SEQ ID NO: 3423226 - DNA, 12 bp, Homo sapiens
cccaaagaagga

SEQ ID NO: 3423227 - DNA, 23 bp, Homo sapiens
cccaaaggtctatctactaaact

SEQ ID NO: 3423228 - DNA, 12 bp, Homo sapiens
cccaacagttta

SEQ ID NO: 3423229 - DNA, 21 bp, Homo sapiens
cccaattcttacaaacatgtg

SEQ ID NO: 3423230 - DNA, 13 bp, Homo sapiens
cccaccctcagcc

SEQ ID NO: 3423231 - DNA, 14 bp, Homo sapiens
cccacctggctccc

SEQ ID NO: 3423232 - DNA, 18 bp, Homo sapiens
cccactctccacctcact

SEQ ID NO: 3423233 - DNA, 14 bp, Homo sapiens
cccacttctgcact

SEQ ID NO: 3423234 - DNA, 16 bp, Homo sapiens
cccacttctgcacttg

SEQ ID NO: 3423235 - DNA, 21 bp, Homo sapiens
cccactttgctgttccttact

SEQ ID NO: 3423236 - DNA, 22 bp, Homo sapiens
cccagaaaaaaagcccaacaca

SEQ ID NO: 3423237 - DNA, 21 bp, Homo sapiens
cccagagaaagcgcagatgct

SEQ ID NO: 3423238 - DNA, 15 bp, Homo sapiens
cccagaggagggcag

SEQ ID NO: 3423239 - DNA, 13 bp, Homo sapiens
cccagaggggcct

SEQ ID NO: 3423240 - DNA, 14 bp, Homo sapiens
cccagaggggcctg

SEQ ID NO: 3423241 - DNA, 17 bp, Homo sapiens
cccagattggctcacac

SEQ ID NO: 3423242 - DNA, 21 bp, Homo sapiens
cccagattggctcacactgag

SEQ ID NO: 3423243 - DNA, 22 bp, Homo sapiens
cccagattggctcacactgaga

SEQ ID NO: 3423244 - DNA, 20 bp, Homo sapiens
cccagcggacagtggcagga

SEQ ID NO: 3423245 - DNA, 15 bp, Homo sapiens
cccaggactgggcca

SEQ ID NO: 3423246 - DNA, 13 bp, Homo sapiens
cccaggagctccc

SEQ ID NO: 3423247 - DNA, 14 bp, Homo sapiens
cccaggccaggact

SEQ ID NO: 3423248 - DNA, 15 bp, Homo sapiens
ctccctgcctgtttc

SEQ ID NO: 3423249 - DNA, 19 bp, Homo sapiens
ctccctggtgagagggccg

SEQ ID NO: 3423250 - DNA, 15 bp, Homo sapiens
ctccctttctcccct

SEQ ID NO: 3423251 - DNA, 18 bp, Homo sapiens
ctccgctgggaggaacct

SEQ ID NO: 3423252 - DNA, 20 bp, Homo sapiens
ctcctactgcttcctctgaa

SEQ ID NO: 3423253 - DNA, 15 bp, Homo sapiens
ctcctcagctccctg

SEQ ID NO: 3423254 - DNA, 19 bp, Homo sapiens
ctcctcagctccctgcctg

SEQ ID NO: 3423255 - DNA, 16 bp, Homo sapiens
ctcctccactctcccc

SEQ ID NO: 3423256 - DNA, 20 bp, Homo sapiens
ctcctcttaaaaaataaaaa

SEQ ID NO: 3423257 - DNA, 23 bp, Homo sapiens
ctcctcttaaaaaataaaaactg

SEQ ID NO: 3423258 - DNA, 17 bp, Homo sapiens
ctccttcagccctcacc

SEQ ID NO: 3423259 - DNA, 14 bp, Homo sapiens
ctccttgtggccta

SEQ ID NO: 3423260 - DNA, 15 bp, Homo sapiens
ctcgactcccccctg

SEQ ID NO: 3423261 - DNA, 12 bp, Homo sapiens
ctcgcaggaaga

SEQ ID NO: 3423262 - DNA, 20 bp, Homo sapiens
ctcgggccccagctccgcct

SEQ ID NO: 3423263 - DNA, 16 bp, Homo sapiens
ctcgtgtcagctcagg

SEQ ID NO: 3423264 - DNA, 12 bp, Homo sapiens
ctcgtttgatag

SEQ ID NO: 3423265 - DNA, 13 bp, Homo sapiens
ctctactctgctt

SEQ ID NO: 3423266 - DNA, 14 bp, Homo sapiens
ctctactgtgtaat

SEQ ID NO: 3423267 - DNA, 15 bp, Homo sapiens
ctctagaggctgcct

SEQ ID NO: 3423268 - DNA, 13 bp, Homo sapiens
ctctcacattact

SEQ ID NO: 3423269 - DNA, 15 bp, Homo sapiens
ctctccacctcacta

SEQ ID NO: 3423270 - DNA, 13 bp, Homo sapiens
ctctccatctcta

SEQ ID NO: 3423271 - DNA, 20 bp, Homo sapiens
ctctcccctgccccctgcag

SEQ ID NO: 3423272 - DNA, 22 bp, Homo sapiens
ctctcccctgccccctgcagga

SEQ ID NO: 3423273 - DNA, 19 bp, Homo sapiens
ctctctggcttccatgctc

SEQ ID NO: 3423274 - DNA, 21 bp, Homo sapiens
ctctcttgtgagccatagaga

SEQ ID NO: 3423275 - DNA, 14 bp, Homo sapiens
ctctgacaaagtgt

SEQ ID NO: 3423276 - DNA, 11 bp, Homo sapiens
ctctgagctgt

SEQ ID NO: 3423277 - DNA, 15 bp, Homo sapiens
ctctgccccaccctc

SEQ ID NO: 3423278 - DNA, 18 bp, Homo sapiens
ctctggacctctcttgtg

SEQ ID NO: 3423279 - DNA, 23 bp, Homo sapiens
ctctgggtttacaacaaacactg

SEQ ID NO: 3423280 - DNA, 13 bp, Homo sapiens
ctctgtaaaagtg

SEQ ID NO: 3423281 - DNA, 16 bp, Homo sapiens
ctctgtaaaagtgtct

SEQ ID NO: 3423282 - DNA, 13 bp, Homo sapiens
ctctgtcagtgtg

SEQ ID NO: 3423283 - DNA, 21 bp, Homo sapiens
ctctgtccccttctctcatct

SEQ ID NO: 3423284 - DNA, 14 bp, Homo sapiens
ctctgtgtctgagt

SEQ ID NO: 3423285 - DNA, 20 bp, Homo sapiens
ctctgtgtctgagtggcttc

SEQ ID NO: 3423286 - DNA, 17 bp, Homo sapiens
ctcttaaaaaataaaaa

SEQ ID NO: 3423287 - DNA, 19 bp, Homo sapiens
ctcttaaaaaataaaaact

SEQ ID NO: 3423288 - DNA, 13 bp, Homo sapiens
ctcttaaatcatt

SEQ ID NO: 3423289 - DNA, 15 bp, Homo sapiens
ctcttaaatcatttg

SEQ ID NO: 3423290 - DNA, 16 bp, Homo sapiens
ctcttaagtgtaaata

SEQ ID NO: 3423291 - DNA, 11 bp, Homo sapiens
ctcttatctca

SEQ ID NO: 3423292 - DNA, 23 bp, Homo sapiens
ctcttatctcagtcatgcataaa

SEQ ID NO: 3423293 - DNA, 18 bp, Homo sapiens
ctcttcctggaataaaca

SEQ ID NO: 3423294 - DNA, 12 bp, Homo sapiens
ctcttctcattt

SEQ ID NO: 3423295 - DNA, 19 bp, Homo sapiens
ctcttctcatttcacccct

SEQ ID NO: 3423296 - DNA, 14 bp, Homo sapiens
ctcttggggaaata

SEQ ID NO: 3423297 - DNA, 22 bp, Homo sapiens
ctcttgtttggagggatcattt

SEQ ID NO: 3423298 - DNA, 17 bp, Homo sapiens
ctgaaaattaacactgc

SEQ ID NO: 3423299 - DNA, 11 bp, Homo sapiens
ctgaaattaaa

SEQ ID NO: 3423300 - DNA, 21 bp, Homo sapiens
ctgaagagaagggcagggctg

SEQ ID NO: 3423301 - DNA, 12 bp, Homo sapiens
ctgaagggaggg

SEQ ID NO: 3423302 - DNA, 13 bp, Homo sapiens
ctgaagggagggg

SEQ ID NO: 3423303 - DNA, 13 bp, Homo sapiens
ctgaagtcttgca

SEQ ID NO: 3423304 - DNA, 19 bp, Homo sapiens
ctgaatgagacttaatttt

SEQ ID NO: 3423305 - DNA, 16 bp, Homo sapiens
ctgaccttgatgagct

SEQ ID NO: 3423306 - DNA, 14 bp, Homo sapiens
ctgactctgttatt

SEQ ID NO: 3423307 - DNA, 19 bp, Homo sapiens
ctgagagtatttaggcaga

SEQ ID NO: 3423308 - DNA, 16 bp, Homo sapiens
ctgagatttcatctgc

SEQ ID NO: 3423309 - DNA, 22 bp, Homo sapiens
ctgagatttcatctgctctcct

SEQ ID NO: 3423310 - DNA, 18 bp, Homo sapiens
ctgaggaagagggactgt

SEQ ID NO: 3423311 - DNA, 22 bp, Homo sapiens
ctgaggatttaagggatggaaa

SEQ ID NO: 3423312 - DNA, 16 bp, Homo sapiens
ctgagtgagttttact

SEQ ID NO: 3423313 - DNA, 21 bp, Homo sapiens
ctgagtggcttcactcctgct

SEQ ID NO: 3423314 - DNA, 23 bp, Homo sapiens
ctgagtggcttcactcctgctgt

SEQ ID NO: 3423315 - DNA, 20 bp, Homo sapiens
ctgagttgacttgacagaac

SEQ ID NO: 3423316 - DNA, 22 bp, Homo sapiens
ctgagttgcaccattctttctt

SEQ ID NO: 3423317 - DNA, 20 bp, Homo sapiens
ctgagttgttgagtctgttt

SEQ ID NO: 3423318 - DNA, 17 bp, Homo sapiens
ctgatcaatgacagagc

SEQ ID NO: 3423319 - DNA, 14 bp, Homo sapiens
ctgatctgattttt

SEQ ID NO: 3423320 - DNA, 18 bp, Homo sapiens
ctgatctgtactttgtgt

SEQ ID NO: 3423321 - DNA, 11 bp, Homo sapiens
ctgcaacatgg

SEQ ID NO: 3423322 - DNA, 12 bp, Homo sapiens
ctgcaacatgga

SEQ ID NO: 3423323 - DNA, 18 bp, Homo sapiens
ctgcaagcatttttccat

SEQ ID NO: 3423324 - DNA, 18 bp, Homo sapiens
ctgcaatgcgtcttgtga

SEQ ID NO: 3423325 - DNA, 20 bp, Homo sapiens
ctgcaatgcgtcttgtgaaa

SEQ ID NO: 3423326 - DNA, 21 bp, Homo sapiens
ctgcaatgcgtcttgtgaaat

SEQ ID NO: 3423327 - DNA, 22 bp, Homo sapiens
ctgcaatgcgtcttgtgaaatt

SEQ ID NO: 3423328 - DNA, 23 bp, Homo sapiens
ctgcaatgcgtcttgtgaaattg

SEQ ID NO: 3423329 - DNA, 18 bp, Homo sapiens
ctgcaatgtgatctatgt

SEQ ID NO: 3423330 - DNA, 18 bp, Homo sapiens
ctgcaatgtttttgtgta

SEQ ID NO: 3423331 - DNA, 19 bp, Homo sapiens
ctgcaggaaggagctgcct

SEQ ID NO: 3423332 - DNA, 23 bp, Homo sapiens
ctgcaggaaggagctgcctggac

SEQ ID NO: 3423333 - DNA, 16 bp, Homo sapiens
ctgcaggggcatggga

SEQ ID NO: 3423334 - DNA, 21 bp, Homo sapiens
ctgcatgtaaaatcttcagct

SEQ ID NO: 3423335 - DNA, 22 bp, Homo sapiens
ctgcattaataatagctaataa

SEQ ID NO: 3423336 - DNA, 22 bp, Homo sapiens
ctgcattggaactggaggcagg

SEQ ID NO: 3423337 - DNA, 20 bp, Homo sapiens
ctgccacctggacccctgca

SEQ ID NO: 3423338 - DNA, 22 bp, Homo sapiens
ctgccacctggacccctgcatt

SEQ ID NO: 3423339 - DNA, 22 bp, Homo sapiens
ctgcccagggtcagtgtatcta

SEQ ID NO: 3423340 - DNA, 11 bp, Homo sapiens
ctgccccaccc

SEQ ID NO: 3423341 - DNA, 15 bp, Homo sapiens
ctgcccccaggactg

SEQ ID NO: 3423342 - DNA, 16 bp, Homo sapiens
ctgcccccaggactgg

SEQ ID NO: 3423343 - DNA, 17 bp, Homo sapiens
ctgcccccaggactggg

SEQ ID NO: 3423344 - DNA, 13 bp, Homo sapiens
ctgccccctgcag

SEQ ID NO: 3423345 - DNA, 22 bp, Homo sapiens
ctgccccctgcaggaaggagct

SEQ ID NO: 3423346 - DNA, 23 bp, Homo sapiens
ctgccctcccacctccgctggga

SEQ ID NO: 3423347 - DNA, 15 bp, Homo sapiens
ctgcccttccgcagt

SEQ ID NO: 3423348 - DNA, 18 bp, Homo sapiens
ctgcccttccgcagtgtg

SEQ ID NO: 3423349 - DNA, 23 bp, Homo sapiens
ctgccctttcccaggtaatttaa

SEQ ID NO: 3423350 - DNA, 14 bp, Homo sapiens
ctgccgcagagctg

SEQ ID NO: 3423351 - DNA, 17 bp, Homo sapiens
ctgcctccagggctgga

SEQ ID NO: 3423352 - DNA, 22 bp, Homo sapiens
ctgcctggacttggcccctgcc

SEQ ID NO: 3423353 - DNA, 19 bp, Homo sapiens
ctgcctggttttatttata

SEQ ID NO: 3423354 - DNA, 15 bp, Homo sapiens
ctgcctgtaattaaa

SEQ ID NO: 3423355 - DNA, 22 bp, Homo sapiens
ctgcctgtaattaaactagttt

SEQ ID NO: 3423356 - DNA, 21 bp, Homo sapiens
ctgccttttaagtttgaaact

SEQ ID NO: 3423357 - DNA, 21 bp, Homo sapiens
ctgctaaagggagaaatgcca

SEQ ID NO: 3423358 - DNA, 20 bp, Homo sapiens
ctgctcattaaactgattcc

SEQ ID NO: 3423359 - DNA, 13 bp, Homo sapiens
gatcaatgaaatg

SEQ ID NO: 3423360 - DNA, 13 bp, Homo sapiens
gatcacatctaaa

SEQ ID NO: 3423361 - DNA, 15 bp, Homo sapiens
gatcagatgctgaat

SEQ ID NO: 3423362 - DNA, 19 bp, Homo sapiens
gatcatctttgctgaatgt

SEQ ID NO: 3423363 - DNA, 16 bp, Homo sapiens
gatctgtactttgtgt

SEQ ID NO: 3423364 - DNA, 13 bp, Homo sapiens
gatctttggacag

SEQ ID NO: 3423365 - DNA, 19 bp, Homo sapiens
gatctttgtttaaatgcca

SEQ ID NO: 3423366 - DNA, 13 bp, Homo sapiens
gatgaacagactg

SEQ ID NO: 3423367 - DNA, 18 bp, Homo sapiens
gatgagagcccagaggta

SEQ ID NO: 3423368 - DNA, 19 bp, Homo sapiens
gatgaggccctccacacct

SEQ ID NO: 3423369 - DNA, 20 bp, Homo sapiens
gatgaggccctccacacctg

SEQ ID NO: 3423370 - DNA, 13 bp, Homo sapiens
gatggaatgatgg

SEQ ID NO: 3423371 - DNA, 20 bp, Homo sapiens
gatggcaaagaaggagagca

SEQ ID NO: 3423372 - DNA, 21 bp, Homo sapiens
gatggccgcagggctgtgcac

SEQ ID NO: 3423373 - DNA, 21 bp, Homo sapiens
gatgggtcagttgtatcagca

SEQ ID NO: 3423374 - DNA, 21 bp, Homo sapiens
gatgtgcatttttgtgaaatg

SEQ ID NO: 3423375 - DNA, 23 bp, Homo sapiens
gatgtgcatttttgtgaaatgaa

SEQ ID NO: 3423376 - DNA, 19 bp, Homo sapiens
gattaccagtctgattata

SEQ ID NO: 3423377 - DNA, 16 bp, Homo sapiens
gattagggaaaatgga

SEQ ID NO: 3423378 - DNA, 20 bp, Homo sapiens
gattagggaaaatggatata

SEQ ID NO: 3423379 - DNA, 18 bp, Homo sapiens
gattatttaataacatta

SEQ ID NO: 3423380 - DNA, 18 bp, Homo sapiens
gattccacacaaaatgtc

SEQ ID NO: 3423381 - DNA, 22 bp, Homo sapiens
gattgcaatttgcacaagtttt

SEQ ID NO: 3423382 - DNA, 23 bp, Homo sapiens
gattgcaggagtccctgccatca

SEQ ID NO: 3423383 - DNA, 13 bp, Homo sapiens
gattggattattt

SEQ ID NO: 3423384 - DNA, 21 bp, Homo sapiens
gattggattatttaataacat

SEQ ID NO: 3423385 - DNA, 18 bp, Homo sapiens
gattggatttgctgtgac

SEQ ID NO: 3423386 - DNA, 17 bp, Homo sapiens
gattggctcacactgag

SEQ ID NO: 3423387 - DNA, 20 bp, Homo sapiens
gattggctcacactgagaat

SEQ ID NO: 3423388 - DNA, 13 bp, Homo sapiens
gattgtaaaaaaa

SEQ ID NO: 3423389 - DNA, 18 bp, Homo sapiens
gattgtaaaaaaaaatgc

SEQ ID NO: 3423390 - DNA, 12 bp, Homo sapiens
gattgtagtatt

SEQ ID NO: 3423391 - DNA, 13 bp, Homo sapiens
gattgtattgctg

SEQ ID NO: 3423392 - DNA, 17 bp, Homo sapiens
gatttaataaaataatt

SEQ ID NO: 3423393 - DNA, 19 bp, Homo sapiens
gatttaataaaataattct

SEQ ID NO: 3423394 - DNA, 12 bp, Homo sapiens
gatttcatctgc

SEQ ID NO: 3423395 - DNA, 21 bp, Homo sapiens
gatttcatctgctctccttcc

SEQ ID NO: 3423396 - DNA, 13 bp, Homo sapiens
gatttgaaaaact

SEQ ID NO: 3423397 - DNA, 14 bp, Homo sapiens
gatttgaaaaactt

SEQ ID NO: 3423398 - DNA, 15 bp, Homo sapiens
gatttgaaaaacttt

SEQ ID NO: 3423399 - DNA, 16 bp, Homo sapiens
gatttgaaaaactttt

SEQ ID NO: 3423400 - DNA, 18 bp, Homo sapiens
gatttgaagatctgattt

SEQ ID NO: 3423401 - DNA, 14 bp, Homo sapiens
gatttgatctttgt

SEQ ID NO: 3423402 - DNA, 19 bp, Homo sapiens
gatttggtgtacaattcag

SEQ ID NO: 3423403 - DNA, 17 bp, Homo sapiens
gattttaaaaatacatt

SEQ ID NO: 3423404 - DNA, 20 bp, Homo sapiens
gattttaaaaatacattttt

SEQ ID NO: 3423405 - DNA, 15 bp, Homo sapiens
gattttatctgtgga

SEQ ID NO: 3423406 - DNA, 20 bp, Homo sapiens
gatttttattaactgctttt

SEQ ID NO: 3423407 - DNA, 18 bp, Homo sapiens
gatttttctcaaagtttt

SEQ ID NO: 3423408 - DNA, 19 bp, Homo sapiens
gattttttttttaagtgac

SEQ ID NO: 3423409 - DNA, 21 bp, Homo sapiens
gcaaaatattcttctttgata

SEQ ID NO: 3423410 - DNA, 13 bp, Homo sapiens
gcaaactgcttta

SEQ ID NO: 3423411 - DNA, 21 bp, Homo sapiens
gcaaagactattcccttctaa

SEQ ID NO: 3423412 - DNA, 22 bp, Homo sapiens
gcaaagactattcccttctaac

SEQ ID NO: 3423413 - DNA, 20 bp, Homo sapiens
gcaaatgagatttctttgaa

SEQ ID NO: 3423414 - DNA, 18 bp, Homo sapiens
gcaacgttagtagaactt

SEQ ID NO: 3423415 - DNA, 16 bp, Homo sapiens
gcaactaaatgagacc

SEQ ID NO: 3423416 - DNA, 17 bp, Homo sapiens
gcaactgaatacttgaa

SEQ ID NO: 3423417 - DNA, 14 bp, Homo sapiens
gcaagagagatgtt

SEQ ID NO: 3423418 - DNA, 17 bp, Homo sapiens
gcaagagagatgttttg

SEQ ID NO: 3423419 - DNA, 18 bp, Homo sapiens
gcaataaaattatttgca

SEQ ID NO: 3423420 - DNA, 16 bp, Homo sapiens
gcaatgcgtcttgtga

SEQ ID NO: 3423421 - DNA, 17 bp, Homo sapiens
gcaatgcgtcttgtgaa

SEQ ID NO: 3423422 - DNA, 22 bp, Homo sapiens
gcaatgcgtcttgtgaaattgt

SEQ ID NO: 3423423 - DNA, 14 bp, Homo sapiens
gcacaaagtggcat

SEQ ID NO: 3423424 - DNA, 18 bp, Homo sapiens
gcacacagaggggagtca

SEQ ID NO: 3423425 - DNA, 17 bp, Homo sapiens
gcacccggtcccctctg

SEQ ID NO: 3423426 - DNA, 14 bp, Homo sapiens
gcaccggaccagcc

SEQ ID NO: 3423427 - DNA, 16 bp, Homo sapiens
gcaccggaccagcctg

SEQ ID NO: 3423428 - DNA, 20 bp, Homo sapiens
gcactctttaagggagtgta

SEQ ID NO: 3423429 - DNA, 11 bp, Homo sapiens
gcactgaggaa

SEQ ID NO: 3423430 - DNA, 21 bp, Homo sapiens
gcacttaatattagcttgctt

SEQ ID NO: 3423431 - DNA, 12 bp, Homo sapiens
gcacttttattt

SEQ ID NO: 3423432 - DNA, 19 bp, Homo sapiens
gcacttttattttcattgt

SEQ ID NO: 3423433 - DNA, 14 bp, Homo sapiens
gcagaagacaccag

SEQ ID NO: 3423434 - DNA, 15 bp, Homo sapiens
gcagaagacaccaga

SEQ ID NO: 3423435 - DNA, 18 bp, Homo sapiens
gcagaagacaccagagca

SEQ ID NO: 3423436 - DNA, 20 bp, Homo sapiens
gcagaagacaccagagcaga

SEQ ID NO: 3423437 - DNA, 14 bp, Homo sapiens
gcagaagggggtgg

SEQ ID NO: 3423438 - DNA, 19 bp, Homo sapiens
gcagacatgtgcacttgaa

SEQ ID NO: 3423439 - DNA, 13 bp, Homo sapiens
gcagacgcccaga

SEQ ID NO: 3423440 - DNA, 14 bp, Homo sapiens
gcagagttctttgc

SEQ ID NO: 3423441 - DNA, 15 bp, Homo sapiens
gcagagttctttgca

SEQ ID NO: 3423442 - DNA, 19 bp, Homo sapiens
gcagagttctttgcaagct

SEQ ID NO: 3423443 - DNA, 15 bp, Homo sapiens
gcagatgcagagagc

SEQ ID NO: 3423444 - DNA, 23 bp, Homo sapiens
gcagatttttatattagttgctt

SEQ ID NO: 3423445 - DNA, 12 bp, Homo sapiens
gcagcagaaggg

SEQ ID NO: 3423446 - DNA, 22 bp, Homo sapiens
gcagcagaagggggtggtgtct

SEQ ID NO: 3423447 - DNA, 20 bp, Homo sapiens
gcagcaggtggcagaatggg

SEQ ID NO: 3423448 - DNA, 19 bp, Homo sapiens
gcagcatcttcacttctaa

SEQ ID NO: 3423449 - DNA, 15 bp, Homo sapiens
gcagccagggagagc

SEQ ID NO: 3423450 - DNA, 18 bp, Homo sapiens
gcagccagggagagccca

SEQ ID NO: 3423451 - DNA, 19 bp, Homo sapiens
gcagccagggagagcccag

SEQ ID NO: 3423452 - DNA, 20 bp, Homo sapiens
gcagccctgctgctgcctgc

SEQ ID NO: 3423453 - DNA, 22 bp, Homo sapiens
gcaggaagccaaagagactggg

SEQ ID NO: 3423454 - DNA, 13 bp, Homo sapiens
gcaggacaggaaa

SEQ ID NO: 3423455 - DNA, 16 bp, Homo sapiens
gcaggcaagcccttcg

SEQ ID NO: 3423456 - DNA, 17 bp, Homo sapiens
gcagggaacatggggag

SEQ ID NO: 3423457 - DNA, 18 bp, Homo sapiens
gcagggaacatggggagg

SEQ ID NO: 3423458 - DNA, 21 bp, Homo sapiens
gcaggggagggtcagccaggg

SEQ ID NO: 3423459 - DNA, 15 bp, Homo sapiens
gcaggggtccctgct

SEQ ID NO: 3423460 - DNA, 17 bp, Homo sapiens
gcaggtagacctgtctc

SEQ ID NO: 3423461 - DNA, 14 bp, Homo sapiens
gcaggtctttaaat

SEQ ID NO: 3423462 - DNA, 21 bp, Homo sapiens
gcaggtctttaaatcatttta

SEQ ID NO: 3423463 - DNA, 17 bp, Homo sapiens
gcagtcgtcccaggctg

SEQ ID NO: 3423464 - DNA, 19 bp, Homo sapiens
gcagtgatatggcagaaga

SEQ ID NO: 3423465 - DNA, 13 bp, Homo sapiens
gcagtgtttgtat

SEQ ID NO: 3423466 - DNA, 22 bp, Homo sapiens
gcagtttcatgtatgtatataa

SEQ ID NO: 3423467 - DNA, 15 bp, Homo sapiens
gcataaatatgcagt

SEQ ID NO: 3423468 - DNA, 15 bp, Homo sapiens
gcataatttgtctta

SEQ ID NO: 3423469 - DNA, 13 bp, Homo sapiens
gcatacttttaat

SEQ ID NO: 3423470 - DNA, 10 bp, Homo sapiens
gcatagagca

SEQ ID NO: 3423471 - DNA, 18 bp, Homo sapiens
gggcatattaaaggcttt

SEQ ID NO: 3423472 - DNA, 17 bp, Homo sapiens
gggccatgttgtgcctc

SEQ ID NO: 3423473 - DNA, 15 bp, Homo sapiens
gggcctaggccagga

SEQ ID NO: 3423474 - DNA, 19 bp, Homo sapiens
gggcctgccacctggaccc

SEQ ID NO: 3423475 - DNA, 23 bp, Homo sapiens
gggcctgccacctggacccctgc

SEQ ID NO: 3423476 - DNA, 23 bp, Homo sapiens
gggccttgctacctcaaggggga

SEQ ID NO: 3423477 - DNA, 20 bp, Homo sapiens
gggctaacatttaggagaag

SEQ ID NO: 3423478 - DNA, 15 bp, Homo sapiens
gggctcttctcattt

SEQ ID NO: 3423479 - DNA, 21 bp, Homo sapiens
gggctggacctggcggcagga

SEQ ID NO: 3423480 - DNA, 17 bp, Homo sapiens
gggctggaggagcccag

SEQ ID NO: 3423481 - DNA, 22 bp, Homo sapiens
gggctggaggagcccaggccag

SEQ ID NO: 3423482 - DNA, 22 bp, Homo sapiens
gggctgtgcacccagaagaaga

SEQ ID NO: 3423483 - DNA, 18 bp, Homo sapiens
gggcttacggccctggcc

SEQ ID NO: 3423484 - DNA, 17 bp, Homo sapiens
gggcttttaaaaggaaa

SEQ ID NO: 3423485 - DNA, 14 bp, Homo sapiens
ggggactgtctttc

SEQ ID NO: 3423486 - DNA, 18 bp, Homo sapiens
ggggcctgccacctggac

SEQ ID NO: 3423487 - DNA, 20 bp, Homo sapiens
ggggcctgccacctggaccc

SEQ ID NO: 3423488 - DNA, 22 bp, Homo sapiens
ggggcctgccacctggacccct

SEQ ID NO: 3423489 - DNA, 14 bp, Homo sapiens
ggggctcttctcat

SEQ ID NO: 3423490 - DNA, 17 bp, Homo sapiens
ggggctggaggagccca

SEQ ID NO: 3423491 - DNA, 17 bp, Homo sapiens
ggggcttttaaaaggaa

SEQ ID NO: 3423492 - DNA, 12 bp, Homo sapiens
gggggcagaagt

SEQ ID NO: 3423493 - DNA, 21 bp, Homo sapiens
gggggcgctattgcttcagct

SEQ ID NO: 3423494 - DNA, 14 bp, Homo sapiens
gggggctggctctg

SEQ ID NO: 3423495 - DNA, 23 bp, Homo sapiens
ggggtcctcctccagggacagca

SEQ ID NO: 3423496 - DNA, 21 bp, Homo sapiens
gggtcatctgtacctctgcct

SEQ ID NO: 3423497 - DNA, 18 bp, Homo sapiens
gggtcctcctccagggac

SEQ ID NO: 3423498 - DNA, 20 bp, Homo sapiens
gggtcctcctccagggacag

SEQ ID NO: 3423499 - DNA, 15 bp, Homo sapiens
gggtgatttctagaa

SEQ ID NO: 3423500 - DNA, 13 bp, Homo sapiens
ggtaaataaagct

SEQ ID NO: 3423501 - DNA, 18 bp, Homo sapiens
ggtaaatacaagtgaaca

SEQ ID NO: 3423502 - DNA, 23 bp, Homo sapiens
ggtaacaaataacctataaagtg

SEQ ID NO: 3423503 - DNA, 18 bp, Homo sapiens
ggtaacagaacagcttca

SEQ ID NO: 3423504 - DNA, 14 bp, Homo sapiens
ggtagacctgtctc

SEQ ID NO: 3423505 - DNA, 23 bp, Homo sapiens
ggtatctgcatgtaaaatcttca

SEQ ID NO: 3423506 - DNA, 15 bp, Homo sapiens
ggtcatagattcttg

SEQ ID NO: 3423507 - DNA, 17 bp, Homo sapiens
ggtcctcctccagggac

SEQ ID NO: 3423508 - DNA, 19 bp, Homo sapiens
ggtcctcctccagggacag

SEQ ID NO: 3423509 - DNA, 14 bp, Homo sapiens
ggtcggtgccttca

SEQ ID NO: 3423510 - DNA, 23 bp, Homo sapiens
ggtcttactttgtgcaaaagcag

SEQ ID NO: 3423511 - DNA, 22 bp, Homo sapiens
ggtcttcttacatgcatttgag

SEQ ID NO: 3423512 - DNA, 13 bp, Homo sapiens
ggtctttgtaaga

SEQ ID NO: 3423513 - DNA, 14 bp, Homo sapiens
ggtctttgtaagag

SEQ ID NO: 3423514 - DNA, 19 bp, Homo sapiens
ggtctttgtaagagtgtag

SEQ ID NO: 3423515 - DNA, 22 bp, Homo sapiens
ggtcttttacatacagtgatat

SEQ ID NO: 3423516 - DNA, 14 bp, Homo sapiens
ggtgacatgtgaaa

SEQ ID NO: 3423517 - DNA, 18 bp, Homo sapiens
ggtgacatgtgaaacctt

SEQ ID NO: 3423518 - DNA, 20 bp, Homo sapiens
ggtgagagggccgggcagag

SEQ ID NO: 3423519 - DNA, 19 bp, Homo sapiens
ggtgcaattaactctggac

SEQ ID NO: 3423520 - DNA, 19 bp, Homo sapiens
ggtggaagcttggggaaga

SEQ ID NO: 3423521 - DNA, 13 bp, Homo sapiens
ggtggatggtgac

SEQ ID NO: 3423522 - DNA, 15 bp, Homo sapiens
ggtggatggtgactt

SEQ ID NO: 3423523 - DNA, 22 bp, Homo sapiens
ggtggatggtgacttttgaaga

SEQ ID NO: 3423524 - DNA, 18 bp, Homo sapiens
ggtggccctctcccctgc

SEQ ID NO: 3423525 - DNA, 20 bp, Homo sapiens
ggtggccctctcccctgccc

SEQ ID NO: 3423526 - DNA, 14 bp, Homo sapiens
ggtgtaataagaca

SEQ ID NO: 3423527 - DNA, 15 bp, Homo sapiens
ggttaaatcatttgg

SEQ ID NO: 3423528 - DNA, 14 bp, Homo sapiens
ggttaagaaatacc

SEQ ID NO: 3423529 - DNA, 17 bp, Homo sapiens
ggttatcgaaataacaa

SEQ ID NO: 3423530 - DNA, 15 bp, Homo sapiens
ggttgcactttgtag

SEQ ID NO: 3423531 - DNA, 19 bp, Homo sapiens
ggttgggagaatgtcagta

SEQ ID NO: 3423532 - DNA, 15 bp, Homo sapiens
ggtttacaacaaaca

SEQ ID NO: 3423533 - DNA, 19 bp, Homo sapiens
ggtttacaacaaacactgt

SEQ ID NO: 3423534 - DNA, 13 bp, Homo sapiens
ggtttataataaa

SEQ ID NO: 3423535 - DNA, 15 bp, Homo sapiens
ggtttataataaact

SEQ ID NO: 3423536 - DNA, 12 bp, Homo sapiens
ggtttcaattta

SEQ ID NO: 3423537 - DNA, 20 bp, Homo sapiens
ggtttctgatctgtactttg

SEQ ID NO: 3423538 - DNA, 22 bp, Homo sapiens
ggtttgtttagaagaagtgtgt

SEQ ID NO: 3423539 - DNA, 13 bp, Homo sapiens
ggttttgactgga

SEQ ID NO: 3423540 - DNA, 19 bp, Homo sapiens
gtaaaaaaaaatgcctttg

SEQ ID NO: 3423541 - DNA, 23 bp, Homo sapiens
gtaaaaaaaaatgcctttgagac

SEQ ID NO: 3423542 - DNA, 21 bp, Homo sapiens
gtaaaatagttttgctttgtt

SEQ ID NO: 3423543 - DNA, 14 bp, Homo sapiens
gtaaaatcttcagc

SEQ ID NO: 3423544 - DNA, 19 bp, Homo sapiens
gtaaaatcttcagctggtg

SEQ ID NO: 3423545 - DNA, 21 bp, Homo sapiens
gtaaaatcttcagctggtgga

SEQ ID NO: 3423546 - DNA, 11 bp, Homo sapiens
gtaaataaagc

SEQ ID NO: 3423547 - DNA, 16 bp, Homo sapiens
gtaaatttatgtgatg

SEQ ID NO: 3423548 - DNA, 17 bp, Homo sapiens
gtaaatttatgtgatgg

SEQ ID NO: 3423549 - DNA, 14 bp, Homo sapiens
gtaacaaataacct

SEQ ID NO: 3423550 - DNA, 22 bp, Homo sapiens
gtaacagaacagcttcaggtta

SEQ ID NO: 3423551 - DNA, 14 bp, Homo sapiens
gtaacaggtctcct

SEQ ID NO: 3423552 - DNA, 21 bp, Homo sapiens
gtaacaggtctcctcttaaaa

SEQ ID NO: 3423553 - DNA, 18 bp, Homo sapiens
gtaagagtgtagaagcat

SEQ ID NO: 3423554 - DNA, 22 bp, Homo sapiens
gtaagagtgtagaagcattcct

SEQ ID NO: 3423555 - DNA, 16 bp, Homo sapiens
gtaagctctatctgca

SEQ ID NO: 3423556 - DNA, 12 bp, Homo sapiens
gtaaggctgtac

SEQ ID NO: 3423557 - DNA, 21 bp, Homo sapiens
gtaaggctgtacatagtcctt

SEQ ID NO: 3423558 - DNA, 21 bp, Homo sapiens
gtaataaaaagagatgaaata

SEQ ID NO: 3423559 - DNA, 13 bp, Homo sapiens
gtaataagacata

SEQ ID NO: 3423560 - DNA, 12 bp, Homo sapiens
gtaatatgagaa

SEQ ID NO: 3423561 - DNA, 23 bp, Homo sapiens
gtaattccacatcatgttacttg

SEQ ID NO: 3423562 - DNA, 21 bp, Homo sapiens
gtacaaactaactaataaaat

SEQ ID NO: 3423563 - DNA, 18 bp, Homo sapiens
gtacaaggtatgtacagt

SEQ ID NO: 3423564 - DNA, 17 bp, Homo sapiens
gtacaagtcagtttcta

SEQ ID NO: 3423565 - DNA, 15 bp, Homo sapiens
gtacagttcataaat

SEQ ID NO: 3423566 - DNA, 16 bp, Homo sapiens
gtacatttatgattta

SEQ ID NO: 3423567 - DNA, 21 bp, Homo sapiens
gtaccatgtgctacaggggcc

SEQ ID NO: 3423568 - DNA, 19 bp, Homo sapiens
gtacttaaatgagttactt

SEQ ID NO: 3423569 - DNA, 18 bp, Homo sapiens
gtagaaagacagagctgg

SEQ ID NO: 3423570 - DNA, 22 bp, Homo sapiens
gtagaacacaaggtcatttgct

SEQ ID NO: 3423571 - DNA, 23 bp, Homo sapiens
gtagactatggaatgtcagtgtt

SEQ ID NO: 3423572 - DNA, 17 bp, Homo sapiens
gtagagtgtttgtgagc

SEQ ID NO: 3423573 - DNA, 15 bp, Homo sapiens
gtagagttaagaagc

SEQ ID NO: 3423574 - DNA, 17 bp, Homo sapiens
gtagagttaagaagctg

SEQ ID NO: 3423575 - DNA, 14 bp, Homo sapiens
gtagccctcccact

SEQ ID NO: 3423576 - DNA, 15 bp, Homo sapiens
gtagccctcccactt

SEQ ID NO: 3423577 - DNA, 23 bp, Homo sapiens
gtagctcctcaactcacctaatg

SEQ ID NO: 3423578 - DNA, 17 bp, Homo sapiens
gtagggggctggaggag

SEQ ID NO: 3423579 - DNA, 20 bp, Homo sapiens
gtagggggctggaggagccc

SEQ ID NO: 3423580 - DNA, 15 bp, Homo sapiens
gtataatatttttaa

SEQ ID NO: 3423581 - DNA, 14 bp, Homo sapiens
gtataatctcctct

SEQ ID NO: 3423582 - DNA, 10 bp, Homo sapiens
taagtgacat

SEQ ID NO: 3423583 - DNA, 21 bp, Homo sapiens
taagtgcgtgtgtagagttaa

SEQ ID NO: 3423584 - DNA, 16 bp, Homo sapiens
taagtttcaggtgaca

SEQ ID NO: 3423585 - DNA, 15 bp, Homo sapiens
taataaatatttatg

SEQ ID NO: 3423586 - DNA, 16 bp, Homo sapiens
taataaatatttatgt

SEQ ID NO: 3423587 - DNA, 22 bp, Homo sapiens
taataattggccttcgatttta

SEQ ID NO: 3423588 - DNA, 21 bp, Homo sapiens
taatagtgcttaaaaatcatt

SEQ ID NO: 3423589 - DNA, 19 bp, Homo sapiens
taatataaagttggatgcg

SEQ ID NO: 3423590 - DNA, 12 bp, Homo sapiens
taatattctctg

SEQ ID NO: 3423591 - DNA, 17 bp, Homo sapiens
taatattctctgatgtt

SEQ ID NO: 3423592 - DNA, 18 bp, Homo sapiens
taatatttcttcaagtga

SEQ ID NO: 3423593 - DNA, 22 bp, Homo sapiens
taatatttcttcaagtgagtgg

SEQ ID NO: 3423594 - DNA, 19 bp, Homo sapiens
taatcacttaacattccta

SEQ ID NO: 3423595 - DNA, 19 bp, Homo sapiens
taatcatgctcatgtatat

SEQ ID NO: 3423596 - DNA, 21 bp, Homo sapiens
taatcatgctcatgtatattt

SEQ ID NO: 3423597 - DNA, 16 bp, Homo sapiens
taatctatattaaatg

SEQ ID NO: 3423598 - DNA, 18 bp, Homo sapiens
taatctatattaaatgag

SEQ ID NO: 3423599 - DNA, 21 bp, Homo sapiens
taatctccacccaatgaatga

SEQ ID NO: 3423600 - DNA, 17 bp, Homo sapiens
taatctcctctgctcat

SEQ ID NO: 3423601 - DNA, 22 bp, Homo sapiens
taatctcctctgctcattaaac

SEQ ID NO: 3423602 - DNA, 12 bp, Homo sapiens
taatctgcctgg

SEQ ID NO: 3423603 - DNA, 15 bp, Homo sapiens
taatctgttgtttga

SEQ ID NO: 3423604 - DNA, 22 bp, Homo sapiens
taatgaaagtgatgacatattt

SEQ ID NO: 3423605 - DNA, 14 bp, Homo sapiens
taatgatgtaacag

SEQ ID NO: 3423606 - DNA, 18 bp, Homo sapiens
taatgatgtaacagtgca

SEQ ID NO: 3423607 - DNA, 16 bp, Homo sapiens
taatgatttttgtgta

SEQ ID NO: 3423608 - DNA, 18 bp, Homo sapiens
taatgatttttgtgtatc

SEQ ID NO: 3423609 - DNA, 15 bp, Homo sapiens
taatgcttatgtgtt

SEQ ID NO: 3423610 - DNA, 15 bp, Homo sapiens
taatggtttgaatat

SEQ ID NO: 3423611 - DNA, 11 bp, Homo sapiens
taatgtctctg

SEQ ID NO: 3423612 - DNA, 13 bp, Homo sapiens
taatgttaaattt

SEQ ID NO: 3423613 - DNA, 17 bp, Homo sapiens
taatgttaaatttgtaa

SEQ ID NO: 3423614 - DNA, 20 bp, Homo sapiens
taatgttctccactgacaca

SEQ ID NO: 3423615 - DNA, 15 bp, Homo sapiens
taatgtttatgagcc

SEQ ID NO: 3423616 - DNA, 16 bp, Homo sapiens
taatgtttatgagcca

SEQ ID NO: 3423617 - DNA, 17 bp, Homo sapiens
taattaaaaactttaaa

SEQ ID NO: 3423618 - DNA, 13 bp, Homo sapiens
taattccacatca

SEQ ID NO: 3423619 - DNA, 21 bp, Homo sapiens
taattgaaatttaaaaataaa

SEQ ID NO: 3423620 - DNA, 23 bp, Homo sapiens
taattgatcagatgctgaattga

SEQ ID NO: 3423621 - DNA, 19 bp, Homo sapiens
taattgttccttgctttta

SEQ ID NO: 3423622 - DNA, 15 bp, Homo sapiens
taatttaaaattgtg

SEQ ID NO: 3423623 - DNA, 20 bp, Homo sapiens
taatttaaaattgtgatgtg

SEQ ID NO: 3423624 - DNA, 14 bp, Homo sapiens
taatttatactggc

SEQ ID NO: 3423625 - DNA, 11 bp, Homo sapiens
taatttattct

SEQ ID NO: 3423626 - DNA, 22 bp, Homo sapiens
taatttgatagtattgtgcata

SEQ ID NO: 3423627 - DNA, 16 bp, Homo sapiens
taattttgtctttcaa

SEQ ID NO: 3423628 - DNA, 18 bp, Homo sapiens
tacaaattcctttcagag

SEQ ID NO: 3423629 - DNA, 12 bp, Homo sapiens
tacaacaaacac

SEQ ID NO: 3423630 - DNA, 14 bp, Homo sapiens
tacaacaaacactg

SEQ ID NO: 3423631 - DNA, 20 bp, Homo sapiens
tacaacaaacactgtgatgt

SEQ ID NO: 3423632 - DNA, 17 bp, Homo sapiens
tacaagcttaaagcttg

SEQ ID NO: 3423633 - DNA, 16 bp, Homo sapiens
tacaagtcagtttcta

SEQ ID NO: 3423634 - DNA, 13 bp, Homo sapiens
tacaataaaagta

SEQ ID NO: 3423635 - DNA, 19 bp, Homo sapiens
tacaataaaggatgtttat

SEQ ID NO: 3423636 - DNA, 16 bp, Homo sapiens
tacacaacatgtatgt

SEQ ID NO: 3423637 - DNA, 21 bp, Homo sapiens
tacacaacatgtatgtggata

SEQ ID NO: 3423638 - DNA, 22 bp, Homo sapiens
tacacagtgtgaataaagtgct

SEQ ID NO: 3423639 - DNA, 17 bp, Homo sapiens
tacacagttaaataaat

SEQ ID NO: 3423640 - DNA, 20 bp, Homo sapiens
tacacatctctgtcagtgtg

SEQ ID NO: 3423641 - DNA, 20 bp, Homo sapiens
tacagatggagcaaatgtcc

SEQ ID NO: 3423642 - DNA, 16 bp, Homo sapiens
tacagatgtagatata

SEQ ID NO: 3423643 - DNA, 13 bp, Homo sapiens
tacaggggccaga

SEQ ID NO: 3423644 - DNA, 15 bp, Homo sapiens
tacaggggccagaag

SEQ ID NO: 3423645 - DNA, 17 bp, Homo sapiens
tacagtaaatgaactga

SEQ ID NO: 3423646 - DNA, 17 bp, Homo sapiens
tacagtattcccactct

SEQ ID NO: 3423647 - DNA, 17 bp, Homo sapiens
tacagtctcaattttgt

SEQ ID NO: 3423648 - DNA, 20 bp, Homo sapiens
tacagtctcaattttgtatt

SEQ ID NO: 3423649 - DNA, 17 bp, Homo sapiens
tacagttcataaatttg

SEQ ID NO: 3423650 - DNA, 13 bp, Homo sapiens
tacatagtccttt

SEQ ID NO: 3423651 - DNA, 19 bp, Homo sapiens
tacatattaggaaaatatg

SEQ ID NO: 3423652 - DNA, 23 bp, Homo sapiens
tacatattaggaaaatatgggtt

SEQ ID NO: 3423653 - DNA, 16 bp, Homo sapiens
tacatggttgtgacct

SEQ ID NO: 3423654 - DNA, 16 bp, Homo sapiens
tacatttatgatttaa

SEQ ID NO: 3423655 - DNA, 18 bp, Homo sapiens
tacatttatgatttaata

SEQ ID NO: 3423656 - DNA, 21 bp, Homo sapiens
tacattttggatttctttata

SEQ ID NO: 3423657 - DNA, 17 bp, Homo sapiens
taccaagtatgaagtat

SEQ ID NO: 3423658 - DNA, 20 bp, Homo sapiens
taccagcaaagagaatgtat

SEQ ID NO: 3423659 - DNA, 23 bp, Homo sapiens
taccagcaaagagaatgtatttc

SEQ ID NO: 3423660 - DNA, 14 bp, Homo sapiens
taccaggtgttcta

SEQ ID NO: 3423661 - DNA, 22 bp, Homo sapiens
taccagtctgattataccatgt

SEQ ID NO: 3423662 - DNA, 16 bp, Homo sapiens
taccatagagtaatga

SEQ ID NO: 3423663 - DNA, 17 bp, Homo sapiens
taccatgtgctacaggg

SEQ ID NO: 3423664 - DNA, 17 bp, Homo sapiens
taccatgtgtgctaata

SEQ ID NO: 3423665 - DNA, 18 bp, Homo sapiens
taccctcctctatttctt

SEQ ID NO: 3423666 - DNA, 13 bp, Homo sapiens
taccgcttcctta

SEQ ID NO: 3423667 - DNA, 23 bp, Homo sapiens
tacctctccagcctcagctctca

SEQ ID NO: 3423668 - DNA, 18 bp, Homo sapiens
tacctgatcaatgacaga

SEQ ID NO: 3423669 - DNA, 17 bp, Homo sapiens
tacctgccttttaagtt

SEQ ID NO: 3423670 - DNA, 20 bp, Homo sapiens
tacctgccttttaagtttga

SEQ ID NO: 3423671 - DNA, 18 bp, Homo sapiens
tacctttttatatttaaa

SEQ ID NO: 3423672 - DNA, 12 bp, Homo sapiens
tacggtgggggt

SEQ ID NO: 3423673 - DNA, 17 bp, Homo sapiens
tacgtataatgctttct

SEQ ID NO: 3423674 - DNA, 14 bp, Homo sapiens
tactacagttttta

SEQ ID NO: 3423675 - DNA, 18 bp, Homo sapiens
tactctgaaatgcactag

SEQ ID NO: 3423676 - DNA, 14 bp, Homo sapiens
tactgaatttattg

SEQ ID NO: 3423677 - DNA, 15 bp, Homo sapiens
tactgcctgaataaa

SEQ ID NO: 3423678 - DNA, 20 bp, Homo sapiens
tactgcctgaataaagagcc

SEQ ID NO: 3423679 - DNA, 16 bp, Homo sapiens
tactgctctagaaagt

SEQ ID NO: 3423680 - DNA, 13 bp, Homo sapiens
tactgctgacctt

SEQ ID NO: 3423681 - DNA, 16 bp, Homo sapiens
tactgcttctctttgt

SEQ ID NO: 3423682 - DNA, 21 bp, Homo sapiens
tactgcttctctttgtgcagt

SEQ ID NO: 3423683 - DNA, 12 bp, Homo sapiens
tactgtggagga

SEQ ID NO: 3423684 - DNA, 18 bp, Homo sapiens
tactgtggaggaaggatt

SEQ ID NO: 3423685 - DNA, 15 bp, Homo sapiens
tacttaaacatcatt

SEQ ID NO: 3423686 - DNA, 12 bp, Homo sapiens
tacttaaatgag

SEQ ID NO: 3423687 - DNA, 22 bp, Homo sapiens
tacttagaatgccataaaattg

SEQ ID NO: 3423688 - DNA, 16 bp, Homo sapiens
tacttgagaagtgctt

SEQ ID NO: 3423689 - DNA, 14 bp, Homo sapiens
tacttgatcattct

SEQ ID NO: 3423690 - DNA, 18 bp, Homo sapiens
tacttgatcattctcagt

SEQ ID NO: 3423691 - DNA, 13 bp, Homo sapiens
tactttgtgcaaa

SEQ ID NO: 3423692 - DNA, 13 bp, Homo sapiens
tacttttaaaata

SEQ ID NO: 3423693 - DNA, 21 bp, Homo sapiens
tactttttaaacagtgtttat

SEQ ID NO: 3423694 - DNA, 12 bp, Homo sapiens
tcccccactttc

SEQ ID NO: 3423695 - DNA, 21 bp, Homo sapiens
tcccctcgacagctctctggg

SEQ ID NO: 3423696 - DNA, 19 bp, Homo sapiens
tcccctcgtgtcagctcag

SEQ ID NO: 3423697 - DNA, 20 bp, Homo sapiens
tcccctcgtgtcagctcagg

SEQ ID NO: 3423698 - DNA, 19 bp, Homo sapiens
tcccctctgccccaccctc

SEQ ID NO: 3423699 - DNA, 20 bp, Homo sapiens
tcccctctgccccaccctca

SEQ ID NO: 3423700 - DNA, 14 bp, Homo sapiens
tcccctgcccccag

SEQ ID NO: 3423701 - DNA, 22 bp, Homo sapiens
tcccctgcccccaggactgggc

SEQ ID NO: 3423702 - DNA, 19 bp, Homo sapiens
tcccctgccccctgcagga

SEQ ID NO: 3423703 - DNA, 23 bp, Homo sapiens
tcccctgccccctgcaggaagga

SEQ ID NO: 3423704 - DNA, 15 bp, Homo sapiens
tcccgtaaggctgta

SEQ ID NO: 3423705 - DNA, 18 bp, Homo sapiens
tccctcattctgcattaa

SEQ ID NO: 3423706 - DNA, 23 bp, Homo sapiens
tccctgaccctttgaggccccca

SEQ ID NO: 3423707 - DNA, 16 bp, Homo sapiens
tccctgcctcaggcct

SEQ ID NO: 3423708 - DNA, 17 bp, Homo sapiens
tccctgcctcaggcctc

SEQ ID NO: 3423709 - DNA, 18 bp, Homo sapiens
tcccttgcccccctggcc

SEQ ID NO: 3423710 - DNA, 14 bp, Homo sapiens
tccctttctcccct

SEQ ID NO: 3423711 - DNA, 16 bp, Homo sapiens
tccctttctcccctgc

SEQ ID NO: 3423712 - DNA, 23 bp, Homo sapiens
tccctttctcccctgcccccagg

SEQ ID NO: 3423713 - DNA, 19 bp, Homo sapiens
tccgcagtgtggccaggct

SEQ ID NO: 3423714 - DNA, 15 bp, Homo sapiens
tccgctatccaccaa

SEQ ID NO: 3423715 - DNA, 16 bp, Homo sapiens
tccgctttcatgaaca

SEQ ID NO: 3423716 - DNA, 19 bp, Homo sapiens
tccggcatggacaatggac

SEQ ID NO: 3423717 - DNA, 23 bp, Homo sapiens
tccgtctagttaacatttcaagg

SEQ ID NO: 3423718 - DNA, 13 bp, Homo sapiens
tcctaatgcatta

SEQ ID NO: 3423719 - DNA, 13 bp, Homo sapiens
tcctatatgcact

SEQ ID NO: 3423720 - DNA, 15 bp, Homo sapiens
tcctatctagcattt

SEQ ID NO: 3423721 - DNA, 12 bp, Homo sapiens
tcctatgcaata

SEQ ID NO: 3423722 - DNA, 13 bp, Homo sapiens
tcctatgcaataa

SEQ ID NO: 3423723 - DNA, 12 bp, Homo sapiens
tcctcagccagt

SEQ ID NO: 3423724 - DNA, 21 bp, Homo sapiens
tcctcagctccctgcctgttt

SEQ ID NO: 3423725 - DNA, 14 bp, Homo sapiens
tcctccagggacag

SEQ ID NO: 3423726 - DNA, 16 bp, Homo sapiens
tcctccagggacagca

SEQ ID NO: 3423727 - DNA, 15 bp, Homo sapiens
tcctcctccagggac

SEQ ID NO: 3423728 - DNA, 15 bp, Homo sapiens
tcctcgttctccctg

SEQ ID NO: 3423729 - DNA, 14 bp, Homo sapiens
tcctctatttcttt

SEQ ID NO: 3423730 - DNA, 15 bp, Homo sapiens
tcctctatttcttta

SEQ ID NO: 3423731 - DNA, 23 bp, Homo sapiens
tcctgagccagtgtcaggaggaa

SEQ ID NO: 3423732 - DNA, 17 bp, Homo sapiens
tcctgcatgtgtatata

SEQ ID NO: 3423733 - DNA, 13 bp, Homo sapiens
tcctgccgcagag

SEQ ID NO: 3423734 - DNA, 16 bp, Homo sapiens
tcctgccgcagagctg

SEQ ID NO: 3423735 - DNA, 18 bp, Homo sapiens
tcctgccgcagagctggc

SEQ ID NO: 3423736 - DNA, 20 bp, Homo sapiens
tcctgccgcagagctggccg

SEQ ID NO: 3423737 - DNA, 19 bp, Homo sapiens
tcctgtccctcatccatag

SEQ ID NO: 3423738 - DNA, 13 bp, Homo sapiens
tcctgtctgttta

SEQ ID NO: 3423739 - DNA, 14 bp, Homo sapiens
tccttcagccctca

SEQ ID NO: 3423740 - DNA, 21 bp, Homo sapiens
tccttcagccctcacccctgg

SEQ ID NO: 3423741 - DNA, 22 bp, Homo sapiens
tccttcccagaggggcctgcca

SEQ ID NO: 3423742 - DNA, 16 bp, Homo sapiens
tccttcctcacaccag

SEQ ID NO: 3423743 - DNA, 16 bp, Homo sapiens
tccttcctttttattc

SEQ ID NO: 3423744 - DNA, 13 bp, Homo sapiens
tccttctcctcct

SEQ ID NO: 3423745 - DNA, 13 bp, Homo sapiens
tcctttcagagtt

SEQ ID NO: 3423746 - DNA, 23 bp, Homo sapiens
tccttttatctccttgtggccta

SEQ ID NO: 3423747 - DNA, 21 bp, Homo sapiens
tcgaaagtgtcatcaatttgt

SEQ ID NO: 3423748 - DNA, 18 bp, Homo sapiens
tcgaaataacaatgttaa

SEQ ID NO: 3423749 - DNA, 19 bp, Homo sapiens
tcgaaataacaatgttaag

SEQ ID NO: 3423750 - DNA, 16 bp, Homo sapiens
tcgacagctctctggg

SEQ ID NO: 3423751 - DNA, 14 bp, Homo sapiens
tcgagaactttcat

SEQ ID NO: 3423752 - DNA, 15 bp, Homo sapiens
tcgagaactttcatt

SEQ ID NO: 3423753 - DNA, 16 bp, Homo sapiens
tcgagaactttcattt

SEQ ID NO: 3423754 - DNA, 17 bp, Homo sapiens
tcgaggcggatctttgg

SEQ ID NO: 3423755 - DNA, 22 bp, Homo sapiens
tcgaggcggatctttggacaga

SEQ ID NO: 3423756 - DNA, 14 bp, Homo sapiens
tcggctcacaaatt

SEQ ID NO: 3423757 - DNA, 14 bp, Homo sapiens
tcgggaattttccc

SEQ ID NO: 3423758 - DNA, 15 bp, Homo sapiens
tcgtaccgcttcctt

SEQ ID NO: 3423759 - DNA, 16 bp, Homo sapiens
tcgtaccgcttcctta

SEQ ID NO: 3423760 - DNA, 23 bp, Homo sapiens
tctaaatgcatatcctgagccat

SEQ ID NO: 3423761 - DNA, 19 bp, Homo sapiens
tctaaattgatcattcata

SEQ ID NO: 3423762 - DNA, 15 bp, Homo sapiens
tctaagtatatgtga

SEQ ID NO: 3423763 - DNA, 15 bp, Homo sapiens
tctaatcataacata

SEQ ID NO: 3423764 - DNA, 14 bp, Homo sapiens
tctacacaacatgt

SEQ ID NO: 3423765 - DNA, 15 bp, Homo sapiens
tctacactcatctta

SEQ ID NO: 3423766 - DNA, 21 bp, Homo sapiens
tctacactgggtgctgatcct

SEQ ID NO: 3423767 - DNA, 20 bp, Homo sapiens
tctacattcttggttgttaa

SEQ ID NO: 3423768 - DNA, 15 bp, Homo sapiens
tctacctcttggctg

SEQ ID NO: 3423769 - DNA, 17 bp, Homo sapiens
tctagaccctatacatt

SEQ ID NO: 3423770 - DNA, 15 bp, Homo sapiens
tctagagtcatgtga

SEQ ID NO: 3423771 - DNA, 18 bp, Homo sapiens
tctagcatttatttctct

SEQ ID NO: 3423772 - DNA, 16 bp, Homo sapiens
tctagtagaacaatgt

SEQ ID NO: 3423773 - DNA, 15 bp, Homo sapiens
tctagtggtctttgt

SEQ ID NO: 3423774 - DNA, 21 bp, Homo sapiens
tctagtggtctttgtaagagt

SEQ ID NO: 3423775 - DNA, 22 bp, Homo sapiens
tctagtggtctttgtaagagtg

SEQ ID NO: 3423776 - DNA, 20 bp, Homo sapiens
tctagtgtttttttccctct

SEQ ID NO: 3423777 - DNA, 14 bp, Homo sapiens
tctatacctgcctt

SEQ ID NO: 3423778 - DNA, 20 bp, Homo sapiens
tctatttctgagaaggtcct

SEQ ID NO: 3423779 - DNA, 12 bp, Homo sapiens
tctatttcttta

SEQ ID NO: 3423780 - DNA, 22 bp, Homo sapiens
tctatttttaaaatcataacat

SEQ ID NO: 3423781 - DNA, 18 bp, Homo sapiens
tctcaaagttttgaaaag

SEQ ID NO: 3423782 - DNA, 20 bp, Homo sapiens
tctcaaggtgggccttgcta

SEQ ID NO: 3423783 - DNA, 16 bp, Homo sapiens
tctcaattttgtattt

SEQ ID NO: 3423784 - DNA, 16 bp, Homo sapiens
tctcagtcactttttc

SEQ ID NO: 3423785 - DNA, 14 bp, Homo sapiens
tctcagtcatgcat

SEQ ID NO: 3423786 - DNA, 14 bp, Homo sapiens
tctcagttgcagcc

SEQ ID NO: 3423787 - DNA, 17 bp, Homo sapiens
tctcatttcacccctcc

SEQ ID NO: 3423788 - DNA, 14 bp, Homo sapiens
tctccaaaccactt

SEQ ID NO: 3423789 - DNA, 18 bp, Homo sapiens
tctccaaccccccagcac

SEQ ID NO: 3423790 - DNA, 19 bp, Homo sapiens
tctccaaccccccagcact

SEQ ID NO: 3423791 - DNA, 20 bp, Homo sapiens
tctccaattctgaaatactt

SEQ ID NO: 3423792 - DNA, 12 bp, Homo sapiens
tctccatctcta

SEQ ID NO: 3423793 - DNA, 12 bp, Homo sapiens
tctccatgaaga

SEQ ID NO: 3423794 - DNA, 12 bp, Homo sapiens
tctcccccaccc

SEQ ID NO: 3423795 - DNA, 15 bp, Homo sapiens
tctcccctgccccca

SEQ ID NO: 3423796 - DNA, 16 bp, Homo sapiens
tctcccctgcccccag

SEQ ID NO: 3423797 - DNA, 21 bp, Homo sapiens
tctcccctgcccccaggactg

SEQ ID NO: 3423798 - DNA, 22 bp, Homo sapiens
tctcccctgcccccaggactgg

SEQ ID NO: 3423799 - DNA, 19 bp, Homo sapiens
tctcctctgctcattaaac

SEQ ID NO: 3423800 - DNA, 21 bp, Homo sapiens
tctcctctgctcattaaactg

SEQ ID NO: 3423801 - DNA, 12 bp, Homo sapiens
tctcctcttaaa

SEQ ID NO: 3423802 - DNA, 15 bp, Homo sapiens
tctccttgtggccta

SEQ ID NO: 3423803 - DNA, 13 bp, Homo sapiens
tctctactctgct

SEQ ID NO: 3423804 - DNA, 20 bp, Homo sapiens
tctctagtccctgtgttctg

SEQ ID NO: 3423805 - DNA, 14 bp, Homo sapiens
tctctcatctctta

SEQ ID NO: 3423806 - DNA, 21 bp, Homo sapiens
tgcctccagggctggactgag

SEQ ID NO: 3423807 - DNA, 23 bp, Homo sapiens
tgcctccagggctggactgaggc

SEQ ID NO: 3423808 - DNA, 13 bp, Homo sapiens
tgcctccctggtg

SEQ ID NO: 3423809 - DNA, 17 bp, Homo sapiens
tgcctcctgtgcctccc

SEQ ID NO: 3423810 - DNA, 17 bp, Homo sapiens
tgcctcgaaagtgtcat

SEQ ID NO: 3423811 - DNA, 16 bp, Homo sapiens
tgcctcggctcacaaa

SEQ ID NO: 3423812 - DNA, 14 bp, Homo sapiens
tgcctctcacagct

SEQ ID NO: 3423813 - DNA, 21 bp, Homo sapiens
tgcctctcacagctgagttgt

SEQ ID NO: 3423814 - DNA, 15 bp, Homo sapiens
tgcctctgtcccctt

SEQ ID NO: 3423815 - DNA, 21 bp, Homo sapiens
tgcctctgtccccttctctca

SEQ ID NO: 3423816 - DNA, 12 bp, Homo sapiens
tgcctgaataaa

SEQ ID NO: 3423817 - DNA, 11 bp, Homo sapiens
tgcctggaccc

SEQ ID NO: 3423818 - DNA, 17 bp, Homo sapiens
tgcctggttttatttat

SEQ ID NO: 3423819 - DNA, 22 bp, Homo sapiens
tgcctgtaattaaactagttta

SEQ ID NO: 3423820 - DNA, 16 bp, Homo sapiens
tgccttggtgtgctgt

SEQ ID NO: 3423821 - DNA, 20 bp, Homo sapiens
tgccttttaagtttgaaact

SEQ ID NO: 3423822 - DNA, 21 bp, Homo sapiens
tgcgggcattttgaatgtgat

SEQ ID NO: 3423823 - DNA, 12 bp, Homo sapiens
tgcgtcttgtga

SEQ ID NO: 3423824 - DNA, 16 bp, Homo sapiens
tgcgtcttgtgaaatt

SEQ ID NO: 3423825 - DNA, 20 bp, Homo sapiens
tgcgtcttgtgaaattgtgt

SEQ ID NO: 3423826 - DNA, 12 bp, Homo sapiens
tgcgtgtgtaga

SEQ ID NO: 3423827 - DNA, 17 bp, Homo sapiens
tgctaaagccttcctat

SEQ ID NO: 3423828 - DNA, 20 bp, Homo sapiens
tgctaaagggagaaatgcca

SEQ ID NO: 3423829 - DNA, 20 bp, Homo sapiens
tgctaactagcttggaaact

SEQ ID NO: 3423830 - DNA, 19 bp, Homo sapiens
tgctcatgtatatttagtt

SEQ ID NO: 3423831 - DNA, 19 bp, Homo sapiens
tgctccagacctgcccctc

SEQ ID NO: 3423832 - DNA, 23 bp, Homo sapiens
tgctccagacctgcccctccctc

SEQ ID NO: 3423833 - DNA, 22 bp, Homo sapiens
tgctctaagaagctcgtttctt

SEQ ID NO: 3423834 - DNA, 13 bp, Homo sapiens
tgctctagaaagt

SEQ ID NO: 3423835 - DNA, 17 bp, Homo sapiens
tgctctccttcctggag

SEQ ID NO: 3423836 - DNA, 18 bp, Homo sapiens
tgctctccttcctggagc

SEQ ID NO: 3423837 - DNA, 18 bp, Homo sapiens
tgctgaaagtcctgcttt

SEQ ID NO: 3423838 - DNA, 16 bp, Homo sapiens
tgctgaatgtcattat

SEQ ID NO: 3423839 - DNA, 16 bp, Homo sapiens
tgctgaattgagaata

SEQ ID NO: 3423840 - DNA, 15 bp, Homo sapiens
tgctgcggagcaaga

SEQ ID NO: 3423841 - DNA, 16 bp, Homo sapiens
tgctgcggagcaagag

SEQ ID NO: 3423842 - DNA, 20 bp, Homo sapiens
tgctgcggagcaagaggagg

SEQ ID NO: 3423843 - DNA, 23 bp, Homo sapiens
tgctgcgtcattacagggcacag

SEQ ID NO: 3423844 - DNA, 14 bp, Homo sapiens
tgctgctgcctgcc

SEQ ID NO: 3423845 - DNA, 19 bp, Homo sapiens
tgctggccctgcgctgcct

SEQ ID NO: 3423846 - DNA, 19 bp, Homo sapiens
tgctgtaaatttggcttct

SEQ ID NO: 3423847 - DNA, 13 bp, Homo sapiens
tgctgtatttctt

SEQ ID NO: 3423848 - DNA, 22 bp, Homo sapiens
tgctgttactgcttctctttgt

SEQ ID NO: 3423849 - DNA, 15 bp, Homo sapiens
tgctgttccttactt

SEQ ID NO: 3423850 - DNA, 16 bp, Homo sapiens
tgctgtttatgacaca

SEQ ID NO: 3423851 - DNA, 17 bp, Homo sapiens
tgcttaaaaatcattga

SEQ ID NO: 3423852 - DNA, 18 bp, Homo sapiens
tgcttaaaaatcattgat

SEQ ID NO: 3423853 - DNA, 19 bp, Homo sapiens
tgcttaaaaatcattgatt

SEQ ID NO: 3423854 - DNA, 16 bp, Homo sapiens
tgcttatgtgttgcat

SEQ ID NO: 3423855 - DNA, 14 bp, Homo sapiens
tgcttctctttgtg

SEQ ID NO: 3423856 - DNA, 18 bp, Homo sapiens
tgcttctctttgtgcagt

SEQ ID NO: 3423857 - DNA, 22 bp, Homo sapiens
tgcttctggctttgttcttgtc

SEQ ID NO: 3423858 - DNA, 23 bp, Homo sapiens
tgcttctggctttgttcttgtca

SEQ ID NO: 3423859 - DNA, 15 bp, Homo sapiens
tgcttcttgtaatat

SEQ ID NO: 3423860 - DNA, 20 bp, Homo sapiens
tgcttcttgtaatatttctt

SEQ ID NO: 3423861 - DNA, 20 bp, Homo sapiens
tgctttataccccatttgat

SEQ ID NO: 3423862 - DNA, 21 bp, Homo sapiens
tgctttgcctcgaaagtgtca

SEQ ID NO: 3423863 - DNA, 22 bp, Homo sapiens
tgctttgcctcgaaagtgtcat

SEQ ID NO: 3423864 - DNA, 15 bp, Homo sapiens
tgctttgttgaataa

SEQ ID NO: 3423865 - DNA, 16 bp, Homo sapiens
tgcttttatagttgta

SEQ ID NO: 3423866 - DNA, 14 bp, Homo sapiens
tggaaaagaaatca

SEQ ID NO: 3423867 - DNA, 19 bp, Homo sapiens
tggaaaagaaatcaatttt

SEQ ID NO: 3423868 - DNA, 15 bp, Homo sapiens
tggaaaaggaagact

SEQ ID NO: 3423869 - DNA, 18 bp, Homo sapiens
tggaaaaggaagactaga

SEQ ID NO: 3423870 - DNA, 19 bp, Homo sapiens
tggaaactaccagtgggca

SEQ ID NO: 3423871 - DNA, 22 bp, Homo sapiens
tggaaaggagcctaggccaggt

SEQ ID NO: 3423872 - DNA, 18 bp, Homo sapiens
tggaaaggattctaaaca

SEQ ID NO: 3423873 - DNA, 13 bp, Homo sapiens
tggaacagtgaaa

SEQ ID NO: 3423874 - DNA, 22 bp, Homo sapiens
tggaacagtgaaagtcaattca

SEQ ID NO: 3423875 - DNA, 13 bp, Homo sapiens
tggaactggaggc

SEQ ID NO: 3423876 - DNA, 17 bp, Homo sapiens
tggaactggaggcaggg

SEQ ID NO: 3423877 - DNA, 15 bp, Homo sapiens
tggaagaagtttttt

SEQ ID NO: 3423878 - DNA, 22 bp, Homo sapiens
tggaagaagttttttactttgg

SEQ ID NO: 3423879 - DNA, 14 bp, Homo sapiens
tggaagtgtgggtc

SEQ ID NO: 3423880 - DNA, 20 bp, Homo sapiens
tggaagtgtgggtctgtgtg

SEQ ID NO: 3423881 - DNA, 14 bp, Homo sapiens
tggaatgtcagtgt

SEQ ID NO: 3423882 - DNA, 12 bp, Homo sapiens
tggacagaagaa

SEQ ID NO: 3423883 - DNA, 15 bp, Homo sapiens
tggacatcgatatga

SEQ ID NO: 3423884 - DNA, 16 bp, Homo sapiens
tggacatcgatatgaa

SEQ ID NO: 3423885 - DNA, 22 bp, Homo sapiens
tggaccactcctgaatgagact

SEQ ID NO: 3423886 - DNA, 22 bp, Homo sapiens
tggacccgttcatgggggaggg

SEQ ID NO: 3423887 - DNA, 20 bp, Homo sapiens
tggacctggcggcaggaagc

SEQ ID NO: 3423888 - DNA, 22 bp, Homo sapiens
tggacctttcctgaggaagagg

SEQ ID NO: 3423889 - DNA, 11 bp, Homo sapiens
tggactgaggc

SEQ ID NO: 3423890 - DNA, 14 bp, Homo sapiens
tggactgaggcctg

SEQ ID NO: 3423891 - DNA, 18 bp, Homo sapiens
tggagaagccacaggcct

SEQ ID NO: 3423892 - DNA, 15 bp, Homo sapiens
tggagcccagaggag

SEQ ID NO: 3423893 - DNA, 20 bp, Homo sapiens
tggagcccagaggagggcag

SEQ ID NO: 3423894 - DNA, 23 bp, Homo sapiens
tggagcccagaggagggcagcag

SEQ ID NO: 3423895 - DNA, 12 bp, Homo sapiens
tggagcggctca

SEQ ID NO: 3423896 - DNA, 18 bp, Homo sapiens
tggaggaaggattgtaaa

SEQ ID NO: 3423897 - DNA, 14 bp, Homo sapiens
tggaggagcccagg

SEQ ID NO: 3423898 - DNA, 19 bp, Homo sapiens
tggaggagcccaggccagg

SEQ ID NO: 3423899 - DNA, 19 bp, Homo sapiens
tggaggagctcaggacact

SEQ ID NO: 3423900 - DNA, 15 bp, Homo sapiens
tggataaatttgaac

SEQ ID NO: 3423901 - DNA, 21 bp, Homo sapiens
tggataaatttgaactccatg

SEQ ID NO: 3423902 - DNA, 17 bp, Homo sapiens
tggatatagaaaatctt

SEQ ID NO: 3423903 - DNA, 12 bp, Homo sapiens
tggatggtgact

SEQ ID NO: 3423904 - DNA, 14 bp, Homo sapiens
tggatggtgacttt

SEQ ID NO: 3423905 - DNA, 17 bp, Homo sapiens
tggatggtgacttttga

SEQ ID NO: 3423906 - DNA, 14 bp, Homo sapiens
tggattatttaata

SEQ ID NO: 3423907 - DNA, 15 bp, Homo sapiens
tggattatttaataa

SEQ ID NO: 3423908 - DNA, 20 bp, Homo sapiens
tggattggattatttaataa

SEQ ID NO: 3423909 - DNA, 23 bp, Homo sapiens
tggattggattatttaataacat

SEQ ID NO: 3423910 - DNA, 17 bp, Homo sapiens
tggcaaacatgtgcaac

SEQ ID NO: 3423911 - DNA, 15 bp, Homo sapiens
tggcaaacttttctt

SEQ ID NO: 3423912 - DNA, 20 bp, Homo sapiens
tggcacagcccaaagaagga

SEQ ID NO: 3423913 - DNA, 21 bp, Homo sapiens
tggcagaagacaccagagcag

SEQ ID NO: 3423914 - DNA, 20 bp, Homo sapiens
tggcatgtgggttgtgatat

SEQ ID NO: 3423915 - DNA, 14 bp, Homo sapiens
tggccagtggctgg

SEQ ID NO: 3423916 - DNA, 18 bp, Homo sapiens
tggccatatatgctgtat

SEQ ID NO: 3423917 - DNA, 15 bp, Homo sapiens
ttaggcagattgaaa

SEQ ID NO: 3423918 - DNA, 13 bp, Homo sapiens
ttagtagaactta

SEQ ID NO: 3423919 - DNA, 19 bp, Homo sapiens
ttagtagaacttactgctg

SEQ ID NO: 3423920 - DNA, 16 bp, Homo sapiens
ttagtatatgaaatat

SEQ ID NO: 3423921 - DNA, 20 bp, Homo sapiens
ttagtcattattattacttt

SEQ ID NO: 3423922 - DNA, 20 bp, Homo sapiens
ttataagcgtatttagactg

SEQ ID NO: 3423923 - DNA, 20 bp, Homo sapiens
ttataatgcaatgataaata

SEQ ID NO: 3423924 - DNA, 21 bp, Homo sapiens
ttataatgcaatgataaataa

SEQ ID NO: 3423925 - DNA, 22 bp, Homo sapiens
ttataatgcaatgataaataaa

SEQ ID NO: 3423926 - DNA, 16 bp, Homo sapiens
ttataatgccagaata

SEQ ID NO: 3423927 - DNA, 18 bp, Homo sapiens
ttataatgccagaatata

SEQ ID NO: 3423928 - DNA, 19 bp, Homo sapiens
ttataccatgtgtgctaat

SEQ ID NO: 3423929 - DNA, 17 bp, Homo sapiens
ttatagattgtcttaat

SEQ ID NO: 3423930 - DNA, 16 bp, Homo sapiens
ttatagccgaaatgat

SEQ ID NO: 3423931 - DNA, 18 bp, Homo sapiens
ttatagttgtattttgta

SEQ ID NO: 3423932 - DNA, 15 bp, Homo sapiens
ttatatattgaaagt

SEQ ID NO: 3423933 - DNA, 20 bp, Homo sapiens
ttatattagttgctttgtta

SEQ ID NO: 3423934 - DNA, 14 bp, Homo sapiens
ttatcaacatttgt

SEQ ID NO: 3423935 - DNA, 19 bp, Homo sapiens
ttatcaccaggatttatac

SEQ ID NO: 3423936 - DNA, 13 bp, Homo sapiens
ttatcgaaataac

SEQ ID NO: 3423937 - DNA, 14 bp, Homo sapiens
ttatcgaaataaca

SEQ ID NO: 3423938 - DNA, 21 bp, Homo sapiens
ttatcgaaataacaatgttaa

SEQ ID NO: 3423939 - DNA, 19 bp, Homo sapiens
ttatctcagtcatgcataa

SEQ ID NO: 3423940 - DNA, 18 bp, Homo sapiens
ttatcttacaactccccc

SEQ ID NO: 3423941 - DNA, 22 bp, Homo sapiens
ttatgatattctcattatttca

SEQ ID NO: 3423942 - DNA, 20 bp, Homo sapiens
ttatgatgtgggtcaaggaa

SEQ ID NO: 3423943 - DNA, 13 bp, Homo sapiens
ttatgatttaata

SEQ ID NO: 3423944 - DNA, 15 bp, Homo sapiens
ttatgcaaatgagat

SEQ ID NO: 3423945 - DNA, 22 bp, Homo sapiens
ttatggacatcgatatgaaaaa

SEQ ID NO: 3423946 - DNA, 20 bp, Homo sapiens
ttatgtgttacattattcca

SEQ ID NO: 3423947 - DNA, 19 bp, Homo sapiens
ttattcagctagaatttct

SEQ ID NO: 3423948 - DNA, 21 bp, Homo sapiens
ttattcagctagaatttctgg

SEQ ID NO: 3423949 - DNA, 20 bp, Homo sapiens
ttattgagcaagtatccttc

SEQ ID NO: 3423950 - DNA, 19 bp, Homo sapiens
ttatttaaagcacatgcca

SEQ ID NO: 3423951 - DNA, 15 bp, Homo sapiens
ttatttaataacatt

SEQ ID NO: 3423952 - DNA, 16 bp, Homo sapiens
ttatttatatcttgtt

SEQ ID NO: 3423953 - DNA, 21 bp, Homo sapiens
ttatttgtcggggaagatgaa

SEQ ID NO: 3423954 - DNA, 18 bp, Homo sapiens
ttcaaaatgtctgtagct

SEQ ID NO: 3423955 - DNA, 16 bp, Homo sapiens
ttcaaattggtctgaa

SEQ ID NO: 3423956 - DNA, 22 bp, Homo sapiens
ttcaaatttactgtcttaaatc

SEQ ID NO: 3423957 - DNA, 19 bp, Homo sapiens
ttcaaggctttaaaagtca

SEQ ID NO: 3423958 - DNA, 17 bp, Homo sapiens
ttcaagttaaattttat

SEQ ID NO: 3423959 - DNA, 22 bp, Homo sapiens
ttcaatggtttgcaaggaagcc

SEQ ID NO: 3423960 - DNA, 20 bp, Homo sapiens
ttcaatttactttttaaaca

SEQ ID NO: 3423961 - DNA, 22 bp, Homo sapiens
ttcaatttactttttaaacagt

SEQ ID NO: 3423962 - DNA, 22 bp, Homo sapiens
ttcaatttggagcattaactaa

SEQ ID NO: 3423963 - DNA, 16 bp, Homo sapiens
ttcacagttctgtaat

SEQ ID NO: 3423964 - DNA, 20 bp, Homo sapiens
ttcacagttctgtaatgtag

SEQ ID NO: 3423965 - DNA, 20 bp, Homo sapiens
ttcacatttcaagatccaaa

SEQ ID NO: 3423966 - DNA, 12 bp, Homo sapiens
ttcacccctccc

SEQ ID NO: 3423967 - DNA, 22 bp, Homo sapiens
ttcacccctccctttctcccct

SEQ ID NO: 3423968 - DNA, 19 bp, Homo sapiens
ttcacgtgttttccatccc

SEQ ID NO: 3423969 - DNA, 20 bp, Homo sapiens
ttcacgtgttttccatccca

SEQ ID NO: 3423970 - DNA, 14 bp, Homo sapiens
ttcactcctgctgt

SEQ ID NO: 3423971 - DNA, 12 bp, Homo sapiens
ttcactgtacgt

SEQ ID NO: 3423972 - DNA, 18 bp, Homo sapiens
ttcactgtataaatagga

SEQ ID NO: 3423973 - DNA, 19 bp, Homo sapiens
ttcactgtataaataggag

SEQ ID NO: 3423974 - DNA, 23 bp, Homo sapiens
ttcactgtataaataggagagga

SEQ ID NO: 3423975 - DNA, 12 bp, Homo sapiens
ttcagagtttta

SEQ ID NO: 3423976 - DNA, 20 bp, Homo sapiens
ttcagcatcaaacatgaaaa

SEQ ID NO: 3423977 - DNA, 22 bp, Homo sapiens
ttcagcggcagtgtgtccatca

SEQ ID NO: 3423978 - DNA, 20 bp, Homo sapiens
ttcagctggtggatggtgac

SEQ ID NO: 3423979 - DNA, 15 bp, Homo sapiens
ttcaggatactgtag

SEQ ID NO: 3423980 - DNA, 21 bp, Homo sapiens
ttcaggttatcgaaataacaa

SEQ ID NO: 3423981 - DNA, 24 bp, Homo sapiens
ttcaggttatcgaaataacaatgt

SEQ ID NO: 3423982 - DNA, 18 bp, Homo sapiens
ttcagtattttccagcct

SEQ ID NO: 3423983 - DNA, 20 bp, Homo sapiens
ttcagtgagggtcttcttac

SEQ ID NO: 3423984 - DNA, 21 bp, Homo sapiens
ttcagtgtcgggaattttccc

SEQ ID NO: 3423985 - DNA, 19 bp, Homo sapiens
ttcataaatttgttgtcat

SEQ ID NO: 3423986 - DNA, 23 bp, Homo sapiens
ttcataaatttgttgtcatgtgt

SEQ ID NO: 3423987 - DNA, 14 bp, Homo sapiens
ttcatcaaataaac

SEQ ID NO: 3423988 - DNA, 20 bp, Homo sapiens
ttcatcaaataaaccttgtt

SEQ ID NO: 3423989 - DNA, 17 bp, Homo sapiens
ttcatctatttctgaga

SEQ ID NO: 3423990 - DNA, 17 bp, Homo sapiens
ttcatgtatgtatataa

SEQ ID NO: 3423991 - DNA, 14 bp, Homo sapiens
ttcattggttaaaa

SEQ ID NO: 3423992 - DNA, 22 bp, Homo sapiens
ttccaagacagtatacagtcct

SEQ ID NO: 3423993 - DNA, 13 bp, Homo sapiens
ttccaagagctga

SEQ ID NO: 3423994 - DNA, 15 bp, Homo sapiens
ttccacatcatgtta

SEQ ID NO: 3423995 - DNA, 22 bp, Homo sapiens
ttccagaaagaaaatgaatttg

SEQ ID NO: 3423996 - DNA, 17 bp, Homo sapiens
ttccagccttatgtgtt

SEQ ID NO: 3423997 - DNA, 21 bp, Homo sapiens
ttccagccttatgtgttacat

SEQ ID NO: 3423998 - DNA, 22 bp, Homo sapiens
ttccagccttatgtgttacatt

SEQ ID NO: 3423999 - DNA, 23 bp, Homo sapiens
ttcccctgcaatgcgtcttgtga

SEQ ID NO: 3424000 - DNA, 15 bp, Homo sapiens
ttccctcattctgca

SEQ ID NO: 3424001 - DNA, 16 bp, Homo sapiens
ttccctctcctgtcct

SEQ ID NO: 3424002 - DNA, 18 bp, Homo sapiens
ttcctaacacagcatgtg

SEQ ID NO: 3424003 - DNA, 21 bp, Homo sapiens
ttcctgattaccagtctgatt

SEQ ID NO: 3424004 - DNA, 22 bp, Homo sapiens
ttcctgattaccagtctgatta

SEQ ID NO: 3424005 - DNA, 16 bp, Homo sapiens
ttcctggaataaacat

SEQ ID NO: 3424006 - DNA, 13 bp, Homo sapiens
ttcctgtctgttt

SEQ ID NO: 3424007 - DNA, 15 bp, Homo sapiens
ttcctgtctgtttat

SEQ ID NO: 3424008 - DNA, 17 bp, Homo sapiens
ttcctgtctgtttatat

SEQ ID NO: 3424009 - DNA, 19 bp, Homo sapiens
ttccttctttgataatgtt

SEQ ID NO: 3424010 - DNA, 22 bp, Homo sapiens
ttccttctttgataatgttaaa

SEQ ID NO: 3424011 - DNA, 14 bp, Homo sapiens
ttccttgcttttat

SEQ ID NO: 3424012 - DNA, 23 bp, Homo sapiens
ttcctttaaaaaaatttaagtgc

SEQ ID NO: 3424013 - DNA, 16 bp, Homo sapiens
ttcgtaccgcttcctt

SEQ ID NO: 3424014 - DNA, 20 bp, Homo sapiens
ttctaaatgcatatcctgag

SEQ ID NO: 3424015 - DNA, 23 bp, Homo sapiens
ttctacactgggtgctgatcctt

SEQ ID NO: 3424016 - DNA, 16 bp, Homo sapiens
ttctacttgatatttc

SEQ ID NO: 3424017 - DNA, 15 bp, Homo sapiens
ttctagtggtctttg

SEQ ID NO: 3424018 - DNA, 22 bp, Homo sapiens
ttctagtggtctttgtaagagt

SEQ ID NO: 3424019 - DNA, 21 bp, Homo sapiens
ttctcaaagttttgaaaagct

SEQ ID NO: 3424020 - DNA, 22 bp, Homo sapiens
ttctcagccacaaaccctgcct

SEQ ID NO: 3424021 - DNA, 15 bp, Homo sapiens
ttctcatcctgcagg

SEQ ID NO: 3424022 - DNA, 14 bp, Homo sapiens
ttctcatggatttg

SEQ ID NO: 3424023 - DNA, 17 bp, Homo sapiens
ttctcattatttcatca

SEQ ID NO: 3424024 - DNA, 15 bp, Homo sapiens
ttctcatttcacccc

SEQ ID NO: 3424025 - DNA, 15 bp, Homo sapiens
ttctcccctgccccc

SEQ ID NO: 3424026 - DNA, 12 bp, Homo sapiens
ttctctcatctc

SEQ ID NO: 3424027 - DNA, 15 bp, Homo sapiens
gccttgttgatgtgg

SEQ ID NO: 3424028 - DNA, 23 bp, Homo sapiens
gcctttactgaccctggggctgg

SEQ ID NO: 3424029 - DNA, 20 bp, Homo sapiens
gcctttattgtgtttgtcat

SEQ ID NO: 3424030 - DNA, 13 bp, Homo sapiens
gcctttgaatgta

SEQ ID NO: 3424031 - DNA, 17 bp, Homo sapiens
gcctttgatcaggtggg

SEQ ID NO: 3424032 - DNA, 15 bp, Homo sapiens
gcctttgcctccccg

SEQ ID NO: 3424033 - DNA, 16 bp, Homo sapiens
gccttttgcagaagag

SEQ ID NO: 3424034 - DNA, 21 bp, Homo sapiens
gccttttgggggtgggtctgg

SEQ ID NO: 3424035 - DNA, 23 bp, Homo sapiens
gcctttttcacaattccatttcc

SEQ ID NO: 3424036 - DNA, 10 bp, Homo sapiens
gcgacctcct

SEQ ID NO: 3424037 - DNA, 21 bp, Homo sapiens
gcgacgttagtcgtgagctct

SEQ ID NO: 3424038 - DNA, 17 bp, Homo sapiens
gcgagccctggtggcag

SEQ ID NO: 3424039 - DNA, 20 bp, Homo sapiens
gcgaggagatgctccttggg

SEQ ID NO: 3424040 - DNA, 19 bp, Homo sapiens
gcgaggcccttcctctttg

SEQ ID NO: 3424041 - DNA, 16 bp, Homo sapiens
gcgatccacctgtctc

SEQ ID NO: 3424042 - DNA, 21 bp, Homo sapiens
gcgatccacctgtctcagcct

SEQ ID NO: 3424043 - DNA, 22 bp, Homo sapiens
gcgatgggtcaggtagggggga

SEQ ID NO: 3424044 - DNA, 17 bp, Homo sapiens
gcgattctcctgcctca

SEQ ID NO: 3424045 - DNA, 14 bp, Homo sapiens
gcgattcttctgct

SEQ ID NO: 3424046 - DNA, 15 bp, Homo sapiens
gcgcaaagggcatgg

SEQ ID NO: 3424047 - DNA, 20 bp, Homo sapiens
gcgcacaatagtaacctggg

SEQ ID NO: 3424048 - DNA, 15 bp, Homo sapiens
gcgcagccccatctg

SEQ ID NO: 3424049 - DNA, 19 bp, Homo sapiens
gcgcattctaacctggagg

SEQ ID NO: 3424050 - DNA, 18 bp, Homo sapiens
gcgccaaataatgtctct

SEQ ID NO: 3424051 - DNA, 14 bp, Homo sapiens
gcgccacaggaccc

SEQ ID NO: 3424052 - DNA, 20 bp, Homo sapiens
gcgccaggctgaccacagca

SEQ ID NO: 3424053 - DNA, 23 bp, Homo sapiens
gcgcccagttgggtggatgcctg

SEQ ID NO: 3424054 - DNA, 13 bp, Homo sapiens
gcgcccctagccg

SEQ ID NO: 3424055 - DNA, 13 bp, Homo sapiens
gcgccgtctccag

SEQ ID NO: 3424056 - DNA, 15 bp, Homo sapiens
gcgccgtctccaggg

SEQ ID NO: 3424057 - DNA, 22 bp, Homo sapiens
gcgccgtctccaggggctgctt

SEQ ID NO: 3424058 - DNA, 20 bp, Homo sapiens
gcgcctacaggagtgagcac

SEQ ID NO: 3424059 - DNA, 18 bp, Homo sapiens
gcgcctgcccctcccaga

SEQ ID NO: 3424060 - DNA, 16 bp, Homo sapiens
gcgcctgtgatgctgg

SEQ ID NO: 3424061 - DNA, 16 bp, Homo sapiens
gcgcctttcccaactc

SEQ ID NO: 3424062 - DNA, 14 bp, Homo sapiens
gcgcgcccctagcc

SEQ ID NO: 3424063 - DNA, 22 bp, Homo sapiens
gcgctattgcactccagtctgg

SEQ ID NO: 3424064 - DNA, 13 bp, Homo sapiens
gcgctcagggcca

SEQ ID NO: 3424065 - DNA, 16 bp, Homo sapiens
gcgctgggcacttccc

SEQ ID NO: 3424066 - DNA, 19 bp, Homo sapiens
gcgctgggcacttccctgc

SEQ ID NO: 3424067 - DNA, 15 bp, Homo sapiens
gcggacagccacggc

SEQ ID NO: 3424068 - DNA, 19 bp, Homo sapiens
gcggacagccacggccagg

SEQ ID NO: 3424069 - DNA, 23 bp, Homo sapiens
gcggacagccacggccaggccag

SEQ ID NO: 3424070 - DNA, 12 bp, Homo sapiens
gcggagctggcc

SEQ ID NO: 3424071 - DNA, 17 bp, Homo sapiens
gcggagctggccccgcc

SEQ ID NO: 3424072 - DNA, 21 bp, Homo sapiens
gcggaggtgtggagccgaggc

SEQ ID NO: 3424073 - DNA, 15 bp, Homo sapiens
gcggatggatggaag

SEQ ID NO: 3424074 - DNA, 17 bp, Homo sapiens
gcggcaggactgcagag

SEQ ID NO: 3424075 - DNA, 16 bp, Homo sapiens
gcggcattaaagccat

SEQ ID NO: 3424076 - DNA, 14 bp, Homo sapiens
gcggcgggcggctg

SEQ ID NO: 3424077 - DNA, 16 bp, Homo sapiens
gcggcgtacaggctgg

SEQ ID NO: 3424078 - DNA, 16 bp, Homo sapiens
gcgggcagagggctgg

SEQ ID NO: 3424079 - DNA, 18 bp, Homo sapiens
gcgggcaggttctgcctg

SEQ ID NO: 3424080 - DNA, 19 bp, Homo sapiens
gcgggcggctgggtctgtg

SEQ ID NO: 3424081 - DNA, 12 bp, Homo sapiens
gcggggacagct

SEQ ID NO: 3424082 - DNA, 17 bp, Homo sapiens
gcggggacagctccttc

SEQ ID NO: 3424083 - DNA, 18 bp, Homo sapiens
gcggggacagctccttct

SEQ ID NO: 3424084 - DNA, 15 bp, Homo sapiens
gcggtagccagcaca

SEQ ID NO: 3424085 - DNA, 21 bp, Homo sapiens
gcggtagccagcacacagggc

SEQ ID NO: 3424086 - DNA, 22 bp, Homo sapiens
gcggtagccagcacacagggca

SEQ ID NO: 3424087 - DNA, 23 bp, Homo sapiens
gcggtagccagcacacagggcag

SEQ ID NO: 3424088 - DNA, 16 bp, Homo sapiens
gcggtccacccaggag

SEQ ID NO: 3424089 - DNA, 18 bp, Homo sapiens
gcggtccacccaggagcc

SEQ ID NO: 3424090 - DNA, 19 bp, Homo sapiens
gcggtcccctccgccaggc

SEQ ID NO: 3424091 - DNA, 19 bp, Homo sapiens
gcggtgagaggggaacaga

SEQ ID NO: 3424092 - DNA, 15 bp, Homo sapiens
gcggtgccatgtctg

SEQ ID NO: 3424093 - DNA, 21 bp, Homo sapiens
gcggtgccatgtctgcagtgt

SEQ ID NO: 3424094 - DNA, 17 bp, Homo sapiens
gcggtgcttgatagaaa

SEQ ID NO: 3424095 - DNA, 18 bp, Homo sapiens
gcggtgggcacccaccct

SEQ ID NO: 3424096 - DNA, 13 bp, Homo sapiens
gcgtacacagaga

SEQ ID NO: 3424097 - DNA, 17 bp, Homo sapiens
gcgtctgttcccccttc

SEQ ID NO: 3424098 - DNA, 15 bp, Homo sapiens
gcgtgatcaaagcca

SEQ ID NO: 3424099 - DNA, 18 bp, Homo sapiens
gcgtgcacacaccagagc

SEQ ID NO: 3424100 - DNA, 19 bp, Homo sapiens
gcgtgcacacaccagagcc

SEQ ID NO: 3424101 - DNA, 14 bp, Homo sapiens
gcgtggacaggtgt

SEQ ID NO: 3424102 - DNA, 16 bp, Homo sapiens
gcgtggagctgcctga

SEQ ID NO: 3424103 - DNA, 17 bp, Homo sapiens
gcgttccatgatgctgg

SEQ ID NO: 3424104 - DNA, 18 bp, Homo sapiens
gcgttccatgatgctggg

SEQ ID NO: 3424105 - DNA, 14 bp, Homo sapiens
gcgttggtctctgc

SEQ ID NO: 3424106 - DNA, 14 bp, Homo sapiens
gcgttgtaaaatat

SEQ ID NO: 3424107 - DNA, 19 bp, Homo sapiens
gcgttgtaaaatatagctg

SEQ ID NO: 3424108 - DNA, 22 bp, Homo sapiens
gcgtttgaccttttatgtagta

SEQ ID NO: 3424109 - DNA, 14 bp, Homo sapiens
gctaaaaagcaaca

SEQ ID NO: 3424110 - DNA, 20 bp, Homo sapiens
gctaaaatagaatatagcat

SEQ ID NO: 3424111 - DNA, 17 bp, Homo sapiens
gctaaagcaatatgcat

SEQ ID NO: 3424112 - DNA, 16 bp, Homo sapiens
gctaacaccagacaga

SEQ ID NO: 3424113 - DNA, 14 bp, Homo sapiens
gctaactgtaaatc

SEQ ID NO: 3424114 - DNA, 16 bp, Homo sapiens
gctaagaacctggaac

SEQ ID NO: 3424115 - DNA, 19 bp, Homo sapiens
gctaagagtgtcctaggag

SEQ ID NO: 3424116 - DNA, 18 bp, Homo sapiens
gctaagccccagcaagca

SEQ ID NO: 3424117 - DNA, 20 bp, Homo sapiens
gctaagccccagcaagcaat

SEQ ID NO: 3424118 - DNA, 18 bp, Homo sapiens
gctaaggcgtggagctgc

SEQ ID NO: 3424119 - DNA, 20 bp, Homo sapiens
gctaaggcgtggagctgcct

SEQ ID NO: 3424120 - DNA, 17 bp, Homo sapiens
gctaatacccagagcac

SEQ ID NO: 3424121 - DNA, 20 bp, Homo sapiens
gctaatatcaatagaaggat

SEQ ID NO: 3424122 - DNA, 13 bp, Homo sapiens
gctaatgaccaac

SEQ ID NO: 3424123 - DNA, 22 bp, Homo sapiens
gctaatgttgctggatcaggaa

SEQ ID NO: 3424124 - DNA, 15 bp, Homo sapiens
gctaatttaaagaga

SEQ ID NO: 3424125 - DNA, 15 bp, Homo sapiens
gctaatttgcattaa

SEQ ID NO: 3424126 - DNA, 17 bp, Homo sapiens
gctaatttttacttttt

SEQ ID NO: 3424127 - DNA, 19 bp, Homo sapiens
gctacacccttttccagct

SEQ ID NO: 3424128 - DNA, 15 bp, Homo sapiens
gctacacctttctcc

SEQ ID NO: 3424129 - DNA, 21 bp, Homo sapiens
gctaccaacttgtatccaggc

SEQ ID NO: 3424130 - DNA, 20 bp, Homo sapiens
gctaccattttacatttcta

SEQ ID NO: 3424131 - DNA, 13 bp, Homo sapiens
gctaccccaccca

SEQ ID NO: 3424132 - DNA, 14 bp, Homo sapiens
gctaccctgagctg

SEQ ID NO: 3424133 - DNA, 15 bp, Homo sapiens
gctacctctctgtcc

SEQ ID NO: 3424134 - DNA, 17 bp, Homo sapiens
gctacgcctcttctgtc

SEQ ID NO: 3424135 - DNA, 12 bp, Homo sapiens
gctacgcctgca

SEQ ID NO: 3424136 - DNA, 22 bp, Homo sapiens
gctactctccccacgagggctg

SEQ ID NO: 3424137 - DNA, 17 bp, Homo sapiens
gctactctgttccttca

SEQ ID NO: 3424138 - DNA, 15 bp, Homo sapiens
gctactgtgtgtgtg

SEQ ID NO: 3424139 - DNA, 15 bp, Homo sapiens
gctacttggtttgtg

SEQ ID NO: 3424140 - DNA, 18 bp, Homo sapiens
gctagccagaggactgtg

SEQ ID NO: 3424141 - DNA, 17 bp, Homo sapiens
gctaggagaagggctga

SEQ ID NO: 3424142 - DNA, 16 bp, Homo sapiens
gctaggcctggccaga

SEQ ID NO: 3424143 - DNA, 18 bp, Homo sapiens
gctagtcaagctcctcct

SEQ ID NO: 3424144 - DNA, 19 bp, Homo sapiens
gctagtcaagctcctcctc

SEQ ID NO: 3424145 - DNA, 23 bp, Homo sapiens
gctagtcaagctcctcctccctg

SEQ ID NO: 3424146 - DNA, 17 bp, Homo sapiens
gctagtggctcttctca

SEQ ID NO: 3424147 - DNA, 22 bp, Homo sapiens
gctagtgtacctcctctcagtg

SEQ ID NO: 3424148 - DNA, 14 bp, Homo sapiens
gctatagtatttga

SEQ ID NO: 3424149 - DNA, 19 bp, Homo sapiens
gctatattgcccaggctgg

SEQ ID NO: 3424150 - DNA, 21 bp, Homo sapiens
gctatctgcctgacaggctgt

SEQ ID NO: 3424151 - DNA, 23 bp, Homo sapiens
gctatgacatggaggcactgaag

SEQ ID NO: 3424152 - DNA, 18 bp, Homo sapiens
gctatgttctgtcttccc

SEQ ID NO: 3424153 - DNA, 21 bp, Homo sapiens
gctatgttctgtcttcccaaa

SEQ ID NO: 3424154 - DNA, 14 bp, Homo sapiens
gctattgcactcca

SEQ ID NO: 3424155 - DNA, 18 bp, Homo sapiens
gctattgcactccagtct

SEQ ID NO: 3424156 - DNA, 16 bp, Homo sapiens
gctattggaggatcag

SEQ ID NO: 3424157 - DNA, 12 bp, Homo sapiens
gctcaaaggcac

SEQ ID NO: 3424158 - DNA, 21 bp, Homo sapiens
gctcaaaggcacagtgaaggc

SEQ ID NO: 3424159 - DNA, 16 bp, Homo sapiens
cctgcccccaatccat

SEQ ID NO: 3424160 - DNA, 20 bp, Homo sapiens
cctgcccccaggactgggcc

SEQ ID NO: 3424161 - DNA, 15 bp, Homo sapiens
cctgcccctcccaga

SEQ ID NO: 3424162 - DNA, 16 bp, Homo sapiens
cctgccccttccttta

SEQ ID NO: 3424163 - DNA, 18 bp, Homo sapiens
cctgcccgcagacctctg

SEQ ID NO: 3424164 - DNA, 21 bp, Homo sapiens
cctgcccgtaaacacgcctgc

SEQ ID NO: 3424165 - DNA, 22 bp, Homo sapiens
cctgcccgtaaacacgcctgca

SEQ ID NO: 3424166 - DNA, 13 bp, Homo sapiens
cctgccctcccct

SEQ ID NO: 3424167 - DNA, 13 bp, Homo sapiens
cctgcccttggca

SEQ ID NO: 3424168 - DNA, 14 bp, Homo sapiens
cctgccgcagagct

SEQ ID NO: 3424169 - DNA, 21 bp, Homo sapiens
cctgccgggctgagggcctgc

SEQ ID NO: 3424170 - DNA, 22 bp, Homo sapiens
cctgccggtaaacacgcctgca

SEQ ID NO: 3424171 - DNA, 23 bp, Homo sapiens
cctgccggtaaacacgcctgcaa

SEQ ID NO: 3424172 - DNA, 12 bp, Homo sapiens
cctgcctcagcc

SEQ ID NO: 3424173 - DNA, 14 bp, Homo sapiens
cctgcctccaggaa

SEQ ID NO: 3424174 - DNA, 15 bp, Homo sapiens
cctgcctccaggaac

SEQ ID NO: 3424175 - DNA, 15 bp, Homo sapiens
cctgcctccagggct

SEQ ID NO: 3424176 - DNA, 23 bp, Homo sapiens
cctgcctccagggctggactgag

SEQ ID NO: 3424177 - DNA, 17 bp, Homo sapiens
cctgcctcctactccag

SEQ ID NO: 3424178 - DNA, 21 bp, Homo sapiens
cctgcctcgaactggctgcaa

SEQ ID NO: 3424179 - DNA, 23 bp, Homo sapiens
cctgcctcgaactggctgcaaag

SEQ ID NO: 3424180 - DNA, 14 bp, Homo sapiens
cctgcctggcaggc

SEQ ID NO: 3424181 - DNA, 13 bp, Homo sapiens
cctgcctgtctgc

SEQ ID NO: 3424182 - DNA, 23 bp, Homo sapiens
cctgcctgtggcgccgtctccag

SEQ ID NO: 3424183 - DNA, 22 bp, Homo sapiens
cctgccttcctcctgggccctc

SEQ ID NO: 3424184 - DNA, 18 bp, Homo sapiens
cctgcgcccagtccttcc

SEQ ID NO: 3424185 - DNA, 22 bp, Homo sapiens
cctgcgcccagtccttccacct

SEQ ID NO: 3424186 - DNA, 18 bp, Homo sapiens
cctgcgcctgctgcatgc

SEQ ID NO: 3424187 - DNA, 18 bp, Homo sapiens
cctgcggagccggcacct

SEQ ID NO: 3424188 - DNA, 21 bp, Homo sapiens
cctgcggcaggactgcagagc

SEQ ID NO: 3424189 - DNA, 17 bp, Homo sapiens
cctgctaattccccaga

SEQ ID NO: 3424190 - DNA, 11 bp, Homo sapiens
cctgctccaga

SEQ ID NO: 3424191 - DNA, 14 bp, Homo sapiens
cctgctccagacct

SEQ ID NO: 3424192 - DNA, 22 bp, Homo sapiens
cctgctctccgaccagacacct

SEQ ID NO: 3424193 - DNA, 15 bp, Homo sapiens
cctgctgctgcctgc

SEQ ID NO: 3424194 - DNA, 19 bp, Homo sapiens
cctgctgctgtcacctctc

SEQ ID NO: 3424195 - DNA, 22 bp, Homo sapiens
cctgctgctgtcacctctccca

SEQ ID NO: 3424196 - DNA, 15 bp, Homo sapiens
cctgctgcttctcca

SEQ ID NO: 3424197 - DNA, 13 bp, Homo sapiens
cctgctggaggcc

SEQ ID NO: 3424198 - DNA, 14 bp, Homo sapiens
cctgctggaggcct

SEQ ID NO: 3424199 - DNA, 17 bp, Homo sapiens
cctgctggaggcctcag

SEQ ID NO: 3424200 - DNA, 18 bp, Homo sapiens
cctgctggaggcctcagg

SEQ ID NO: 3424201 - DNA, 19 bp, Homo sapiens
cctgctggttcagggttgg

SEQ ID NO: 3424202 - DNA, 15 bp, Homo sapiens
cctgctgtctctctg

SEQ ID NO: 3424203 - DNA, 16 bp, Homo sapiens
cctgctgtctctctgg

SEQ ID NO: 3424204 - DNA, 18 bp, Homo sapiens
cctgctgtctctctgggc

SEQ ID NO: 3424205 - DNA, 22 bp, Homo sapiens
cctgcttgatgggattctggac

SEQ ID NO: 3424206 - DNA, 13 bp, Homo sapiens
cctggaacttggg

SEQ ID NO: 3424207 - DNA, 13 bp, Homo sapiens
cctggaagacaga

SEQ ID NO: 3424208 - DNA, 16 bp, Homo sapiens
cctggaagagcccagt

SEQ ID NO: 3424209 - DNA, 18 bp, Homo sapiens
cctggaagagcccagtct

SEQ ID NO: 3424210 - DNA, 13 bp, Homo sapiens
cctggacacaggc

SEQ ID NO: 3424211 - DNA, 16 bp, Homo sapiens
cctggacacaggcctg

SEQ ID NO: 3424212 - DNA, 21 bp, Homo sapiens
cctggacatgaagattctttc

SEQ ID NO: 3424213 - DNA, 17 bp, Homo sapiens
cctggacatgcctgtcc

SEQ ID NO: 3424214 - DNA, 19 bp, Homo sapiens
cctggacatgcctgtcctg

SEQ ID NO: 3424215 - DNA, 15 bp, Homo sapiens
cctggactagaggga

SEQ ID NO: 3424216 - DNA, 22 bp, Homo sapiens
cctggactagagggacctctcc

SEQ ID NO: 3424217 - DNA, 21 bp, Homo sapiens
cctggagatcctcctgcagac

SEQ ID NO: 3424218 - DNA, 21 bp, Homo sapiens
cctggagcaatcacagatgag

SEQ ID NO: 3424219 - DNA, 17 bp, Homo sapiens
cctggagcccagaggag

SEQ ID NO: 3424220 - DNA, 17 bp, Homo sapiens
cctggagccctccgcct

SEQ ID NO: 3424221 - DNA, 21 bp, Homo sapiens
cctggagccctccgccttcac

SEQ ID NO: 3424222 - DNA, 16 bp, Homo sapiens
cctggaggatttcatc

SEQ ID NO: 3424223 - DNA, 16 bp, Homo sapiens
cctggaggcccagttc

SEQ ID NO: 3424224 - DNA, 16 bp, Homo sapiens
cctggaggctgcctcc

SEQ ID NO: 3424225 - DNA, 18 bp, Homo sapiens
cctggaggctgcctccca

SEQ ID NO: 3424226 - DNA, 19 bp, Homo sapiens
cctggaggctgcctcccaa

SEQ ID NO: 3424227 - DNA, 12 bp, Homo sapiens
cctggatgtttg

SEQ ID NO: 3424228 - DNA, 23 bp, Homo sapiens
ccttgagttgattcagctctgca

SEQ ID NO: 3424229 - DNA, 13 bp, Homo sapiens
ccttgatgactgc

SEQ ID NO: 3424230 - DNA, 16 bp, Homo sapiens
ccttgatgactgcctt

SEQ ID NO: 3424231 - DNA, 23 bp, Homo sapiens
ccttgattgttcgggtgtgcaat

SEQ ID NO: 3424232 - DNA, 12 bp, Homo sapiens
ccttgccagaga

SEQ ID NO: 3424233 - DNA, 16 bp, Homo sapiens
ccttgccagagatcca

SEQ ID NO: 3424234 - DNA, 18 bp, Homo sapiens
ccttgccatccattctgg

SEQ ID NO: 3424235 - DNA, 13 bp, Homo sapiens
ccttgcctggcct

SEQ ID NO: 3424236 - DNA, 19 bp, Homo sapiens
ccttgcctttcgaggcctg

SEQ ID NO: 3424237 - DNA, 20 bp, Homo sapiens
ccttgcttcttactgataat

SEQ ID NO: 3424238 - DNA, 13 bp, Homo sapiens
ccttgcttttgct

SEQ ID NO: 3424239 - DNA, 13 bp, Homo sapiens
ccttggaggacag

SEQ ID NO: 3424240 - DNA, 18 bp, Homo sapiens
ccttggaggacagtggga

SEQ ID NO: 3424241 - DNA, 16 bp, Homo sapiens
ccttggaggccagcca

SEQ ID NO: 3424242 - DNA, 13 bp, Homo sapiens
ccttggcctgggc

SEQ ID NO: 3424243 - DNA, 12 bp, Homo sapiens
ccttggccttct

SEQ ID NO: 3424244 - DNA, 14 bp, Homo sapiens
ccttggccttctcc

SEQ ID NO: 3424245 - DNA, 22 bp, Homo sapiens
ccttggctcaagtcctcttttc

SEQ ID NO: 3424246 - DNA, 12 bp, Homo sapiens
ccttggctggtg

SEQ ID NO: 3424247 - DNA, 16 bp, Homo sapiens
ccttggcttgcccacg

SEQ ID NO: 3424248 - DNA, 18 bp, Homo sapiens
ccttggcttgcccacgtg

SEQ ID NO: 3424249 - DNA, 13 bp, Homo sapiens
ccttggcttgtta

SEQ ID NO: 3424250 - DNA, 20 bp, Homo sapiens
ccttgggaggccccactggg

SEQ ID NO: 3424251 - DNA, 14 bp, Homo sapiens
ccttgggccctttg

SEQ ID NO: 3424252 - DNA, 17 bp, Homo sapiens
ccttgggccctttgagt

SEQ ID NO: 3424253 - DNA, 14 bp, Homo sapiens
ccttggggcaggca

SEQ ID NO: 3424254 - DNA, 21 bp, Homo sapiens
ccttggggccttgatgactgc

SEQ ID NO: 3424255 - DNA, 12 bp, Homo sapiens
ccttgtctctgg

SEQ ID NO: 3424256 - DNA, 18 bp, Homo sapiens
ccttgttacttctgaggt

SEQ ID NO: 3424257 - DNA, 21 bp, Homo sapiens
ccttgttatttctcagacttt

SEQ ID NO: 3424258 - DNA, 20 bp, Homo sapiens
ccttgttgtaaaaagcccag

SEQ ID NO: 3424259 - DNA, 15 bp, Homo sapiens
cctttaaaaaagaaa

SEQ ID NO: 3424260 - DNA, 12 bp, Homo sapiens
cctttaaaattt

SEQ ID NO: 3424261 - DNA, 20 bp, Homo sapiens
cctttaaaatttttttagaa

SEQ ID NO: 3424262 - DNA, 19 bp, Homo sapiens
cctttacggacaccccctc

SEQ ID NO: 3424263 - DNA, 19 bp, Homo sapiens
cctttacgtgtttaaaaaa

SEQ ID NO: 3424264 - DNA, 16 bp, Homo sapiens
cctttactgaccctgg

SEQ ID NO: 3424265 - DNA, 14 bp, Homo sapiens
cctttagaaaatat

SEQ ID NO: 3424266 - DNA, 16 bp, Homo sapiens
cctttagaaaatataa

SEQ ID NO: 3424267 - DNA, 16 bp, Homo sapiens
cctttagcccctccca

SEQ ID NO: 3424268 - DNA, 14 bp, Homo sapiens
cctttagcgcccag

SEQ ID NO: 3424269 - DNA, 17 bp, Homo sapiens
cctttcaccccagggcc

SEQ ID NO: 3424270 - DNA, 19 bp, Homo sapiens
cctttcaccccagggcctg

SEQ ID NO: 3424271 - DNA, 12 bp, Homo sapiens
cctttccaaaga

SEQ ID NO: 3424272 - DNA, 19 bp, Homo sapiens
cctttccaccacagccagc

SEQ ID NO: 3424273 - DNA, 23 bp, Homo sapiens
cctttccaccacagccagcacct

SEQ ID NO: 3424274 - DNA, 14 bp, Homo sapiens
cctttcctacattt

SEQ ID NO: 3424275 - DNA, 15 bp, Homo sapiens
cctttcctgtcccac

SEQ ID NO: 3424276 - DNA, 14 bp, Homo sapiens
cctttctagagcac

SEQ ID NO: 3424277 - DNA, 17 bp, Homo sapiens
cctttgaatgtaaccaa

SEQ ID NO: 3424278 - DNA, 22 bp, Homo sapiens
cctttgagtgcagtcctgatca

SEQ ID NO: 3424279 - DNA, 18 bp, Homo sapiens
cctttgctgtcccatagt

SEQ ID NO: 3424280 - DNA, 15 bp, Homo sapiens
cctttggagatgctg

SEQ ID NO: 3424281 - DNA, 11 bp, Homo sapiens
cctttggcttc

SEQ ID NO: 3424282 - DNA, 20 bp, Homo sapiens
cctttggttctggccagaat

SEQ ID NO: 3424283 - DNA, 16 bp, Homo sapiens
cctttgtacagcccag

SEQ ID NO: 3424284 - DNA, 13 bp, Homo sapiens
cctttgtgaatat

SEQ ID NO: 3424285 - DNA, 22 bp, Homo sapiens
ccttttataggtgagaaaaaaa

SEQ ID NO: 3424286 - DNA, 22 bp, Homo sapiens
ttaacgtattagttgccaatat

SEQ ID NO: 3424287 - DNA, 17 bp, Homo sapiens
ttaacgtcatctcaggg

SEQ ID NO: 3424288 - DNA, 23 bp, Homo sapiens
ttaactccctttttacactttat

SEQ ID NO: 3424289 - DNA, 12 bp, Homo sapiens
ttaacttctgcc

SEQ ID NO: 3424290 - DNA, 16 bp, Homo sapiens
ttaacttcttcataat

SEQ ID NO: 3424291 - DNA, 14 bp, Homo sapiens
ttaagaaaatcata

SEQ ID NO: 3424292 - DNA, 18 bp, Homo sapiens
ttaagaaattttgccttt

SEQ ID NO: 3424293 - DNA, 14 bp, Homo sapiens
ttaagaaggcaaaa

SEQ ID NO: 3424294 - DNA, 23 bp, Homo sapiens
ttaagagcagaacagatctttta

SEQ ID NO: 3424295 - DNA, 13 bp, Homo sapiens
ttaagaggcaggg

SEQ ID NO: 3424296 - DNA, 16 bp, Homo sapiens
ttaagaggcagggtct

SEQ ID NO: 3424297 - DNA, 16 bp, Homo sapiens
ttaagatacaaatggt

SEQ ID NO: 3424298 - DNA, 22 bp, Homo sapiens
ttaagatggtaagacctctgag

SEQ ID NO: 3424299 - DNA, 22 bp, Homo sapiens
ttaagcagctaaattttctgaa

SEQ ID NO: 3424300 - DNA, 17 bp, Homo sapiens
ttaagcctgaagagctt

SEQ ID NO: 3424301 - DNA, 21 bp, Homo sapiens
ttaagctgttcctgttcagta

SEQ ID NO: 3424302 - DNA, 14 bp, Homo sapiens
ttaagcttctattt

SEQ ID NO: 3424303 - DNA, 21 bp, Homo sapiens
ttaaggaagacaatgtgaaaa

SEQ ID NO: 3424304 - DNA, 17 bp, Homo sapiens
ttaaggtgtagccacac

SEQ ID NO: 3424305 - DNA, 20 bp, Homo sapiens
ttaagtttccttccagccca

SEQ ID NO: 3424306 - DNA, 21 bp, Homo sapiens
ttaagtttccttccagcccag

SEQ ID NO: 3424307 - DNA, 11 bp, Homo sapiens
ttaataaaaag

SEQ ID NO: 3424308 - DNA, 18 bp, Homo sapiens
ttaataatatacttgtgg

SEQ ID NO: 3424309 - DNA, 15 bp, Homo sapiens
ttaatagtaatttgt

SEQ ID NO: 3424310 - DNA, 23 bp, Homo sapiens
ttaatataaagtagtcctgtgaa

SEQ ID NO: 3424311 - DNA, 14 bp, Homo sapiens
ttaatatgaaaact

SEQ ID NO: 3424312 - DNA, 19 bp, Homo sapiens
ttaatattttttcttttcc

SEQ ID NO: 3424313 - DNA, 13 bp, Homo sapiens
ttaatcattttca

SEQ ID NO: 3424314 - DNA, 19 bp, Homo sapiens
ttaatcattttcattccta

SEQ ID NO: 3424315 - DNA, 18 bp, Homo sapiens
ttaatgaagtttgaatgt

SEQ ID NO: 3424316 - DNA, 18 bp, Homo sapiens
ttaatgcatctagattat

SEQ ID NO: 3424317 - DNA, 23 bp, Homo sapiens
ttaatgccgatatactctagatg

SEQ ID NO: 3424318 - DNA, 14 bp, Homo sapiens
ttaatgctatttga

SEQ ID NO: 3424319 - DNA, 20 bp, Homo sapiens
ttaatgctatttgaacaagt

SEQ ID NO: 3424320 - DNA, 14 bp, Homo sapiens
ttaatgcttaagat

SEQ ID NO: 3424321 - DNA, 22 bp, Homo sapiens
ttaatgtcaattcttgccaaat

SEQ ID NO: 3424322 - DNA, 16 bp, Homo sapiens
ttaatgtggttgaaga

SEQ ID NO: 3424323 - DNA, 23 bp, Homo sapiens
ttaatgttttaaatgtacagaca

SEQ ID NO: 3424324 - DNA, 13 bp, Homo sapiens
ttaattcatgttt

SEQ ID NO: 3424325 - DNA, 13 bp, Homo sapiens
ttaattctgtctt

SEQ ID NO: 3424326 - DNA, 12 bp, Homo sapiens
ttaattgctttg

SEQ ID NO: 3424327 - DNA, 13 bp, Homo sapiens
ttaattgctttga

SEQ ID NO: 3424328 - DNA, 12 bp, Homo sapiens
ttaatttagata

SEQ ID NO: 3424329 - DNA, 22 bp, Homo sapiens
ttaatttagatattttccatat

SEQ ID NO: 3424330 - DNA, 17 bp, Homo sapiens
ttaatttagtaaatgtt

SEQ ID NO: 3424331 - DNA, 14 bp, Homo sapiens
ttaatttgtattga

SEQ ID NO: 3424332 - DNA, 19 bp, Homo sapiens
ttaatttttacatggagaa

SEQ ID NO: 3424333 - DNA, 14 bp, Homo sapiens
ttacaaaaacactt

SEQ ID NO: 3424334 - DNA, 18 bp, Homo sapiens
ttacaaaactacatgaga

SEQ ID NO: 3424335 - DNA, 20 bp, Homo sapiens
ttacaaaactacatgagaac

SEQ ID NO: 3424336 - DNA, 14 bp, Homo sapiens
ttacaaagtgtgta

SEQ ID NO: 3424337 - DNA, 15 bp, Homo sapiens
ttacaaagtgtgtat

SEQ ID NO: 3424338 - DNA, 17 bp, Homo sapiens
ttacaagcccccccttc

SEQ ID NO: 3424339 - DNA, 16 bp, Homo sapiens
ttacaatgttcatccc

SEQ ID NO: 3424340 - DNA, 13 bp, Homo sapiens
ttacaatttacaa

SEQ ID NO: 3424341 - DNA, 22 bp, Homo sapiens
ttacacaatggtttttaaattt

SEQ ID NO: 3424342 - DNA, 18 bp, Homo sapiens
ttacacagaaatgctgct

SEQ ID NO: 3424343 - DNA, 14 bp, Homo sapiens
ttacactttatggt

SEQ ID NO: 3424344 - DNA, 20 bp, Homo sapiens
ttacagctgggtggcactgc

SEQ ID NO: 3424345 - DNA, 17 bp, Homo sapiens
ttacaggatattccaaa

SEQ ID NO: 3424346 - DNA, 19 bp, Homo sapiens
ttacaggatattccaaaat

SEQ ID NO: 3424347 - DNA, 20 bp, Homo sapiens
ttacaggatattccaaaata

SEQ ID NO: 3424348 - DNA, 14 bp, Homo sapiens
ttacaggtgtgaac

SEQ ID NO: 3424349 - DNA, 19 bp, Homo sapiens
ttacaggtgtgcaccacca

SEQ ID NO: 3424350 - DNA, 21 bp, Homo sapiens
ttacagtaaagtatagaaata

SEQ ID NO: 3424351 - DNA, 17 bp, Homo sapiens
ttacagtaggagcccag

SEQ ID NO: 3424352 - DNA, 17 bp, Homo sapiens
ttacagtatgcttgctc

SEQ ID NO: 3424353 - DNA, 14 bp, Homo sapiens
ttacagtgcagtgc

SEQ ID NO: 3424354 - DNA, 23 bp, Homo sapiens
ttacatggagaaaaccaaaatga

SEQ ID NO: 3424355 - DNA, 15 bp, Homo sapiens
ttacatgtaatttga

SEQ ID NO: 3424356 - DNA, 12 bp, Homo sapiens
ttacatgttttc

SEQ ID NO: 3424357 - DNA, 12 bp, Homo sapiens
ttaccaaaaatt

SEQ ID NO: 3424358 - DNA, 16 bp, Homo sapiens
ttaccaaagtgtcttt

SEQ ID NO: 3424359 - DNA, 13 bp, Homo sapiens
ttaccatgtaaat

SEQ ID NO: 3424360 - DNA, 19 bp, Homo sapiens
ttaccatgtaaataatctg

SEQ ID NO: 3424361 - DNA, 23 bp, Homo sapiens
ttaccattttggggtacccactg

SEQ ID NO: 3424362 - DNA, 18 bp, Homo sapiens
ttacccactcggtcccag

SEQ ID NO: 3424363 - DNA, 20 bp, Homo sapiens
ttacccagggtggagtgcag

SEQ ID NO: 3424364 - DNA, 16 bp, Homo sapiens
ttaccgagagccaaac

SEQ ID NO: 3424365 - DNA, 19 bp, Homo sapiens
ttaccgagagccaaacaga

SEQ ID NO: 3424366 - DNA, 21 bp, Homo sapiens
ttaccgcgttgtaaaatatag

SEQ ID NO: 3424367 - DNA, 11 bp, Homo sapiens
ttacctcctga

SEQ ID NO: 3424368 - DNA, 12 bp, Homo sapiens
ttaccttcctga

SEQ ID NO: 3424369 - DNA, 16 bp, Homo sapiens
ttacgctttgattcat

SEQ ID NO: 3424370 - DNA, 16 bp, Homo sapiens
ttacggacaccccctc

SEQ ID NO: 3424371 - DNA, 12 bp, Homo sapiens
ttactagaaatg

SEQ ID NO: 3424372 - DNA, 18 bp, Homo sapiens
ttactagaaatgggaatc

SEQ ID NO: 3424373 - DNA, 23 bp, Homo sapiens
ttactagaaatgggaatcatggc

SEQ ID NO: 3424374 - DNA, 13 bp, Homo sapiens
ttactattaaaat

SEQ ID NO: 3424375 - DNA, 16 bp, Homo sapiens
ttactattaacatgat

SEQ ID NO: 3424376 - DNA, 20 bp, Homo sapiens
ttactattaacatgatgtac

SEQ ID NO: 3424377 - DNA, 15 bp, Homo sapiens
ttactcctcacactt

SEQ ID NO: 3424378 - DNA, 13 bp, Homo sapiens
ttactccttctgt

SEQ ID NO: 3424379 - DNA, 16 bp, Homo sapiens
ttactgaagcctttct

SEQ ID NO: 3424380 - DNA, 19 bp, Homo sapiens
ttactgaaggtaaaattga

SEQ ID NO: 3424381 - DNA, 15 bp, Homo sapiens
ttactgcttcatttt

SEQ ID NO: 3424382 - DNA, 23 bp, Homo sapiens
ttactgggtttgtttttcaaagc

SEQ ID NO: 3424383 - DNA, 15 bp, Homo sapiens
ttactgtaattcctc

SEQ ID NO: 3424384 - DNA, 16 bp, Homo sapiens
ttactgtagcctcaga

SEQ ID NO: 3424385 - DNA, 24 bp, Homo sapiens
ttactgttgtacaatcatgttctg

SEQ ID NO: 3424386 - DNA, 21 bp, Homo sapiens
ttacttaaaccgccaaggctg

SEQ ID NO: 3424387 - DNA, 18 bp, Homo sapiens
ttacttctctataaaaaa

SEQ ID NO: 3424388 - DNA, 14 bp, Homo sapiens
ttactttgtgttca

SEQ ID NO: 3424389 - DNA, 19 bp, Homo sapiens
ttactttttcttgtattca

SEQ ID NO: 3424390 - DNA, 20 bp, Homo sapiens
ttagaaaaagaacatgcagt

SEQ ID NO: 3424391 - DNA, 22 bp, Homo sapiens
ttagaaaaagaacatgcagttt

SEQ ID NO: 3424392 - DNA, 16 bp, Homo sapiens
ttagaaagcatttgaa

SEQ ID NO: 3424393 - DNA, 19 bp, Homo sapiens
ttagaaagcatttgaatgc

SEQ ID NO: 3424394 - DNA, 23 bp, Homo sapiens
ttagaaagcatttgaatgcattt

SEQ ID NO: 3424395 - DNA, 22 bp, Homo sapiens
ttagaaagtaagagctctaagt

SEQ ID NO: 3424396 - DNA, 17 bp, Homo sapiens
ttagaaatttatttcct

SEQ ID NO: 3424397 - DNA, 16 bp, Homo sapiens
ttagaagtcacacagt

SEQ ID NO: 3424398 - DNA, 18 bp, Homo sapiens
ttagaatccaaacttgga

SEQ ID NO: 3424399 - DNA, 21 bp, Homo sapiens
ttagaatccacgtattcccct

SEQ ID NO: 3424400 - DNA, 17 bp, Homo sapiens
ttagaattaaaaaagca

SEQ ID NO: 3424401 - DNA, 18 bp, Homo sapiens
ttagactaaggccattat

SEQ ID NO: 3424402 - DNA, 20 bp, Homo sapiens
ttagactgttggggtgggta

SEQ ID NO: 3424403 - DNA, 21 bp, Homo sapiens
ttagagctgacacaaacctgc

SEQ ID NO: 3424404 - DNA, 20 bp, Homo sapiens
ttagagtcctagttttccta

SEQ ID NO: 3424405 - DNA, 19 bp, Homo sapiens
ttagatattttccatatat

SEQ ID NO: 3424406 - DNA, 23 bp, Homo sapiens
ttagatggattctccactcagtt

SEQ ID NO: 3424407 - DNA, 21 bp, Homo sapiens
ttagatggtggcacattcctt

SEQ ID NO: 3424408 - DNA, 15 bp, Homo sapiens
ttagatgttctctat

SEQ ID NO: 3424409 - DNA, 20 bp, Homo sapiens
ttagatgttctctatcattt

SEQ ID NO: 3424410 - DNA, 21 bp, Homo sapiens
ttagatgttctctatcattta

SEQ ID NO: 3424411 - DNA, 15 bp, Homo sapiens
ttagatgtttcacac

SEQ ID NO: 3424412 - DNA, 13 bp, Homo sapiens
ttagattgtaaac

SEQ ID NO: 3424413 - DNA, 15 bp, Homo sapiens
ttagccaaacaacaa

SEQ ID NO: 3424414 - DNA, 20 bp, Homo sapiens
ttagccactggtttctcaga

SEQ ID NO: 3424415 - DNA, 17 bp, Homo sapiens
ttagccagatttgtctt

SEQ ID NO: 3424416 - DNA, 17 bp, Homo sapiens
ttagccatgtgaaactc

SEQ ID NO: 3424417 - DNA, 14 bp, Homo sapiens
ttagcggagacgga

SEQ ID NO: 3424418 - DNA, 14 bp, Homo sapiens
ttcaaattgtgtgt

SEQ ID NO: 3424419 - DNA, 16 bp, Homo sapiens
ttcaacagtgaagaca

SEQ ID NO: 3424420 - DNA, 17 bp, Homo sapiens
ttcaacccacagctact

SEQ ID NO: 3424421 - DNA, 15 bp, Homo sapiens
ttcaactatgtaggt

SEQ ID NO: 3424422 - DNA, 16 bp, Homo sapiens
ttcaactatgtaggta

SEQ ID NO: 3424423 - DNA, 19 bp, Homo sapiens
ttcaactttgaataaagaa

SEQ ID NO: 3424424 - DNA, 22 bp, Homo sapiens
ttcaactttgaataaagaatac

SEQ ID NO: 3424425 - DNA, 15 bp, Homo sapiens
ttcaagccttccagg

SEQ ID NO: 3424426 - DNA, 16 bp, Homo sapiens
ttcaaggccatccttc

SEQ ID NO: 3424427 - DNA, 15 bp, Homo sapiens
ttcaaggccttcagt

SEQ ID NO: 3424428 - DNA, 17 bp, Homo sapiens
ttcaaggccttcagttt

SEQ ID NO: 3424429 - DNA, 22 bp, Homo sapiens
ttcaagttttgggtatgtttaa

SEQ ID NO: 3424430 - DNA, 19 bp, Homo sapiens
ttcaatattgaatttttcc

SEQ ID NO: 3424431 - DNA, 15 bp, Homo sapiens
ttcaattcctggccc

SEQ ID NO: 3424432 - DNA, 18 bp, Homo sapiens
ttcaattctcatttgtca

SEQ ID NO: 3424433 - DNA, 15 bp, Homo sapiens
ttcaattgcatctcc

SEQ ID NO: 3424434 - DNA, 21 bp, Homo sapiens
ttcacagatgcctacttttgg

SEQ ID NO: 3424435 - DNA, 16 bp, Homo sapiens
ttcacagcaacatttt

SEQ ID NO: 3424436 - DNA, 18 bp, Homo sapiens
ttcacagcaacattttct

SEQ ID NO: 3424437 - DNA, 22 bp, Homo sapiens
ttcacagtgatcgatgattcag

SEQ ID NO: 3424438 - DNA, 16 bp, Homo sapiens
ttcacagtgtttctta

SEQ ID NO: 3424439 - DNA, 18 bp, Homo sapiens
ttcacatcctgtgtttct

SEQ ID NO: 3424440 - DNA, 19 bp, Homo sapiens
ttcacatcctgtgtttcta

SEQ ID NO: 3424441 - DNA, 21 bp, Homo sapiens
ttcacatcctgtgtttctagg

SEQ ID NO: 3424442 - DNA, 13 bp, Homo sapiens
ttcaccaccccct

SEQ ID NO: 3424443 - DNA, 21 bp, Homo sapiens
ttcaccatgatggccaggctg

SEQ ID NO: 3424444 - DNA, 21 bp, Homo sapiens
ttcacccaggcctatgttgat

SEQ ID NO: 3424445 - DNA, 17 bp, Homo sapiens
ttcaccccaatcccagc

SEQ ID NO: 3424446 - DNA, 20 bp, Homo sapiens
ttcaccccagggcctgagcc

SEQ ID NO: 3424447 - DNA, 18 bp, Homo sapiens
ttcacccctccctttctc

SEQ ID NO: 3424448 - DNA, 13 bp, Homo sapiens
ttcacctccttca

SEQ ID NO: 3424449 - DNA, 12 bp, Homo sapiens
ttcacctgagca

SEQ ID NO: 3424450 - DNA, 16 bp, Homo sapiens
ttcacctgattcaact

SEQ ID NO: 3424451 - DNA, 18 bp, Homo sapiens
ttcacctgccccaactct

SEQ ID NO: 3424452 - DNA, 19 bp, Homo sapiens
ttcacctgtttttaagctg

SEQ ID NO: 3424453 - DNA, 23 bp, Homo sapiens
ttcacctgtttttaagctgtttc

SEQ ID NO: 3424454 - DNA, 14 bp, Homo sapiens
ttcaccttgaagaa

SEQ ID NO: 3424455 - DNA, 13 bp, Homo sapiens
ttcacggaagagc

SEQ ID NO: 3424456 - DNA, 14 bp, Homo sapiens
ttcacgtgcagctc

SEQ ID NO: 3424457 - DNA, 13 bp, Homo sapiens
ttcactagggaat

SEQ ID NO: 3424458 - DNA, 21 bp, Homo sapiens
ttcactggcgaggtgcggcca

SEQ ID NO: 3424459 - DNA, 14 bp, Homo sapiens
ttcactttcatttt

SEQ ID NO: 3424460 - DNA, 15 bp, Homo sapiens
ttcactttcattttt

SEQ ID NO: 3424461 - DNA, 17 bp, Homo sapiens
ttcacttttgacaaagg

SEQ ID NO: 3424462 - DNA, 20 bp, Homo sapiens
ttcacttttgacaaaggcaa

SEQ ID NO: 3424463 - DNA, 16 bp, Homo sapiens
ttcagaaagtgtgctt

SEQ ID NO: 3424464 - DNA, 17 bp, Homo sapiens
ttcagaatatcatcttt

SEQ ID NO: 3424465 - DNA, 21 bp, Homo sapiens
ttcagaatcacttctgagaac

SEQ ID NO: 3424466 - DNA, 16 bp, Homo sapiens
ttcagaatctttgtta

SEQ ID NO: 3424467 - DNA, 21 bp, Homo sapiens
ttcagacacatgctatgttct

SEQ ID NO: 3424468 - DNA, 16 bp, Homo sapiens
ttcagagatggacaga

SEQ ID NO: 3424469 - DNA, 18 bp, Homo sapiens
ttcagagatggacagaga

SEQ ID NO: 3424470 - DNA, 21 bp, Homo sapiens
ttcagatcttaatataaattc

SEQ ID NO: 3424471 - DNA, 19 bp, Homo sapiens
ttcagatgatttgaaagca

SEQ ID NO: 3424472 - DNA, 13 bp, Homo sapiens
ttcagcaaaccat

SEQ ID NO: 3424473 - DNA, 20 bp, Homo sapiens
ttcagcagcaaattttcagc

SEQ ID NO: 3424474 - DNA, 17 bp, Homo sapiens
ttcagcattaagctgtt

SEQ ID NO: 3424475 - DNA, 11 bp, Homo sapiens
ttcagccaagg

SEQ ID NO: 3424476 - DNA, 16 bp, Homo sapiens
ttcagccactaagaac

SEQ ID NO: 3424477 - DNA, 16 bp, Homo sapiens
ttcagccctcacccct

SEQ ID NO: 3424478 - DNA, 14 bp, Homo sapiens
ttcagctcacgctt

SEQ ID NO: 3424479 - DNA, 16 bp, Homo sapiens
ttcagctcacgcttca

SEQ ID NO: 3424480 - DNA, 22 bp, Homo sapiens
ttcagctccagctcaccagccc

SEQ ID NO: 3424481 - DNA, 17 bp, Homo sapiens
ttcagctgacttttctg

SEQ ID NO: 3424482 - DNA, 21 bp, Homo sapiens
ttcagctggttgaggtttcaa

SEQ ID NO: 3424483 - DNA, 16 bp, Homo sapiens
ttcaggaacaccccca

SEQ ID NO: 3424484 - DNA, 14 bp, Homo sapiens
ttcagggttggccc

SEQ ID NO: 3424485 - DNA, 15 bp, Homo sapiens
ttcaggttttgtaaa

SEQ ID NO: 3424486 - DNA, 14 bp, Homo sapiens
ttcagtaagccgtg

SEQ ID NO: 3424487 - DNA, 19 bp, Homo sapiens
ttcagtacttttttaaata

SEQ ID NO: 3424488 - DNA, 17 bp, Homo sapiens
ttcagtatgttgtcaaa

SEQ ID NO: 3424489 - DNA, 19 bp, Homo sapiens
ttcagtatgttgtcaaaga

SEQ ID NO: 3424490 - DNA, 13 bp, Homo sapiens
ttcagtggcagct

SEQ ID NO: 3424491 - DNA, 16 bp, Homo sapiens
ttcagtggcagctgct

SEQ ID NO: 3424492 - DNA, 15 bp, Homo sapiens
ttcataacctagcct

SEQ ID NO: 3424493 - DNA, 23 bp, Homo sapiens
ttcataattttagtaatttccta

SEQ ID NO: 3424494 - DNA, 16 bp, Homo sapiens
ttcatatattgcattt

SEQ ID NO: 3424495 - DNA, 23 bp, Homo sapiens
ttcatatgaaaggtgccatggaa

SEQ ID NO: 3424496 - DNA, 23 bp, Homo sapiens
ttcatatgacattcatgcctggc

SEQ ID NO: 3424497 - DNA, 14 bp, Homo sapiens
ttcatattgaatat

SEQ ID NO: 3424498 - DNA, 18 bp, Homo sapiens
ttcatattgctgagagaa

SEQ ID NO: 3424499 - DNA, 19 bp, Homo sapiens
ttcatcccatgatgtagtg

SEQ ID NO: 3424500 - DNA, 20 bp, Homo sapiens
ttcatcgaatctactaattc

SEQ ID NO: 3424501 - DNA, 23 bp, Homo sapiens
ttcatctatggcagtccagccag

SEQ ID NO: 3424502 - DNA, 12 bp, Homo sapiens
ttcatctgccca

SEQ ID NO: 3424503 - DNA, 16 bp, Homo sapiens
ttcatctgctctcctt

SEQ ID NO: 3424504 - DNA, 19 bp, Homo sapiens
ttcatctgctctccttcct

SEQ ID NO: 3424505 - DNA, 21 bp, Homo sapiens
ttcatctgctctccttcctgg

SEQ ID NO: 3424506 - DNA, 20 bp, Homo sapiens
ttcatcttccaactcaaact

SEQ ID NO: 3424507 - DNA, 15 bp, Homo sapiens
ttcatcttcctgtgt

SEQ ID NO: 3424508 - DNA, 20 bp, Homo sapiens
ttcatcttcctgtgtcctga

SEQ ID NO: 3424509 - DNA, 19 bp, Homo sapiens
ttcatcttttattttggaa

SEQ ID NO: 3424510 - DNA, 16 bp, Homo sapiens
ttcatgcctggcttcg

SEQ ID NO: 3424511 - DNA, 14 bp, Homo sapiens
ttcatgctacagaa

SEQ ID NO: 3424512 - DNA, 17 bp, Homo sapiens
ttcatgtaaactgtgca

SEQ ID NO: 3424513 - DNA, 14 bp, Homo sapiens
ttcatgtctattcc

SEQ ID NO: 3424514 - DNA, 21 bp, Homo sapiens
ttcatgtctattccattccct

SEQ ID NO: 3424515 - DNA, 16 bp, Homo sapiens
ttcatgtctgctatca

SEQ ID NO: 3424516 - DNA, 12 bp, Homo sapiens
ttcatgtttctt

SEQ ID NO: 3424517 - DNA, 13 bp, Homo sapiens
ttcatgtttctta

SEQ ID NO: 3424518 - DNA, 16 bp, Homo sapiens
ttcattatttgtcaaa

SEQ ID NO: 3424519 - DNA, 21 bp, Homo sapiens
ttcattatttgtcaaattgtc

SEQ ID NO: 3424520 - DNA, 15 bp, Homo sapiens
ttcattccctgtagt

SEQ ID NO: 3424521 - DNA, 16 bp, Homo sapiens
ttcattcctaaagaaa

SEQ ID NO: 3424522 - DNA, 12 bp, Homo sapiens
ttcattctcctt

SEQ ID NO: 3424523 - DNA, 13 bp, Homo sapiens
ttcattcttgaaa

SEQ ID NO: 3424524 - DNA, 15 bp, Homo sapiens
ttcatttctaattaa

SEQ ID NO: 3424525 - DNA, 15 bp, Homo sapiens
ttcatttctttcctt

SEQ ID NO: 3424526 - DNA, 14 bp, Homo sapiens
ttcattttctagat

SEQ ID NO: 3424527 - DNA, 21 bp, Homo sapiens
ttcattttctagatacaataa

SEQ ID NO: 3424528 - DNA, 19 bp, Homo sapiens
ttcattttgagtattttta

SEQ ID NO: 3424529 - DNA, 16 bp, Homo sapiens
ttcatttttgtaataa

SEQ ID NO: 3424530 - DNA, 18 bp, Homo sapiens
ttcatttttgtaataaca

SEQ ID NO: 3424531 - DNA, 17 bp, Homo sapiens
ttccaaaagtggcctct

SEQ ID NO: 3424532 - DNA, 11 bp, Homo sapiens
ttccaaagcaa

SEQ ID NO: 3424533 - DNA, 20 bp, Homo sapiens
ttccaaataaaatgttccct

SEQ ID NO: 3424534 - DNA, 22 bp, Homo sapiens
ttccaactcgtatagcatgcat

SEQ ID NO: 3424535 - DNA, 17 bp, Homo sapiens
ttccaacttggctgcag

SEQ ID NO: 3424536 - DNA, 22 bp, Homo sapiens
ttccaacttggctgcaggaatc

SEQ ID NO: 3424537 - DNA, 22 bp, Homo sapiens
ttccacaccttttattgacaca

SEQ ID NO: 3424538 - DNA, 21 bp, Homo sapiens
ttccacggagccactcctctg

SEQ ID NO: 3424539 - DNA, 22 bp, Homo sapiens
ttccacggagccactcctctga

SEQ ID NO: 3424540 - DNA, 15 bp, Homo sapiens
ttccactactgctac

SEQ ID NO: 3424541 - DNA, 16 bp, Homo sapiens
ttccactctgatagaa

SEQ ID NO: 3424542 - DNA, 18 bp, Homo sapiens
ttccactctgatagaatt

SEQ ID NO: 3424543 - DNA, 19 bp, Homo sapiens
ttccacttggctacacagg

SEQ ID NO: 3424544 - DNA, 19 bp, Homo sapiens
ttccacttgtttgcactgt

SEQ ID NO: 3424545 - DNA, 20 bp, Homo sapiens
ttccacttttttttgtatgt

SEQ ID NO: 3424546 - DNA, 14 bp, Homo sapiens
ttccagaatgctgt

SEQ ID NO: 3424547 - DNA, 14 bp, Homo sapiens
ttccagcccctctg

SEQ ID NO: 3424548 - DNA, 16 bp, Homo sapiens
ttccagcccctctggt

SEQ ID NO: 3424549 - DNA, 20 bp, Homo sapiens
ttccagggatttgcctcacc

SEQ ID NO: 3424550 - DNA, 21 bp, Homo sapiens
ttccagggatttgcctcacct

SEQ ID NO: 3424551 - DNA, 18 bp, Homo sapiens
ttctacccaacggccctg

SEQ ID NO: 3424552 - DNA, 19 bp, Homo sapiens
ttctacccagcgagccctg

SEQ ID NO: 3424553 - DNA, 21 bp, Homo sapiens
ttctacccagcgagccctggt

SEQ ID NO: 3424554 - DNA, 18 bp, Homo sapiens
ttctagaggctcatggcc

SEQ ID NO: 3424555 - DNA, 16 bp, Homo sapiens
ttctagatacaataaa

SEQ ID NO: 3424556 - DNA, 19 bp, Homo sapiens
ttctagatacaataaattg

SEQ ID NO: 3424557 - DNA, 20 bp, Homo sapiens
ttctagatacaataaattgc

SEQ ID NO: 3424558 - DNA, 19 bp, Homo sapiens
ttctagatgcaagtctctt

SEQ ID NO: 3424559 - DNA, 12 bp, Homo sapiens
ttctagctgttg

SEQ ID NO: 3424560 - DNA, 20 bp, Homo sapiens
ttctagctgttgagctgttt

SEQ ID NO: 3424561 - DNA, 19 bp, Homo sapiens
ttctaggaaattcttgaaa

SEQ ID NO: 3424562 - DNA, 16 bp, Homo sapiens
ttctaggcatctctgt

SEQ ID NO: 3424563 - DNA, 20 bp, Homo sapiens
ttctaggcatctctgtactt

SEQ ID NO: 3424564 - DNA, 15 bp, Homo sapiens
ttctagggaaatgaa

SEQ ID NO: 3424565 - DNA, 14 bp, Homo sapiens
ttctataaggccat

SEQ ID NO: 3424566 - DNA, 21 bp, Homo sapiens
ttctataaggccataaaacag

SEQ ID NO: 3424567 - DNA, 19 bp, Homo sapiens
ttctatccttccagaaaaa

SEQ ID NO: 3424568 - DNA, 13 bp, Homo sapiens
ttctatcttttgt

SEQ ID NO: 3424569 - DNA, 20 bp, Homo sapiens
ttctatcttttgtttccttt

SEQ ID NO: 3424570 - DNA, 22 bp, Homo sapiens
ttctattttttacttgttttcg

SEQ ID NO: 3424571 - DNA, 16 bp, Homo sapiens
ttctcaaaagaactta

SEQ ID NO: 3424572 - DNA, 15 bp, Homo sapiens
ttctcaaacctccaa

SEQ ID NO: 3424573 - DNA, 12 bp, Homo sapiens
ttctcaccagct

SEQ ID NO: 3424574 - DNA, 13 bp, Homo sapiens
ttctcaccagctg

SEQ ID NO: 3424575 - DNA, 14 bp, Homo sapiens
ttctcaccagctgc

SEQ ID NO: 3424576 - DNA, 15 bp, Homo sapiens
ttctcaccagctgca

SEQ ID NO: 3424577 - DNA, 18 bp, Homo sapiens
ttctcaccagctgcaaag

SEQ ID NO: 3424578 - DNA, 20 bp, Homo sapiens
ttctcacttttggaaggtga

SEQ ID NO: 3424579 - DNA, 20 bp, Homo sapiens
ttctcagaatccaaagatca

SEQ ID NO: 3424580 - DNA, 13 bp, Homo sapiens
ttctcagaatcta

SEQ ID NO: 3424581 - DNA, 22 bp, Homo sapiens
ttctcagactttggaaaatgca

SEQ ID NO: 3424582 - DNA, 17 bp, Homo sapiens
ttctcaggccatcatca

SEQ ID NO: 3424583 - DNA, 13 bp, Homo sapiens
ttctcagggtctc

SEQ ID NO: 3424584 - DNA, 16 bp, Homo sapiens
ttctcagggtctctgc

SEQ ID NO: 3424585 - DNA, 17 bp, Homo sapiens
ttctcagggtctctgct

SEQ ID NO: 3424586 - DNA, 21 bp, Homo sapiens
ttctcagggtctctgctgccg

SEQ ID NO: 3424587 - DNA, 15 bp, Homo sapiens
ttctcatcctgcagg

SEQ ID NO: 3424588 - DNA, 18 bp, Homo sapiens
ttctcatctttcttgatc

SEQ ID NO: 3424589 - DNA, 15 bp, Homo sapiens
ttctcatttcacccc

SEQ ID NO: 3424590 - DNA, 19 bp, Homo sapiens
ttctccaaaaatctgcctg

SEQ ID NO: 3424591 - DNA, 21 bp, Homo sapiens
ttctccaaaaatctgcctggg

SEQ ID NO: 3424592 - DNA, 22 bp, Homo sapiens
ttctccacagcaaccccaggct

SEQ ID NO: 3424593 - DNA, 14 bp, Homo sapiens
ttctccagggtcag

SEQ ID NO: 3424594 - DNA, 18 bp, Homo sapiens
ttctcccctcttctgagc

SEQ ID NO: 3424595 - DNA, 19 bp, Homo sapiens
ttctcccctcttctgagct

SEQ ID NO: 3424596 - DNA, 21 bp, Homo sapiens
ttctcccctgcccccaggact

SEQ ID NO: 3424597 - DNA, 19 bp, Homo sapiens
ttctccgttagctcctgtg

SEQ ID NO: 3424598 - DNA, 17 bp, Homo sapiens
ttctcctcttgtaaata

SEQ ID NO: 3424599 - DNA, 14 bp, Homo sapiens
ttctcctggatgct

SEQ ID NO: 3424600 - DNA, 21 bp, Homo sapiens
ttctccttgttgttggttgtt

SEQ ID NO: 3424601 - DNA, 19 bp, Homo sapiens
ttctcgctgtcctttctag

SEQ ID NO: 3424602 - DNA, 24 bp, Homo sapiens
ttctctaagagaacaatgtgctat

SEQ ID NO: 3424603 - DNA, 16 bp, Homo sapiens
ttctctacccatctcc

SEQ ID NO: 3424604 - DNA, 17 bp, Homo sapiens
ttctctacccatctccc

SEQ ID NO: 3424605 - DNA, 18 bp, Homo sapiens
ttctctataaaaaatatg

SEQ ID NO: 3424606 - DNA, 16 bp, Homo sapiens
ttctctatcatttaat

SEQ ID NO: 3424607 - DNA, 12 bp, Homo sapiens
ttctctcatctc

SEQ ID NO: 3424608 - DNA, 13 bp, Homo sapiens
ttctctcatctct

SEQ ID NO: 3424609 - DNA, 19 bp, Homo sapiens
ttctctcctgtcctccctc

SEQ ID NO: 3424610 - DNA, 18 bp, Homo sapiens
ttctctgagctgtgcagg

SEQ ID NO: 3424611 - DNA, 14 bp, Homo sapiens
ttctctgaggacac

SEQ ID NO: 3424612 - DNA, 18 bp, Homo sapiens
ttctctgtacttttcatt

SEQ ID NO: 3424613 - DNA, 11 bp, Homo sapiens
ttctctgtcca

SEQ ID NO: 3424614 - DNA, 12 bp, Homo sapiens
ttctctgtctca

SEQ ID NO: 3424615 - DNA, 13 bp, Homo sapiens
ttctctgtctcat

SEQ ID NO: 3424616 - DNA, 17 bp, Homo sapiens
ttctctgtctcatccat

SEQ ID NO: 3424617 - DNA, 12 bp, Homo sapiens
ttctctgtgaac

SEQ ID NO: 3424618 - DNA, 23 bp, Homo sapiens
ttctctgtgtatgagtgtgaatg

SEQ ID NO: 3424619 - DNA, 23 bp, Homo sapiens
ttctcttccctgcgcctgtgatg

SEQ ID NO: 3424620 - DNA, 17 bp, Homo sapiens
ttctcttgggaactgaa

SEQ ID NO: 3424621 - DNA, 14 bp, Homo sapiens
ttctcttttcacag

SEQ ID NO: 3424622 - DNA, 21 bp, Homo sapiens
ttctcttttcccctttcctgt

SEQ ID NO: 3424623 - DNA, 22 bp, Homo sapiens
ttctcttttcccctttcctgtc

SEQ ID NO: 3424624 - DNA, 15 bp, Homo sapiens
ttctcttttctaaaa

SEQ ID NO: 3424625 - DNA, 15 bp, Homo sapiens
ttctgaatttgcaaa

SEQ ID NO: 3424626 - DNA, 18 bp, Homo sapiens
ttctgaatttgcaaagta

SEQ ID NO: 3424627 - DNA, 20 bp, Homo sapiens
ttctgaatttgcaaagtact

SEQ ID NO: 3424628 - DNA, 18 bp, Homo sapiens
ttctgacagtttttctgt

SEQ ID NO: 3424629 - DNA, 16 bp, Homo sapiens
ttctgaccttcagctc

SEQ ID NO: 3424630 - DNA, 18 bp, Homo sapiens
ttctgaccttcagctcac

SEQ ID NO: 3424631 - DNA, 18 bp, Homo sapiens
ttctgactcggtttctcc

SEQ ID NO: 3424632 - DNA, 16 bp, Homo sapiens
ttctgagataagtgtt

SEQ ID NO: 3424633 - DNA, 21 bp, Homo sapiens
ttctgagattcaatattgaat

SEQ ID NO: 3424634 - DNA, 21 bp, Homo sapiens
ttctgagctagttggttgaat

SEQ ID NO: 3424635 - DNA, 22 bp, Homo sapiens
ttctgataactagatggtgctg

SEQ ID NO: 3424636 - DNA, 11 bp, Homo sapiens
ttctgattctt

SEQ ID NO: 3424637 - DNA, 21 bp, Homo sapiens
ttctgcacagcttttccaaaa

SEQ ID NO: 3424638 - DNA, 19 bp, Homo sapiens
ttctgcaccttgccaggga

SEQ ID NO: 3424639 - DNA, 15 bp, Homo sapiens
ttctgcagaagagga

SEQ ID NO: 3424640 - DNA, 22 bp, Homo sapiens
ttctgcagtaaatcttttacaa

SEQ ID NO: 3424641 - DNA, 21 bp, Homo sapiens
ttctgcatatgttgaatactt

SEQ ID NO: 3424642 - DNA, 17 bp, Homo sapiens
ttctgccacccctaaac

SEQ ID NO: 3424643 - DNA, 12 bp, Homo sapiens
ttctgcctcctt

SEQ ID NO: 3424644 - DNA, 13 bp, Homo sapiens
ttctgcctccttt

SEQ ID NO: 3424645 - DNA, 12 bp, Homo sapiens
ttctgcctctcc

SEQ ID NO: 3424646 - DNA, 19 bp, Homo sapiens
ttctgcctgccagctgcac

SEQ ID NO: 3424647 - DNA, 17 bp, Homo sapiens
ttctgcctgcccaggcc

SEQ ID NO: 3424648 - DNA, 14 bp, Homo sapiens
ttctgcctggagac

SEQ ID NO: 3424649 - DNA, 14 bp, Homo sapiens
ttctgctcatcatt

SEQ ID NO: 3424650 - DNA, 20 bp, Homo sapiens
ttctgcttaaagttgtaaca

SEQ ID NO: 3424651 - DNA, 15 bp, Homo sapiens
ttctgcttcagcctc

SEQ ID NO: 3424652 - DNA, 19 bp, Homo sapiens
ttctgcttcagcctcccga

SEQ ID NO: 3424653 - DNA, 22 bp, Homo sapiens
ttctgctttctccccaatgaga

SEQ ID NO: 3424654 - DNA, 19 bp, Homo sapiens
ttctggacagtcagctctt

SEQ ID NO: 3424655 - DNA, 22 bp, Homo sapiens
ttctggagatggaagcttgttg

SEQ ID NO: 3424656 - DNA, 19 bp, Homo sapiens
ttctggaggaaagggagga

SEQ ID NO: 3424657 - DNA, 17 bp, Homo sapiens
ttctggcaggtcctccc

SEQ ID NO: 3424658 - DNA, 14 bp, Homo sapiens
ttctggcctcccac

SEQ ID NO: 3424659 - DNA, 14 bp, Homo sapiens
ttctggctccctct

SEQ ID NO: 3424660 - DNA, 14 bp, Homo sapiens
ttctgggagggcag

SEQ ID NO: 3424661 - DNA, 16 bp, Homo sapiens
ttctgggttttctgaa

SEQ ID NO: 3424662 - DNA, 17 bp, Homo sapiens
ttctgggttttctgaaa

SEQ ID NO: 3424663 - DNA, 16 bp, Homo sapiens
ttctggtggtttgatt

SEQ ID NO: 3424664 - DNA, 13 bp, Homo sapiens
ttctggtgtttta

SEQ ID NO: 3424665 - DNA, 17 bp, Homo sapiens
ttctggttccagggtcc

SEQ ID NO: 3424666 - DNA, 22 bp, Homo sapiens
ttctgtaaactctgcatccaga

SEQ ID NO: 3424667 - DNA, 18 bp, Homo sapiens
ttctgtaatttaaaagct

SEQ ID NO: 3424668 - DNA, 15 bp, Homo sapiens
ttctgtagaaatggt

SEQ ID NO: 3424669 - DNA, 17 bp, Homo sapiens
ttctgtatatacttttt

SEQ ID NO: 3424670 - DNA, 19 bp, Homo sapiens
ttctgtcactcaggctgga

SEQ ID NO: 3424671 - DNA, 16 bp, Homo sapiens
ttctgtcccctcttcc

SEQ ID NO: 3424672 - DNA, 18 bp, Homo sapiens
ttctgtctactaagtgat

SEQ ID NO: 3424673 - DNA, 22 bp, Homo sapiens
ttctgtggatgccgatttctgt

SEQ ID NO: 3424674 - DNA, 22 bp, Homo sapiens
ttctgtgggagaattcttacat

SEQ ID NO: 3424675 - DNA, 19 bp, Homo sapiens
ttctgtggggcccctcacc

SEQ ID NO: 3424676 - DNA, 20 bp, Homo sapiens
ttctgtggggcccctcacct

SEQ ID NO: 3424677 - DNA, 17 bp, Homo sapiens
ttcttaaacacttgcaa

SEQ ID NO: 3424678 - DNA, 19 bp, Homo sapiens
ttcttaaccagatggttgt

SEQ ID NO: 3424679 - DNA, 11 bp, Homo sapiens
ttcttaagata

SEQ ID NO: 3424680 - DNA, 16 bp, Homo sapiens
ttcttactgataattt

SEQ ID NO: 3424681 - DNA, 20 bp, Homo sapiens
ttcttactgataattttgct

SEQ ID NO: 3424682 - DNA, 12 bp, Homo sapiens
ttcttagaaatt

SEQ ID NO: 3424683 - DNA, 23 bp, Homo sapiens
ttgattcggtatccccccatctt

SEQ ID NO: 3424684 - DNA, 13 bp, Homo sapiens
ttgattctccttc

SEQ ID NO: 3424685 - DNA, 20 bp, Homo sapiens
ttgattctccttcagccctc

SEQ ID NO: 3424686 - DNA, 11 bp, Homo sapiens
ttgattctgat

SEQ ID NO: 3424687 - DNA, 20 bp, Homo sapiens
ttgattctgcagtaaatctt

SEQ ID NO: 3424688 - DNA, 16 bp, Homo sapiens
ttgatttcctgtgtca

SEQ ID NO: 3424689 - DNA, 13 bp, Homo sapiens
ttgatttgaagaa

SEQ ID NO: 3424690 - DNA, 18 bp, Homo sapiens
ttgatttgaagaacatgt

SEQ ID NO: 3424691 - DNA, 15 bp, Homo sapiens
ttgatttgcattgaa

SEQ ID NO: 3424692 - DNA, 19 bp, Homo sapiens
ttgatttgcattgaacaca

SEQ ID NO: 3424693 - DNA, 13 bp, Homo sapiens
ttgattttacaat

SEQ ID NO: 3424694 - DNA, 13 bp, Homo sapiens
ttgcaaatacctc

SEQ ID NO: 3424695 - DNA, 17 bp, Homo sapiens
ttgcaaatcttgaaatt

SEQ ID NO: 3424696 - DNA, 17 bp, Homo sapiens
ttgcaacaggctgggct

SEQ ID NO: 3424697 - DNA, 19 bp, Homo sapiens
ttgcaagggaaaagtctct

SEQ ID NO: 3424698 - DNA, 13 bp, Homo sapiens
ttgcaataatgca

SEQ ID NO: 3424699 - DNA, 14 bp, Homo sapiens
ttgcaataatgcag

SEQ ID NO: 3424700 - DNA, 16 bp, Homo sapiens
ttgcaataatgcagta

SEQ ID NO: 3424701 - DNA, 20 bp, Homo sapiens
ttgcaatataacattctatt

SEQ ID NO: 3424702 - DNA, 19 bp, Homo sapiens
ttgcaatggcagccttggc

SEQ ID NO: 3424703 - DNA, 17 bp, Homo sapiens
ttgcacagaagtcctgt

SEQ ID NO: 3424704 - DNA, 23 bp, Homo sapiens
ttgcacagaagtcctgtatgtct

SEQ ID NO: 3424705 - DNA, 13 bp, Homo sapiens
ttgcacagggatt

SEQ ID NO: 3424706 - DNA, 14 bp, Homo sapiens
ttgcaccactgcac

SEQ ID NO: 3424707 - DNA, 15 bp, Homo sapiens
ttgcaccactgcact

SEQ ID NO: 3424708 - DNA, 16 bp, Homo sapiens
ttgcaccactgcactc

SEQ ID NO: 3424709 - DNA, 14 bp, Homo sapiens
ttgcacggctgctg

SEQ ID NO: 3424710 - DNA, 15 bp, Homo sapiens
ttgcacggctgctga

SEQ ID NO: 3424711 - DNA, 14 bp, Homo sapiens
ttgcactccagtct

SEQ ID NO: 3424712 - DNA, 17 bp, Homo sapiens
ttgcacttgtgattatt

SEQ ID NO: 3424713 - DNA, 20 bp, Homo sapiens
ttgcacttgtgattatttat

SEQ ID NO: 3424714 - DNA, 13 bp, Homo sapiens
ttgcagaagaggg

SEQ ID NO: 3424715 - DNA, 21 bp, Homo sapiens
ttgcagaagagggtgtgtttg

SEQ ID NO: 3424716 - DNA, 22 bp, Homo sapiens
ttgcagccctgctgctgcctgc

SEQ ID NO: 3424717 - DNA, 23 bp, Homo sapiens
ttgcagctaaggaggggaaaaaa

SEQ ID NO: 3424718 - DNA, 23 bp, Homo sapiens
ttgcagggtcctcttctgggcct

SEQ ID NO: 3424719 - DNA, 23 bp, Homo sapiens
ttgcaggtgggggttgctgtata

SEQ ID NO: 3424720 - DNA, 23 bp, Homo sapiens
ttgcagtccttttactacagcta

SEQ ID NO: 3424721 - DNA, 17 bp, Homo sapiens
ttgcatagcagctgcta

SEQ ID NO: 3424722 - DNA, 19 bp, Homo sapiens
ttgcatagcagctgctact

SEQ ID NO: 3424723 - DNA, 15 bp, Homo sapiens
ttgcattgaacacaa

SEQ ID NO: 3424724 - DNA, 18 bp, Homo sapiens
ttgcattgaacacaaact

SEQ ID NO: 3424725 - DNA, 22 bp, Homo sapiens
ttgcattgaacacaaactgtaa

SEQ ID NO: 3424726 - DNA, 12 bp, Homo sapiens
ttgcatttggaa

SEQ ID NO: 3424727 - DNA, 18 bp, Homo sapiens
ttgccacaggacacagtc

SEQ ID NO: 3424728 - DNA, 21 bp, Homo sapiens
ttgccagccagaagcctctgc

SEQ ID NO: 3424729 - DNA, 20 bp, Homo sapiens
ttgccagggaggtggaagga

SEQ ID NO: 3424730 - DNA, 15 bp, Homo sapiens
ttgccatattgcaca

SEQ ID NO: 3424731 - DNA, 23 bp, Homo sapiens
ttgccatattgcacatgtcttaa

SEQ ID NO: 3424732 - DNA, 16 bp, Homo sapiens
ttgccatgttggccag

SEQ ID NO: 3424733 - DNA, 20 bp, Homo sapiens
ttgccatgttggccaggctg

SEQ ID NO: 3424734 - DNA, 17 bp, Homo sapiens
ttgccattctcttgcat

SEQ ID NO: 3424735 - DNA, 22 bp, Homo sapiens
ttgcccagcattttactgattc

SEQ ID NO: 3424736 - DNA, 11 bp, Homo sapiens
ttgcccaggca

SEQ ID NO: 3424737 - DNA, 13 bp, Homo sapiens
ttgcccaggcagg

SEQ ID NO: 3424738 - DNA, 18 bp, Homo sapiens
ttgcccaggcaggtcttg

SEQ ID NO: 3424739 - DNA, 11 bp, Homo sapiens
ttgcccaggct

SEQ ID NO: 3424740 - DNA, 23 bp, Homo sapiens
ttgcccaggctggcgtgcagtgg

SEQ ID NO: 3424741 - DNA, 11 bp, Homo sapiens
ttgccccactc

SEQ ID NO: 3424742 - DNA, 15 bp, Homo sapiens
ttgccccactctgcc

SEQ ID NO: 3424743 - DNA, 20 bp, Homo sapiens
ttgccccactctgcctgcct

SEQ ID NO: 3424744 - DNA, 17 bp, Homo sapiens
ttgccccgtctctgttc

SEQ ID NO: 3424745 - DNA, 20 bp, Homo sapiens
ttgcctaaatccaaagaaaa

SEQ ID NO: 3424746 - DNA, 14 bp, Homo sapiens
ttgcctcctcagta

SEQ ID NO: 3424747 - DNA, 12 bp, Homo sapiens
ttgcctctactt

SEQ ID NO: 3424748 - DNA, 14 bp, Homo sapiens
ttgcctctgcctct

SEQ ID NO: 3424749 - DNA, 14 bp, Homo sapiens
ttgcctctgtgctg

SEQ ID NO: 3424750 - DNA, 20 bp, Homo sapiens
ttgcctcttttacctgctgc

SEQ ID NO: 3424751 - DNA, 22 bp, Homo sapiens
ttgccttccagaaaacaaaact

SEQ ID NO: 3424752 - DNA, 22 bp, Homo sapiens
ttgcctttagtgatcacagcag

SEQ ID NO: 3424753 - DNA, 16 bp, Homo sapiens
ttgcctttcgaggcct

SEQ ID NO: 3424754 - DNA, 19 bp, Homo sapiens
ttgccttttaatttttaat

SEQ ID NO: 3424755 - DNA, 17 bp, Homo sapiens
ttgcgaatggttccatt

SEQ ID NO: 3424756 - DNA, 15 bp, Homo sapiens
ttgcgtacacagaga

SEQ ID NO: 3424757 - DNA, 18 bp, Homo sapiens
ttgcgtacacagagaagg

SEQ ID NO: 3424758 - DNA, 23 bp, Homo sapiens
ttgcgtacacagagaaggctatg

SEQ ID NO: 3424759 - DNA, 21 bp, Homo sapiens
ttgctaagccccagcaagcaa

SEQ ID NO: 3424760 - DNA, 13 bp, Homo sapiens
ttgctaatgttgc

SEQ ID NO: 3424761 - DNA, 20 bp, Homo sapiens
ttgctactacttacctacca

SEQ ID NO: 3424762 - DNA, 18 bp, Homo sapiens
ttgctatcaacaataaaa

SEQ ID NO: 3424763 - DNA, 13 bp, Homo sapiens
ttgctcacctggg

SEQ ID NO: 3424764 - DNA, 15 bp, Homo sapiens
ttgctcacctggggt

SEQ ID NO: 3424765 - DNA, 17 bp, Homo sapiens
ttgctcccctgatagaa

SEQ ID NO: 3424766 - DNA, 21 bp, Homo sapiens
ttgctcccctgatagaagatt

SEQ ID NO: 3424767 - DNA, 19 bp, Homo sapiens
ttgctctatgctttccaaa

SEQ ID NO: 3424768 - DNA, 20 bp, Homo sapiens
ttgctctgccaacttcttca

SEQ ID NO: 3424769 - DNA, 19 bp, Homo sapiens
ttgctgaatacagaggcaa

SEQ ID NO: 3424770 - DNA, 14 bp, Homo sapiens
ttgctgagcctctg

SEQ ID NO: 3424771 - DNA, 18 bp, Homo sapiens
ttgctgccacactgtctc

SEQ ID NO: 3424772 - DNA, 19 bp, Homo sapiens
ttgctgccagagaagtctg

SEQ ID NO: 3424773 - DNA, 19 bp, Homo sapiens
ttgctgccccatcagtgct

SEQ ID NO: 3424774 - DNA, 18 bp, Homo sapiens
ttgctgctgtccagtgcc

SEQ ID NO: 3424775 - DNA, 18 bp, Homo sapiens
ttgctgcttttccttggg

SEQ ID NO: 3424776 - DNA, 13 bp, Homo sapiens
ttgctggaacaca

SEQ ID NO: 3424777 - DNA, 17 bp, Homo sapiens
ttgctggatcaggaagc

SEQ ID NO: 3424778 - DNA, 19 bp, Homo sapiens
ttgctgtaagatgtctgtt

SEQ ID NO: 3424779 - DNA, 16 bp, Homo sapiens
ttgctgtaggatctaa

SEQ ID NO: 3424780 - DNA, 14 bp, Homo sapiens
ttgctgtcacttct

SEQ ID NO: 3424781 - DNA, 15 bp, Homo sapiens
ttgctgtcacttctt

SEQ ID NO: 3424782 - DNA, 14 bp, Homo sapiens
ttgctgtctgcagc

SEQ ID NO: 3424783 - DNA, 14 bp, Homo sapiens
ttgctgtgaactga

SEQ ID NO: 3424784 - DNA, 13 bp, Homo sapiens
ttgctgttattat

SEQ ID NO: 3424785 - DNA, 22 bp, Homo sapiens
ttgcttatgtgtaggtgaacag

SEQ ID NO: 3424786 - DNA, 18 bp, Homo sapiens
ttgcttcttactgataat

SEQ ID NO: 3424787 - DNA, 16 bp, Homo sapiens
ttgcttggactattat

SEQ ID NO: 3424788 - DNA, 15 bp, Homo sapiens
ttgctttctgctcag

SEQ ID NO: 3424789 - DNA, 20 bp, Homo sapiens
ttgctttctgctcagcttct

SEQ ID NO: 3424790 - DNA, 14 bp, Homo sapiens
ttgctttgaaaaag

SEQ ID NO: 3424791 - DNA, 22 bp, Homo sapiens
ttggaaacattttttaaaacaa

SEQ ID NO: 3424792 - DNA, 17 bp, Homo sapiens
ttggaactatgaagact

SEQ ID NO: 3424793 - DNA, 16 bp, Homo sapiens
ttggaagttgcatggc

SEQ ID NO: 3424794 - DNA, 13 bp, Homo sapiens
ttggaatgcacag

SEQ ID NO: 3424795 - DNA, 20 bp, Homo sapiens
ttggacatcagtgtttgttg

SEQ ID NO: 3424796 - DNA, 13 bp, Homo sapiens
ttggacccttcca

SEQ ID NO: 3424797 - DNA, 13 bp, Homo sapiens
ttggagaatttag

SEQ ID NO: 3424798 - DNA, 16 bp, Homo sapiens
ttggagagtttcctga

SEQ ID NO: 3424799 - DNA, 23 bp, Homo sapiens
ttggagatcaaaatcctacagat

SEQ ID NO: 3424800 - DNA, 14 bp, Homo sapiens
ttggagatcaagga

SEQ ID NO: 3424801 - DNA, 11 bp, Homo sapiens
ttggaggacag

SEQ ID NO: 3424802 - DNA, 16 bp, Homo sapiens
ttggagtgttatgtat

SEQ ID NO: 3424803 - DNA, 18 bp, Homo sapiens
ttggagtgttatgtattt

SEQ ID NO: 3424804 - DNA, 22 bp, Homo sapiens
ttggatccgtttgaccaatttg

SEQ ID NO: 3424805 - DNA, 24 bp, Homo sapiens
ttggatgcagtgctcgctgttgct

SEQ ID NO: 3424806 - DNA, 22 bp, Homo sapiens
ttggattctttaaatatatatt

SEQ ID NO: 3424807 - DNA, 14 bp, Homo sapiens
ttggatttgacatt

SEQ ID NO: 3424808 - DNA, 13 bp, Homo sapiens
ttggcaaggaaag

SEQ ID NO: 3424809 - DNA, 17 bp, Homo sapiens
ttggcaatgccatcatc

SEQ ID NO: 3424810 - DNA, 20 bp, Homo sapiens
ttggcaccagacacccagga

SEQ ID NO: 3424811 - DNA, 19 bp, Homo sapiens
ttggcacctaatccaggca

SEQ ID NO: 3424812 - DNA, 14 bp, Homo sapiens
ttggcactgctaaa

SEQ ID NO: 3424813 - DNA, 14 bp, Homo sapiens
ttggccaggctggt

SEQ ID NO: 3424814 - DNA, 18 bp, Homo sapiens
ttggcccctgcccggctg

SEQ ID NO: 3424815 - DNA, 13 bp, Homo sapiens
ttggcctccatcc

SEQ ID NO: 3424816 - DNA, 11 bp, Homo sapiens
aaaaaaagaca

SEQ ID NO: 3424817 - DNA, 12 bp, Homo sapiens
aaaaaaagtatt

SEQ ID NO: 3424818 - DNA, 22 bp, Homo sapiens
aaaaaactgctgactgttttct

SEQ ID NO: 3424819 - DNA, 13 bp, Homo sapiens
aaaaaagatatat

SEQ ID NO: 3424820 - DNA, 11 bp, Homo sapiens
aaaaaatatgt

SEQ ID NO: 3424821 - DNA, 15 bp, Homo sapiens
aaaaaatattttcct

SEQ ID NO: 3424822 - DNA, 13 bp, Homo sapiens
aaaaaatctgcag

SEQ ID NO: 3424823 - DNA, 12 bp, Homo sapiens
aaaaaattcaca

SEQ ID NO: 3424824 - DNA, 20 bp, Homo sapiens
aaaaacaaatatatatatgt

SEQ ID NO: 3424825 - DNA, 20 bp, Homo sapiens
aaaaacatgtatgtgcattt

SEQ ID NO: 3424826 - DNA, 22 bp, Homo sapiens
aaaaaccaaaatactccaaaga

SEQ ID NO: 3424827 - DNA, 17 bp, Homo sapiens
aaaaaccctatatgctt

SEQ ID NO: 3424828 - DNA, 18 bp, Homo sapiens
aaaaaccctatatgctta

SEQ ID NO: 3424829 - DNA, 19 bp, Homo sapiens
aaaaactacaaccaatgga

SEQ ID NO: 3424830 - DNA, 15 bp, Homo sapiens
aaaaactgtctttaa

SEQ ID NO: 3424831 - DNA, 13 bp, Homo sapiens
aaaaagacaaaca

SEQ ID NO: 3424832 - DNA, 13 bp, Homo sapiens
aaaaaggtttaca

SEQ ID NO: 3424833 - DNA, 19 bp, Homo sapiens
aaaaagtattattttccaa

SEQ ID NO: 3424834 - DNA, 23 bp, Homo sapiens
aaaaagtcaccattctgcattta

SEQ ID NO: 3424835 - DNA, 16 bp, Homo sapiens
aaaaagtccaatttta

SEQ ID NO: 3424836 - DNA, 14 bp, Homo sapiens
aaaaagtctgtatg

SEQ ID NO: 3424837 - DNA, 15 bp, Homo sapiens
aaaaagtctgtatgg

SEQ ID NO: 3424838 - DNA, 14 bp, Homo sapiens
aaaaataaacacta

SEQ ID NO: 3424839 - DNA, 21 bp, Homo sapiens
aaaaataaatttggttctaat

SEQ ID NO: 3424840 - DNA, 21 bp, Homo sapiens
aaaaatactttttctaatgag

SEQ ID NO: 3424841 - DNA, 14 bp, Homo sapiens
aaaaatagcaactt

SEQ ID NO: 3424842 - DNA, 13 bp, Homo sapiens
aaaaatataaaac

SEQ ID NO: 3424843 - DNA, 11 bp, Homo sapiens
aaaaatattta

SEQ ID NO: 3424844 - DNA, 13 bp, Homo sapiens
aaaaatattttct

SEQ ID NO: 3424845 - DNA, 23 bp, Homo sapiens
aaaaatcaactttttattgcctt

SEQ ID NO: 3424846 - DNA, 20 bp, Homo sapiens
aaaaatgagagctgtaactg

SEQ ID NO: 3424847 - DNA, 22 bp, Homo sapiens
aaaaatgcaaatcctatgtgat

SEQ ID NO: 3424848 - DNA, 19 bp, Homo sapiens
aaaaatggaaaaataaaca

SEQ ID NO: 3424849 - DNA, 16 bp, Homo sapiens
aaaaatgttttttcat

SEQ ID NO: 3424850 - DNA, 11 bp, Homo sapiens
aaaaattaaaa

SEQ ID NO: 3424851 - DNA, 14 bp, Homo sapiens
aaagcataaaaaca

SEQ ID NO: 3424852 - DNA, 15 bp, Homo sapiens
aaagcatttataaat

SEQ ID NO: 3424853 - DNA, 13 bp, Homo sapiens
aaagcatttgaat

SEQ ID NO: 3424854 - DNA, 15 bp, Homo sapiens
aaagcatttgaatgc

SEQ ID NO: 3424855 - DNA, 17 bp, Homo sapiens
aaagcatttgaatgcat

SEQ ID NO: 3424856 - DNA, 19 bp, Homo sapiens
aaagcatttgaatgcattt

SEQ ID NO: 3424857 - DNA, 20 bp, Homo sapiens
aaagcatttgaatgcatttt

SEQ ID NO: 3424858 - DNA, 23 bp, Homo sapiens
aaagcatttgaatgcattttgtt

SEQ ID NO: 3424859 - DNA, 13 bp, Homo sapiens
aaagccatgctgg

SEQ ID NO: 3424860 - DNA, 14 bp, Homo sapiens
aaagcggctgcctc

SEQ ID NO: 3424861 - DNA, 17 bp, Homo sapiens
aaagctaggcctggcca

SEQ ID NO: 3424862 - DNA, 21 bp, Homo sapiens
aaagctgctcagggaaaagca

SEQ ID NO: 3424863 - DNA, 15 bp, Homo sapiens
aaagctgtattttga

SEQ ID NO: 3424864 - DNA, 12 bp, Homo sapiens
aaagctttctgc

SEQ ID NO: 3424865 - DNA, 14 bp, Homo sapiens
aaaggactctggaa

SEQ ID NO: 3424866 - DNA, 17 bp, Homo sapiens
aaaggagagctagcagc

SEQ ID NO: 3424867 - DNA, 19 bp, Homo sapiens
aaaggagcccttatctgtg

SEQ ID NO: 3424868 - DNA, 22 bp, Homo sapiens
aaaggagctcgaaggatattgt

SEQ ID NO: 3424869 - DNA, 18 bp, Homo sapiens
aaaggatactgtaacact

SEQ ID NO: 3424870 - DNA, 13 bp, Homo sapiens
aaaggcaaggtcc

SEQ ID NO: 3424871 - DNA, 12 bp, Homo sapiens
aaaggcacagtg

SEQ ID NO: 3424872 - DNA, 17 bp, Homo sapiens
aaaggcacctataaaac

SEQ ID NO: 3424873 - DNA, 18 bp, Homo sapiens
aaaggcagtattttgtgt

SEQ ID NO: 3424874 - DNA, 19 bp, Homo sapiens
aaaggcagtattttgtgtc

SEQ ID NO: 3424875 - DNA, 16 bp, Homo sapiens
aaaggcattctctgaa

SEQ ID NO: 3424876 - DNA, 14 bp, Homo sapiens
aaaggccaaacctc

SEQ ID NO: 3424877 - DNA, 18 bp, Homo sapiens
aaaggccaaacctctgtt

SEQ ID NO: 3424878 - DNA, 20 bp, Homo sapiens
aaaggccagctggcagcaga

SEQ ID NO: 3424879 - DNA, 19 bp, Homo sapiens
aaaggctcgattttgtatc

SEQ ID NO: 3424880 - DNA, 20 bp, Homo sapiens
aaagggcgcaaagggcatgg

SEQ ID NO: 3424881 - DNA, 14 bp, Homo sapiens
aaaggtgaaggaat

SEQ ID NO: 3424882 - DNA, 18 bp, Homo sapiens
aaaggtgtcaacttttga

SEQ ID NO: 3424883 - DNA, 16 bp, Homo sapiens
aaaggttccattcagt

SEQ ID NO: 3424884 - DNA, 13 bp, Homo sapiens
aaaggttttgagc

SEQ ID NO: 3424885 - DNA, 19 bp, Homo sapiens
aaagtacttctccaccctg

SEQ ID NO: 3424886 - DNA, 21 bp, Homo sapiens
aaagtacttctccaccctgct

SEQ ID NO: 3424887 - DNA, 17 bp, Homo sapiens
aaagtattatcattgct

SEQ ID NO: 3424888 - DNA, 19 bp, Homo sapiens
aaagtattctgtactctta

SEQ ID NO: 3424889 - DNA, 13 bp, Homo sapiens
aaagtattgtaaa

SEQ ID NO: 3424890 - DNA, 18 bp, Homo sapiens
aaagtatttaattagtgc

SEQ ID NO: 3424891 - DNA, 20 bp, Homo sapiens
aaagtatttaattagtgcta

SEQ ID NO: 3424892 - DNA, 21 bp, Homo sapiens
aaagtcaccattctgcattta

SEQ ID NO: 3424893 - DNA, 21 bp, Homo sapiens
aaagtcatgcaaaggctggga

SEQ ID NO: 3424894 - DNA, 13 bp, Homo sapiens
aaagtcattggct

SEQ ID NO: 3424895 - DNA, 20 bp, Homo sapiens
aaagtccaattttaatttag

SEQ ID NO: 3424896 - DNA, 18 bp, Homo sapiens
aaagtcctttttttccat

SEQ ID NO: 3424897 - DNA, 22 bp, Homo sapiens
aaagtctctcattctaggcctc

SEQ ID NO: 3424898 - DNA, 19 bp, Homo sapiens
aaagtgactaatggcatga

SEQ ID NO: 3424899 - DNA, 21 bp, Homo sapiens
aaagtgataatttctggaatt

SEQ ID NO: 3424900 - DNA, 18 bp, Homo sapiens
aaagtggcctctttgtct

SEQ ID NO: 3424901 - DNA, 14 bp, Homo sapiens
aaagtgtgctttat

SEQ ID NO: 3424902 - DNA, 19 bp, Homo sapiens
aaagtgtgctttatgctga

SEQ ID NO: 3424903 - DNA, 12 bp, Homo sapiens
aaagtgtgtatt

SEQ ID NO: 3424904 - DNA, 20 bp, Homo sapiens
aaagttactaggtaacttca

SEQ ID NO: 3424905 - DNA, 15 bp, Homo sapiens
aaagttgccattatt

SEQ ID NO: 3424906 - DNA, 17 bp, Homo sapiens
aaagttgccattattct

SEQ ID NO: 3424907 - DNA, 14 bp, Homo sapiens
aaagtttagaactt

SEQ ID NO: 3424908 - DNA, 15 bp, Homo sapiens
aaagtttagaacttg

SEQ ID NO: 3424909 - DNA, 21 bp, Homo sapiens
aaagtttctcttttcaaaaca

SEQ ID NO: 3424910 - DNA, 16 bp, Homo sapiens
aaagtttttttcctta

SEQ ID NO: 3424911 - DNA, 20 bp, Homo sapiens
aaataaaacaaagggcacag

SEQ ID NO: 3424912 - DNA, 13 bp, Homo sapiens
aaataaaacagta

SEQ ID NO: 3424913 - DNA, 18 bp, Homo sapiens
aaataaaaggaagccaaa

SEQ ID NO: 3424914 - DNA, 16 bp, Homo sapiens
aaataaaaggactctg

SEQ ID NO: 3424915 - DNA, 16 bp, Homo sapiens
aaataaacactacaga

SEQ ID NO: 3424916 - DNA, 11 bp, Homo sapiens
aaataaactgt

SEQ ID NO: 3424917 - DNA, 14 bp, Homo sapiens
aaataaactgttgc

SEQ ID NO: 3424918 - DNA, 22 bp, Homo sapiens
aaataaagagagaacaggacta

SEQ ID NO: 3424919 - DNA, 11 bp, Homo sapiens
aaataaatata

SEQ ID NO: 3424920 - DNA, 12 bp, Homo sapiens
aaataaatatat

SEQ ID NO: 3424921 - DNA, 14 bp, Homo sapiens
aaataaatatatat

SEQ ID NO: 3424922 - DNA, 17 bp, Homo sapiens
aaataaattctgattct

SEQ ID NO: 3424923 - DNA, 21 bp, Homo sapiens
aaataaattgtatattcactt

SEQ ID NO: 3424924 - DNA, 20 bp, Homo sapiens
aaataactggaacaaattat

SEQ ID NO: 3424925 - DNA, 12 bp, Homo sapiens
aaataatatgca

SEQ ID NO: 3424926 - DNA, 21 bp, Homo sapiens
aaataatctgtgagtgaaagt

SEQ ID NO: 3424927 - DNA, 12 bp, Homo sapiens
aaataatgtctc

SEQ ID NO: 3424928 - DNA, 16 bp, Homo sapiens
aaatacacatggaaaa

SEQ ID NO: 3424929 - DNA, 23 bp, Homo sapiens
aaatacagtcttccatttgcaag

SEQ ID NO: 3424930 - DNA, 22 bp, Homo sapiens
aaatacagtttgtcacatgaaa

SEQ ID NO: 3424931 - DNA, 14 bp, Homo sapiens
aaatacttttcctt

SEQ ID NO: 3424932 - DNA, 15 bp, Homo sapiens
aaatagaaaagttat

SEQ ID NO: 3424933 - DNA, 21 bp, Homo sapiens
aaatagaatatagcatctttc

SEQ ID NO: 3424934 - DNA, 19 bp, Homo sapiens
aaatagacaagagaatgct

SEQ ID NO: 3424935 - DNA, 19 bp, Homo sapiens
aaatagagtatatgcactt

SEQ ID NO: 3424936 - DNA, 21 bp, Homo sapiens
aaatagataagagtagaaact

SEQ ID NO: 3424937 - DNA, 24 bp, Homo sapiens
aaatagctcaggtgtccctgcact

SEQ ID NO: 3424938 - DNA, 16 bp, Homo sapiens
aaataggatttttaga

SEQ ID NO: 3424939 - DNA, 14 bp, Homo sapiens
aaataggcaggaag

SEQ ID NO: 3424940 - DNA, 14 bp, Homo sapiens
aaataggttaaact

SEQ ID NO: 3424941 - DNA, 19 bp, Homo sapiens
aaatagtgacataatatat

SEQ ID NO: 3424942 - DNA, 22 bp, Homo sapiens
aaatagttaagacatgatttcc

SEQ ID NO: 3424943 - DNA, 14 bp, Homo sapiens
aaatagttaatata

SEQ ID NO: 3424944 - DNA, 20 bp, Homo sapiens
aaatataagtggtgcttaga

SEQ ID NO: 3424945 - DNA, 21 bp, Homo sapiens
aaatatagctgtacaaatata

SEQ ID NO: 3424946 - DNA, 16 bp, Homo sapiens
aaatatataaatatat

SEQ ID NO: 3424947 - DNA, 16 bp, Homo sapiens
aaatatatataaacct

SEQ ID NO: 3424948 - DNA, 20 bp, Homo sapiens
aaatatatatatatataaaa

SEQ ID NO: 3424949 - DNA, 15 bp, Homo sapiens
aaatatatgaacatt

SEQ ID NO: 3424950 - DNA, 18 bp, Homo sapiens
aaatatggaacttacatt

SEQ ID NO: 3424951 - DNA, 21 bp, Homo sapiens
aaatatggaacttacattgtt

SEQ ID NO: 3424952 - DNA, 15 bp, Homo sapiens
aaatatggacactta

SEQ ID NO: 3424953 - DNA, 17 bp, Homo sapiens
aaatatgtcgtagaatt

SEQ ID NO: 3424954 - DNA, 22 bp, Homo sapiens
aaatatgtgaaaggaacatttt

SEQ ID NO: 3424955 - DNA, 20 bp, Homo sapiens
aaatattattttatgaaagg

SEQ ID NO: 3424956 - DNA, 18 bp, Homo sapiens
aaatattccctagaaact

SEQ ID NO: 3424957 - DNA, 19 bp, Homo sapiens
aaatatttataaaacttct

SEQ ID NO: 3424958 - DNA, 12 bp, Homo sapiens
aaatatttatct

SEQ ID NO: 3424959 - DNA, 15 bp, Homo sapiens
aaatatttattcatt

SEQ ID NO: 3424960 - DNA, 23 bp, Homo sapiens
aaatatttattcattatttgtca

SEQ ID NO: 3424961 - DNA, 14 bp, Homo sapiens
aaatattttctatt

SEQ ID NO: 3424962 - DNA, 15 bp, Homo sapiens
aaatattttctattt

SEQ ID NO: 3424963 - DNA, 12 bp, Homo sapiens
aaatattttctc

SEQ ID NO: 3424964 - DNA, 14 bp, Homo sapiens
aaatattttgtcta

SEQ ID NO: 3424965 - DNA, 16 bp, Homo sapiens
aaatattttgtctaaa

SEQ ID NO: 3424966 - DNA, 17 bp, Homo sapiens
aaatattttgtctaaaa

SEQ ID NO: 3424967 - DNA, 11 bp, Homo sapiens
aaatcaacttt

SEQ ID NO: 3424968 - DNA, 17 bp, Homo sapiens
aaatcaagcaagcctct

SEQ ID NO: 3424969 - DNA, 18 bp, Homo sapiens
aaatcaagtatttgggaa

SEQ ID NO: 3424970 - DNA, 23 bp, Homo sapiens
aaatcaagtatttgggaagtgaa

SEQ ID NO: 3424971 - DNA, 15 bp, Homo sapiens
aatccaatacctctt

SEQ ID NO: 3424972 - DNA, 15 bp, Homo sapiens
aatccaatgaaatga

SEQ ID NO: 3424973 - DNA, 23 bp, Homo sapiens
aatccagctgggctagaggctga

SEQ ID NO: 3424974 - DNA, 17 bp, Homo sapiens
aatccaggcagatccag

SEQ ID NO: 3424975 - DNA, 20 bp, Homo sapiens
aatccaggcagatccaggac

SEQ ID NO: 3424976 - DNA, 22 bp, Homo sapiens
aatccaggcagatccaggacta

SEQ ID NO: 3424977 - DNA, 11 bp, Homo sapiens
aatcccaaatt

SEQ ID NO: 3424978 - DNA, 14 bp, Homo sapiens
aatcccaagtaaaa

SEQ ID NO: 3424979 - DNA, 16 bp, Homo sapiens
aatccccagtaaaatt

SEQ ID NO: 3424980 - DNA, 17 bp, Homo sapiens
aatccccagtaaaattg

SEQ ID NO: 3424981 - DNA, 23 bp, Homo sapiens
aatccccagttcgcctggagccc

SEQ ID NO: 3424982 - DNA, 23 bp, Homo sapiens
aatccctagactttaggctttca

SEQ ID NO: 3424983 - DNA, 15 bp, Homo sapiens
aatcctacctgtttt

SEQ ID NO: 3424984 - DNA, 14 bp, Homo sapiens
aatcctaccttgct

SEQ ID NO: 3424985 - DNA, 17 bp, Homo sapiens
aatcctaccttgctttt

SEQ ID NO: 3424986 - DNA, 21 bp, Homo sapiens
aatcctaccttgcttttgctt

SEQ ID NO: 3424987 - DNA, 18 bp, Homo sapiens
aatcctactaataaacca

SEQ ID NO: 3424988 - DNA, 20 bp, Homo sapiens
aatcctatgtgattttaact

SEQ ID NO: 3424989 - DNA, 20 bp, Homo sapiens
aatcctcagtttttgtgaaa

SEQ ID NO: 3424990 - DNA, 19 bp, Homo sapiens
aatcctgcggcaggactgc

SEQ ID NO: 3424991 - DNA, 23 bp, Homo sapiens
aatcctgcggcaggactgcagag

SEQ ID NO: 3424992 - DNA, 19 bp, Homo sapiens
aatccttagatctggcatg

SEQ ID NO: 3424993 - DNA, 21 bp, Homo sapiens
aatcggatctggggctctggg

SEQ ID NO: 3424994 - DNA, 17 bp, Homo sapiens
aatctaatatttctagt

SEQ ID NO: 3424995 - DNA, 15 bp, Homo sapiens
aatctacccaaagga

SEQ ID NO: 3424996 - DNA, 21 bp, Homo sapiens
aatctatggtcgggagacagc

SEQ ID NO: 3424997 - DNA, 20 bp, Homo sapiens
aatctatttaattaggaaaa

SEQ ID NO: 3424998 - DNA, 15 bp, Homo sapiens
aatctcagagacagg

SEQ ID NO: 3424999 - DNA, 21 bp, Homo sapiens
aatctgaggcatcctctgact

SEQ ID NO: 3425000 - DNA, 19 bp, Homo sapiens
aatctgcaatttctactac

SEQ ID NO: 3425001 - DNA, 10 bp, Homo sapiens
aatctgcctg

SEQ ID NO: 3425002 - DNA, 20 bp, Homo sapiens
aatctgtcaagagtagttat

SEQ ID NO: 3425003 - DNA, 22 bp, Homo sapiens
aatctgtcacgtagaacttgga

SEQ ID NO: 3425004 - DNA, 17 bp, Homo sapiens
aatctgtgagtgaaagt

SEQ ID NO: 3425005 - DNA, 18 bp, Homo sapiens
aatctgtgagtgaaagtt

SEQ ID NO: 3425006 - DNA, 20 bp, Homo sapiens
aatctgttatgtactagtgt

SEQ ID NO: 3425007 - DNA, 14 bp, Homo sapiens
aatcttacagctgg

SEQ ID NO: 3425008 - DNA, 18 bp, Homo sapiens
aatcttacagctgggtgg

SEQ ID NO: 3425009 - DNA, 19 bp, Homo sapiens
aatcttataatttaaaata

SEQ ID NO: 3425010 - DNA, 20 bp, Homo sapiens
aatcttattagggagaaaat

SEQ ID NO: 3425011 - DNA, 14 bp, Homo sapiens
aatcttgaaattaa

SEQ ID NO: 3425012 - DNA, 22 bp, Homo sapiens
aatcttgactacagtcaggaaa

SEQ ID NO: 3425013 - DNA, 15 bp, Homo sapiens
aatcttgctttcttt

SEQ ID NO: 3425014 - DNA, 21 bp, Homo sapiens
aatcttgctttctttagaatt

SEQ ID NO: 3425015 - DNA, 22 bp, Homo sapiens
aatcttgctttctttagaattt

SEQ ID NO: 3425016 - DNA, 13 bp, Homo sapiens
aatcttggtttgc

SEQ ID NO: 3425017 - DNA, 15 bp, Homo sapiens
aatcttgtctcaatg

SEQ ID NO: 3425018 - DNA, 20 bp, Homo sapiens
aatcttgtctcaatgctcat

SEQ ID NO: 3425019 - DNA, 15 bp, Homo sapiens
aatctttattgagaa

SEQ ID NO: 3425020 - DNA, 16 bp, Homo sapiens
aatctttctttcttag

SEQ ID NO: 3425021 - DNA, 19 bp, Homo sapiens
aatctttctttcttagaaa

SEQ ID NO: 3425022 - DNA, 14 bp, Homo sapiens
aatgaaaaaatgta

SEQ ID NO: 3425023 - DNA, 13 bp, Homo sapiens
aatgaaaagagaa

SEQ ID NO: 3425024 - DNA, 16 bp, Homo sapiens
aatgaaaatgtcttgt

SEQ ID NO: 3425025 - DNA, 21 bp, Homo sapiens
aatgaaataatgtacatctgg

SEQ ID NO: 3425026 - DNA, 14 bp, Homo sapiens
aatgaaatattgct

SEQ ID NO: 3425027 - DNA, 18 bp, Homo sapiens
aatgaacactcttttgct

SEQ ID NO: 3425028 - DNA, 21 bp, Homo sapiens
aatgaacactcttttgcttta

SEQ ID NO: 3425029 - DNA, 17 bp, Homo sapiens
aatgaaccacatcttgc

SEQ ID NO: 3425030 - DNA, 21 bp, Homo sapiens
aatgaacccctggctccttca

SEQ ID NO: 3425031 - DNA, 12 bp, Homo sapiens
aatgaagtttga

SEQ ID NO: 3425032 - DNA, 13 bp, Homo sapiens
aatgaagtttgaa

SEQ ID NO: 3425033 - DNA, 17 bp, Homo sapiens
aatgaagtttgaatgtt

SEQ ID NO: 3425034 - DNA, 21 bp, Homo sapiens
aatgaattcctagaattaaac

SEQ ID NO: 3425035 - DNA, 17 bp, Homo sapiens
aatgacataaaaagaag

SEQ ID NO: 3425036 - DNA, 22 bp, Homo sapiens
aatgacataaaaagaagccttc

SEQ ID NO: 3425037 - DNA, 20 bp, Homo sapiens
aatgactaaaaaacaaagaa

SEQ ID NO: 3425038 - DNA, 22 bp, Homo sapiens
aatgagaagaaaatggaaccag

SEQ ID NO: 3425039 - DNA, 20 bp, Homo sapiens
aatgagaatgtgccatgtat

SEQ ID NO: 3425040 - DNA, 19 bp, Homo sapiens
aatgagagcgacacagacg

SEQ ID NO: 3425041 - DNA, 12 bp, Homo sapiens
aatgagcctggc

SEQ ID NO: 3425042 - DNA, 13 bp, Homo sapiens
aatgagcctggca

SEQ ID NO: 3425043 - DNA, 14 bp, Homo sapiens
aatgagcctggcaa

SEQ ID NO: 3425044 - DNA, 14 bp, Homo sapiens
aatgagccttaaga

SEQ ID NO: 3425045 - DNA, 16 bp, Homo sapiens
aatgaggagagaaaat

SEQ ID NO: 3425046 - DNA, 19 bp, Homo sapiens
aatgaggagagaaaatata

SEQ ID NO: 3425047 - DNA, 19 bp, Homo sapiens
aatgatcctgtattcagac

SEQ ID NO: 3425048 - DNA, 21 bp, Homo sapiens
aatgatcctgtattcagacag

SEQ ID NO: 3425049 - DNA, 18 bp, Homo sapiens
aatgatggatttaacagc

SEQ ID NO: 3425050 - DNA, 13 bp, Homo sapiens
aatgattagaagt

SEQ ID NO: 3425051 - DNA, 22 bp, Homo sapiens
aatgattcagtgttaaatgtga

SEQ ID NO: 3425052 - DNA, 12 bp, Homo sapiens
aatgatttgtca

SEQ ID NO: 3425053 - DNA, 16 bp, Homo sapiens
aatgcaaatcctatgt

SEQ ID NO: 3425054 - DNA, 17 bp, Homo sapiens
aatgcaagagaacattt

SEQ ID NO: 3425055 - DNA, 20 bp, Homo sapiens
aatgcaagagaacattttac

SEQ ID NO: 3425056 - DNA, 13 bp, Homo sapiens
aatgcacagggca

SEQ ID NO: 3425057 - DNA, 14 bp, Homo sapiens
aatgcagcgtgaag

SEQ ID NO: 3425058 - DNA, 17 bp, Homo sapiens
aatgcagtatggtacat

SEQ ID NO: 3425059 - DNA, 19 bp, Homo sapiens
aatgcagtatggtacattt

SEQ ID NO: 3425060 - DNA, 19 bp, Homo sapiens
aatgcagtctgtccaggct

SEQ ID NO: 3425061 - DNA, 18 bp, Homo sapiens
aatgcatcatcatagaaa

SEQ ID NO: 3425062 - DNA, 20 bp, Homo sapiens
aatgcatctcatcaacttaa

SEQ ID NO: 3425063 - DNA, 17 bp, Homo sapiens
aatgcatgattttgtaa

SEQ ID NO: 3425064 - DNA, 19 bp, Homo sapiens
aatgcatgattttgtaacc

SEQ ID NO: 3425065 - DNA, 15 bp, Homo sapiens
aatgcatttatagat

SEQ ID NO: 3425066 - DNA, 23 bp, Homo sapiens
aatgcatttatagatcatttcta

SEQ ID NO: 3425067 - DNA, 23 bp, Homo sapiens
aatgcattttgtttggtattgta

SEQ ID NO: 3425068 - DNA, 14 bp, Homo sapiens
aatgccaagcactt

SEQ ID NO: 3425069 - DNA, 18 bp, Homo sapiens
aatgccaggatttctcat

SEQ ID NO: 3425070 - DNA, 15 bp, Homo sapiens
aatgccatcatctcc

SEQ ID NO: 3425071 - DNA, 17 bp, Homo sapiens
aatgccatcctcaaaca

SEQ ID NO: 3425072 - DNA, 23 bp, Homo sapiens
aatgccgcgatgggtcaggtagg

SEQ ID NO: 3425073 - DNA, 21 bp, Homo sapiens
aatgcctcagtgtatttgtat

SEQ ID NO: 3425074 - DNA, 17 bp, Homo sapiens
aatgcctgagtgcctgg

SEQ ID NO: 3425075 - DNA, 19 bp, Homo sapiens
aatgctaagaatgcattat

SEQ ID NO: 3425076 - DNA, 23 bp, Homo sapiens
aatgctaccgccccaaagtaaaa

SEQ ID NO: 3425077 - DNA, 16 bp, Homo sapiens
aatgctatttgaacaa

SEQ ID NO: 3425078 - DNA, 15 bp, Homo sapiens
aatgctcagaccagc

SEQ ID NO: 3425079 - DNA, 14 bp, Homo sapiens
aatgctctctcttc

SEQ ID NO: 3425080 - DNA, 23 bp, Homo sapiens
aatgctgtacatctattttggat

SEQ ID NO: 3425081 - DNA, 21 bp, Homo sapiens
aatgcttaagagggaatgata

SEQ ID NO: 3425082 - DNA, 12 bp, Homo sapiens
aatgcttaagat

SEQ ID NO: 3425083 - DNA, 15 bp, Homo sapiens
aatgcttaagatttg

SEQ ID NO: 3425084 - DNA, 19 bp, Homo sapiens
aatgctttagaaaggtttt

SEQ ID NO: 3425085 - DNA, 20 bp, Homo sapiens
aatgctttttatttctgcat

SEQ ID NO: 3425086 - DNA, 12 bp, Homo sapiens
aatggacacttt

SEQ ID NO: 3425087 - DNA, 19 bp, Homo sapiens
aatggacttttgtacatag

SEQ ID NO: 3425088 - DNA, 20 bp, Homo sapiens
aatggagattcagttttcat

SEQ ID NO: 3425089 - DNA, 18 bp, Homo sapiens
aatggatacataaagact

SEQ ID NO: 3425090 - DNA, 22 bp, Homo sapiens
aatggatgccttgaataataag

SEQ ID NO: 3425091 - DNA, 20 bp, Homo sapiens
aatggcatgagaaatacaaa

SEQ ID NO: 3425092 - DNA, 17 bp, Homo sapiens
aatggctgtaatcattt

SEQ ID NO: 3425093 - DNA, 21 bp, Homo sapiens
aatggcttatccagctggtga

SEQ ID NO: 3425094 - DNA, 17 bp, Homo sapiens
aatgggaatcatggcct

SEQ ID NO: 3425095 - DNA, 12 bp, Homo sapiens
aatggggccaga

SEQ ID NO: 3425096 - DNA, 17 bp, Homo sapiens
aatggggtcctggccat

SEQ ID NO: 3425097 - DNA, 18 bp, Homo sapiens
aatggggtcctggccatc

SEQ ID NO: 3425098 - DNA, 17 bp, Homo sapiens
aatggtaggcatttcct

SEQ ID NO: 3425099 - DNA, 19 bp, Homo sapiens
aatggtccaggagaaggcc

SEQ ID NO: 3425100 - DNA, 23 bp, Homo sapiens
aatggttgtattagatgttctct

SEQ ID NO: 3425101 - DNA, 17 bp, Homo sapiens
aatggtttttaaatttt

SEQ ID NO: 3425102 - DNA, 13 bp, Homo sapiens
aatgtaaacattt

SEQ ID NO: 3425103 - DNA, 15 bp, Homo sapiens
aatgtaaagccatgc

SEQ ID NO: 3425104 - DNA, 15 bp, Homo sapiens
aatgtaattgtaatt

SEQ ID NO: 3425105 - DNA, 13 bp, Homo sapiens
aatgtaatttagt

SEQ ID NO: 3425106 - DNA, 17 bp, Homo sapiens
aatgtacagacatattt

SEQ ID NO: 3425107 - DNA, 19 bp, Homo sapiens
aataactagtgttgcttgg

SEQ ID NO: 3425108 - DNA, 20 bp, Homo sapiens
aataactggaacaaattatt

SEQ ID NO: 3425109 - DNA, 15 bp, Homo sapiens
aataagaatggaaaa

SEQ ID NO: 3425110 - DNA, 22 bp, Homo sapiens
aataaggacaagcctaacttca

SEQ ID NO: 3425111 - DNA, 13 bp, Homo sapiens
aataagttttttt

SEQ ID NO: 3425112 - DNA, 12 bp, Homo sapiens
aataatatactt

SEQ ID NO: 3425113 - DNA, 13 bp, Homo sapiens
aataatatacttg

SEQ ID NO: 3425114 - DNA, 20 bp, Homo sapiens
aataatctgtgagtgaaagt

SEQ ID NO: 3425115 - DNA, 13 bp, Homo sapiens
aataatcttatta

SEQ ID NO: 3425116 - DNA, 12 bp, Homo sapiens
aataatgcagta

SEQ ID NO: 3425117 - DNA, 11 bp, Homo sapiens
aataatgtctc

SEQ ID NO: 3425118 - DNA, 12 bp, Homo sapiens
aataatgtctct

SEQ ID NO: 3425119 - DNA, 20 bp, Homo sapiens
aataatttacaggttcttag

SEQ ID NO: 3425120 - DNA, 15 bp, Homo sapiens
aatacaaattggttg

SEQ ID NO: 3425121 - DNA, 14 bp, Homo sapiens
aatacacatggaaa

SEQ ID NO: 3425122 - DNA, 19 bp, Homo sapiens
aatacagattttgatagca

SEQ ID NO: 3425123 - DNA, 17 bp, Homo sapiens
aatacagtacaggcagc

SEQ ID NO: 3425124 - DNA, 21 bp, Homo sapiens
aatacagtacaggcagcacag

SEQ ID NO: 3425125 - DNA, 19 bp, Homo sapiens
aatacagtttgtcacatga

SEQ ID NO: 3425126 - DNA, 13 bp, Homo sapiens
aatacatgcatct

SEQ ID NO: 3425127 - DNA, 14 bp, Homo sapiens
aatacccagagcac

SEQ ID NO: 3425128 - DNA, 13 bp, Homo sapiens
aatacctcttgga

SEQ ID NO: 3425129 - DNA, 15 bp, Homo sapiens
aatactaccttgaaa

SEQ ID NO: 3425130 - DNA, 17 bp, Homo sapiens
aatactaccttgaaaat

SEQ ID NO: 3425131 - DNA, 16 bp, Homo sapiens
aatactccaaagatga

SEQ ID NO: 3425132 - DNA, 20 bp, Homo sapiens
aatactctaccctcttagaa

SEQ ID NO: 3425133 - DNA, 23 bp, Homo sapiens
aatactctgccctctagagcctt

SEQ ID NO: 3425134 - DNA, 13 bp, Homo sapiens
aatactgctgaga

SEQ ID NO: 3425135 - DNA, 14 bp, Homo sapiens
aatacttgaacttg

SEQ ID NO: 3425136 - DNA, 20 bp, Homo sapiens
aatacttgaacttgcctctt

SEQ ID NO: 3425137 - DNA, 11 bp, Homo sapiens
aatacttttgc

SEQ ID NO: 3425138 - DNA, 15 bp, Homo sapiens
aatactttttacaat

SEQ ID NO: 3425139 - DNA, 15 bp, Homo sapiens
aatagaaaagttatt

SEQ ID NO: 3425140 - DNA, 22 bp, Homo sapiens
aatagaaataaaggatgtgatt

SEQ ID NO: 3425141 - DNA, 19 bp, Homo sapiens
aatagaaggatgtacattt

SEQ ID NO: 3425142 - DNA, 18 bp, Homo sapiens
aatagaagtgctcccctc

SEQ ID NO: 3425143 - DNA, 13 bp, Homo sapiens
aatagaatatagc

SEQ ID NO: 3425144 - DNA, 14 bp, Homo sapiens
aatagaatatagca

SEQ ID NO: 3425145 - DNA, 23 bp, Homo sapiens
aatagacactccccgaagtcttt

SEQ ID NO: 3425146 - DNA, 16 bp, Homo sapiens
aatagagtatatgcac

SEQ ID NO: 3425147 - DNA, 16 bp, Homo sapiens
aatagcatctgtacaa

SEQ ID NO: 3425148 - DNA, 20 bp, Homo sapiens
aatagcatctgtacaaaggg

SEQ ID NO: 3425149 - DNA, 20 bp, Homo sapiens
aatagccacatttggaatac

SEQ ID NO: 3425150 - DNA, 22 bp, Homo sapiens
aatagcgctgtttttgttgtgt

SEQ ID NO: 3425151 - DNA, 13 bp, Homo sapiens
aatagctgggact

SEQ ID NO: 3425152 - DNA, 16 bp, Homo sapiens
aataggatttttagaa

SEQ ID NO: 3425153 - DNA, 14 bp, Homo sapiens
aataggcaggaagc

SEQ ID NO: 3425154 - DNA, 16 bp, Homo sapiens
aataggcattaacaca

SEQ ID NO: 3425155 - DNA, 22 bp, Homo sapiens
aataggcgatcacaacgtgcat

SEQ ID NO: 3425156 - DNA, 18 bp, Homo sapiens
aataggttaaactgaagc

SEQ ID NO: 3425157 - DNA, 12 bp, Homo sapiens
aatagtaactct

SEQ ID NO: 3425158 - DNA, 16 bp, Homo sapiens
aatagtaatttgtaaa

SEQ ID NO: 3425159 - DNA, 16 bp, Homo sapiens
aatagtctttgccagt

SEQ ID NO: 3425160 - DNA, 13 bp, Homo sapiens
aatagttaatata

SEQ ID NO: 3425161 - DNA, 15 bp, Homo sapiens
aatagttactccagt

SEQ ID NO: 3425162 - DNA, 18 bp, Homo sapiens
aatagttactccagtgcc

SEQ ID NO: 3425163 - DNA, 20 bp, Homo sapiens
aatagttactccagtgccaa

SEQ ID NO: 3425164 - DNA, 17 bp, Homo sapiens
aatataaattcactttc

SEQ ID NO: 3425165 - DNA, 14 bp, Homo sapiens
aatataagtaaagt

SEQ ID NO: 3425166 - DNA, 16 bp, Homo sapiens
aatataagtaaagtga

SEQ ID NO: 3425167 - DNA, 17 bp, Homo sapiens
aatatacttgtggacta

SEQ ID NO: 3425168 - DNA, 17 bp, Homo sapiens
aatatagcatctttcat

SEQ ID NO: 3425169 - DNA, 21 bp, Homo sapiens
aatatagctgtacaaatataa

SEQ ID NO: 3425170 - DNA, 22 bp, Homo sapiens
aatatagctgtacaaatataag

SEQ ID NO: 3425171 - DNA, 11 bp, Homo sapiens
aatatataaat

SEQ ID NO: 3425172 - DNA, 14 bp, Homo sapiens
aatatataatttat

SEQ ID NO: 3425173 - DNA, 13 bp, Homo sapiens
aatatatataaac

SEQ ID NO: 3425174 - DNA, 22 bp, Homo sapiens
aatatatatatatataaaataa

SEQ ID NO: 3425175 - DNA, 17 bp, Homo sapiens
aatatatattattctca

SEQ ID NO: 3425176 - DNA, 18 bp, Homo sapiens
aatatatattattctcat

SEQ ID NO: 3425177 - DNA, 20 bp, Homo sapiens
aatatatattattctcattt

SEQ ID NO: 3425178 - DNA, 21 bp, Homo sapiens
aatatatggcagagttgtaaa

SEQ ID NO: 3425179 - DNA, 22 bp, Homo sapiens
aatatatgtatttttatataat

SEQ ID NO: 3425180 - DNA, 13 bp, Homo sapiens
aatatatttgtgt

SEQ ID NO: 3425181 - DNA, 14 bp, Homo sapiens
aatatatttgtgta

SEQ ID NO: 3425182 - DNA, 21 bp, Homo sapiens
aatatcaaatgcagtatattt

SEQ ID NO: 3425183 - DNA, 17 bp, Homo sapiens
aatatcccgggggtggg

SEQ ID NO: 3425184 - DNA, 15 bp, Homo sapiens
aatatctaaagttat

SEQ ID NO: 3425185 - DNA, 20 bp, Homo sapiens
aatatgaatctgctcacttt

SEQ ID NO: 3425186 - DNA, 17 bp, Homo sapiens
aatatgaatgagaatgt

SEQ ID NO: 3425187 - DNA, 18 bp, Homo sapiens
aatatgaatgagaatgtg

SEQ ID NO: 3425188 - DNA, 14 bp, Homo sapiens
aatatgatgcaaac

SEQ ID NO: 3425189 - DNA, 18 bp, Homo sapiens
aatatgccagcttggaca

SEQ ID NO: 3425190 - DNA, 17 bp, Homo sapiens
aatatgctgcaacaaaa

SEQ ID NO: 3425191 - DNA, 16 bp, Homo sapiens
aatatgctggctggag

SEQ ID NO: 3425192 - DNA, 15 bp, Homo sapiens
aatatggaacttaca

SEQ ID NO: 3425193 - DNA, 16 bp, Homo sapiens
aatatggaacttacat

SEQ ID NO: 3425194 - DNA, 21 bp, Homo sapiens
aatatgtatttaccaaaaatt

SEQ ID NO: 3425195 - DNA, 20 bp, Homo sapiens
aatatgtgaagcccagcatc

SEQ ID NO: 3425196 - DNA, 20 bp, Homo sapiens
aatattaaaaagtctgtatg

SEQ ID NO: 3425197 - DNA, 14 bp, Homo sapiens
aatattatgagatg

SEQ ID NO: 3425198 - DNA, 19 bp, Homo sapiens
aatattcagacaaaatgga

SEQ ID NO: 3425199 - DNA, 20 bp, Homo sapiens
aatattcagacaaaatggat

SEQ ID NO: 3425200 - DNA, 18 bp, Homo sapiens
aatattgaatttttccta

SEQ ID NO: 3425201 - DNA, 14 bp, Homo sapiens
aatattgactttgt

SEQ ID NO: 3425202 - DNA, 16 bp, Homo sapiens
aatattgactttgtct

SEQ ID NO: 3425203 - DNA, 12 bp, Homo sapiens
aatattggtgta

SEQ ID NO: 3425204 - DNA, 13 bp, Homo sapiens
aatattgtttcta

SEQ ID NO: 3425205 - DNA, 15 bp, Homo sapiens
aatatttaaaaatgt

SEQ ID NO: 3425206 - DNA, 19 bp, Homo sapiens
aatatttaacctcttttta

SEQ ID NO: 3425207 - DNA, 22 bp, Homo sapiens
aatatttattcattatttgtca

SEQ ID NO: 3425208 - DNA, 13 bp, Homo sapiens
aatatttctattg

SEQ ID NO: 3425209 - DNA, 14 bp, Homo sapiens
aatatttctattga

SEQ ID NO: 3425210 - DNA, 12 bp, Homo sapiens
aatatttgaatc

SEQ ID NO: 3425211 - DNA, 16 bp, Homo sapiens
aatatttgaatcttgt

SEQ ID NO: 3425212 - DNA, 12 bp, Homo sapiens
aatatttgctga

SEQ ID NO: 3425213 - DNA, 14 bp, Homo sapiens
aatattttcaacta

SEQ ID NO: 3425214 - DNA, 13 bp, Homo sapiens
aatattttctatt

SEQ ID NO: 3425215 - DNA, 16 bp, Homo sapiens
aatattttctatttta

SEQ ID NO: 3425216 - DNA, 22 bp, Homo sapiens
aatattttctctgtacttttca

SEQ ID NO: 3425217 - DNA, 18 bp, Homo sapiens
aatattttctttaatgct

SEQ ID NO: 3425218 - DNA, 21 bp, Homo sapiens
aatattttctttaatgctttt

SEQ ID NO: 3425219 - DNA, 14 bp, Homo sapiens
aatattttgtctaa

SEQ ID NO: 3425220 - DNA, 14 bp, Homo sapiens
aatattttgttctt

SEQ ID NO: 3425221 - DNA, 16 bp, Homo sapiens
aatattttgttcttat

SEQ ID NO: 3425222 - DNA, 14 bp, Homo sapiens
aatatttttagata

SEQ ID NO: 3425223 - DNA, 22 bp, Homo sapiens
aatcaactttttattgccttct

SEQ ID NO: 3425224 - DNA, 15 bp, Homo sapiens
aatcaagtctgttta

SEQ ID NO: 3425225 - DNA, 12 bp, Homo sapiens
aatcagaactca

SEQ ID NO: 3425226 - DNA, 21 bp, Homo sapiens
aatcagagaccaggccctggc

SEQ ID NO: 3425227 - DNA, 14 bp, Homo sapiens
aatcagatcatttc

SEQ ID NO: 3425228 - DNA, 15 bp, Homo sapiens
aatcagatcatttca

SEQ ID NO: 3425229 - DNA, 20 bp, Homo sapiens
aatcagccaattatgttaaa

SEQ ID NO: 3425230 - DNA, 19 bp, Homo sapiens
aatcagcctgctccagctg

SEQ ID NO: 3425231 - DNA, 15 bp, Homo sapiens
aatcagtataaacaa

SEQ ID NO: 3425232 - DNA, 17 bp, Homo sapiens
aatcagtataaacaaag

SEQ ID NO: 3425233 - DNA, 12 bp, Homo sapiens
aatcatcaagaa

SEQ ID NO: 3425234 - DNA, 15 bp, Homo sapiens
aatcatccaatgctc

SEQ ID NO: 3425235 - DNA, 17 bp, Homo sapiens
aatcatgaaatatgcat

SEQ ID NO: 3425236 - DNA, 13 bp, Homo sapiens
aatcatgagcctg

SEQ ID NO: 3425237 - DNA, 16 bp, Homo sapiens
aatcatgagcctgctg

SEQ ID NO: 3425238 - DNA, 18 bp, Homo sapiens
aatcatgagcctgctgga

SEQ ID NO: 3425239 - DNA, 13 bp, Homo sapiens
aatcatgtagttt

SEQ ID NO: 3425240 - DNA, 13 bp, Homo sapiens
aatcatgttctgg

SEQ ID NO: 3425241 - DNA, 14 bp, Homo sapiens
aatcatttgtttac

SEQ ID NO: 3425242 - DNA, 22 bp, Homo sapiens
aatcatttgtttacatttgatg

SEQ ID NO: 3425243 - DNA, 20 bp, Homo sapiens
aatcattttatatgtcaaag

SEQ ID NO: 3425244 - DNA, 18 bp, Homo sapiens
aatcattttcattcctaa

SEQ ID NO: 3425245 - DNA, 15 bp, Homo sapiens
aatccaaagaaaaag

SEQ ID NO: 3425246 - DNA, 17 bp, Homo sapiens
aagcctgtgcaaaaaaa

SEQ ID NO: 3425247 - DNA, 13 bp, Homo sapiens
aagcctgtggctg

SEQ ID NO: 3425248 - DNA, 17 bp, Homo sapiens
aagcctttactgaccct

SEQ ID NO: 3425249 - DNA, 23 bp, Homo sapiens
aagcctttactgaccctggggct

SEQ ID NO: 3425250 - DNA, 15 bp, Homo sapiens
aagcgattctcctgc

SEQ ID NO: 3425251 - DNA, 14 bp, Homo sapiens
aagcgattcttctg

SEQ ID NO: 3425252 - DNA, 17 bp, Homo sapiens
aagcgattcttctgctt

SEQ ID NO: 3425253 - DNA, 21 bp, Homo sapiens
aagcgattcttctgcttcagc

SEQ ID NO: 3425254 - DNA, 15 bp, Homo sapiens
aagcggctgcctcca

SEQ ID NO: 3425255 - DNA, 14 bp, Homo sapiens
aagcggctggcagc

SEQ ID NO: 3425256 - DNA, 17 bp, Homo sapiens
aagctaagatgggtgga

SEQ ID NO: 3425257 - DNA, 15 bp, Homo sapiens
aagctaatgaccaac

SEQ ID NO: 3425258 - DNA, 23 bp, Homo sapiens
aagctactgtgtgtgtgaatgaa

SEQ ID NO: 3425259 - DNA, 12 bp, Homo sapiens
aagctaggcctg

SEQ ID NO: 3425260 - DNA, 16 bp, Homo sapiens
aagctaggcctggcca

SEQ ID NO: 3425261 - DNA, 21 bp, Homo sapiens
aagctagtgtacctcctctca

SEQ ID NO: 3425262 - DNA, 17 bp, Homo sapiens
aagctatcctggctctt

SEQ ID NO: 3425263 - DNA, 19 bp, Homo sapiens
aagctcatctatttggaac

SEQ ID NO: 3425264 - DNA, 19 bp, Homo sapiens
aagctcccaagggatggtg

SEQ ID NO: 3425265 - DNA, 21 bp, Homo sapiens
aagctcccaagggatggtgcc

SEQ ID NO: 3425266 - DNA, 15 bp, Homo sapiens
aagctccgcaggact

SEQ ID NO: 3425267 - DNA, 16 bp, Homo sapiens
aagctcctcctccctg

SEQ ID NO: 3425268 - DNA, 19 bp, Homo sapiens
aagctcctcctccctgcat

SEQ ID NO: 3425269 - DNA, 21 bp, Homo sapiens
aagctcctcctccctgcatct

SEQ ID NO: 3425270 - DNA, 20 bp, Homo sapiens
aagctcctctccccagccca

SEQ ID NO: 3425271 - DNA, 23 bp, Homo sapiens
aagctcctctccccagcccagag

SEQ ID NO: 3425272 - DNA, 22 bp, Homo sapiens
aagctctgtttataaaaacaaa

SEQ ID NO: 3425273 - DNA, 17 bp, Homo sapiens
aagctgacattgccaaa

SEQ ID NO: 3425274 - DNA, 22 bp, Homo sapiens
aagctgacattgccaaaaagga

SEQ ID NO: 3425275 - DNA, 19 bp, Homo sapiens
aagctgacgaacttccatg

SEQ ID NO: 3425276 - DNA, 13 bp, Homo sapiens
aagctgcaccctc

SEQ ID NO: 3425277 - DNA, 16 bp, Homo sapiens
aagctgctgacagtgt

SEQ ID NO: 3425278 - DNA, 20 bp, Homo sapiens
aagctggctggggtggcctg

SEQ ID NO: 3425279 - DNA, 23 bp, Homo sapiens
aagctggctggggtggcctgtgt

SEQ ID NO: 3425280 - DNA, 11 bp, Homo sapiens
aagctgggcag

SEQ ID NO: 3425281 - DNA, 18 bp, Homo sapiens
aagctggtcccactcagt

SEQ ID NO: 3425282 - DNA, 19 bp, Homo sapiens
aagctggtggcagagtcct

SEQ ID NO: 3425283 - DNA, 13 bp, Homo sapiens
aagctgttcctgt

SEQ ID NO: 3425284 - DNA, 23 bp, Homo sapiens
aagctgttctcattcctgttctt

SEQ ID NO: 3425285 - DNA, 10 bp, Homo sapiens
aagcttagaa

SEQ ID NO: 3425286 - DNA, 11 bp, Homo sapiens
aagcttagaac

SEQ ID NO: 3425287 - DNA, 18 bp, Homo sapiens
aagcttcaaccctcagcc

SEQ ID NO: 3425288 - DNA, 19 bp, Homo sapiens
aagcttcaaccctcagcct

SEQ ID NO: 3425289 - DNA, 20 bp, Homo sapiens
aagcttccatagctgctgcc

SEQ ID NO: 3425290 - DNA, 16 bp, Homo sapiens
aagcttccatgattct

SEQ ID NO: 3425291 - DNA, 21 bp, Homo sapiens
aagcttccatgattctattta

SEQ ID NO: 3425292 - DNA, 11 bp, Homo sapiens
aagcttccctc

SEQ ID NO: 3425293 - DNA, 15 bp, Homo sapiens
aagctttctgtctcc

SEQ ID NO: 3425294 - DNA, 19 bp, Homo sapiens
aagctttggtgagaacctg

SEQ ID NO: 3425295 - DNA, 18 bp, Homo sapiens
aagcttttagaaatactg

SEQ ID NO: 3425296 - DNA, 23 bp, Homo sapiens
aagcttttatttaacagtgcaaa

SEQ ID NO: 3425297 - DNA, 14 bp, Homo sapiens
aaggaaaaatgtgt

SEQ ID NO: 3425298 - DNA, 15 bp, Homo sapiens
aaggaaaaatgtgta

SEQ ID NO: 3425299 - DNA, 16 bp, Homo sapiens
aaggaaaagattcctg

SEQ ID NO: 3425300 - DNA, 20 bp, Homo sapiens
aaggaaaccacagctgctgg

SEQ ID NO: 3425301 - DNA, 12 bp, Homo sapiens
aaggaaactttc

SEQ ID NO: 3425302 - DNA, 21 bp, Homo sapiens
aaggaaactttcctttaactc

SEQ ID NO: 3425303 - DNA, 16 bp, Homo sapiens
aaggaaatctcacccc

SEQ ID NO: 3425304 - DNA, 13 bp, Homo sapiens
aaggaacttgtct

SEQ ID NO: 3425305 - DNA, 17 bp, Homo sapiens
aaggaaggtggatggcc

SEQ ID NO: 3425306 - DNA, 16 bp, Homo sapiens
aaggaatatatggcag

SEQ ID NO: 3425307 - DNA, 17 bp, Homo sapiens
aaggaatatatggcaga

SEQ ID NO: 3425308 - DNA, 23 bp, Homo sapiens
aaggaatatatggcagagttgta

SEQ ID NO: 3425309 - DNA, 12 bp, Homo sapiens
aaggacactggg

SEQ ID NO: 3425310 - DNA, 16 bp, Homo sapiens
aaggacactggggtct

SEQ ID NO: 3425311 - DNA, 18 bp, Homo sapiens
aaggacatgatgctttta

SEQ ID NO: 3425312 - DNA, 22 bp, Homo sapiens
aaggactctggaagattttcat

SEQ ID NO: 3425313 - DNA, 20 bp, Homo sapiens
aaggacttcctgtccagctc

SEQ ID NO: 3425314 - DNA, 19 bp, Homo sapiens
aaggagacaggcagagctg

SEQ ID NO: 3425315 - DNA, 19 bp, Homo sapiens
aaggagcccagaaaacctc

SEQ ID NO: 3425316 - DNA, 20 bp, Homo sapiens
aaggagcccttatctgtgct

SEQ ID NO: 3425317 - DNA, 12 bp, Homo sapiens
aaggagctgcta

SEQ ID NO: 3425318 - DNA, 14 bp, Homo sapiens
aaggagctgctata

SEQ ID NO: 3425319 - DNA, 23 bp, Homo sapiens
aaggaggattccatttggcagag

SEQ ID NO: 3425320 - DNA, 18 bp, Homo sapiens
aaggaggggaaaaaaatg

SEQ ID NO: 3425321 - DNA, 19 bp, Homo sapiens
aaggaggggaaaaaaatgt

SEQ ID NO: 3425322 - DNA, 20 bp, Homo sapiens
aaggaggggaaaaaaatgtt

SEQ ID NO: 3425323 - DNA, 16 bp, Homo sapiens
aaggatctttgtggcc

SEQ ID NO: 3425324 - DNA, 18 bp, Homo sapiens
aaggatctttgtggccaa

SEQ ID NO: 3425325 - DNA, 13 bp, Homo sapiens
aaggatgagcaga

SEQ ID NO: 3425326 - DNA, 23 bp, Homo sapiens
aaggatgtagcttttcaccttta

SEQ ID NO: 3425327 - DNA, 15 bp, Homo sapiens
aaggatgtgattgtg

SEQ ID NO: 3425328 - DNA, 16 bp, Homo sapiens
aaggatgtgggggaag

SEQ ID NO: 3425329 - DNA, 14 bp, Homo sapiens
aaggcaaaaatgta

SEQ ID NO: 3425330 - DNA, 20 bp, Homo sapiens
aaggcaaacccatcaacaaa

SEQ ID NO: 3425331 - DNA, 17 bp, Homo sapiens
aaggcaaatgcccaagg

SEQ ID NO: 3425332 - DNA, 22 bp, Homo sapiens
aaggcaatgccatcctcaaaca

SEQ ID NO: 3425333 - DNA, 15 bp, Homo sapiens
aaggcatgtgtgaaa

SEQ ID NO: 3425334 - DNA, 19 bp, Homo sapiens
aaggcatgtgtgaaacata

SEQ ID NO: 3425335 - DNA, 17 bp, Homo sapiens
aaggcattgtcctgtga

SEQ ID NO: 3425336 - DNA, 16 bp, Homo sapiens
aaggccaaacctctgt

SEQ ID NO: 3425337 - DNA, 17 bp, Homo sapiens
aaggccataaaacaggt

SEQ ID NO: 3425338 - DNA, 21 bp, Homo sapiens
aaggccatggagagctggagc

SEQ ID NO: 3425339 - DNA, 19 bp, Homo sapiens
aaggccgctgccccagccc

SEQ ID NO: 3425340 - DNA, 13 bp, Homo sapiens
aaggcctgaatca

SEQ ID NO: 3425341 - DNA, 21 bp, Homo sapiens
aaggccttcagtttatttcca

SEQ ID NO: 3425342 - DNA, 15 bp, Homo sapiens
aaggcctttaaaatt

SEQ ID NO: 3425343 - DNA, 23 bp, Homo sapiens
aaggcgatcccatcttgataaga

SEQ ID NO: 3425344 - DNA, 14 bp, Homo sapiens
aaggcgtggagctg

SEQ ID NO: 3425345 - DNA, 15 bp, Homo sapiens
aaggctatgtaaaca

SEQ ID NO: 3425346 - DNA, 23 bp, Homo sapiens
aaggctcgattttgtatctgcag

SEQ ID NO: 3425347 - DNA, 21 bp, Homo sapiens
aaggctcttctccttggagga

SEQ ID NO: 3425348 - DNA, 15 bp, Homo sapiens
aaggctgaaaagaag

SEQ ID NO: 3425349 - DNA, 17 bp, Homo sapiens
aaggctgaggaaaggcc

SEQ ID NO: 3425350 - DNA, 20 bp, Homo sapiens
aaggctgaggaaaggccagc

SEQ ID NO: 3425351 - DNA, 20 bp, Homo sapiens
aaggctggcgagagtctggc

SEQ ID NO: 3425352 - DNA, 13 bp, Homo sapiens
aagaattccaaag

SEQ ID NO: 3425353 - DNA, 14 bp, Homo sapiens
aagaattccaaagc

SEQ ID NO: 3425354 - DNA, 23 bp, Homo sapiens
aagaattctgtgagaaaaaattt

SEQ ID NO: 3425355 - DNA, 16 bp, Homo sapiens
aagaattgaagcagga

SEQ ID NO: 3425356 - DNA, 14 bp, Homo sapiens
aagaatttcacaag

SEQ ID NO: 3425357 - DNA, 18 bp, Homo sapiens
aagacaaattctgtttct

SEQ ID NO: 3425358 - DNA, 21 bp, Homo sapiens
aagacaacattaaaacaatat

SEQ ID NO: 3425359 - DNA, 15 bp, Homo sapiens
aagacaagacttcag

SEQ ID NO: 3425360 - DNA, 15 bp, Homo sapiens
aagacaatcactgcc

SEQ ID NO: 3425361 - DNA, 15 bp, Homo sapiens
aagacaatgacatac

SEQ ID NO: 3425362 - DNA, 18 bp, Homo sapiens
aagacagaagtttgcact

SEQ ID NO: 3425363 - DNA, 21 bp, Homo sapiens
aagacattagtaacataataa

SEQ ID NO: 3425364 - DNA, 16 bp, Homo sapiens
aagaccaccacctcag

SEQ ID NO: 3425365 - DNA, 19 bp, Homo sapiens
aagaccaccacctcagagt

SEQ ID NO: 3425366 - DNA, 15 bp, Homo sapiens
aagacccccagcact

SEQ ID NO: 3425367 - DNA, 15 bp, Homo sapiens
aagacctcagggcac

SEQ ID NO: 3425368 - DNA, 14 bp, Homo sapiens
aagacgccctctat

SEQ ID NO: 3425369 - DNA, 23 bp, Homo sapiens
aagacgtgtttgtgtttgtgtgt

SEQ ID NO: 3425370 - DNA, 22 bp, Homo sapiens
aagactggaagctaatttgcat

SEQ ID NO: 3425371 - DNA, 20 bp, Homo sapiens
aagacttcagtatgttgtca

SEQ ID NO: 3425372 - DNA, 18 bp, Homo sapiens
aagacttccctaacactt

SEQ ID NO: 3425373 - DNA, 14 bp, Homo sapiens
aagacttttttccc

SEQ ID NO: 3425374 - DNA, 13 bp, Homo sapiens
aagagaacatttt

SEQ ID NO: 3425375 - DNA, 18 bp, Homo sapiens
aagagaatattttaagta

SEQ ID NO: 3425376 - DNA, 20 bp, Homo sapiens
aagagaatgatgctcaaaat

SEQ ID NO: 3425377 - DNA, 22 bp, Homo sapiens
aagagacagtcaccccaggact

SEQ ID NO: 3425378 - DNA, 17 bp, Homo sapiens
aagagagaacaggacta

SEQ ID NO: 3425379 - DNA, 22 bp, Homo sapiens
aagagagcttaatgataatatt

SEQ ID NO: 3425380 - DNA, 13 bp, Homo sapiens
aagagatattttg

SEQ ID NO: 3425381 - DNA, 19 bp, Homo sapiens
aagagcaatgtgtggctga

SEQ ID NO: 3425382 - DNA, 16 bp, Homo sapiens
aagagcacttaagaga

SEQ ID NO: 3425383 - DNA, 17 bp, Homo sapiens
aagagcacttaagagaa

SEQ ID NO: 3425384 - DNA, 18 bp, Homo sapiens
aagagcccagtctgttga

SEQ ID NO: 3425385 - DNA, 14 bp, Homo sapiens
aagaggcaagaggc

SEQ ID NO: 3425386 - DNA, 16 bp, Homo sapiens
aagagggtgagggcct

SEQ ID NO: 3425387 - DNA, 20 bp, Homo sapiens
aagagggtgagggccttctt

SEQ ID NO: 3425388 - DNA, 22 bp, Homo sapiens
aagagggttttaggtagaaaaa

SEQ ID NO: 3425389 - DNA, 22 bp, Homo sapiens
aagagtctaaaccccagattct

SEQ ID NO: 3425390 - DNA, 22 bp, Homo sapiens
aagagtgacagtggattgcatt

SEQ ID NO: 3425391 - DNA, 19 bp, Homo sapiens
aagagtgactctccagggg

SEQ ID NO: 3425392 - DNA, 22 bp, Homo sapiens
aagagtgactctccaggggtcc

SEQ ID NO: 3425393 - DNA, 22 bp, Homo sapiens
aagataagatttctgtctacta

SEQ ID NO: 3425394 - DNA, 21 bp, Homo sapiens
aagataagtgtatttttcaat

SEQ ID NO: 3425395 - DNA, 21 bp, Homo sapiens
aagataatattaaggaagaca

SEQ ID NO: 3425396 - DNA, 20 bp, Homo sapiens
aagatacagaactctttcaa

SEQ ID NO: 3425397 - DNA, 17 bp, Homo sapiens
aagatagcttcacccca

SEQ ID NO: 3425398 - DNA, 16 bp, Homo sapiens
aagatataagtgctgt

SEQ ID NO: 3425399 - DNA, 20 bp, Homo sapiens
aagatataagtgctgtataa

SEQ ID NO: 3425400 - DNA, 19 bp, Homo sapiens
aagatatattaaaaatata

SEQ ID NO: 3425401 - DNA, 20 bp, Homo sapiens
aagatatattaaaaatataa

SEQ ID NO: 3425402 - DNA, 19 bp, Homo sapiens
aagatattttaaaatctgt

SEQ ID NO: 3425403 - DNA, 20 bp, Homo sapiens
aagatcactgccagagataa

SEQ ID NO: 3425404 - DNA, 21 bp, Homo sapiens
aagatctcactctgccccccc

SEQ ID NO: 3425405 - DNA, 17 bp, Homo sapiens
aagatctgtcctcagcc

SEQ ID NO: 3425406 - DNA, 18 bp, Homo sapiens
aagatctgtcctcagcct

SEQ ID NO: 3425407 - DNA, 19 bp, Homo sapiens
aagatgacttcccctgcct

SEQ ID NO: 3425408 - DNA, 22 bp, Homo sapiens
aagatgacttcccctgcctcct

SEQ ID NO: 3425409 - DNA, 18 bp, Homo sapiens
aagatgagagaactggag

SEQ ID NO: 3425410 - DNA, 16 bp, Homo sapiens
aagatgcttctcactg

SEQ ID NO: 3425411 - DNA, 12 bp, Homo sapiens
aagatgctttta

SEQ ID NO: 3425412 - DNA, 19 bp, Homo sapiens
aagatgggggcagggctgt

SEQ ID NO: 3425413 - DNA, 18 bp, Homo sapiens
aagatggggtctgtaaaa

SEQ ID NO: 3425414 - DNA, 19 bp, Homo sapiens
aagatggggtctgtaaaat

SEQ ID NO: 3425415 - DNA, 20 bp, Homo sapiens
aagatggggtctgtaaaatc

SEQ ID NO: 3425416 - DNA, 11 bp, Homo sapiens
aagatgtctgt

SEQ ID NO: 3425417 - DNA, 12 bp, Homo sapiens
aagatgtctgtt

SEQ ID NO: 3425418 - DNA, 17 bp, Homo sapiens
aagattcctgtccttca

SEQ ID NO: 3425419 - DNA, 17 bp, Homo sapiens
aagatttggaagctctt

SEQ ID NO: 3425420 - DNA, 17 bp, Homo sapiens
aagatttggaataaagt

SEQ ID NO: 3425421 - DNA, 17 bp, Homo sapiens
aagattttaatcaagtt

SEQ ID NO: 3425422 - DNA, 16 bp, Homo sapiens
aagcaaacccagacgg

SEQ ID NO: 3425423 - DNA, 12 bp, Homo sapiens
aagcaaagggga

SEQ ID NO: 3425424 - DNA, 14 bp, Homo sapiens
aagcaaggcggtgg

SEQ ID NO: 3425425 - DNA, 22 bp, Homo sapiens
aagcaagtgattgggacagagg

SEQ ID NO: 3425426 - DNA, 19 bp, Homo sapiens
aagcacactcatcccctca

SEQ ID NO: 3425427 - DNA, 11 bp, Homo sapiens
aagcacagcag

SEQ ID NO: 3425428 - DNA, 16 bp, Homo sapiens
aagcacagcagcctgg

SEQ ID NO: 3425429 - DNA, 11 bp, Homo sapiens
aagcacagctg

SEQ ID NO: 3425430 - DNA, 16 bp, Homo sapiens
aagcacatctgcattt

SEQ ID NO: 3425431 - DNA, 13 bp, Homo sapiens
aagcacctcctgc

SEQ ID NO: 3425432 - DNA, 14 bp, Homo sapiens
aagcacctcctgcc

SEQ ID NO: 3425433 - DNA, 16 bp, Homo sapiens
aagcacctcctgcctc

SEQ ID NO: 3425434 - DNA, 12 bp, Homo sapiens
aagcactgagca

SEQ ID NO: 3425435 - DNA, 15 bp, Homo sapiens
aagcactgtgctcag

SEQ ID NO: 3425436 - DNA, 16 bp, Homo sapiens
aagcactgtgctcagg

SEQ ID NO: 3425437 - DNA, 14 bp, Homo sapiens
aagcacttgaagaa

SEQ ID NO: 3425438 - DNA, 19 bp, Homo sapiens
aagcagaaaataaaggaag

SEQ ID NO: 3425439 - DNA, 21 bp, Homo sapiens
aagcagaccactgataaaacc

SEQ ID NO: 3425440 - DNA, 14 bp, Homo sapiens
aagcagagaagctc

SEQ ID NO: 3425441 - DNA, 15 bp, Homo sapiens
aagcagagcattttt

SEQ ID NO: 3425442 - DNA, 14 bp, Homo sapiens
aagcagaggaagga

SEQ ID NO: 3425443 - DNA, 20 bp, Homo sapiens
aagcagaggaggggccgctg

SEQ ID NO: 3425444 - DNA, 18 bp, Homo sapiens
aagcagatgcaaagaggc

SEQ ID NO: 3425445 - DNA, 19 bp, Homo sapiens
aagcagatgcaaagaggca

SEQ ID NO: 3425446 - DNA, 21 bp, Homo sapiens
aagcagatgcaaagaggcaag

SEQ ID NO: 3425447 - DNA, 23 bp, Homo sapiens
aagcagatgcaaagaggcaagag

SEQ ID NO: 3425448 - DNA, 16 bp, Homo sapiens
aagcagcctctcccca

SEQ ID NO: 3425449 - DNA, 18 bp, Homo sapiens
aagcaggaaaaacaaatg

SEQ ID NO: 3425450 - DNA, 11 bp, Homo sapiens
aagcaggaagc

SEQ ID NO: 3425451 - DNA, 13 bp, Homo sapiens
aagcaggaagctc

SEQ ID NO: 3425452 - DNA, 16 bp, Homo sapiens
aagcaggctacactga

SEQ ID NO: 3425453 - DNA, 17 bp, Homo sapiens
aagcaggggagtatgca

SEQ ID NO: 3425454 - DNA, 19 bp, Homo sapiens
aagcaggggagtatgcaaa

SEQ ID NO: 3425455 - DNA, 14 bp, Homo sapiens
aagcagtagacaag

SEQ ID NO: 3425456 - DNA, 17 bp, Homo sapiens
aagcagtcgtgcctgtg

SEQ ID NO: 3425457 - DNA, 17 bp, Homo sapiens
aagcataaaaacatttt

SEQ ID NO: 3425458 - DNA, 18 bp, Homo sapiens
aagcatactttgtaaata

SEQ ID NO: 3425459 - DNA, 21 bp, Homo sapiens
aagcatatcgtaaagctgttc

SEQ ID NO: 3425460 - DNA, 20 bp, Homo sapiens
aagcatcttgggggggtggc

SEQ ID NO: 3425461 - DNA, 22 bp, Homo sapiens
aagcatgggggaccccttccca

SEQ ID NO: 3425462 - DNA, 13 bp, Homo sapiens
aagcatgttgtga

SEQ ID NO: 3425463 - DNA, 12 bp, Homo sapiens
aagcattcacaa

SEQ ID NO: 3425464 - DNA, 13 bp, Homo sapiens
aagccaaagccaa

SEQ ID NO: 3425465 - DNA, 17 bp, Homo sapiens
aagccaaagctaggcct

SEQ ID NO: 3425466 - DNA, 14 bp, Homo sapiens
aagccaagaaagat

SEQ ID NO: 3425467 - DNA, 13 bp, Homo sapiens
aacgctgcctgcc

SEQ ID NO: 3425468 - DNA, 15 bp, Homo sapiens
aacgctgcctgccca

SEQ ID NO: 3425469 - DNA, 14 bp, Homo sapiens
aacggagaaaggtg

SEQ ID NO: 3425470 - DNA, 19 bp, Homo sapiens
aacggagagcgcctgcccc

SEQ ID NO: 3425471 - DNA, 16 bp, Homo sapiens
aacggggctcttctca

SEQ ID NO: 3425472 - DNA, 18 bp, Homo sapiens
aacggggctcttctcatt

SEQ ID NO: 3425473 - DNA, 17 bp, Homo sapiens
aacggtaaatttctgtg

SEQ ID NO: 3425474 - DNA, 16 bp, Homo sapiens
aacgtattagttgcca

SEQ ID NO: 3425475 - DNA, 14 bp, Homo sapiens
aacgtcatctcagg

SEQ ID NO: 3425476 - DNA, 18 bp, Homo sapiens
aacgtgaaacttatagtt

SEQ ID NO: 3425477 - DNA, 16 bp, Homo sapiens
aactaaactcatttat

SEQ ID NO: 3425478 - DNA, 16 bp, Homo sapiens
aactaaactctctttg

SEQ ID NO: 3425479 - DNA, 19 bp, Homo sapiens
aactaaagaagatctgtaa

SEQ ID NO: 3425480 - DNA, 15 bp, Homo sapiens
aactaaggtgctaaa

SEQ ID NO: 3425481 - DNA, 20 bp, Homo sapiens
aactaattgactttagaaag

SEQ ID NO: 3425482 - DNA, 20 bp, Homo sapiens
aactagatcaaggagcccag

SEQ ID NO: 3425483 - DNA, 18 bp, Homo sapiens
aactagcatatctgcctt

SEQ ID NO: 3425484 - DNA, 13 bp, Homo sapiens
aactagcccctgg

SEQ ID NO: 3425485 - DNA, 16 bp, Homo sapiens
aactatattttgtcat

SEQ ID NO: 3425486 - DNA, 18 bp, Homo sapiens
aactatggatcagaatag

SEQ ID NO: 3425487 - DNA, 21 bp, Homo sapiens
aactattaaggatgtagcttt

SEQ ID NO: 3425488 - DNA, 14 bp, Homo sapiens
aactattcatgcta

SEQ ID NO: 3425489 - DNA, 21 bp, Homo sapiens
aactatttattgactctgggt

SEQ ID NO: 3425490 - DNA, 12 bp, Homo sapiens
aactattttcag

SEQ ID NO: 3425491 - DNA, 14 bp, Homo sapiens
aactattttcagat

SEQ ID NO: 3425492 - DNA, 22 bp, Homo sapiens
aactcaaacttctggctccctc

SEQ ID NO: 3425493 - DNA, 23 bp, Homo sapiens
aactcaaacttctggctccctct

SEQ ID NO: 3425494 - DNA, 20 bp, Homo sapiens
aactcacctggggctgctgg

SEQ ID NO: 3425495 - DNA, 14 bp, Homo sapiens
aactcagatccagg

SEQ ID NO: 3425496 - DNA, 18 bp, Homo sapiens
aactcagttttaactaga

SEQ ID NO: 3425497 - DNA, 18 bp, Homo sapiens
aactcatcactgtggctg

SEQ ID NO: 3425498 - DNA, 19 bp, Homo sapiens
aactccaccttgcggggat

SEQ ID NO: 3425499 - DNA, 18 bp, Homo sapiens
aactccctttttacactt

SEQ ID NO: 3425500 - DNA, 21 bp, Homo sapiens
aactcctagggccactgaaga

SEQ ID NO: 3425501 - DNA, 14 bp, Homo sapiens
aactccttcctggc

SEQ ID NO: 3425502 - DNA, 17 bp, Homo sapiens
aactccttcctggcctg

SEQ ID NO: 3425503 - DNA, 19 bp, Homo sapiens
aactctagctgggggtggg

SEQ ID NO: 3425504 - DNA, 17 bp, Homo sapiens
aactcttgattatccat

SEQ ID NO: 3425505 - DNA, 12 bp, Homo sapiens
aactctttcaaa

SEQ ID NO: 3425506 - DNA, 18 bp, Homo sapiens
aactgaagcagcctctcc

SEQ ID NO: 3425507 - DNA, 12 bp, Homo sapiens
aactgagcctag

SEQ ID NO: 3425508 - DNA, 17 bp, Homo sapiens
aactgagcctagctacc

SEQ ID NO: 3425509 - DNA, 13 bp, Homo sapiens
aactgagggctga

SEQ ID NO: 3425510 - DNA, 17 bp, Homo sapiens
aactgagggctgatctt

SEQ ID NO: 3425511 - DNA, 18 bp, Homo sapiens
aactgagggctgatcttt

SEQ ID NO: 3425512 - DNA, 21 bp, Homo sapiens
aactgattaaatatttgaaga

SEQ ID NO: 3425513 - DNA, 18 bp, Homo sapiens
aactgcaggccctggcct

SEQ ID NO: 3425514 - DNA, 23 bp, Homo sapiens
aactgcaggccctggcctcccct

SEQ ID NO: 3425515 - DNA, 16 bp, Homo sapiens
aactgcatgctgctgg

SEQ ID NO: 3425516 - DNA, 14 bp, Homo sapiens
aactgcattgagaa

SEQ ID NO: 3425517 - DNA, 20 bp, Homo sapiens
aactgcattgagaactgcat

SEQ ID NO: 3425518 - DNA, 16 bp, Homo sapiens
aactgcattggctttg

SEQ ID NO: 3425519 - DNA, 19 bp, Homo sapiens
aactggaccctgttgctaa

SEQ ID NO: 3425520 - DNA, 11 bp, Homo sapiens
aactggctgca

SEQ ID NO: 3425521 - DNA, 21 bp, Homo sapiens
aactggtattctgttctggag

SEQ ID NO: 3425522 - DNA, 22 bp, Homo sapiens
aactggtattctgttctggagg

SEQ ID NO: 3425523 - DNA, 17 bp, Homo sapiens
aactggtcttccttttt

SEQ ID NO: 3425524 - DNA, 20 bp, Homo sapiens
aactggtgcactttgtaaat

SEQ ID NO: 3425525 - DNA, 13 bp, Homo sapiens
aactgtaaataaa

SEQ ID NO: 3425526 - DNA, 11 bp, Homo sapiens
aactgtaaatc

SEQ ID NO: 3425527 - DNA, 18 bp, Homo sapiens
aactgtacttttaaggca

SEQ ID NO: 3425528 - DNA, 23 bp, Homo sapiens
aactgtgatgaagccgaccttag

SEQ ID NO: 3425529 - DNA, 13 bp, Homo sapiens
aactgtgtagcat

SEQ ID NO: 3425530 - DNA, 15 bp, Homo sapiens
aactgtgtagcatct

SEQ ID NO: 3425531 - DNA, 15 bp, Homo sapiens
aactgttcccacctg

SEQ ID NO: 3425532 - DNA, 18 bp, Homo sapiens
aactgttcccacctgctg

SEQ ID NO: 3425533 - DNA, 16 bp, Homo sapiens
aactgtttcaaagcca

SEQ ID NO: 3425534 - DNA, 14 bp, Homo sapiens
aacttaagcaaagg

SEQ ID NO: 3425535 - DNA, 18 bp, Homo sapiens
aacttacaaaaacacttc

SEQ ID NO: 3425536 - DNA, 21 bp, Homo sapiens
aacttacattgttcaattaga

SEQ ID NO: 3425537 - DNA, 22 bp, Homo sapiens
aacttagccatttttcaaagca

SEQ ID NO: 3425538 - DNA, 17 bp, Homo sapiens
aacttccccatcttcta

SEQ ID NO: 3425539 - DNA, 12 bp, Homo sapiens
aacttgaaaaat

SEQ ID NO: 3425540 - DNA, 22 bp, Homo sapiens
aacttgaaatctaatatttcta

SEQ ID NO: 3425541 - DNA, 15 bp, Homo sapiens
aacttgaccctgagc

SEQ ID NO: 3425542 - DNA, 18 bp, Homo sapiens
aacttgaccctgagctga

SEQ ID NO: 3425543 - DNA, 22 bp, Homo sapiens
aacttgcctcttttacctgctg

SEQ ID NO: 3425544 - DNA, 14 bp, Homo sapiens
aacttgctgctgtc

SEQ ID NO: 3425545 - DNA, 18 bp, Homo sapiens
aacttgcttatcaacttc

SEQ ID NO: 3425546 - DNA, 22 bp, Homo sapiens
aacttggctcgaatctctgtgc

SEQ ID NO: 3425547 - DNA, 19 bp, Homo sapiens
aacttggctgcaggaatct

SEQ ID NO: 3425548 - DNA, 16 bp, Homo sapiens
aacttgggcacatgct

SEQ ID NO: 3425549 - DNA, 14 bp, Homo sapiens
aactttattaaata

SEQ ID NO: 3425550 - DNA, 23 bp, Homo sapiens
aactttattaaatacaaaacttc

SEQ ID NO: 3425551 - DNA, 19 bp, Homo sapiens
aactttcctggatgtctga

SEQ ID NO: 3425552 - DNA, 15 bp, Homo sapiens
aactttcttatccta

SEQ ID NO: 3425553 - DNA, 14 bp, Homo sapiens
aactttgaataaag

SEQ ID NO: 3425554 - DNA, 20 bp, Homo sapiens
aactttgaataaagaatact

SEQ ID NO: 3425555 - DNA, 17 bp, Homo sapiens
aactttggttcctgtga

SEQ ID NO: 3425556 - DNA, 19 bp, Homo sapiens
aacttttcattccctgtag

SEQ ID NO: 3425557 - DNA, 14 bp, Homo sapiens
aactttttacatta

SEQ ID NO: 3425558 - DNA, 12 bp, Homo sapiens
aacttttttggt

SEQ ID NO: 3425559 - DNA, 12 bp, Homo sapiens
aagaaaaagatt

SEQ ID NO: 3425560 - DNA, 20 bp, Homo sapiens
aagaaaaccaccccttagat

SEQ ID NO: 3425561 - DNA, 22 bp, Homo sapiens
aagaaaagtgcatatttatcca

SEQ ID NO: 3425562 - DNA, 12 bp, Homo sapiens
aagaaaatagat

SEQ ID NO: 3425563 - DNA, 11 bp, Homo sapiens
aagaaaatatt

SEQ ID NO: 3425564 - DNA, 13 bp, Homo sapiens
aagaaaatatttt

SEQ ID NO: 3425565 - DNA, 20 bp, Homo sapiens
aagaaaatattttgtctaaa

SEQ ID NO: 3425566 - DNA, 16 bp, Homo sapiens
aagaaacccgacagag

SEQ ID NO: 3425567 - DNA, 15 bp, Homo sapiens
aagaaacctactgcc

SEQ ID NO: 3425568 - DNA, 16 bp, Homo sapiens
aagaaacctactgccc

SEQ ID NO: 3425569 - DNA, 12 bp, Homo sapiens
aagaaagaatgt

SEQ ID NO: 3425570 - DNA, 20 bp, Homo sapiens
aagaaagaatgttactgcct

SEQ ID NO: 3425571 - DNA, 22 bp, Homo sapiens
aagaaagaatgttactgcctta

SEQ ID NO: 3425572 - DNA, 22 bp, Homo sapiens
aagaaagttgcacggctgctga

SEQ ID NO: 3425573 - DNA, 20 bp, Homo sapiens
aagaacaaaaaaatctgcag

SEQ ID NO: 3425574 - DNA, 16 bp, Homo sapiens
aagaacatgatgggcc

SEQ ID NO: 3425575 - DNA, 19 bp, Homo sapiens
aagaacatgcagtttgaaa

SEQ ID NO: 3425576 - DNA, 20 bp, Homo sapiens
aagaacatgcagtttgaaat

SEQ ID NO: 3425577 - DNA, 15 bp, Homo sapiens
aagaacccctctgct

SEQ ID NO: 3425578 - DNA, 20 bp, Homo sapiens
aagaactacaaacaaaattt

SEQ ID NO: 3425579 - DNA, 19 bp, Homo sapiens
aagaactcatcactgtggc

SEQ ID NO: 3425580 - DNA, 20 bp, Homo sapiens
aagaactcatcactgtggct

SEQ ID NO: 3425581 - DNA, 20 bp, Homo sapiens
aagaactgtcatgtaaacat

SEQ ID NO: 3425582 - DNA, 22 bp, Homo sapiens
aagaactgtcatgtaaacatac

SEQ ID NO: 3425583 - DNA, 13 bp, Homo sapiens
aagaactttgagc

SEQ ID NO: 3425584 - DNA, 12 bp, Homo sapiens
aagaagaaaaag

SEQ ID NO: 3425585 - DNA, 14 bp, Homo sapiens
aagaagaaaaaggt

SEQ ID NO: 3425586 - DNA, 22 bp, Homo sapiens
aagaagatgatcagtggacagt

SEQ ID NO: 3425587 - DNA, 12 bp, Homo sapiens
aagaagcaggct

SEQ ID NO: 3425588 - DNA, 14 bp, Homo sapiens
aagaagcaggctac

SEQ ID NO: 3425589 - DNA, 15 bp, Homo sapiens
aagaagctctctcct

SEQ ID NO: 3425590 - DNA, 11 bp, Homo sapiens
aagaagggctg

SEQ ID NO: 3425591 - DNA, 22 bp, Homo sapiens
agggatcaaccagctaagaaaa

SEQ ID NO: 3425592 - DNA, 16 bp, Homo sapiens
agggatccctcatctg

SEQ ID NO: 3425593 - DNA, 22 bp, Homo sapiens
agggatccctcatctgtccctc

SEQ ID NO: 3425594 - DNA, 17 bp, Homo sapiens
agggatgaaagagaagg

SEQ ID NO: 3425595 - DNA, 19 bp, Homo sapiens
agggatgagcatggagctg

SEQ ID NO: 3425596 - DNA, 17 bp, Homo sapiens
agggatgccctggaggt

SEQ ID NO: 3425597 - DNA, 20 bp, Homo sapiens
agggatgccctggaggtggc

SEQ ID NO: 3425598 - DNA, 21 bp, Homo sapiens
agggatgttattatccttggg

SEQ ID NO: 3425599 - DNA, 16 bp, Homo sapiens
agggattctcacaata

SEQ ID NO: 3425600 - DNA, 20 bp, Homo sapiens
agggattctggttccagggt

SEQ ID NO: 3425601 - DNA, 22 bp, Homo sapiens
agggatttgcctcaccttgggg

SEQ ID NO: 3425602 - DNA, 19 bp, Homo sapiens
agggcaagctccgcaggac

SEQ ID NO: 3425603 - DNA, 20 bp, Homo sapiens
agggcacaagtcctggatgt

SEQ ID NO: 3425604 - DNA, 21 bp, Homo sapiens
agggcacaccgggcactcaga

SEQ ID NO: 3425605 - DNA, 14 bp, Homo sapiens
agggcaccaggggt

SEQ ID NO: 3425606 - DNA, 15 bp, Homo sapiens
agggcagcagaaggg

SEQ ID NO: 3425607 - DNA, 21 bp, Homo sapiens
agggcagcagaagggggtggt

SEQ ID NO: 3425608 - DNA, 15 bp, Homo sapiens
agggcagcagggcta

SEQ ID NO: 3425609 - DNA, 20 bp, Homo sapiens
agggcagtcattggctgtct

SEQ ID NO: 3425610 - DNA, 13 bp, Homo sapiens
agggcatcttgct

SEQ ID NO: 3425611 - DNA, 14 bp, Homo sapiens
agggcatgggtcgg

SEQ ID NO: 3425612 - DNA, 20 bp, Homo sapiens
agggccaaacgctgagccac

SEQ ID NO: 3425613 - DNA, 22 bp, Homo sapiens
agggccaaacgctgagccacct

SEQ ID NO: 3425614 - DNA, 12 bp, Homo sapiens
agggccaacaac

SEQ ID NO: 3425615 - DNA, 21 bp, Homo sapiens
agggccaagcccagcactgct

SEQ ID NO: 3425616 - DNA, 16 bp, Homo sapiens
agggccacgctccagc

SEQ ID NO: 3425617 - DNA, 14 bp, Homo sapiens
agggccactgaaga

SEQ ID NO: 3425618 - DNA, 13 bp, Homo sapiens
agggccagagcca

SEQ ID NO: 3425619 - DNA, 23 bp, Homo sapiens
agggccatgctgaggcctgggcc

SEQ ID NO: 3425620 - DNA, 18 bp, Homo sapiens
agggcccagagagggtgg

SEQ ID NO: 3425621 - DNA, 15 bp, Homo sapiens
agggcccagagccca

SEQ ID NO: 3425622 - DNA, 16 bp, Homo sapiens
agggcccagagcccag

SEQ ID NO: 3425623 - DNA, 18 bp, Homo sapiens
agggcctgagcctggcca

SEQ ID NO: 3425624 - DNA, 20 bp, Homo sapiens
agggcctgagcctggccagc

SEQ ID NO: 3425625 - DNA, 20 bp, Homo sapiens
agggcctgcaggacctgcct

SEQ ID NO: 3425626 - DNA, 22 bp, Homo sapiens
agggcctgcaggacctgcctgt

SEQ ID NO: 3425627 - DNA, 23 bp, Homo sapiens
agggcctgcaggacctgcctgta

SEQ ID NO: 3425628 - DNA, 13 bp, Homo sapiens
agggcctgctgga

SEQ ID NO: 3425629 - DNA, 15 bp, Homo sapiens
agggcctgctggagg

SEQ ID NO: 3425630 - DNA, 17 bp, Homo sapiens
agggcctggttgaagaa

SEQ ID NO: 3425631 - DNA, 13 bp, Homo sapiens
agggcggcagggg

SEQ ID NO: 3425632 - DNA, 20 bp, Homo sapiens
agggcgggcagagggctgga

SEQ ID NO: 3425633 - DNA, 20 bp, Homo sapiens
agggcgttcttaggctgctg

SEQ ID NO: 3425634 - DNA, 20 bp, Homo sapiens
agggctaccctgagctgagg

SEQ ID NO: 3425635 - DNA, 15 bp, Homo sapiens
agggctatggtgtgg

SEQ ID NO: 3425636 - DNA, 15 bp, Homo sapiens
agggctctaaaaaaa

SEQ ID NO: 3425637 - DNA, 14 bp, Homo sapiens
agggctctgaccag

SEQ ID NO: 3425638 - DNA, 15 bp, Homo sapiens
agggctctgaccagt

SEQ ID NO: 3425639 - DNA, 14 bp, Homo sapiens
agggctgaaccctc

SEQ ID NO: 3425640 - DNA, 15 bp, Homo sapiens
agggctgcatgatgt

SEQ ID NO: 3425641 - DNA, 17 bp, Homo sapiens
agggctgccgggccagg

SEQ ID NO: 3425642 - DNA, 17 bp, Homo sapiens
agggctgctagacggag

SEQ ID NO: 3425643 - DNA, 16 bp, Homo sapiens
agggctggactgaggc

SEQ ID NO: 3425644 - DNA, 15 bp, Homo sapiens
agggctggaggccca

SEQ ID NO: 3425645 - DNA, 19 bp, Homo sapiens
agggctggaggcccaggct

SEQ ID NO: 3425646 - DNA, 21 bp, Homo sapiens
agggctggaggcccaggctgg

SEQ ID NO: 3425647 - DNA, 19 bp, Homo sapiens
agggctgtcatctgtgcac

SEQ ID NO: 3425648 - DNA, 23 bp, Homo sapiens
agggcttctgccatttctgagat

SEQ ID NO: 3425649 - DNA, 15 bp, Homo sapiens
aggggaaaaaaatgt

SEQ ID NO: 3425650 - DNA, 17 bp, Homo sapiens
aggggaaaaaaatgttg

SEQ ID NO: 3425651 - DNA, 18 bp, Homo sapiens
aggggacccccgccccct

SEQ ID NO: 3425652 - DNA, 22 bp, Homo sapiens
aggggacccccgccccctgccc

SEQ ID NO: 3425653 - DNA, 15 bp, Homo sapiens
aggggacgcaggccc

SEQ ID NO: 3425654 - DNA, 19 bp, Homo sapiens
aggggacgcaggcccctct

SEQ ID NO: 3425655 - DNA, 13 bp, Homo sapiens
aggggagcccact

SEQ ID NO: 3425656 - DNA, 12 bp, Homo sapiens
aggggagtagag

SEQ ID NO: 3425657 - DNA, 16 bp, Homo sapiens
aggggagttgtgtctg

SEQ ID NO: 3425658 - DNA, 15 bp, Homo sapiens
aggggatggagtgag

SEQ ID NO: 3425659 - DNA, 21 bp, Homo sapiens
aggggatggagtgagcccatg

SEQ ID NO: 3425660 - DNA, 17 bp, Homo sapiens
aggggcaaattcttttg

SEQ ID NO: 3425661 - DNA, 12 bp, Homo sapiens
aggggccagagg

SEQ ID NO: 3425662 - DNA, 18 bp, Homo sapiens
aggggcccccctgccctg

SEQ ID NO: 3425663 - DNA, 17 bp, Homo sapiens
aggggcccggccagcca

SEQ ID NO: 3425664 - DNA, 15 bp, Homo sapiens
aggggccgctgccac

SEQ ID NO: 3425665 - DNA, 16 bp, Homo sapiens
aggggccgctgccacc

SEQ ID NO: 3425666 - DNA, 19 bp, Homo sapiens
aggggcctaggcctcagcc

SEQ ID NO: 3425667 - DNA, 21 bp, Homo sapiens
aggggcctggagatcctcctg

SEQ ID NO: 3425668 - DNA, 18 bp, Homo sapiens
aggggcggtgcccacacc

SEQ ID NO: 3425669 - DNA, 22 bp, Homo sapiens
aggggcgtctgttcccccttca

SEQ ID NO: 3425670 - DNA, 20 bp, Homo sapiens
aggggcgtgggagtggcctg

SEQ ID NO: 3425671 - DNA, 16 bp, Homo sapiens
aggggctgcttcctcc

SEQ ID NO: 3425672 - DNA, 19 bp, Homo sapiens
agggggatccgactgcttt

SEQ ID NO: 3425673 - DNA, 16 bp, Homo sapiens
agggggatgccactcc

SEQ ID NO: 3425674 - DNA, 19 bp, Homo sapiens
aggggtcgacttcgggctg

SEQ ID NO: 3425675 - DNA, 15 bp, Homo sapiens
aggggtcggctgacc

SEQ ID NO: 3425676 - DNA, 21 bp, Homo sapiens
aggggtggctgcctcatttag

SEQ ID NO: 3425677 - DNA, 16 bp, Homo sapiens
agggtatcaggtgctg

SEQ ID NO: 3425678 - DNA, 19 bp, Homo sapiens
agggtatcaggtgctgcca

SEQ ID NO: 3425679 - DNA, 20 bp, Homo sapiens
agggtcaacatcttttacat

SEQ ID NO: 3425680 - DNA, 12 bp, Homo sapiens
agggtccctggg

SEQ ID NO: 3425681 - DNA, 21 bp, Homo sapiens
agggtctcactctgtcgccca

SEQ ID NO: 3425682 - DNA, 13 bp, Homo sapiens
agggtctctgctg

SEQ ID NO: 3425683 - DNA, 16 bp, Homo sapiens
agggtgagggccttct

SEQ ID NO: 3425684 - DNA, 17 bp, Homo sapiens
agggtgagggccttctt

SEQ ID NO: 3425685 - DNA, 18 bp, Homo sapiens
agggtgagggccttctta

SEQ ID NO: 3425686 - DNA, 20 bp, Homo sapiens
agggtgagggccttcttaag

SEQ ID NO: 3425687 - DNA, 17 bp, Homo sapiens
agggtggtgacctctgc

SEQ ID NO: 3425688 - DNA, 19 bp, Homo sapiens
agggtggtgacctctgcct

SEQ ID NO: 3425689 - DNA, 17 bp, Homo sapiens
agggtggtggagccagt

SEQ ID NO: 3425690 - DNA, 20 bp, Homo sapiens
agggttacagagacctatgt

SEQ ID NO: 3425691 - DNA, 17 bp, Homo sapiens
agggttcaagccttcca

SEQ ID NO: 3425692 - DNA, 19 bp, Homo sapiens
agggttctgcctctccagg

SEQ ID NO: 3425693 - DNA, 13 bp, Homo sapiens
agggttgggctgg

SEQ ID NO: 3425694 - DNA, 22 bp, Homo sapiens
agggtttggctgtgtctaaact

SEQ ID NO: 3425695 - DNA, 23 bp, Homo sapiens
agggttttgccatgttggccagg

SEQ ID NO: 3425696 - DNA, 20 bp, Homo sapiens
agggtttttagagaatgtgt

SEQ ID NO: 3425697 - DNA, 14 bp, Homo sapiens
aggtaaaacaaaac

SEQ ID NO: 3425698 - DNA, 22 bp, Homo sapiens
aggtaaaacaaaacaaaacaac

SEQ ID NO: 3425699 - DNA, 16 bp, Homo sapiens
aggtaacaggcagata

SEQ ID NO: 3425700 - DNA, 15 bp, Homo sapiens
aggtagcctgctggt

SEQ ID NO: 3425701 - DNA, 14 bp, Homo sapiens
aggtatgggctggg

SEQ ID NO: 3425702 - DNA, 16 bp, Homo sapiens
aggtatgggctggggg

SEQ ID NO: 3425703 - DNA, 17 bp, Homo sapiens
aggtatgtttgtaactt

SEQ ID NO: 3425704 - DNA, 20 bp, Homo sapiens
aggtatgtttgtaacttttt

SEQ ID NO: 3425705 - DNA, 23 bp, Homo sapiens
aggtatgtttgtaactttttaca

SEQ ID NO: 3425706 - DNA, 20 bp, Homo sapiens
aggtattcaatatcctttgc

SEQ ID NO: 3425707 - DNA, 15 bp, Homo sapiens
aggccgagaagcaag

SEQ ID NO: 3425708 - DNA, 19 bp, Homo sapiens
aggccgagaagcaagaaag

SEQ ID NO: 3425709 - DNA, 19 bp, Homo sapiens
aggccgctgccccagcccc

SEQ ID NO: 3425710 - DNA, 13 bp, Homo sapiens
aggccggcagccc

SEQ ID NO: 3425711 - DNA, 15 bp, Homo sapiens
aggccggcagcccca

SEQ ID NO: 3425712 - DNA, 19 bp, Homo sapiens
aggccggcagccccagcct

SEQ ID NO: 3425713 - DNA, 20 bp, Homo sapiens
aggccggcagccccagcctg

SEQ ID NO: 3425714 - DNA, 22 bp, Homo sapiens
aggccggcagccccagcctgct

SEQ ID NO: 3425715 - DNA, 23 bp, Homo sapiens
aggccggcagccccagcctgcta

SEQ ID NO: 3425716 - DNA, 19 bp, Homo sapiens
aggccggcgagccctgtgg

SEQ ID NO: 3425717 - DNA, 20 bp, Homo sapiens
aggccggcgagccctgtgga

SEQ ID NO: 3425718 - DNA, 14 bp, Homo sapiens
aggccggtgtgcct

SEQ ID NO: 3425719 - DNA, 15 bp, Homo sapiens
aggcctaggacctat

SEQ ID NO: 3425720 - DNA, 17 bp, Homo sapiens
aggcctaggacctatgt

SEQ ID NO: 3425721 - DNA, 18 bp, Homo sapiens
aggcctaggacctatgtt

SEQ ID NO: 3425722 - DNA, 11 bp, Homo sapiens
aggcctatcaa

SEQ ID NO: 3425723 - DNA, 21 bp, Homo sapiens
aggcctcaggtgctgtccatg

SEQ ID NO: 3425724 - DNA, 19 bp, Homo sapiens
aggcctgaagccagctgcc

SEQ ID NO: 3425725 - DNA, 21 bp, Homo sapiens
aggcctgaagccagctgccct

SEQ ID NO: 3425726 - DNA, 20 bp, Homo sapiens
aggcctgaatcatgagcctg

SEQ ID NO: 3425727 - DNA, 22 bp, Homo sapiens
aggcctgaatcatgagcctgct

SEQ ID NO: 3425728 - DNA, 17 bp, Homo sapiens
aggcctgagatttcatc

SEQ ID NO: 3425729 - DNA, 18 bp, Homo sapiens
aggcctgagctgcttcac

SEQ ID NO: 3425730 - DNA, 20 bp, Homo sapiens
aggcctgcctccagggctgg

SEQ ID NO: 3425731 - DNA, 16 bp, Homo sapiens
aggcctggccagatgc

SEQ ID NO: 3425732 - DNA, 21 bp, Homo sapiens
aggcctggccagatgcaccag

SEQ ID NO: 3425733 - DNA, 12 bp, Homo sapiens
aggcctggggac

SEQ ID NO: 3425734 - DNA, 17 bp, Homo sapiens
aggccttatctccaaga

SEQ ID NO: 3425735 - DNA, 19 bp, Homo sapiens
aggccttatctccaagacc

SEQ ID NO: 3425736 - DNA, 18 bp, Homo sapiens
aggccttcagacacatgc

SEQ ID NO: 3425737 - DNA, 15 bp, Homo sapiens
aggccttcctctctc

SEQ ID NO: 3425738 - DNA, 16 bp, Homo sapiens
aggccttcctctctcc

SEQ ID NO: 3425739 - DNA, 17 bp, Homo sapiens
aggccttctctgaagga

SEQ ID NO: 3425740 - DNA, 18 bp, Homo sapiens
aggccttctctgaaggac

SEQ ID NO: 3425741 - DNA, 16 bp, Homo sapiens
aggccttgcctggcct

SEQ ID NO: 3425742 - DNA, 14 bp, Homo sapiens
aggccttgtcccag

SEQ ID NO: 3425743 - DNA, 15 bp, Homo sapiens
aggcctttaaaattt

SEQ ID NO: 3425744 - DNA, 21 bp, Homo sapiens
aggcgcactgtgacccccagc

SEQ ID NO: 3425745 - DNA, 20 bp, Homo sapiens
aggcggtggacttgaacttt

SEQ ID NO: 3425746 - DNA, 16 bp, Homo sapiens
aggcgtggagctgcct

SEQ ID NO: 3425747 - DNA, 17 bp, Homo sapiens
aggcgttgctttcactc

SEQ ID NO: 3425748 - DNA, 13 bp, Homo sapiens
aggctaaacatcc

SEQ ID NO: 3425749 - DNA, 15 bp, Homo sapiens
aggctaaggcgtgga

SEQ ID NO: 3425750 - DNA, 20 bp, Homo sapiens
aggctaaggcgtggagctgc

SEQ ID NO: 3425751 - DNA, 12 bp, Homo sapiens
aggctacagggc

SEQ ID NO: 3425752 - DNA, 16 bp, Homo sapiens
aggctcacccccttct

SEQ ID NO: 3425753 - DNA, 21 bp, Homo sapiens
aggctcacccccttctccatc

SEQ ID NO: 3425754 - DNA, 23 bp, Homo sapiens
aggctcacccccttctccatcca

SEQ ID NO: 3425755 - DNA, 10 bp, Homo sapiens
aggctcaggt

SEQ ID NO: 3425756 - DNA, 20 bp, Homo sapiens
aggctcatggccctgtagtt

SEQ ID NO: 3425757 - DNA, 15 bp, Homo sapiens
aggctcccagggaca

SEQ ID NO: 3425758 - DNA, 19 bp, Homo sapiens
aggctcgattttgtatctg

SEQ ID NO: 3425759 - DNA, 16 bp, Homo sapiens
aggctcgccaaggcct

SEQ ID NO: 3425760 - DNA, 20 bp, Homo sapiens
aggctctcaacaggggagag

SEQ ID NO: 3425761 - DNA, 11 bp, Homo sapiens
aggctctgcct

SEQ ID NO: 3425762 - DNA, 13 bp, Homo sapiens
aggctctgccttc

SEQ ID NO: 3425763 - DNA, 16 bp, Homo sapiens
aggctcttctccccag

SEQ ID NO: 3425764 - DNA, 19 bp, Homo sapiens
aggctcttctccccagagt

SEQ ID NO: 3425765 - DNA, 23 bp, Homo sapiens
aggctgactggatgtccagagct

SEQ ID NO: 3425766 - DNA, 14 bp, Homo sapiens
aggctgaggaaagg

SEQ ID NO: 3425767 - DNA, 15 bp, Homo sapiens
aggctgaggaaaggc

SEQ ID NO: 3425768 - DNA, 19 bp, Homo sapiens
aggctgaggaaaggccagc

SEQ ID NO: 3425769 - DNA, 20 bp, Homo sapiens
aggctgaggaaaggccagct

SEQ ID NO: 3425770 - DNA, 18 bp, Homo sapiens
aggctgaggcaagagaat

SEQ ID NO: 3425771 - DNA, 15 bp, Homo sapiens
aggctgaggctggca

SEQ ID NO: 3425772 - DNA, 17 bp, Homo sapiens
aggctgaggctggcaca

SEQ ID NO: 3425773 - DNA, 19 bp, Homo sapiens
aggctgcactgcagccaca

SEQ ID NO: 3425774 - DNA, 19 bp, Homo sapiens
aggctgcagtgagccgaga

SEQ ID NO: 3425775 - DNA, 18 bp, Homo sapiens
aggctggcacaggacatg

SEQ ID NO: 3425776 - DNA, 15 bp, Homo sapiens
aggctggccagtcca

SEQ ID NO: 3425777 - DNA, 17 bp, Homo sapiens
aggctggcgtgcagtgg

SEQ ID NO: 3425778 - DNA, 20 bp, Homo sapiens
aggctggcttgtcccctcct

SEQ ID NO: 3425779 - DNA, 18 bp, Homo sapiens
aggctgggaactcatctg

SEQ ID NO: 3425780 - DNA, 17 bp, Homo sapiens
aggctgggaccacgtga

SEQ ID NO: 3425781 - DNA, 11 bp, Homo sapiens
aggctgggagg

SEQ ID NO: 3425782 - DNA, 17 bp, Homo sapiens
aggctgggaggagcccc

SEQ ID NO: 3425783 - DNA, 23 bp, Homo sapiens
aggctgggaggagcccctggaca

SEQ ID NO: 3425784 - DNA, 18 bp, Homo sapiens
aggctgggcttcagtggc

SEQ ID NO: 3425785 - DNA, 19 bp, Homo sapiens
aggctgggggagagccgtg

SEQ ID NO: 3425786 - DNA, 15 bp, Homo sapiens
aggctggtcttgaag

SEQ ID NO: 3425787 - DNA, 18 bp, Homo sapiens
aggctgtatcccatgagc

SEQ ID NO: 3425788 - DNA, 20 bp, Homo sapiens
aggctgtatcccatgagcct

SEQ ID NO: 3425789 - DNA, 24 bp, Homo sapiens
aggctgtatcccatgagcctcagc

SEQ ID NO: 3425790 - DNA, 19 bp, Homo sapiens
aggctgtccttacccatct

SEQ ID NO: 3425791 - DNA, 17 bp, Homo sapiens
aggctgtctggccaggc

SEQ ID NO: 3425792 - DNA, 18 bp, Homo sapiens
aggctgtgactcttctct

SEQ ID NO: 3425793 - DNA, 16 bp, Homo sapiens
aggctgtggtcacagc

SEQ ID NO: 3425794 - DNA, 20 bp, Homo sapiens
aggctgtgtttggctttcag

SEQ ID NO: 3425795 - DNA, 20 bp, Homo sapiens
aggctgttcccatgtagccc

SEQ ID NO: 3425796 - DNA, 14 bp, Homo sapiens
aggctgtttgcttc

SEQ ID NO: 3425797 - DNA, 19 bp, Homo sapiens
aggctgtttgcttcaccgt

SEQ ID NO: 3425798 - DNA, 12 bp, Homo sapiens
aggctttcagct

SEQ ID NO: 3425799 - DNA, 13 bp, Homo sapiens
aggctttcagctt

SEQ ID NO: 3425800 - DNA, 16 bp, Homo sapiens
agggaaaagcagctct

SEQ ID NO: 3425801 - DNA, 20 bp, Homo sapiens
agggaaaataggcaggaagc

SEQ ID NO: 3425802 - DNA, 18 bp, Homo sapiens
agggaaaattatttgcat

SEQ ID NO: 3425803 - DNA, 15 bp, Homo sapiens
agggaaatatcattt

SEQ ID NO: 3425804 - DNA, 14 bp, Homo sapiens
agggaaatggcctt

SEQ ID NO: 3425805 - DNA, 16 bp, Homo sapiens
agggaaatggccttcc

SEQ ID NO: 3425806 - DNA, 17 bp, Homo sapiens
agggaaatggccttccc

SEQ ID NO: 3425807 - DNA, 14 bp, Homo sapiens
agggaacctgtgtc

SEQ ID NO: 3425808 - DNA, 16 bp, Homo sapiens
agggaagaaaagagct

SEQ ID NO: 3425809 - DNA, 17 bp, Homo sapiens
agggaatagtatagaca

SEQ ID NO: 3425810 - DNA, 18 bp, Homo sapiens
agggaatcctcctccagg

SEQ ID NO: 3425811 - DNA, 16 bp, Homo sapiens
agggaatcctgcggca

SEQ ID NO: 3425812 - DNA, 18 bp, Homo sapiens
agggaatgcctgagtgcc

SEQ ID NO: 3425813 - DNA, 16 bp, Homo sapiens
agggaatgtgagcaca

SEQ ID NO: 3425814 - DNA, 14 bp, Homo sapiens
agggacacctggga

SEQ ID NO: 3425815 - DNA, 15 bp, Homo sapiens
agggacaggagaaga

SEQ ID NO: 3425816 - DNA, 22 bp, Homo sapiens
agcccagggcatcttgctggct

SEQ ID NO: 3425817 - DNA, 16 bp, Homo sapiens
agcccagggctcctgc

SEQ ID NO: 3425818 - DNA, 15 bp, Homo sapiens
agccccagcctgcta

SEQ ID NO: 3425819 - DNA, 17 bp, Homo sapiens
agccccagcctgctagc

SEQ ID NO: 3425820 - DNA, 23 bp, Homo sapiens
agccccatctgtgcattctcctg

SEQ ID NO: 3425821 - DNA, 16 bp, Homo sapiens
agccccattctgcctg

SEQ ID NO: 3425822 - DNA, 17 bp, Homo sapiens
agccccattctgcctgc

SEQ ID NO: 3425823 - DNA, 18 bp, Homo sapiens
agccccattctgcctgcc

SEQ ID NO: 3425824 - DNA, 20 bp, Homo sapiens
agccccattctgcctgccca

SEQ ID NO: 3425825 - DNA, 23 bp, Homo sapiens
agccccattctgcctgcccaggc

SEQ ID NO: 3425826 - DNA, 19 bp, Homo sapiens
agcccccaccgtgggcagg

SEQ ID NO: 3425827 - DNA, 20 bp, Homo sapiens
agcccccagctaagaacctg

SEQ ID NO: 3425828 - DNA, 16 bp, Homo sapiens
agccccctggcctctg

SEQ ID NO: 3425829 - DNA, 17 bp, Homo sapiens
agccccgaggccttctc

SEQ ID NO: 3425830 - DNA, 17 bp, Homo sapiens
agccccggtggctgggc

SEQ ID NO: 3425831 - DNA, 16 bp, Homo sapiens
agcccctactgctgtg

SEQ ID NO: 3425832 - DNA, 12 bp, Homo sapiens
agcccctctggt

SEQ ID NO: 3425833 - DNA, 23 bp, Homo sapiens
agcccctggacatgcctgtcctg

SEQ ID NO: 3425834 - DNA, 21 bp, Homo sapiens
agccccttactatgatctcag

SEQ ID NO: 3425835 - DNA, 16 bp, Homo sapiens
agccccttctgctcag

SEQ ID NO: 3425836 - DNA, 17 bp, Homo sapiens
agccccttgagaaacct

SEQ ID NO: 3425837 - DNA, 15 bp, Homo sapiens
agcccgcacacctgc

SEQ ID NO: 3425838 - DNA, 15 bp, Homo sapiens
agcccgcggggacat

SEQ ID NO: 3425839 - DNA, 14 bp, Homo sapiens
agcccggagctccg

SEQ ID NO: 3425840 - DNA, 20 bp, Homo sapiens
agcccggagctccggcctgc

SEQ ID NO: 3425841 - DNA, 16 bp, Homo sapiens
agccctagggtggaga

SEQ ID NO: 3425842 - DNA, 20 bp, Homo sapiens
agccctagggtggagagcca

SEQ ID NO: 3425843 - DNA, 24 bp, Homo sapiens
agccctcagaacccttggcttgcc

SEQ ID NO: 3425844 - DNA, 13 bp, Homo sapiens
agccctctccctc

SEQ ID NO: 3425845 - DNA, 15 bp, Homo sapiens
agccctgaccctgtg

SEQ ID NO: 3425846 - DNA, 15 bp, Homo sapiens
agccctgagctttct

SEQ ID NO: 3425847 - DNA, 16 bp, Homo sapiens
agccctgcggagccgg

SEQ ID NO: 3425848 - DNA, 20 bp, Homo sapiens
agccctgcggagccggcacc

SEQ ID NO: 3425849 - DNA, 18 bp, Homo sapiens
agccctgctgctgcctgc

SEQ ID NO: 3425850 - DNA, 19 bp, Homo sapiens
agccctgctgctgcctgcc

SEQ ID NO: 3425851 - DNA, 12 bp, Homo sapiens
agccctggcccc

SEQ ID NO: 3425852 - DNA, 16 bp, Homo sapiens
agccctggccccctga

SEQ ID NO: 3425853 - DNA, 16 bp, Homo sapiens
agccctgggatcactg

SEQ ID NO: 3425854 - DNA, 18 bp, Homo sapiens
agccctgggatcactgtg

SEQ ID NO: 3425855 - DNA, 23 bp, Homo sapiens
agccctgttgacacaggtctttc

SEQ ID NO: 3425856 - DNA, 22 bp, Homo sapiens
agccggcacctacatccccagg

SEQ ID NO: 3425857 - DNA, 13 bp, Homo sapiens
agccggggcctta

SEQ ID NO: 3425858 - DNA, 16 bp, Homo sapiens
agccgggtctgcctct

SEQ ID NO: 3425859 - DNA, 14 bp, Homo sapiens
agccggttcctgtc

SEQ ID NO: 3425860 - DNA, 15 bp, Homo sapiens
agccgtggtccctga

SEQ ID NO: 3425861 - DNA, 13 bp, Homo sapiens
agcctaagaagct

SEQ ID NO: 3425862 - DNA, 23 bp, Homo sapiens
agcctagtgaaggcttctctctg

SEQ ID NO: 3425863 - DNA, 19 bp, Homo sapiens
agcctagtggcttgtcctc

SEQ ID NO: 3425864 - DNA, 17 bp, Homo sapiens
agcctcaacctcctggg

SEQ ID NO: 3425865 - DNA, 19 bp, Homo sapiens
agcctcaacctcctgggct

SEQ ID NO: 3425866 - DNA, 20 bp, Homo sapiens
agcctcaacctcctgggcta

SEQ ID NO: 3425867 - DNA, 22 bp, Homo sapiens
agcctcagatgatttcccccct

SEQ ID NO: 3425868 - DNA, 13 bp, Homo sapiens
agcctcagcatcc

SEQ ID NO: 3425869 - DNA, 14 bp, Homo sapiens
agcctcagcatcct

SEQ ID NO: 3425870 - DNA, 15 bp, Homo sapiens
agcctcagcatcctg

SEQ ID NO: 3425871 - DNA, 21 bp, Homo sapiens
agcctcagcatcctggcaccc

SEQ ID NO: 3425872 - DNA, 17 bp, Homo sapiens
agcctcatcatcagagc

SEQ ID NO: 3425873 - DNA, 16 bp, Homo sapiens
agcctccagtccaagg

SEQ ID NO: 3425874 - DNA, 13 bp, Homo sapiens
agcctcccacccc

SEQ ID NO: 3425875 - DNA, 18 bp, Homo sapiens
agcctcccgaatagctgg

SEQ ID NO: 3425876 - DNA, 18 bp, Homo sapiens
agcctcccgagtagctgg

SEQ ID NO: 3425877 - DNA, 19 bp, Homo sapiens
agcctcccgagtagggagg

SEQ ID NO: 3425878 - DNA, 17 bp, Homo sapiens
agcttgctgtcacttct

SEQ ID NO: 3425879 - DNA, 18 bp, Homo sapiens
agcttgctgtcacttctt

SEQ ID NO: 3425880 - DNA, 23 bp, Homo sapiens
agcttggacatcagtgtttgttg

SEQ ID NO: 3425881 - DNA, 20 bp, Homo sapiens
agcttgtcaatgatttcaaa

SEQ ID NO: 3425882 - DNA, 16 bp, Homo sapiens
agcttgttatttataa

SEQ ID NO: 3425883 - DNA, 14 bp, Homo sapiens
agctttatttcaaa

SEQ ID NO: 3425884 - DNA, 19 bp, Homo sapiens
agctttctgaccttcagct

SEQ ID NO: 3425885 - DNA, 13 bp, Homo sapiens
agctttgctgctg

SEQ ID NO: 3425886 - DNA, 22 bp, Homo sapiens
agctttgctgctgaaggctcat

SEQ ID NO: 3425887 - DNA, 24 bp, Homo sapiens
aggaaaaaaactattaaggatgta

SEQ ID NO: 3425888 - DNA, 13 bp, Homo sapiens
aggaaaaacaggt

SEQ ID NO: 3425889 - DNA, 14 bp, Homo sapiens
aggaaaaacaggtc

SEQ ID NO: 3425890 - DNA, 17 bp, Homo sapiens
aggaaaccacagctgct

SEQ ID NO: 3425891 - DNA, 13 bp, Homo sapiens
aggaaactttcct

SEQ ID NO: 3425892 - DNA, 18 bp, Homo sapiens
aggaaactttcctttaac

SEQ ID NO: 3425893 - DNA, 14 bp, Homo sapiens
aggaaaggccagct

SEQ ID NO: 3425894 - DNA, 21 bp, Homo sapiens
aggaaaggccagctggcagca

SEQ ID NO: 3425895 - DNA, 13 bp, Homo sapiens
aggaaagtcattg

SEQ ID NO: 3425896 - DNA, 17 bp, Homo sapiens
aggaaagtcattggctt

SEQ ID NO: 3425897 - DNA, 23 bp, Homo sapiens
aggaaagtcattggctttatcct

SEQ ID NO: 3425898 - DNA, 16 bp, Homo sapiens
aggaaatattgctggg

SEQ ID NO: 3425899 - DNA, 15 bp, Homo sapiens
aggaaccacaccaca

SEQ ID NO: 3425900 - DNA, 17 bp, Homo sapiens
aggaaccacaccacatc

SEQ ID NO: 3425901 - DNA, 15 bp, Homo sapiens
aggaagaaagaatgt

SEQ ID NO: 3425902 - DNA, 12 bp, Homo sapiens
aggaagaacggg

SEQ ID NO: 3425903 - DNA, 22 bp, Homo sapiens
aggaagacatctgtagggaatt

SEQ ID NO: 3425904 - DNA, 14 bp, Homo sapiens
aggaagagaaaaaa

SEQ ID NO: 3425905 - DNA, 14 bp, Homo sapiens
aggaagagacactc

SEQ ID NO: 3425906 - DNA, 13 bp, Homo sapiens
aggaagatttgga

SEQ ID NO: 3425907 - DNA, 19 bp, Homo sapiens
aggaagcccaattgctgga

SEQ ID NO: 3425908 - DNA, 18 bp, Homo sapiens
aggaagccgccagtactt

SEQ ID NO: 3425909 - DNA, 22 bp, Homo sapiens
aggaagccgccagtacttgtca

SEQ ID NO: 3425910 - DNA, 17 bp, Homo sapiens
aggaagctcagactggt

SEQ ID NO: 3425911 - DNA, 23 bp, Homo sapiens
aggaagctttggtgagaacctgg

SEQ ID NO: 3425912 - DNA, 14 bp, Homo sapiens
aggaaggaaaagaa

SEQ ID NO: 3425913 - DNA, 21 bp, Homo sapiens
aggaaggcttgttgtgctttt

SEQ ID NO: 3425914 - DNA, 14 bp, Homo sapiens
aggaagtaggaagt

SEQ ID NO: 3425915 - DNA, 14 bp, Homo sapiens
aggaagtgaagaat

SEQ ID NO: 3425916 - DNA, 12 bp, Homo sapiens
aggaatatatgg

SEQ ID NO: 3425917 - DNA, 23 bp, Homo sapiens
aggaatatatggcagagttgtaa

SEQ ID NO: 3425918 - DNA, 15 bp, Homo sapiens
aggaatattttccaa

SEQ ID NO: 3425919 - DNA, 21 bp, Homo sapiens
aggaatccactcccaggcagc

SEQ ID NO: 3425920 - DNA, 18 bp, Homo sapiens
aggaatctcagagacagg

SEQ ID NO: 3425921 - DNA, 16 bp, Homo sapiens
aggaatctttaaaaga

SEQ ID NO: 3425922 - DNA, 22 bp, Homo sapiens
aggaatctttaaaagatgcttt

SEQ ID NO: 3425923 - DNA, 13 bp, Homo sapiens
aggaatgagaagt

SEQ ID NO: 3425924 - DNA, 22 bp, Homo sapiens
aggaatgttttgtagctctagg

SEQ ID NO: 3425925 - DNA, 14 bp, Homo sapiens
aggacaacgaggaa

SEQ ID NO: 3425926 - DNA, 18 bp, Homo sapiens
aggacactaaccacgctg

SEQ ID NO: 3425927 - DNA, 23 bp, Homo sapiens
aggacactaaccacgctggacct

SEQ ID NO: 3425928 - DNA, 14 bp, Homo sapiens
aggacacttccgta

SEQ ID NO: 3425929 - DNA, 21 bp, Homo sapiens
aggacagtgcttgatacagga

SEQ ID NO: 3425930 - DNA, 15 bp, Homo sapiens
aggacataatggggt

SEQ ID NO: 3425931 - DNA, 24 bp, Homo sapiens
aggacataatggggtcctggccat

SEQ ID NO: 3425932 - DNA, 13 bp, Homo sapiens
aggacatgaaact

SEQ ID NO: 3425933 - DNA, 17 bp, Homo sapiens
aggacatgatgctttta

SEQ ID NO: 3425934 - DNA, 14 bp, Homo sapiens
aggacattcttgta

SEQ ID NO: 3425935 - DNA, 24 bp, Homo sapiens
aggaccagctcaggacagatgcca

SEQ ID NO: 3425936 - DNA, 13 bp, Homo sapiens
aggaccaggcaat

SEQ ID NO: 3425937 - DNA, 13 bp, Homo sapiens
aggacccagagga

SEQ ID NO: 3425938 - DNA, 15 bp, Homo sapiens
aggacccagaggaag

SEQ ID NO: 3425939 - DNA, 18 bp, Homo sapiens
aggacctatgttgtaatt

SEQ ID NO: 3425940 - DNA, 20 bp, Homo sapiens
aggacctctgaaaccctgga

SEQ ID NO: 3425941 - DNA, 16 bp, Homo sapiens
aggacctggctgccat

SEQ ID NO: 3425942 - DNA, 17 bp, Homo sapiens
aggacctggctgccata

SEQ ID NO: 3425943 - DNA, 20 bp, Homo sapiens
aggaccttcgggctgtgccc

SEQ ID NO: 3425944 - DNA, 22 bp, Homo sapiens
aggacctttccaccacagccag

SEQ ID NO: 3425945 - DNA, 15 bp, Homo sapiens
aggacgccacccagc

SEQ ID NO: 3425946 - DNA, 17 bp, Homo sapiens
aggactcagctccccag

SEQ ID NO: 3425947 - DNA, 20 bp, Homo sapiens
aggactcagctccccagagt

SEQ ID NO: 3425948 - DNA, 16 bp, Homo sapiens
aggactccaggcccaa

SEQ ID NO: 3425949 - DNA, 20 bp, Homo sapiens
aggactgagcaccctctgga

SEQ ID NO: 3425950 - DNA, 15 bp, Homo sapiens
aggactgcagagcag

SEQ ID NO: 3425951 - DNA, 16 bp, Homo sapiens
aggactgcagagcaga

SEQ ID NO: 3425952 - DNA, 20 bp, Homo sapiens
aggactgcagagcagatggc

SEQ ID NO: 3425953 - DNA, 19 bp, Homo sapiens
aggacttatttaaactctg

SEQ ID NO: 3425954 - DNA, 20 bp, Homo sapiens
aggacttcctgtccagctcc

SEQ ID NO: 3425955 - DNA, 19 bp, Homo sapiens
aggacttcggggtagaggc

SEQ ID NO: 3425956 - DNA, 15 bp, Homo sapiens
aggacttctgcctga

SEQ ID NO: 3425957 - DNA, 17 bp, Homo sapiens
aggacttttctttgtgg

SEQ ID NO: 3425958 - DNA, 22 bp, Homo sapiens
aggacttttctttgtggcttcc

SEQ ID NO: 3425959 - DNA, 15 bp, Homo sapiens
aggagaagagaggaa

SEQ ID NO: 3425960 - DNA, 13 bp, Homo sapiens
aggagaagccagg

SEQ ID NO: 3425961 - DNA, 14 bp, Homo sapiens
aggagaagggctga

SEQ ID NO: 3425962 - DNA, 15 bp, Homo sapiens
aggagaagggctggg

SEQ ID NO: 3425963 - DNA, 16 bp, Homo sapiens
aggagaatctcttgaa

SEQ ID NO: 3425964 - DNA, 21 bp, Homo sapiens
aggagacctggcactggatgc

SEQ ID NO: 3425965 - DNA, 16 bp, Homo sapiens
aggagacggaggggag

SEQ ID NO: 3425966 - DNA, 14 bp, Homo sapiens
aggagagaaaatat

SEQ ID NO: 3425967 - DNA, 22 bp, Homo sapiens
aggagagaaaatatatgtattt

SEQ ID NO: 3425968 - DNA, 13 bp, Homo sapiens
aggagagagcctt

SEQ ID NO: 3425969 - DNA, 14 bp, Homo sapiens
aggagagagccttg

SEQ ID NO: 3425970 - DNA, 17 bp, Homo sapiens
agcagatgcaaagaggc

SEQ ID NO: 3425971 - DNA, 18 bp, Homo sapiens
agcagatgcaaagaggca

SEQ ID NO: 3425972 - DNA, 22 bp, Homo sapiens
agcagattttaattttgaataa

SEQ ID NO: 3425973 - DNA, 19 bp, Homo sapiens
agcagcaccgttctgtgca

SEQ ID NO: 3425974 - DNA, 19 bp, Homo sapiens
agcagcagcctttaatgca

SEQ ID NO: 3425975 - DNA, 20 bp, Homo sapiens
agcagccaagggatgaaaga

SEQ ID NO: 3425976 - DNA, 21 bp, Homo sapiens
agcagcccaagcttccctcca

SEQ ID NO: 3425977 - DNA, 13 bp, Homo sapiens
agcagcctgagca

SEQ ID NO: 3425978 - DNA, 19 bp, Homo sapiens
agcagcctgagcaactctt

SEQ ID NO: 3425979 - DNA, 20 bp, Homo sapiens
agcagctaaaccaaggactg

SEQ ID NO: 3425980 - DNA, 20 bp, Homo sapiens
agcagctcaaaggcacagtg

SEQ ID NO: 3425981 - DNA, 12 bp, Homo sapiens
agcagctctccc

SEQ ID NO: 3425982 - DNA, 13 bp, Homo sapiens
agcagctgcattt

SEQ ID NO: 3425983 - DNA, 11 bp, Homo sapiens
agcagctgcta

SEQ ID NO: 3425984 - DNA, 18 bp, Homo sapiens
agcagcttagactaaggc

SEQ ID NO: 3425985 - DNA, 15 bp, Homo sapiens
agcaggaaatgaaaa

SEQ ID NO: 3425986 - DNA, 23 bp, Homo sapiens
agcaggaaatgaaaatgtcttgt

SEQ ID NO: 3425987 - DNA, 20 bp, Homo sapiens
agcaggaatatatgtgtgcc

SEQ ID NO: 3425988 - DNA, 15 bp, Homo sapiens
agcaggactccaggc

SEQ ID NO: 3425989 - DNA, 19 bp, Homo sapiens
agcaggactccaggcccaa

SEQ ID NO: 3425990 - DNA, 23 bp, Homo sapiens
agcaggactccaggcccaaggct

SEQ ID NO: 3425991 - DNA, 14 bp, Homo sapiens
agcaggaggccagg

SEQ ID NO: 3425992 - DNA, 17 bp, Homo sapiens
agcagggatgccctgga

SEQ ID NO: 3425993 - DNA, 14 bp, Homo sapiens
agcagggctcagcg

SEQ ID NO: 3425994 - DNA, 23 bp, Homo sapiens
agcaggttcccaagctcagaggc

SEQ ID NO: 3425995 - DNA, 22 bp, Homo sapiens
agcagtcctgcctcagcctccg

SEQ ID NO: 3425996 - DNA, 16 bp, Homo sapiens
agcagtcgtgcctgtg

SEQ ID NO: 3425997 - DNA, 14 bp, Homo sapiens
agcagtctctgcct

SEQ ID NO: 3425998 - DNA, 19 bp, Homo sapiens
agcagtctctgccttgcct

SEQ ID NO: 3425999 - DNA, 20 bp, Homo sapiens
agcagtgaatgattcagtgt

SEQ ID NO: 3426000 - DNA, 15 bp, Homo sapiens
agcagtgcaggcaca

SEQ ID NO: 3426001 - DNA, 13 bp, Homo sapiens
agcagtgcctgcc

SEQ ID NO: 3426002 - DNA, 15 bp, Homo sapiens
agcagtgtgaggcca

SEQ ID NO: 3426003 - DNA, 13 bp, Homo sapiens
agcagttttcaag

SEQ ID NO: 3426004 - DNA, 21 bp, Homo sapiens
agcataaaaacattttaaaaa

SEQ ID NO: 3426005 - DNA, 19 bp, Homo sapiens
agcataaaaattagccaag

SEQ ID NO: 3426006 - DNA, 23 bp, Homo sapiens
agcataaaaattagccaagtgtg

SEQ ID NO: 3426007 - DNA, 15 bp, Homo sapiens
agcatacttctagga

SEQ ID NO: 3426008 - DNA, 13 bp, Homo sapiens
agcatactttgta

SEQ ID NO: 3426009 - DNA, 15 bp, Homo sapiens
agcatatctgccttt

SEQ ID NO: 3426010 - DNA, 23 bp, Homo sapiens
agcatatctgcctttattgtgtt

SEQ ID NO: 3426011 - DNA, 20 bp, Homo sapiens
agcatcacatgaacttgtaa

SEQ ID NO: 3426012 - DNA, 22 bp, Homo sapiens
agcatcagggttaagaagactt

SEQ ID NO: 3426013 - DNA, 21 bp, Homo sapiens
agcatcccttgaccaggcctg

SEQ ID NO: 3426014 - DNA, 22 bp, Homo sapiens
agcatcccttgaccaggcctgg

SEQ ID NO: 3426015 - DNA, 16 bp, Homo sapiens
agcatccgcaggtgct

SEQ ID NO: 3426016 - DNA, 13 bp, Homo sapiens
agcatcctggcac

SEQ ID NO: 3426017 - DNA, 18 bp, Homo sapiens
agcatcctggcacccggc

SEQ ID NO: 3426018 - DNA, 22 bp, Homo sapiens
agcatcggacaagacccccagc

SEQ ID NO: 3426019 - DNA, 23 bp, Homo sapiens
agcatcggacaagacccccagca

SEQ ID NO: 3426020 - DNA, 15 bp, Homo sapiens
agcatctacttcagg

SEQ ID NO: 3426021 - DNA, 13 bp, Homo sapiens
agcatctgtacaa

SEQ ID NO: 3426022 - DNA, 23 bp, Homo sapiens
agcatcttgggggggtggccgct

SEQ ID NO: 3426023 - DNA, 15 bp, Homo sapiens
agcatgacagcctgc

SEQ ID NO: 3426024 - DNA, 13 bp, Homo sapiens
agcatggagctgg

SEQ ID NO: 3426025 - DNA, 19 bp, Homo sapiens
agcatgggggaccccttcc

SEQ ID NO: 3426026 - DNA, 21 bp, Homo sapiens
agcatgtaatgttaatgttat

SEQ ID NO: 3426027 - DNA, 17 bp, Homo sapiens
agcattagatagtcatg

SEQ ID NO: 3426028 - DNA, 14 bp, Homo sapiens
agcattccttttga

SEQ ID NO: 3426029 - DNA, 14 bp, Homo sapiens
agcatttataaatt

SEQ ID NO: 3426030 - DNA, 11 bp, Homo sapiens
agcatttgaat

SEQ ID NO: 3426031 - DNA, 22 bp, Homo sapiens
agcatttgatctgttgcaagcc

SEQ ID NO: 3426032 - DNA, 19 bp, Homo sapiens
agcatttgattaacatttg

SEQ ID NO: 3426033 - DNA, 15 bp, Homo sapiens
agcattttttaaaaa

SEQ ID NO: 3426034 - DNA, 17 bp, Homo sapiens
agcatttttttattcag

SEQ ID NO: 3426035 - DNA, 17 bp, Homo sapiens
agccaaaatgtaggctt

SEQ ID NO: 3426036 - DNA, 15 bp, Homo sapiens
agccaaacccactct

SEQ ID NO: 3426037 - DNA, 14 bp, Homo sapiens
agccaaacgggagc

SEQ ID NO: 3426038 - DNA, 19 bp, Homo sapiens
agccaaagctaggcctggc

SEQ ID NO: 3426039 - DNA, 16 bp, Homo sapiens
agccaagcagccaagc

SEQ ID NO: 3426040 - DNA, 17 bp, Homo sapiens
agatgagttatctaaga

SEQ ID NO: 3426041 - DNA, 16 bp, Homo sapiens
agatgatggatgccaa

SEQ ID NO: 3426042 - DNA, 16 bp, Homo sapiens
agatgatttcccccct

SEQ ID NO: 3426043 - DNA, 22 bp, Homo sapiens
agatgatttcccccctccgcct

SEQ ID NO: 3426044 - DNA, 18 bp, Homo sapiens
agatgcaaagaggcaaga

SEQ ID NO: 3426045 - DNA, 20 bp, Homo sapiens
agatgcaaagaggcaagagg

SEQ ID NO: 3426046 - DNA, 15 bp, Homo sapiens
agatgcaagtctctt

SEQ ID NO: 3426047 - DNA, 19 bp, Homo sapiens
agatgcacatgttggagga

SEQ ID NO: 3426048 - DNA, 16 bp, Homo sapiens
agatgcagggcagtca

SEQ ID NO: 3426049 - DNA, 14 bp, Homo sapiens
agatgccccaggga

SEQ ID NO: 3426050 - DNA, 18 bp, Homo sapiens
agatgcccgagggagggg

SEQ ID NO: 3426051 - DNA, 19 bp, Homo sapiens
agatgcctacttttggcct

SEQ ID NO: 3426052 - DNA, 15 bp, Homo sapiens
agatgcctgatcaga

SEQ ID NO: 3426053 - DNA, 22 bp, Homo sapiens
agatgccttttttgtagttttt

SEQ ID NO: 3426054 - DNA, 18 bp, Homo sapiens
agatgcgcagccccatct

SEQ ID NO: 3426055 - DNA, 22 bp, Homo sapiens
agatgcgcattctaacctggag

SEQ ID NO: 3426056 - DNA, 15 bp, Homo sapiens
agatgctccttgggc

SEQ ID NO: 3426057 - DNA, 15 bp, Homo sapiens
agatgctggcccagg

SEQ ID NO: 3426058 - DNA, 21 bp, Homo sapiens
agatgctggcccagggcccag

SEQ ID NO: 3426059 - DNA, 18 bp, Homo sapiens
agatgcttctcactgcca

SEQ ID NO: 3426060 - DNA, 20 bp, Homo sapiens
agatgcttttaacagagtct

SEQ ID NO: 3426061 - DNA, 18 bp, Homo sapiens
agatggaaccgcaggaag

SEQ ID NO: 3426062 - DNA, 21 bp, Homo sapiens
agatggaaccgcaggaagctg

SEQ ID NO: 3426063 - DNA, 19 bp, Homo sapiens
agatggaagcttgttgaaa

SEQ ID NO: 3426064 - DNA, 23 bp, Homo sapiens
agatggattctccactcagttgc

SEQ ID NO: 3426065 - DNA, 14 bp, Homo sapiens
agatggcagtcact

SEQ ID NO: 3426066 - DNA, 14 bp, Homo sapiens
agatggctcctctc

SEQ ID NO: 3426067 - DNA, 16 bp, Homo sapiens
agatggggtctgtaaa

SEQ ID NO: 3426068 - DNA, 19 bp, Homo sapiens
agatggggtctgtaaaatc

SEQ ID NO: 3426069 - DNA, 17 bp, Homo sapiens
agatgggtgaaggctgg

SEQ ID NO: 3426070 - DNA, 22 bp, Homo sapiens
agatgggtggatcacttgaggt

SEQ ID NO: 3426071 - DNA, 19 bp, Homo sapiens
agatggtaagacctctgag

SEQ ID NO: 3426072 - DNA, 19 bp, Homo sapiens
agatggtcacgcacctggg

SEQ ID NO: 3426073 - DNA, 14 bp, Homo sapiens
agatggtggcacat

SEQ ID NO: 3426074 - DNA, 22 bp, Homo sapiens
agatggtgtgggtgtcctgcct

SEQ ID NO: 3426075 - DNA, 16 bp, Homo sapiens
agatggttgtgtatgg

SEQ ID NO: 3426076 - DNA, 19 bp, Homo sapiens
agatgtagataaactcaga

SEQ ID NO: 3426077 - DNA, 12 bp, Homo sapiens
agatgtctattc

SEQ ID NO: 3426078 - DNA, 11 bp, Homo sapiens
agatgtctgtt

SEQ ID NO: 3426079 - DNA, 22 bp, Homo sapiens
agatgttctaagtctttccatt

SEQ ID NO: 3426080 - DNA, 15 bp, Homo sapiens
agatgttctctatca

SEQ ID NO: 3426081 - DNA, 11 bp, Homo sapiens
agattaatatt

SEQ ID NO: 3426082 - DNA, 21 bp, Homo sapiens
agattaatctaccttgcagtg

SEQ ID NO: 3426083 - DNA, 22 bp, Homo sapiens
agattacccaaaaactgtcttt

SEQ ID NO: 3426084 - DNA, 20 bp, Homo sapiens
agattatggagcttttttcc

SEQ ID NO: 3426085 - DNA, 14 bp, Homo sapiens
agattattccttct

SEQ ID NO: 3426086 - DNA, 20 bp, Homo sapiens
agattattccttcttctagt

SEQ ID NO: 3426087 - DNA, 21 bp, Homo sapiens
agattattgtagtgttcaaaa

SEQ ID NO: 3426088 - DNA, 15 bp, Homo sapiens
agattcattttctag

SEQ ID NO: 3426089 - DNA, 16 bp, Homo sapiens
agattcattttctaga

SEQ ID NO: 3426090 - DNA, 16 bp, Homo sapiens
agattcccctgtgtca

SEQ ID NO: 3426091 - DNA, 13 bp, Homo sapiens
agattcctgtcct

SEQ ID NO: 3426092 - DNA, 12 bp, Homo sapiens
agattcttcagc

SEQ ID NO: 3426093 - DNA, 17 bp, Homo sapiens
agattgcaacaggctgg

SEQ ID NO: 3426094 - DNA, 21 bp, Homo sapiens
agattgcaacaggctgggctt

SEQ ID NO: 3426095 - DNA, 15 bp, Homo sapiens
agattgcatgtgact

SEQ ID NO: 3426096 - DNA, 15 bp, Homo sapiens
agattgcttaaaata

SEQ ID NO: 3426097 - DNA, 23 bp, Homo sapiens
agattggggtaacgtgcactgta

SEQ ID NO: 3426098 - DNA, 14 bp, Homo sapiens
agattgttaaaata

SEQ ID NO: 3426099 - DNA, 21 bp, Homo sapiens
agattgttggtgaattttcaa

SEQ ID NO: 3426100 - DNA, 18 bp, Homo sapiens
agatttcatctgctctcc

SEQ ID NO: 3426101 - DNA, 23 bp, Homo sapiens
agatttcatctgctctccttcct

SEQ ID NO: 3426102 - DNA, 15 bp, Homo sapiens
agatttccagtctcc

SEQ ID NO: 3426103 - DNA, 19 bp, Homo sapiens
agatttcttgagttttgtt

SEQ ID NO: 3426104 - DNA, 21 bp, Homo sapiens
agatttgctttaccttcctga

SEQ ID NO: 3426105 - DNA, 21 bp, Homo sapiens
agattttaattttgaataaat

SEQ ID NO: 3426106 - DNA, 20 bp, Homo sapiens
agattttcattgaggataaa

SEQ ID NO: 3426107 - DNA, 15 bp, Homo sapiens
agattttgatagcaa

SEQ ID NO: 3426108 - DNA, 18 bp, Homo sapiens
agattttgatagcaaagc

SEQ ID NO: 3426109 - DNA, 21 bp, Homo sapiens
agatttttaaaaaatattttc

SEQ ID NO: 3426110 - DNA, 21 bp, Homo sapiens
agattttttcagacttgtcaa

SEQ ID NO: 3426111 - DNA, 22 bp, Homo sapiens
agcaaaaaagtccaattttaat

SEQ ID NO: 3426112 - DNA, 12 bp, Homo sapiens
agcaaaacaaaa

SEQ ID NO: 3426113 - DNA, 18 bp, Homo sapiens
agcaaaagatgcttctca

SEQ ID NO: 3426114 - DNA, 20 bp, Homo sapiens
agcaaaatcaagcaagcctc

SEQ ID NO: 3426115 - DNA, 14 bp, Homo sapiens
agcaaaatcatttt

SEQ ID NO: 3426116 - DNA, 17 bp, Homo sapiens
agcaaaccatttttaaa

SEQ ID NO: 3426117 - DNA, 23 bp, Homo sapiens
agcaaaccatttttaaagtagaa

SEQ ID NO: 3426118 - DNA, 17 bp, Homo sapiens
agagccttgggagccac

SEQ ID NO: 3426119 - DNA, 18 bp, Homo sapiens
agagccttgggagccact

SEQ ID NO: 3426120 - DNA, 20 bp, Homo sapiens
agagccttgggagccactgc

SEQ ID NO: 3426121 - DNA, 15 bp, Homo sapiens
agagcgcctgcccct

SEQ ID NO: 3426122 - DNA, 19 bp, Homo sapiens
agagctaaactccttcctg

SEQ ID NO: 3426123 - DNA, 23 bp, Homo sapiens
agagctctaagtacctttcctac

SEQ ID NO: 3426124 - DNA, 15 bp, Homo sapiens
agagctggagcctgg

SEQ ID NO: 3426125 - DNA, 15 bp, Homo sapiens
agagctggctctgag

SEQ ID NO: 3426126 - DNA, 16 bp, Homo sapiens
agagctggctctgagc

SEQ ID NO: 3426127 - DNA, 19 bp, Homo sapiens
agagctgggtgtcaagagg

SEQ ID NO: 3426128 - DNA, 20 bp, Homo sapiens
agagcttccctgactcattc

SEQ ID NO: 3426129 - DNA, 15 bp, Homo sapiens
agagcttttcagatt

SEQ ID NO: 3426130 - DNA, 20 bp, Homo sapiens
agagcttttcagattgtgga

SEQ ID NO: 3426131 - DNA, 12 bp, Homo sapiens
agaggaaaagaa

SEQ ID NO: 3426132 - DNA, 20 bp, Homo sapiens
agaggaaatattgctggggt

SEQ ID NO: 3426133 - DNA, 16 bp, Homo sapiens
agaggaagagacactc

SEQ ID NO: 3426134 - DNA, 16 bp, Homo sapiens
agaggaaggggccaga

SEQ ID NO: 3426135 - DNA, 13 bp, Homo sapiens
agaggaagggtgg

SEQ ID NO: 3426136 - DNA, 18 bp, Homo sapiens
agaggaagttcagatctt

SEQ ID NO: 3426137 - DNA, 15 bp, Homo sapiens
agaggaccggcggct

SEQ ID NO: 3426138 - DNA, 22 bp, Homo sapiens
agaggacgtgttacccactgcc

SEQ ID NO: 3426139 - DNA, 23 bp, Homo sapiens
agaggacttcggggtagaggctg

SEQ ID NO: 3426140 - DNA, 14 bp, Homo sapiens
agaggacttttctt

SEQ ID NO: 3426141 - DNA, 23 bp, Homo sapiens
agaggaggcaaatggcactgcag

SEQ ID NO: 3426142 - DNA, 20 bp, Homo sapiens
agaggagtacaggtgaagca

SEQ ID NO: 3426143 - DNA, 18 bp, Homo sapiens
agaggcaactgcattggc

SEQ ID NO: 3426144 - DNA, 21 bp, Homo sapiens
agaggcagccccattctgcct

SEQ ID NO: 3426145 - DNA, 22 bp, Homo sapiens
agaggcagccccattctgcctg

SEQ ID NO: 3426146 - DNA, 24 bp, Homo sapiens
agaggcagccccattctgcctgcc

SEQ ID NO: 3426147 - DNA, 16 bp, Homo sapiens
agaggcagcccgcaca

SEQ ID NO: 3426148 - DNA, 10 bp, Homo sapiens
agaggcaggg

SEQ ID NO: 3426149 - DNA, 13 bp, Homo sapiens
agaggccccagcc

SEQ ID NO: 3426150 - DNA, 22 bp, Homo sapiens
agaggcccccagcccagggctc

SEQ ID NO: 3426151 - DNA, 21 bp, Homo sapiens
agaggccctctggagtggcca

SEQ ID NO: 3426152 - DNA, 22 bp, Homo sapiens
agaggccctctggagtggccac

SEQ ID NO: 3426153 - DNA, 17 bp, Homo sapiens
agaggccctttgctgtc

SEQ ID NO: 3426154 - DNA, 19 bp, Homo sapiens
agaggctaaattactcagg

SEQ ID NO: 3426155 - DNA, 16 bp, Homo sapiens
agaggctacagggcca

SEQ ID NO: 3426156 - DNA, 14 bp, Homo sapiens
agaggctcatggcc

SEQ ID NO: 3426157 - DNA, 14 bp, Homo sapiens
agaggctgagcacc

SEQ ID NO: 3426158 - DNA, 18 bp, Homo sapiens
agaggctgcactgcagcc

SEQ ID NO: 3426159 - DNA, 12 bp, Homo sapiens
agaggctgcagg

SEQ ID NO: 3426160 - DNA, 19 bp, Homo sapiens
agaggctggcctctacatc

SEQ ID NO: 3426161 - DNA, 13 bp, Homo sapiens
agaggctgggagg

SEQ ID NO: 3426162 - DNA, 21 bp, Homo sapiens
agaggctgggaggagcccctg

SEQ ID NO: 3426163 - DNA, 19 bp, Homo sapiens
agagggacctctcccaggg

SEQ ID NO: 3426164 - DNA, 15 bp, Homo sapiens
agagggacgcctggg

SEQ ID NO: 3426165 - DNA, 16 bp, Homo sapiens
agagggaggcaagccc

SEQ ID NO: 3426166 - DNA, 13 bp, Homo sapiens
agagggaggggcc

SEQ ID NO: 3426167 - DNA, 16 bp, Homo sapiens
agagggaggggcctag

SEQ ID NO: 3426168 - DNA, 17 bp, Homo sapiens
agaggggacgcaggccc

SEQ ID NO: 3426169 - DNA, 18 bp, Homo sapiens
agaggggacgcaggcccc

SEQ ID NO: 3426170 - DNA, 19 bp, Homo sapiens
agagggggcctgggacttc

SEQ ID NO: 3426171 - DNA, 14 bp, Homo sapiens
agagggtgagggcc

SEQ ID NO: 3426172 - DNA, 17 bp, Homo sapiens
agagggtgagggccttc

SEQ ID NO: 3426173 - DNA, 18 bp, Homo sapiens
agagggtgagggccttct

SEQ ID NO: 3426174 - DNA, 19 bp, Homo sapiens
agagggtggtgacctctgc

SEQ ID NO: 3426175 - DNA, 15 bp, Homo sapiens
agagggtgtcatcta

SEQ ID NO: 3426176 - DNA, 23 bp, Homo sapiens
agagggttttaggtagaaaaaca

SEQ ID NO: 3426177 - DNA, 13 bp, Homo sapiens
agaggtgggccag

SEQ ID NO: 3426178 - DNA, 15 bp, Homo sapiens
agagtagaattgcat

SEQ ID NO: 3426179 - DNA, 17 bp, Homo sapiens
agagtagaattgcattg

SEQ ID NO: 3426180 - DNA, 23 bp, Homo sapiens
agagtattggtctcctctcagcc

SEQ ID NO: 3426181 - DNA, 20 bp, Homo sapiens
agagtcacacgggggcagct

SEQ ID NO: 3426182 - DNA, 21 bp, Homo sapiens
agagtcacacgggggcagctg

SEQ ID NO: 3426183 - DNA, 21 bp, Homo sapiens
agagtcagccccgacttcctg

SEQ ID NO: 3426184 - DNA, 16 bp, Homo sapiens
agagtcagctctctgc

SEQ ID NO: 3426185 - DNA, 18 bp, Homo sapiens
agagtcagctctctgccc

SEQ ID NO: 3426186 - DNA, 20 bp, Homo sapiens
agagtcagctctctgccctg

SEQ ID NO: 3426187 - DNA, 12 bp, Homo sapiens
agagtcctctga

SEQ ID NO: 3426188 - DNA, 15 bp, Homo sapiens
agagtctggccctag

SEQ ID NO: 3426189 - DNA, 22 bp, Homo sapiens
agagtgacacccaagagggctg

SEQ ID NO: 3426190 - DNA, 20 bp, Homo sapiens
agagtgtcttcacggcagga

SEQ ID NO: 3426191 - DNA, 14 bp, Homo sapiens
agagtgtgcctgaa

SEQ ID NO: 3426192 - DNA, 12 bp, Homo sapiens
agagttagactg

SEQ ID NO: 3426193 - DNA, 15 bp, Homo sapiens
agagttagactgttg

SEQ ID NO: 3426194 - DNA, 19 bp, Homo sapiens
agagttccccatgcagaca

SEQ ID NO: 3426195 - DNA, 16 bp, Homo sapiens
agagttgtaaatatat

SEQ ID NO: 3426196 - DNA, 19 bp, Homo sapiens
agagttgtaaatatataaa

SEQ ID NO: 3426197 - DNA, 12 bp, Homo sapiens
agagtttacagt

SEQ ID NO: 3426198 - DNA, 17 bp, Homo sapiens
agagttttggatgcagt

SEQ ID NO: 3426199 - DNA, 18 bp, Homo sapiens
agagttttggatgcagtg

SEQ ID NO: 3426200 - DNA, 19 bp, Homo sapiens
agagttttggatgcagtgc

SEQ ID NO: 3426201 - DNA, 20 bp, Homo sapiens
agagttttggatgcagtgct

SEQ ID NO: 3426202 - DNA, 13 bp, Homo sapiens
agataaactcaga

SEQ ID NO: 3426203 - DNA, 17 bp, Homo sapiens
agataaagatttcttga

SEQ ID NO: 3426204 - DNA, 20 bp, Homo sapiens
acttgtcatatgtagccttc

SEQ ID NO: 3426205 - DNA, 20 bp, Homo sapiens
acttgtctcttcatctaata

SEQ ID NO: 3426206 - DNA, 14 bp, Homo sapiens
acttgtggacacag

SEQ ID NO: 3426207 - DNA, 18 bp, Homo sapiens
acttgtggacacagctct

SEQ ID NO: 3426208 - DNA, 22 bp, Homo sapiens
acttgtggacacagctcttctc

SEQ ID NO: 3426209 - DNA, 15 bp, Homo sapiens
acttgtggactaaaa

SEQ ID NO: 3426210 - DNA, 20 bp, Homo sapiens
acttgtggactaaaagatat

SEQ ID NO: 3426211 - DNA, 13 bp, Homo sapiens
acttgtttgcact

SEQ ID NO: 3426212 - DNA, 14 bp, Homo sapiens
actttaatttatgt

SEQ ID NO: 3426213 - DNA, 22 bp, Homo sapiens
actttaatttatgtaacttgaa

SEQ ID NO: 3426214 - DNA, 19 bp, Homo sapiens
actttacaatgttcatccc

SEQ ID NO: 3426215 - DNA, 21 bp, Homo sapiens
actttagaagtagaattgaca

SEQ ID NO: 3426216 - DNA, 15 bp, Homo sapiens
actttagggctgtaa

SEQ ID NO: 3426217 - DNA, 14 bp, Homo sapiens
actttatcaattaa

SEQ ID NO: 3426218 - DNA, 20 bp, Homo sapiens
actttattaaatacaaaact

SEQ ID NO: 3426219 - DNA, 21 bp, Homo sapiens
actttattgccttttaatttt

SEQ ID NO: 3426220 - DNA, 19 bp, Homo sapiens
actttcctcctgaggcttt

SEQ ID NO: 3426221 - DNA, 18 bp, Homo sapiens
actttcctcttcctgcct

SEQ ID NO: 3426222 - DNA, 17 bp, Homo sapiens
actttctacaatgtgaa

SEQ ID NO: 3426223 - DNA, 12 bp, Homo sapiens
actttcttaaaa

SEQ ID NO: 3426224 - DNA, 23 bp, Homo sapiens
actttcttctaccagacccttct

SEQ ID NO: 3426225 - DNA, 14 bp, Homo sapiens
actttcttctgaat

SEQ ID NO: 3426226 - DNA, 12 bp, Homo sapiens
actttgaataaa

SEQ ID NO: 3426227 - DNA, 14 bp, Homo sapiens
actttgaataaaga

SEQ ID NO: 3426228 - DNA, 18 bp, Homo sapiens
actttgaataaagaatac

SEQ ID NO: 3426229 - DNA, 19 bp, Homo sapiens
actttgaataaagaatact

SEQ ID NO: 3426230 - DNA, 21 bp, Homo sapiens
actttgaataaagaatacttg

SEQ ID NO: 3426231 - DNA, 22 bp, Homo sapiens
actttgaataaagaatacttga

SEQ ID NO: 3426232 - DNA, 23 bp, Homo sapiens
actttgaataaagaatacttgaa

SEQ ID NO: 3426233 - DNA, 18 bp, Homo sapiens
actttgaggataactttt

SEQ ID NO: 3426234 - DNA, 17 bp, Homo sapiens
actttgcatagcagctg

SEQ ID NO: 3426235 - DNA, 13 bp, Homo sapiens
actttgctcctca

SEQ ID NO: 3426236 - DNA, 12 bp, Homo sapiens
actttgctttgg

SEQ ID NO: 3426237 - DNA, 22 bp, Homo sapiens
actttgctttgggtttgtggca

SEQ ID NO: 3426238 - DNA, 15 bp, Homo sapiens
actttggaacactac

SEQ ID NO: 3426239 - DNA, 23 bp, Homo sapiens
actttgtaaataggatttttaga

SEQ ID NO: 3426240 - DNA, 15 bp, Homo sapiens
actttgtggtctaaa

SEQ ID NO: 3426241 - DNA, 20 bp, Homo sapiens
actttgtggtctaaagtgtt

SEQ ID NO: 3426242 - DNA, 17 bp, Homo sapiens
acttttcattccctgta

SEQ ID NO: 3426243 - DNA, 14 bp, Homo sapiens
acttttcattctct

SEQ ID NO: 3426244 - DNA, 15 bp, Homo sapiens
acttttgccctttga

SEQ ID NO: 3426245 - DNA, 14 bp, Homo sapiens
actttttacattac

SEQ ID NO: 3426246 - DNA, 17 bp, Homo sapiens
actttttagtaatttct

SEQ ID NO: 3426247 - DNA, 12 bp, Homo sapiens
actttttattgc

SEQ ID NO: 3426248 - DNA, 18 bp, Homo sapiens
actttttattgccttctc

SEQ ID NO: 3426249 - DNA, 12 bp, Homo sapiens
actttttgcagc

SEQ ID NO: 3426250 - DNA, 23 bp, Homo sapiens
agaaaaaagtcaccattctgcat

SEQ ID NO: 3426251 - DNA, 18 bp, Homo sapiens
agaaaaaataacacacat

SEQ ID NO: 3426252 - DNA, 23 bp, Homo sapiens
agaaaaaatattttcctgccagg

SEQ ID NO: 3426253 - DNA, 16 bp, Homo sapiens
agaaaaagggctgccg

SEQ ID NO: 3426254 - DNA, 17 bp, Homo sapiens
agaaaaccaaaatgata

SEQ ID NO: 3426255 - DNA, 18 bp, Homo sapiens
agaaaagattttaatcaa

SEQ ID NO: 3426256 - DNA, 21 bp, Homo sapiens
agaaaagtattgtttggagga

SEQ ID NO: 3426257 - DNA, 12 bp, Homo sapiens
agaaaatataag

SEQ ID NO: 3426258 - DNA, 14 bp, Homo sapiens
agaaaatatatgta

SEQ ID NO: 3426259 - DNA, 16 bp, Homo sapiens
agaaaatattttgtct

SEQ ID NO: 3426260 - DNA, 18 bp, Homo sapiens
agaaaatattttgtctaa

SEQ ID NO: 3426261 - DNA, 19 bp, Homo sapiens
agaaaatattttgtctaaa

SEQ ID NO: 3426262 - DNA, 20 bp, Homo sapiens
agaaaatattttgtctaaaa

SEQ ID NO: 3426263 - DNA, 21 bp, Homo sapiens
agaaaatattttgtctaaaat

SEQ ID NO: 3426264 - DNA, 19 bp, Homo sapiens
agaaaatcatattgcttct

SEQ ID NO: 3426265 - DNA, 13 bp, Homo sapiens
agaaaatcatcaa

SEQ ID NO: 3426266 - DNA, 17 bp, Homo sapiens
agaaaatcatcaagaag

SEQ ID NO: 3426267 - DNA, 19 bp, Homo sapiens
agaaaatcatcaagaaggg

SEQ ID NO: 3426268 - DNA, 13 bp, Homo sapiens
agaaaatgttatt

SEQ ID NO: 3426269 - DNA, 18 bp, Homo sapiens
agaaaatgttatttaaca

SEQ ID NO: 3426270 - DNA, 17 bp, Homo sapiens
agaaaatgttgagaatc

SEQ ID NO: 3426271 - DNA, 12 bp, Homo sapiens
agaaaattcaat

SEQ ID NO: 3426272 - DNA, 17 bp, Homo sapiens
agaaaattcaattgtaa

SEQ ID NO: 3426273 - DNA, 22 bp, Homo sapiens
agaaaattcctataaggaagat

SEQ ID NO: 3426274 - DNA, 17 bp, Homo sapiens
agaaacaactctttgag

SEQ ID NO: 3426275 - DNA, 17 bp, Homo sapiens
agaaacacactgaggca

SEQ ID NO: 3426276 - DNA, 14 bp, Homo sapiens
agaaacatcagtta

SEQ ID NO: 3426277 - DNA, 16 bp, Homo sapiens
agaaacatcagttact

SEQ ID NO: 3426278 - DNA, 23 bp, Homo sapiens
agaaacatcagttactctgaagg

SEQ ID NO: 3426279 - DNA, 21 bp, Homo sapiens
agaaacatccatattgcacaa

SEQ ID NO: 3426280 - DNA, 22 bp, Homo sapiens
agaaaccaaagctttatttcaa

SEQ ID NO: 3426281 - DNA, 17 bp, Homo sapiens
agaaacccaccagccta

SEQ ID NO: 3426282 - DNA, 16 bp, Homo sapiens
agaaacctactgccca

SEQ ID NO: 3426283 - DNA, 16 bp, Homo sapiens
agaaaccttattgtac

SEQ ID NO: 3426284 - DNA, 18 bp, Homo sapiens
agaaaccttattgtacct

SEQ ID NO: 3426285 - DNA, 15 bp, Homo sapiens
agaaacgtcttctaa

SEQ ID NO: 3426286 - DNA, 16 bp, Homo sapiens
agaaacgtcttctaaa

SEQ ID NO: 3426287 - DNA, 15 bp, Homo sapiens
agaaactgttcccac

SEQ ID NO: 3426288 - DNA, 18 bp, Homo sapiens
agaaacttaagcaaaggg

SEQ ID NO: 3426289 - DNA, 22 bp, Homo sapiens
agaaagaaacccgacagaggga

SEQ ID NO: 3426290 - DNA, 19 bp, Homo sapiens
agaaagagcacttaagaga

SEQ ID NO: 3426291 - DNA, 14 bp, Homo sapiens
agaaagatgtatat

SEQ ID NO: 3426292 - DNA, 20 bp, Homo sapiens
agaaagatgtatataggtgt

SEQ ID NO: 3426293 - DNA, 20 bp, Homo sapiens
agaaagcatttgaatgcatt

SEQ ID NO: 3426294 - DNA, 22 bp, Homo sapiens
agaaagcatttgaatgcatttt

SEQ ID NO: 3426295 - DNA, 14 bp, Homo sapiens
agaaaggcctttaa

SEQ ID NO: 3426296 - DNA, 17 bp, Homo sapiens
agaaaggcctttaaaat

SEQ ID NO: 3426297 - DNA, 14 bp, Homo sapiens
agaaaggggagccc

SEQ ID NO: 3426298 - DNA, 16 bp, Homo sapiens
agaaaggggagcccac

SEQ ID NO: 3426299 - DNA, 17 bp, Homo sapiens
agaaaggggagcccact

SEQ ID NO: 3426300 - DNA, 20 bp, Homo sapiens
agaaaggtggactggaaggg

SEQ ID NO: 3426301 - DNA, 19 bp, Homo sapiens
agaaagtggaaaacaagga

SEQ ID NO: 3426302 - DNA, 19 bp, Homo sapiens
agaaagttgcacggctgct

SEQ ID NO: 3426303 - DNA, 17 bp, Homo sapiens
agaaataaaaggaagcc

SEQ ID NO: 3426304 - DNA, 19 bp, Homo sapiens
agaaataaaaggaagccaa

SEQ ID NO: 3426305 - DNA, 20 bp, Homo sapiens
agaaataaaaggaagccaaa

SEQ ID NO: 3426306 - DNA, 14 bp, Homo sapiens
agaaatacaaaaat

SEQ ID NO: 3426307 - DNA, 21 bp, Homo sapiens
agaaatacagattttgatagc

SEQ ID NO: 3426308 - DNA, 14 bp, Homo sapiens
agaaatacagtctt

SEQ ID NO: 3426309 - DNA, 20 bp, Homo sapiens
agaaatatggaacttacatt

SEQ ID NO: 3426310 - DNA, 17 bp, Homo sapiens
agaaatctggcttctgg

SEQ ID NO: 3426311 - DNA, 16 bp, Homo sapiens
agaaatggaaattttg

SEQ ID NO: 3426312 - DNA, 20 bp, Homo sapiens
agaaatgggacttaactcct

SEQ ID NO: 3426313 - DNA, 19 bp, Homo sapiens
agaaatggtgagattgttt

SEQ ID NO: 3426314 - DNA, 15 bp, Homo sapiens
agaaatggttgtatt

SEQ ID NO: 3426315 - DNA, 21 bp, Homo sapiens
agaaatggttgtattagatgt

SEQ ID NO: 3426316 - DNA, 21 bp, Homo sapiens
agaatttattcaattcctctg

SEQ ID NO: 3426317 - DNA, 22 bp, Homo sapiens
agacaaaatattttcctgccac

SEQ ID NO: 3426318 - DNA, 16 bp, Homo sapiens
agacaaatcaaagcag

SEQ ID NO: 3426319 - DNA, 21 bp, Homo sapiens
agacaagacttcagtatgttg

SEQ ID NO: 3426320 - DNA, 14 bp, Homo sapiens
agacaagagaatgc

SEQ ID NO: 3426321 - DNA, 15 bp, Homo sapiens
agacaagccagaact

SEQ ID NO: 3426322 - DNA, 21 bp, Homo sapiens
agacaatatgtgagtgccttt

SEQ ID NO: 3426323 - DNA, 20 bp, Homo sapiens
agacaatgtctgcagccctg

SEQ ID NO: 3426324 - DNA, 19 bp, Homo sapiens
agacaattgacaacagtta

SEQ ID NO: 3426325 - DNA, 13 bp, Homo sapiens
agacaatttgcac

SEQ ID NO: 3426326 - DNA, 18 bp, Homo sapiens
agacacaacaactcctag

SEQ ID NO: 3426327 - DNA, 15 bp, Homo sapiens
agacacacacacagc

SEQ ID NO: 3426328 - DNA, 13 bp, Homo sapiens
agacacaggcccg

SEQ ID NO: 3426329 - DNA, 21 bp, Homo sapiens
agacacaggcccggctccagg

SEQ ID NO: 3426330 - DNA, 14 bp, Homo sapiens
agacacatatgagg

SEQ ID NO: 3426331 - DNA, 16 bp, Homo sapiens
agacacatatgagggg

SEQ ID NO: 3426332 - DNA, 16 bp, Homo sapiens
agacacatgctatgtt

SEQ ID NO: 3426333 - DNA, 12 bp, Homo sapiens
agacacccagga

SEQ ID NO: 3426334 - DNA, 13 bp, Homo sapiens
agacacccaggac

SEQ ID NO: 3426335 - DNA, 14 bp, Homo sapiens
agacacccaggact

SEQ ID NO: 3426336 - DNA, 21 bp, Homo sapiens
agacaccctcaacctcttctg

SEQ ID NO: 3426337 - DNA, 22 bp, Homo sapiens
agacaccttgacagggcacacc

SEQ ID NO: 3426338 - DNA, 18 bp, Homo sapiens
agacacggatctgagaat

SEQ ID NO: 3426339 - DNA, 21 bp, Homo sapiens
agacacggatctgagaatctt

SEQ ID NO: 3426340 - DNA, 20 bp, Homo sapiens
agacactccccgaagtcttt

SEQ ID NO: 3426341 - DNA, 22 bp, Homo sapiens
agacactccccgaagtcttttg

SEQ ID NO: 3426342 - DNA, 21 bp, Homo sapiens
agacacttcatggaccaagaa

SEQ ID NO: 3426343 - DNA, 22 bp, Homo sapiens
agacacttcatggaccaagaat

SEQ ID NO: 3426344 - DNA, 17 bp, Homo sapiens
agacagaaagagacaca

SEQ ID NO: 3426345 - DNA, 14 bp, Homo sapiens
agacagaccctctg

SEQ ID NO: 3426346 - DNA, 13 bp, Homo sapiens
agacagaccttca

SEQ ID NO: 3426347 - DNA, 15 bp, Homo sapiens
agacagagaaacaga

SEQ ID NO: 3426348 - DNA, 21 bp, Homo sapiens
agacagagaatatgtctgctc

SEQ ID NO: 3426349 - DNA, 14 bp, Homo sapiens
acgtcatctcaggg

SEQ ID NO: 3426350 - DNA, 17 bp, Homo sapiens
acgtcatctcagggtcc

SEQ ID NO: 3426351 - DNA, 16 bp, Homo sapiens
acgtctcgccaagcag

SEQ ID NO: 3426352 - DNA, 14 bp, Homo sapiens
acgtctgacaggca

SEQ ID NO: 3426353 - DNA, 15 bp, Homo sapiens
acgtctgacaggcaa

SEQ ID NO: 3426354 - DNA, 23 bp, Homo sapiens
acgtctgacaggcaatgctggct

SEQ ID NO: 3426355 - DNA, 21 bp, Homo sapiens
acgtgacacaaacacacacaa

SEQ ID NO: 3426356 - DNA, 14 bp, Homo sapiens
acgtgagagtgtct

SEQ ID NO: 3426357 - DNA, 16 bp, Homo sapiens
acgtgagatcattcac

SEQ ID NO: 3426358 - DNA, 20 bp, Homo sapiens
acgtgatcctctcacctcag

SEQ ID NO: 3426359 - DNA, 14 bp, Homo sapiens
acgtgcaaagccaa

SEQ ID NO: 3426360 - DNA, 15 bp, Homo sapiens
acgtgcattgtgctt

SEQ ID NO: 3426361 - DNA, 22 bp, Homo sapiens
acgtgcattgtgcttctttctt

SEQ ID NO: 3426362 - DNA, 18 bp, Homo sapiens
acgtgcctgtgggcctgg

SEQ ID NO: 3426363 - DNA, 20 bp, Homo sapiens
acgtgcgctgggcacttccc

SEQ ID NO: 3426364 - DNA, 22 bp, Homo sapiens
acgtgcgctgggcacttccctg

SEQ ID NO: 3426365 - DNA, 18 bp, Homo sapiens
acgtggaggagcagtgca

SEQ ID NO: 3426366 - DNA, 19 bp, Homo sapiens
acgtgggcaaacaggcagt

SEQ ID NO: 3426367 - DNA, 23 bp, Homo sapiens
acgttaacccatttttgagccaa

SEQ ID NO: 3426368 - DNA, 19 bp, Homo sapiens
acgttaggcatttcctgct

SEQ ID NO: 3426369 - DNA, 20 bp, Homo sapiens
acgtttggaagatcctgtga

SEQ ID NO: 3426370 - DNA, 18 bp, Homo sapiens
acgttttttcctcagtgc

SEQ ID NO: 3426371 - DNA, 16 bp, Homo sapiens
actaaaagatataagt

SEQ ID NO: 3426372 - DNA, 18 bp, Homo sapiens
actaaacacgtgacacaa

SEQ ID NO: 3426373 - DNA, 12 bp, Homo sapiens
actaaactcatt

SEQ ID NO: 3426374 - DNA, 17 bp, Homo sapiens
actaaagccaaacatat

SEQ ID NO: 3426375 - DNA, 17 bp, Homo sapiens
actaacaggatatttaa

SEQ ID NO: 3426376 - DNA, 14 bp, Homo sapiens
actaactaaactct

SEQ ID NO: 3426377 - DNA, 19 bp, Homo sapiens
actaagaacccctctgctt

SEQ ID NO: 3426378 - DNA, 12 bp, Homo sapiens
actaagcagagg

SEQ ID NO: 3426379 - DNA, 22 bp, Homo sapiens
actaaggggcccggccagccat

SEQ ID NO: 3426380 - DNA, 13 bp, Homo sapiens
actaataaaccag

SEQ ID NO: 3426381 - DNA, 18 bp, Homo sapiens
actaatccaatacctctt

SEQ ID NO: 3426382 - DNA, 22 bp, Homo sapiens
actaatggcatgagaaatacaa

SEQ ID NO: 3426383 - DNA, 17 bp, Homo sapiens
actaattatactacttt

SEQ ID NO: 3426384 - DNA, 15 bp, Homo sapiens
actaattccacacct

SEQ ID NO: 3426385 - DNA, 16 bp, Homo sapiens
actaatttcaaaatgc

SEQ ID NO: 3426386 - DNA, 19 bp, Homo sapiens
actaatttcaaaatgcttt

SEQ ID NO: 3426387 - DNA, 12 bp, Homo sapiens
actaatttcttc

SEQ ID NO: 3426388 - DNA, 15 bp, Homo sapiens
actaattttacatgt

SEQ ID NO: 3426389 - DNA, 19 bp, Homo sapiens
actaatttttgtattattt

SEQ ID NO: 3426390 - DNA, 11 bp, Homo sapiens
actacaaatca

SEQ ID NO: 3426391 - DNA, 19 bp, Homo sapiens
actacaaatcaagtatttg

SEQ ID NO: 3426392 - DNA, 15 bp, Homo sapiens
actacagtcaggaaa

SEQ ID NO: 3426393 - DNA, 20 bp, Homo sapiens
actacatgagaacaaacaga

SEQ ID NO: 3426394 - DNA, 17 bp, Homo sapiens
actaccttgaaaataag

SEQ ID NO: 3426395 - DNA, 14 bp, Homo sapiens
actactcttacatg

SEQ ID NO: 3426396 - DNA, 19 bp, Homo sapiens
actagaaatgggaatcatg

SEQ ID NO: 3426397 - DNA, 15 bp, Homo sapiens
actagaatttattca

SEQ ID NO: 3426398 - DNA, 20 bp, Homo sapiens
actagagggacctctcccag

SEQ ID NO: 3426399 - DNA, 13 bp, Homo sapiens
actagatgatgga

SEQ ID NO: 3426400 - DNA, 15 bp, Homo sapiens
actagatggtgctga

SEQ ID NO: 3426401 - DNA, 16 bp, Homo sapiens
actagatggtgctgag

SEQ ID NO: 3426402 - DNA, 18 bp, Homo sapiens
actagatggtgctgagaa

SEQ ID NO: 3426403 - DNA, 20 bp, Homo sapiens
actagattttcacttatgaa

SEQ ID NO: 3426404 - DNA, 23 bp, Homo sapiens
actagcaccattttaagtccctg

SEQ ID NO: 3426405 - DNA, 15 bp, Homo sapiens
actagcatatctgcc

SEQ ID NO: 3426406 - DNA, 20 bp, Homo sapiens
actaggcccccacttgcctc

SEQ ID NO: 3426407 - DNA, 15 bp, Homo sapiens
actagggagccatgt

SEQ ID NO: 3426408 - DNA, 16 bp, Homo sapiens
actagggatccctcat

SEQ ID NO: 3426409 - DNA, 18 bp, Homo sapiens
actagggatccctcatct

SEQ ID NO: 3426410 - DNA, 16 bp, Homo sapiens
actagggccaagccca

SEQ ID NO: 3426411 - DNA, 18 bp, Homo sapiens
actaggtaacttcatatt

SEQ ID NO: 3426412 - DNA, 20 bp, Homo sapiens
actagtggggtttcctggca

SEQ ID NO: 3426413 - DNA, 20 bp, Homo sapiens
actataaagaagtaacaaaa

SEQ ID NO: 3426414 - DNA, 17 bp, Homo sapiens
actatagcctaggtgac

SEQ ID NO: 3426415 - DNA, 22 bp, Homo sapiens
actatagcctaggtgacagagt

SEQ ID NO: 3426416 - DNA, 19 bp, Homo sapiens
actatattgattgtccttt

SEQ ID NO: 3426417 - DNA, 23 bp, Homo sapiens
actatatttgggcctgctccaga

SEQ ID NO: 3426418 - DNA, 16 bp, Homo sapiens
actatattttgtcata

SEQ ID NO: 3426419 - DNA, 17 bp, Homo sapiens
actatctactctcctca

SEQ ID NO: 3426420 - DNA, 18 bp, Homo sapiens
actatctttcagctccag

SEQ ID NO: 3426421 - DNA, 17 bp, Homo sapiens
actatgcagaggcctgg

SEQ ID NO: 3426422 - DNA, 20 bp, Homo sapiens
actatgcatggtgccccagg

SEQ ID NO: 3426423 - DNA, 22 bp, Homo sapiens
actatgcatggtgccccaggac

SEQ ID NO: 3426424 - DNA, 23 bp, Homo sapiens
actatgcatggtgccccaggacc

SEQ ID NO: 3426425 - DNA, 12 bp, Homo sapiens
actatgcctgtg

SEQ ID NO: 3426426 - DNA, 19 bp, Homo sapiens
actatgcctgtgtcttctc

SEQ ID NO: 3426427 - DNA, 21 bp, Homo sapiens
actatggataaactaaacacg

SEQ ID NO: 3426428 - DNA, 18 bp, Homo sapiens
actatgtctagagcctct

SEQ ID NO: 3426429 - DNA, 14 bp, Homo sapiens
actatgttgcccag

SEQ ID NO: 3426430 - DNA, 17 bp, Homo sapiens
actatgttgcccaggca

SEQ ID NO: 3426431 - DNA, 18 bp, Homo sapiens
actattaaaatattttgg

SEQ ID NO: 3426432 - DNA, 13 bp, Homo sapiens
actattaacatga

SEQ ID NO: 3426433 - DNA, 17 bp, Homo sapiens
actattaacatgatgta

SEQ ID NO: 3426434 - DNA, 19 bp, Homo sapiens
actattaacatgatgtact

SEQ ID NO: 3426435 - DNA, 20 bp, Homo sapiens
actattaaggatgtagcttt

SEQ ID NO: 3426436 - DNA, 17 bp, Homo sapiens
actattataatttaatg

SEQ ID NO: 3426437 - DNA, 22 bp, Homo sapiens
actattgcagacctgtcaccct

SEQ ID NO: 3426438 - DNA, 15 bp, Homo sapiens
actatttcttcagag

SEQ ID NO: 3426439 - DNA, 20 bp, Homo sapiens
actattttaatttgtattga

SEQ ID NO: 3426440 - DNA, 13 bp, Homo sapiens
actattttcaaag

SEQ ID NO: 3426441 - DNA, 22 bp, Homo sapiens
actattttcagatgtgaaccat

SEQ ID NO: 3426442 - DNA, 15 bp, Homo sapiens
actcaaagagggtga

SEQ ID NO: 3426443 - DNA, 21 bp, Homo sapiens
actcaaagagggtgagggcct

SEQ ID NO: 3426444 - DNA, 20 bp, Homo sapiens
actcaaagtttcagagacca

SEQ ID NO: 3426445 - DNA, 17 bp, Homo sapiens
actcaaatggggccaga

SEQ ID NO: 3426446 - DNA, 20 bp, Homo sapiens
actcaaatggggccagatcc

SEQ ID NO: 3426447 - DNA, 21 bp, Homo sapiens
actcaaatggggccagatcca

SEQ ID NO: 3426448 - DNA, 22 bp, Homo sapiens
actcaaatggggccagatccag

SEQ ID NO: 3426449 - DNA, 13 bp, Homo sapiens
actcaagaagcag

SEQ ID NO: 3426450 - DNA, 14 bp, Homo sapiens
actcaagaagcagg

SEQ ID NO: 3426451 - DNA, 15 bp, Homo sapiens
actcaagaagcaggc

SEQ ID NO: 3426452 - DNA, 14 bp, Homo sapiens
actcaagcccgcgg

SEQ ID NO: 3426453 - DNA, 17 bp, Homo sapiens
actcaatgaaatatgtg

SEQ ID NO: 3426454 - DNA, 16 bp, Homo sapiens
actcaatgcactgaca

SEQ ID NO: 3426455 - DNA, 13 bp, Homo sapiens
actcaccatctgt

SEQ ID NO: 3426456 - DNA, 14 bp, Homo sapiens
actcaccatctgtg

SEQ ID NO: 3426457 - DNA, 20 bp, Homo sapiens
actcacctggggctgctggc

SEQ ID NO: 3426458 - DNA, 15 bp, Homo sapiens
actcactaggccccc

SEQ ID NO: 3426459 - DNA, 14 bp, Homo sapiens
actcagaaagccaa

SEQ ID NO: 3426460 - DNA, 21 bp, Homo sapiens
actcagaaatttaattcatgt

SEQ ID NO: 3426461 - DNA, 14 bp, Homo sapiens
actcagaagacact

SEQ ID NO: 3426462 - DNA, 15 bp, Homo sapiens
actcagaagcctctg

SEQ ID NO: 3426463 - DNA, 15 bp, Homo sapiens
actcagaccagagaa

SEQ ID NO: 3426464 - DNA, 22 bp, Homo sapiens
actcagataaggtaaaatgcca

SEQ ID NO: 3426465 - DNA, 11 bp, Homo sapiens
actcagatcca

SEQ ID NO: 3426466 - DNA, 16 bp, Homo sapiens
actcagatccagggac

SEQ ID NO: 3426467 - DNA, 17 bp, Homo sapiens
actcagatccagggaca

SEQ ID NO: 3426468 - DNA, 22 bp, Homo sapiens
actcagatggaaccgcaggaag

SEQ ID NO: 3426469 - DNA, 23 bp, Homo sapiens
actcagcatttgattaacatttg

SEQ ID NO: 3426470 - DNA, 23 bp, Homo sapiens
actcagccttcagacagagagga

SEQ ID NO: 3426471 - DNA, 19 bp, Homo sapiens
actcagctccccagagtcc

SEQ ID NO: 3426472 - DNA, 12 bp, Homo sapiens
actcaggctgga

SEQ ID NO: 3426473 - DNA, 16 bp, Homo sapiens
actcagggctcctggg

SEQ ID NO: 3426474 - DNA, 20 bp, Homo sapiens
actcataagttggaccagag

SEQ ID NO: 3426475 - DNA, 23 bp, Homo sapiens
actcataatctataaacaatgaa

SEQ ID NO: 3426476 - DNA, 14 bp, Homo sapiens
actcatacatctgg

SEQ ID NO: 3426477 - DNA, 13 bp, Homo sapiens
actcatcatttgt

SEQ ID NO: 3426478 - DNA, 21 bp, Homo sapiens
actcattcaaaagttgaaatt

SEQ ID NO: 3426479 - DNA, 19 bp, Homo sapiens
actcattccagatcccagg

SEQ ID NO: 3426480 - DNA, 21 bp, Homo sapiens
actcattgctgagcctctgct

SEQ ID NO: 3426481 - DNA, 22 bp, Homo sapiens
actcattgctgagcctctgctc

SEQ ID NO: 3426482 - DNA, 23 bp, Homo sapiens
actcattgctgagcctctgctcc

SEQ ID NO: 3426483 - DNA, 16 bp, Homo sapiens
actcatttcctatgta

SEQ ID NO: 3426484 - DNA, 18 bp, Homo sapiens
actccaacagaagaactg

SEQ ID NO: 3426485 - DNA, 15 bp, Homo sapiens
accttaggcagggaa

SEQ ID NO: 3426486 - DNA, 13 bp, Homo sapiens
accttaggccttc

SEQ ID NO: 3426487 - DNA, 15 bp, Homo sapiens
accttaggccttcct

SEQ ID NO: 3426488 - DNA, 21 bp, Homo sapiens
accttaggccttcctctctcc

SEQ ID NO: 3426489 - DNA, 19 bp, Homo sapiens
accttagtttcaagagtct

SEQ ID NO: 3426490 - DNA, 20 bp, Homo sapiens
accttattgtacctctctta

SEQ ID NO: 3426491 - DNA, 19 bp, Homo sapiens
accttcaaactagggccaa

SEQ ID NO: 3426492 - DNA, 14 bp, Homo sapiens
accttcccaaacgc

SEQ ID NO: 3426493 - DNA, 19 bp, Homo sapiens
accttcccaaacgcctccc

SEQ ID NO: 3426494 - DNA, 22 bp, Homo sapiens
accttcccaaacgcctcccctg

SEQ ID NO: 3426495 - DNA, 14 bp, Homo sapiens
accttcgggctgtg

SEQ ID NO: 3426496 - DNA, 22 bp, Homo sapiens
accttcgtttactatgcctgtg

SEQ ID NO: 3426497 - DNA, 22 bp, Homo sapiens
accttctctatggggcatcctc

SEQ ID NO: 3426498 - DNA, 12 bp, Homo sapiens
accttctgcctt

SEQ ID NO: 3426499 - DNA, 18 bp, Homo sapiens
accttctggcctcccaca

SEQ ID NO: 3426500 - DNA, 22 bp, Homo sapiens
accttctggcctcccacagact

SEQ ID NO: 3426501 - DNA, 20 bp, Homo sapiens
accttgaactgggtacttgt

SEQ ID NO: 3426502 - DNA, 17 bp, Homo sapiens
accttgacctttgtaca

SEQ ID NO: 3426503 - DNA, 18 bp, Homo sapiens
accttgacctttgtacag

SEQ ID NO: 3426504 - DNA, 17 bp, Homo sapiens
accttgccaattagtaa

SEQ ID NO: 3426505 - DNA, 14 bp, Homo sapiens
accttgccagggag

SEQ ID NO: 3426506 - DNA, 13 bp, Homo sapiens
accttgcttttgc

SEQ ID NO: 3426507 - DNA, 15 bp, Homo sapiens
accttgcttttgctt

SEQ ID NO: 3426508 - DNA, 17 bp, Homo sapiens
accttgcttttgcttct

SEQ ID NO: 3426509 - DNA, 18 bp, Homo sapiens
accttgcttttgcttcta

SEQ ID NO: 3426510 - DNA, 16 bp, Homo sapiens
accttggcaccagaca

SEQ ID NO: 3426511 - DNA, 15 bp, Homo sapiens
accttggcctgggcc

SEQ ID NO: 3426512 - DNA, 22 bp, Homo sapiens
accttggggccttgatgactgc

SEQ ID NO: 3426513 - DNA, 16 bp, Homo sapiens
accttgggtggcccct

SEQ ID NO: 3426514 - DNA, 15 bp, Homo sapiens
accttgttacttctg

SEQ ID NO: 3426515 - DNA, 17 bp, Homo sapiens
accttgttatttctcag

SEQ ID NO: 3426516 - DNA, 14 bp, Homo sapiens
acctttaagaattt

SEQ ID NO: 3426517 - DNA, 18 bp, Homo sapiens
acctttaccccatccctg

SEQ ID NO: 3426518 - DNA, 13 bp, Homo sapiens
acctttattcttt

SEQ ID NO: 3426519 - DNA, 17 bp, Homo sapiens
acctttattcttttcca

SEQ ID NO: 3426520 - DNA, 18 bp, Homo sapiens
acctttcataatctttgc

SEQ ID NO: 3426521 - DNA, 17 bp, Homo sapiens
acctttcccactttctt

SEQ ID NO: 3426522 - DNA, 15 bp, Homo sapiens
acctttcctacattt

SEQ ID NO: 3426523 - DNA, 23 bp, Homo sapiens
acctttctcctttgtactttgtg

SEQ ID NO: 3426524 - DNA, 16 bp, Homo sapiens
acctttgttttttgtt

SEQ ID NO: 3426525 - DNA, 14 bp, Homo sapiens
accttttattacat

SEQ ID NO: 3426526 - DNA, 20 bp, Homo sapiens
accttttattgacacagaaa

SEQ ID NO: 3426527 - DNA, 16 bp, Homo sapiens
accttttgggaatgtt

SEQ ID NO: 3426528 - DNA, 19 bp, Homo sapiens
accttttgggaatgtttta

SEQ ID NO: 3426529 - DNA, 22 bp, Homo sapiens
accttttgggaatgttttaaat

SEQ ID NO: 3426530 - DNA, 13 bp, Homo sapiens
accttttggggga

SEQ ID NO: 3426531 - DNA, 17 bp, Homo sapiens
accttttgggggagggc

SEQ ID NO: 3426532 - DNA, 15 bp, Homo sapiens
acctttttccttcct

SEQ ID NO: 3426533 - DNA, 19 bp, Homo sapiens
acgaatttctgtgccctcc

SEQ ID NO: 3426534 - DNA, 19 bp, Homo sapiens
acgacaaggaaaggcaaat

SEQ ID NO: 3426535 - DNA, 21 bp, Homo sapiens
acgacctaggcagtaggccgg

SEQ ID NO: 3426536 - DNA, 12 bp, Homo sapiens
acgaggaagccc

SEQ ID NO: 3426537 - DNA, 22 bp, Homo sapiens
acgaggaatctgtgggtctggg

SEQ ID NO: 3426538 - DNA, 14 bp, Homo sapiens
acgagggctggctg

SEQ ID NO: 3426539 - DNA, 20 bp, Homo sapiens
acgagggctggctggcctca

SEQ ID NO: 3426540 - DNA, 18 bp, Homo sapiens
acgaggggtgtcttgggc

SEQ ID NO: 3426541 - DNA, 15 bp, Homo sapiens
acgattaagtccaaa

SEQ ID NO: 3426542 - DNA, 21 bp, Homo sapiens
acgattggtatgatgctgccg

SEQ ID NO: 3426543 - DNA, 17 bp, Homo sapiens
acgcacctgcctcagga

SEQ ID NO: 3426544 - DNA, 11 bp, Homo sapiens
acgcaggcccc

SEQ ID NO: 3426545 - DNA, 17 bp, Homo sapiens
acgcaggcccctctcct

SEQ ID NO: 3426546 - DNA, 19 bp, Homo sapiens
acgcaggcccctctcctcc

SEQ ID NO: 3426547 - DNA, 18 bp, Homo sapiens
acgccactgcactatagc

SEQ ID NO: 3426548 - DNA, 18 bp, Homo sapiens
acgccaggggaaaatcag

SEQ ID NO: 3426549 - DNA, 23 bp, Homo sapiens
acgccaggggaaaatcagcctgc

SEQ ID NO: 3426550 - DNA, 14 bp, Homo sapiens
acgcccccccccac

SEQ ID NO: 3426551 - DNA, 16 bp, Homo sapiens
acgcccccccccaccc

SEQ ID NO: 3426552 - DNA, 16 bp, Homo sapiens
acgcccgtcctgcctg

SEQ ID NO: 3426553 - DNA, 19 bp, Homo sapiens
acgcccgtcctgcctgtgg

SEQ ID NO: 3426554 - DNA, 21 bp, Homo sapiens
acgccctctatcatggtgaaa

SEQ ID NO: 3426555 - DNA, 18 bp, Homo sapiens
acgccctttcctcctcag

SEQ ID NO: 3426556 - DNA, 14 bp, Homo sapiens
acgcctgcaaacgc

SEQ ID NO: 3426557 - DNA, 18 bp, Homo sapiens
acgcctgcaaacgctgcc

SEQ ID NO: 3426558 - DNA, 19 bp, Homo sapiens
acgcctgcaaacgctgcct

SEQ ID NO: 3426559 - DNA, 20 bp, Homo sapiens
acgcctgcaaacgctgcctg

SEQ ID NO: 3426560 - DNA, 21 bp, Homo sapiens
acgcctgcaaacgctgcctgc

SEQ ID NO: 3426561 - DNA, 22 bp, Homo sapiens
acgcctgcaaacgctgcctgcc

SEQ ID NO: 3426562 - DNA, 18 bp, Homo sapiens
acgcctgggggtgccagg

SEQ ID NO: 3426563 - DNA, 12 bp, Homo sapiens
acgcgtatttac

SEQ ID NO: 3426564 - DNA, 15 bp, Homo sapiens
acgctacctctctgt

SEQ ID NO: 3426565 - DNA, 20 bp, Homo sapiens
acgctacctctctgtccctt

SEQ ID NO: 3426566 - DNA, 18 bp, Homo sapiens
acgctactataaagagaa

SEQ ID NO: 3426567 - DNA, 11 bp, Homo sapiens
acgctccagct

SEQ ID NO: 3426568 - DNA, 14 bp, Homo sapiens
acgctccagctgcc

SEQ ID NO: 3426569 - DNA, 16 bp, Homo sapiens
acgctccagctgcccc

SEQ ID NO: 3426570 - DNA, 19 bp, Homo sapiens
acgctccagctgccccggc

SEQ ID NO: 3426571 - DNA, 14 bp, Homo sapiens
acgctgagccacct

SEQ ID NO: 3426572 - DNA, 17 bp, Homo sapiens
acgctgagccacctgcc

SEQ ID NO: 3426573 - DNA, 14 bp, Homo sapiens
acgctgcctgcccg

SEQ ID NO: 3426574 - DNA, 23 bp, Homo sapiens
acgctggaccttgaactgggtac

SEQ ID NO: 3426575 - DNA, 18 bp, Homo sapiens
acgctggagtgcagtgag

SEQ ID NO: 3426576 - DNA, 18 bp, Homo sapiens
acgctgggtattaccatg

SEQ ID NO: 3426577 - DNA, 20 bp, Homo sapiens
acgctgggtattaccatgta

SEQ ID NO: 3426578 - DNA, 22 bp, Homo sapiens
acgcttttaatgaaaaggaatc

SEQ ID NO: 3426579 - DNA, 14 bp, Homo sapiens
acgcttttctttgt

SEQ ID NO: 3426580 - DNA, 16 bp, Homo sapiens
acggaagagccttgcg

SEQ ID NO: 3426581 - DNA, 15 bp, Homo sapiens
acggaatagttggct

SEQ ID NO: 3426582 - DNA, 13 bp, Homo sapiens
acggagagcgcct

SEQ ID NO: 3426583 - DNA, 19 bp, Homo sapiens
acggagcagttcagagtgg

SEQ ID NO: 3426584 - DNA, 21 bp, Homo sapiens
acggagccactcctctgactc

SEQ ID NO: 3426585 - DNA, 15 bp, Homo sapiens
acggagcccagccct

SEQ ID NO: 3426586 - DNA, 18 bp, Homo sapiens
acggccacatcaaagagg

SEQ ID NO: 3426587 - DNA, 16 bp, Homo sapiens
acggccaggccagagg

SEQ ID NO: 3426588 - DNA, 17 bp, Homo sapiens
acggccagggagaagct

SEQ ID NO: 3426589 - DNA, 18 bp, Homo sapiens
acggccctgcagccagct

SEQ ID NO: 3426590 - DNA, 20 bp, Homo sapiens
acggcctgcccagtcgaccc

SEQ ID NO: 3426591 - DNA, 22 bp, Homo sapiens
acggcctgcccagtcgacccca

SEQ ID NO: 3426592 - DNA, 14 bp, Homo sapiens
acggctcactgcag

SEQ ID NO: 3426593 - DNA, 15 bp, Homo sapiens
acggctcactgcagc

SEQ ID NO: 3426594 - DNA, 17 bp, Homo sapiens
acggctcactgcagcct

SEQ ID NO: 3426595 - DNA, 18 bp, Homo sapiens
acggctcactgcagcctc

SEQ ID NO: 3426596 - DNA, 20 bp, Homo sapiens
acggtacgcagcccagagca

SEQ ID NO: 3426597 - DNA, 15 bp, Homo sapiens
acggtgcccaagcca

SEQ ID NO: 3426598 - DNA, 21 bp, Homo sapiens
acggtgccttttttcacggaa

SEQ ID NO: 3426599 - DNA, 18 bp, Homo sapiens
acggtgctccaggcaggc

SEQ ID NO: 3426600 - DNA, 17 bp, Homo sapiens
acggtgtcttgttctgt

SEQ ID NO: 3426601 - DNA, 22 bp, Homo sapiens
acggtgtcttgttctgtcactc

SEQ ID NO: 3426602 - DNA, 15 bp, Homo sapiens
acgtaaagaactttt

SEQ ID NO: 3426603 - DNA, 13 bp, Homo sapiens
acgtacacacaca

SEQ ID NO: 3426604 - DNA, 19 bp, Homo sapiens
acgtatgtaacatgatgtt

SEQ ID NO: 3426605 - DNA, 17 bp, Homo sapiens
acgtattagttgccaat

SEQ ID NO: 3426606 - DNA, 22 bp, Homo sapiens
acgtattagttgccaatatgcc

SEQ ID NO: 3426607 - DNA, 15 bp, Homo sapiens
accatagagtccaga

SEQ ID NO: 3426608 - DNA, 20 bp, Homo sapiens
accatagtaccatttataca

SEQ ID NO: 3426609 - DNA, 21 bp, Homo sapiens
accatagtaccatttatacaa

SEQ ID NO: 3426610 - DNA, 13 bp, Homo sapiens
accatcactgagt

SEQ ID NO: 3426611 - DNA, 14 bp, Homo sapiens
accatcatgtctgg

SEQ ID NO: 3426612 - DNA, 17 bp, Homo sapiens
accatcatgtctggcta

SEQ ID NO: 3426613 - DNA, 19 bp, Homo sapiens
accatccctttttgaagtg

SEQ ID NO: 3426614 - DNA, 13 bp, Homo sapiens
accatctgctgcc

SEQ ID NO: 3426615 - DNA, 17 bp, Homo sapiens
accatcttctgtaccaa

SEQ ID NO: 3426616 - DNA, 21 bp, Homo sapiens
accatgaatgaacccctggct

SEQ ID NO: 3426617 - DNA, 18 bp, Homo sapiens
accatgatggccaggctg

SEQ ID NO: 3426618 - DNA, 23 bp, Homo sapiens
accatgcgacactgggaggccag

SEQ ID NO: 3426619 - DNA, 18 bp, Homo sapiens
accatgtaaataatctgt

SEQ ID NO: 3426620 - DNA, 19 bp, Homo sapiens
accatgtaaataatctgtg

SEQ ID NO: 3426621 - DNA, 15 bp, Homo sapiens
accatgtcagcaaaa

SEQ ID NO: 3426622 - DNA, 19 bp, Homo sapiens
accatgtcagcaaaaagca

SEQ ID NO: 3426623 - DNA, 19 bp, Homo sapiens
accattacaactagatcaa

SEQ ID NO: 3426624 - DNA, 13 bp, Homo sapiens
accattctgactc

SEQ ID NO: 3426625 - DNA, 21 bp, Homo sapiens
accattctgactcggtttctc

SEQ ID NO: 3426626 - DNA, 24 bp, Homo sapiens
accattctgactcggtttctccaa

SEQ ID NO: 3426627 - DNA, 14 bp, Homo sapiens
accattctgcattt

SEQ ID NO: 3426628 - DNA, 19 bp, Homo sapiens
accattctgcatttagctg

SEQ ID NO: 3426629 - DNA, 20 bp, Homo sapiens
accattttttttttcttttt

SEQ ID NO: 3426630 - DNA, 15 bp, Homo sapiens
acccaagcttagaac

SEQ ID NO: 3426631 - DNA, 17 bp, Homo sapiens
acccaatagctgcccat

SEQ ID NO: 3426632 - DNA, 14 bp, Homo sapiens
acccaatccaaatg

SEQ ID NO: 3426633 - DNA, 15 bp, Homo sapiens
acccacccctgcaca

SEQ ID NO: 3426634 - DNA, 15 bp, Homo sapiens
acccaccctcctttc

SEQ ID NO: 3426635 - DNA, 13 bp, Homo sapiens
acccacctccctg

SEQ ID NO: 3426636 - DNA, 16 bp, Homo sapiens
acccacctccctgcct

SEQ ID NO: 3426637 - DNA, 13 bp, Homo sapiens
acccactcagctc

SEQ ID NO: 3426638 - DNA, 13 bp, Homo sapiens
acccactgctctg

SEQ ID NO: 3426639 - DNA, 14 bp, Homo sapiens
acccactgctctgg

SEQ ID NO: 3426640 - DNA, 15 bp, Homo sapiens
acccagactcagaca

SEQ ID NO: 3426641 - DNA, 11 bp, Homo sapiens
acccagagcac

SEQ ID NO: 3426642 - DNA, 20 bp, Homo sapiens
acccagattttgctgtatat

SEQ ID NO: 3426643 - DNA, 18 bp, Homo sapiens
acccagcccacttctgcc

SEQ ID NO: 3426644 - DNA, 17 bp, Homo sapiens
acccagccccttgagaa

SEQ ID NO: 3426645 - DNA, 21 bp, Homo sapiens
acccagccccttgagaaacct

SEQ ID NO: 3426646 - DNA, 17 bp, Homo sapiens
acccagcgagccctggt

SEQ ID NO: 3426647 - DNA, 23 bp, Homo sapiens
acccaggacttatttaaactctg

SEQ ID NO: 3426648 - DNA, 15 bp, Homo sapiens
acccaggagccccga

SEQ ID NO: 3426649 - DNA, 23 bp, Homo sapiens
acccaggagccccgaggccttct

SEQ ID NO: 3426650 - DNA, 23 bp, Homo sapiens
acccaggaggcagaggttgcagt

SEQ ID NO: 3426651 - DNA, 17 bp, Homo sapiens
acccaggcctatgttga

SEQ ID NO: 3426652 - DNA, 13 bp, Homo sapiens
acccaggctgggc

SEQ ID NO: 3426653 - DNA, 22 bp, Homo sapiens
acccaggctgggcaaggaggcc

SEQ ID NO: 3426654 - DNA, 13 bp, Homo sapiens
acccagggaacag

SEQ ID NO: 3426655 - DNA, 12 bp, Homo sapiens
acccagggcctg

SEQ ID NO: 3426656 - DNA, 15 bp, Homo sapiens
acccagggtggagtg

SEQ ID NO: 3426657 - DNA, 19 bp, Homo sapiens
acccagggtggagtgcagt

SEQ ID NO: 3426658 - DNA, 14 bp, Homo sapiens
acccaggtgggtcc

SEQ ID NO: 3426659 - DNA, 13 bp, Homo sapiens
acccagtcgccct

SEQ ID NO: 3426660 - DNA, 14 bp, Homo sapiens
acccagtcgccctt

SEQ ID NO: 3426661 - DNA, 15 bp, Homo sapiens
acccagtgcccccac

SEQ ID NO: 3426662 - DNA, 23 bp, Homo sapiens
acccatatccttaccctccttgg

SEQ ID NO: 3426663 - DNA, 17 bp, Homo sapiens
acccatccccgcagtgt

SEQ ID NO: 3426664 - DNA, 24 bp, Homo sapiens
acccatgtgcacaagtgtgcacag

SEQ ID NO: 3426665 - DNA, 22 bp, Homo sapiens
acccatttttgagccaagcttc

SEQ ID NO: 3426666 - DNA, 15 bp, Homo sapiens
accccaacaaaccat

SEQ ID NO: 3426667 - DNA, 17 bp, Homo sapiens
accccaaggagggagat

SEQ ID NO: 3426668 - DNA, 14 bp, Homo sapiens
accccaatcccagc

SEQ ID NO: 3426669 - DNA, 19 bp, Homo sapiens
accccaccatatgaattgt

SEQ ID NO: 3426670 - DNA, 19 bp, Homo sapiens
accccacccttcccctcct

SEQ ID NO: 3426671 - DNA, 23 bp, Homo sapiens
accccaggacctcttctggagat

SEQ ID NO: 3426672 - DNA, 13 bp, Homo sapiens
accccaggccctg

SEQ ID NO: 3426673 - DNA, 14 bp, Homo sapiens
accccaggccctgc

SEQ ID NO: 3426674 - DNA, 19 bp, Homo sapiens
accccagggcccccacagg

SEQ ID NO: 3426675 - DNA, 20 bp, Homo sapiens
accccagggcccccacaggc

SEQ ID NO: 3426676 - DNA, 13 bp, Homo sapiens
accccaggtttct

SEQ ID NO: 3426677 - DNA, 21 bp, Homo sapiens
accccatctggctgtgacagc

SEQ ID NO: 3426678 - DNA, 17 bp, Homo sapiens
acccccactggactgac

SEQ ID NO: 3426679 - DNA, 14 bp, Homo sapiens
acccccagcctgct

SEQ ID NO: 3426680 - DNA, 14 bp, Homo sapiens
acccccagtgcagc

SEQ ID NO: 3426681 - DNA, 14 bp, Homo sapiens
acccccagttccta

SEQ ID NO: 3426682 - DNA, 20 bp, Homo sapiens
acccccagttcctatgacac

SEQ ID NO: 3426683 - DNA, 17 bp, Homo sapiens
acccccatctctccctc

SEQ ID NO: 3426684 - DNA, 15 bp, Homo sapiens
acccccgccccctgc

SEQ ID NO: 3426685 - DNA, 19 bp, Homo sapiens
acccccgccccctgccctc

SEQ ID NO: 3426686 - DNA, 15 bp, Homo sapiens
accccctccccgccc

SEQ ID NO: 3426687 - DNA, 12 bp, Homo sapiens
accccctccttc

SEQ ID NO: 3426688 - DNA, 15 bp, Homo sapiens
accccctccttcaga

SEQ ID NO: 3426689 - DNA, 17 bp, Homo sapiens
accccctccttcagaca

SEQ ID NO: 3426690 - DNA, 20 bp, Homo sapiens
accccctcttctgagcacag

SEQ ID NO: 3426691 - DNA, 19 bp, Homo sapiens
acccccttctccatccaca

SEQ ID NO: 3426692 - DNA, 15 bp, Homo sapiens
accccgcagacacct

SEQ ID NO: 3426693 - DNA, 21 bp, Homo sapiens
accccggggtgcccacaggcc

SEQ ID NO: 3426694 - DNA, 16 bp, Homo sapiens
acccctaaactccagg

SEQ ID NO: 3426695 - DNA, 16 bp, Homo sapiens
acccctccatgtgggc

SEQ ID NO: 3426696 - DNA, 15 bp, Homo sapiens
acccctccccattca

SEQ ID NO: 3426697 - DNA, 20 bp, Homo sapiens
acccctccccattcacagag

SEQ ID NO: 3426698 - DNA, 22 bp, Homo sapiens
acccctccccattcacagagcc

SEQ ID NO: 3426699 - DNA, 23 bp, Homo sapiens
acccctccctttctcccctgccc

SEQ ID NO: 3426700 - DNA, 18 bp, Homo sapiens
acccctctatttctagag

SEQ ID NO: 3426701 - DNA, 23 bp, Homo sapiens
acccctggaagagcccagtctgt

SEQ ID NO: 3426702 - DNA, 12 bp, Homo sapiens
acccctggctct

SEQ ID NO: 3426703 - DNA, 17 bp, Homo sapiens
acccctgggggctctca

SEQ ID NO: 3426704 - DNA, 16 bp, Homo sapiens
acccctggttctcatc

SEQ ID NO: 3426705 - DNA, 22 bp, Homo sapiens
acccctggttctcatctttctt

SEQ ID NO: 3426706 - DNA, 19 bp, Homo sapiens
accccttaagccctggccc

SEQ ID NO: 3426707 - DNA, 16 bp, Homo sapiens
accccttcgctcctgt

SEQ ID NO: 3426708 - DNA, 20 bp, Homo sapiens
accccttcgctcctgtgtct

SEQ ID NO: 3426709 - DNA, 21 bp, Homo sapiens
acccgacagagggaagaaaag

SEQ ID NO: 3426710 - DNA, 20 bp, Homo sapiens
acccggcccctgctggttca

SEQ ID NO: 3426711 - DNA, 23 bp, Homo sapiens
acccgggaacctccccagcctgc

SEQ ID NO: 3426712 - DNA, 14 bp, Homo sapiens
acccggggcccagg

SEQ ID NO: 3426713 - DNA, 20 bp, Homo sapiens
acatcatcaaggcactgcct

SEQ ID NO: 3426714 - DNA, 22 bp, Homo sapiens
acatcatcgctcccaaaggaaa

SEQ ID NO: 3426715 - DNA, 21 bp, Homo sapiens
acatccaaaatagttaagaca

SEQ ID NO: 3426716 - DNA, 16 bp, Homo sapiens
acatccattgtctctt

SEQ ID NO: 3426717 - DNA, 15 bp, Homo sapiens
acatccccaggtctc

SEQ ID NO: 3426718 - DNA, 15 bp, Homo sapiens
acatcccgggcctca

SEQ ID NO: 3426719 - DNA, 16 bp, Homo sapiens
acatccctgccagctc

SEQ ID NO: 3426720 - DNA, 18 bp, Homo sapiens
acatcctgctgggccccc

SEQ ID NO: 3426721 - DNA, 14 bp, Homo sapiens
acatcctgtgtttc

SEQ ID NO: 3426722 - DNA, 23 bp, Homo sapiens
acatcctgtgtttctagggaaat

SEQ ID NO: 3426723 - DNA, 13 bp, Homo sapiens
acatctaagcctg

SEQ ID NO: 3426724 - DNA, 21 bp, Homo sapiens
acatctaagcctgaaggggcg

SEQ ID NO: 3426725 - DNA, 23 bp, Homo sapiens
acatctattttggattgtatatt

SEQ ID NO: 3426726 - DNA, 13 bp, Homo sapiens
acatctcttcctc

SEQ ID NO: 3426727 - DNA, 23 bp, Homo sapiens
acatctcttcctccgaggccagt

SEQ ID NO: 3426728 - DNA, 22 bp, Homo sapiens
acatctgtagggaattcttctg

SEQ ID NO: 3426729 - DNA, 23 bp, Homo sapiens
acatctgtagggaattcttctgt

SEQ ID NO: 3426730 - DNA, 16 bp, Homo sapiens
acatcttcagcaaata

SEQ ID NO: 3426731 - DNA, 24 bp, Homo sapiens
acatcttccatttccatgtcccct

SEQ ID NO: 3426732 - DNA, 20 bp, Homo sapiens
acatcttgaaaatattgaag

SEQ ID NO: 3426733 - DNA, 13 bp, Homo sapiens
acatcttgctctg

SEQ ID NO: 3426734 - DNA, 17 bp, Homo sapiens
acatcttgctctgctga

SEQ ID NO: 3426735 - DNA, 19 bp, Homo sapiens
acatcttgctctgctgaca

SEQ ID NO: 3426736 - DNA, 13 bp, Homo sapiens
acatcttggcaca

SEQ ID NO: 3426737 - DNA, 24 bp, Homo sapiens
acatcttggcacatttaagagaca

SEQ ID NO: 3426738 - DNA, 12 bp, Homo sapiens
acatctttcaca

SEQ ID NO: 3426739 - DNA, 15 bp, Homo sapiens
acatctttcacattg

SEQ ID NO: 3426740 - DNA, 15 bp, Homo sapiens
acatgagaacaaaca

SEQ ID NO: 3426741 - DNA, 18 bp, Homo sapiens
acatgatgcttttactga

SEQ ID NO: 3426742 - DNA, 13 bp, Homo sapiens
acatgatgggcct

SEQ ID NO: 3426743 - DNA, 15 bp, Homo sapiens
acatgatgggcctga

SEQ ID NO: 3426744 - DNA, 15 bp, Homo sapiens
acatgatgttaactt

SEQ ID NO: 3426745 - DNA, 14 bp, Homo sapiens
acatgattccttcc

SEQ ID NO: 3426746 - DNA, 18 bp, Homo sapiens
acatgcactcagctcttg

SEQ ID NO: 3426747 - DNA, 11 bp, Homo sapiens
acatgcagttt

SEQ ID NO: 3426748 - DNA, 16 bp, Homo sapiens
acatgcagtttgaaat

SEQ ID NO: 3426749 - DNA, 19 bp, Homo sapiens
acatgcagtttgaaattct

SEQ ID NO: 3426750 - DNA, 18 bp, Homo sapiens
acatgcctgtcctgaaag

SEQ ID NO: 3426751 - DNA, 19 bp, Homo sapiens
acatggaggcactgaagcc

SEQ ID NO: 3426752 - DNA, 23 bp, Homo sapiens
acatgggagccgggtctgcctct

SEQ ID NO: 3426753 - DNA, 16 bp, Homo sapiens
acatgggtattttata

SEQ ID NO: 3426754 - DNA, 14 bp, Homo sapiens
acatgggtttagtt

SEQ ID NO: 3426755 - DNA, 19 bp, Homo sapiens
acatggtgctacgcctgca

SEQ ID NO: 3426756 - DNA, 13 bp, Homo sapiens
acatgtataaagt

SEQ ID NO: 3426757 - DNA, 16 bp, Homo sapiens
acatgtataaagtgat

SEQ ID NO: 3426758 - DNA, 19 bp, Homo sapiens
acatgtcagtaccttcaaa

SEQ ID NO: 3426759 - DNA, 19 bp, Homo sapiens
acatgtcctaattcttctg

SEQ ID NO: 3426760 - DNA, 20 bp, Homo sapiens
acatgtcctaattcttctgt

SEQ ID NO: 3426761 - DNA, 12 bp, Homo sapiens
acatgtcttaat

SEQ ID NO: 3426762 - DNA, 23 bp, Homo sapiens
acatgtgagcatggtcacaagca

SEQ ID NO: 3426763 - DNA, 16 bp, Homo sapiens
acatgtgcacatgcac

SEQ ID NO: 3426764 - DNA, 20 bp, Homo sapiens
acatgtgttaagtattttca

SEQ ID NO: 3426765 - DNA, 21 bp, Homo sapiens
acatgttggaggagagagcct

SEQ ID NO: 3426766 - DNA, 14 bp, Homo sapiens
acatgttgtacatt

SEQ ID NO: 3426767 - DNA, 13 bp, Homo sapiens
acatgtttataaa

SEQ ID NO: 3426768 - DNA, 12 bp, Homo sapiens
acattaagaaaa

SEQ ID NO: 3426769 - DNA, 14 bp, Homo sapiens
acattaagaaaatc

SEQ ID NO: 3426770 - DNA, 16 bp, Homo sapiens
acattaagaaaatcat

SEQ ID NO: 3426771 - DNA, 17 bp, Homo sapiens
acattaagaaaatcata

SEQ ID NO: 3426772 - DNA, 21 bp, Homo sapiens
acattagaagacaattgacaa

SEQ ID NO: 3426773 - DNA, 14 bp, Homo sapiens
acattagttgcact

SEQ ID NO: 3426774 - DNA, 19 bp, Homo sapiens
acattatctcacttgtgcc

SEQ ID NO: 3426775 - DNA, 19 bp, Homo sapiens
acattcccctggggaccca

SEQ ID NO: 3426776 - DNA, 23 bp, Homo sapiens
acattccgaggggctcagttctg

SEQ ID NO: 3426777 - DNA, 11 bp, Homo sapiens
acattccttct

SEQ ID NO: 3426778 - DNA, 23 bp, Homo sapiens
acattccttctcccatctcttcc

SEQ ID NO: 3426779 - DNA, 18 bp, Homo sapiens
acattccttgcctgcaca

SEQ ID NO: 3426780 - DNA, 13 bp, Homo sapiens
acattcctttggg

SEQ ID NO: 3426781 - DNA, 19 bp, Homo sapiens
acattctcgcttccctgaa

SEQ ID NO: 3426782 - DNA, 18 bp, Homo sapiens
acattctgctttcatctt

SEQ ID NO: 3426783 - DNA, 23 bp, Homo sapiens
acattcttggcttaatcattttc

SEQ ID NO: 3426784 - DNA, 12 bp, Homo sapiens
acattgcctttg

SEQ ID NO: 3426785 - DNA, 16 bp, Homo sapiens
acattgcctttgaatg

SEQ ID NO: 3426786 - DNA, 21 bp, Homo sapiens
acattggcacctaatccaggc

SEQ ID NO: 3426787 - DNA, 22 bp, Homo sapiens
acattgtgatgtatattccttt

SEQ ID NO: 3426788 - DNA, 20 bp, Homo sapiens
acattgttcaattagaatag

SEQ ID NO: 3426789 - DNA, 20 bp, Homo sapiens
acatttaagagacagtcacc

SEQ ID NO: 3426790 - DNA, 23 bp, Homo sapiens
acatttaatttagatattttcca

SEQ ID NO: 3426791 - DNA, 19 bp, Homo sapiens
acatttagccaaagttgag

SEQ ID NO: 3426792 - DNA, 14 bp, Homo sapiens
acatttattctgct

SEQ ID NO: 3426793 - DNA, 20 bp, Homo sapiens
acatttcaccatggccccct

SEQ ID NO: 3426794 - DNA, 20 bp, Homo sapiens
acatttgatgcatgtctttt

SEQ ID NO: 3426795 - DNA, 12 bp, Homo sapiens
acatttggaata

SEQ ID NO: 3426796 - DNA, 20 bp, Homo sapiens
acatttgtgtaatatgaaat

SEQ ID NO: 3426797 - DNA, 13 bp, Homo sapiens
acattttaattca

SEQ ID NO: 3426798 - DNA, 11 bp, Homo sapiens
acattttactg

SEQ ID NO: 3426799 - DNA, 13 bp, Homo sapiens
acattttactgtt

SEQ ID NO: 3426800 - DNA, 11 bp, Homo sapiens
acattttagtt

SEQ ID NO: 3426801 - DNA, 17 bp, Homo sapiens
acattttcttgaatttt

SEQ ID NO: 3426802 - DNA, 19 bp, Homo sapiens
acatttttcaactttgaat

SEQ ID NO: 3426803 - DNA, 21 bp, Homo sapiens
acatttttccgtttgcttttg

SEQ ID NO: 3426804 - DNA, 16 bp, Homo sapiens
accaaaatactccaaa

SEQ ID NO: 3426805 - DNA, 18 bp, Homo sapiens
accaaaatactccaaaga

SEQ ID NO: 3426806 - DNA, 18 bp, Homo sapiens
accaaaggtgaaggaata

SEQ ID NO: 3426807 - DNA, 13 bp, Homo sapiens
accaaatctggaa

SEQ ID NO: 3426808 - DNA, 20 bp, Homo sapiens
accaaattaacttacttcca

SEQ ID NO: 3426809 - DNA, 17 bp, Homo sapiens
accaagctatcctggct

SEQ ID NO: 3426810 - DNA, 21 bp, Homo sapiens
accaaggaaacgctacctctc

SEQ ID NO: 3426811 - DNA, 19 bp, Homo sapiens
accaatcctactaataaac

SEQ ID NO: 3426812 - DNA, 13 bp, Homo sapiens
accaatcctggac

SEQ ID NO: 3426813 - DNA, 15 bp, Homo sapiens
accaatgttctctct

SEQ ID NO: 3426814 - DNA, 20 bp, Homo sapiens
accacaactattttcagatg

SEQ ID NO: 3426815 - DNA, 20 bp, Homo sapiens
accacacccagcccacttct

SEQ ID NO: 3426816 - DNA, 22 bp, Homo sapiens
accacactggactccggccctc

SEQ ID NO: 3426817 - DNA, 15 bp, Homo sapiens
accacagcacagcca

SEQ ID NO: 3426818 - DNA, 16 bp, Homo sapiens
accacagccagcacct

SEQ ID NO: 3426819 - DNA, 16 bp, Homo sapiens
accacaggtgtgagcc

SEQ ID NO: 3426820 - DNA, 16 bp, Homo sapiens
accacatcttgctctg

SEQ ID NO: 3426821 - DNA, 20 bp, Homo sapiens
accacatcttgctctgctga

SEQ ID NO: 3426822 - DNA, 22 bp, Homo sapiens
accacatgccaagcactgtgct

SEQ ID NO: 3426823 - DNA, 18 bp, Homo sapiens
accacatgtgcacatgca

SEQ ID NO: 3426824 - DNA, 14 bp, Homo sapiens
accaccctgtcttc

SEQ ID NO: 3426825 - DNA, 21 bp, Homo sapiens
accaccctgtcttcctctgca

SEQ ID NO: 3426826 - DNA, 16 bp, Homo sapiens
accacgactggccagg

SEQ ID NO: 3426827 - DNA, 18 bp, Homo sapiens
accacgctggaccttgaa

SEQ ID NO: 3426828 - DNA, 14 bp, Homo sapiens
accactataaaatg

SEQ ID NO: 3426829 - DNA, 15 bp, Homo sapiens
accactataaaatgt

SEQ ID NO: 3426830 - DNA, 22 bp, Homo sapiens
accactgcaagtccttttgtaa

SEQ ID NO: 3426831 - DNA, 13 bp, Homo sapiens
accacttcgaaac

SEQ ID NO: 3426832 - DNA, 14 bp, Homo sapiens
accactttttgcag

SEQ ID NO: 3426833 - DNA, 15 bp, Homo sapiens
accactttttgcagc

SEQ ID NO: 3426834 - DNA, 21 bp, Homo sapiens
accagacaatgttgtgtttgg

SEQ ID NO: 3426835 - DNA, 14 bp, Homo sapiens
accagacacccagg

SEQ ID NO: 3426836 - DNA, 15 bp, Homo sapiens
accagacacccagga

SEQ ID NO: 3426837 - DNA, 17 bp, Homo sapiens
accagacaccttgacag

SEQ ID NO: 3426838 - DNA, 23 bp, Homo sapiens
accagacaccttgacagggcaca

SEQ ID NO: 3426839 - DNA, 11 bp, Homo sapiens
accagacaggt

SEQ ID NO: 3426840 - DNA, 14 bp, Homo sapiens
accagagcccacct

SEQ ID NO: 3426841 - DNA, 16 bp, Homo sapiens
accagaggaagcccct

SEQ ID NO: 3426842 - DNA, 23 bp, Homo sapiens
accagatggttgtgtatgggtag

SEQ ID NO: 3426843 - DNA, 17 bp, Homo sapiens
accagcagcgcctttcc

SEQ ID NO: 3426844 - DNA, 22 bp, Homo sapiens
accagcatcccttgaccaggcc

SEQ ID NO: 3426845 - DNA, 15 bp, Homo sapiens
accagcattcctttt

SEQ ID NO: 3426846 - DNA, 17 bp, Homo sapiens
accagccccagtgccca

SEQ ID NO: 3426847 - DNA, 18 bp, Homo sapiens
accagccccagtgcccac

SEQ ID NO: 3426848 - DNA, 19 bp, Homo sapiens
accagccgtgagcatgttt

SEQ ID NO: 3426849 - DNA, 20 bp, Homo sapiens
acagatctggaacctcagcc

SEQ ID NO: 3426850 - DNA, 21 bp, Homo sapiens
acagatctggaacctcagcct

SEQ ID NO: 3426851 - DNA, 14 bp, Homo sapiens
acagatgaatgtat

SEQ ID NO: 3426852 - DNA, 17 bp, Homo sapiens
acagatgaatgtattta

SEQ ID NO: 3426853 - DNA, 19 bp, Homo sapiens
acagatgccttttttgtag

SEQ ID NO: 3426854 - DNA, 22 bp, Homo sapiens
acagatgcgttcagcagactgg

SEQ ID NO: 3426855 - DNA, 19 bp, Homo sapiens
acagatgttcccccatctc

SEQ ID NO: 3426856 - DNA, 24 bp, Homo sapiens
acagatgtttcttttgtatgtaaa

SEQ ID NO: 3426857 - DNA, 23 bp, Homo sapiens
acagcaacaggaatctcagagac

SEQ ID NO: 3426858 - DNA, 13 bp, Homo sapiens
acagcatcagggt

SEQ ID NO: 3426859 - DNA, 19 bp, Homo sapiens
acagccaactagcccctgg

SEQ ID NO: 3426860 - DNA, 20 bp, Homo sapiens
acagccaactagcccctggg

SEQ ID NO: 3426861 - DNA, 21 bp, Homo sapiens
acagccaactagcccctgggg

SEQ ID NO: 3426862 - DNA, 18 bp, Homo sapiens
acagccacggccaggcca

SEQ ID NO: 3426863 - DNA, 12 bp, Homo sapiens
acagccagagcc

SEQ ID NO: 3426864 - DNA, 15 bp, Homo sapiens
acagccagagcctgt

SEQ ID NO: 3426865 - DNA, 14 bp, Homo sapiens
acagccagggggat

SEQ ID NO: 3426866 - DNA, 19 bp, Homo sapiens
acagccgattcacctgagc

SEQ ID NO: 3426867 - DNA, 15 bp, Homo sapiens
acagcctcccacccc

SEQ ID NO: 3426868 - DNA, 18 bp, Homo sapiens
acagcctcccctgccagg

SEQ ID NO: 3426869 - DNA, 13 bp, Homo sapiens
acagcctttgaat

SEQ ID NO: 3426870 - DNA, 20 bp, Homo sapiens
acagcctttgaatgtaacca

SEQ ID NO: 3426871 - DNA, 21 bp, Homo sapiens
acagcctttgaatgtaaccaa

SEQ ID NO: 3426872 - DNA, 22 bp, Homo sapiens
acagcctttgcccaaaactgtc

SEQ ID NO: 3426873 - DNA, 18 bp, Homo sapiens
acagcggagtctgtcctg

SEQ ID NO: 3426874 - DNA, 19 bp, Homo sapiens
acagctaacaattgtgaag

SEQ ID NO: 3426875 - DNA, 18 bp, Homo sapiens
acagctaacacacagctc

SEQ ID NO: 3426876 - DNA, 17 bp, Homo sapiens
acagctaatgggacact

SEQ ID NO: 3426877 - DNA, 22 bp, Homo sapiens
acagctactctccccacgaggg

SEQ ID NO: 3426878 - DNA, 14 bp, Homo sapiens
acagctatgaagaa

SEQ ID NO: 3426879 - DNA, 17 bp, Homo sapiens
acagctccaccctggcc

SEQ ID NO: 3426880 - DNA, 23 bp, Homo sapiens
acagctccttctgtcctactctg

SEQ ID NO: 3426881 - DNA, 17 bp, Homo sapiens
acagctcttctccaggc

SEQ ID NO: 3426882 - DNA, 19 bp, Homo sapiens
acagctcttctccaggctg

SEQ ID NO: 3426883 - DNA, 20 bp, Homo sapiens
acagctcttctccaggctgt

SEQ ID NO: 3426884 - DNA, 12 bp, Homo sapiens
acagctgcctta

SEQ ID NO: 3426885 - DNA, 15 bp, Homo sapiens
acagctgccttagct

SEQ ID NO: 3426886 - DNA, 20 bp, Homo sapiens
acagctgctcctagagggag

SEQ ID NO: 3426887 - DNA, 23 bp, Homo sapiens
acagctgctcctagagggagggg

SEQ ID NO: 3426888 - DNA, 19 bp, Homo sapiens
acagctgggtggcactgcc

SEQ ID NO: 3426889 - DNA, 20 bp, Homo sapiens
acagctgggtggcactgcca

SEQ ID NO: 3426890 - DNA, 10 bp, Homo sapiens
acagctgtgt

SEQ ID NO: 3426891 - DNA, 17 bp, Homo sapiens
acagcttcatttcctgt

SEQ ID NO: 3426892 - DNA, 19 bp, Homo sapiens
acagcttcatttcctgtgt

SEQ ID NO: 3426893 - DNA, 21 bp, Homo sapiens
acagcttcatttcctgtgtct

SEQ ID NO: 3426894 - DNA, 22 bp, Homo sapiens
acagcttcctgtccccatctgt

SEQ ID NO: 3426895 - DNA, 17 bp, Homo sapiens
acagcttgacctgaggc

SEQ ID NO: 3426896 - DNA, 21 bp, Homo sapiens
aatgtacagacatatttaact

SEQ ID NO: 3426897 - DNA, 16 bp, Homo sapiens
aatgtacagttgaaat

SEQ ID NO: 3426898 - DNA, 18 bp, Homo sapiens
aatgtagaagtctttcag

SEQ ID NO: 3426899 - DNA, 20 bp, Homo sapiens
aatgtagctgctagctattg

SEQ ID NO: 3426900 - DNA, 13 bp, Homo sapiens
aatgtatatgcac

SEQ ID NO: 3426901 - DNA, 21 bp, Homo sapiens
aatgtatatgttttgtgggaa

SEQ ID NO: 3426902 - DNA, 13 bp, Homo sapiens
aatgtatcttatt

SEQ ID NO: 3426903 - DNA, 17 bp, Homo sapiens
aatgtatcttattcaca

SEQ ID NO: 3426904 - DNA, 18 bp, Homo sapiens
aatgtattgaacttggaa

SEQ ID NO: 3426905 - DNA, 14 bp, Homo sapiens
aatgtatttttcct

SEQ ID NO: 3426906 - DNA, 13 bp, Homo sapiens
aatgtcacaggca

SEQ ID NO: 3426907 - DNA, 14 bp, Homo sapiens
aatgtcacaggcag

SEQ ID NO: 3426908 - DNA, 19 bp, Homo sapiens
aatgtcacaggcaggtcca

SEQ ID NO: 3426909 - DNA, 15 bp, Homo sapiens
aatgtcatatactgc

SEQ ID NO: 3426910 - DNA, 18 bp, Homo sapiens
aatgtctctgtgagactc

SEQ ID NO: 3426911 - DNA, 17 bp, Homo sapiens
aatgtctgagtgaacct

SEQ ID NO: 3426912 - DNA, 21 bp, Homo sapiens
aatgtctgcagccctgagaaa

SEQ ID NO: 3426913 - DNA, 18 bp, Homo sapiens
aatgtcttcttattttgg

SEQ ID NO: 3426914 - DNA, 20 bp, Homo sapiens
aatgtcttgatgcatgcact

SEQ ID NO: 3426915 - DNA, 13 bp, Homo sapiens
aatgtcttgtgtt

SEQ ID NO: 3426916 - DNA, 17 bp, Homo sapiens
aatgtgaaaagaaaaat

SEQ ID NO: 3426917 - DNA, 19 bp, Homo sapiens
aatgtgaaaagaaaaatga

SEQ ID NO: 3426918 - DNA, 12 bp, Homo sapiens
aatgtgatgaat

SEQ ID NO: 3426919 - DNA, 17 bp, Homo sapiens
aatgtgattactgctct

SEQ ID NO: 3426920 - DNA, 23 bp, Homo sapiens
aatgtgcattcttttaaaagaca

SEQ ID NO: 3426921 - DNA, 24 bp, Homo sapiens
aatgtgcattcttttaaaagacaa

SEQ ID NO: 3426922 - DNA, 15 bp, Homo sapiens
aatgtgccatgtata

SEQ ID NO: 3426923 - DNA, 12 bp, Homo sapiens
aatgtggcttga

SEQ ID NO: 3426924 - DNA, 17 bp, Homo sapiens
aatgtggttttcctgaa

SEQ ID NO: 3426925 - DNA, 15 bp, Homo sapiens
aatgtgtaattttgt

SEQ ID NO: 3426926 - DNA, 17 bp, Homo sapiens
aatgtgttttgtacatg

SEQ ID NO: 3426927 - DNA, 22 bp, Homo sapiens
aatgtgttttgtttattaaata

SEQ ID NO: 3426928 - DNA, 17 bp, Homo sapiens
aatgttaaacaccattt

SEQ ID NO: 3426929 - DNA, 22 bp, Homo sapiens
aatgttaaataaattgtatatt

SEQ ID NO: 3426930 - DNA, 13 bp, Homo sapiens
aatgttaattttt

SEQ ID NO: 3426931 - DNA, 23 bp, Homo sapiens
aatgttatcttatactgtacaat

SEQ ID NO: 3426932 - DNA, 22 bp, Homo sapiens
aatgttcatcccatgatgtagt

SEQ ID NO: 3426933 - DNA, 21 bp, Homo sapiens
aatgttctctcttctccacct

SEQ ID NO: 3426934 - DNA, 12 bp, Homo sapiens
aatgttgaaaag

SEQ ID NO: 3426935 - DNA, 19 bp, Homo sapiens
aatgttgaaaagtcaaact

SEQ ID NO: 3426936 - DNA, 16 bp, Homo sapiens
aatgttggataaggaa

SEQ ID NO: 3426937 - DNA, 17 bp, Homo sapiens
aatgttggataaggaat

SEQ ID NO: 3426938 - DNA, 22 bp, Homo sapiens
aatgttgtttcctaatatcaaa

SEQ ID NO: 3426939 - DNA, 23 bp, Homo sapiens
aatgttgtttcctaatatcaaat

SEQ ID NO: 3426940 - DNA, 13 bp, Homo sapiens
aatgtttaaaaca

SEQ ID NO: 3426941 - DNA, 16 bp, Homo sapiens
aatgtttaaacatttt

SEQ ID NO: 3426942 - DNA, 19 bp, Homo sapiens
aatgtttgcctctgcctct

SEQ ID NO: 3426943 - DNA, 18 bp, Homo sapiens
aatgtttgttaaaaataa

SEQ ID NO: 3426944 - DNA, 16 bp, Homo sapiens
aatgttttaaatgtac

SEQ ID NO: 3426945 - DNA, 17 bp, Homo sapiens
aatgttttaaatgtaca

SEQ ID NO: 3426946 - DNA, 13 bp, Homo sapiens
aatgttttaaatt

SEQ ID NO: 3426947 - DNA, 14 bp, Homo sapiens
aatgttttaaattc

SEQ ID NO: 3426948 - DNA, 21 bp, Homo sapiens
aattaaaaaaaaagatctgtt

SEQ ID NO: 3426949 - DNA, 13 bp, Homo sapiens
aattaaaacactt

SEQ ID NO: 3426950 - DNA, 19 bp, Homo sapiens
aattaaaactattcatgct

SEQ ID NO: 3426951 - DNA, 17 bp, Homo sapiens
aattaaattttgtgtct

SEQ ID NO: 3426952 - DNA, 18 bp, Homo sapiens
aattaaattttgtgtctc

SEQ ID NO: 3426953 - DNA, 23 bp, Homo sapiens
aattaagaaggcaaaaatgtaaa

SEQ ID NO: 3426954 - DNA, 12 bp, Homo sapiens
aattaaggaagt

SEQ ID NO: 3426955 - DNA, 15 bp, Homo sapiens
aattacaaaaggctc

SEQ ID NO: 3426956 - DNA, 19 bp, Homo sapiens
aattaccctttcattcagc

SEQ ID NO: 3426957 - DNA, 19 bp, Homo sapiens
aattaccttttttgttgtt

SEQ ID NO: 3426958 - DNA, 13 bp, Homo sapiens
aattactcaggaa

SEQ ID NO: 3426959 - DNA, 19 bp, Homo sapiens
aattactcaggaagaacac

SEQ ID NO: 3426960 - DNA, 21 bp, Homo sapiens
aattacttatccctgcccatt

SEQ ID NO: 3426961 - DNA, 22 bp, Homo sapiens
aattagaaaatgttatttaaca

SEQ ID NO: 3426962 - DNA, 23 bp, Homo sapiens
aattagatgattatatattgttg

SEQ ID NO: 3426963 - DNA, 14 bp, Homo sapiens
aattagatgcatgt

SEQ ID NO: 3426964 - DNA, 14 bp, Homo sapiens
aattagctgcttct

SEQ ID NO: 3426965 - DNA, 17 bp, Homo sapiens
aattaggaaaaaaacta

SEQ ID NO: 3426966 - DNA, 17 bp, Homo sapiens
aattagtaacatgtgtt

SEQ ID NO: 3426967 - DNA, 14 bp, Homo sapiens
aattagtgctaagt

SEQ ID NO: 3426968 - DNA, 22 bp, Homo sapiens
aattagtgctaagtgtgaactg

SEQ ID NO: 3426969 - DNA, 16 bp, Homo sapiens
aaggtgttggacaggg

SEQ ID NO: 3426970 - DNA, 21 bp, Homo sapiens
aaggttcttcccttttacata

SEQ ID NO: 3426971 - DNA, 20 bp, Homo sapiens
aaggtttaggctggtggccc

SEQ ID NO: 3426972 - DNA, 22 bp, Homo sapiens
aaggtttaggctggtggcccag

SEQ ID NO: 3426973 - DNA, 12 bp, Homo sapiens
aagtaaaacttg

SEQ ID NO: 3426974 - DNA, 14 bp, Homo sapiens
aagtaagaaaatat

SEQ ID NO: 3426975 - DNA, 15 bp, Homo sapiens
aagtaagaaaatatt

SEQ ID NO: 3426976 - DNA, 16 bp, Homo sapiens
aagtaagaaaatattt

SEQ ID NO: 3426977 - DNA, 12 bp, Homo sapiens
aagtaagaaatt

SEQ ID NO: 3426978 - DNA, 13 bp, Homo sapiens
aagtaagaaattt

SEQ ID NO: 3426979 - DNA, 20 bp, Homo sapiens
aagtacctttcctacatttt

SEQ ID NO: 3426980 - DNA, 23 bp, Homo sapiens
aagtacctttcctacattttctt

SEQ ID NO: 3426981 - DNA, 14 bp, Homo sapiens
aagtactagctaaa

SEQ ID NO: 3426982 - DNA, 17 bp, Homo sapiens
aagtactgtaagaataa

SEQ ID NO: 3426983 - DNA, 19 bp, Homo sapiens
aagtactgtaagaataatt

SEQ ID NO: 3426984 - DNA, 22 bp, Homo sapiens
aagtactgtaagaataatttat

SEQ ID NO: 3426985 - DNA, 18 bp, Homo sapiens
aagtacttctccaccctg

SEQ ID NO: 3426986 - DNA, 21 bp, Homo sapiens
aagtacttctccaccctgctc

SEQ ID NO: 3426987 - DNA, 11 bp, Homo sapiens
aagtagaaatg

SEQ ID NO: 3426988 - DNA, 13 bp, Homo sapiens
aagtagaaatggt

SEQ ID NO: 3426989 - DNA, 21 bp, Homo sapiens
aagtagacagttttgagaacg

SEQ ID NO: 3426990 - DNA, 17 bp, Homo sapiens
aagtagctgctaccttc

SEQ ID NO: 3426991 - DNA, 13 bp, Homo sapiens
aagtatgctgtgg

SEQ ID NO: 3426992 - DNA, 18 bp, Homo sapiens
aagtattcgttacatctt

SEQ ID NO: 3426993 - DNA, 18 bp, Homo sapiens
aagtattgcatctgtata

SEQ ID NO: 3426994 - DNA, 22 bp, Homo sapiens
aagtattgcatctgtataagta

SEQ ID NO: 3426995 - DNA, 17 bp, Homo sapiens
aagtattgtaaattata

SEQ ID NO: 3426996 - DNA, 20 bp, Homo sapiens
aagtattgtaaattatattt

SEQ ID NO: 3426997 - DNA, 22 bp, Homo sapiens
aagtattgtaaattatatttgt

SEQ ID NO: 3426998 - DNA, 16 bp, Homo sapiens
aagtatttaattagtg

SEQ ID NO: 3426999 - DNA, 18 bp, Homo sapiens
aagtatttaattagtgct

SEQ ID NO: 3427000 - DNA, 20 bp, Homo sapiens
aagtatttaattagtgctaa

SEQ ID NO: 3427001 - DNA, 17 bp, Homo sapiens
aagtattttcataagta

SEQ ID NO: 3427002 - DNA, 22 bp, Homo sapiens
aagtattttcataagtatttca

SEQ ID NO: 3427003 - DNA, 20 bp, Homo sapiens
aagtcaaagcaaggaaacta

SEQ ID NO: 3427004 - DNA, 22 bp, Homo sapiens
aagtcaaagtaaaacttgctgc

SEQ ID NO: 3427005 - DNA, 19 bp, Homo sapiens
aagtcaaattaataatctt

SEQ ID NO: 3427006 - DNA, 21 bp, Homo sapiens
aagtcaagtgaaaaaggagga

SEQ ID NO: 3427007 - DNA, 19 bp, Homo sapiens
aagtcaccattctgcattt

SEQ ID NO: 3427008 - DNA, 22 bp, Homo sapiens
aagtcaccattctgcatttagc

SEQ ID NO: 3427009 - DNA, 23 bp, Homo sapiens
aagtcaccattctgcatttagct

SEQ ID NO: 3427010 - DNA, 19 bp, Homo sapiens
aagtccaagcaacagcctt

SEQ ID NO: 3427011 - DNA, 18 bp, Homo sapiens
aagtccccaggccccagg

SEQ ID NO: 3427012 - DNA, 22 bp, Homo sapiens
aagtcctcttttctgagaggac

SEQ ID NO: 3427013 - DNA, 17 bp, Homo sapiens
aagtcctggcttcaggc

SEQ ID NO: 3427014 - DNA, 21 bp, Homo sapiens
aagtcctttttttccatcttt

SEQ ID NO: 3427015 - DNA, 17 bp, Homo sapiens
aagtctggtcagagcca

SEQ ID NO: 3427016 - DNA, 18 bp, Homo sapiens
aagtctggtcagagccac

SEQ ID NO: 3427017 - DNA, 22 bp, Homo sapiens
aagtctgtatggcatgacaact

SEQ ID NO: 3427018 - DNA, 16 bp, Homo sapiens
aagtctgtttactgca

SEQ ID NO: 3427019 - DNA, 18 bp, Homo sapiens
aagtctttaggtctttgt

SEQ ID NO: 3427020 - DNA, 23 bp, Homo sapiens
aagtctttaggtctttgtaagaa

SEQ ID NO: 3427021 - DNA, 16 bp, Homo sapiens
aagtctttcacattta

SEQ ID NO: 3427022 - DNA, 14 bp, Homo sapiens
aagtctttcagatg

SEQ ID NO: 3427023 - DNA, 13 bp, Homo sapiens
aagtgaaaatctt

SEQ ID NO: 3427024 - DNA, 14 bp, Homo sapiens
aagtgaaaatctta

SEQ ID NO: 3427025 - DNA, 13 bp, Homo sapiens
aagtgaagactgg

SEQ ID NO: 3427026 - DNA, 10 bp, Homo sapiens
aagtgaaggt

SEQ ID NO: 3427027 - DNA, 18 bp, Homo sapiens
aagtgaaggtttacaatt

SEQ ID NO: 3427028 - DNA, 15 bp, Homo sapiens
aagtgaatgctggga

SEQ ID NO: 3427029 - DNA, 19 bp, Homo sapiens
aagtgactaatggcatgag

SEQ ID NO: 3427030 - DNA, 15 bp, Homo sapiens
aagtgataatttctg

SEQ ID NO: 3427031 - DNA, 15 bp, Homo sapiens
aagtgattctcctgc

SEQ ID NO: 3427032 - DNA, 16 bp, Homo sapiens
aagtgattctcctgcc

SEQ ID NO: 3427033 - DNA, 23 bp, Homo sapiens
aagtgcaataaatctgacccagt

SEQ ID NO: 3427034 - DNA, 22 bp, Homo sapiens
aagtgcgtccacgagctgttta

SEQ ID NO: 3427035 - DNA, 22 bp, Homo sapiens
aagtgctcagggaaatggcctt

SEQ ID NO: 3427036 - DNA, 23 bp, Homo sapiens
aagtgctcagggaaatggccttc

SEQ ID NO: 3427037 - DNA, 13 bp, Homo sapiens
aagtgctgtataa

SEQ ID NO: 3427038 - DNA, 17 bp, Homo sapiens
aagtgctgtataaaatc

SEQ ID NO: 3427039 - DNA, 23 bp, Homo sapiens
aagtgctgtataaaatcagccaa

SEQ ID NO: 3427040 - DNA, 16 bp, Homo sapiens
aagtggaggcacttta

SEQ ID NO: 3427041 - DNA, 12 bp, Homo sapiens
aagtgtaactgg

SEQ ID NO: 3427042 - DNA, 15 bp, Homo sapiens
aagtgtaggcagaca

SEQ ID NO: 3427043 - DNA, 12 bp, Homo sapiens
aagtgtcttttt

SEQ ID NO: 3427044 - DNA, 13 bp, Homo sapiens
aagtgtgaactgg

SEQ ID NO: 3427045 - DNA, 21 bp, Homo sapiens
aagtgtgctttatgctgaaac

SEQ ID NO: 3427046 - DNA, 23 bp, Homo sapiens
aagtgtgctttatgctgaaacag

SEQ ID NO: 3427047 - DNA, 13 bp, Homo sapiens
aagtgtggtagag

SEQ ID NO: 3427048 - DNA, 22 bp, Homo sapiens
aagtgttccctgagaaacccac

SEQ ID NO: 3427049 - DNA, 15 bp, Homo sapiens
aagtgttctgagctg

SEQ ID NO: 3427050 - DNA, 16 bp, Homo sapiens
aagttaatgcttaaga

SEQ ID NO: 3427051 - DNA, 21 bp, Homo sapiens
aagttaatgcttaagagggaa

SEQ ID NO: 3427052 - DNA, 19 bp, Homo sapiens
aagttacacagaaatgctg

SEQ ID NO: 3427053 - DNA, 13 bp, Homo sapiens
aagttatatttca

SEQ ID NO: 3427054 - DNA, 17 bp, Homo sapiens
aagttatatttcagatg

SEQ ID NO: 3427055 - DNA, 23 bp, Homo sapiens
aagttatatttcagatgtaatgt

SEQ ID NO: 3427056 - DNA, 10 bp, Homo sapiens
aagttatttt

SEQ ID NO: 3427057 - DNA, 19 bp, Homo sapiens
aagttatttttgtacatgt

SEQ ID NO: 3427058 - DNA, 23 bp, Homo sapiens
aagttcagaaatttaaaagcaga

SEQ ID NO: 3427059 - DNA, 16 bp, Homo sapiens
aagttcctaggaaaaa

SEQ ID NO: 3427060 - DNA, 20 bp, Homo sapiens
aagttctaggaaattcttga

SEQ ID NO: 3427061 - DNA, 16 bp, Homo sapiens
aagttctgctttctcc

SEQ ID NO: 3427062 - DNA, 19 bp, Homo sapiens
aagttctgtactcaaatgt

SEQ ID NO: 3427063 - DNA, 17 bp, Homo sapiens
aagttgaaattaaccat

SEQ ID NO: 3427064 - DNA, 17 bp, Homo sapiens
aagttgagaaggtgcct

SEQ ID NO: 3427065 - DNA, 20 bp, Homo sapiens
aagttgagaaggtgcctgcc

SEQ ID NO: 3427066 - DNA, 17 bp, Homo sapiens
aagttgatatagaacag

SEQ ID NO: 3427067 - DNA, 17 bp, Homo sapiens
aagttgcttttttgact

SEQ ID NO: 3427068 - DNA, 20 bp, Homo sapiens
aagttgttactaactaaact

SEQ ID NO: 3427069 - DNA, 23 bp, Homo sapiens
aagttgttactaactaaactctc

SEQ ID NO: 3427070 - DNA, 13 bp, Homo sapiens
aagtttagaactt

SEQ ID NO: 3427071 - DNA, 21 bp, Homo sapiens
aagtttcagagaccattgcaa

SEQ ID NO: 3427072 - DNA, 12 bp, Homo sapiens
aagtttcagttg

SEQ ID NO: 3427073 - DNA, 18 bp, Homo sapiens
aagtttccttccagccca

SEQ ID NO: 3427074 - DNA, 13 bp, Homo sapiens
aagtttgcttaga

SEQ ID NO: 3427075 - DNA, 16 bp, Homo sapiens
aagtttgcttagaaaa

SEQ ID NO: 3427076 - DNA, 23 bp, Homo sapiens
aagttttgggtatgtttaatctg

SEQ ID NO: 3427077 - DNA, 15 bp, Homo sapiens
aagttttttttctgg

SEQ ID NO: 3427078 - DNA, 17 bp, Homo sapiens
aataaaaaatgaaaaga

SEQ ID NO: 3427079 - DNA, 14 bp, Homo sapiens
aataaaaaccaaga

SEQ ID NO: 3427080 - DNA, 13 bp, Homo sapiens
aataaaaaggcac

SEQ ID NO: 3427081 - DNA, 13 bp, Homo sapiens
aataaaacaaagg

SEQ ID NO: 3427082 - DNA, 14 bp, Homo sapiens
aataaaacaaaggg

SEQ ID NO: 3427083 - DNA, 17 bp, Homo sapiens
aataaaacagtatctct

SEQ ID NO: 3427084 - DNA, 16 bp, Homo sapiens
aataaaattacacagt

SEQ ID NO: 3427085 - DNA, 13 bp, Homo sapiens
aataaactgtaaa

SEQ ID NO: 3427086 - DNA, 15 bp, Homo sapiens
aataaagaatacttg

SEQ ID NO: 3427087 - DNA, 15 bp, Homo sapiens
aataaagctgttctc

SEQ ID NO: 3427088 - DNA, 14 bp, Homo sapiens
aataaaggttgtga

SEQ ID NO: 3427089 - DNA, 13 bp, Homo sapiens
aataaagtattta

SEQ ID NO: 3427090 - DNA, 15 bp, Homo sapiens
aataaagtatttaat

SEQ ID NO: 3427091 - DNA, 19 bp, Homo sapiens
aataaagtatttaattagt

SEQ ID NO: 3427092 - DNA, 20 bp, Homo sapiens
aataaagtatttaattagtg

SEQ ID NO: 3427093 - DNA, 23 bp, Homo sapiens
aataaagtatttaattagtgcta

SEQ ID NO: 3427094 - DNA, 20 bp, Homo sapiens
aataaatgtatcttattcac

SEQ ID NO: 3427095 - DNA, 20 bp, Homo sapiens
aataaattctgattcttcta

SEQ ID NO: 3427096 - DNA, 13 bp, Homo sapiens
aataaattgtata

SEQ ID NO: 3427097 - DNA, 18 bp, Homo sapiens
aataaattgtatattcac

SEQ ID NO: 3427098 - DNA, 18 bp, Homo sapiens
aataaatttatatgaaaa

SEQ ID NO: 3427099 - DNA, 20 bp, Homo sapiens
aataacattcccactgccag

SEQ ID NO: 3427100 - DNA, 12 bp, Homo sapiens
aataacatttaa

SEQ ID NO: 3427101 - DNA, 13 bp, Homo sapiens
aataacatttaat

SEQ ID NO: 3427102 - DNA, 15 bp, Homo sapiens
aataacatttaattt

SEQ ID NO: 3427103 - DNA, 18 bp, Homo sapiens
aataacatttaatttaga

SEQ ID NO: 3427104 - DNA, 15 bp, Homo sapiens
aataacgataaaaga

SEQ ID NO: 3427105 - DNA, 18 bp, Homo sapiens
cgtgatcaaagccacact

SEQ ID NO: 3427106 - DNA, 16 bp, Homo sapiens
cgtgcacacaccagag

SEQ ID NO: 3427107 - DNA, 19 bp, Homo sapiens
cgtgcacacaccagagccc

SEQ ID NO: 3427108 - DNA, 18 bp, Homo sapiens
cgtgcccctgctgctgtc

SEQ ID NO: 3427109 - DNA, 23 bp, Homo sapiens
cgtgcgctgggcacttccctgct

SEQ ID NO: 3427110 - DNA, 19 bp, Homo sapiens
cgtgctcgccccagcaggt

SEQ ID NO: 3427111 - DNA, 15 bp, Homo sapiens
cgtgctgacagctgc

SEQ ID NO: 3427112 - DNA, 16 bp, Homo sapiens
cgtgctgacagctgct

SEQ ID NO: 3427113 - DNA, 17 bp, Homo sapiens
cgtgctgacagctgctc

SEQ ID NO: 3427114 - DNA, 22 bp, Homo sapiens
cgtggaggagcagtgcaggcac

SEQ ID NO: 3427115 - DNA, 22 bp, Homo sapiens
cgtggcatttcaattcctggcc

SEQ ID NO: 3427116 - DNA, 14 bp, Homo sapiens
cgtggctcagccag

SEQ ID NO: 3427117 - DNA, 20 bp, Homo sapiens
cgtgggacggtgcccaagcc

SEQ ID NO: 3427118 - DNA, 15 bp, Homo sapiens
cgtggtatgtctgcc

SEQ ID NO: 3427119 - DNA, 10 bp, Homo sapiens
cgtgtacata

SEQ ID NO: 3427120 - DNA, 20 bp, Homo sapiens
cgtgtacatagtgcattgtt

SEQ ID NO: 3427121 - DNA, 16 bp, Homo sapiens
cgtgtcacctgtgctt

SEQ ID NO: 3427122 - DNA, 21 bp, Homo sapiens
cgtgtgagaagtgaatgctgg

SEQ ID NO: 3427123 - DNA, 17 bp, Homo sapiens
cgtgttacccactgcca

SEQ ID NO: 3427124 - DNA, 17 bp, Homo sapiens
cgttagaggaaaaatat

SEQ ID NO: 3427125 - DNA, 13 bp, Homo sapiens
cgttagctcctgt

SEQ ID NO: 3427126 - DNA, 16 bp, Homo sapiens
cgttagctcctgtggc

SEQ ID NO: 3427127 - DNA, 20 bp, Homo sapiens
cgttagtcgtgagctcttgt

SEQ ID NO: 3427128 - DNA, 21 bp, Homo sapiens
cgttcgcagagcttttcagat

SEQ ID NO: 3427129 - DNA, 14 bp, Homo sapiens
cgttgtaaaatata

SEQ ID NO: 3427130 - DNA, 24 bp, Homo sapiens
cgttgtaaaatatagctgtacaaa

SEQ ID NO: 3427131 - DNA, 23 bp, Homo sapiens
cgtttacaagcccccccttccac

SEQ ID NO: 3427132 - DNA, 11 bp, Homo sapiens
cgtttgaccaa

SEQ ID NO: 3427133 - DNA, 17 bp, Homo sapiens
cgtttgaccttttatgt

SEQ ID NO: 3427134 - DNA, 13 bp, Homo sapiens
cgttttgaagcta

SEQ ID NO: 3427135 - DNA, 20 bp, Homo sapiens
cgttttgaagctactgtgtg

SEQ ID NO: 3427136 - DNA, 19 bp, Homo sapiens
ctaaaaaagatatattaaa

SEQ ID NO: 3427137 - DNA, 12 bp, Homo sapiens
ctaaaacaataa

SEQ ID NO: 3427138 - DNA, 11 bp, Homo sapiens
ctaaaaccatt

SEQ ID NO: 3427139 - DNA, 19 bp, Homo sapiens
ctaaaccaaggactgagca

SEQ ID NO: 3427140 - DNA, 13 bp, Homo sapiens
ctaaacctcagtt

SEQ ID NO: 3427141 - DNA, 17 bp, Homo sapiens
ctaaacctcagttatta

SEQ ID NO: 3427142 - DNA, 17 bp, Homo sapiens
ctaaactcatttataaa

SEQ ID NO: 3427143 - DNA, 22 bp, Homo sapiens
ctaaactccttcctggcctgag

SEQ ID NO: 3427144 - DNA, 16 bp, Homo sapiens
ctaaacttccccatct

SEQ ID NO: 3427145 - DNA, 21 bp, Homo sapiens
ctaaagaaaaatatcttggcc

SEQ ID NO: 3427146 - DNA, 14 bp, Homo sapiens
ctaaagaagatctg

SEQ ID NO: 3427147 - DNA, 16 bp, Homo sapiens
ctaaagaagatctgta

SEQ ID NO: 3427148 - DNA, 19 bp, Homo sapiens
ctaaaggtgttgtcccttc

SEQ ID NO: 3427149 - DNA, 20 bp, Homo sapiens
ctaaaggtgttgtcccttct

SEQ ID NO: 3427150 - DNA, 14 bp, Homo sapiens
ctaaagttatattt

SEQ ID NO: 3427151 - DNA, 15 bp, Homo sapiens
ctaaagttatatttc

SEQ ID NO: 3427152 - DNA, 16 bp, Homo sapiens
ctaaagttatatttca

SEQ ID NO: 3427153 - DNA, 13 bp, Homo sapiens
ctaaagttgtagt

SEQ ID NO: 3427154 - DNA, 18 bp, Homo sapiens
ctaaataaaagttttaca

SEQ ID NO: 3427155 - DNA, 20 bp, Homo sapiens
ctaaataatcttactctaga

SEQ ID NO: 3427156 - DNA, 20 bp, Homo sapiens
ctaaatattatgagatgctg

SEQ ID NO: 3427157 - DNA, 13 bp, Homo sapiens
ctaaatccaaaga

SEQ ID NO: 3427158 - DNA, 15 bp, Homo sapiens
ctaaattttctgaaa

SEQ ID NO: 3427159 - DNA, 12 bp, Homo sapiens
ctaacacacaga

SEQ ID NO: 3427160 - DNA, 15 bp, Homo sapiens
ctaacacacagctcc

SEQ ID NO: 3427161 - DNA, 16 bp, Homo sapiens
ctaacacttaccccat

SEQ ID NO: 3427162 - DNA, 23 bp, Homo sapiens
ctaacacttaccccatggctgca

SEQ ID NO: 3427163 - DNA, 12 bp, Homo sapiens
ctaaccacgctg

SEQ ID NO: 3427164 - DNA, 21 bp, Homo sapiens
ctaaccagggaagctgtccct

SEQ ID NO: 3427165 - DNA, 22 bp, Homo sapiens
ctaacctcaagtgatcctccca

SEQ ID NO: 3427166 - DNA, 12 bp, Homo sapiens
ctaacctcatct

SEQ ID NO: 3427167 - DNA, 16 bp, Homo sapiens
ctaacctcgccctctc

SEQ ID NO: 3427168 - DNA, 13 bp, Homo sapiens
ctaacttctgtaa

SEQ ID NO: 3427169 - DNA, 21 bp, Homo sapiens
ctaagaaaagattttaatcaa

SEQ ID NO: 3427170 - DNA, 14 bp, Homo sapiens
ctaagcagaggagg

SEQ ID NO: 3427171 - DNA, 17 bp, Homo sapiens
ctaagccccagcaagca

SEQ ID NO: 3427172 - DNA, 17 bp, Homo sapiens
ctaagcctgaaggggcg

SEQ ID NO: 3427173 - DNA, 21 bp, Homo sapiens
ctaagcttcactgtaaaataa

SEQ ID NO: 3427174 - DNA, 17 bp, Homo sapiens
ctaaggaggggaaaaaa

SEQ ID NO: 3427175 - DNA, 21 bp, Homo sapiens
ctaaggaggggaaaaaaatgt

SEQ ID NO: 3427176 - DNA, 18 bp, Homo sapiens
ctaaggcgtggagctgcc

SEQ ID NO: 3427177 - DNA, 21 bp, Homo sapiens
ctaaggcgtggagctgcctga

SEQ ID NO: 3427178 - DNA, 22 bp, Homo sapiens
ctaaggcgtggagctgcctgat

SEQ ID NO: 3427179 - DNA, 15 bp, Homo sapiens
ctaaggctgtttgct

SEQ ID NO: 3427180 - DNA, 16 bp, Homo sapiens
ctaaggtgtgctctga

SEQ ID NO: 3427181 - DNA, 15 bp, Homo sapiens
ctaagtcaaaacttg

SEQ ID NO: 3427182 - DNA, 22 bp, Homo sapiens
ctaagtgatcctcccacctcag

SEQ ID NO: 3427183 - DNA, 23 bp, Homo sapiens
ctaagtgatcctcccacctcagc

SEQ ID NO: 3427184 - DNA, 15 bp, Homo sapiens
ctaagtgatgctgtg

SEQ ID NO: 3427185 - DNA, 16 bp, Homo sapiens
ctaatacccagagcac

SEQ ID NO: 3427186 - DNA, 20 bp, Homo sapiens
ctaatatggccacagtagtc

SEQ ID NO: 3427187 - DNA, 18 bp, Homo sapiens
ctaatccaatacctcttg

SEQ ID NO: 3427188 - DNA, 20 bp, Homo sapiens
ctaatccaggcagatccagg

SEQ ID NO: 3427189 - DNA, 19 bp, Homo sapiens
ctaatctagatatcgactt

SEQ ID NO: 3427190 - DNA, 20 bp, Homo sapiens
ctaatctatggtcgggagac

SEQ ID NO: 3427191 - DNA, 18 bp, Homo sapiens
ctaatgaggagagaaaat

SEQ ID NO: 3427192 - DNA, 19 bp, Homo sapiens
ctaatgaggagagaaaata

SEQ ID NO: 3427193 - DNA, 13 bp, Homo sapiens
ctaatgctcacct

SEQ ID NO: 3427194 - DNA, 23 bp, Homo sapiens
ctaatgctgcagatttgggctgg

SEQ ID NO: 3427195 - DNA, 16 bp, Homo sapiens
ctaatggcatgagaaa

SEQ ID NO: 3427196 - DNA, 13 bp, Homo sapiens
ctaatgggacact

SEQ ID NO: 3427197 - DNA, 14 bp, Homo sapiens
ctaattaaggaagt

SEQ ID NO: 3427198 - DNA, 19 bp, Homo sapiens
ctaattcagccatgtacag

SEQ ID NO: 3427199 - DNA, 15 bp, Homo sapiens
ctaatttaaagagac

SEQ ID NO: 3427200 - DNA, 18 bp, Homo sapiens
ctaatttcaaaatgcttt

SEQ ID NO: 3427201 - DNA, 13 bp, Homo sapiens
ctaatttgcatta

SEQ ID NO: 3427202 - DNA, 14 bp, Homo sapiens
ctaatttgcattaa

SEQ ID NO: 3427203 - DNA, 19 bp, Homo sapiens
ctaatttgcattaaattca

SEQ ID NO: 3427204 - DNA, 12 bp, Homo sapiens
ctaatttttaag

SEQ ID NO: 3427205 - DNA, 17 bp, Homo sapiens
ctaatttttaagcaaaa

SEQ ID NO: 3427206 - DNA, 20 bp, Homo sapiens
ctaatttttgtaattttagt

SEQ ID NO: 3427207 - DNA, 21 bp, Homo sapiens
ctacaaaataaagctgttctc

SEQ ID NO: 3427208 - DNA, 17 bp, Homo sapiens
ctacaaacaaaatttct

SEQ ID NO: 3427209 - DNA, 18 bp, Homo sapiens
ctacaatgtgaactttat

SEQ ID NO: 3427210 - DNA, 19 bp, Homo sapiens
ctacaatgtgaactttatt

SEQ ID NO: 3427211 - DNA, 22 bp, Homo sapiens
ctacacactgtcatgcttcatc

SEQ ID NO: 3427212 - DNA, 16 bp, Homo sapiens
ctacaccaattaatgt

SEQ ID NO: 3427213 - DNA, 18 bp, Homo sapiens
ctacacccttttccagct

SEQ ID NO: 3427214 - DNA, 15 bp, Homo sapiens
ctacacctttctcct

SEQ ID NO: 3427215 - DNA, 18 bp, Homo sapiens
ctacacctttctcctttg

SEQ ID NO: 3427216 - DNA, 16 bp, Homo sapiens
ctacactgacactggt

SEQ ID NO: 3427217 - DNA, 16 bp, Homo sapiens
ctacagagcttccctg

SEQ ID NO: 3427218 - DNA, 18 bp, Homo sapiens
ctacagagcttccctgac

SEQ ID NO: 3427219 - DNA, 15 bp, Homo sapiens
ctacagaggccatgg

SEQ ID NO: 3427220 - DNA, 13 bp, Homo sapiens
ctacagctatgaa

SEQ ID NO: 3427221 - DNA, 16 bp, Homo sapiens
ctacagctatgaagaa

SEQ ID NO: 3427222 - DNA, 16 bp, Homo sapiens
ctacaggagtgagcac

SEQ ID NO: 3427223 - DNA, 16 bp, Homo sapiens
ctacaggtgtgagtca

SEQ ID NO: 3427224 - DNA, 21 bp, Homo sapiens
ctacagtcaggaaaggaatca

SEQ ID NO: 3427225 - DNA, 20 bp, Homo sapiens
ctacatcccgggcctcagtg

SEQ ID NO: 3427226 - DNA, 13 bp, Homo sapiens
ctacatgagaaca

SEQ ID NO: 3427227 - DNA, 14 bp, Homo sapiens
ctacatgagaacaa

SEQ ID NO: 3427228 - DNA, 12 bp, Homo sapiens
ctacattcattt

SEQ ID NO: 3427229 - DNA, 20 bp, Homo sapiens
ctaccaacttgtatccaggc

SEQ ID NO: 3427230 - DNA, 20 bp, Homo sapiens
ctaccacacatctgtggaga

SEQ ID NO: 3427231 - DNA, 14 bp, Homo sapiens
ctaccacctcccca

SEQ ID NO: 3427232 - DNA, 17 bp, Homo sapiens
ctaccacctccccagcc

SEQ ID NO: 3427233 - DNA, 17 bp, Homo sapiens
ctaccactcctgccaag

SEQ ID NO: 3427234 - DNA, 13 bp, Homo sapiens
ctaccattcagtg

SEQ ID NO: 3427235 - DNA, 19 bp, Homo sapiens
ctaccattttacatttcta

SEQ ID NO: 3427236 - DNA, 17 bp, Homo sapiens
ctacccagcgagccctg

SEQ ID NO: 3427237 - DNA, 18 bp, Homo sapiens
ctacccagcgagccctgg

SEQ ID NO: 3427238 - DNA, 18 bp, Homo sapiens
ctacccccagctgtgctt

SEQ ID NO: 3427239 - DNA, 15 bp, Homo sapiens
ctaccccgcagacac

SEQ ID NO: 3427240 - DNA, 15 bp, Homo sapiens
ctaccgacccagggt

SEQ ID NO: 3427241 - DNA, 23 bp, Homo sapiens
ctaccgccccaaagtaaaagaaa

SEQ ID NO: 3427242 - DNA, 14 bp, Homo sapiens
cgcttccccacaga

SEQ ID NO: 3427243 - DNA, 15 bp, Homo sapiens
cgcttccccacagaa

SEQ ID NO: 3427244 - DNA, 14 bp, Homo sapiens
cgcttctgcctgca

SEQ ID NO: 3427245 - DNA, 14 bp, Homo sapiens
cgctttctacccag

SEQ ID NO: 3427246 - DNA, 16 bp, Homo sapiens
cgctttctagctgttg

SEQ ID NO: 3427247 - DNA, 11 bp, Homo sapiens
cgcttttcctt

SEQ ID NO: 3427248 - DNA, 12 bp, Homo sapiens
cggaaagcagct

SEQ ID NO: 3427249 - DNA, 17 bp, Homo sapiens
cggaacccaagcttaga

SEQ ID NO: 3427250 - DNA, 17 bp, Homo sapiens
cggaactgcatgctgct

SEQ ID NO: 3427251 - DNA, 17 bp, Homo sapiens
cggaagaatcacttgaa

SEQ ID NO: 3427252 - DNA, 17 bp, Homo sapiens
cggaaggtttttaaaca

SEQ ID NO: 3427253 - DNA, 12 bp, Homo sapiens
cggaagttttca

SEQ ID NO: 3427254 - DNA, 13 bp, Homo sapiens
cggaagttttcaa

SEQ ID NO: 3427255 - DNA, 18 bp, Homo sapiens
cggaagttttcaatgatg

SEQ ID NO: 3427256 - DNA, 16 bp, Homo sapiens
cggaatagttggctag

SEQ ID NO: 3427257 - DNA, 20 bp, Homo sapiens
cggaatgaaccacatcttgc

SEQ ID NO: 3427258 - DNA, 21 bp, Homo sapiens
cggaatttttaaaataaactg

SEQ ID NO: 3427259 - DNA, 22 bp, Homo sapiens
cggaatttttaaaataaactgt

SEQ ID NO: 3427260 - DNA, 18 bp, Homo sapiens
cggacaagacccccagca

SEQ ID NO: 3427261 - DNA, 15 bp, Homo sapiens
cggacagccacggcc

SEQ ID NO: 3427262 - DNA, 16 bp, Homo sapiens
cggacagccacggcca

SEQ ID NO: 3427263 - DNA, 20 bp, Homo sapiens
cggacagccacggccaggcc

SEQ ID NO: 3427264 - DNA, 15 bp, Homo sapiens
cggacttttctgcaa

SEQ ID NO: 3427265 - DNA, 15 bp, Homo sapiens
cggagacggagtccc

SEQ ID NO: 3427266 - DNA, 21 bp, Homo sapiens
cggagccactcctctgactca

SEQ ID NO: 3427267 - DNA, 16 bp, Homo sapiens
cggagctggccccgcc

SEQ ID NO: 3427268 - DNA, 21 bp, Homo sapiens
cggagctggccccgccgcctg

SEQ ID NO: 3427269 - DNA, 13 bp, Homo sapiens
cggaggccagcta

SEQ ID NO: 3427270 - DNA, 17 bp, Homo sapiens
cggagggattcccctaa

SEQ ID NO: 3427271 - DNA, 16 bp, Homo sapiens
cggaggtgtggagccg

SEQ ID NO: 3427272 - DNA, 19 bp, Homo sapiens
cggaggttccagtgagccg

SEQ ID NO: 3427273 - DNA, 19 bp, Homo sapiens
cggagtcagccaggagctg

SEQ ID NO: 3427274 - DNA, 14 bp, Homo sapiens
cggagtcccacctt

SEQ ID NO: 3427275 - DNA, 23 bp, Homo sapiens
cggagtcccaccttggctgcagg

SEQ ID NO: 3427276 - DNA, 23 bp, Homo sapiens
cggcacctacatccccaggtctc

SEQ ID NO: 3427277 - DNA, 19 bp, Homo sapiens
cggcactgcaaagagacgc

SEQ ID NO: 3427278 - DNA, 16 bp, Homo sapiens
cggcagccccagcctg

SEQ ID NO: 3427279 - DNA, 17 bp, Homo sapiens
cggcagccccagcctgc

SEQ ID NO: 3427280 - DNA, 19 bp, Homo sapiens
cggcaggactgcagagcag

SEQ ID NO: 3427281 - DNA, 23 bp, Homo sapiens
cggcagggcgggcagagggctgg

SEQ ID NO: 3427282 - DNA, 15 bp, Homo sapiens
cggcaggggcctgga

SEQ ID NO: 3427283 - DNA, 19 bp, Homo sapiens
cggcaggggcctggagatc

SEQ ID NO: 3427284 - DNA, 21 bp, Homo sapiens
cggcagttctgggtgctccct

SEQ ID NO: 3427285 - DNA, 14 bp, Homo sapiens
cggccacacatcct

SEQ ID NO: 3427286 - DNA, 15 bp, Homo sapiens
cggccagccatgtct

SEQ ID NO: 3427287 - DNA, 20 bp, Homo sapiens
cggccaggccagagggagtg

SEQ ID NO: 3427288 - DNA, 17 bp, Homo sapiens
cggccagggagaagctc

SEQ ID NO: 3427289 - DNA, 14 bp, Homo sapiens
cggcccctccccct

SEQ ID NO: 3427290 - DNA, 19 bp, Homo sapiens
cggcccctgctggttcagg

SEQ ID NO: 3427291 - DNA, 21 bp, Homo sapiens
cggcctgtcctccaacaccaa

SEQ ID NO: 3427292 - DNA, 15 bp, Homo sapiens
cggcctttggcttca

SEQ ID NO: 3427293 - DNA, 13 bp, Homo sapiens
cggcggagctggc

SEQ ID NO: 3427294 - DNA, 19 bp, Homo sapiens
cggcggagctggccccgcc

SEQ ID NO: 3427295 - DNA, 15 bp, Homo sapiens
cggctcactgcagcc

SEQ ID NO: 3427296 - DNA, 18 bp, Homo sapiens
cggctcactgcagcctca

SEQ ID NO: 3427297 - DNA, 19 bp, Homo sapiens
cggctcactgcagcctcaa

SEQ ID NO: 3427298 - DNA, 20 bp, Homo sapiens
cggctcagtgcaacctctgc

SEQ ID NO: 3427299 - DNA, 15 bp, Homo sapiens
cggctccactaggac

SEQ ID NO: 3427300 - DNA, 13 bp, Homo sapiens
cggctccagctca

SEQ ID NO: 3427301 - DNA, 12 bp, Homo sapiens
cggctccaggct

SEQ ID NO: 3427302 - DNA, 15 bp, Homo sapiens
cggctcccagcctca

SEQ ID NO: 3427303 - DNA, 14 bp, Homo sapiens
cggctcccccaggc

SEQ ID NO: 3427304 - DNA, 15 bp, Homo sapiens
cggctcccccaggcc

SEQ ID NO: 3427305 - DNA, 17 bp, Homo sapiens
cggctcccccaggcctg

SEQ ID NO: 3427306 - DNA, 20 bp, Homo sapiens
cggctcccccaggcctgagc

SEQ ID NO: 3427307 - DNA, 20 bp, Homo sapiens
cggctctgtgggtgatgggg

SEQ ID NO: 3427308 - DNA, 22 bp, Homo sapiens
cggctctgtgggtgatggggag

SEQ ID NO: 3427309 - DNA, 14 bp, Homo sapiens
cggctgaccatgct

SEQ ID NO: 3427310 - DNA, 16 bp, Homo sapiens
cggctgaccatgctca

SEQ ID NO: 3427311 - DNA, 12 bp, Homo sapiens
cggctgcagagg

SEQ ID NO: 3427312 - DNA, 20 bp, Homo sapiens
cggctgcagaggccagaggc

SEQ ID NO: 3427313 - DNA, 13 bp, Homo sapiens
cggctgcctccat

SEQ ID NO: 3427314 - DNA, 14 bp, Homo sapiens
cggctgggtctgtg

SEQ ID NO: 3427315 - DNA, 13 bp, Homo sapiens
cggctgtgctggg

SEQ ID NO: 3427316 - DNA, 17 bp, Homo sapiens
cgggaacctccccagcc

SEQ ID NO: 3427317 - DNA, 22 bp, Homo sapiens
cgggaacctccccagcctgcgc

SEQ ID NO: 3427318 - DNA, 13 bp, Homo sapiens
cgggacctggtgc

SEQ ID NO: 3427319 - DNA, 16 bp, Homo sapiens
cgggagaggggacgca

SEQ ID NO: 3427320 - DNA, 22 bp, Homo sapiens
cgggagaggggacgcaggcccc

SEQ ID NO: 3427321 - DNA, 21 bp, Homo sapiens
cgggaggcggaggttccagtg

SEQ ID NO: 3427322 - DNA, 16 bp, Homo sapiens
cgggaggtcgaggcag

SEQ ID NO: 3427323 - DNA, 17 bp, Homo sapiens
cgggaggtcgaggcagg

SEQ ID NO: 3427324 - DNA, 14 bp, Homo sapiens
cgggcaccagccag

SEQ ID NO: 3427325 - DNA, 15 bp, Homo sapiens
cgggcaccagccagc

SEQ ID NO: 3427326 - DNA, 16 bp, Homo sapiens
cgggcagagggctgga

SEQ ID NO: 3427327 - DNA, 22 bp, Homo sapiens
cgggcagagggctggaggccca

SEQ ID NO: 3427328 - DNA, 17 bp, Homo sapiens
cgggccagggctgcccc

SEQ ID NO: 3427329 - DNA, 21 bp, Homo sapiens
cgggcccttcccacaggacat

SEQ ID NO: 3427330 - DNA, 15 bp, Homo sapiens
cgggcctcagtgccc

SEQ ID NO: 3427331 - DNA, 15 bp, Homo sapiens
cgggctcagcaaaag

SEQ ID NO: 3427332 - DNA, 13 bp, Homo sapiens
cgggctccagcca

SEQ ID NO: 3427333 - DNA, 14 bp, Homo sapiens
cgggctgagggcct

SEQ ID NO: 3427334 - DNA, 20 bp, Homo sapiens
cgggctttgtgtgaaggcag

SEQ ID NO: 3427335 - DNA, 22 bp, Homo sapiens
cgggctttgtgtgaaggcagag

SEQ ID NO: 3427336 - DNA, 14 bp, Homo sapiens
cggggcccagggca

SEQ ID NO: 3427337 - DNA, 21 bp, Homo sapiens
cggggccttatcgggctccag

SEQ ID NO: 3427338 - DNA, 22 bp, Homo sapiens
cggggccttatcgggctccagc

SEQ ID NO: 3427339 - DNA, 16 bp, Homo sapiens
cggggtgcccacaggc

SEQ ID NO: 3427340 - DNA, 19 bp, Homo sapiens
cgggtccccagctccccag

SEQ ID NO: 3427341 - DNA, 18 bp, Homo sapiens
cgggtcgggggcaggtgc

SEQ ID NO: 3427342 - DNA, 21 bp, Homo sapiens
cgggtgaacaaagcagccacg

SEQ ID NO: 3427343 - DNA, 22 bp, Homo sapiens
cgggtgtgcaatgtctgagtga

SEQ ID NO: 3427344 - DNA, 15 bp, Homo sapiens
cggtagccagcacac

SEQ ID NO: 3427345 - DNA, 18 bp, Homo sapiens
cggtcccctccgccaggc

SEQ ID NO: 3427346 - DNA, 19 bp, Homo sapiens
cggtgccatgtctgcagtg

SEQ ID NO: 3427347 - DNA, 15 bp, Homo sapiens
cggtgcccaagccag

SEQ ID NO: 3427348 - DNA, 13 bp, Homo sapiens
cggtgcccacacc

SEQ ID NO: 3427349 - DNA, 22 bp, Homo sapiens
cggtgctgtcctcaggtggcca

SEQ ID NO: 3427350 - DNA, 22 bp, Homo sapiens
cggtggacttgaactttcctgg

SEQ ID NO: 3427351 - DNA, 21 bp, Homo sapiens
cggtggctgggcagagctgca

SEQ ID NO: 3427352 - DNA, 23 bp, Homo sapiens
cggtgggcacccaccctgggacc

SEQ ID NO: 3427353 - DNA, 11 bp, Homo sapiens
cgtacacagag

SEQ ID NO: 3427354 - DNA, 13 bp, Homo sapiens
cgtacacagagaa

SEQ ID NO: 3427355 - DNA, 15 bp, Homo sapiens
cgtacacagagaagg

SEQ ID NO: 3427356 - DNA, 17 bp, Homo sapiens
cgtacaggctggcgcag

SEQ ID NO: 3427357 - DNA, 13 bp, Homo sapiens
cgtacttgtgatt

SEQ ID NO: 3427358 - DNA, 17 bp, Homo sapiens
cgtatatataagaaaga

SEQ ID NO: 3427359 - DNA, 23 bp, Homo sapiens
cgtatatataagaaagacatctt

SEQ ID NO: 3427360 - DNA, 21 bp, Homo sapiens
cgtattagttgccaatatgcc

SEQ ID NO: 3427361 - DNA, 16 bp, Homo sapiens
cgtcaacgttgtactg

SEQ ID NO: 3427362 - DNA, 18 bp, Homo sapiens
cgtcaccacgactggcca

SEQ ID NO: 3427363 - DNA, 15 bp, Homo sapiens
cgtcatgcttgtgtt

SEQ ID NO: 3427364 - DNA, 15 bp, Homo sapiens
cgtccacagcttcct

SEQ ID NO: 3427365 - DNA, 11 bp, Homo sapiens
cgtccagggag

SEQ ID NO: 3427366 - DNA, 18 bp, Homo sapiens
cgtcctgctttggcagtg

SEQ ID NO: 3427367 - DNA, 15 bp, Homo sapiens
cgtcgccctcccagg

SEQ ID NO: 3427368 - DNA, 20 bp, Homo sapiens
cgtctccaggggctgcttcc

SEQ ID NO: 3427369 - DNA, 21 bp, Homo sapiens
cgtctccaggggctgcttcct

SEQ ID NO: 3427370 - DNA, 13 bp, Homo sapiens
cgtctgacaggca

SEQ ID NO: 3427371 - DNA, 18 bp, Homo sapiens
cgtgaaaacggagctgaa

SEQ ID NO: 3427372 - DNA, 19 bp, Homo sapiens
cgtgaaggccgagaagcaa

SEQ ID NO: 3427373 - DNA, 13 bp, Homo sapiens
cgtgacacaaaca

SEQ ID NO: 3427374 - DNA, 20 bp, Homo sapiens
cgtgaccggacttttctgca

SEQ ID NO: 3427375 - DNA, 23 bp, Homo sapiens
cgtgagagtgtcttcacggcagg

SEQ ID NO: 3427376 - DNA, 20 bp, Homo sapiens
cgtgagcatgtttggaaggg

SEQ ID NO: 3427377 - DNA, 20 bp, Homo sapiens
cgtgagccactgcaccgggc

SEQ ID NO: 3427378 - DNA, 19 bp, Homo sapiens
cgtgagtgtctcttgtcta

SEQ ID NO: 3427379 - DNA, 15 bp, Homo sapiens
cctttgttcccggct

SEQ ID NO: 3427380 - DNA, 17 bp, Homo sapiens
ccttttcgcctttcctc

SEQ ID NO: 3427381 - DNA, 22 bp, Homo sapiens
ccttttctgggtttgaagctgc

SEQ ID NO: 3427382 - DNA, 19 bp, Homo sapiens
ccttttctttgttcaagat

SEQ ID NO: 3427383 - DNA, 15 bp, Homo sapiens
ccttttgcagaagag

SEQ ID NO: 3427384 - DNA, 12 bp, Homo sapiens
ccttttgtaaag

SEQ ID NO: 3427385 - DNA, 12 bp, Homo sapiens
cctttttgaagt

SEQ ID NO: 3427386 - DNA, 22 bp, Homo sapiens
cctttttgaagtgtaggcagac

SEQ ID NO: 3427387 - DNA, 17 bp, Homo sapiens
ccttttttaaaaatgca

SEQ ID NO: 3427388 - DNA, 11 bp, Homo sapiens
ccttttttccc

SEQ ID NO: 3427389 - DNA, 14 bp, Homo sapiens
ccttttttcttttt

SEQ ID NO: 3427390 - DNA, 23 bp, Homo sapiens
ccttttttgttttttcaaaatag

SEQ ID NO: 3427391 - DNA, 18 bp, Homo sapiens
cctttttttccatcttta

SEQ ID NO: 3427392 - DNA, 17 bp, Homo sapiens
ccttttttttttttcca

SEQ ID NO: 3427393 - DNA, 18 bp, Homo sapiens
cgaaacctgggattcagg

SEQ ID NO: 3427394 - DNA, 22 bp, Homo sapiens
cgaaagggacttggaagctccg

SEQ ID NO: 3427395 - DNA, 23 bp, Homo sapiens
cgaaagggacttggaagctccgc

SEQ ID NO: 3427396 - DNA, 13 bp, Homo sapiens
cgaaccccaagga

SEQ ID NO: 3427397 - DNA, 19 bp, Homo sapiens
cgaactcctaacctcaagt

SEQ ID NO: 3427398 - DNA, 15 bp, Homo sapiens
cgaagagtcagcccc

SEQ ID NO: 3427399 - DNA, 13 bp, Homo sapiens
cgaatagctggga

SEQ ID NO: 3427400 - DNA, 12 bp, Homo sapiens
cgaatctctgtg

SEQ ID NO: 3427401 - DNA, 22 bp, Homo sapiens
cgaatctctttttgctttcgaa

SEQ ID NO: 3427402 - DNA, 21 bp, Homo sapiens
cgactctttctgagtgccttc

SEQ ID NO: 3427403 - DNA, 14 bp, Homo sapiens
cgactttctgcctg

SEQ ID NO: 3427404 - DNA, 15 bp, Homo sapiens
cgactttctgcctgg

SEQ ID NO: 3427405 - DNA, 16 bp, Homo sapiens
cgactttctgcctgga

SEQ ID NO: 3427406 - DNA, 13 bp, Homo sapiens
cgagaagcaagaa

SEQ ID NO: 3427407 - DNA, 16 bp, Homo sapiens
cgagaccagcctggcc

SEQ ID NO: 3427408 - DNA, 14 bp, Homo sapiens
cgagagctggccaa

SEQ ID NO: 3427409 - DNA, 19 bp, Homo sapiens
cgagaggccaaaggctggt

SEQ ID NO: 3427410 - DNA, 15 bp, Homo sapiens
cgagaggtgggccag

SEQ ID NO: 3427411 - DNA, 22 bp, Homo sapiens
cgagaggtgggccagtctgtgg

SEQ ID NO: 3427412 - DNA, 19 bp, Homo sapiens
cgagagtctggccctagac

SEQ ID NO: 3427413 - DNA, 17 bp, Homo sapiens
cgagatcacgccactgc

SEQ ID NO: 3427414 - DNA, 18 bp, Homo sapiens
cgagatcacgccactgca

SEQ ID NO: 3427415 - DNA, 20 bp, Homo sapiens
cgagattgcaccactgcact

SEQ ID NO: 3427416 - DNA, 22 bp, Homo sapiens
cgagcccctcggctctggaggc

SEQ ID NO: 3427417 - DNA, 11 bp, Homo sapiens
cgaggaagccc

SEQ ID NO: 3427418 - DNA, 16 bp, Homo sapiens
cgaggaatctgtgggt

SEQ ID NO: 3427419 - DNA, 22 bp, Homo sapiens
cgaggaatctgtgggtctggga

SEQ ID NO: 3427420 - DNA, 16 bp, Homo sapiens
cgaggacagggaggtg

SEQ ID NO: 3427421 - DNA, 18 bp, Homo sapiens
cgaggccttctctgaagg

SEQ ID NO: 3427422 - DNA, 19 bp, Homo sapiens
cgaggccttctctgaagga

SEQ ID NO: 3427423 - DNA, 18 bp, Homo sapiens
cgaggtgcggccaccacc

SEQ ID NO: 3427424 - DNA, 17 bp, Homo sapiens
cgagtactgtgggcaat

SEQ ID NO: 3427425 - DNA, 22 bp, Homo sapiens
cgagtactgtgggcaatttaga

SEQ ID NO: 3427426 - DNA, 15 bp, Homo sapiens
cgagtcacattctgc

SEQ ID NO: 3427427 - DNA, 13 bp, Homo sapiens
cgagtccaagctg

SEQ ID NO: 3427428 - DNA, 14 bp, Homo sapiens
cgagtccaagctgg

SEQ ID NO: 3427429 - DNA, 15 bp, Homo sapiens
cgagtccaagctggg

SEQ ID NO: 3427430 - DNA, 22 bp, Homo sapiens
cgatactgcgactttctgcctg

SEQ ID NO: 3427431 - DNA, 15 bp, Homo sapiens
cgatctcggctcagt

SEQ ID NO: 3427432 - DNA, 23 bp, Homo sapiens
cgatctggaccgtcccctgccca

SEQ ID NO: 3427433 - DNA, 16 bp, Homo sapiens
cgatgacagtgctcta

SEQ ID NO: 3427434 - DNA, 16 bp, Homo sapiens
cgatgattcaggtgca

SEQ ID NO: 3427435 - DNA, 18 bp, Homo sapiens
cgatgggcccctggcccc

SEQ ID NO: 3427436 - DNA, 18 bp, Homo sapiens
cgatggtacgtgaccctc

SEQ ID NO: 3427437 - DNA, 17 bp, Homo sapiens
cgatttctgtaaactct

SEQ ID NO: 3427438 - DNA, 14 bp, Homo sapiens
cgcaccattctgac

SEQ ID NO: 3427439 - DNA, 16 bp, Homo sapiens
cgcacctcccatccta

SEQ ID NO: 3427440 - DNA, 18 bp, Homo sapiens
cgcacctcccatcctaat

SEQ ID NO: 3427441 - DNA, 14 bp, Homo sapiens
cgcacctgcctcag

SEQ ID NO: 3427442 - DNA, 16 bp, Homo sapiens
cgcacctgcctcagga

SEQ ID NO: 3427443 - DNA, 16 bp, Homo sapiens
cgcacgcctctccctg

SEQ ID NO: 3427444 - DNA, 19 bp, Homo sapiens
cgcagaacgaaccttggcc

SEQ ID NO: 3427445 - DNA, 14 bp, Homo sapiens
cgcagagctggccg

SEQ ID NO: 3427446 - DNA, 18 bp, Homo sapiens
cgcagagcttttcagatt

SEQ ID NO: 3427447 - DNA, 14 bp, Homo sapiens
cgcagcaccctgca

SEQ ID NO: 3427448 - DNA, 17 bp, Homo sapiens
cgcagcaggaggccagg

SEQ ID NO: 3427449 - DNA, 12 bp, Homo sapiens
cgcagccccatc

SEQ ID NO: 3427450 - DNA, 14 bp, Homo sapiens
cgcaggcccctctc

SEQ ID NO: 3427451 - DNA, 23 bp, Homo sapiens
cgcaggcccctctcctccgtggc

SEQ ID NO: 3427452 - DNA, 17 bp, Homo sapiens
cgcagtgtgcactaagg

SEQ ID NO: 3427453 - DNA, 15 bp, Homo sapiens
cgcataggacctttc

SEQ ID NO: 3427454 - DNA, 16 bp, Homo sapiens
cgcatgtaatcccagc

SEQ ID NO: 3427455 - DNA, 20 bp, Homo sapiens
cgcatgtaatcccagctact

SEQ ID NO: 3427456 - DNA, 19 bp, Homo sapiens
cgcattctaacctggaggt

SEQ ID NO: 3427457 - DNA, 17 bp, Homo sapiens
cgccaaataatgtctct

SEQ ID NO: 3427458 - DNA, 19 bp, Homo sapiens
cgccaaataatgtctctgt

SEQ ID NO: 3427459 - DNA, 16 bp, Homo sapiens
cgccaggctgaccaca

SEQ ID NO: 3427460 - DNA, 17 bp, Homo sapiens
cgccaggctgaccacag

SEQ ID NO: 3427461 - DNA, 12 bp, Homo sapiens
cgcccaaggccc

SEQ ID NO: 3427462 - DNA, 22 bp, Homo sapiens
cgcccagagacccaagctgcct

SEQ ID NO: 3427463 - DNA, 20 bp, Homo sapiens
cgcccaggctggagtgcagt

SEQ ID NO: 3427464 - DNA, 21 bp, Homo sapiens
cgccccaaagtaaaagaaacc

SEQ ID NO: 3427465 - DNA, 20 bp, Homo sapiens
cgccccctccgccctgccac

SEQ ID NO: 3427466 - DNA, 19 bp, Homo sapiens
cgccccctgccctcccctc

SEQ ID NO: 3427467 - DNA, 11 bp, Homo sapiens
cgccctctcct

SEQ ID NO: 3427468 - DNA, 14 bp, Homo sapiens
cgccctgccactca

SEQ ID NO: 3427469 - DNA, 16 bp, Homo sapiens
cgccctttcctcctca

SEQ ID NO: 3427470 - DNA, 20 bp, Homo sapiens
cgccgcaaaccacactggac

SEQ ID NO: 3427471 - DNA, 21 bp, Homo sapiens
cgccgcaaaccacactggact

SEQ ID NO: 3427472 - DNA, 22 bp, Homo sapiens
cgccgcaaaccacactggactc

SEQ ID NO: 3427473 - DNA, 23 bp, Homo sapiens
cgccgcaaaccacactggactcc

SEQ ID NO: 3427474 - DNA, 15 bp, Homo sapiens
cgccgcctggtactc

SEQ ID NO: 3427475 - DNA, 15 bp, Homo sapiens
cgcctccaggagcct

SEQ ID NO: 3427476 - DNA, 16 bp, Homo sapiens
cgcctcccctgcccca

SEQ ID NO: 3427477 - DNA, 17 bp, Homo sapiens
cgcctctccctgcactc

SEQ ID NO: 3427478 - DNA, 16 bp, Homo sapiens
cgcctgaggccagcct

SEQ ID NO: 3427479 - DNA, 20 bp, Homo sapiens
cgcctgcaaacgctgcctgc

SEQ ID NO: 3427480 - DNA, 22 bp, Homo sapiens
cgcctgcaaacgctgcctgccc

SEQ ID NO: 3427481 - DNA, 15 bp, Homo sapiens
cgcctgctgcatgcc

SEQ ID NO: 3427482 - DNA, 13 bp, Homo sapiens
cgcctggagccct

SEQ ID NO: 3427483 - DNA, 22 bp, Homo sapiens
cgcctggccggctccagtttcc

SEQ ID NO: 3427484 - DNA, 22 bp, Homo sapiens
cgccttagcactaccactcctg

SEQ ID NO: 3427485 - DNA, 13 bp, Homo sapiens
cgcctttcccagg

SEQ ID NO: 3427486 - DNA, 13 bp, Homo sapiens
cgcctttcctctc

SEQ ID NO: 3427487 - DNA, 17 bp, Homo sapiens
cgcgccacaggaccctc

SEQ ID NO: 3427488 - DNA, 21 bp, Homo sapiens
cgcgccacaggaccctcgccg

SEQ ID NO: 3427489 - DNA, 15 bp, Homo sapiens
cgcggcggagctggc

SEQ ID NO: 3427490 - DNA, 21 bp, Homo sapiens
cgcggcggagctggccccgcc

SEQ ID NO: 3427491 - DNA, 15 bp, Homo sapiens
cgctacctccctccc

SEQ ID NO: 3427492 - DNA, 13 bp, Homo sapiens
cgctccagctgcc

SEQ ID NO: 3427493 - DNA, 15 bp, Homo sapiens
cgctccagctgcccc

SEQ ID NO: 3427494 - DNA, 15 bp, Homo sapiens
cgctccctcccagga

SEQ ID NO: 3427495 - DNA, 21 bp, Homo sapiens
cgctccctcccaggactctga

SEQ ID NO: 3427496 - DNA, 20 bp, Homo sapiens
cgctcctgccgcagagctgg

SEQ ID NO: 3427497 - DNA, 14 bp, Homo sapiens
cgctgagccacctg

SEQ ID NO: 3427498 - DNA, 19 bp, Homo sapiens
cgctgcaacctgttgatag

SEQ ID NO: 3427499 - DNA, 19 bp, Homo sapiens
cgctgccagctctgtatca

SEQ ID NO: 3427500 - DNA, 23 bp, Homo sapiens
cgctgccccatctcccctcagct

SEQ ID NO: 3427501 - DNA, 24 bp, Homo sapiens
cgctgccccatctcccctcagctc

SEQ ID NO: 3427502 - DNA, 15 bp, Homo sapiens
cgctgcccgctcagc

SEQ ID NO: 3427503 - DNA, 19 bp, Homo sapiens
cgctggaccttgaactggg

SEQ ID NO: 3427504 - DNA, 23 bp, Homo sapiens
cgctggaccttgaactgggtact

SEQ ID NO: 3427505 - DNA, 17 bp, Homo sapiens
cgctggagtgcagtgag

SEQ ID NO: 3427506 - DNA, 18 bp, Homo sapiens
cgctggagtgcagtgagc

SEQ ID NO: 3427507 - DNA, 16 bp, Homo sapiens
cgctgggcacttccct

SEQ ID NO: 3427508 - DNA, 18 bp, Homo sapiens
cgctgggcacttccctgc

SEQ ID NO: 3427509 - DNA, 19 bp, Homo sapiens
cgctgggcacttccctgct

SEQ ID NO: 3427510 - DNA, 20 bp, Homo sapiens
cgctgggcacttccctgctg

SEQ ID NO: 3427511 - DNA, 18 bp, Homo sapiens
cgctgggtattaccatgt

SEQ ID NO: 3427512 - DNA, 18 bp, Homo sapiens
cgctggtgaccctctgct

SEQ ID NO: 3427513 - DNA, 13 bp, Homo sapiens
cgctgttgctgaa

SEQ ID NO: 3427514 - DNA, 21 bp, Homo sapiens
cgctgtttttgttgtgtgtgc

SEQ ID NO: 3427515 - DNA, 13 bp, Homo sapiens
cgcttccccacag

SEQ ID NO: 3427516 - DNA, 18 bp, Homo sapiens
cctgtttttaagctgttt

SEQ ID NO: 3427517 - DNA, 14 bp, Homo sapiens
ccttaagccctggc

SEQ ID NO: 3427518 - DNA, 18 bp, Homo sapiens
ccttaagtccttaatgaa

SEQ ID NO: 3427519 - DNA, 18 bp, Homo sapiens
ccttaccgagagccaaac

SEQ ID NO: 3427520 - DNA, 14 bp, Homo sapiens
ccttagacctgagg

SEQ ID NO: 3427521 - DNA, 16 bp, Homo sapiens
ccttagccatgatctg

SEQ ID NO: 3427522 - DNA, 14 bp, Homo sapiens
ccttagcttcagga

SEQ ID NO: 3427523 - DNA, 19 bp, Homo sapiens
ccttagcttcaggaacctc

SEQ ID NO: 3427524 - DNA, 15 bp, Homo sapiens
ccttaggcagggaag

SEQ ID NO: 3427525 - DNA, 13 bp, Homo sapiens
ccttaggccttcc

SEQ ID NO: 3427526 - DNA, 15 bp, Homo sapiens
ccttaggccttcctc

SEQ ID NO: 3427527 - DNA, 23 bp, Homo sapiens
ccttaggccttcctctctccaga

SEQ ID NO: 3427528 - DNA, 22 bp, Homo sapiens
ccttatagtttgggcttcagcc

SEQ ID NO: 3427529 - DNA, 14 bp, Homo sapiens
ccttatcaggcaaa

SEQ ID NO: 3427530 - DNA, 16 bp, Homo sapiens
ccttatctccaagacc

SEQ ID NO: 3427531 - DNA, 22 bp, Homo sapiens
ccttatctccaagaccagagat

SEQ ID NO: 3427532 - DNA, 17 bp, Homo sapiens
ccttatctgtgctcagg

SEQ ID NO: 3427533 - DNA, 19 bp, Homo sapiens
ccttatgcttctttcaaat

SEQ ID NO: 3427534 - DNA, 15 bp, Homo sapiens
ccttattgtacctct

SEQ ID NO: 3427535 - DNA, 18 bp, Homo sapiens
ccttcacaaagcccaagg

SEQ ID NO: 3427536 - DNA, 10 bp, Homo sapiens
ccttcagaca

SEQ ID NO: 3427537 - DNA, 19 bp, Homo sapiens
ccttcagagccagccggct

SEQ ID NO: 3427538 - DNA, 14 bp, Homo sapiens
ccttcagccctcac

SEQ ID NO: 3427539 - DNA, 13 bp, Homo sapiens
ccttcagccttaa

SEQ ID NO: 3427540 - DNA, 18 bp, Homo sapiens
ccttcagctcacgcttca

SEQ ID NO: 3427541 - DNA, 22 bp, Homo sapiens
ccttcagtaacccccactggac

SEQ ID NO: 3427542 - DNA, 23 bp, Homo sapiens
ccttcatatgaaaggtgccatgg

SEQ ID NO: 3427543 - DNA, 17 bp, Homo sapiens
ccttcatcatgagttct

SEQ ID NO: 3427544 - DNA, 16 bp, Homo sapiens
ccttcatcttcctgtg

SEQ ID NO: 3427545 - DNA, 19 bp, Homo sapiens
ccttcatcttcctgtgtcc

SEQ ID NO: 3427546 - DNA, 21 bp, Homo sapiens
ccttcattgatttcctgtgtc

SEQ ID NO: 3427547 - DNA, 16 bp, Homo sapiens
ccttccaacaggagct

SEQ ID NO: 3427548 - DNA, 19 bp, Homo sapiens
ccttccaacaggagctggg

SEQ ID NO: 3427549 - DNA, 15 bp, Homo sapiens
ccttccactgagggc

SEQ ID NO: 3427550 - DNA, 13 bp, Homo sapiens
ccttccagcccag

SEQ ID NO: 3427551 - DNA, 14 bp, Homo sapiens
ccttccagcccaga

SEQ ID NO: 3427552 - DNA, 23 bp, Homo sapiens
ccttccagggatttgcctcacct

SEQ ID NO: 3427553 - DNA, 22 bp, Homo sapiens
ccttccagtgtccttagaacat

SEQ ID NO: 3427554 - DNA, 18 bp, Homo sapiens
ccttcccatgacccaggc

SEQ ID NO: 3427555 - DNA, 21 bp, Homo sapiens
ccttcccatgacccaggctgg

SEQ ID NO: 3427556 - DNA, 23 bp, Homo sapiens
ccttcccatgacccaggctgggc

SEQ ID NO: 3427557 - DNA, 24 bp, Homo sapiens
ccttccctcaccttggcaccagac

SEQ ID NO: 3427558 - DNA, 21 bp, Homo sapiens
ccttccgatgacagtgctcta

SEQ ID NO: 3427559 - DNA, 17 bp, Homo sapiens
ccttcctaagcctgtgg

SEQ ID NO: 3427560 - DNA, 21 bp, Homo sapiens
ccttcctattccaagcttcca

SEQ ID NO: 3427561 - DNA, 13 bp, Homo sapiens
ccttcctcctggg

SEQ ID NO: 3427562 - DNA, 17 bp, Homo sapiens
ccttcctctctccagat

SEQ ID NO: 3427563 - DNA, 20 bp, Homo sapiens
ccttcctggagactgcccag

SEQ ID NO: 3427564 - DNA, 16 bp, Homo sapiens
ccttcctggcctgaga

SEQ ID NO: 3427565 - DNA, 18 bp, Homo sapiens
ccttcgaaaggccttcag

SEQ ID NO: 3427566 - DNA, 19 bp, Homo sapiens
ccttcgaaaggccttcaga

SEQ ID NO: 3427567 - DNA, 19 bp, Homo sapiens
ccttcgcttcttgcctctg

SEQ ID NO: 3427568 - DNA, 21 bp, Homo sapiens
ccttcgcttcttgcctctgtg

SEQ ID NO: 3427569 - DNA, 23 bp, Homo sapiens
ccttcgcttcttgcctctgtgct

SEQ ID NO: 3427570 - DNA, 17 bp, Homo sapiens
ccttcgtttactatgcc

SEQ ID NO: 3427571 - DNA, 19 bp, Homo sapiens
ccttcgtttactatgcctg

SEQ ID NO: 3427572 - DNA, 22 bp, Homo sapiens
ccttcgtttactatgcctgtgt

SEQ ID NO: 3427573 - DNA, 23 bp, Homo sapiens
ccttcgtttactatgcctgtgtc

SEQ ID NO: 3427574 - DNA, 19 bp, Homo sapiens
ccttctcaccagctgcaaa

SEQ ID NO: 3427575 - DNA, 21 bp, Homo sapiens
ccttctcaccagctgcaaagt

SEQ ID NO: 3427576 - DNA, 13 bp, Homo sapiens
ccttctccatcca

SEQ ID NO: 3427577 - DNA, 22 bp, Homo sapiens
ccttctccatccacatgggagc

SEQ ID NO: 3427578 - DNA, 17 bp, Homo sapiens
ccttctcccctcttctg

SEQ ID NO: 3427579 - DNA, 17 bp, Homo sapiens
ccttctcctcttgtaaa

SEQ ID NO: 3427580 - DNA, 18 bp, Homo sapiens
ccttctctacccatctcc

SEQ ID NO: 3427581 - DNA, 14 bp, Homo sapiens
ccttctctcatctc

SEQ ID NO: 3427582 - DNA, 16 bp, Homo sapiens
ccttctctcatctctt

SEQ ID NO: 3427583 - DNA, 16 bp, Homo sapiens
ccttctgcggccagag

SEQ ID NO: 3427584 - DNA, 20 bp, Homo sapiens
ccttctggcctcccacagac

SEQ ID NO: 3427585 - DNA, 18 bp, Homo sapiens
ccttctgtccctcacagc

SEQ ID NO: 3427586 - DNA, 13 bp, Homo sapiens
ccttcttcagggc

SEQ ID NO: 3427587 - DNA, 18 bp, Homo sapiens
ccttcttcagggcctggt

SEQ ID NO: 3427588 - DNA, 18 bp, Homo sapiens
ccttgaagaactgcaggc

SEQ ID NO: 3427589 - DNA, 14 bp, Homo sapiens
ccttgaattgtcta

SEQ ID NO: 3427590 - DNA, 21 bp, Homo sapiens
ccttgacaactggcaggcagg

SEQ ID NO: 3427591 - DNA, 15 bp, Homo sapiens
ccttgacagggcaca

SEQ ID NO: 3427592 - DNA, 19 bp, Homo sapiens
ccttgacctgcattgtaaa

SEQ ID NO: 3427593 - DNA, 20 bp, Homo sapiens
ccttgactatgtctagagcc

SEQ ID NO: 3427594 - DNA, 16 bp, Homo sapiens
ccttgacttagattct

SEQ ID NO: 3427595 - DNA, 13 bp, Homo sapiens
ccttgactttgct

SEQ ID NO: 3427596 - DNA, 16 bp, Homo sapiens
ccttgagagaccaggc

SEQ ID NO: 3427597 - DNA, 18 bp, Homo sapiens
ccttgaggaaacaacagc

SEQ ID NO: 3427598 - DNA, 19 bp, Homo sapiens
ccttgatttaaacacacag

SEQ ID NO: 3427599 - DNA, 14 bp, Homo sapiens
ccttgcacatagta

SEQ ID NO: 3427600 - DNA, 19 bp, Homo sapiens
ccttgcagtgtaggaattc

SEQ ID NO: 3427601 - DNA, 15 bp, Homo sapiens
ccttgccagggaggt

SEQ ID NO: 3427602 - DNA, 22 bp, Homo sapiens
ccttgccagggaggtggaagga

SEQ ID NO: 3427603 - DNA, 12 bp, Homo sapiens
ccttggaggaca

SEQ ID NO: 3427604 - DNA, 23 bp, Homo sapiens
ccttggcaccagacacccaggac

SEQ ID NO: 3427605 - DNA, 23 bp, Homo sapiens
ccttggccttctcccctcttctg

SEQ ID NO: 3427606 - DNA, 12 bp, Homo sapiens
ccttggctgcag

SEQ ID NO: 3427607 - DNA, 16 bp, Homo sapiens
ccttggctgcagggag

SEQ ID NO: 3427608 - DNA, 13 bp, Homo sapiens
ccttggctggtgc

SEQ ID NO: 3427609 - DNA, 19 bp, Homo sapiens
ccttggctttatgcacatt

SEQ ID NO: 3427610 - DNA, 14 bp, Homo sapiens
ccttgggagccact

SEQ ID NO: 3427611 - DNA, 15 bp, Homo sapiens
ccttgggagccactg

SEQ ID NO: 3427612 - DNA, 16 bp, Homo sapiens
ccttgggagccactgc

SEQ ID NO: 3427613 - DNA, 21 bp, Homo sapiens
ccttgggagccactgccactc

SEQ ID NO: 3427614 - DNA, 15 bp, Homo sapiens
ccttgggaggcccca

SEQ ID NO: 3427615 - DNA, 19 bp, Homo sapiens
ccttgggaggccccactgg

SEQ ID NO: 3427616 - DNA, 13 bp, Homo sapiens
ccttgggctccct

SEQ ID NO: 3427617 - DNA, 15 bp, Homo sapiens
ccttggggcaggcag

SEQ ID NO: 3427618 - DNA, 16 bp, Homo sapiens
ccttggggcaggcagt

SEQ ID NO: 3427619 - DNA, 16 bp, Homo sapiens
ccttggttcccccact

SEQ ID NO: 3427620 - DNA, 22 bp, Homo sapiens
ccttgtggcctgggcctcctca

SEQ ID NO: 3427621 - DNA, 15 bp, Homo sapiens
ccttgttacttctga

SEQ ID NO: 3427622 - DNA, 19 bp, Homo sapiens
ccttgttacttctgaggta

SEQ ID NO: 3427623 - DNA, 15 bp, Homo sapiens
cctttaactgagggc

SEQ ID NO: 3427624 - DNA, 24 bp, Homo sapiens
cctttaactgagggctgatcttta

SEQ ID NO: 3427625 - DNA, 21 bp, Homo sapiens
cctttaagcctgcattcttaa

SEQ ID NO: 3427626 - DNA, 13 bp, Homo sapiens
cctttaatgcatc

SEQ ID NO: 3427627 - DNA, 14 bp, Homo sapiens
cctttaattcaggt

SEQ ID NO: 3427628 - DNA, 19 bp, Homo sapiens
cctttaccctctttgctgc

SEQ ID NO: 3427629 - DNA, 21 bp, Homo sapiens
cctttaccctctttgctgcag

SEQ ID NO: 3427630 - DNA, 18 bp, Homo sapiens
cctttagggttctgcctc

SEQ ID NO: 3427631 - DNA, 22 bp, Homo sapiens
cctttatcacctcattctgaac

SEQ ID NO: 3427632 - DNA, 23 bp, Homo sapiens
cctttattaccccctccttcaga

SEQ ID NO: 3427633 - DNA, 12 bp, Homo sapiens
cctttattgtgt

SEQ ID NO: 3427634 - DNA, 16 bp, Homo sapiens
cctttcaaatttagaa

SEQ ID NO: 3427635 - DNA, 22 bp, Homo sapiens
cctttcacaaaattttattcct

SEQ ID NO: 3427636 - DNA, 21 bp, Homo sapiens
cctttcaccccagggcctgag

SEQ ID NO: 3427637 - DNA, 13 bp, Homo sapiens
cctttccaaagag

SEQ ID NO: 3427638 - DNA, 11 bp, Homo sapiens
cctttcctgtc

SEQ ID NO: 3427639 - DNA, 15 bp, Homo sapiens
cctttctcccctgcc

SEQ ID NO: 3427640 - DNA, 13 bp, Homo sapiens
cctttgaatgtaa

SEQ ID NO: 3427641 - DNA, 17 bp, Homo sapiens
cctttgagaatacaaga

SEQ ID NO: 3427642 - DNA, 22 bp, Homo sapiens
cctttggaaacaacatttaagg

SEQ ID NO: 3427643 - DNA, 20 bp, Homo sapiens
cctttggagatgctgagggt

SEQ ID NO: 3427644 - DNA, 17 bp, Homo sapiens
cctttggtttggcctcc

SEQ ID NO: 3427645 - DNA, 18 bp, Homo sapiens
cctttggtttggcctcca

SEQ ID NO: 3427646 - DNA, 17 bp, Homo sapiens
cctttgtacagcccaga

SEQ ID NO: 3427647 - DNA, 16 bp, Homo sapiens
cctttgtagcactcag

SEQ ID NO: 3427648 - DNA, 18 bp, Homo sapiens
cctttgtcatctttcttc

SEQ ID NO: 3427649 - DNA, 23 bp, Homo sapiens
cctttgtcatctttcttctattt

SEQ ID NO: 3427650 - DNA, 16 bp, Homo sapiens
cctttgtgctctatag

SEQ ID NO: 3427651 - DNA, 16 bp, Homo sapiens
cctttgtgtgtgtgtc

SEQ ID NO: 3427652 - DNA, 19 bp, Homo sapiens
cctggacttggcccctgcc

SEQ ID NO: 3427653 - DNA, 13 bp, Homo sapiens
cctggagatcctc

SEQ ID NO: 3427654 - DNA, 17 bp, Homo sapiens
cctggagatcctcctgc

SEQ ID NO: 3427655 - DNA, 20 bp, Homo sapiens
cctggagcaatcacagatga

SEQ ID NO: 3427656 - DNA, 14 bp, Homo sapiens
cctggagcccagag

SEQ ID NO: 3427657 - DNA, 13 bp, Homo sapiens
cctggaggcccag

SEQ ID NO: 3427658 - DNA, 21 bp, Homo sapiens
cctggaggctgcctcccaaca

SEQ ID NO: 3427659 - DNA, 22 bp, Homo sapiens
cctggatgggcctttgagcctg

SEQ ID NO: 3427660 - DNA, 17 bp, Homo sapiens
cctggatgtctgaactt

SEQ ID NO: 3427661 - DNA, 17 bp, Homo sapiens
cctggatgttgtgtgta

SEQ ID NO: 3427662 - DNA, 13 bp, Homo sapiens
cctggcagctctg

SEQ ID NO: 3427663 - DNA, 19 bp, Homo sapiens
cctggcagctctggacagc

SEQ ID NO: 3427664 - DNA, 20 bp, Homo sapiens
cctggcagctctggacagcc

SEQ ID NO: 3427665 - DNA, 21 bp, Homo sapiens
cctggcagctctggacagccc

SEQ ID NO: 3427666 - DNA, 21 bp, Homo sapiens
cctggcaggctgtctggccag

SEQ ID NO: 3427667 - DNA, 22 bp, Homo sapiens
cctggcagggtcatcctgtgct

SEQ ID NO: 3427668 - DNA, 12 bp, Homo sapiens
cctggccagaca

SEQ ID NO: 3427669 - DNA, 14 bp, Homo sapiens
cctggccagacaca

SEQ ID NO: 3427670 - DNA, 16 bp, Homo sapiens
cctggccagacacagg

SEQ ID NO: 3427671 - DNA, 23 bp, Homo sapiens
cctggccagggcctggaagacag

SEQ ID NO: 3427672 - DNA, 14 bp, Homo sapiens
cctggccatcccac

SEQ ID NO: 3427673 - DNA, 15 bp, Homo sapiens
cctggccatcccaca

SEQ ID NO: 3427674 - DNA, 17 bp, Homo sapiens
cctggccatcccacaag

SEQ ID NO: 3427675 - DNA, 19 bp, Homo sapiens
cctggccatcccacaagtg

SEQ ID NO: 3427676 - DNA, 14 bp, Homo sapiens
cctggcccactgca

SEQ ID NO: 3427677 - DNA, 15 bp, Homo sapiens
cctggccccgcctgc

SEQ ID NO: 3427678 - DNA, 18 bp, Homo sapiens
cctggccgagtccaagct

SEQ ID NO: 3427679 - DNA, 15 bp, Homo sapiens
cctggccgcctccag

SEQ ID NO: 3427680 - DNA, 16 bp, Homo sapiens
cctggccgcctccagg

SEQ ID NO: 3427681 - DNA, 17 bp, Homo sapiens
cctggccgcctccagga

SEQ ID NO: 3427682 - DNA, 20 bp, Homo sapiens
cctggccgcctccaggagcc

SEQ ID NO: 3427683 - DNA, 14 bp, Homo sapiens
cctggccggctcca

SEQ ID NO: 3427684 - DNA, 17 bp, Homo sapiens
cctggcctcccctgcca

SEQ ID NO: 3427685 - DNA, 18 bp, Homo sapiens
cctggcctcccctgccac

SEQ ID NO: 3427686 - DNA, 19 bp, Homo sapiens
cctggcctcccctgccacc

SEQ ID NO: 3427687 - DNA, 16 bp, Homo sapiens
cctggcctgagagtca

SEQ ID NO: 3427688 - DNA, 14 bp, Homo sapiens
cctggctccagtga

SEQ ID NO: 3427689 - DNA, 12 bp, Homo sapiens
cctggctccttc

SEQ ID NO: 3427690 - DNA, 20 bp, Homo sapiens
cctggctctgaccgaaacag

SEQ ID NO: 3427691 - DNA, 20 bp, Homo sapiens
cctggctgggacgtggctca

SEQ ID NO: 3427692 - DNA, 21 bp, Homo sapiens
cctggctgggacgtggctcag

SEQ ID NO: 3427693 - DNA, 22 bp, Homo sapiens
cctggctgggacgtggctcagc

SEQ ID NO: 3427694 - DNA, 24 bp, Homo sapiens
cctggctgggacgtggctcagcca

SEQ ID NO: 3427695 - DNA, 22 bp, Homo sapiens
cctggcttctgtggggcccctc

SEQ ID NO: 3427696 - DNA, 22 bp, Homo sapiens
cctgggaggtcaaggctgcagt

SEQ ID NO: 3427697 - DNA, 21 bp, Homo sapiens
cctgggatgagagttttggat

SEQ ID NO: 3427698 - DNA, 15 bp, Homo sapiens
cctgggccctgggct

SEQ ID NO: 3427699 - DNA, 12 bp, Homo sapiens
cctgggcctgca

SEQ ID NO: 3427700 - DNA, 22 bp, Homo sapiens
cctgggctgagagaacctcacg

SEQ ID NO: 3427701 - DNA, 12 bp, Homo sapiens
cctggggaagga

SEQ ID NO: 3427702 - DNA, 12 bp, Homo sapiens
cctggggaccca

SEQ ID NO: 3427703 - DNA, 15 bp, Homo sapiens
cctggggagaaagta

SEQ ID NO: 3427704 - DNA, 14 bp, Homo sapiens
cctggggcctgact

SEQ ID NO: 3427705 - DNA, 17 bp, Homo sapiens
cctggggcctgactgct

SEQ ID NO: 3427706 - DNA, 18 bp, Homo sapiens
cctggggcctgactgctc

SEQ ID NO: 3427707 - DNA, 15 bp, Homo sapiens
cctggggctgctggc

SEQ ID NO: 3427708 - DNA, 17 bp, Homo sapiens
cctggggctgctggcct

SEQ ID NO: 3427709 - DNA, 15 bp, Homo sapiens
cctggggctggcctc

SEQ ID NO: 3427710 - DNA, 16 bp, Homo sapiens
cctggggctggcctcc

SEQ ID NO: 3427711 - DNA, 19 bp, Homo sapiens
cctggggctggcctcccaa

SEQ ID NO: 3427712 - DNA, 12 bp, Homo sapiens
cctgggggctct

SEQ ID NO: 3427713 - DNA, 14 bp, Homo sapiens
cctgggggctctca

SEQ ID NO: 3427714 - DNA, 12 bp, Homo sapiens
cctggggggcag

SEQ ID NO: 3427715 - DNA, 22 bp, Homo sapiens
cctgggtaaatgcagcgtgaag

SEQ ID NO: 3427716 - DNA, 16 bp, Homo sapiens
cctgggtttaagggga

SEQ ID NO: 3427717 - DNA, 12 bp, Homo sapiens
cctgggttttgt

SEQ ID NO: 3427718 - DNA, 21 bp, Homo sapiens
cctgggttttgtattctctga

SEQ ID NO: 3427719 - DNA, 19 bp, Homo sapiens
cctggtactcaagcccgcg

SEQ ID NO: 3427720 - DNA, 19 bp, Homo sapiens
cctggtaggagtgtgtgat

SEQ ID NO: 3427721 - DNA, 15 bp, Homo sapiens
cctggtcctggcctc

SEQ ID NO: 3427722 - DNA, 17 bp, Homo sapiens
cctggtcctggcctcct

SEQ ID NO: 3427723 - DNA, 13 bp, Homo sapiens
cctggtgctgctg

SEQ ID NO: 3427724 - DNA, 18 bp, Homo sapiens
cctggtggcagctgcggt

SEQ ID NO: 3427725 - DNA, 13 bp, Homo sapiens
cctggtggcagtg

SEQ ID NO: 3427726 - DNA, 15 bp, Homo sapiens
cctggtggcagtggg

SEQ ID NO: 3427727 - DNA, 16 bp, Homo sapiens
cctgtaatcccagcac

SEQ ID NO: 3427728 - DNA, 17 bp, Homo sapiens
cctgtaatcccagcact

SEQ ID NO: 3427729 - DNA, 23 bp, Homo sapiens
cctgtaatcccagcactttggga

SEQ ID NO: 3427730 - DNA, 20 bp, Homo sapiens
cctgtaatcctagcactttg

SEQ ID NO: 3427731 - DNA, 20 bp, Homo sapiens
cctgtacagtagattttcca

SEQ ID NO: 3427732 - DNA, 21 bp, Homo sapiens
cctgtacagtagattttccaa

SEQ ID NO: 3427733 - DNA, 12 bp, Homo sapiens
cctgtacttttt

SEQ ID NO: 3427734 - DNA, 21 bp, Homo sapiens
cctgtagagtgggagctgagt

SEQ ID NO: 3427735 - DNA, 23 bp, Homo sapiens
cctgtagagtgggagctgagtgg

SEQ ID NO: 3427736 - DNA, 22 bp, Homo sapiens
cctgtagcccactctgctcgcc

SEQ ID NO: 3427737 - DNA, 18 bp, Homo sapiens
cctgtaggatttttttct

SEQ ID NO: 3427738 - DNA, 16 bp, Homo sapiens
cctgtataagtggagg

SEQ ID NO: 3427739 - DNA, 18 bp, Homo sapiens
cctgtatgtctgtcattg

SEQ ID NO: 3427740 - DNA, 15 bp, Homo sapiens
cctgtattcagacag

SEQ ID NO: 3427741 - DNA, 22 bp, Homo sapiens
cctgtcaaacaaagccagaagc

SEQ ID NO: 3427742 - DNA, 23 bp, Homo sapiens
cctgtcaaacaaagccagaagct

SEQ ID NO: 3427743 - DNA, 12 bp, Homo sapiens
cctgtcacctct

SEQ ID NO: 3427744 - DNA, 19 bp, Homo sapiens
cctgtccagctccaacctg

SEQ ID NO: 3427745 - DNA, 15 bp, Homo sapiens
cctgtccccatctgt

SEQ ID NO: 3427746 - DNA, 21 bp, Homo sapiens
cctgtccccatctgtcggcct

SEQ ID NO: 3427747 - DNA, 13 bp, Homo sapiens
cctgtccctgcgc

SEQ ID NO: 3427748 - DNA, 22 bp, Homo sapiens
cctgtcctccaacaccaagcac

SEQ ID NO: 3427749 - DNA, 13 bp, Homo sapiens
cctgtcctgaaag

SEQ ID NO: 3427750 - DNA, 14 bp, Homo sapiens
cctgtcctgaaagc

SEQ ID NO: 3427751 - DNA, 21 bp, Homo sapiens
cctgtcctgaaagcggctgcc

SEQ ID NO: 3427752 - DNA, 16 bp, Homo sapiens
cctgtctagagaggga

SEQ ID NO: 3427753 - DNA, 14 bp, Homo sapiens
cctgtctcggggct

SEQ ID NO: 3427754 - DNA, 15 bp, Homo sapiens
cctgtcttcctctgc

SEQ ID NO: 3427755 - DNA, 19 bp, Homo sapiens
cctgtcttcctctgcaagt

SEQ ID NO: 3427756 - DNA, 13 bp, Homo sapiens
cctgtctttccta

SEQ ID NO: 3427757 - DNA, 20 bp, Homo sapiens
cctgtctttcctaagacctg

SEQ ID NO: 3427758 - DNA, 17 bp, Homo sapiens
cctgtgaatgccactgc

SEQ ID NO: 3427759 - DNA, 15 bp, Homo sapiens
cctgtgagcccagct

SEQ ID NO: 3427760 - DNA, 17 bp, Homo sapiens
cctgtgatacatttctg

SEQ ID NO: 3427761 - DNA, 18 bp, Homo sapiens
cctgtgcagccgctgagc

SEQ ID NO: 3427762 - DNA, 20 bp, Homo sapiens
cctgtgcagccgctgagcga

SEQ ID NO: 3427763 - DNA, 16 bp, Homo sapiens
cctgtgccctccttcc

SEQ ID NO: 3427764 - DNA, 17 bp, Homo sapiens
cctgtgccctccttccc

SEQ ID NO: 3427765 - DNA, 21 bp, Homo sapiens
cctgtgccctccttcccaatc

SEQ ID NO: 3427766 - DNA, 16 bp, Homo sapiens
cctgtggccccaccct

SEQ ID NO: 3427767 - DNA, 17 bp, Homo sapiens
cctgtggccccaccctg

SEQ ID NO: 3427768 - DNA, 18 bp, Homo sapiens
cctgtggccccaccctgg

SEQ ID NO: 3427769 - DNA, 20 bp, Homo sapiens
cctgtggccccaccctgggc

SEQ ID NO: 3427770 - DNA, 22 bp, Homo sapiens
cctgtggccctgtcctgccatg

SEQ ID NO: 3427771 - DNA, 21 bp, Homo sapiens
cctgtggcgccgtctccaggg

SEQ ID NO: 3427772 - DNA, 22 bp, Homo sapiens
cctgtggcgccgtctccagggg

SEQ ID NO: 3427773 - DNA, 16 bp, Homo sapiens
cctgtggctgtggaga

SEQ ID NO: 3427774 - DNA, 19 bp, Homo sapiens
cctgtgtcttgcaatggca

SEQ ID NO: 3427775 - DNA, 14 bp, Homo sapiens
cctgtgtgattgac

SEQ ID NO: 3427776 - DNA, 15 bp, Homo sapiens
cctgtgtgcttggtc

SEQ ID NO: 3427777 - DNA, 23 bp, Homo sapiens
cctgtgtggccacttctgtccat

SEQ ID NO: 3427778 - DNA, 20 bp, Homo sapiens
cctgtgtgtccaaaactgcc

SEQ ID NO: 3427779 - DNA, 21 bp, Homo sapiens
cctgttaacgtcatctcaggg

SEQ ID NO: 3427780 - DNA, 15 bp, Homo sapiens
cctgttagcagacag

SEQ ID NO: 3427781 - DNA, 13 bp, Homo sapiens
cctgttcagctcc

SEQ ID NO: 3427782 - DNA, 20 bp, Homo sapiens
cctgttcagctccagctcac

SEQ ID NO: 3427783 - DNA, 23 bp, Homo sapiens
cctgttcagctccagctcaccag

SEQ ID NO: 3427784 - DNA, 23 bp, Homo sapiens
cctgttccccagagaaaggggag

SEQ ID NO: 3427785 - DNA, 22 bp, Homo sapiens
cctgttgaattttgttctctgg

SEQ ID NO: 3427786 - DNA, 13 bp, Homo sapiens
cctgttgctaagc

SEQ ID NO: 3427787 - DNA, 20 bp, Homo sapiens
cctgttttagaaggttctct

SEQ ID NO: 3427788 - DNA, 15 bp, Homo sapiens
cctcttttacctgct

SEQ ID NO: 3427789 - DNA, 21 bp, Homo sapiens
cctcttttacctgctgcttct

SEQ ID NO: 3427790 - DNA, 17 bp, Homo sapiens
cctgaaacgctcctttg

SEQ ID NO: 3427791 - DNA, 18 bp, Homo sapiens
cctgaaagtgacagagac

SEQ ID NO: 3427792 - DNA, 23 bp, Homo sapiens
cctgaaagtgacagagacccaga

SEQ ID NO: 3427793 - DNA, 14 bp, Homo sapiens
cctgaacagaagct

SEQ ID NO: 3427794 - DNA, 14 bp, Homo sapiens
cctgaagaacagta

SEQ ID NO: 3427795 - DNA, 16 bp, Homo sapiens
cctgaagaaccagtcc

SEQ ID NO: 3427796 - DNA, 17 bp, Homo sapiens
cctgaagaaccagtccc

SEQ ID NO: 3427797 - DNA, 21 bp, Homo sapiens
cctgaagactcattcttctgt

SEQ ID NO: 3427798 - DNA, 14 bp, Homo sapiens
cctgaagccagctg

SEQ ID NO: 3427799 - DNA, 20 bp, Homo sapiens
cctgaaggggccatgatggc

SEQ ID NO: 3427800 - DNA, 17 bp, Homo sapiens
cctgaagtcacacagtg

SEQ ID NO: 3427801 - DNA, 17 bp, Homo sapiens
cctgacaaggccagcac

SEQ ID NO: 3427802 - DNA, 13 bp, Homo sapiens
cctgacaggctgt

SEQ ID NO: 3427803 - DNA, 17 bp, Homo sapiens
cctgacagtgtgggaca

SEQ ID NO: 3427804 - DNA, 21 bp, Homo sapiens
cctgacagtgtgggacaggct

SEQ ID NO: 3427805 - DNA, 22 bp, Homo sapiens
cctgacagtgtgggacaggctc

SEQ ID NO: 3427806 - DNA, 23 bp, Homo sapiens
cctgacagtgtgggacaggctct

SEQ ID NO: 3427807 - DNA, 20 bp, Homo sapiens
cctgaccacgctttctagct

SEQ ID NO: 3427808 - DNA, 19 bp, Homo sapiens
cctgaccctgtatatagcc

SEQ ID NO: 3427809 - DNA, 14 bp, Homo sapiens
cctgacctgtgagc

SEQ ID NO: 3427810 - DNA, 19 bp, Homo sapiens
cctgactagggagccatgt

SEQ ID NO: 3427811 - DNA, 19 bp, Homo sapiens
cctgactctcacctgtact

SEQ ID NO: 3427812 - DNA, 22 bp, Homo sapiens
cctgactgcccagcatttgggt

SEQ ID NO: 3427813 - DNA, 22 bp, Homo sapiens
cctgagagtcagctctctgccc

SEQ ID NO: 3427814 - DNA, 11 bp, Homo sapiens
cctgagatttc

SEQ ID NO: 3427815 - DNA, 15 bp, Homo sapiens
cctgagatttcatct

SEQ ID NO: 3427816 - DNA, 18 bp, Homo sapiens
cctgagatttcatctgct

SEQ ID NO: 3427817 - DNA, 22 bp, Homo sapiens
cctgagatttcatctgctctcc

SEQ ID NO: 3427818 - DNA, 15 bp, Homo sapiens
cctgagcaactcttg

SEQ ID NO: 3427819 - DNA, 18 bp, Homo sapiens
cctgagcaactcttgatt

SEQ ID NO: 3427820 - DNA, 16 bp, Homo sapiens
cctgagcgctcctgcc

SEQ ID NO: 3427821 - DNA, 23 bp, Homo sapiens
cctgagcgctcctgccgcagagc

SEQ ID NO: 3427822 - DNA, 17 bp, Homo sapiens
cctgagctgaccagccg

SEQ ID NO: 3427823 - DNA, 12 bp, Homo sapiens
cctgagctgctt

SEQ ID NO: 3427824 - DNA, 20 bp, Homo sapiens
cctgaggatgggtcagagct

SEQ ID NO: 3427825 - DNA, 15 bp, Homo sapiens
cctgaggctgtggtc

SEQ ID NO: 3427826 - DNA, 16 bp, Homo sapiens
cctgaggctgtggtca

SEQ ID NO: 3427827 - DNA, 22 bp, Homo sapiens
cctgaggctttggatttgacat

SEQ ID NO: 3427828 - DNA, 15 bp, Homo sapiens
cctgaggtcactgct

SEQ ID NO: 3427829 - DNA, 16 bp, Homo sapiens
cctgaggtcactgcta

SEQ ID NO: 3427830 - DNA, 17 bp, Homo sapiens
cctgaggtcactgctag

SEQ ID NO: 3427831 - DNA, 20 bp, Homo sapiens
cctgagtagaaaggccttta

SEQ ID NO: 3427832 - DNA, 13 bp, Homo sapiens
cctgatcctggag

SEQ ID NO: 3427833 - DNA, 18 bp, Homo sapiens
cctgatcctggaggccca

SEQ ID NO: 3427834 - DNA, 13 bp, Homo sapiens
cctgatgctgaca

SEQ ID NO: 3427835 - DNA, 21 bp, Homo sapiens
cctgatgctgacattcacctg

SEQ ID NO: 3427836 - DNA, 17 bp, Homo sapiens
cctgatggacctgtcac

SEQ ID NO: 3427837 - DNA, 20 bp, Homo sapiens
cctgatggcaggatggcctg

SEQ ID NO: 3427838 - DNA, 17 bp, Homo sapiens
cctgattgccaagctca

SEQ ID NO: 3427839 - DNA, 21 bp, Homo sapiens
cctgatttaggagaagccagg

SEQ ID NO: 3427840 - DNA, 19 bp, Homo sapiens
cctgcaaacgctgcctgcc

SEQ ID NO: 3427841 - DNA, 18 bp, Homo sapiens
cctgcacttgcagactct

SEQ ID NO: 3427842 - DNA, 16 bp, Homo sapiens
cctgcagaatttgggt

SEQ ID NO: 3427843 - DNA, 17 bp, Homo sapiens
cctgcagagcacacagg

SEQ ID NO: 3427844 - DNA, 13 bp, Homo sapiens
cctgcagccagct

SEQ ID NO: 3427845 - DNA, 13 bp, Homo sapiens
cctgcagcttatt

SEQ ID NO: 3427846 - DNA, 19 bp, Homo sapiens
cctgcaggacctgcctgta

SEQ ID NO: 3427847 - DNA, 20 bp, Homo sapiens
cctgcaggacctgcctgtag

SEQ ID NO: 3427848 - DNA, 22 bp, Homo sapiens
cctgcatgtaaacacgcctgca

SEQ ID NO: 3427849 - DNA, 14 bp, Homo sapiens
cctgcattgtaaat

SEQ ID NO: 3427850 - DNA, 12 bp, Homo sapiens
cctgccacagcc

SEQ ID NO: 3427851 - DNA, 17 bp, Homo sapiens
cctgccaccaccctgtc

SEQ ID NO: 3427852 - DNA, 20 bp, Homo sapiens
cctgccaccaccctgtcttc

SEQ ID NO: 3427853 - DNA, 21 bp, Homo sapiens
cctgccaccaccctgtcttcc

SEQ ID NO: 3427854 - DNA, 22 bp, Homo sapiens
cctgccaccaccctgtcttcct

SEQ ID NO: 3427855 - DNA, 15 bp, Homo sapiens
cctgccaccctgggc

SEQ ID NO: 3427856 - DNA, 21 bp, Homo sapiens
cctgccaccctgggcctggca

SEQ ID NO: 3427857 - DNA, 24 bp, Homo sapiens
cctgccaccctgggcctggcagct

SEQ ID NO: 3427858 - DNA, 15 bp, Homo sapiens
cctgccactcactag

SEQ ID NO: 3427859 - DNA, 15 bp, Homo sapiens
cctgccagagcaggg

SEQ ID NO: 3427860 - DNA, 13 bp, Homo sapiens
cctgccagctgca

SEQ ID NO: 3427861 - DNA, 14 bp, Homo sapiens
cctgccagctgcac

SEQ ID NO: 3427862 - DNA, 13 bp, Homo sapiens
cctgccagggcag

SEQ ID NO: 3427863 - DNA, 18 bp, Homo sapiens
cctgccatagccaggagc

SEQ ID NO: 3427864 - DNA, 14 bp, Homo sapiens
cctgcccacacagg

SEQ ID NO: 3427865 - DNA, 22 bp, Homo sapiens
cctgcccacacaggttcacgtg

SEQ ID NO: 3427866 - DNA, 13 bp, Homo sapiens
cctgcccacctgt

SEQ ID NO: 3427867 - DNA, 16 bp, Homo sapiens
cctgcccaggcccctg

SEQ ID NO: 3427868 - DNA, 21 bp, Homo sapiens
cctgcccaggcccctgccacc

SEQ ID NO: 3427869 - DNA, 20 bp, Homo sapiens
cctgccccaatccctttatt

SEQ ID NO: 3427870 - DNA, 12 bp, Homo sapiens
cctgcccccagg

SEQ ID NO: 3427871 - DNA, 19 bp, Homo sapiens
cctgcccccaggactgggc

SEQ ID NO: 3427872 - DNA, 14 bp, Homo sapiens
cctgcccctcccag

SEQ ID NO: 3427873 - DNA, 19 bp, Homo sapiens
cctgcccgcagacctctgg

SEQ ID NO: 3427874 - DNA, 20 bp, Homo sapiens
cctgcccgcagacctctgga

SEQ ID NO: 3427875 - DNA, 14 bp, Homo sapiens
cctgcccggctgcg

SEQ ID NO: 3427876 - DNA, 16 bp, Homo sapiens
cctgcccggctgcgga

SEQ ID NO: 3427877 - DNA, 15 bp, Homo sapiens
cctgcccgtaaacac

SEQ ID NO: 3427878 - DNA, 16 bp, Homo sapiens
cctgcccgtgtacata

SEQ ID NO: 3427879 - DNA, 18 bp, Homo sapiens
cctgccctcacctccctt

SEQ ID NO: 3427880 - DNA, 15 bp, Homo sapiens
cctgcccttgtccca

SEQ ID NO: 3427881 - DNA, 19 bp, Homo sapiens
cctgcccttgtcccactca

SEQ ID NO: 3427882 - DNA, 16 bp, Homo sapiens
cctgccgcagagctgg

SEQ ID NO: 3427883 - DNA, 17 bp, Homo sapiens
cctgccgcagagctggc

SEQ ID NO: 3427884 - DNA, 21 bp, Homo sapiens
cctgccggtaaacacgcctgc

SEQ ID NO: 3427885 - DNA, 19 bp, Homo sapiens
cctgcctcagcctcccgag

SEQ ID NO: 3427886 - DNA, 12 bp, Homo sapiens
cctgcctcagga

SEQ ID NO: 3427887 - DNA, 12 bp, Homo sapiens
cctgcctccagg

SEQ ID NO: 3427888 - DNA, 16 bp, Homo sapiens
cctgcctccagggctg

SEQ ID NO: 3427889 - DNA, 11 bp, Homo sapiens
cctgcctccta

SEQ ID NO: 3427890 - DNA, 19 bp, Homo sapiens
cctgcctcgaactggctgc

SEQ ID NO: 3427891 - DNA, 13 bp, Homo sapiens
cctgcctgccacc

SEQ ID NO: 3427892 - DNA, 15 bp, Homo sapiens
cctgcctgtctgccc

SEQ ID NO: 3427893 - DNA, 16 bp, Homo sapiens
cctgcctgtctgcccc

SEQ ID NO: 3427894 - DNA, 16 bp, Homo sapiens
cctgccttcctcctgg

SEQ ID NO: 3427895 - DNA, 17 bp, Homo sapiens
cctgcgccagtcctgct

SEQ ID NO: 3427896 - DNA, 20 bp, Homo sapiens
cctgcgcccagtccttccac

SEQ ID NO: 3427897 - DNA, 15 bp, Homo sapiens
cctgcgcctgctgca

SEQ ID NO: 3427898 - DNA, 20 bp, Homo sapiens
cctgcggcaggactgcagag

SEQ ID NO: 3427899 - DNA, 24 bp, Homo sapiens
cctgcgggtgaacaaagcagccac

SEQ ID NO: 3427900 - DNA, 21 bp, Homo sapiens
cctgcgggtggggcttggggc

SEQ ID NO: 3427901 - DNA, 14 bp, Homo sapiens
cctgcgtcagcccc

SEQ ID NO: 3427902 - DNA, 21 bp, Homo sapiens
cctgctaattccccagattgc

SEQ ID NO: 3427903 - DNA, 15 bp, Homo sapiens
cctgctagctagctc

SEQ ID NO: 3427904 - DNA, 23 bp, Homo sapiens
cctgctagctagctcaactagtg

SEQ ID NO: 3427905 - DNA, 12 bp, Homo sapiens
cctgctccagac

SEQ ID NO: 3427906 - DNA, 22 bp, Homo sapiens
cctgctccagacctgatcctgg

SEQ ID NO: 3427907 - DNA, 14 bp, Homo sapiens
cctgctccagctgt

SEQ ID NO: 3427908 - DNA, 21 bp, Homo sapiens
cctgctctccgaccagacacc

SEQ ID NO: 3427909 - DNA, 13 bp, Homo sapiens
cctgctgcatgcc

SEQ ID NO: 3427910 - DNA, 18 bp, Homo sapiens
cctgctgctgcctgcctg

SEQ ID NO: 3427911 - DNA, 20 bp, Homo sapiens
cctgctgctgtcacctctcc

SEQ ID NO: 3427912 - DNA, 12 bp, Homo sapiens
cctgctggaagc

SEQ ID NO: 3427913 - DNA, 16 bp, Homo sapiens
cctgctggaagcccag

SEQ ID NO: 3427914 - DNA, 12 bp, Homo sapiens
cctgctggaggc

SEQ ID NO: 3427915 - DNA, 15 bp, Homo sapiens
cctgctggaggcctc

SEQ ID NO: 3427916 - DNA, 15 bp, Homo sapiens
cctgcttaaaaatgt

SEQ ID NO: 3427917 - DNA, 22 bp, Homo sapiens
cctggaacatcatcaaggcact

SEQ ID NO: 3427918 - DNA, 16 bp, Homo sapiens
cctggaacttggggag

SEQ ID NO: 3427919 - DNA, 17 bp, Homo sapiens
cctggaacttggggagt

SEQ ID NO: 3427920 - DNA, 14 bp, Homo sapiens
cctggaagacagag

SEQ ID NO: 3427921 - DNA, 20 bp, Homo sapiens
cctggacacaggcctgctct

SEQ ID NO: 3427922 - DNA, 13 bp, Homo sapiens
cctggacatgcct

SEQ ID NO: 3427923 - DNA, 20 bp, Homo sapiens
cctggacatgcctgtcctga

SEQ ID NO: 3427924 - DNA, 13 bp, Homo sapiens
cctggaccctgtg

SEQ ID NO: 3427925 - DNA, 21 bp, Homo sapiens
cctccagggctggactgaggc

SEQ ID NO: 3427926 - DNA, 23 bp, Homo sapiens
cctccagggctggactgaggcct

SEQ ID NO: 3427927 - DNA, 17 bp, Homo sapiens
cctccagggtgtgtgct

SEQ ID NO: 3427928 - DNA, 19 bp, Homo sapiens
cctccatattttctttaaa

SEQ ID NO: 3427929 - DNA, 18 bp, Homo sapiens
cctccatcctcatctctc

SEQ ID NO: 3427930 - DNA, 12 bp, Homo sapiens
cctccatgtggg

SEQ ID NO: 3427931 - DNA, 16 bp, Homo sapiens
cctccattatccattc

SEQ ID NO: 3427932 - DNA, 16 bp, Homo sapiens
cctcccaaccccaggg

SEQ ID NO: 3427933 - DNA, 16 bp, Homo sapiens
cctcccacactcccaa

SEQ ID NO: 3427934 - DNA, 19 bp, Homo sapiens
cctcccacactcccaaggt

SEQ ID NO: 3427935 - DNA, 13 bp, Homo sapiens
cctccccagcctg

SEQ ID NO: 3427936 - DNA, 14 bp, Homo sapiens
cctccccagcctgc

SEQ ID NO: 3427937 - DNA, 15 bp, Homo sapiens
cctccccagcctgcg

SEQ ID NO: 3427938 - DNA, 16 bp, Homo sapiens
cctccccagcctgcgc

SEQ ID NO: 3427939 - DNA, 21 bp, Homo sapiens
cctccccattcagacacttca

SEQ ID NO: 3427940 - DNA, 16 bp, Homo sapiens
cctccccgcccttttt

SEQ ID NO: 3427941 - DNA, 23 bp, Homo sapiens
cctccccggctcgagcagtcctg

SEQ ID NO: 3427942 - DNA, 17 bp, Homo sapiens
cctccccgtctcattcc

SEQ ID NO: 3427943 - DNA, 13 bp, Homo sapiens
cctcccctctctt

SEQ ID NO: 3427944 - DNA, 13 bp, Homo sapiens
cctcccctgccac

SEQ ID NO: 3427945 - DNA, 17 bp, Homo sapiens
cctcccgaatagctggg

SEQ ID NO: 3427946 - DNA, 20 bp, Homo sapiens
cctcccgagtagctgggact

SEQ ID NO: 3427947 - DNA, 18 bp, Homo sapiens
cctccctgcttaaaaatg

SEQ ID NO: 3427948 - DNA, 19 bp, Homo sapiens
cctccctgttccccagaga

SEQ ID NO: 3427949 - DNA, 10 bp, Homo sapiens
cctcccttct

SEQ ID NO: 3427950 - DNA, 13 bp, Homo sapiens
cctccctttctcc

SEQ ID NO: 3427951 - DNA, 16 bp, Homo sapiens
cctccgccaggcgaga

SEQ ID NO: 3427952 - DNA, 16 bp, Homo sapiens
cctccggactggtgcc

SEQ ID NO: 3427953 - DNA, 16 bp, Homo sapiens
cctcctaccctgcgcc

SEQ ID NO: 3427954 - DNA, 14 bp, Homo sapiens
cctcctcactccct

SEQ ID NO: 3427955 - DNA, 21 bp, Homo sapiens
cctcctcagtatgtgggggct

SEQ ID NO: 3427956 - DNA, 21 bp, Homo sapiens
cctcctccagccgccatgctc

SEQ ID NO: 3427957 - DNA, 23 bp, Homo sapiens
cctcctcccacccggctgcagag

SEQ ID NO: 3427958 - DNA, 13 bp, Homo sapiens
cctcctccctgca

SEQ ID NO: 3427959 - DNA, 16 bp, Homo sapiens
cctcctccctgcatct

SEQ ID NO: 3427960 - DNA, 13 bp, Homo sapiens
cctcctctcagtg

SEQ ID NO: 3427961 - DNA, 14 bp, Homo sapiens
cctcctctcagtgt

SEQ ID NO: 3427962 - DNA, 15 bp, Homo sapiens
cctcctctgaaacag

SEQ ID NO: 3427963 - DNA, 16 bp, Homo sapiens
cctcctctgaaacagc

SEQ ID NO: 3427964 - DNA, 20 bp, Homo sapiens
cctcctctgaaacagctgcc

SEQ ID NO: 3427965 - DNA, 18 bp, Homo sapiens
cctcctctgacttgggga

SEQ ID NO: 3427966 - DNA, 11 bp, Homo sapiens
cctcctctgtg

SEQ ID NO: 3427967 - DNA, 13 bp, Homo sapiens
cctcctctgtgaa

SEQ ID NO: 3427968 - DNA, 22 bp, Homo sapiens
cctcctctgtgaccaatgtctt

SEQ ID NO: 3427969 - DNA, 14 bp, Homo sapiens
cctcctgcccacct

SEQ ID NO: 3427970 - DNA, 13 bp, Homo sapiens
cctcctgcctcga

SEQ ID NO: 3427971 - DNA, 15 bp, Homo sapiens
cctcctggcccaggt

SEQ ID NO: 3427972 - DNA, 22 bp, Homo sapiens
cctcctgtgtgtgcgcctacag

SEQ ID NO: 3427973 - DNA, 23 bp, Homo sapiens
cctcctgtgtgtgcgcctacagg

SEQ ID NO: 3427974 - DNA, 22 bp, Homo sapiens
cctccttcagacaccctcaacc

SEQ ID NO: 3427975 - DNA, 23 bp, Homo sapiens
cctccttcatatgaaaggtgcca

SEQ ID NO: 3427976 - DNA, 11 bp, Homo sapiens
cctccttccca

SEQ ID NO: 3427977 - DNA, 19 bp, Homo sapiens
cctcctttcatcacactgg

SEQ ID NO: 3427978 - DNA, 18 bp, Homo sapiens
cctcctttcctcctctga

SEQ ID NO: 3427979 - DNA, 16 bp, Homo sapiens
cctcgaggtgccttct

SEQ ID NO: 3427980 - DNA, 13 bp, Homo sapiens
cctcgagtactgt

SEQ ID NO: 3427981 - DNA, 17 bp, Homo sapiens
cctcgagtactgtgggc

SEQ ID NO: 3427982 - DNA, 19 bp, Homo sapiens
cctcgagtactgtgggcaa

SEQ ID NO: 3427983 - DNA, 14 bp, Homo sapiens
cctcgcaagctggg

SEQ ID NO: 3427984 - DNA, 22 bp, Homo sapiens
cctcgccggaccctctaacctc

SEQ ID NO: 3427985 - DNA, 19 bp, Homo sapiens
cctcgctctgttacccagg

SEQ ID NO: 3427986 - DNA, 14 bp, Homo sapiens
cctcgctgccagct

SEQ ID NO: 3427987 - DNA, 19 bp, Homo sapiens
cctcgctgccagctctgta

SEQ ID NO: 3427988 - DNA, 22 bp, Homo sapiens
cctcggcctcccaaagtgctgg

SEQ ID NO: 3427989 - DNA, 20 bp, Homo sapiens
cctcgggctggagcctccga

SEQ ID NO: 3427990 - DNA, 16 bp, Homo sapiens
cctcggtgccttcctc

SEQ ID NO: 3427991 - DNA, 20 bp, Homo sapiens
cctctaacctcgccctctcc

SEQ ID NO: 3427992 - DNA, 13 bp, Homo sapiens
cctctcagtgttt

SEQ ID NO: 3427993 - DNA, 15 bp, Homo sapiens
cctctcatctcaggt

SEQ ID NO: 3427994 - DNA, 15 bp, Homo sapiens
cctctcccacgggac

SEQ ID NO: 3427995 - DNA, 11 bp, Homo sapiens
cctctcccagg

SEQ ID NO: 3427996 - DNA, 12 bp, Homo sapiens
cctctcccaggg

SEQ ID NO: 3427997 - DNA, 15 bp, Homo sapiens
cctctccccagcaag

SEQ ID NO: 3427998 - DNA, 20 bp, Homo sapiens
cctctccccagcaagtgaga

SEQ ID NO: 3427999 - DNA, 16 bp, Homo sapiens
cctctccccagcccag

SEQ ID NO: 3428000 - DNA, 19 bp, Homo sapiens
cctctccccagcccagaga

SEQ ID NO: 3428001 - DNA, 23 bp, Homo sapiens
cctctccccaggtccagctctgg

SEQ ID NO: 3428002 - DNA, 12 bp, Homo sapiens
cctctccctgac

SEQ ID NO: 3428003 - DNA, 13 bp, Homo sapiens
cctctccctgttg

SEQ ID NO: 3428004 - DNA, 19 bp, Homo sapiens
cctctcctccgtggcacat

SEQ ID NO: 3428005 - DNA, 15 bp, Homo sapiens
cctctccttcctgtg

SEQ ID NO: 3428006 - DNA, 21 bp, Homo sapiens
cctctccttgtggcctgggcc

SEQ ID NO: 3428007 - DNA, 13 bp, Homo sapiens
cctctctctgtgg

SEQ ID NO: 3428008 - DNA, 17 bp, Homo sapiens
cctctctctgtggggct

SEQ ID NO: 3428009 - DNA, 22 bp, Homo sapiens
cctctctgcagacttcccagct

SEQ ID NO: 3428010 - DNA, 16 bp, Homo sapiens
cctctctgctctgcgt

SEQ ID NO: 3428011 - DNA, 16 bp, Homo sapiens
cctctctgggcctcag

SEQ ID NO: 3428012 - DNA, 17 bp, Homo sapiens
cctctcttctcaccttt

SEQ ID NO: 3428013 - DNA, 19 bp, Homo sapiens
cctctcttgaaccccaaat

SEQ ID NO: 3428014 - DNA, 23 bp, Homo sapiens
cctctgaaaaccaatgttctctc

SEQ ID NO: 3428015 - DNA, 12 bp, Homo sapiens
cctctgaaacag

SEQ ID NO: 3428016 - DNA, 16 bp, Homo sapiens
cctctgaaacagctgc

SEQ ID NO: 3428017 - DNA, 21 bp, Homo sapiens
cctctgaaacagctgccttag

SEQ ID NO: 3428018 - DNA, 23 bp, Homo sapiens
cctctgaaacagctgccttagct

SEQ ID NO: 3428019 - DNA, 13 bp, Homo sapiens
cctctgacacaca

SEQ ID NO: 3428020 - DNA, 17 bp, Homo sapiens
cctctgacacacagctc

SEQ ID NO: 3428021 - DNA, 18 bp, Homo sapiens
cctctgacacacagctct

SEQ ID NO: 3428022 - DNA, 19 bp, Homo sapiens
cctctgactcagggctcct

SEQ ID NO: 3428023 - DNA, 21 bp, Homo sapiens
cctctgactcagggctcctgg

SEQ ID NO: 3428024 - DNA, 22 bp, Homo sapiens
cctctgactcagggctcctggg

SEQ ID NO: 3428025 - DNA, 14 bp, Homo sapiens
cctctgactccact

SEQ ID NO: 3428026 - DNA, 16 bp, Homo sapiens
cctctgcaactgctca

SEQ ID NO: 3428027 - DNA, 14 bp, Homo sapiens
cctctgcaagtgct

SEQ ID NO: 3428028 - DNA, 18 bp, Homo sapiens
cctctgcaagtgctcagg

SEQ ID NO: 3428029 - DNA, 11 bp, Homo sapiens
cctctgcacaa

SEQ ID NO: 3428030 - DNA, 17 bp, Homo sapiens
cctctgcacaagctgca

SEQ ID NO: 3428031 - DNA, 15 bp, Homo sapiens
cctctgcttcccagg

SEQ ID NO: 3428032 - DNA, 13 bp, Homo sapiens
cctctggagtggc

SEQ ID NO: 3428033 - DNA, 21 bp, Homo sapiens
cctctggagtggccactaagc

SEQ ID NO: 3428034 - DNA, 13 bp, Homo sapiens
cctctgggggctc

SEQ ID NO: 3428035 - DNA, 16 bp, Homo sapiens
cctctgggggctctgg

SEQ ID NO: 3428036 - DNA, 20 bp, Homo sapiens
cctctgggtcagtggtccac

SEQ ID NO: 3428037 - DNA, 16 bp, Homo sapiens
cctctggtcgctcctg

SEQ ID NO: 3428038 - DNA, 17 bp, Homo sapiens
cctctggtcgctcctgc

SEQ ID NO: 3428039 - DNA, 19 bp, Homo sapiens
cctctggtcgctcctgccc

SEQ ID NO: 3428040 - DNA, 19 bp, Homo sapiens
cctctgtaccccatgacct

SEQ ID NO: 3428041 - DNA, 18 bp, Homo sapiens
cctctgtcagtcacagcc

SEQ ID NO: 3428042 - DNA, 15 bp, Homo sapiens
cctctgtccaggcac

SEQ ID NO: 3428043 - DNA, 16 bp, Homo sapiens
cctctgtcttctggac

SEQ ID NO: 3428044 - DNA, 13 bp, Homo sapiens
cctctgtgctgtg

SEQ ID NO: 3428045 - DNA, 22 bp, Homo sapiens
cctctgttcagtgtaaatagtt

SEQ ID NO: 3428046 - DNA, 20 bp, Homo sapiens
cctcttcctaccctgcctcc

SEQ ID NO: 3428047 - DNA, 15 bp, Homo sapiens
cctcttcctgcctag

SEQ ID NO: 3428048 - DNA, 15 bp, Homo sapiens
cctcttcctttagga

SEQ ID NO: 3428049 - DNA, 23 bp, Homo sapiens
cctcttctggagatggaagcttg

SEQ ID NO: 3428050 - DNA, 17 bp, Homo sapiens
cctcttctgggagggca

SEQ ID NO: 3428051 - DNA, 23 bp, Homo sapiens
cctcttctttcagacttgccatg

SEQ ID NO: 3428052 - DNA, 18 bp, Homo sapiens
cctcttgaagagaaaaaa

SEQ ID NO: 3428053 - DNA, 19 bp, Homo sapiens
cctcttgaagagaaaaaag

SEQ ID NO: 3428054 - DNA, 16 bp, Homo sapiens
cctcttggggaagggg

SEQ ID NO: 3428055 - DNA, 19 bp, Homo sapiens
cctcttggggaaggggcac

SEQ ID NO: 3428056 - DNA, 14 bp, Homo sapiens
cctcttgtaaataa

SEQ ID NO: 3428057 - DNA, 18 bp, Homo sapiens
cctcttgtaaataaagcc

SEQ ID NO: 3428058 - DNA, 13 bp, Homo sapiens
cctctttcatcca

SEQ ID NO: 3428059 - DNA, 17 bp, Homo sapiens
cctctttgctttgcttt

SEQ ID NO: 3428060 - DNA, 21 bp, Homo sapiens
cctctttggtggcatggaagg

SEQ ID NO: 3428061 - DNA, 19 bp, Homo sapiens
cctctttgtctaaaacaat

SEQ ID NO: 3428062 - DNA, 14 bp, Homo sapiens
ccctcttctgagct

SEQ ID NO: 3428063 - DNA, 15 bp, Homo sapiens
ccctcttctgagcta

SEQ ID NO: 3428064 - DNA, 15 bp, Homo sapiens
ccctgaaagccctga

SEQ ID NO: 3428065 - DNA, 15 bp, Homo sapiens
ccctgaagatttcag

SEQ ID NO: 3428066 - DNA, 17 bp, Homo sapiens
ccctgaagatttcagag

SEQ ID NO: 3428067 - DNA, 18 bp, Homo sapiens
ccctgaagatttcagagg

SEQ ID NO: 3428068 - DNA, 20 bp, Homo sapiens
ccctgacagtccctcctctc

SEQ ID NO: 3428069 - DNA, 17 bp, Homo sapiens
ccctgacctccctctaa

SEQ ID NO: 3428070 - DNA, 13 bp, Homo sapiens
ccctgactgggag

SEQ ID NO: 3428071 - DNA, 14 bp, Homo sapiens
ccctgacttttctg

SEQ ID NO: 3428072 - DNA, 19 bp, Homo sapiens
ccctgagaaacccaccagc

SEQ ID NO: 3428073 - DNA, 23 bp, Homo sapiens
ccctgagaggaggtcgaatgggt

SEQ ID NO: 3428074 - DNA, 16 bp, Homo sapiens
ccctgagctgaggcag

SEQ ID NO: 3428075 - DNA, 19 bp, Homo sapiens
ccctgagctgaggcagcag

SEQ ID NO: 3428076 - DNA, 21 bp, Homo sapiens
ccctgaggatgggtcagagct

SEQ ID NO: 3428077 - DNA, 15 bp, Homo sapiens
ccctgaggtcactgc

SEQ ID NO: 3428078 - DNA, 15 bp, Homo sapiens
ccctgatcctgtgaa

SEQ ID NO: 3428079 - DNA, 17 bp, Homo sapiens
ccctgcactccctcctg

SEQ ID NO: 3428080 - DNA, 22 bp, Homo sapiens
ccctgcacttgcagactctaca

SEQ ID NO: 3428081 - DNA, 17 bp, Homo sapiens
ccctgcagagcacacag

SEQ ID NO: 3428082 - DNA, 18 bp, Homo sapiens
ccctgcaggacttgccac

SEQ ID NO: 3428083 - DNA, 18 bp, Homo sapiens
ccctgcatctgaccagca

SEQ ID NO: 3428084 - DNA, 15 bp, Homo sapiens
ccctgccaccaggcc

SEQ ID NO: 3428085 - DNA, 12 bp, Homo sapiens
ccctgccaccct

SEQ ID NO: 3428086 - DNA, 15 bp, Homo sapiens
ccctgccaccctggg

SEQ ID NO: 3428087 - DNA, 18 bp, Homo sapiens
ccctgccacctcctgcct

SEQ ID NO: 3428088 - DNA, 18 bp, Homo sapiens
ccctgccactcactaggc

SEQ ID NO: 3428089 - DNA, 12 bp, Homo sapiens
ccctgccagctc

SEQ ID NO: 3428090 - DNA, 14 bp, Homo sapiens
ccctgccagggcag

SEQ ID NO: 3428091 - DNA, 13 bp, Homo sapiens
ccctgcccccagg

SEQ ID NO: 3428092 - DNA, 14 bp, Homo sapiens
ccctgcccccagga

SEQ ID NO: 3428093 - DNA, 16 bp, Homo sapiens
ccctgcccccaggact

SEQ ID NO: 3428094 - DNA, 17 bp, Homo sapiens
ccctgcccccaggactg

SEQ ID NO: 3428095 - DNA, 14 bp, Homo sapiens
ccctgcccggctgc

SEQ ID NO: 3428096 - DNA, 16 bp, Homo sapiens
ccctgcccgtgtacat

SEQ ID NO: 3428097 - DNA, 15 bp, Homo sapiens
ccctgccctcccctc

SEQ ID NO: 3428098 - DNA, 15 bp, Homo sapiens
ccctgccctgtgggg

SEQ ID NO: 3428099 - DNA, 22 bp, Homo sapiens
ccctgcgcctgtgatgctgggc

SEQ ID NO: 3428100 - DNA, 18 bp, Homo sapiens
ccctgcgcctttcctttt

SEQ ID NO: 3428101 - DNA, 22 bp, Homo sapiens
ccctgcgggtgaacaaagcagc

SEQ ID NO: 3428102 - DNA, 18 bp, Homo sapiens
ccctgctgagtcatctgt

SEQ ID NO: 3428103 - DNA, 16 bp, Homo sapiens
ccctgctgctgcctgc

SEQ ID NO: 3428104 - DNA, 17 bp, Homo sapiens
ccctgctgctgtcacct

SEQ ID NO: 3428105 - DNA, 19 bp, Homo sapiens
ccctgctggttcagggttg

SEQ ID NO: 3428106 - DNA, 13 bp, Homo sapiens
ccctgctgtctct

SEQ ID NO: 3428107 - DNA, 17 bp, Homo sapiens
ccctgctgtctctctgg

SEQ ID NO: 3428108 - DNA, 19 bp, Homo sapiens
ccctgctgtctctctgggc

SEQ ID NO: 3428109 - DNA, 22 bp, Homo sapiens
ccctgctgtctctctgggctgc

SEQ ID NO: 3428110 - DNA, 14 bp, Homo sapiens
ccctggacatgcct

SEQ ID NO: 3428111 - DNA, 21 bp, Homo sapiens
ccctggacatgcctgtcctga

SEQ ID NO: 3428112 - DNA, 22 bp, Homo sapiens
ccctggacatgcctgtcctgaa

SEQ ID NO: 3428113 - DNA, 21 bp, Homo sapiens
ccctggaccagtggtctcaca

SEQ ID NO: 3428114 - DNA, 18 bp, Homo sapiens
ccaagtggcagagcttgg

SEQ ID NO: 3428115 - DNA, 19 bp, Homo sapiens
ccaagtggcagagcttgga

SEQ ID NO: 3428116 - DNA, 21 bp, Homo sapiens
ccaagtggtgggaatcagatc

SEQ ID NO: 3428117 - DNA, 18 bp, Homo sapiens
ccagctgccccagccaga

SEQ ID NO: 3428118 - DNA, 18 bp, Homo sapiens
ccagctgccccggcccct

SEQ ID NO: 3428119 - DNA, 12 bp, Homo sapiens
ccagctgcctcc

SEQ ID NO: 3428120 - DNA, 16 bp, Homo sapiens
ccagctggcagcagag

SEQ ID NO: 3428121 - DNA, 17 bp, Homo sapiens
ccagctgggtcaggcag

SEQ ID NO: 3428122 - DNA, 20 bp, Homo sapiens
ccagctgtgctctggacagg

SEQ ID NO: 3428123 - DNA, 15 bp, Homo sapiens
ccagctgtgcttatg

SEQ ID NO: 3428124 - DNA, 21 bp, Homo sapiens
ccagctgtgcttatggtacca

SEQ ID NO: 3428125 - DNA, 15 bp, Homo sapiens
ccaggaagccgtgcc

SEQ ID NO: 3428126 - DNA, 15 bp, Homo sapiens
ccaggaagctttggt

SEQ ID NO: 3428127 - DNA, 17 bp, Homo sapiens
ccaggaatttcccagga

SEQ ID NO: 3428128 - DNA, 13 bp, Homo sapiens
ccaggaccagctc

SEQ ID NO: 3428129 - DNA, 15 bp, Homo sapiens
ccaggaccagctcag

SEQ ID NO: 3428130 - DNA, 16 bp, Homo sapiens
ccaggaccagctcagg

SEQ ID NO: 3428131 - DNA, 15 bp, Homo sapiens
ccaggaccatcatcc

SEQ ID NO: 3428132 - DNA, 14 bp, Homo sapiens
ccaggaccctgaag

SEQ ID NO: 3428133 - DNA, 20 bp, Homo sapiens
ccaggactatatttgggcct

SEQ ID NO: 3428134 - DNA, 16 bp, Homo sapiens
ccaggactcaccctca

SEQ ID NO: 3428135 - DNA, 14 bp, Homo sapiens
ccaggactctgacc

SEQ ID NO: 3428136 - DNA, 14 bp, Homo sapiens
ccaggactggctgt

SEQ ID NO: 3428137 - DNA, 13 bp, Homo sapiens
ccaggactgggcc

SEQ ID NO: 3428138 - DNA, 16 bp, Homo sapiens
ccaggagaagggctgg

SEQ ID NO: 3428139 - DNA, 19 bp, Homo sapiens
ccaggagccccgaggcctt

SEQ ID NO: 3428140 - DNA, 20 bp, Homo sapiens
ccaggagccccgaggccttc

SEQ ID NO: 3428141 - DNA, 12 bp, Homo sapiens
ccaggagcctac

SEQ ID NO: 3428142 - DNA, 23 bp, Homo sapiens
ccaggagctgtcaccaaggaaac

SEQ ID NO: 3428143 - DNA, 22 bp, Homo sapiens
ccaggagcttcttgtttccttg

SEQ ID NO: 3428144 - DNA, 18 bp, Homo sapiens
ccaggatagagactggaa

SEQ ID NO: 3428145 - DNA, 18 bp, Homo sapiens
ccaggatcagattgcatg

SEQ ID NO: 3428146 - DNA, 19 bp, Homo sapiens
ccaggatcagattgcatgt

SEQ ID NO: 3428147 - DNA, 21 bp, Homo sapiens
ccaggatgataagttcctttc

SEQ ID NO: 3428148 - DNA, 13 bp, Homo sapiens
ccaggcactgcaa

SEQ ID NO: 3428149 - DNA, 13 bp, Homo sapiens
ccaggcagatcca

SEQ ID NO: 3428150 - DNA, 16 bp, Homo sapiens
ccaggcagatccagga

SEQ ID NO: 3428151 - DNA, 17 bp, Homo sapiens
ccaggcagatccaggac

SEQ ID NO: 3428152 - DNA, 14 bp, Homo sapiens
ccaggcaggtcttg

SEQ ID NO: 3428153 - DNA, 12 bp, Homo sapiens
ccaggccagagg

SEQ ID NO: 3428154 - DNA, 14 bp, Homo sapiens
ccaggcccaaggct

SEQ ID NO: 3428155 - DNA, 18 bp, Homo sapiens
ccaggcccaaggctcccg

SEQ ID NO: 3428156 - DNA, 15 bp, Homo sapiens
ccaggcccctgccac

SEQ ID NO: 3428157 - DNA, 20 bp, Homo sapiens
ccaggccctgccagagcagg

SEQ ID NO: 3428158 - DNA, 23 bp, Homo sapiens
ccaggccctgccagtggggaagg

SEQ ID NO: 3428159 - DNA, 18 bp, Homo sapiens
ccaggccggcgagccctg

SEQ ID NO: 3428160 - DNA, 14 bp, Homo sapiens
ccaggcctgagctg

SEQ ID NO: 3428161 - DNA, 16 bp, Homo sapiens
ccaggctgaccacagc

SEQ ID NO: 3428162 - DNA, 17 bp, Homo sapiens
ccaggctggcgtgcagt

SEQ ID NO: 3428163 - DNA, 19 bp, Homo sapiens
ccaggctggtctcaaactc

SEQ ID NO: 3428164 - DNA, 21 bp, Homo sapiens
ccaggctggtttcgaactcct

SEQ ID NO: 3428165 - DNA, 24 bp, Homo sapiens
ccaggctgtatcccatgagcctca

SEQ ID NO: 3428166 - DNA, 12 bp, Homo sapiens
ccaggcttggaa

SEQ ID NO: 3428167 - DNA, 22 bp, Homo sapiens
ccaggcttgtcactagcagctg

SEQ ID NO: 3428168 - DNA, 13 bp, Homo sapiens
ccagggagaagct

SEQ ID NO: 3428169 - DNA, 17 bp, Homo sapiens
ccagggagacctggaca

SEQ ID NO: 3428170 - DNA, 21 bp, Homo sapiens
ccagggagacctggacacagg

SEQ ID NO: 3428171 - DNA, 22 bp, Homo sapiens
ccagggagacctggacacaggc

SEQ ID NO: 3428172 - DNA, 19 bp, Homo sapiens
ccagggagcattttcctcc

SEQ ID NO: 3428173 - DNA, 21 bp, Homo sapiens
ccagggagcattttcctccat

SEQ ID NO: 3428174 - DNA, 12 bp, Homo sapiens
ccagggagcctt

SEQ ID NO: 3428175 - DNA, 14 bp, Homo sapiens
ccagggagcctttg

SEQ ID NO: 3428176 - DNA, 18 bp, Homo sapiens
ccagggagcctttggttc

SEQ ID NO: 3428177 - DNA, 22 bp, Homo sapiens
ccagggaggtggaaggaccctg

SEQ ID NO: 3428178 - DNA, 19 bp, Homo sapiens
ccagggatgggaggtatgg

SEQ ID NO: 3428179 - DNA, 21 bp, Homo sapiens
ccagggcaagggttaaggcct

SEQ ID NO: 3428180 - DNA, 21 bp, Homo sapiens
ccagggcatcttgctggctac

SEQ ID NO: 3428181 - DNA, 18 bp, Homo sapiens
ccagggccacgctccagc

SEQ ID NO: 3428182 - DNA, 14 bp, Homo sapiens
ccagggcccagagc

SEQ ID NO: 3428183 - DNA, 15 bp, Homo sapiens
ccagggcccagagcc

SEQ ID NO: 3428184 - DNA, 16 bp, Homo sapiens
ccagggcccagagccc

SEQ ID NO: 3428185 - DNA, 17 bp, Homo sapiens
ccagggcccagagccca

SEQ ID NO: 3428186 - DNA, 17 bp, Homo sapiens
ccagggcccccacaggc

SEQ ID NO: 3428187 - DNA, 17 bp, Homo sapiens
ccagggcccccatctca

SEQ ID NO: 3428188 - DNA, 14 bp, Homo sapiens
ccagggcctgagcc

SEQ ID NO: 3428189 - DNA, 19 bp, Homo sapiens
ccagggcctgagcctggcc

SEQ ID NO: 3428190 - DNA, 14 bp, Homo sapiens
ccagggctcctgca

SEQ ID NO: 3428191 - DNA, 16 bp, Homo sapiens
ccagggctggactgag

SEQ ID NO: 3428192 - DNA, 20 bp, Homo sapiens
ccaggggctgcttcctcctg

SEQ ID NO: 3428193 - DNA, 21 bp, Homo sapiens
ccaggggctgcttcctcctgg

SEQ ID NO: 3428194 - DNA, 23 bp, Homo sapiens
ccaggggctgcttcctcctggaa

SEQ ID NO: 3428195 - DNA, 17 bp, Homo sapiens
ccaggggggtgaggagc

SEQ ID NO: 3428196 - DNA, 13 bp, Homo sapiens
ccaggggtttctc

SEQ ID NO: 3428197 - DNA, 18 bp, Homo sapiens
ccagggtcagaaacagga

SEQ ID NO: 3428198 - DNA, 16 bp, Homo sapiens
ccagggttgaccccag

SEQ ID NO: 3428199 - DNA, 15 bp, Homo sapiens
ccaggtccagctctg

SEQ ID NO: 3428200 - DNA, 16 bp, Homo sapiens
ccaggtccagctctgg

SEQ ID NO: 3428201 - DNA, 18 bp, Homo sapiens
ccaggtccagctctggag

SEQ ID NO: 3428202 - DNA, 19 bp, Homo sapiens
ccaggtccagctctggagg

SEQ ID NO: 3428203 - DNA, 17 bp, Homo sapiens
ccaggtcttgaggagag

SEQ ID NO: 3428204 - DNA, 20 bp, Homo sapiens
ccaggtcttgaggagagaga

SEQ ID NO: 3428205 - DNA, 21 bp, Homo sapiens
ccaggtcttgaggagagagac

SEQ ID NO: 3428206 - DNA, 21 bp, Homo sapiens
ccaggtgagtcctagagctac

SEQ ID NO: 3428207 - DNA, 14 bp, Homo sapiens
ccaggtgcagccag

SEQ ID NO: 3428208 - DNA, 21 bp, Homo sapiens
ccaggtgcctttcaaatttag

SEQ ID NO: 3428209 - DNA, 20 bp, Homo sapiens
ccaggttcaacccacagcta

SEQ ID NO: 3428210 - DNA, 22 bp, Homo sapiens
ccaggttcaagcgattctcctg

SEQ ID NO: 3428211 - DNA, 22 bp, Homo sapiens
ccaggtttctggtctctaggct

SEQ ID NO: 3428212 - DNA, 17 bp, Homo sapiens
ccaggtttttggtctga

SEQ ID NO: 3428213 - DNA, 22 bp, Homo sapiens
ccagtacctcctgtctctggcc

SEQ ID NO: 3428214 - DNA, 14 bp, Homo sapiens
ccagtacttgtcat

SEQ ID NO: 3428215 - DNA, 22 bp, Homo sapiens
ccagtagaccttgttacttctg

SEQ ID NO: 3428216 - DNA, 22 bp, Homo sapiens
ccagtatgacagaggaggatgt

SEQ ID NO: 3428217 - DNA, 19 bp, Homo sapiens
ccagtatttttgctgcttc

SEQ ID NO: 3428218 - DNA, 16 bp, Homo sapiens
ccagtcaagaagaaaa

SEQ ID NO: 3428219 - DNA, 21 bp, Homo sapiens
ccagtcccaccctgctgctgc

SEQ ID NO: 3428220 - DNA, 15 bp, Homo sapiens
ccagtccccccaccc

SEQ ID NO: 3428221 - DNA, 17 bp, Homo sapiens
ccagtccccccaccctc

SEQ ID NO: 3428222 - DNA, 21 bp, Homo sapiens
ccagtcctaggcccctgccct

SEQ ID NO: 3428223 - DNA, 11 bp, Homo sapiens
ccagtcctgct

SEQ ID NO: 3428224 - DNA, 13 bp, Homo sapiens
ccagtcgacccca

SEQ ID NO: 3428225 - DNA, 23 bp, Homo sapiens
ccagtcgaccccaaaggaacact

SEQ ID NO: 3428226 - DNA, 23 bp, Homo sapiens
ccagtcgcccttacttcttgccc

SEQ ID NO: 3428227 - DNA, 18 bp, Homo sapiens
ccagtctccaccaggaac

SEQ ID NO: 3428228 - DNA, 12 bp, Homo sapiens
ccagtgaatttt

SEQ ID NO: 3428229 - DNA, 19 bp, Homo sapiens
ccagtgaatttttgcaata

SEQ ID NO: 3428230 - DNA, 19 bp, Homo sapiens
ccagtgacctgaggaagcg

SEQ ID NO: 3428231 - DNA, 17 bp, Homo sapiens
ccagtgagatgcattct

SEQ ID NO: 3428232 - DNA, 21 bp, Homo sapiens
ccagtgagatgcattcttggt

SEQ ID NO: 3428233 - DNA, 16 bp, Homo sapiens
ccagtgcccccactga

SEQ ID NO: 3428234 - DNA, 14 bp, Homo sapiens
ccagtgcctacatc

SEQ ID NO: 3428235 - DNA, 14 bp, Homo sapiens
ccagtggctgctgc

SEQ ID NO: 3428236 - DNA, 19 bp, Homo sapiens
ccagtggctgctgcccagg

SEQ ID NO: 3428237 - DNA, 21 bp, Homo sapiens
ccagtgtgcacccctccccat

SEQ ID NO: 3428238 - DNA, 17 bp, Homo sapiens
ccagtgttagggaaggg

SEQ ID NO: 3428239 - DNA, 17 bp, Homo sapiens
ccagttcctatgacaca

SEQ ID NO: 3428240 - DNA, 15 bp, Homo sapiens
ccagttggagttttt

SEQ ID NO: 3428241 - DNA, 23 bp, Homo sapiens
ccagttggagttttttgtaccaa

SEQ ID NO: 3428242 - DNA, 20 bp, Homo sapiens
ccagtttccccatggggctg

SEQ ID NO: 3428243 - DNA, 15 bp, Homo sapiens
ccataaaagaagttt

SEQ ID NO: 3428244 - DNA, 20 bp, Homo sapiens
ccataaagacaatcactgcc

SEQ ID NO: 3428245 - DNA, 15 bp, Homo sapiens
ccataaccactgaag

SEQ ID NO: 3428246 - DNA, 17 bp, Homo sapiens
ccataaccgctgattct

SEQ ID NO: 3428247 - DNA, 20 bp, Homo sapiens
ccataagtaagaaatttcta

SEQ ID NO: 3428248 - DNA, 19 bp, Homo sapiens
ccataataaaaggctttga

SEQ ID NO: 3428249 - DNA, 21 bp, Homo sapiens
ccataataaaggttgtgaatg

SEQ ID NO: 3428250 - DNA, 13 bp, Homo sapiens
ccataatatgatg

SEQ ID NO: 3428251 - DNA, 15 bp, Homo sapiens
ccataatatgatgca

SEQ ID NO: 3428252 - DNA, 14 bp, Homo sapiens
ccataatgatggat

SEQ ID NO: 3428253 - DNA, 22 bp, Homo sapiens
ccataccacccaatgctgatgt

SEQ ID NO: 3428254 - DNA, 23 bp, Homo sapiens
ccatacgcgttctaggcatacaa

SEQ ID NO: 3428255 - DNA, 15 bp, Homo sapiens
ccatatatccttttc

SEQ ID NO: 3428256 - DNA, 21 bp, Homo sapiens
ccatatattggcactgctaaa

SEQ ID NO: 3428257 - DNA, 17 bp, Homo sapiens
ccatatgaattgtacag

SEQ ID NO: 3428258 - DNA, 15 bp, Homo sapiens
ccatattctgttggc

SEQ ID NO: 3428259 - DNA, 18 bp, Homo sapiens
ccatattgcacatgtctt

SEQ ID NO: 3428260 - DNA, 23 bp, Homo sapiens
ccatattgcacatgtcttaatga

SEQ ID NO: 3428261 - DNA, 22 bp, Homo sapiens
ccatcacagatcgcatttccta

SEQ ID NO: 3428262 - DNA, 18 bp, Homo sapiens
ccatcactgagttttcca

SEQ ID NO: 3428263 - DNA, 13 bp, Homo sapiens
ccatcatctcctg

SEQ ID NO: 3428264 - DNA, 14 bp, Homo sapiens
cattaagaaaatca

SEQ ID NO: 3428265 - DNA, 16 bp, Homo sapiens
cattaatatttgctga

SEQ ID NO: 3428266 - DNA, 24 bp, Homo sapiens
cattacagggaatgcctgagtgcc

SEQ ID NO: 3428267 - DNA, 15 bp, Homo sapiens
cattacccttttctg

SEQ ID NO: 3428268 - DNA, 22 bp, Homo sapiens
cattaccgcgttgtaaaatata

SEQ ID NO: 3428269 - DNA, 15 bp, Homo sapiens
cattactataagaac

SEQ ID NO: 3428270 - DNA, 17 bp, Homo sapiens
cattactgcttcatttt

SEQ ID NO: 3428271 - DNA, 22 bp, Homo sapiens
cattactgcttcatttttgtaa

SEQ ID NO: 3428272 - DNA, 19 bp, Homo sapiens
cattagaagacaattgaca

SEQ ID NO: 3428273 - DNA, 17 bp, Homo sapiens
cattagaagttaccaaa

SEQ ID NO: 3428274 - DNA, 19 bp, Homo sapiens
cattagaagttaccaaatt

SEQ ID NO: 3428275 - DNA, 13 bp, Homo sapiens
cattagagcaggc

SEQ ID NO: 3428276 - DNA, 23 bp, Homo sapiens
cattagagcaggcgttcagctca

SEQ ID NO: 3428277 - DNA, 14 bp, Homo sapiens
cattagcctgagta

SEQ ID NO: 3428278 - DNA, 17 bp, Homo sapiens
cattagcctgagtagaa

SEQ ID NO: 3428279 - DNA, 21 bp, Homo sapiens
cattagtaacataataaatta

SEQ ID NO: 3428280 - DNA, 20 bp, Homo sapiens
cattagttgcactaactgct

SEQ ID NO: 3428281 - DNA, 17 bp, Homo sapiens
cattatccattcccaag

SEQ ID NO: 3428282 - DNA, 23 bp, Homo sapiens
cattatccattcccaagatgcct

SEQ ID NO: 3428283 - DNA, 15 bp, Homo sapiens
cattattctatgtag

SEQ ID NO: 3428284 - DNA, 22 bp, Homo sapiens
cattattctatgtagtggtttt

SEQ ID NO: 3428285 - DNA, 13 bp, Homo sapiens
cattatttgtcaa

SEQ ID NO: 3428286 - DNA, 14 bp, Homo sapiens
cattatttgtcaaa

SEQ ID NO: 3428287 - DNA, 15 bp, Homo sapiens
cattatttgtcaaat

SEQ ID NO: 3428288 - DNA, 17 bp, Homo sapiens
cattcaaaagttgaaat

SEQ ID NO: 3428289 - DNA, 12 bp, Homo sapiens
cattcaacaaga

SEQ ID NO: 3428290 - DNA, 14 bp, Homo sapiens
cattcacagagcct

SEQ ID NO: 3428291 - DNA, 13 bp, Homo sapiens
cattcacctgccc

SEQ ID NO: 3428292 - DNA, 18 bp, Homo sapiens
cattcacttgcatttctt

SEQ ID NO: 3428293 - DNA, 16 bp, Homo sapiens
cattcaggagcttcct

SEQ ID NO: 3428294 - DNA, 23 bp, Homo sapiens
cattcagtccgcctggccggctc

SEQ ID NO: 3428295 - DNA, 12 bp, Homo sapiens
cattccaaagtt

SEQ ID NO: 3428296 - DNA, 21 bp, Homo sapiens
cattccaactcgtatagcatg

SEQ ID NO: 3428297 - DNA, 19 bp, Homo sapiens
cattccagcccctctggtc

SEQ ID NO: 3428298 - DNA, 17 bp, Homo sapiens
cattcccaagatgcctg

SEQ ID NO: 3428299 - DNA, 12 bp, Homo sapiens
cattcccactgc

SEQ ID NO: 3428300 - DNA, 16 bp, Homo sapiens
cattccgttgtctgtg

SEQ ID NO: 3428301 - DNA, 17 bp, Homo sapiens
cattcctgaagaaccag

SEQ ID NO: 3428302 - DNA, 21 bp, Homo sapiens
cattcctgggaaatattccct

SEQ ID NO: 3428303 - DNA, 14 bp, Homo sapiens
cattcctgttcttt

SEQ ID NO: 3428304 - DNA, 13 bp, Homo sapiens
cattccttgcctg

SEQ ID NO: 3428305 - DNA, 16 bp, Homo sapiens
cattcgcgctctgctc

SEQ ID NO: 3428306 - DNA, 17 bp, Homo sapiens
cattcgcgctctgctca

SEQ ID NO: 3428307 - DNA, 18 bp, Homo sapiens
cattcgcgctctgctcag

SEQ ID NO: 3428308 - DNA, 16 bp, Homo sapiens
cattctacacagagca

SEQ ID NO: 3428309 - DNA, 17 bp, Homo sapiens
cattctaggctcactgc

SEQ ID NO: 3428310 - DNA, 16 bp, Homo sapiens
cattctcaggcaccag

SEQ ID NO: 3428311 - DNA, 17 bp, Homo sapiens
cattctcgcttccctga

SEQ ID NO: 3428312 - DNA, 14 bp, Homo sapiens
cattctctgtctca

SEQ ID NO: 3428313 - DNA, 23 bp, Homo sapiens
cattctctgtctcatccatcatc

SEQ ID NO: 3428314 - DNA, 12 bp, Homo sapiens
cattctgactcg

SEQ ID NO: 3428315 - DNA, 17 bp, Homo sapiens
cattctgcctgcccagg

SEQ ID NO: 3428316 - DNA, 18 bp, Homo sapiens
cattctgcctgcccaggc

SEQ ID NO: 3428317 - DNA, 13 bp, Homo sapiens
cattctggaataa

SEQ ID NO: 3428318 - DNA, 18 bp, Homo sapiens
cattcttaacaaactctt

SEQ ID NO: 3428319 - DNA, 12 bp, Homo sapiens
cattcttggctt

SEQ ID NO: 3428320 - DNA, 16 bp, Homo sapiens
cattcttggttggctg

SEQ ID NO: 3428321 - DNA, 19 bp, Homo sapiens
cattcttgtaaggctttga

SEQ ID NO: 3428322 - DNA, 22 bp, Homo sapiens
cattcttgtaaggctttgatta

SEQ ID NO: 3428323 - DNA, 17 bp, Homo sapiens
cattctttctgataact

SEQ ID NO: 3428324 - DNA, 16 bp, Homo sapiens
cattcttttaaaagac

SEQ ID NO: 3428325 - DNA, 18 bp, Homo sapiens
cattcttttaaaagacaa

SEQ ID NO: 3428326 - DNA, 16 bp, Homo sapiens
cattcttttgtaattt

SEQ ID NO: 3428327 - DNA, 18 bp, Homo sapiens
cattcttttgtaatttaa

SEQ ID NO: 3428328 - DNA, 21 bp, Homo sapiens
cattgaattcttggttgagga

SEQ ID NO: 3428329 - DNA, 21 bp, Homo sapiens
cattgaccgcgactaatttca

SEQ ID NO: 3428330 - DNA, 19 bp, Homo sapiens
cattgagaactgcatatgt

SEQ ID NO: 3428331 - DNA, 23 bp, Homo sapiens
cattgagaactgcatatgtttcg

SEQ ID NO: 3428332 - DNA, 22 bp, Homo sapiens
cattgaggataaattgccataa

SEQ ID NO: 3428333 - DNA, 16 bp, Homo sapiens
cattgatggggaagga

SEQ ID NO: 3428334 - DNA, 20 bp, Homo sapiens
cattgattcaccttgttttt

SEQ ID NO: 3428335 - DNA, 15 bp, Homo sapiens
cattgattcagcctg

SEQ ID NO: 3428336 - DNA, 14 bp, Homo sapiens
cattgatttcctgt

SEQ ID NO: 3428337 - DNA, 16 bp, Homo sapiens
cattgcacccagccca

SEQ ID NO: 3428338 - DNA, 20 bp, Homo sapiens
cattgcagtttaagagcaga

SEQ ID NO: 3428339 - DNA, 22 bp, Homo sapiens
cattgcctttgaatgttaattt

SEQ ID NO: 3428340 - DNA, 21 bp, Homo sapiens
cattgcggacagccacggcca

SEQ ID NO: 3428341 - DNA, 20 bp, Homo sapiens
cattgctcccctgatagaag

SEQ ID NO: 3428342 - DNA, 18 bp, Homo sapiens
cattgctgagcctctgct

SEQ ID NO: 3428343 - DNA, 21 bp, Homo sapiens
cattgctgtctgcagccttga

SEQ ID NO: 3428344 - DNA, 19 bp, Homo sapiens
cattgctgttgtccaacta

SEQ ID NO: 3428345 - DNA, 22 bp, Homo sapiens
cattgctgttgtccaactattt

SEQ ID NO: 3428346 - DNA, 20 bp, Homo sapiens
cattggcacctaatccaggc

SEQ ID NO: 3428347 - DNA, 21 bp, Homo sapiens
cattggcacctaatccaggca

SEQ ID NO: 3428348 - DNA, 23 bp, Homo sapiens
cattgggaaggggacccccgccc

SEQ ID NO: 3428349 - DNA, 20 bp, Homo sapiens
cattgggtgaggtaataaac

SEQ ID NO: 3428350 - DNA, 18 bp, Homo sapiens
cattgtccctctgcccca

SEQ ID NO: 3428351 - DNA, 21 bp, Homo sapiens
cattgtccctctgccccatcc

SEQ ID NO: 3428352 - DNA, 14 bp, Homo sapiens
cattgtctttttag

SEQ ID NO: 3428353 - DNA, 13 bp, Homo sapiens
cattgtgcttctt

SEQ ID NO: 3428354 - DNA, 17 bp, Homo sapiens
cattgttcacctttgta

SEQ ID NO: 3428355 - DNA, 18 bp, Homo sapiens
cattgttggccaaagcca

SEQ ID NO: 3428356 - DNA, 19 bp, Homo sapiens
cattgttggtgttaattga

SEQ ID NO: 3428357 - DNA, 21 bp, Homo sapiens
cattgtttaaaaatacacatg

SEQ ID NO: 3428358 - DNA, 19 bp, Homo sapiens
catttaagagacagtcacc

SEQ ID NO: 3428359 - DNA, 20 bp, Homo sapiens
catttaataatatacttgtg

SEQ ID NO: 3428360 - DNA, 13 bp, Homo sapiens
catttaatttaga

SEQ ID NO: 3428361 - DNA, 22 bp, Homo sapiens
catttaatttagatattttcca

SEQ ID NO: 3428362 - DNA, 16 bp, Homo sapiens
catttagctgtattca

SEQ ID NO: 3428363 - DNA, 18 bp, Homo sapiens
catttataaagctaaaat

SEQ ID NO: 3428364 - DNA, 21 bp, Homo sapiens
catttataaagctaaaataac

SEQ ID NO: 3428365 - DNA, 15 bp, Homo sapiens
catttatagatcatt

SEQ ID NO: 3428366 - DNA, 20 bp, Homo sapiens
catttatagatcatttctag

SEQ ID NO: 3428367 - DNA, 14 bp, Homo sapiens
catttattctgctc

SEQ ID NO: 3428368 - DNA, 15 bp, Homo sapiens
catttattttgagaa

SEQ ID NO: 3428369 - DNA, 20 bp, Homo sapiens
catttattttgagaagctct

SEQ ID NO: 3428370 - DNA, 14 bp, Homo sapiens
catttcaagtttac

SEQ ID NO: 3428371 - DNA, 17 bp, Homo sapiens
catttcaattcctggcc

SEQ ID NO: 3428372 - DNA, 15 bp, Homo sapiens
catttcacccctccc

SEQ ID NO: 3428373 - DNA, 17 bp, Homo sapiens
catttcacccctccctt

SEQ ID NO: 3428374 - DNA, 20 bp, Homo sapiens
catttcacccctccctttct

SEQ ID NO: 3428375 - DNA, 21 bp, Homo sapiens
catttcacccctccctttctc

SEQ ID NO: 3428376 - DNA, 15 bp, Homo sapiens
catttcaggagcagc

SEQ ID NO: 3428377 - DNA, 15 bp, Homo sapiens
catttcatgtatagt

SEQ ID NO: 3428378 - DNA, 19 bp, Homo sapiens
catttccacaccaagcagc

SEQ ID NO: 3428379 - DNA, 23 bp, Homo sapiens
catttcctatcacctatttccat

SEQ ID NO: 3428380 - DNA, 14 bp, Homo sapiens
cagttgtccttaaa

SEQ ID NO: 3428381 - DNA, 19 bp, Homo sapiens
cagttgtccttaaatttgt

SEQ ID NO: 3428382 - DNA, 12 bp, Homo sapiens
cagttgtgcagc

SEQ ID NO: 3428383 - DNA, 20 bp, Homo sapiens
cagtttaacctgatgcagtc

SEQ ID NO: 3428384 - DNA, 20 bp, Homo sapiens
cagtttaagattttaagtat

SEQ ID NO: 3428385 - DNA, 21 bp, Homo sapiens
cagtttatttccactattttc

SEQ ID NO: 3428386 - DNA, 21 bp, Homo sapiens
cagtttatttttaaagataga

SEQ ID NO: 3428387 - DNA, 15 bp, Homo sapiens
cagtttcagagatgg

SEQ ID NO: 3428388 - DNA, 16 bp, Homo sapiens
cagtttcagagatgga

SEQ ID NO: 3428389 - DNA, 20 bp, Homo sapiens
cagtttgaaattctgaattt

SEQ ID NO: 3428390 - DNA, 15 bp, Homo sapiens
cagtttgagacagga

SEQ ID NO: 3428391 - DNA, 18 bp, Homo sapiens
cagtttgagacaggagac

SEQ ID NO: 3428392 - DNA, 14 bp, Homo sapiens
cagtttgtatatac

SEQ ID NO: 3428393 - DNA, 20 bp, Homo sapiens
cagtttgtggcatcttgcca

SEQ ID NO: 3428394 - DNA, 13 bp, Homo sapiens
cagttttccttct

SEQ ID NO: 3428395 - DNA, 22 bp, Homo sapiens
cagttttccttctcatctgtga

SEQ ID NO: 3428396 - DNA, 19 bp, Homo sapiens
cataaaaacattttaaaaa

SEQ ID NO: 3428397 - DNA, 23 bp, Homo sapiens
cataaaaagcaaaacaaaaatta

SEQ ID NO: 3428398 - DNA, 11 bp, Homo sapiens
cataaaacatt

SEQ ID NO: 3428399 - DNA, 22 bp, Homo sapiens
cataaaacattaagaaaatcat

SEQ ID NO: 3428400 - DNA, 21 bp, Homo sapiens
cataaagacaatcactgccaa

SEQ ID NO: 3428401 - DNA, 15 bp, Homo sapiens
cataaagtcagtgcc

SEQ ID NO: 3428402 - DNA, 14 bp, Homo sapiens
cataacaattcctc

SEQ ID NO: 3428403 - DNA, 16 bp, Homo sapiens
cataacctagccttag

SEQ ID NO: 3428404 - DNA, 16 bp, Homo sapiens
cataaggtttttatgc

SEQ ID NO: 3428405 - DNA, 17 bp, Homo sapiens
cataaggtttttatgca

SEQ ID NO: 3428406 - DNA, 12 bp, Homo sapiens
cataagtaagaa

SEQ ID NO: 3428407 - DNA, 15 bp, Homo sapiens
cataagtaagaaatt

SEQ ID NO: 3428408 - DNA, 20 bp, Homo sapiens
cataataaacgatgttgtga

SEQ ID NO: 3428409 - DNA, 15 bp, Homo sapiens
cataataaaggttgt

SEQ ID NO: 3428410 - DNA, 20 bp, Homo sapiens
cataatctaccaacgaaaga

SEQ ID NO: 3428411 - DNA, 18 bp, Homo sapiens
cataatgctaatttaaag

SEQ ID NO: 3428412 - DNA, 21 bp, Homo sapiens
cataatgggccactgaaatct

SEQ ID NO: 3428413 - DNA, 17 bp, Homo sapiens
cataattcactctgagt

SEQ ID NO: 3428414 - DNA, 21 bp, Homo sapiens
cataatttgtacatatgtaaa

SEQ ID NO: 3428415 - DNA, 23 bp, Homo sapiens
cataattttagtaatttcctaga

SEQ ID NO: 3428416 - DNA, 18 bp, Homo sapiens
catacaagggggtaactc

SEQ ID NO: 3428417 - DNA, 13 bp, Homo sapiens
catacaccagcat

SEQ ID NO: 3428418 - DNA, 14 bp, Homo sapiens
catacaccagcatt

SEQ ID NO: 3428419 - DNA, 21 bp, Homo sapiens
catacactgtatgttatagaa

SEQ ID NO: 3428420 - DNA, 13 bp, Homo sapiens
catacttgaaggg

SEQ ID NO: 3428421 - DNA, 18 bp, Homo sapiens
catacttgaagggccaga

SEQ ID NO: 3428422 - DNA, 22 bp, Homo sapiens
catacttgaagggccagagcca

SEQ ID NO: 3428423 - DNA, 13 bp, Homo sapiens
catagcaaacttc

SEQ ID NO: 3428424 - DNA, 23 bp, Homo sapiens
catagcaagattgcttaaaatag

SEQ ID NO: 3428425 - DNA, 19 bp, Homo sapiens
catagcagagaatgaaagg

SEQ ID NO: 3428426 - DNA, 17 bp, Homo sapiens
catagcagattttaatt

SEQ ID NO: 3428427 - DNA, 17 bp, Homo sapiens
catagcatgacatttct

SEQ ID NO: 3428428 - DNA, 18 bp, Homo sapiens
catagcatgacatttctt

SEQ ID NO: 3428429 - DNA, 13 bp, Homo sapiens
catagctgctgcc

SEQ ID NO: 3428430 - DNA, 23 bp, Homo sapiens
cataggactcaaagtttcagaga

SEQ ID NO: 3428431 - DNA, 16 bp, Homo sapiens
cataggtttaataatt

SEQ ID NO: 3428432 - DNA, 21 bp, Homo sapiens
catagtaacttcttatggaat

SEQ ID NO: 3428433 - DNA, 19 bp, Homo sapiens
catagtaccatttatacaa

SEQ ID NO: 3428434 - DNA, 22 bp, Homo sapiens
catagtaccatttatacaaatt

SEQ ID NO: 3428435 - DNA, 13 bp, Homo sapiens
catagtagttttt

SEQ ID NO: 3428436 - DNA, 18 bp, Homo sapiens
catagtatggtggctggg

SEQ ID NO: 3428437 - DNA, 20 bp, Homo sapiens
catagtatggtggctgggtt

SEQ ID NO: 3428438 - DNA, 16 bp, Homo sapiens
catagtttttcagtct

SEQ ID NO: 3428439 - DNA, 23 bp, Homo sapiens
catataaaataatgcaaagaatc

SEQ ID NO: 3428440 - DNA, 22 bp, Homo sapiens
catataagttgagaaggtgcct

SEQ ID NO: 3428441 - DNA, 23 bp, Homo sapiens
catataagttgagaaggtgcctg

SEQ ID NO: 3428442 - DNA, 14 bp, Homo sapiens
catatatatactat

SEQ ID NO: 3428443 - DNA, 22 bp, Homo sapiens
catatatccttttcttctatgt

SEQ ID NO: 3428444 - DNA, 23 bp, Homo sapiens
catatatccttttcttctatgta

SEQ ID NO: 3428445 - DNA, 14 bp, Homo sapiens
catatattgcattt

SEQ ID NO: 3428446 - DNA, 15 bp, Homo sapiens
catatattgcatttc

SEQ ID NO: 3428447 - DNA, 16 bp, Homo sapiens
catatattttttagaa

SEQ ID NO: 3428448 - DNA, 11 bp, Homo sapiens
catatctgcct

SEQ ID NO: 3428449 - DNA, 13 bp, Homo sapiens
catatctgccttt

SEQ ID NO: 3428450 - DNA, 15 bp, Homo sapiens
catatctgcctttat

SEQ ID NO: 3428451 - DNA, 15 bp, Homo sapiens
catatgaaaggagag

SEQ ID NO: 3428452 - DNA, 19 bp, Homo sapiens
catatgaaaggtgccatgg

SEQ ID NO: 3428453 - DNA, 21 bp, Homo sapiens
catatgaaaggtgccatggaa

SEQ ID NO: 3428454 - DNA, 15 bp, Homo sapiens
catatgaattgtaca

SEQ ID NO: 3428455 - DNA, 20 bp, Homo sapiens
catatgacaagcctttgtgc

SEQ ID NO: 3428456 - DNA, 21 bp, Homo sapiens
catatgacattcatgcctggc

SEQ ID NO: 3428457 - DNA, 22 bp, Homo sapiens
catatgactcacatgatgcata

SEQ ID NO: 3428458 - DNA, 16 bp, Homo sapiens
catatgctgacagctc

SEQ ID NO: 3428459 - DNA, 20 bp, Homo sapiens
catatggtctccattttaca

SEQ ID NO: 3428460 - DNA, 18 bp, Homo sapiens
catatggttgaataaata

SEQ ID NO: 3428461 - DNA, 13 bp, Homo sapiens
catatgtaaaata

SEQ ID NO: 3428462 - DNA, 13 bp, Homo sapiens
catatgtacagaa

SEQ ID NO: 3428463 - DNA, 17 bp, Homo sapiens
catatgtagccttcaca

SEQ ID NO: 3428464 - DNA, 13 bp, Homo sapiens
catatgtgtgtgt

SEQ ID NO: 3428465 - DNA, 13 bp, Homo sapiens
catatgttaagca

SEQ ID NO: 3428466 - DNA, 16 bp, Homo sapiens
catatgttgaatactt

SEQ ID NO: 3428467 - DNA, 18 bp, Homo sapiens
catatgttgaatactttt

SEQ ID NO: 3428468 - DNA, 22 bp, Homo sapiens
catattctgttggccagtgtga

SEQ ID NO: 3428469 - DNA, 15 bp, Homo sapiens
catattcttgtgctt

SEQ ID NO: 3428470 - DNA, 14 bp, Homo sapiens
caggttggtggggg

SEQ ID NO: 3428471 - DNA, 21 bp, Homo sapiens
caggttggtgggggcctcggt

SEQ ID NO: 3428472 - DNA, 18 bp, Homo sapiens
caggtttaagctgttact

SEQ ID NO: 3428473 - DNA, 20 bp, Homo sapiens
caggtttctggtctctaggc

SEQ ID NO: 3428474 - DNA, 23 bp, Homo sapiens
caggtttttggtctgacccactg

SEQ ID NO: 3428475 - DNA, 18 bp, Homo sapiens
cagtaaaattgccatatt

SEQ ID NO: 3428476 - DNA, 20 bp, Homo sapiens
cagtaaaattgccatattgc

SEQ ID NO: 3428477 - DNA, 16 bp, Homo sapiens
cagtaaacagaggagt

SEQ ID NO: 3428478 - DNA, 18 bp, Homo sapiens
cagtaacgcaggggaaac

SEQ ID NO: 3428479 - DNA, 12 bp, Homo sapiens
cagtacaggcag

SEQ ID NO: 3428480 - DNA, 14 bp, Homo sapiens
cagtacaggcagca

SEQ ID NO: 3428481 - DNA, 16 bp, Homo sapiens
cagtacaggcagcaca

SEQ ID NO: 3428482 - DNA, 19 bp, Homo sapiens
cagtacaggcagcacagag

SEQ ID NO: 3428483 - DNA, 15 bp, Homo sapiens
cagtacttttttaaa

SEQ ID NO: 3428484 - DNA, 23 bp, Homo sapiens
cagtacttttttaaatattttct

SEQ ID NO: 3428485 - DNA, 19 bp, Homo sapiens
cagtagaaataatatgcat

SEQ ID NO: 3428486 - DNA, 20 bp, Homo sapiens
cagtagaccttgttacttct

SEQ ID NO: 3428487 - DNA, 16 bp, Homo sapiens
cagtagattttccaaa

SEQ ID NO: 3428488 - DNA, 14 bp, Homo sapiens
cagtaggagcccag

SEQ ID NO: 3428489 - DNA, 22 bp, Homo sapiens
cagtaggagcccagctctgaaa

SEQ ID NO: 3428490 - DNA, 22 bp, Homo sapiens
cagtaggttatttagcttggga

SEQ ID NO: 3428491 - DNA, 18 bp, Homo sapiens
cagtagtttgagaccagc

SEQ ID NO: 3428492 - DNA, 21 bp, Homo sapiens
cagtagtttgagaccagcctg

SEQ ID NO: 3428493 - DNA, 22 bp, Homo sapiens
cagtagtttgagaccagcctgg

SEQ ID NO: 3428494 - DNA, 24 bp, Homo sapiens
cagtatccatgctcttgaccttgt

SEQ ID NO: 3428495 - DNA, 18 bp, Homo sapiens
cagtatgacagaggagga

SEQ ID NO: 3428496 - DNA, 23 bp, Homo sapiens
cagtatggtacatttttcaactt

SEQ ID NO: 3428497 - DNA, 13 bp, Homo sapiens
cagtatgttgtca

SEQ ID NO: 3428498 - DNA, 15 bp, Homo sapiens
cagtatgttgtcaaa

SEQ ID NO: 3428499 - DNA, 18 bp, Homo sapiens
cagtattacttctgctac

SEQ ID NO: 3428500 - DNA, 19 bp, Homo sapiens
cagtattacttctgctaca

SEQ ID NO: 3428501 - DNA, 17 bp, Homo sapiens
cagtattttgtgtcctc

SEQ ID NO: 3428502 - DNA, 15 bp, Homo sapiens
cagtcaaatctgggc

SEQ ID NO: 3428503 - DNA, 15 bp, Homo sapiens
cagtcaacagttcaa

SEQ ID NO: 3428504 - DNA, 23 bp, Homo sapiens
cagtcaacagttcaaagaagtca

SEQ ID NO: 3428505 - DNA, 15 bp, Homo sapiens
cagtcaacctgggca

SEQ ID NO: 3428506 - DNA, 16 bp, Homo sapiens
cagtcaacctgggcaa

SEQ ID NO: 3428507 - DNA, 22 bp, Homo sapiens
cagtcaacctgggcaaagccta

SEQ ID NO: 3428508 - DNA, 13 bp, Homo sapiens
cagtcaagaagaa

SEQ ID NO: 3428509 - DNA, 13 bp, Homo sapiens
cagtcacgcctga

SEQ ID NO: 3428510 - DNA, 23 bp, Homo sapiens
cagtcacgtggaggagcagtgca

SEQ ID NO: 3428511 - DNA, 17 bp, Homo sapiens
cagtcactgaattccat

SEQ ID NO: 3428512 - DNA, 21 bp, Homo sapiens
cagtcacttcggccagagctg

SEQ ID NO: 3428513 - DNA, 20 bp, Homo sapiens
cagtcagatttccagtctcc

SEQ ID NO: 3428514 - DNA, 21 bp, Homo sapiens
cagtcaggaaaggaatcattt

SEQ ID NO: 3428515 - DNA, 13 bp, Homo sapiens
cagtcattggctg

SEQ ID NO: 3428516 - DNA, 19 bp, Homo sapiens
cagtccaaggaaaccacag

SEQ ID NO: 3428517 - DNA, 13 bp, Homo sapiens
cagtccacaaaat

SEQ ID NO: 3428518 - DNA, 16 bp, Homo sapiens
cagtccagccagctcc

SEQ ID NO: 3428519 - DNA, 14 bp, Homo sapiens
cagtccagcctgga

SEQ ID NO: 3428520 - DNA, 15 bp, Homo sapiens
cagtccaggctgccg

SEQ ID NO: 3428521 - DNA, 19 bp, Homo sapiens
cagtcccaaatccttccca

SEQ ID NO: 3428522 - DNA, 20 bp, Homo sapiens
cagtcccaccctgctgctgc

SEQ ID NO: 3428523 - DNA, 18 bp, Homo sapiens
cagtccccattttctggt

SEQ ID NO: 3428524 - DNA, 15 bp, Homo sapiens
cagtccgcctggccg

SEQ ID NO: 3428525 - DNA, 22 bp, Homo sapiens
cagtccgcctggccggctccag

SEQ ID NO: 3428526 - DNA, 13 bp, Homo sapiens
cagtcctctttca

SEQ ID NO: 3428527 - DNA, 13 bp, Homo sapiens
cagtcctgaagca

SEQ ID NO: 3428528 - DNA, 16 bp, Homo sapiens
cagtcctgaagcagca

SEQ ID NO: 3428529 - DNA, 12 bp, Homo sapiens
cagtcctgccac

SEQ ID NO: 3428530 - DNA, 13 bp, Homo sapiens
cagtcctgccacc

SEQ ID NO: 3428531 - DNA, 19 bp, Homo sapiens
cagtcctgcctcagcctcc

SEQ ID NO: 3428532 - DNA, 16 bp, Homo sapiens
cagtccttaaaaatca

SEQ ID NO: 3428533 - DNA, 21 bp, Homo sapiens
cagtccttttactacagctat

SEQ ID NO: 3428534 - DNA, 17 bp, Homo sapiens
cagtcgtgcctgtgtcc

SEQ ID NO: 3428535 - DNA, 16 bp, Homo sapiens
cagtctccaccaggaa

SEQ ID NO: 3428536 - DNA, 13 bp, Homo sapiens
cagtctcctctcc

SEQ ID NO: 3428537 - DNA, 14 bp, Homo sapiens
cagtctctgagcag

SEQ ID NO: 3428538 - DNA, 21 bp, Homo sapiens
cagtctctttattttactaga

SEQ ID NO: 3428539 - DNA, 23 bp, Homo sapiens
cagtctctttattttactagaaa

SEQ ID NO: 3428540 - DNA, 19 bp, Homo sapiens
cagtctgattcccaagctc

SEQ ID NO: 3428541 - DNA, 19 bp, Homo sapiens
cagtcttccacaaagaaaa

SEQ ID NO: 3428542 - DNA, 20 bp, Homo sapiens
cagtcttccacaaagaaaat

SEQ ID NO: 3428543 - DNA, 21 bp, Homo sapiens
cagtcttccatttgcaaggga

SEQ ID NO: 3428544 - DNA, 14 bp, Homo sapiens
cagtcttgcagcag

SEQ ID NO: 3428545 - DNA, 17 bp, Homo sapiens
cagtgaatttttgcaat

SEQ ID NO: 3428546 - DNA, 19 bp, Homo sapiens
cagtgaatttttgcaataa

SEQ ID NO: 3428547 - DNA, 21 bp, Homo sapiens
cagtgaatttttgcaataatg

SEQ ID NO: 3428548 - DNA, 14 bp, Homo sapiens
cagtgacctgagga

SEQ ID NO: 3428549 - DNA, 18 bp, Homo sapiens
cagtgacctgaggaagcg

SEQ ID NO: 3428550 - DNA, 19 bp, Homo sapiens
cagtgacctgaggaagcgt

SEQ ID NO: 3428551 - DNA, 24 bp, Homo sapiens
cagtgagccgagattgcaccactg

SEQ ID NO: 3428552 - DNA, 16 bp, Homo sapiens
caggactcaccctcat

SEQ ID NO: 3428553 - DNA, 20 bp, Homo sapiens
caggactcagaagcctctgg

SEQ ID NO: 3428554 - DNA, 17 bp, Homo sapiens
caggactcagctcccca

SEQ ID NO: 3428555 - DNA, 20 bp, Homo sapiens
caggactcagctccccagag

SEQ ID NO: 3428556 - DNA, 21 bp, Homo sapiens
caggactcagctccccagagt

SEQ ID NO: 3428557 - DNA, 16 bp, Homo sapiens
caggactccaggccca

SEQ ID NO: 3428558 - DNA, 12 bp, Homo sapiens
caggactctgac

SEQ ID NO: 3428559 - DNA, 13 bp, Homo sapiens
caggactgcagag

SEQ ID NO: 3428560 - DNA, 15 bp, Homo sapiens
caggactgcagagca

SEQ ID NO: 3428561 - DNA, 13 bp, Homo sapiens
caggactggctgt

SEQ ID NO: 3428562 - DNA, 15 bp, Homo sapiens
caggactgggccact

SEQ ID NO: 3428563 - DNA, 16 bp, Homo sapiens
caggactgggccactt

SEQ ID NO: 3428564 - DNA, 21 bp, Homo sapiens
caggacttccccggagggctg

SEQ ID NO: 3428565 - DNA, 19 bp, Homo sapiens
caggacttctgcctgaacc

SEQ ID NO: 3428566 - DNA, 14 bp, Homo sapiens
caggagaagagagg

SEQ ID NO: 3428567 - DNA, 22 bp, Homo sapiens
caggagaaggccaattcctata

SEQ ID NO: 3428568 - DNA, 19 bp, Homo sapiens
caggagaagggctggggcc

SEQ ID NO: 3428569 - DNA, 22 bp, Homo sapiens
caggagactgggctctggctct

SEQ ID NO: 3428570 - DNA, 19 bp, Homo sapiens
caggagcacacccagcccc

SEQ ID NO: 3428571 - DNA, 23 bp, Homo sapiens
caggagccccgaggccttctctg

SEQ ID NO: 3428572 - DNA, 14 bp, Homo sapiens
caggagctgggatc

SEQ ID NO: 3428573 - DNA, 22 bp, Homo sapiens
caggagctgtcaccaaggaaac

SEQ ID NO: 3428574 - DNA, 17 bp, Homo sapiens
caggagcttgcaagaag

SEQ ID NO: 3428575 - DNA, 21 bp, Homo sapiens
caggaggagttagccaaacaa

SEQ ID NO: 3428576 - DNA, 19 bp, Homo sapiens
caggaggatcacttgagtc

SEQ ID NO: 3428577 - DNA, 18 bp, Homo sapiens
caggaggcaggaccttcg

SEQ ID NO: 3428578 - DNA, 21 bp, Homo sapiens
caggaggccctggtcctggcc

SEQ ID NO: 3428579 - DNA, 18 bp, Homo sapiens
caggagtccactttgttt

SEQ ID NO: 3428580 - DNA, 22 bp, Homo sapiens
caggagtttgagaccaacctgg

SEQ ID NO: 3428581 - DNA, 20 bp, Homo sapiens
caggatcagattgcatgtga

SEQ ID NO: 3428582 - DNA, 14 bp, Homo sapiens
caggatcagtctga

SEQ ID NO: 3428583 - DNA, 13 bp, Homo sapiens
caggatccagcct

SEQ ID NO: 3428584 - DNA, 15 bp, Homo sapiens
caggatcgaagggtt

SEQ ID NO: 3428585 - DNA, 18 bp, Homo sapiens
caggatctcttagcattt

SEQ ID NO: 3428586 - DNA, 14 bp, Homo sapiens
caggatttgcacag

SEQ ID NO: 3428587 - DNA, 16 bp, Homo sapiens
caggatttgcacagaa

SEQ ID NO: 3428588 - DNA, 20 bp, Homo sapiens
caggatttgttctctgtcca

SEQ ID NO: 3428589 - DNA, 14 bp, Homo sapiens
caggcaagcacctc

SEQ ID NO: 3428590 - DNA, 16 bp, Homo sapiens
caggcaatgctggctg

SEQ ID NO: 3428591 - DNA, 20 bp, Homo sapiens
caggcaatgctggctgttgg

SEQ ID NO: 3428592 - DNA, 21 bp, Homo sapiens
caggcaatgctggctgttggc

SEQ ID NO: 3428593 - DNA, 13 bp, Homo sapiens
caggcacacagct

SEQ ID NO: 3428594 - DNA, 16 bp, Homo sapiens
caggcaccagtccctg

SEQ ID NO: 3428595 - DNA, 18 bp, Homo sapiens
caggcaccagtccctgtc

SEQ ID NO: 3428596 - DNA, 22 bp, Homo sapiens
caggcacccaccatcatgtctg

SEQ ID NO: 3428597 - DNA, 14 bp, Homo sapiens
caggcacggtttgg

SEQ ID NO: 3428598 - DNA, 14 bp, Homo sapiens
caggcactgcaaac

SEQ ID NO: 3428599 - DNA, 15 bp, Homo sapiens
caggcagcacagaga

SEQ ID NO: 3428600 - DNA, 16 bp, Homo sapiens
caggcaggctcccagg

SEQ ID NO: 3428601 - DNA, 15 bp, Homo sapiens
caggcaggtccaggg

SEQ ID NO: 3428602 - DNA, 19 bp, Homo sapiens
caggcaggtccagggtttg

SEQ ID NO: 3428603 - DNA, 15 bp, Homo sapiens
caggcaggtgggatg

SEQ ID NO: 3428604 - DNA, 19 bp, Homo sapiens
caggcagtttcagagatgg

SEQ ID NO: 3428605 - DNA, 22 bp, Homo sapiens
caggcagtttcagagatggaca

SEQ ID NO: 3428606 - DNA, 18 bp, Homo sapiens
caggcatgttctctgagg

SEQ ID NO: 3428607 - DNA, 17 bp, Homo sapiens
caggccaagaaacgtct

SEQ ID NO: 3428608 - DNA, 11 bp, Homo sapiens
caggccacctc

SEQ ID NO: 3428609 - DNA, 12 bp, Homo sapiens
caggccacctcc

SEQ ID NO: 3428610 - DNA, 15 bp, Homo sapiens
caggccactgggccc

SEQ ID NO: 3428611 - DNA, 23 bp, Homo sapiens
caggccactgggccctgagccag

SEQ ID NO: 3428612 - DNA, 24 bp, Homo sapiens
caggccactgggccctgagccaga

SEQ ID NO: 3428613 - DNA, 13 bp, Homo sapiens
caggccagagcca

SEQ ID NO: 3428614 - DNA, 19 bp, Homo sapiens
caggccagagggagtgaca

SEQ ID NO: 3428615 - DNA, 21 bp, Homo sapiens
caggccatcatcagtggagcc

SEQ ID NO: 3428616 - DNA, 20 bp, Homo sapiens
caggccattgtgaaccaatg

SEQ ID NO: 3428617 - DNA, 14 bp, Homo sapiens
caggccccaggaag

SEQ ID NO: 3428618 - DNA, 16 bp, Homo sapiens
cagcgaggaggctcca

SEQ ID NO: 3428619 - DNA, 18 bp, Homo sapiens
cagcgaggaggctccaga

SEQ ID NO: 3428620 - DNA, 19 bp, Homo sapiens
cagcgctgggtccacccca

SEQ ID NO: 3428621 - DNA, 20 bp, Homo sapiens
cagcggctcacgcctgtaat

SEQ ID NO: 3428622 - DNA, 22 bp, Homo sapiens
cagcgggaatggcagctgccac

SEQ ID NO: 3428623 - DNA, 19 bp, Homo sapiens
cagcggggacagctccttc

SEQ ID NO: 3428624 - DNA, 21 bp, Homo sapiens
cagcggggacagctccttctg

SEQ ID NO: 3428625 - DNA, 15 bp, Homo sapiens
cagcgtgctttaaaa

SEQ ID NO: 3428626 - DNA, 15 bp, Homo sapiens
cagctaaagatgaga

SEQ ID NO: 3428627 - DNA, 12 bp, Homo sapiens
cagctaaagcaa

SEQ ID NO: 3428628 - DNA, 17 bp, Homo sapiens
cagctaacaattgtgaa

SEQ ID NO: 3428629 - DNA, 18 bp, Homo sapiens
cagctaacacacagctcc

SEQ ID NO: 3428630 - DNA, 12 bp, Homo sapiens
cagctaagaaaa

SEQ ID NO: 3428631 - DNA, 23 bp, Homo sapiens
cagctaagaacctggaacttggg

SEQ ID NO: 3428632 - DNA, 18 bp, Homo sapiens
cagctaatacccagagca

SEQ ID NO: 3428633 - DNA, 18 bp, Homo sapiens
cagctacacctttctcct

SEQ ID NO: 3428634 - DNA, 14 bp, Homo sapiens
cagctactcgggag

SEQ ID NO: 3428635 - DNA, 15 bp, Homo sapiens
cagctactctgatcc

SEQ ID NO: 3428636 - DNA, 23 bp, Homo sapiens
cagctactctgatccctctgggg

SEQ ID NO: 3428637 - DNA, 17 bp, Homo sapiens
cagctacttggtttgtg

SEQ ID NO: 3428638 - DNA, 22 bp, Homo sapiens
cagctatacctgtgcctcggct

SEQ ID NO: 3428639 - DNA, 13 bp, Homo sapiens
cagctatctgcct

SEQ ID NO: 3428640 - DNA, 13 bp, Homo sapiens
cagctcacagtgc

SEQ ID NO: 3428641 - DNA, 19 bp, Homo sapiens
cagctcaccagccccagtg

SEQ ID NO: 3428642 - DNA, 21 bp, Homo sapiens
cagctcaccagccccagtgcc

SEQ ID NO: 3428643 - DNA, 13 bp, Homo sapiens
cagctcacgcttc

SEQ ID NO: 3428644 - DNA, 16 bp, Homo sapiens
cagctcaggacagatg

SEQ ID NO: 3428645 - DNA, 22 bp, Homo sapiens
cagctcaggacagatgccacac

SEQ ID NO: 3428646 - DNA, 17 bp, Homo sapiens
cagctccaacctgcaaa

SEQ ID NO: 3428647 - DNA, 23 bp, Homo sapiens
cagctccaacctgcaaagatctg

SEQ ID NO: 3428648 - DNA, 15 bp, Homo sapiens
cagctccagctcacc

SEQ ID NO: 3428649 - DNA, 18 bp, Homo sapiens
cagctccagctcaccagc

SEQ ID NO: 3428650 - DNA, 20 bp, Homo sapiens
cagctccagctcaccagccc

SEQ ID NO: 3428651 - DNA, 15 bp, Homo sapiens
cagctccccagagtc

SEQ ID NO: 3428652 - DNA, 15 bp, Homo sapiens
cagctccccaggact

SEQ ID NO: 3428653 - DNA, 14 bp, Homo sapiens
cagctccctggctt

SEQ ID NO: 3428654 - DNA, 20 bp, Homo sapiens
cagctccctggcttctgtgg

SEQ ID NO: 3428655 - DNA, 19 bp, Homo sapiens
cagctcctcatccagggct

SEQ ID NO: 3428656 - DNA, 20 bp, Homo sapiens
cagctcctcatccagggctc

SEQ ID NO: 3428657 - DNA, 16 bp, Homo sapiens
cagctcctgggcagct

SEQ ID NO: 3428658 - DNA, 19 bp, Homo sapiens
cagctcctgggcagcttga

SEQ ID NO: 3428659 - DNA, 14 bp, Homo sapiens
cagctccttcctgg

SEQ ID NO: 3428660 - DNA, 16 bp, Homo sapiens
cagctccttcctggag

SEQ ID NO: 3428661 - DNA, 23 bp, Homo sapiens
cagctccttctgtcctactctgt

SEQ ID NO: 3428662 - DNA, 18 bp, Homo sapiens
cagctctcagttgcagcc

SEQ ID NO: 3428663 - DNA, 15 bp, Homo sapiens
cagctctctgccctg

SEQ ID NO: 3428664 - DNA, 21 bp, Homo sapiens
cagctctgcaagaattgaagc

SEQ ID NO: 3428665 - DNA, 17 bp, Homo sapiens
cagctctggacagcccc

SEQ ID NO: 3428666 - DNA, 21 bp, Homo sapiens
cagctctggacagccccaccc

SEQ ID NO: 3428667 - DNA, 11 bp, Homo sapiens
cagctctggag

SEQ ID NO: 3428668 - DNA, 12 bp, Homo sapiens
cagctctgggcc

SEQ ID NO: 3428669 - DNA, 13 bp, Homo sapiens
cagctctgtcctg

SEQ ID NO: 3428670 - DNA, 14 bp, Homo sapiens
cagctctgtcctgg

SEQ ID NO: 3428671 - DNA, 14 bp, Homo sapiens
cagctcttctccag

SEQ ID NO: 3428672 - DNA, 15 bp, Homo sapiens
cagctcttctccagg

SEQ ID NO: 3428673 - DNA, 17 bp, Homo sapiens
cagctcttctccaggct

SEQ ID NO: 3428674 - DNA, 13 bp, Homo sapiens
cagctctttcctc

SEQ ID NO: 3428675 - DNA, 18 bp, Homo sapiens
cagctctttcctccttcc

SEQ ID NO: 3428676 - DNA, 16 bp, Homo sapiens
caacgtgcaaagccaa

SEQ ID NO: 3428677 - DNA, 20 bp, Homo sapiens
caacgtgcaaagccaaggca

SEQ ID NO: 3428678 - DNA, 17 bp, Homo sapiens
caactacccaaaacaag

SEQ ID NO: 3428679 - DNA, 21 bp, Homo sapiens
caactacccaaaacaagcctg

SEQ ID NO: 3428680 - DNA, 17 bp, Homo sapiens
caactacccccagctgt

SEQ ID NO: 3428681 - DNA, 19 bp, Homo sapiens
caactacccccagctgtgc

SEQ ID NO: 3428682 - DNA, 21 bp, Homo sapiens
caactagatcaaggagcccag

SEQ ID NO: 3428683 - DNA, 16 bp, Homo sapiens
caactagttttgttta

SEQ ID NO: 3428684 - DNA, 19 bp, Homo sapiens
caactatattatcatgcaa

SEQ ID NO: 3428685 - DNA, 21 bp, Homo sapiens
caactatttattgactctggg

SEQ ID NO: 3428686 - DNA, 22 bp, Homo sapiens
caactatttattgactctgggt

SEQ ID NO: 3428687 - DNA, 16 bp, Homo sapiens
caactcattccagatc

SEQ ID NO: 3428688 - DNA, 19 bp, Homo sapiens
caactcctcgacatcactg

SEQ ID NO: 3428689 - DNA, 21 bp, Homo sapiens
caactcctcgacatcactgtt

SEQ ID NO: 3428690 - DNA, 19 bp, Homo sapiens
caactcgtatagcatgcat

SEQ ID NO: 3428691 - DNA, 13 bp, Homo sapiens
caactctagctgg

SEQ ID NO: 3428692 - DNA, 16 bp, Homo sapiens
caactcttgattatcc

SEQ ID NO: 3428693 - DNA, 16 bp, Homo sapiens
caactctttgagaaac

SEQ ID NO: 3428694 - DNA, 23 bp, Homo sapiens
caactgcctcgaaacacagaaac

SEQ ID NO: 3428695 - DNA, 17 bp, Homo sapiens
caactgctcagctctgg

SEQ ID NO: 3428696 - DNA, 14 bp, Homo sapiens
caactggcaggcag

SEQ ID NO: 3428697 - DNA, 14 bp, Homo sapiens
caactgtgtagcat

SEQ ID NO: 3428698 - DNA, 22 bp, Homo sapiens
caacttctgcctcccatgctta

SEQ ID NO: 3428699 - DNA, 20 bp, Homo sapiens
caacttctttttattttctt

SEQ ID NO: 3428700 - DNA, 20 bp, Homo sapiens
caacttgtatccaggcctgg

SEQ ID NO: 3428701 - DNA, 18 bp, Homo sapiens
caactttggttcctgtga

SEQ ID NO: 3428702 - DNA, 19 bp, Homo sapiens
caactttttattgccttct

SEQ ID NO: 3428703 - DNA, 20 bp, Homo sapiens
caactttttattgccttctc

SEQ ID NO: 3428704 - DNA, 13 bp, Homo sapiens
caagaaataaaag

SEQ ID NO: 3428705 - DNA, 19 bp, Homo sapiens
caagaaataaaaggaagcc

SEQ ID NO: 3428706 - DNA, 20 bp, Homo sapiens
caagaaataaaaggaagcca

SEQ ID NO: 3428707 - DNA, 16 bp, Homo sapiens
caagaactcatcactg

SEQ ID NO: 3428708 - DNA, 21 bp, Homo sapiens
caagaactcatcactgtggct

SEQ ID NO: 3428709 - DNA, 13 bp, Homo sapiens
caagaagaaaaag

SEQ ID NO: 3428710 - DNA, 15 bp, Homo sapiens
caagaagcaggaagg

SEQ ID NO: 3428711 - DNA, 23 bp, Homo sapiens
caagaatagcatctgtacaaagg

SEQ ID NO: 3428712 - DNA, 23 bp, Homo sapiens
caagaccccaagaggaagttcag

SEQ ID NO: 3428713 - DNA, 13 bp, Homo sapiens
caagacccccagc

SEQ ID NO: 3428714 - DNA, 18 bp, Homo sapiens
caagactctttggacact

SEQ ID NO: 3428715 - DNA, 18 bp, Homo sapiens
caagagaacattttactg

SEQ ID NO: 3428716 - DNA, 18 bp, Homo sapiens
caagagatattttgggca

SEQ ID NO: 3428717 - DNA, 16 bp, Homo sapiens
caagagcacacttggc

SEQ ID NO: 3428718 - DNA, 20 bp, Homo sapiens
caagagccatgtagaagctg

SEQ ID NO: 3428719 - DNA, 19 bp, Homo sapiens
caagagggacgcctggggg

SEQ ID NO: 3428720 - DNA, 12 bp, Homo sapiens
caagagggctgc

SEQ ID NO: 3428721 - DNA, 13 bp, Homo sapiens
caagagggctgct

SEQ ID NO: 3428722 - DNA, 16 bp, Homo sapiens
caagagggtctgagga

SEQ ID NO: 3428723 - DNA, 19 bp, Homo sapiens
caagagtagttatataatt

SEQ ID NO: 3428724 - DNA, 14 bp, Homo sapiens
caagatattatgta

SEQ ID NO: 3428725 - DNA, 13 bp, Homo sapiens
caagatgacagct

SEQ ID NO: 3428726 - DNA, 15 bp, Homo sapiens
caagatgacagctct

SEQ ID NO: 3428727 - DNA, 17 bp, Homo sapiens
caagatgacagctcttc

SEQ ID NO: 3428728 - DNA, 23 bp, Homo sapiens
caagatgacagctcttctaagga

SEQ ID NO: 3428729 - DNA, 16 bp, Homo sapiens
caagatgccccaggga

SEQ ID NO: 3428730 - DNA, 12 bp, Homo sapiens
caagatgcctga

SEQ ID NO: 3428731 - DNA, 18 bp, Homo sapiens
caagatgggggcagggct

SEQ ID NO: 3428732 - DNA, 13 bp, Homo sapiens
caagattgcttaa

SEQ ID NO: 3428733 - DNA, 16 bp, Homo sapiens
caagattgcttaaaat

SEQ ID NO: 3428734 - DNA, 15 bp, Homo sapiens
caagcaacagccttt

SEQ ID NO: 3428735 - DNA, 12 bp, Homo sapiens
caagcaagctcc

SEQ ID NO: 3428736 - DNA, 23 bp, Homo sapiens
caagcaagctcccaagggatggt

SEQ ID NO: 3428737 - DNA, 15 bp, Homo sapiens
caagcacctcctgcc

SEQ ID NO: 3428738 - DNA, 18 bp, Homo sapiens
caagcacctcctgcctcg

SEQ ID NO: 3428739 - DNA, 12 bp, Homo sapiens
caagcactgtgc

SEQ ID NO: 3428740 - DNA, 17 bp, Homo sapiens
caagcaggaaatgaaaa

SEQ ID NO: 3428741 - DNA, 15 bp, Homo sapiens
caagcaggaagctca

SEQ ID NO: 3428742 - DNA, 18 bp, Homo sapiens
caagcaggacagtgcttg

SEQ ID NO: 3428743 - DNA, 19 bp, Homo sapiens
caagcagtcgtgcctgtgt

SEQ ID NO: 3428744 - DNA, 21 bp, Homo sapiens
caagcagtcgtgcctgtgtcc

SEQ ID NO: 3428745 - DNA, 17 bp, Homo sapiens
caagccaagaaagatgt

SEQ ID NO: 3428746 - DNA, 18 bp, Homo sapiens
caagccaagcagccaagc

SEQ ID NO: 3428747 - DNA, 21 bp, Homo sapiens
caagccaagggaacctgtgtc

SEQ ID NO: 3428748 - DNA, 23 bp, Homo sapiens
caagccaagggaacctgtgtccg

SEQ ID NO: 3428749 - DNA, 13 bp, Homo sapiens
caagccagctgcc

SEQ ID NO: 3428750 - DNA, 17 bp, Homo sapiens
caagccagctgcctagg

SEQ ID NO: 3428751 - DNA, 17 bp, Homo sapiens
caagcccctctttctgt

SEQ ID NO: 3428752 - DNA, 21 bp, Homo sapiens
caagcccctgctccagaagat

SEQ ID NO: 3428753 - DNA, 19 bp, Homo sapiens
caagcctcatattttctgt

SEQ ID NO: 3428754 - DNA, 22 bp, Homo sapiens
caagcctgcagtcatcttgacc

SEQ ID NO: 3428755 - DNA, 19 bp, Homo sapiens
caagccttccagggatttg

SEQ ID NO: 3428756 - DNA, 20 bp, Homo sapiens
caagcgattctcctgcctca

SEQ ID NO: 3428757 - DNA, 17 bp, Homo sapiens
caagcgattcttctgct

SEQ ID NO: 3428758 - DNA, 22 bp, Homo sapiens
caagcgattcttctgcttcagc

SEQ ID NO: 3428759 - DNA, 16 bp, Homo sapiens
caagcgtgagccactg

SEQ ID NO: 3428760 - DNA, 15 bp, Homo sapiens
caagctatcctggct

SEQ ID NO: 3428761 - DNA, 21 bp, Homo sapiens
caagctcagaggcgcactgtg

SEQ ID NO: 3428762 - DNA, 23 bp, Homo sapiens
caagctcctcctccctgcatctg

SEQ ID NO: 3428763 - DNA, 15 bp, Homo sapiens
caagctctgctcctc

SEQ ID NO: 3428764 - DNA, 21 bp, Homo sapiens
caagctgcaccctcaggcagg

SEQ ID NO: 3428765 - DNA, 15 bp, Homo sapiens
caagctgctctgagc

SEQ ID NO: 3428766 - DNA, 22 bp, Homo sapiens
caagctgctctgagccacagtg

SEQ ID NO: 3428767 - DNA, 14 bp, Homo sapiens
caagctggctgggg

SEQ ID NO: 3428768 - DNA, 21 bp, Homo sapiens
caagctggtcccactcagtcc

SEQ ID NO: 3428769 - DNA, 17 bp, Homo sapiens
caagcttcaaccctcag

SEQ ID NO: 3428770 - DNA, 21 bp, Homo sapiens
caagcttccatagctgctgcc

SEQ ID NO: 3428771 - DNA, 17 bp, Homo sapiens
caaggaaaccacagctg

SEQ ID NO: 3428772 - DNA, 21 bp, Homo sapiens
caaggaaaccacagctgctgg

SEQ ID NO: 3428773 - DNA, 22 bp, Homo sapiens
caaggaaactttcctttaactc

SEQ ID NO: 3428774 - DNA, 14 bp, Homo sapiens
caaggaaaggcctg

SEQ ID NO: 3428775 - DNA, 22 bp, Homo sapiens
caaggactaatccaatacctct

SEQ ID NO: 3428776 - DNA, 12 bp, Homo sapiens
caaggactgagc

SEQ ID NO: 3428777 - DNA, 13 bp, Homo sapiens
caaggactgagca

SEQ ID NO: 3428778 - DNA, 14 bp, Homo sapiens
caaggacttcctgt

SEQ ID NO: 3428779 - DNA, 19 bp, Homo sapiens
caaggacttcctgtccagc

SEQ ID NO: 3428780 - DNA, 22 bp, Homo sapiens
caaggacttcctgtccagctcc

SEQ ID NO: 3428781 - DNA, 23 bp, Homo sapiens
caaggacttcctgtccagctcca

SEQ ID NO: 3428782 - DNA, 14 bp, Homo sapiens
caaggagaggaggc

SEQ ID NO: 3428783 - DNA, 18 bp, Homo sapiens
caaggagaggaggcaact

SEQ ID NO: 3428784 - DNA, 22 bp, Homo sapiens
caaggagctgctatagcctggg

SEQ ID NO: 3428785 - DNA, 19 bp, Homo sapiens
caaggagggtgagtgcaag

SEQ ID NO: 3428786 - DNA, 16 bp, Homo sapiens
caaggatagatgctgg

SEQ ID NO: 3428787 - DNA, 15 bp, Homo sapiens
caaggattgctactg

SEQ ID NO: 3428788 - DNA, 16 bp, Homo sapiens
caaggcactgcctgat

SEQ ID NO: 3428789 - DNA, 15 bp, Homo sapiens
caaggccagggacag

SEQ ID NO: 3428790 - DNA, 17 bp, Homo sapiens
caaggccatctgggctc

SEQ ID NO: 3428791 - DNA, 16 bp, Homo sapiens
caaggcccagatgtgg

SEQ ID NO: 3428792 - DNA, 22 bp, Homo sapiens
caaggccttattggaaagcagt

SEQ ID NO: 3428793 - DNA, 12 bp, Homo sapiens
caaggccttcag

SEQ ID NO: 3428794 - DNA, 21 bp, Homo sapiens
caaggcggtggacttgaactt

SEQ ID NO: 3428795 - DNA, 22 bp, Homo sapiens
caaggcggtggacttgaacttt

SEQ ID NO: 3428796 - DNA, 21 bp, Homo sapiens
caaggctcttctccttggagg

SEQ ID NO: 3428797 - DNA, 17 bp, Homo sapiens
caaggctgtgctccctg

SEQ ID NO: 3428798 - DNA, 16 bp, Homo sapiens
caagggaacctgtgtc

SEQ ID NO: 3428799 - DNA, 20 bp, Homo sapiens
caagggatctggtcctaccc

SEQ ID NO: 3428800 - DNA, 13 bp, Homo sapiens
caagggatggtgc

SEQ ID NO: 3428801 - DNA, 15 bp, Homo sapiens
caagggccagacaga

SEQ ID NO: 3428802 - DNA, 18 bp, Homo sapiens
caaggggaatcagaactc

SEQ ID NO: 3428803 - DNA, 17 bp, Homo sapiens
caagggttaaggcctga

SEQ ID NO: 3428804 - DNA, 18 bp, Homo sapiens
caagggttaaggcctgaa

SEQ ID NO: 3428805 - DNA, 17 bp, Homo sapiens
cactatggtatttgagt

SEQ ID NO: 3428806 - DNA, 18 bp, Homo sapiens
cactcaaaagctgggcag

SEQ ID NO: 3428807 - DNA, 15 bp, Homo sapiens
cactcaaagagggtg

SEQ ID NO: 3428808 - DNA, 14 bp, Homo sapiens
cactcaagaagcag

SEQ ID NO: 3428809 - DNA, 20 bp, Homo sapiens
cactcaagaagcaggctaca

SEQ ID NO: 3428810 - DNA, 12 bp, Homo sapiens
cactcaagccaa

SEQ ID NO: 3428811 - DNA, 17 bp, Homo sapiens
cactcaaggcggtgctt

SEQ ID NO: 3428812 - DNA, 19 bp, Homo sapiens
cactcacatttattctgct

SEQ ID NO: 3428813 - DNA, 20 bp, Homo sapiens
cactcacatttattctgctc

SEQ ID NO: 3428814 - DNA, 17 bp, Homo sapiens
cactcactaggccccca

SEQ ID NO: 3428815 - DNA, 22 bp, Homo sapiens
cactcactaggcccccacttgc

SEQ ID NO: 3428816 - DNA, 18 bp, Homo sapiens
cactcagaagacactgat

SEQ ID NO: 3428817 - DNA, 19 bp, Homo sapiens
cactcagaagacactgatg

SEQ ID NO: 3428818 - DNA, 12 bp, Homo sapiens
cactcagcacaa

SEQ ID NO: 3428819 - DNA, 15 bp, Homo sapiens
cactcagcacaaggc

SEQ ID NO: 3428820 - DNA, 13 bp, Homo sapiens
cactcaggctgga

SEQ ID NO: 3428821 - DNA, 14 bp, Homo sapiens
cactcaggctggag

SEQ ID NO: 3428822 - DNA, 16 bp, Homo sapiens
cactcattgctgagcc

SEQ ID NO: 3428823 - DNA, 14 bp, Homo sapiens
cactccagcctggg

SEQ ID NO: 3428824 - DNA, 16 bp, Homo sapiens
cactccagtcctgcca

SEQ ID NO: 3428825 - DNA, 17 bp, Homo sapiens
cactccagtcctgccac

SEQ ID NO: 3428826 - DNA, 19 bp, Homo sapiens
cactcccaaggttggagcc

SEQ ID NO: 3428827 - DNA, 16 bp, Homo sapiens
cactcccctccactct

SEQ ID NO: 3428828 - DNA, 19 bp, Homo sapiens
cactcccttcccataagct

SEQ ID NO: 3428829 - DNA, 22 bp, Homo sapiens
cactcccttcccatgacccagg

SEQ ID NO: 3428830 - DNA, 13 bp, Homo sapiens
cactcccttgggc

SEQ ID NO: 3428831 - DNA, 14 bp, Homo sapiens
cactcctccctccg

SEQ ID NO: 3428832 - DNA, 13 bp, Homo sapiens
cactcctctgact

SEQ ID NO: 3428833 - DNA, 15 bp, Homo sapiens
cactctctaccagat

SEQ ID NO: 3428834 - DNA, 16 bp, Homo sapiens
cactctgagtgtttta

SEQ ID NO: 3428835 - DNA, 11 bp, Homo sapiens
cactctgcccc

SEQ ID NO: 3428836 - DNA, 12 bp, Homo sapiens
cactctgcctgc

SEQ ID NO: 3428837 - DNA, 14 bp, Homo sapiens
cactctgcctgcct

SEQ ID NO: 3428838 - DNA, 15 bp, Homo sapiens
cactctgctcgcctt

SEQ ID NO: 3428839 - DNA, 19 bp, Homo sapiens
cactctgcttctctgactt

SEQ ID NO: 3428840 - DNA, 16 bp, Homo sapiens
cactctgcttgttatt

SEQ ID NO: 3428841 - DNA, 19 bp, Homo sapiens
cactcttattgcccacgct

SEQ ID NO: 3428842 - DNA, 15 bp, Homo sapiens
cactcttttgcttta

SEQ ID NO: 3428843 - DNA, 11 bp, Homo sapiens
cactgaagccc

SEQ ID NO: 3428844 - DNA, 13 bp, Homo sapiens
cactgacactggt

SEQ ID NO: 3428845 - DNA, 13 bp, Homo sapiens
cactgacagcctc

SEQ ID NO: 3428846 - DNA, 13 bp, Homo sapiens
cactgacccaaat

SEQ ID NO: 3428847 - DNA, 19 bp, Homo sapiens
cactgagaatgtaagaact

SEQ ID NO: 3428848 - DNA, 17 bp, Homo sapiens
cactgaggaagaacggg

SEQ ID NO: 3428849 - DNA, 18 bp, Homo sapiens
cactgaggcagggaagtc

SEQ ID NO: 3428850 - DNA, 21 bp, Homo sapiens
cactgagttttccatggcagg

SEQ ID NO: 3428851 - DNA, 12 bp, Homo sapiens
cactgatgctgc

SEQ ID NO: 3428852 - DNA, 15 bp, Homo sapiens
cactgatgcttagat

SEQ ID NO: 3428853 - DNA, 16 bp, Homo sapiens
cactgatgcttagatg

SEQ ID NO: 3428854 - DNA, 14 bp, Homo sapiens
cactgatgggcaac

SEQ ID NO: 3428855 - DNA, 21 bp, Homo sapiens
cactgcaaaccgccacctccc

SEQ ID NO: 3428856 - DNA, 14 bp, Homo sapiens
cactgcaacctccg

SEQ ID NO: 3428857 - DNA, 12 bp, Homo sapiens
cactgcaagaag

SEQ ID NO: 3428858 - DNA, 14 bp, Homo sapiens
cactgcaccgggcc

SEQ ID NO: 3428859 - DNA, 15 bp, Homo sapiens
cactgcaccgggcca

SEQ ID NO: 3428860 - DNA, 19 bp, Homo sapiens
cactgcactatagcctagg

SEQ ID NO: 3428861 - DNA, 18 bp, Homo sapiens
cactgcactccagcctgg

SEQ ID NO: 3428862 - DNA, 19 bp, Homo sapiens
cactgcactccagcctggg

SEQ ID NO: 3428863 - DNA, 17 bp, Homo sapiens
cactgcagaaaccctga

SEQ ID NO: 3428864 - DNA, 17 bp, Homo sapiens
cactgcagcccctgaga

SEQ ID NO: 3428865 - DNA, 20 bp, Homo sapiens
cactgcagcctcaacctcct

SEQ ID NO: 3428866 - DNA, 23 bp, Homo sapiens
cactgcagcctcaacctcctggg

SEQ ID NO: 3428867 - DNA, 20 bp, Homo sapiens
cactgcaggcatcacagcta

SEQ ID NO: 3428868 - DNA, 19 bp, Homo sapiens
cactgccactccagtcctg

SEQ ID NO: 3428869 - DNA, 20 bp, Homo sapiens
cactgccaggggttcttgag

SEQ ID NO: 3428870 - DNA, 21 bp, Homo sapiens
cactgccaggggttcttgagc

SEQ ID NO: 3428871 - DNA, 17 bp, Homo sapiens
cactgccataaaacatt

SEQ ID NO: 3428872 - DNA, 18 bp, Homo sapiens
cactgccttcgcttcttg

SEQ ID NO: 3428873 - DNA, 19 bp, Homo sapiens
cactgccttcgcttcttgc

SEQ ID NO: 3428874 - DNA, 13 bp, Homo sapiens
cactgctctcagc

SEQ ID NO: 3428875 - DNA, 20 bp, Homo sapiens
cactgcttttggtctgtgtg

SEQ ID NO: 3428876 - DNA, 16 bp, Homo sapiens
cactggactccggccc

SEQ ID NO: 3428877 - DNA, 19 bp, Homo sapiens
cactggcgaggtgcggcca

SEQ ID NO: 3428878 - DNA, 18 bp, Homo sapiens
cactggctttgcggaggc

SEQ ID NO: 3428879 - DNA, 18 bp, Homo sapiens
cactgggaaacagaggct

SEQ ID NO: 3428880 - DNA, 14 bp, Homo sapiens
cactgggaggccag

SEQ ID NO: 3428881 - DNA, 12 bp, Homo sapiens
cactgggatcac

SEQ ID NO: 3428882 - DNA, 21 bp, Homo sapiens
cactggggaaataacagctgt

SEQ ID NO: 3428883 - DNA, 15 bp, Homo sapiens
cactgggtggtggcc

SEQ ID NO: 3428884 - DNA, 18 bp, Homo sapiens
cactgggtggtggcctgg

SEQ ID NO: 3428885 - DNA, 19 bp, Homo sapiens
cactggtattcctgcctcc

SEQ ID NO: 3428886 - DNA, 20 bp, Homo sapiens
cactggtattcctgcctcca

SEQ ID NO: 3428887 - DNA, 15 bp, Homo sapiens
cactggttgcactta

SEQ ID NO: 3428888 - DNA, 17 bp, Homo sapiens
cactgtatgttatagaa

SEQ ID NO: 3428889 - DNA, 18 bp, Homo sapiens
cactgtcctccaagccag

SEQ ID NO: 3428890 - DNA, 13 bp, Homo sapiens
cactgtgaagaga

SEQ ID NO: 3428891 - DNA, 14 bp, Homo sapiens
cactgtgaaggacc

SEQ ID NO: 3428892 - DNA, 14 bp, Homo sapiens
cactgtgaccccca

SEQ ID NO: 3428893 - DNA, 22 bp, Homo sapiens
cactgtgacccccagctccggc

SEQ ID NO: 3428894 - DNA, 23 bp, Homo sapiens
cactgtgacccccagctccggcc

SEQ ID NO: 3428895 - DNA, 20 bp, Homo sapiens
cactgtgcacatctgtgtct

SEQ ID NO: 3428896 - DNA, 22 bp, Homo sapiens
cactgtgcacatctgtgtcttg

SEQ ID NO: 3428897 - DNA, 16 bp, Homo sapiens
cactgtgccatgtgcc

SEQ ID NO: 3428898 - DNA, 16 bp, Homo sapiens
cactgtgggtgtgtga

SEQ ID NO: 3428899 - DNA, 13 bp, Homo sapiens
cactgtggtggca

SEQ ID NO: 3428900 - DNA, 15 bp, Homo sapiens
cactgtgtgctgact

SEQ ID NO: 3428901 - DNA, 20 bp, Homo sapiens
cactgtgttactgctttgca

SEQ ID NO: 3428902 - DNA, 14 bp, Homo sapiens
cactgttcatgctg

SEQ ID NO: 3428903 - DNA, 17 bp, Homo sapiens
cactgttccccctgtgc

SEQ ID NO: 3428904 - DNA, 23 bp, Homo sapiens
cactgttctattcatctcaagga

SEQ ID NO: 3428905 - DNA, 15 bp, Homo sapiens
cactgttgcccaggc

SEQ ID NO: 3428906 - DNA, 18 bp, Homo sapiens
cactgttgcccaggctgg

SEQ ID NO: 3428907 - DNA, 12 bp, Homo sapiens
cactgtttcctg

SEQ ID NO: 3428908 - DNA, 15 bp, Homo sapiens
cactgtttgttttta

SEQ ID NO: 3428909 - DNA, 15 bp, Homo sapiens
cacttaagagaatat

SEQ ID NO: 3428910 - DNA, 22 bp, Homo sapiens
cacttaagagaatattttaagt

SEQ ID NO: 3428911 - DNA, 15 bp, Homo sapiens
cacttactggtagga

SEQ ID NO: 3428912 - DNA, 17 bp, Homo sapiens
cacttactgtaagacat

SEQ ID NO: 3428913 - DNA, 16 bp, Homo sapiens
cacttacttgcttatt

SEQ ID NO: 3428914 - DNA, 12 bp, Homo sapiens
cacttcagctga

SEQ ID NO: 3428915 - DNA, 19 bp, Homo sapiens
cacttcatggaccaagaat

SEQ ID NO: 3428916 - DNA, 14 bp, Homo sapiens
cacttccctgctgc

SEQ ID NO: 3428917 - DNA, 17 bp, Homo sapiens
cacttcggccagagctg

SEQ ID NO: 3428918 - DNA, 13 bp, Homo sapiens
cacttctcttcct

SEQ ID NO: 3428919 - DNA, 14 bp, Homo sapiens
cacttctgtccata

SEQ ID NO: 3428920 - DNA, 13 bp, Homo sapiens
cacttctgtgcca

SEQ ID NO: 3428921 - DNA, 20 bp, Homo sapiens
cacttcttcacctcttccac

SEQ ID NO: 3428922 - DNA, 18 bp, Homo sapiens
cacttcttgttccccact

SEQ ID NO: 3428923 - DNA, 18 bp, Homo sapiens
cacttgaggtcaggagtt

SEQ ID NO: 3428924 - DNA, 13 bp, Homo sapiens
cacttgagtccag

SEQ ID NO: 3428925 - DNA, 19 bp, Homo sapiens
cacttgcagactctacaga

SEQ ID NO: 3428926 - DNA, 24 bp, Homo sapiens
cacttgcagactctacagaggcca

SEQ ID NO: 3428927 - DNA, 14 bp, Homo sapiens
cacttgcctcttcc

SEQ ID NO: 3428928 - DNA, 21 bp, Homo sapiens
cacttgcctcttccttgaaga

SEQ ID NO: 3428929 - DNA, 12 bp, Homo sapiens
cacttgtcccca

SEQ ID NO: 3428930 - DNA, 20 bp, Homo sapiens
cacttgtccccaaatccgaa

SEQ ID NO: 3428931 - DNA, 24 bp, Homo sapiens
cacttgtgccaacactcaagaagc

SEQ ID NO: 3428932 - DNA, 13 bp, Homo sapiens
cactttaaacctg

SEQ ID NO: 3428933 - DNA, 22 bp, Homo sapiens
cactttacaatgttcatcccat

SEQ ID NO: 3428934 - DNA, 18 bp, Homo sapiens
cactttagggctgtaaaa

SEQ ID NO: 3428935 - DNA, 23 bp, Homo sapiens
cactttagggctgtaaaatgcat

SEQ ID NO: 3428936 - DNA, 20 bp, Homo sapiens
cactttataagtcattgtat

SEQ ID NO: 3428937 - DNA, 12 bp, Homo sapiens
cactttcaaaac

SEQ ID NO: 3428938 - DNA, 14 bp, Homo sapiens
cactttcatttttg

SEQ ID NO: 3428939 - DNA, 21 bp, Homo sapiens
cacttttttgagtggatgatg

SEQ ID NO: 3428940 - DNA, 18 bp, Homo sapiens
cagaaaaatatgtaccaa

SEQ ID NO: 3428941 - DNA, 20 bp, Homo sapiens
cagaaaaatggagcaaagtg

SEQ ID NO: 3428942 - DNA, 13 bp, Homo sapiens
cagaaaacctcca

SEQ ID NO: 3428943 - DNA, 23 bp, Homo sapiens
caccaccctgtcttcctctgcaa

SEQ ID NO: 3428944 - DNA, 15 bp, Homo sapiens
caccacgtcacttca

SEQ ID NO: 3428945 - DNA, 18 bp, Homo sapiens
caccagacacccaggact

SEQ ID NO: 3428946 - DNA, 19 bp, Homo sapiens
caccagacacccaggactt

SEQ ID NO: 3428947 - DNA, 14 bp, Homo sapiens
caccagcattcctt

SEQ ID NO: 3428948 - DNA, 15 bp, Homo sapiens
caccagcattccttt

SEQ ID NO: 3428949 - DNA, 11 bp, Homo sapiens
caccagccagc

SEQ ID NO: 3428950 - DNA, 13 bp, Homo sapiens
caccagccccagt

SEQ ID NO: 3428951 - DNA, 14 bp, Homo sapiens
caccagctgcaaag

SEQ ID NO: 3428952 - DNA, 15 bp, Homo sapiens
caccagctgcaaagt

SEQ ID NO: 3428953 - DNA, 16 bp, Homo sapiens
caccaggactggctgt

SEQ ID NO: 3428954 - DNA, 22 bp, Homo sapiens
caccaggatagagactggaaca

SEQ ID NO: 3428955 - DNA, 14 bp, Homo sapiens
caccaggccacctc

SEQ ID NO: 3428956 - DNA, 20 bp, Homo sapiens
caccagtccctgtccggaat

SEQ ID NO: 3428957 - DNA, 20 bp, Homo sapiens
caccagttttatccataatg

SEQ ID NO: 3428958 - DNA, 23 bp, Homo sapiens
caccatacgagcacctccagcct

SEQ ID NO: 3428959 - DNA, 18 bp, Homo sapiens
caccatatgaattgtaca

SEQ ID NO: 3428960 - DNA, 18 bp, Homo sapiens
caccatcatgtctggcta

SEQ ID NO: 3428961 - DNA, 19 bp, Homo sapiens
caccatccctttttgaagt

SEQ ID NO: 3428962 - DNA, 16 bp, Homo sapiens
caccatggccagccaa

SEQ ID NO: 3428963 - DNA, 23 bp, Homo sapiens
caccattttttttttctttttgg

SEQ ID NO: 3428964 - DNA, 13 bp, Homo sapiens
cacccaaagggtt

SEQ ID NO: 3428965 - DNA, 20 bp, Homo sapiens
cacccaagacctcagggcac

SEQ ID NO: 3428966 - DNA, 21 bp, Homo sapiens
cacccaagagggctgcttccc

SEQ ID NO: 3428967 - DNA, 13 bp, Homo sapiens
cacccacctcagc

SEQ ID NO: 3428968 - DNA, 14 bp, Homo sapiens
cacccacctccctg

SEQ ID NO: 3428969 - DNA, 16 bp, Homo sapiens
cacccacctccctgcc

SEQ ID NO: 3428970 - DNA, 18 bp, Homo sapiens
cacccacctccctgcctc

SEQ ID NO: 3428971 - DNA, 23 bp, Homo sapiens
cacccacctccctgcctccagga

SEQ ID NO: 3428972 - DNA, 14 bp, Homo sapiens
cacccactcagctc

SEQ ID NO: 3428973 - DNA, 16 bp, Homo sapiens
cacccagcccacttct

SEQ ID NO: 3428974 - DNA, 13 bp, Homo sapiens
caccccaggactc

SEQ ID NO: 3428975 - DNA, 13 bp, Homo sapiens
cacccccatctct

SEQ ID NO: 3428976 - DNA, 16 bp, Homo sapiens
cacccccccaccccag

SEQ ID NO: 3428977 - DNA, 18 bp, Homo sapiens
cacccctggaagagccca

SEQ ID NO: 3428978 - DNA, 12 bp, Homo sapiens
cacccctggggg

SEQ ID NO: 3428979 - DNA, 14 bp, Homo sapiens
cacccctgggggct

SEQ ID NO: 3428980 - DNA, 18 bp, Homo sapiens
cacccctgggggctctca

SEQ ID NO: 3428981 - DNA, 21 bp, Homo sapiens
cacccggcccctgctggttca

SEQ ID NO: 3428982 - DNA, 18 bp, Homo sapiens
caccctcaacctcttctg

SEQ ID NO: 3428983 - DNA, 16 bp, Homo sapiens
caccctctaaatggga

SEQ ID NO: 3428984 - DNA, 23 bp, Homo sapiens
caccctgcagagcacacaggtac

SEQ ID NO: 3428985 - DNA, 14 bp, Homo sapiens
caccctgggccctg

SEQ ID NO: 3428986 - DNA, 23 bp, Homo sapiens
caccctgggccctgggctggaat

SEQ ID NO: 3428987 - DNA, 15 bp, Homo sapiens
caccctggggagaaa

SEQ ID NO: 3428988 - DNA, 16 bp, Homo sapiens
caccctggggagaaag

SEQ ID NO: 3428989 - DNA, 21 bp, Homo sapiens
caccgcggcgcttcccagcac

SEQ ID NO: 3428990 - DNA, 21 bp, Homo sapiens
caccggatcctgggtggtctg

SEQ ID NO: 3428991 - DNA, 19 bp, Homo sapiens
caccgtgtcaagctgctct

SEQ ID NO: 3428992 - DNA, 20 bp, Homo sapiens
caccgtgtcaagctgctctg

SEQ ID NO: 3428993 - DNA, 13 bp, Homo sapiens
caccgttctgtgc

SEQ ID NO: 3428994 - DNA, 15 bp, Homo sapiens
caccgttctgtgcac

SEQ ID NO: 3428995 - DNA, 21 bp, Homo sapiens
cacctacatccccaggtctct

SEQ ID NO: 3428996 - DNA, 16 bp, Homo sapiens
cacctagaattggctg

SEQ ID NO: 3428997 - DNA, 15 bp, Homo sapiens
cacctagccagctgt

SEQ ID NO: 3428998 - DNA, 18 bp, Homo sapiens
cacctaggcaatgaagaa

SEQ ID NO: 3428999 - DNA, 19 bp, Homo sapiens
cacctataaaacaggtcaa

SEQ ID NO: 3429000 - DNA, 12 bp, Homo sapiens
cacctcagcctc

SEQ ID NO: 3429001 - DNA, 14 bp, Homo sapiens
cacctcattctgaa

SEQ ID NO: 3429002 - DNA, 22 bp, Homo sapiens
cacctcattctgaaccctttcg

SEQ ID NO: 3429003 - DNA, 16 bp, Homo sapiens
cacctccacatcctcc

SEQ ID NO: 3429004 - DNA, 14 bp, Homo sapiens
cacctccccagcct

SEQ ID NO: 3429005 - DNA, 14 bp, Homo sapiens
cacctccctgcctc

SEQ ID NO: 3429006 - DNA, 17 bp, Homo sapiens
cacctccctgcctccag

SEQ ID NO: 3429007 - DNA, 15 bp, Homo sapiens
cacctcctgcctcag

SEQ ID NO: 3429008 - DNA, 12 bp, Homo sapiens
cacctctcttga

SEQ ID NO: 3429009 - DNA, 12 bp, Homo sapiens
cacctcttccac

SEQ ID NO: 3429010 - DNA, 20 bp, Homo sapiens
cacctgagcaggacctctga

SEQ ID NO: 3429011 - DNA, 19 bp, Homo sapiens
cacctgattcaactaaaaa

SEQ ID NO: 3429012 - DNA, 21 bp, Homo sapiens
cacctgattcaactaaaaaaa

SEQ ID NO: 3429013 - DNA, 20 bp, Homo sapiens
cacctgccaccctgggcctg

SEQ ID NO: 3429014 - DNA, 15 bp, Homo sapiens
cacctgctggagtga

SEQ ID NO: 3429015 - DNA, 10 bp, Homo sapiens
cacctggggt

SEQ ID NO: 3429016 - DNA, 18 bp, Homo sapiens
cacctggggtgtgggagg

SEQ ID NO: 3429017 - DNA, 20 bp, Homo sapiens
cacctggggtgtgggaggcc

SEQ ID NO: 3429018 - DNA, 22 bp, Homo sapiens
cacctggggtgtgggaggcccg

SEQ ID NO: 3429019 - DNA, 18 bp, Homo sapiens
cacctgtaatcccagcac

SEQ ID NO: 3429020 - DNA, 22 bp, Homo sapiens
cacctgtagcacttactggtag

SEQ ID NO: 3429021 - DNA, 18 bp, Homo sapiens
cacctgtaggatattgga

SEQ ID NO: 3429022 - DNA, 15 bp, Homo sapiens
cacctgtctcagcct

SEQ ID NO: 3429023 - DNA, 18 bp, Homo sapiens
cacctgtctcagcctccc

SEQ ID NO: 3429024 - DNA, 16 bp, Homo sapiens
cacctgtttgaaacca

SEQ ID NO: 3429025 - DNA, 20 bp, Homo sapiens
cacctgtttttaagctgttt

SEQ ID NO: 3429026 - DNA, 23 bp, Homo sapiens
caccttaatatgctgcaacaaaa

SEQ ID NO: 3429027 - DNA, 13 bp, Homo sapiens
caccttaggcagg

SEQ ID NO: 3429028 - DNA, 14 bp, Homo sapiens
caccttaggcaggg

SEQ ID NO: 3429029 - DNA, 22 bp, Homo sapiens
caccttcgtttactatgcctgt

SEQ ID NO: 3429030 - DNA, 18 bp, Homo sapiens
caccttgacagggcacac

SEQ ID NO: 3429031 - DNA, 14 bp, Homo sapiens
caccttgcggggat

SEQ ID NO: 3429032 - DNA, 14 bp, Homo sapiens
caccttggctcaag

SEQ ID NO: 3429033 - DNA, 14 bp, Homo sapiens
caccttggctgcag

SEQ ID NO: 3429034 - DNA, 15 bp, Homo sapiens
caccttggctgcagg

SEQ ID NO: 3429035 - DNA, 16 bp, Homo sapiens
caccttggcttgttat

SEQ ID NO: 3429036 - DNA, 15 bp, Homo sapiens
caccttggggccttg

SEQ ID NO: 3429037 - DNA, 22 bp, Homo sapiens
cacctttcataatctttgcttt

SEQ ID NO: 3429038 - DNA, 17 bp, Homo sapiens
caccttttttaaggaaa

SEQ ID NO: 3429039 - DNA, 17 bp, Homo sapiens
caccttttttcaacagt

SEQ ID NO: 3429040 - DNA, 16 bp, Homo sapiens
cacgaaactgccctgg

SEQ ID NO: 3429041 - DNA, 16 bp, Homo sapiens
cacgactgcccggcag

SEQ ID NO: 3429042 - DNA, 11 bp, Homo sapiens
cacgagggctg

SEQ ID NO: 3429043 - DNA, 12 bp, Homo sapiens
cacgagggctgg

SEQ ID NO: 3429044 - DNA, 17 bp, Homo sapiens
cacgagggctggctggc

SEQ ID NO: 3429045 - DNA, 21 bp, Homo sapiens
cacgagggctggctggcctca

SEQ ID NO: 3429046 - DNA, 15 bp, Homo sapiens
cacgcacctcccatc

SEQ ID NO: 3429047 - DNA, 13 bp, Homo sapiens
cacgccactgcac

SEQ ID NO: 3429048 - DNA, 15 bp, Homo sapiens
cacgccactgcacta

SEQ ID NO: 3429049 - DNA, 19 bp, Homo sapiens
cacgcccgtcctgcctgtg

SEQ ID NO: 3429050 - DNA, 14 bp, Homo sapiens
cacgcctcccactg

SEQ ID NO: 3429051 - DNA, 15 bp, Homo sapiens
cacgcctcccactgg

SEQ ID NO: 3429052 - DNA, 17 bp, Homo sapiens
cacgcctcccactgggg

SEQ ID NO: 3429053 - DNA, 12 bp, Homo sapiens
cacgcctgaaac

SEQ ID NO: 3429054 - DNA, 20 bp, Homo sapiens
cacgctggagtgcagtgagc

SEQ ID NO: 3429055 - DNA, 17 bp, Homo sapiens
cacgctttctagctgtt

SEQ ID NO: 3429056 - DNA, 16 bp, Homo sapiens
cacggaagagccttgc

SEQ ID NO: 3429057 - DNA, 22 bp, Homo sapiens
cacggaagagccttgcggaagg

SEQ ID NO: 3429058 - DNA, 21 bp, Homo sapiens
cacggagcagttcagagtgga

SEQ ID NO: 3429059 - DNA, 15 bp, Homo sapiens
cacggagccactcct

SEQ ID NO: 3429060 - DNA, 19 bp, Homo sapiens
cacggagccactcctctga

SEQ ID NO: 3429061 - DNA, 21 bp, Homo sapiens
cacggagccactcctctgact

SEQ ID NO: 3429062 - DNA, 13 bp, Homo sapiens
cacggccacatca

SEQ ID NO: 3429063 - DNA, 16 bp, Homo sapiens
cacggccaggccagag

SEQ ID NO: 3429064 - DNA, 16 bp, Homo sapiens
cacggctcccccaggc

SEQ ID NO: 3429065 - DNA, 17 bp, Homo sapiens
cacggctcccccaggcc

SEQ ID NO: 3429066 - DNA, 19 bp, Homo sapiens
cacgtacacacacatacac

SEQ ID NO: 3429067 - DNA, 14 bp, Homo sapiens
cacgtgacacaaac

SEQ ID NO: 3429068 - DNA, 16 bp, Homo sapiens
cacgtgcagctcaagg

SEQ ID NO: 3429069 - DNA, 13 bp, Homo sapiens
cacgtgcctgtgg

SEQ ID NO: 3429070 - DNA, 19 bp, Homo sapiens
cacgttagaggaaaaatat

SEQ ID NO: 3429071 - DNA, 15 bp, Homo sapiens
cacgttttgttttgt

SEQ ID NO: 3429072 - DNA, 13 bp, Homo sapiens
cactaaacaaaga

SEQ ID NO: 3429073 - DNA, 14 bp, Homo sapiens
cactaactgctggt

SEQ ID NO: 3429074 - DNA, 16 bp, Homo sapiens
cactaagcagaggagg

SEQ ID NO: 3429075 - DNA, 16 bp, Homo sapiens
cactagacaagccaga

SEQ ID NO: 3429076 - DNA, 19 bp, Homo sapiens
cactagacaagccagaact

SEQ ID NO: 3429077 - DNA, 21 bp, Homo sapiens
cactagacaagccagaacttg

SEQ ID NO: 3429078 - DNA, 15 bp, Homo sapiens
cactagcagctgcag

SEQ ID NO: 3429079 - DNA, 23 bp, Homo sapiens
cactaggcccccacttgcctctt

SEQ ID NO: 3429080 - DNA, 16 bp, Homo sapiens
cactagtgcaaatcat

SEQ ID NO: 3429081 - DNA, 20 bp, Homo sapiens
atttagctgtattcatatat

SEQ ID NO: 3429082 - DNA, 17 bp, Homo sapiens
atttaggagaagccagg

SEQ ID NO: 3429083 - DNA, 18 bp, Homo sapiens
atttagggaactgcttga

SEQ ID NO: 3429084 - DNA, 17 bp, Homo sapiens
atttaggtttttattag

SEQ ID NO: 3429085 - DNA, 19 bp, Homo sapiens
atttaggtttttattagta

SEQ ID NO: 3429086 - DNA, 17 bp, Homo sapiens
atttagtctaacacagt

SEQ ID NO: 3429087 - DNA, 15 bp, Homo sapiens
atttagtttgattat

SEQ ID NO: 3429088 - DNA, 21 bp, Homo sapiens
atttataaacagacaatatgt

SEQ ID NO: 3429089 - DNA, 18 bp, Homo sapiens
atttatacaaattagaaa

SEQ ID NO: 3429090 - DNA, 14 bp, Homo sapiens
atttatagatcatt

SEQ ID NO: 3429091 - DNA, 16 bp, Homo sapiens
atttatctgtgcaaat

SEQ ID NO: 3429092 - DNA, 14 bp, Homo sapiens
atttatgaatataa

SEQ ID NO: 3429093 - DNA, 18 bp, Homo sapiens
atttattaaatgtattat

SEQ ID NO: 3429094 - DNA, 15 bp, Homo sapiens
atttattaattgctt

SEQ ID NO: 3429095 - DNA, 18 bp, Homo sapiens
atttattaattgctttga

SEQ ID NO: 3429096 - DNA, 14 bp, Homo sapiens
atttattacctctg

SEQ ID NO: 3429097 - DNA, 19 bp, Homo sapiens
atttattatttatttatta

SEQ ID NO: 3429098 - DNA, 14 bp, Homo sapiens
atttattattttca

SEQ ID NO: 3429099 - DNA, 13 bp, Homo sapiens
atttattcaataa

SEQ ID NO: 3429100 - DNA, 15 bp, Homo sapiens
atttattcaataaag

SEQ ID NO: 3429101 - DNA, 21 bp, Homo sapiens
atttattcaataaagtattta

SEQ ID NO: 3429102 - DNA, 22 bp, Homo sapiens
atttattcaataaagtatttaa

SEQ ID NO: 3429103 - DNA, 22 bp, Homo sapiens
atttattcattatttgtcaaat

SEQ ID NO: 3429104 - DNA, 13 bp, Homo sapiens
atttattctgctc

SEQ ID NO: 3429105 - DNA, 19 bp, Homo sapiens
atttattgcacattgttca

SEQ ID NO: 3429106 - DNA, 23 bp, Homo sapiens
atttatttacagatgaatgtatt

SEQ ID NO: 3429107 - DNA, 24 bp, Homo sapiens
atttatttactgagcttctctgtg

SEQ ID NO: 3429108 - DNA, 18 bp, Homo sapiens
atttatttcctagttctg

SEQ ID NO: 3429109 - DNA, 13 bp, Homo sapiens
atttatttgcttc

SEQ ID NO: 3429110 - DNA, 21 bp, Homo sapiens
atttatttttctcatgaatct

SEQ ID NO: 3429111 - DNA, 15 bp, Homo sapiens
atttcacaagctatt

SEQ ID NO: 3429112 - DNA, 21 bp, Homo sapiens
caaactggggcctccagaact

SEQ ID NO: 3429113 - DNA, 14 bp, Homo sapiens
caaactgtaataca

SEQ ID NO: 3429114 - DNA, 22 bp, Homo sapiens
caaactgtctctgcctcttccc

SEQ ID NO: 3429115 - DNA, 21 bp, Homo sapiens
caaagaaggcatttgcagggt

SEQ ID NO: 3429116 - DNA, 19 bp, Homo sapiens
caaagaattccaaagcaaa

SEQ ID NO: 3429117 - DNA, 17 bp, Homo sapiens
caaagaccaaaatgaaa

SEQ ID NO: 3429118 - DNA, 14 bp, Homo sapiens
caaagaggcaagag

SEQ ID NO: 3429119 - DNA, 15 bp, Homo sapiens
caaagaggcaagagg

SEQ ID NO: 3429120 - DNA, 18 bp, Homo sapiens
caaagagggtgagggcct

SEQ ID NO: 3429121 - DNA, 21 bp, Homo sapiens
caaagagggtgagggccttct

SEQ ID NO: 3429122 - DNA, 22 bp, Homo sapiens
caaagagggtgagggccttctt

SEQ ID NO: 3429123 - DNA, 16 bp, Homo sapiens
caaagataccattctt

SEQ ID NO: 3429124 - DNA, 20 bp, Homo sapiens
caaagatctgtcctcagcct

SEQ ID NO: 3429125 - DNA, 15 bp, Homo sapiens
caaagatgacttccc

SEQ ID NO: 3429126 - DNA, 20 bp, Homo sapiens
caaagatgggtgaaggctgg

SEQ ID NO: 3429127 - DNA, 13 bp, Homo sapiens
caaagcaaggaaa

SEQ ID NO: 3429128 - DNA, 13 bp, Homo sapiens
caaagcagacagc

SEQ ID NO: 3429129 - DNA, 13 bp, Homo sapiens
caaagcagccacg

SEQ ID NO: 3429130 - DNA, 22 bp, Homo sapiens
caaagccaaagctaggcctggc

SEQ ID NO: 3429131 - DNA, 18 bp, Homo sapiens
caaagcctcctccagccg

SEQ ID NO: 3429132 - DNA, 14 bp, Homo sapiens
caaagctaggcctg

SEQ ID NO: 3429133 - DNA, 16 bp, Homo sapiens
caaagctaggcctggc

SEQ ID NO: 3429134 - DNA, 17 bp, Homo sapiens
caaagctaggcctggcc

SEQ ID NO: 3429135 - DNA, 18 bp, Homo sapiens
caaagctaggcctggcca

SEQ ID NO: 3429136 - DNA, 22 bp, Homo sapiens
caaagctcaagatgacagctct

SEQ ID NO: 3429137 - DNA, 17 bp, Homo sapiens
caaaggagctcgaagga

SEQ ID NO: 3429138 - DNA, 15 bp, Homo sapiens
caaaggcaagcactt

SEQ ID NO: 3429139 - DNA, 13 bp, Homo sapiens
caaaggccatgga

SEQ ID NO: 3429140 - DNA, 21 bp, Homo sapiens
caaaggggaaagaacataaag

SEQ ID NO: 3429141 - DNA, 21 bp, Homo sapiens
caaagggtccagaaggagaca

SEQ ID NO: 3429142 - DNA, 18 bp, Homo sapiens
caaaggtgaaggaatata

SEQ ID NO: 3429143 - DNA, 16 bp, Homo sapiens
caaagtaaaacttgct

SEQ ID NO: 3429144 - DNA, 16 bp, Homo sapiens
caaagtactagctaaa

SEQ ID NO: 3429145 - DNA, 12 bp, Homo sapiens
caaagtactgta

SEQ ID NO: 3429146 - DNA, 22 bp, Homo sapiens
caaagtactgtaagaataattt

SEQ ID NO: 3429147 - DNA, 19 bp, Homo sapiens
caaagtatcaggacgagaa

SEQ ID NO: 3429148 - DNA, 15 bp, Homo sapiens
caaagtattgtaaat

SEQ ID NO: 3429149 - DNA, 20 bp, Homo sapiens
caaagtattgtaaattatat

SEQ ID NO: 3429150 - DNA, 17 bp, Homo sapiens
caaagtcctttttttcc

SEQ ID NO: 3429151 - DNA, 13 bp, Homo sapiens
caaagtgctggga

SEQ ID NO: 3429152 - DNA, 17 bp, Homo sapiens
caaagtgtgtattaaaa

SEQ ID NO: 3429153 - DNA, 23 bp, Homo sapiens
caaagtgttttgtaccagtgaat

SEQ ID NO: 3429154 - DNA, 21 bp, Homo sapiens
caaagttactaggtaacttca

SEQ ID NO: 3429155 - DNA, 14 bp, Homo sapiens
caaagttcaacttg

SEQ ID NO: 3429156 - DNA, 10 bp, Homo sapiens
caaataaaat

SEQ ID NO: 3429157 - DNA, 13 bp, Homo sapiens
caaatagcaaaga

SEQ ID NO: 3429158 - DNA, 20 bp, Homo sapiens
caaatagtttataaatgtga

SEQ ID NO: 3429159 - DNA, 14 bp, Homo sapiens
caaatcaccacaaa

SEQ ID NO: 3429160 - DNA, 16 bp, Homo sapiens
caaatccgaacctcct

SEQ ID NO: 3429161 - DNA, 18 bp, Homo sapiens
caaatcctatgtgatttt

SEQ ID NO: 3429162 - DNA, 21 bp, Homo sapiens
caaatcctatgtgattttaac

SEQ ID NO: 3429163 - DNA, 19 bp, Homo sapiens
caaatcttgaaattaagaa

SEQ ID NO: 3429164 - DNA, 22 bp, Homo sapiens
caaatcttgttattgaagtgtt

SEQ ID NO: 3429165 - DNA, 12 bp, Homo sapiens
caaatgagccat

SEQ ID NO: 3429166 - DNA, 16 bp, Homo sapiens
caaatgcagtatattt

SEQ ID NO: 3429167 - DNA, 19 bp, Homo sapiens
caaatgcccaagggaaaga

SEQ ID NO: 3429168 - DNA, 14 bp, Homo sapiens
caaatgctctctct

SEQ ID NO: 3429169 - DNA, 15 bp, Homo sapiens
caaatggaagacaca

SEQ ID NO: 3429170 - DNA, 18 bp, Homo sapiens
caaatggcgtctggaagt

SEQ ID NO: 3429171 - DNA, 18 bp, Homo sapiens
caaatgggatggtatgtg

SEQ ID NO: 3429172 - DNA, 15 bp, Homo sapiens
caaatggggccagat

SEQ ID NO: 3429173 - DNA, 17 bp, Homo sapiens
caaatggggccagatcc

SEQ ID NO: 3429174 - DNA, 18 bp, Homo sapiens
caaatggggccagatcca

SEQ ID NO: 3429175 - DNA, 23 bp, Homo sapiens
caaatggttaccttgttatttaa

SEQ ID NO: 3429176 - DNA, 23 bp, Homo sapiens
caaatggtttaacttctgcctgt

SEQ ID NO: 3429177 - DNA, 14 bp, Homo sapiens
caaatgtaaacatt

SEQ ID NO: 3429178 - DNA, 19 bp, Homo sapiens
caaatgtctgggaagccct

SEQ ID NO: 3429179 - DNA, 18 bp, Homo sapiens
caaattagaaaatgttat

SEQ ID NO: 3429180 - DNA, 22 bp, Homo sapiens
caaattagaaaatgttatttaa

SEQ ID NO: 3429181 - DNA, 17 bp, Homo sapiens
caaattcatattctttt

SEQ ID NO: 3429182 - DNA, 20 bp, Homo sapiens
caaattcctatttttaaata

SEQ ID NO: 3429183 - DNA, 23 bp, Homo sapiens
caaattcttttgaattgttacat

SEQ ID NO: 3429184 - DNA, 16 bp, Homo sapiens
caaattctttttttat

SEQ ID NO: 3429185 - DNA, 23 bp, Homo sapiens
caaattgtgtgtgctctgcttca

SEQ ID NO: 3429186 - DNA, 14 bp, Homo sapiens
caaatttgattgat

SEQ ID NO: 3429187 - DNA, 14 bp, Homo sapiens
caacaaagaacact

SEQ ID NO: 3429188 - DNA, 14 bp, Homo sapiens
caacaacaaaaaca

SEQ ID NO: 3429189 - DNA, 20 bp, Homo sapiens
caacaatttctactttgaag

SEQ ID NO: 3429190 - DNA, 22 bp, Homo sapiens
caacaccaagcacagcagcctg

SEQ ID NO: 3429191 - DNA, 19 bp, Homo sapiens
caacacgcacctgcctcag

SEQ ID NO: 3429192 - DNA, 16 bp, Homo sapiens
caacacgcaggagcac

SEQ ID NO: 3429193 - DNA, 15 bp, Homo sapiens
caacagaagcttcca

SEQ ID NO: 3429194 - DNA, 14 bp, Homo sapiens
caacagatctggaa

SEQ ID NO: 3429195 - DNA, 17 bp, Homo sapiens
caacagatctggaacct

SEQ ID NO: 3429196 - DNA, 17 bp, Homo sapiens
caacagcaaatcacgac

SEQ ID NO: 3429197 - DNA, 19 bp, Homo sapiens
caacagcctttgaatgtaa

SEQ ID NO: 3429198 - DNA, 22 bp, Homo sapiens
caacaggaatctcagagacagg

SEQ ID NO: 3429199 - DNA, 14 bp, Homo sapiens
caacaggagctggg

SEQ ID NO: 3429200 - DNA, 20 bp, Homo sapiens
caacaggctgggcttcagtg

SEQ ID NO: 3429201 - DNA, 24 bp, Homo sapiens
caacaggctgggcttcagtggcag

SEQ ID NO: 3429202 - DNA, 16 bp, Homo sapiens
caacagttacataatt

SEQ ID NO: 3429203 - DNA, 21 bp, Homo sapiens
caacatagtattcatgactat

SEQ ID NO: 3429204 - DNA, 14 bp, Homo sapiens
caacatataaaata

SEQ ID NO: 3429205 - DNA, 13 bp, Homo sapiens
caacatctagcaa

SEQ ID NO: 3429206 - DNA, 21 bp, Homo sapiens
caacattacagggaatgcctg

SEQ ID NO: 3429207 - DNA, 20 bp, Homo sapiens
caacattgttcacctttgta

SEQ ID NO: 3429208 - DNA, 18 bp, Homo sapiens
caacatttacaactcatt

SEQ ID NO: 3429209 - DNA, 18 bp, Homo sapiens
caacattttcttgaattt

SEQ ID NO: 3429210 - DNA, 19 bp, Homo sapiens
caacattttcttgaatttt

SEQ ID NO: 3429211 - DNA, 14 bp, Homo sapiens
caaccaatggaatg

SEQ ID NO: 3429212 - DNA, 22 bp, Homo sapiens
caaccagctaagaaaagatttt

SEQ ID NO: 3429213 - DNA, 13 bp, Homo sapiens
caaccccaggctg

SEQ ID NO: 3429214 - DNA, 21 bp, Homo sapiens
caaccccagggcccccacagg

SEQ ID NO: 3429215 - DNA, 23 bp, Homo sapiens
caaccccagggcccccacaggcc

SEQ ID NO: 3429216 - DNA, 14 bp, Homo sapiens
caaccccccagcac

SEQ ID NO: 3429217 - DNA, 16 bp, Homo sapiens
caaccccccagcactg

SEQ ID NO: 3429218 - DNA, 18 bp, Homo sapiens
caaccccccagcactgag

SEQ ID NO: 3429219 - DNA, 20 bp, Homo sapiens
caaccccttaagccctggcc

SEQ ID NO: 3429220 - DNA, 21 bp, Homo sapiens
caaccccttaagccctggccc

SEQ ID NO: 3429221 - DNA, 14 bp, Homo sapiens
caaccccttcgctc

SEQ ID NO: 3429222 - DNA, 16 bp, Homo sapiens
caaccctcagccttga

SEQ ID NO: 3429223 - DNA, 18 bp, Homo sapiens
caacccttccctcacctt

SEQ ID NO: 3429224 - DNA, 23 bp, Homo sapiens
caacccttctcctcttgtaaata

SEQ ID NO: 3429225 - DNA, 13 bp, Homo sapiens
caacctaaatttg

SEQ ID NO: 3429226 - DNA, 16 bp, Homo sapiens
caacctctgcttccca

SEQ ID NO: 3429227 - DNA, 20 bp, Homo sapiens
caacctctgcttcccaggtt

SEQ ID NO: 3429228 - DNA, 18 bp, Homo sapiens
caacctcttctggctcaa

SEQ ID NO: 3429229 - DNA, 15 bp, Homo sapiens
caacctcttggcctg

SEQ ID NO: 3429230 - DNA, 14 bp, Homo sapiens
caaccttgcatcca

SEQ ID NO: 3429231 - DNA, 15 bp, Homo sapiens
caaccttggccttct

SEQ ID NO: 3429232 - DNA, 17 bp, Homo sapiens
caaccttggccttctcc

SEQ ID NO: 3429233 - DNA, 20 bp, Homo sapiens
attgaatcagtataaacaaa

SEQ ID NO: 3429234 - DNA, 14 bp, Homo sapiens
attgaatttttcct

SEQ ID NO: 3429235 - DNA, 20 bp, Homo sapiens
attgacaataatttcaggtt

SEQ ID NO: 3429236 - DNA, 13 bp, Homo sapiens
attgacagctttg

SEQ ID NO: 3429237 - DNA, 14 bp, Homo sapiens
attgacagctttgc

SEQ ID NO: 3429238 - DNA, 17 bp, Homo sapiens
attgaccaccagttaac

SEQ ID NO: 3429239 - DNA, 20 bp, Homo sapiens
attgaccgcgactaatttca

SEQ ID NO: 3429240 - DNA, 23 bp, Homo sapiens
attgaccgcgactaatttcaaaa

SEQ ID NO: 3429241 - DNA, 14 bp, Homo sapiens
attgactctgggtc

SEQ ID NO: 3429242 - DNA, 20 bp, Homo sapiens
attgactctgggtccttcct

SEQ ID NO: 3429243 - DNA, 18 bp, Homo sapiens
attgacttgactttctag

SEQ ID NO: 3429244 - DNA, 12 bp, Homo sapiens
attgagaaagag

SEQ ID NO: 3429245 - DNA, 16 bp, Homo sapiens
attgaggataaattgc

SEQ ID NO: 3429246 - DNA, 16 bp, Homo sapiens
attgatggggaaggag

SEQ ID NO: 3429247 - DNA, 17 bp, Homo sapiens
attgatttcctgtgtca

SEQ ID NO: 3429248 - DNA, 14 bp, Homo sapiens
attgatttgaagaa

SEQ ID NO: 3429249 - DNA, 12 bp, Homo sapiens
attgatttgcat

SEQ ID NO: 3429250 - DNA, 15 bp, Homo sapiens
attgatttgcattga

SEQ ID NO: 3429251 - DNA, 17 bp, Homo sapiens
attgcaaatcttgaaat

SEQ ID NO: 3429252 - DNA, 18 bp, Homo sapiens
attgcaacaggctgggct

SEQ ID NO: 3429253 - DNA, 16 bp, Homo sapiens
attgcacagaagtcct

SEQ ID NO: 3429254 - DNA, 20 bp, Homo sapiens
attgcacatgtcttaatgaa

SEQ ID NO: 3429255 - DNA, 14 bp, Homo sapiens
attgcacattgttc

SEQ ID NO: 3429256 - DNA, 17 bp, Homo sapiens
attgcactccagcctgg

SEQ ID NO: 3429257 - DNA, 13 bp, Homo sapiens
attgcactccagt

SEQ ID NO: 3429258 - DNA, 17 bp, Homo sapiens
attgcagacctgtcacc

SEQ ID NO: 3429259 - DNA, 17 bp, Homo sapiens
attgcaggatggtgtct

SEQ ID NO: 3429260 - DNA, 23 bp, Homo sapiens
attgcatctcccagataatgtga

SEQ ID NO: 3429261 - DNA, 14 bp, Homo sapiens
attgcatctgtata

SEQ ID NO: 3429262 - DNA, 19 bp, Homo sapiens
attgcatctgtataagtaa

SEQ ID NO: 3429263 - DNA, 14 bp, Homo sapiens
attgcatgtgactc

SEQ ID NO: 3429264 - DNA, 12 bp, Homo sapiens
attgcatttctg

SEQ ID NO: 3429265 - DNA, 15 bp, Homo sapiens
attgcatttctgtat

SEQ ID NO: 3429266 - DNA, 17 bp, Homo sapiens
attgcatttctgtattt

SEQ ID NO: 3429267 - DNA, 15 bp, Homo sapiens
attgccaaaaaggat

SEQ ID NO: 3429268 - DNA, 22 bp, Homo sapiens
attgccaagctcaggaccaggc

SEQ ID NO: 3429269 - DNA, 15 bp, Homo sapiens
attgccatattgcac

SEQ ID NO: 3429270 - DNA, 16 bp, Homo sapiens
attgcccaggctggtc

SEQ ID NO: 3429271 - DNA, 22 bp, Homo sapiens
attgcctctactttgattctga

SEQ ID NO: 3429272 - DNA, 16 bp, Homo sapiens
attgcctttgaatgtt

SEQ ID NO: 3429273 - DNA, 13 bp, Homo sapiens
attgcgctgctac

SEQ ID NO: 3429274 - DNA, 19 bp, Homo sapiens
attgcggacagccacggcc

SEQ ID NO: 3429275 - DNA, 20 bp, Homo sapiens
attgcgtttgaccttttatg

SEQ ID NO: 3429276 - DNA, 15 bp, Homo sapiens
attgctaatgttgct

SEQ ID NO: 3429277 - DNA, 14 bp, Homo sapiens
attgctactgtcct

SEQ ID NO: 3429278 - DNA, 15 bp, Homo sapiens
attgctgactgtgta

SEQ ID NO: 3429279 - DNA, 23 bp, Homo sapiens
attgctgagcctctgctccccag

SEQ ID NO: 3429280 - DNA, 14 bp, Homo sapiens
attgctgccagaga

SEQ ID NO: 3429281 - DNA, 17 bp, Homo sapiens
attgctgtctgcagcct

SEQ ID NO: 3429282 - DNA, 19 bp, Homo sapiens
attgctgttgtccaactat

SEQ ID NO: 3429283 - DNA, 16 bp, Homo sapiens
attgcttaaaatagca

SEQ ID NO: 3429284 - DNA, 17 bp, Homo sapiens
attgcttaaaatagcaa

SEQ ID NO: 3429285 - DNA, 18 bp, Homo sapiens
attgcttgagctcaggag

SEQ ID NO: 3429286 - DNA, 14 bp, Homo sapiens
attgcttgggtctc

SEQ ID NO: 3429287 - DNA, 15 bp, Homo sapiens
attgcttgggtctct

SEQ ID NO: 3429288 - DNA, 22 bp, Homo sapiens
attgcttgggtctctctccatt

SEQ ID NO: 3429289 - DNA, 16 bp, Homo sapiens
attgctttgaaaaagt

SEQ ID NO: 3429290 - DNA, 18 bp, Homo sapiens
attggaatgggcagctca

SEQ ID NO: 3429291 - DNA, 16 bp, Homo sapiens
attggataaagcagct

SEQ ID NO: 3429292 - DNA, 20 bp, Homo sapiens
attggcacctaatccaggca

SEQ ID NO: 3429293 - DNA, 16 bp, Homo sapiens
attggctcacactgag

SEQ ID NO: 3429294 - DNA, 21 bp, Homo sapiens
attggctcacactgagaatgt

SEQ ID NO: 3429295 - DNA, 22 bp, Homo sapiens
attggctgaactcatgagaagt

SEQ ID NO: 3429296 - DNA, 20 bp, Homo sapiens
attggcttaaaatgtactct

SEQ ID NO: 3429297 - DNA, 17 bp, Homo sapiens
attggctttatcctctt

SEQ ID NO: 3429298 - DNA, 20 bp, Homo sapiens
attgggaaggggacccccgc

SEQ ID NO: 3429299 - DNA, 18 bp, Homo sapiens
attgggtcatagaaattc

SEQ ID NO: 3429300 - DNA, 17 bp, Homo sapiens
attggtctcctctcagc

SEQ ID NO: 3429301 - DNA, 13 bp, Homo sapiens
attggttaatttt

SEQ ID NO: 3429302 - DNA, 15 bp, Homo sapiens
attggttaattttta

SEQ ID NO: 3429303 - DNA, 14 bp, Homo sapiens
attgtaaaaaattc

SEQ ID NO: 3429304 - DNA, 15 bp, Homo sapiens
attgtaaaaaattca

SEQ ID NO: 3429305 - DNA, 16 bp, Homo sapiens
attgtaaaaaattcac

SEQ ID NO: 3429306 - DNA, 17 bp, Homo sapiens
attgtaaaaaattcaca

SEQ ID NO: 3429307 - DNA, 22 bp, Homo sapiens
attgtaaaaaattcacataata

SEQ ID NO: 3429308 - DNA, 19 bp, Homo sapiens
attgtaaaccgctttggcc

SEQ ID NO: 3429309 - DNA, 23 bp, Homo sapiens
attgtaaattgaatcagtataaa

SEQ ID NO: 3429310 - DNA, 13 bp, Homo sapiens
attgtaactgttc

SEQ ID NO: 3429311 - DNA, 19 bp, Homo sapiens
attgtaactgttcttgaat

SEQ ID NO: 3429312 - DNA, 20 bp, Homo sapiens
attgtaagtgaagtaaaact

SEQ ID NO: 3429313 - DNA, 12 bp, Homo sapiens
attgtaattttg

SEQ ID NO: 3429314 - DNA, 12 bp, Homo sapiens
attgtacctctc

SEQ ID NO: 3429315 - DNA, 18 bp, Homo sapiens
attgtacctctcttatag

SEQ ID NO: 3429316 - DNA, 19 bp, Homo sapiens
attgtacctctcttataga

SEQ ID NO: 3429317 - DNA, 21 bp, Homo sapiens
attgtactaaagccaaacata

SEQ ID NO: 3429318 - DNA, 15 bp, Homo sapiens
attgtatttgtttct

SEQ ID NO: 3429319 - DNA, 23 bp, Homo sapiens
attgtccctctgccccatcctcc

SEQ ID NO: 3429320 - DNA, 12 bp, Homo sapiens
attgtcctgtga

SEQ ID NO: 3429321 - DNA, 18 bp, Homo sapiens
attgtctcctatatattt

SEQ ID NO: 3429322 - DNA, 22 bp, Homo sapiens
attgtctcctatatatttctat

SEQ ID NO: 3429323 - DNA, 20 bp, Homo sapiens
attgtgaagctaatgaccaa

SEQ ID NO: 3429324 - DNA, 16 bp, Homo sapiens
attgtgagccaccacg

SEQ ID NO: 3429325 - DNA, 19 bp, Homo sapiens
attgtgatgtatattcctt

SEQ ID NO: 3429326 - DNA, 14 bp, Homo sapiens
attgtggaatgttg

SEQ ID NO: 3429327 - DNA, 15 bp, Homo sapiens
attgtggaatgttgg

SEQ ID NO: 3429328 - DNA, 12 bp, Homo sapiens
attgtggtgcca

SEQ ID NO: 3429329 - DNA, 15 bp, Homo sapiens
attgtgtatattcat

SEQ ID NO: 3429330 - DNA, 13 bp, Homo sapiens
attgtgtttgtca

SEQ ID NO: 3429331 - DNA, 19 bp, Homo sapiens
attgtgtttgtcattagcc

SEQ ID NO: 3429332 - DNA, 13 bp, Homo sapiens
attgtgtttgtgt

SEQ ID NO: 3429333 - DNA, 21 bp, Homo sapiens
attgttacctgtcattttgca

SEQ ID NO: 3429334 - DNA, 23 bp, Homo sapiens
attgttacctgtcattttgcact

SEQ ID NO: 3429335 - DNA, 16 bp, Homo sapiens
attgttgagctattgc

SEQ ID NO: 3429336 - DNA, 19 bp, Homo sapiens
attgttgagctattgctgt

SEQ ID NO: 3429337 - DNA, 16 bp, Homo sapiens
attgttggtgttaatt

SEQ ID NO: 3429338 - DNA, 24 bp, Homo sapiens
attgttgttactttttcttgtatt

SEQ ID NO: 3429339 - DNA, 21 bp, Homo sapiens
attgtttacaggatattccaa

SEQ ID NO: 3429340 - DNA, 12 bp, Homo sapiens
attgtttgctgc

SEQ ID NO: 3429341 - DNA, 20 bp, Homo sapiens
attgtttgtctgtcttcata

SEQ ID NO: 3429342 - DNA, 16 bp, Homo sapiens
attgtttgtctttaac

SEQ ID NO: 3429343 - DNA, 14 bp, Homo sapiens
atttaaaaatattt

SEQ ID NO: 3429344 - DNA, 12 bp, Homo sapiens
atttaaaaatgt

SEQ ID NO: 3429345 - DNA, 14 bp, Homo sapiens
atttaaaaatgtct

SEQ ID NO: 3429346 - DNA, 15 bp, Homo sapiens
atttaaacaaacaaa

SEQ ID NO: 3429347 - DNA, 14 bp, Homo sapiens
atttaaacacacag

SEQ ID NO: 3429348 - DNA, 15 bp, Homo sapiens
atttaaacacacaga

SEQ ID NO: 3429349 - DNA, 16 bp, Homo sapiens
atttaaagacaaagac

SEQ ID NO: 3429350 - DNA, 21 bp, Homo sapiens
atttaacagctgaattatcta

SEQ ID NO: 3429351 - DNA, 23 bp, Homo sapiens
atttaacctctttttaaggacac

SEQ ID NO: 3429352 - DNA, 21 bp, Homo sapiens
atttaactggtgcactttgta

SEQ ID NO: 3429353 - DNA, 22 bp, Homo sapiens
atttaactggtgcactttgtaa

SEQ ID NO: 3429354 - DNA, 13 bp, Homo sapiens
atttaataatata

SEQ ID NO: 3429355 - DNA, 15 bp, Homo sapiens
atttaataatatact

SEQ ID NO: 3429356 - DNA, 23 bp, Homo sapiens
atttaatgttttaaatgtacaga

SEQ ID NO: 3429357 - DNA, 15 bp, Homo sapiens
atttaattagtgcta

SEQ ID NO: 3429358 - DNA, 21 bp, Homo sapiens
atttaattagtgctaagtgtg

SEQ ID NO: 3429359 - DNA, 18 bp, Homo sapiens
atttaatttaggacacat

SEQ ID NO: 3429360 - DNA, 23 bp, Homo sapiens
atttaatttttttgagacagagt

SEQ ID NO: 3429361 - DNA, 19 bp, Homo sapiens
atttacaaagtgtgtatta

SEQ ID NO: 3429362 - DNA, 17 bp, Homo sapiens
atttacaggttcttagg

SEQ ID NO: 3429363 - DNA, 17 bp, Homo sapiens
atttacgctttgattca

SEQ ID NO: 3429364 - DNA, 21 bp, Homo sapiens
atttagaaaaagaacatgcag

SEQ ID NO: 3429365 - DNA, 22 bp, Homo sapiens
atttagaaaaagaacatgcagt

SEQ ID NO: 3429366 - DNA, 23 bp, Homo sapiens
atttagaaaaagaacatgcagtt

SEQ ID NO: 3429367 - DNA, 17 bp, Homo sapiens
atttagatattttccat

SEQ ID NO: 3429368 - DNA, 18 bp, Homo sapiens
atttagattgttaaaata

SEQ ID NO: 3429369 - DNA, 13 bp, Homo sapiens
atttagccctcac

SEQ ID NO: 3429370 - DNA, 23 bp, Homo sapiens
aggtcaatacagtacaggcagca

SEQ ID NO: 3429371 - DNA, 12 bp, Homo sapiens
aggtcactgcta

SEQ ID NO: 3429372 - DNA, 12 bp, Homo sapiens
aggtcagagcct

SEQ ID NO: 3429373 - DNA, 13 bp, Homo sapiens
aggtcagagcctg

SEQ ID NO: 3429374 - DNA, 15 bp, Homo sapiens
aggtcagagcctgca

SEQ ID NO: 3429375 - DNA, 17 bp, Homo sapiens
aggtcagagcctgcagt

SEQ ID NO: 3429376 - DNA, 19 bp, Homo sapiens
aggtcagcatttgatctgt

SEQ ID NO: 3429377 - DNA, 15 bp, Homo sapiens
aggtcaggagttcct

SEQ ID NO: 3429378 - DNA, 16 bp, Homo sapiens
aggtccagctctggag

SEQ ID NO: 3429379 - DNA, 23 bp, Homo sapiens
aggtccagctctggaggggaggg

SEQ ID NO: 3429380 - DNA, 13 bp, Homo sapiens
aggtcctctgtca

SEQ ID NO: 3429381 - DNA, 22 bp, Homo sapiens
aggtcggtaggttcagccaagg

SEQ ID NO: 3429382 - DNA, 13 bp, Homo sapiens
cacattttgtaat

SEQ ID NO: 3429383 - DNA, 13 bp, Homo sapiens
caccaagcacagc

SEQ ID NO: 3429384 - DNA, 14 bp, Homo sapiens
caccaagcacagca

SEQ ID NO: 3429385 - DNA, 16 bp, Homo sapiens
caccaagcacagcagc

SEQ ID NO: 3429386 - DNA, 19 bp, Homo sapiens
caccaagcacagcagcctg

SEQ ID NO: 3429387 - DNA, 21 bp, Homo sapiens
caccaagcaggaaatgaaaat

SEQ ID NO: 3429388 - DNA, 20 bp, Homo sapiens
caccaaggaaacgctacctc

SEQ ID NO: 3429389 - DNA, 21 bp, Homo sapiens
caccaattggataaagcagct

SEQ ID NO: 3429390 - DNA, 13 bp, Homo sapiens
caccacacccagc

SEQ ID NO: 3429391 - DNA, 14 bp, Homo sapiens
caccacatctaagc

SEQ ID NO: 3429392 - DNA, 18 bp, Homo sapiens
caccacatgtgcacatgc

SEQ ID NO: 3429393 - DNA, 13 bp, Homo sapiens
caccaccaagcca

SEQ ID NO: 3429394 - DNA, 13 bp, Homo sapiens
caccaccacaccc

SEQ ID NO: 3429395 - DNA, 17 bp, Homo sapiens
caccaccctgtcttcct

SEQ ID NO: 3429396 - DNA, 18 bp, Homo sapiens
caccaccctgtcttcctc

SEQ ID NO: 3429397 - DNA, 15 bp, Homo sapiens
cctaaatccaaagaa

SEQ ID NO: 3429398 - DNA, 16 bp, Homo sapiens
cctaaatccaaagaaa

SEQ ID NO: 3429399 - DNA, 14 bp, Homo sapiens
cctaaatggcctca

SEQ ID NO: 3429400 - DNA, 18 bp, Homo sapiens
cctaaatggcctcatgtg

SEQ ID NO: 3429401 - DNA, 22 bp, Homo sapiens
cctaagaagctctggccccagg

SEQ ID NO: 3429402 - DNA, 18 bp, Homo sapiens
cctaagagttgagctctc

SEQ ID NO: 3429403 - DNA, 19 bp, Homo sapiens
cctaagcctgtggctgtgg

SEQ ID NO: 3429404 - DNA, 19 bp, Homo sapiens
cctaagcttctagaggctc

SEQ ID NO: 3429405 - DNA, 19 bp, Homo sapiens
cctaagggctcaccgtggc

SEQ ID NO: 3429406 - DNA, 15 bp, Homo sapiens
cctaagtagaccaaa

SEQ ID NO: 3429407 - DNA, 20 bp, Homo sapiens
cctaagtttcagttgatttt

SEQ ID NO: 3429408 - DNA, 14 bp, Homo sapiens
cctaatccaggcag

SEQ ID NO: 3429409 - DNA, 21 bp, Homo sapiens
cctaatccaggcagatccagg

SEQ ID NO: 3429410 - DNA, 20 bp, Homo sapiens
cctaatctatggtcgggaga

SEQ ID NO: 3429411 - DNA, 12 bp, Homo sapiens
cctaatgctgca

SEQ ID NO: 3429412 - DNA, 15 bp, Homo sapiens
cctacacactgtcat

SEQ ID NO: 3429413 - DNA, 20 bp, Homo sapiens
cctacagctttgatccctga

SEQ ID NO: 3429414 - DNA, 21 bp, Homo sapiens
cctacagctttgatccctgac

SEQ ID NO: 3429415 - DNA, 18 bp, Homo sapiens
cctacaggagtgagcact

SEQ ID NO: 3429416 - DNA, 18 bp, Homo sapiens
cctacatccccaggtctc

SEQ ID NO: 3429417 - DNA, 19 bp, Homo sapiens
cctacatccccaggtctct

SEQ ID NO: 3429418 - DNA, 14 bp, Homo sapiens
cctaccacatgcca

SEQ ID NO: 3429419 - DNA, 13 bp, Homo sapiens
cctacccaccctc

SEQ ID NO: 3429420 - DNA, 19 bp, Homo sapiens
cctacccatccccgcagtg

SEQ ID NO: 3429421 - DNA, 16 bp, Homo sapiens
cctactaataaaccag

SEQ ID NO: 3429422 - DNA, 22 bp, Homo sapiens
cctactccagtatgacagagga

SEQ ID NO: 3429423 - DNA, 20 bp, Homo sapiens
cctactgcccaggcactgca

SEQ ID NO: 3429424 - DNA, 11 bp, Homo sapiens
cctactgctgt

SEQ ID NO: 3429425 - DNA, 20 bp, Homo sapiens
cctacttcattttcagagtg

SEQ ID NO: 3429426 - DNA, 21 bp, Homo sapiens
cctacttcattttcagagtga

SEQ ID NO: 3429427 - DNA, 16 bp, Homo sapiens
cctactttagccactg

SEQ ID NO: 3429428 - DNA, 21 bp, Homo sapiens
cctagactcggggtgcttcct

SEQ ID NO: 3429429 - DNA, 12 bp, Homo sapiens
cctagactttag

SEQ ID NO: 3429430 - DNA, 13 bp, Homo sapiens
cctagaggcccca

SEQ ID NO: 3429431 - DNA, 21 bp, Homo sapiens
cctagaggttctgggttttct

SEQ ID NO: 3429432 - DNA, 16 bp, Homo sapiens
cctagcacatgcttca

SEQ ID NO: 3429433 - DNA, 20 bp, Homo sapiens
cctagcagcaccgttctgtg

SEQ ID NO: 3429434 - DNA, 12 bp, Homo sapiens
cctagccagctg

SEQ ID NO: 3429435 - DNA, 16 bp, Homo sapiens
cctagccctctccctc

SEQ ID NO: 3429436 - DNA, 13 bp, Homo sapiens
cctagccctggga

SEQ ID NO: 3429437 - DNA, 17 bp, Homo sapiens
cctagccggttcctgtc

SEQ ID NO: 3429438 - DNA, 21 bp, Homo sapiens
cctagccggttcctgtccctg

SEQ ID NO: 3429439 - DNA, 22 bp, Homo sapiens
cctagccttagaagtcacacag

SEQ ID NO: 3429440 - DNA, 18 bp, Homo sapiens
cctaggcaggacatgctg

SEQ ID NO: 3429441 - DNA, 22 bp, Homo sapiens
cctaggcaggacatgctgaagc

SEQ ID NO: 3429442 - DNA, 16 bp, Homo sapiens
cctaggcagtgggagg

SEQ ID NO: 3429443 - DNA, 17 bp, Homo sapiens
cctaggcagtgggaggc

SEQ ID NO: 3429444 - DNA, 23 bp, Homo sapiens
cctaggcctcaactcctcccata

SEQ ID NO: 3429445 - DNA, 20 bp, Homo sapiens
cctaggcctcagccagagaa

SEQ ID NO: 3429446 - DNA, 13 bp, Homo sapiens
cctaggctcctct

SEQ ID NO: 3429447 - DNA, 18 bp, Homo sapiens
cctaggtgacagagtgag

SEQ ID NO: 3429448 - DNA, 19 bp, Homo sapiens
cctaggtgcagctcctcag

SEQ ID NO: 3429449 - DNA, 18 bp, Homo sapiens
cctagtgaaggcttctct

SEQ ID NO: 3429450 - DNA, 22 bp, Homo sapiens
cctagtgaaggcttctctctgt

SEQ ID NO: 3429451 - DNA, 20 bp, Homo sapiens
cctagttttctttcctcctt

SEQ ID NO: 3429452 - DNA, 22 bp, Homo sapiens
cctagttttctttcctcctttc

SEQ ID NO: 3429453 - DNA, 12 bp, Homo sapiens
cctataaaacag

SEQ ID NO: 3429454 - DNA, 12 bp, Homo sapiens
cctataaggaag

SEQ ID NO: 3429455 - DNA, 16 bp, Homo sapiens
cctatatagtttattg

SEQ ID NO: 3429456 - DNA, 15 bp, Homo sapiens
cctatatatttctat

SEQ ID NO: 3429457 - DNA, 20 bp, Homo sapiens
cctatcaacctaagcaacag

SEQ ID NO: 3429458 - DNA, 23 bp, Homo sapiens
cctatgctattgacaataaaata

SEQ ID NO: 3429459 - DNA, 12 bp, Homo sapiens
cctatgctttga

SEQ ID NO: 3429460 - DNA, 17 bp, Homo sapiens
cctatgggcctgccggg

SEQ ID NO: 3429461 - DNA, 19 bp, Homo sapiens
cctatgggcctgccgggct

SEQ ID NO: 3429462 - DNA, 18 bp, Homo sapiens
cctatgtagtccgtgctg

SEQ ID NO: 3429463 - DNA, 17 bp, Homo sapiens
cctatgtgattttaact

SEQ ID NO: 3429464 - DNA, 18 bp, Homo sapiens
cctattcctgaactataa

SEQ ID NO: 3429465 - DNA, 15 bp, Homo sapiens
cctattctttcgaaa

SEQ ID NO: 3429466 - DNA, 18 bp, Homo sapiens
cctatttccattcaacaa

SEQ ID NO: 3429467 - DNA, 17 bp, Homo sapiens
cctcaaaaaaagccttt

SEQ ID NO: 3429468 - DNA, 18 bp, Homo sapiens
cctcaaaaacgccctcaa

SEQ ID NO: 3429469 - DNA, 13 bp, Homo sapiens
cctcaaacactgc

SEQ ID NO: 3429470 - DNA, 18 bp, Homo sapiens
cctcaaacactgcaggca

SEQ ID NO: 3429471 - DNA, 16 bp, Homo sapiens
cctcaacacctctgca

SEQ ID NO: 3429472 - DNA, 17 bp, Homo sapiens
cctcaacctcttctggc

SEQ ID NO: 3429473 - DNA, 18 bp, Homo sapiens
cctcaacgtattgtttcg

SEQ ID NO: 3429474 - DNA, 13 bp, Homo sapiens
cctcaagaacatg

SEQ ID NO: 3429475 - DNA, 17 bp, Homo sapiens
cctcaagaacatgatgg

SEQ ID NO: 3429476 - DNA, 17 bp, Homo sapiens
cctcaagtgatcctccc

SEQ ID NO: 3429477 - DNA, 18 bp, Homo sapiens
cctcaagtgatcctccca

SEQ ID NO: 3429478 - DNA, 23 bp, Homo sapiens
cctcaagtgattctcctgcctca

SEQ ID NO: 3429479 - DNA, 18 bp, Homo sapiens
cctcaatccagctatgtt

SEQ ID NO: 3429480 - DNA, 18 bp, Homo sapiens
cctcaatctcaatcctgc

SEQ ID NO: 3429481 - DNA, 15 bp, Homo sapiens
cctcacaggccccag

SEQ ID NO: 3429482 - DNA, 19 bp, Homo sapiens
cctcacccacccctgcaca

SEQ ID NO: 3429483 - DNA, 21 bp, Homo sapiens
cctcacccacccctgcacagt

SEQ ID NO: 3429484 - DNA, 15 bp, Homo sapiens
cctcacccctggttc

SEQ ID NO: 3429485 - DNA, 21 bp, Homo sapiens
cctcacccctggttctcatct

SEQ ID NO: 3429486 - DNA, 22 bp, Homo sapiens
cctcagaacccttggcttgccc

SEQ ID NO: 3429487 - DNA, 21 bp, Homo sapiens
cctcagagtgcaagcccctgc

SEQ ID NO: 3429488 - DNA, 16 bp, Homo sapiens
cctcagccagagaagc

SEQ ID NO: 3429489 - DNA, 17 bp, Homo sapiens
cctcagccagagaagct

SEQ ID NO: 3429490 - DNA, 16 bp, Homo sapiens
cctcagccctgaccct

SEQ ID NO: 3429491 - DNA, 17 bp, Homo sapiens
cctcagccctgaccctg

SEQ ID NO: 3429492 - DNA, 21 bp, Homo sapiens
cctcagccctgaccctgtgga

SEQ ID NO: 3429493 - DNA, 22 bp, Homo sapiens
cctcagcctcccaaagtgctgg

SEQ ID NO: 3429494 - DNA, 22 bp, Homo sapiens
cctcagcctcccaagtagctgg

SEQ ID NO: 3429495 - DNA, 22 bp, Homo sapiens
cctcagcctcccgaatagctgg

SEQ ID NO: 3429496 - DNA, 19 bp, Homo sapiens
cctcagcctggccagacac

SEQ ID NO: 3429497 - DNA, 20 bp, Homo sapiens
cctcagcctggccagacaca

SEQ ID NO: 3429498 - DNA, 20 bp, Homo sapiens
cctcagccttgccagagatc

SEQ ID NO: 3429499 - DNA, 22 bp, Homo sapiens
cctcagccttgccagagatcca

SEQ ID NO: 3429500 - DNA, 14 bp, Homo sapiens
cctcagcgcggccc

SEQ ID NO: 3429501 - DNA, 20 bp, Homo sapiens
cctcaggcacacagctactc

SEQ ID NO: 3429502 - DNA, 11 bp, Homo sapiens
cctcagggcac

SEQ ID NO: 3429503 - DNA, 20 bp, Homo sapiens
cctcaggtgagaagcagagg

SEQ ID NO: 3429504 - DNA, 19 bp, Homo sapiens
cctcaggtgatccacccac

SEQ ID NO: 3429505 - DNA, 15 bp, Homo sapiens
cctcaggtggccatg

SEQ ID NO: 3429506 - DNA, 11 bp, Homo sapiens
cctcagtgcca

SEQ ID NO: 3429507 - DNA, 15 bp, Homo sapiens
cctcagttgtgcagc

SEQ ID NO: 3429508 - DNA, 15 bp, Homo sapiens
cctcataccatctgc

SEQ ID NO: 3429509 - DNA, 15 bp, Homo sapiens
cctcatcatcagagc

SEQ ID NO: 3429510 - DNA, 15 bp, Homo sapiens
cctcatccagggctc

SEQ ID NO: 3429511 - DNA, 20 bp, Homo sapiens
cctcatcccgagcacctcca

SEQ ID NO: 3429512 - DNA, 20 bp, Homo sapiens
cctcatctctctgcccaacc

SEQ ID NO: 3429513 - DNA, 15 bp, Homo sapiens
cctcatctctgcctg

SEQ ID NO: 3429514 - DNA, 17 bp, Homo sapiens
cctcatctctgcctgac

SEQ ID NO: 3429515 - DNA, 17 bp, Homo sapiens
cctcatctgtccctccg

SEQ ID NO: 3429516 - DNA, 17 bp, Homo sapiens
cctcatcttcttcacca

SEQ ID NO: 3429517 - DNA, 19 bp, Homo sapiens
cctcatgacagccagagcc

SEQ ID NO: 3429518 - DNA, 13 bp, Homo sapiens
cctcatgtggctg

SEQ ID NO: 3429519 - DNA, 15 bp, Homo sapiens
cctcatgtggctgga

SEQ ID NO: 3429520 - DNA, 23 bp, Homo sapiens
cctcatgtggctggaagatcctg

SEQ ID NO: 3429521 - DNA, 12 bp, Homo sapiens
cctcattaaatt

SEQ ID NO: 3429522 - DNA, 11 bp, Homo sapiens
cctcatttctc

SEQ ID NO: 3429523 - DNA, 17 bp, Homo sapiens
cctccacgttctgctca

SEQ ID NO: 3429524 - DNA, 17 bp, Homo sapiens
cctccactctcccccac

SEQ ID NO: 3429525 - DNA, 22 bp, Homo sapiens
cctccactctcccccaccccct

SEQ ID NO: 3429526 - DNA, 21 bp, Homo sapiens
cctccagaactcactggggcc

SEQ ID NO: 3429527 - DNA, 19 bp, Homo sapiens
cctccagccaaacgggagc

SEQ ID NO: 3429528 - DNA, 20 bp, Homo sapiens
cctccagccaaacgggagct

SEQ ID NO: 3429529 - DNA, 18 bp, Homo sapiens
cctccaggagcttcttgt

SEQ ID NO: 3429530 - DNA, 23 bp, Homo sapiens
cctccaggagcttcttgtttcct

SEQ ID NO: 3429531 - DNA, 12 bp, Homo sapiens
cctccagggctg

SEQ ID NO: 3429532 - DNA, 13 bp, Homo sapiens
cctccagggctgg

SEQ ID NO: 3429533 - DNA, 12 bp, Homo sapiens
ctacctccctcc

SEQ ID NO: 3429534 - DNA, 13 bp, Homo sapiens
ctacctccctccc

SEQ ID NO: 3429535 - DNA, 23 bp, Homo sapiens
ctacctccctccccgtctcattc

SEQ ID NO: 3429536 - DNA, 12 bp, Homo sapiens
aaaatagaaaag

SEQ ID NO: 3429537 - DNA, 16 bp, Homo sapiens
aaaatagaaaagttat

SEQ ID NO: 3429538 - DNA, 21 bp, Homo sapiens
aaaatagcaacactctatatt

SEQ ID NO: 3429539 - DNA, 22 bp, Homo sapiens
aaaatagcaacactctatattt

SEQ ID NO: 3429540 - DNA, 10 bp, Homo sapiens
aaaatataaa

SEQ ID NO: 3429541 - DNA, 20 bp, Homo sapiens
aaaatatagctgtacaaata

SEQ ID NO: 3429542 - DNA, 12 bp, Homo sapiens
aaaatatatgta

SEQ ID NO: 3429543 - DNA, 14 bp, Homo sapiens
aaaatatatgtatt

SEQ ID NO: 3429544 - DNA, 14 bp, Homo sapiens
aaaatatgtaccaa

SEQ ID NO: 3429545 - DNA, 13 bp, Homo sapiens
aaaatatttataa

SEQ ID NO: 3429546 - DNA, 12 bp, Homo sapiens
aaaatattttgt

SEQ ID NO: 3429547 - DNA, 17 bp, Homo sapiens
aaaatattttttctgta

SEQ ID NO: 3429548 - DNA, 22 bp, Homo sapiens
aaaatcaactttttattgcctt

SEQ ID NO: 3429549 - DNA, 19 bp, Homo sapiens
aaaatcagccaattatgtt

SEQ ID NO: 3429550 - DNA, 12 bp, Homo sapiens
aaaatcatcaag

SEQ ID NO: 3429551 - DNA, 23 bp, Homo sapiens
aaaatcatcaagaagggctgcat

SEQ ID NO: 3429552 - DNA, 18 bp, Homo sapiens
aaaatctgtcactacaat

SEQ ID NO: 3429553 - DNA, 22 bp, Homo sapiens
aaaatctttctttcttagaaat

SEQ ID NO: 3429554 - DNA, 15 bp, Homo sapiens
aaaatgagagctgta

SEQ ID NO: 3429555 - DNA, 14 bp, Homo sapiens
aaaatgagcctggc

SEQ ID NO: 3429556 - DNA, 19 bp, Homo sapiens
aaaatgaggaatgtatatg

SEQ ID NO: 3429557 - DNA, 14 bp, Homo sapiens
aaaatgcattgtat

SEQ ID NO: 3429558 - DNA, 23 bp, Homo sapiens
aaaatgccatgatgcctctgtct

SEQ ID NO: 3429559 - DNA, 18 bp, Homo sapiens
aaaatgcctcagtgtatt

SEQ ID NO: 3429560 - DNA, 19 bp, Homo sapiens
aaaatgctttttatttctg

SEQ ID NO: 3429561 - DNA, 22 bp, Homo sapiens
aaaatgctttttatttctgcat

SEQ ID NO: 3429562 - DNA, 16 bp, Homo sapiens
aaaatggaggtggaaa

SEQ ID NO: 3429563 - DNA, 14 bp, Homo sapiens
aaaatggatacata

SEQ ID NO: 3429564 - DNA, 11 bp, Homo sapiens
aaaatgtaaca

SEQ ID NO: 3429565 - DNA, 21 bp, Homo sapiens
aaaatgtagcagcttcttagt

SEQ ID NO: 3429566 - DNA, 21 bp, Homo sapiens
aaaatgtaggcttagtttgtg

SEQ ID NO: 3429567 - DNA, 21 bp, Homo sapiens
aaaatgtcttcttattttggt

SEQ ID NO: 3429568 - DNA, 16 bp, Homo sapiens
aaaatgttatttaaca

SEQ ID NO: 3429569 - DNA, 19 bp, Homo sapiens
aaaatgttgaaaagtcaaa

SEQ ID NO: 3429570 - DNA, 22 bp, Homo sapiens
aaaattcatgatactcatttct

SEQ ID NO: 3429571 - DNA, 13 bp, Homo sapiens
aaaattcatttct

SEQ ID NO: 3429572 - DNA, 15 bp, Homo sapiens
aaaattcatttctaa

SEQ ID NO: 3429573 - DNA, 16 bp, Homo sapiens
aaaattgccatattgc

SEQ ID NO: 3429574 - DNA, 17 bp, Homo sapiens
aaaattgccatattgca

SEQ ID NO: 3429575 - DNA, 12 bp, Homo sapiens
aaaattgtgaag

SEQ ID NO: 3429576 - DNA, 12 bp, Homo sapiens
aaaatttaactt

SEQ ID NO: 3429577 - DNA, 20 bp, Homo sapiens
aaaatttattttataagaaa

SEQ ID NO: 3429578 - DNA, 13 bp, Homo sapiens
aaaatttcacatt

SEQ ID NO: 3429579 - DNA, 20 bp, Homo sapiens
aaaatttcacattaatattt

SEQ ID NO: 3429580 - DNA, 15 bp, Homo sapiens
aaaatttctattaaa

SEQ ID NO: 3429581 - DNA, 19 bp, Homo sapiens
aaaatttgactaattttac

SEQ ID NO: 3429582 - DNA, 18 bp, Homo sapiens
aaaatttgttattttgca

SEQ ID NO: 3429583 - DNA, 21 bp, Homo sapiens
aaaattttataaaattaagca

SEQ ID NO: 3429584 - DNA, 21 bp, Homo sapiens
aaaattttgtgacattccttc

SEQ ID NO: 3429585 - DNA, 16 bp, Homo sapiens
aaaattttttttcatg

SEQ ID NO: 3429586 - DNA, 19 bp, Homo sapiens
aaaattttttttcatgttt

SEQ ID NO: 3429587 - DNA, 20 bp, Homo sapiens
aaacaagcactaaacaaaga

SEQ ID NO: 3429588 - DNA, 15 bp, Homo sapiens
aaacaatattgtttc

SEQ ID NO: 3429589 - DNA, 17 bp, Homo sapiens
aaacaatattgtttcta

SEQ ID NO: 3429590 - DNA, 12 bp, Homo sapiens
aaacacccctca

SEQ ID NO: 3429591 - DNA, 18 bp, Homo sapiens
aaacacttcgttcgcaga

SEQ ID NO: 3429592 - DNA, 14 bp, Homo sapiens
aaacactttcaaaa

SEQ ID NO: 3429593 - DNA, 16 bp, Homo sapiens
aaacagacaatatgtg

SEQ ID NO: 3429594 - DNA, 22 bp, Homo sapiens
aaacagacaatatgtgagtgcc

SEQ ID NO: 3429595 - DNA, 17 bp, Homo sapiens
aaacagacagaaagaga

SEQ ID NO: 3429596 - DNA, 22 bp, Homo sapiens
aaacagacctaatgctccttgt

SEQ ID NO: 3429597 - DNA, 11 bp, Homo sapiens
aaacagctgcc

SEQ ID NO: 3429598 - DNA, 17 bp, Homo sapiens
aaacaggtcaatacagt

SEQ ID NO: 3429599 - DNA, 12 bp, Homo sapiens
aaacagtatctc

SEQ ID NO: 3429600 - DNA, 17 bp, Homo sapiens
aaacataagatcactgc

SEQ ID NO: 3429601 - DNA, 14 bp, Homo sapiens
aaacatagaaatgg

SEQ ID NO: 3429602 - DNA, 21 bp, Homo sapiens
aaacatagaaatggaaatttt

SEQ ID NO: 3429603 - DNA, 14 bp, Homo sapiens
aaacatcacacaca

SEQ ID NO: 3429604 - DNA, 23 bp, Homo sapiens
aaacatcagttactctgaagggc

SEQ ID NO: 3429605 - DNA, 19 bp, Homo sapiens
aaacatccaatattttctt

SEQ ID NO: 3429606 - DNA, 19 bp, Homo sapiens
aaacatgaccctaaatctt

SEQ ID NO: 3429607 - DNA, 16 bp, Homo sapiens
aaacatgttagaagca

SEQ ID NO: 3429608 - DNA, 12 bp, Homo sapiens
aaacattgaaga

SEQ ID NO: 3429609 - DNA, 23 bp, Homo sapiens
aaacattgttttgtgtaacatat

SEQ ID NO: 3429610 - DNA, 13 bp, Homo sapiens
aaacatttgagtt

SEQ ID NO: 3429611 - DNA, 19 bp, Homo sapiens
aaaccaaaatactccaaag

SEQ ID NO: 3429612 - DNA, 14 bp, Homo sapiens
aaaccaaggactga

SEQ ID NO: 3429613 - DNA, 14 bp, Homo sapiens
aaaccacacaaaga

SEQ ID NO: 3429614 - DNA, 11 bp, Homo sapiens
aaaccagctgc

SEQ ID NO: 3429615 - DNA, 12 bp, Homo sapiens
aaaccagctgct

SEQ ID NO: 3429616 - DNA, 17 bp, Homo sapiens
aaaccatatgaacatat

SEQ ID NO: 3429617 - DNA, 18 bp, Homo sapiens
aaacccatggctctattt

SEQ ID NO: 3429618 - DNA, 17 bp, Homo sapiens
aaaccccatctctacaa

SEQ ID NO: 3429619 - DNA, 21 bp, Homo sapiens
aaacccgggaacctccccagc

SEQ ID NO: 3429620 - DNA, 15 bp, Homo sapiens
aaaccgccaaggctg

SEQ ID NO: 3429621 - DNA, 18 bp, Homo sapiens
aaacctcatgacagccag

SEQ ID NO: 3429622 - DNA, 21 bp, Homo sapiens
aaacctcatgacagccagagc

SEQ ID NO: 3429623 - DNA, 23 bp, Homo sapiens
aaacctcatgacagccagagcct

SEQ ID NO: 3429624 - DNA, 14 bp, Homo sapiens
aaacctctgttcag

SEQ ID NO: 3429625 - DNA, 17 bp, Homo sapiens
aaacctctgttcagtgt

SEQ ID NO: 3429626 - DNA, 21 bp, Homo sapiens
aaacctctgttcagtgtaaat

SEQ ID NO: 3429627 - DNA, 16 bp, Homo sapiens
aaacctgcctgggttt

SEQ ID NO: 3429628 - DNA, 18 bp, Homo sapiens
aaacctgggattcaggaa

SEQ ID NO: 3429629 - DNA, 21 bp, Homo sapiens
aaacctgggattcaggaatgt

SEQ ID NO: 3429630 - DNA, 21 bp, Homo sapiens
aaacctgttgaagattatttc

SEQ ID NO: 3429631 - DNA, 20 bp, Homo sapiens
aaacctgtttttttttcatt

SEQ ID NO: 3429632 - DNA, 23 bp, Homo sapiens
aaaccttagtgtccttttctcat

SEQ ID NO: 3429633 - DNA, 16 bp, Homo sapiens
aaaccttattgtacct

SEQ ID NO: 3429634 - DNA, 18 bp, Homo sapiens
aaacgctacctctctgtc

SEQ ID NO: 3429635 - DNA, 21 bp, Homo sapiens
aaacgctacctctctgtccct

SEQ ID NO: 3429636 - DNA, 16 bp, Homo sapiens
aaacgctcctttgtgt

SEQ ID NO: 3429637 - DNA, 16 bp, Homo sapiens
aaacgctgcctgccca

SEQ ID NO: 3429638 - DNA, 21 bp, Homo sapiens
aaactactgcctttagaaaat

SEQ ID NO: 3429639 - DNA, 19 bp, Homo sapiens
aaactagcatatctgcctt

SEQ ID NO: 3429640 - DNA, 17 bp, Homo sapiens
aaactaggaaatttttt

SEQ ID NO: 3429641 - DNA, 21 bp, Homo sapiens
aaactattaaggatgtagctt

SEQ ID NO: 3429642 - DNA, 24 bp, Homo sapiens
aaactcatttataaagctaaaata

SEQ ID NO: 3429643 - DNA, 14 bp, Homo sapiens
aaactccttcctgg

SEQ ID NO: 3429644 - DNA, 13 bp, Homo sapiens
aaactctctgaac

SEQ ID NO: 3429645 - DNA, 23 bp, Homo sapiens
aaactcttaaaacccaagtgcct

SEQ ID NO: 3429646 - DNA, 22 bp, Homo sapiens
aaactcttcagttaattcttag

SEQ ID NO: 3429647 - DNA, 17 bp, Homo sapiens
aaactgaagcaacttga

SEQ ID NO: 3429648 - DNA, 21 bp, Homo sapiens
aaactgaagcagcctctcccc

SEQ ID NO: 3429649 - DNA, 13 bp, Homo sapiens
aaactgagacagg

SEQ ID NO: 3429650 - DNA, 15 bp, Homo sapiens
aaactgccctggctc

SEQ ID NO: 3429651 - DNA, 17 bp, Homo sapiens
aaactggggcctccaga

SEQ ID NO: 3429652 - DNA, 17 bp, Homo sapiens
aaactgtaatacaatga

SEQ ID NO: 3429653 - DNA, 19 bp, Homo sapiens
aaactgtctttaaaagaga

SEQ ID NO: 3429654 - DNA, 19 bp, Homo sapiens
aaactgtgcttctctatga

SEQ ID NO: 3429655 - DNA, 17 bp, Homo sapiens
aaacttagtgacaaaat

SEQ ID NO: 3429656 - DNA, 19 bp, Homo sapiens
aaacttcgctgtcccccaa

SEQ ID NO: 3429657 - DNA, 17 bp, Homo sapiens
aaacttctggctccctc

SEQ ID NO: 3429658 - DNA, 15 bp, Homo sapiens
aaacttggattctct

SEQ ID NO: 3429659 - DNA, 20 bp, Homo sapiens
aaactttgaggataactttt

SEQ ID NO: 3429660 - DNA, 14 bp, Homo sapiens
aaactttgctaaat

SEQ ID NO: 3429661 - DNA, 16 bp, Homo sapiens
aaagaaaattcctata

SEQ ID NO: 3429662 - DNA, 21 bp, Homo sapiens
aaagaaataaccactgcaagt

SEQ ID NO: 3429663 - DNA, 13 bp, Homo sapiens
aaagaatacttga

SEQ ID NO: 3429664 - DNA, 16 bp, Homo sapiens
aaagaatacttgaact

SEQ ID NO: 3429665 - DNA, 20 bp, Homo sapiens
aaagaatatgactttttata

SEQ ID NO: 3429666 - DNA, 18 bp, Homo sapiens
aaagaatgttactgcctt

SEQ ID NO: 3429667 - DNA, 17 bp, Homo sapiens
aaagacaaattctgttt

SEQ ID NO: 3429668 - DNA, 16 bp, Homo sapiens
aaatttgataatgaca

SEQ ID NO: 3429669 - DNA, 15 bp, Homo sapiens
aaatttgattgattt

SEQ ID NO: 3429670 - DNA, 17 bp, Homo sapiens
aaatttgattgatttga

SEQ ID NO: 3429671 - DNA, 21 bp, Homo sapiens
aaattttgctatcaacaataa

SEQ ID NO: 3429672 - DNA, 12 bp, Homo sapiens
aaattttgtaat

SEQ ID NO: 3429673 - DNA, 15 bp, Homo sapiens
aaattttgtaatgaa

SEQ ID NO: 3429674 - DNA, 13 bp, Homo sapiens
aacaaaaaaatct

SEQ ID NO: 3429675 - DNA, 13 bp, Homo sapiens
aacaaaaagaaca

SEQ ID NO: 3429676 - DNA, 18 bp, Homo sapiens
aacaaaacaaaacaacat

SEQ ID NO: 3429677 - DNA, 17 bp, Homo sapiens
aacaaaatggcttcagt

SEQ ID NO: 3429678 - DNA, 14 bp, Homo sapiens
aacaaaatgtagaa

SEQ ID NO: 3429679 - DNA, 11 bp, Homo sapiens
aacaaaatttg

SEQ ID NO: 3429680 - DNA, 20 bp, Homo sapiens
aacaaaatttgactaatttt

SEQ ID NO: 3429681 - DNA, 14 bp, Homo sapiens
aacaaacaaacaaa

SEQ ID NO: 3429682 - DNA, 10 bp, Homo sapiens
aacaaaccat

SEQ ID NO: 3429683 - DNA, 22 bp, Homo sapiens
aacaaaggattaattgctgcaa

SEQ ID NO: 3429684 - DNA, 13 bp, Homo sapiens
aacaaagttacta

SEQ ID NO: 3429685 - DNA, 19 bp, Homo sapiens
aacaaatacattcaaattc

SEQ ID NO: 3429686 - DNA, 13 bp, Homo sapiens
aacaaatatgcaa

SEQ ID NO: 3429687 - DNA, 22 bp, Homo sapiens
aacaacatttaagggaatgtga

SEQ ID NO: 3429688 - DNA, 22 bp, Homo sapiens
aacaacgtctttttgtttgttt

SEQ ID NO: 3429689 - DNA, 22 bp, Homo sapiens
aacaagaccaccacttcgaaac

SEQ ID NO: 3429690 - DNA, 19 bp, Homo sapiens
aacaagcaagctcccaagg

SEQ ID NO: 3429691 - DNA, 21 bp, Homo sapiens
aacaagcctccttttaaagta

SEQ ID NO: 3429692 - DNA, 22 bp, Homo sapiens
aacaagcctgaccctgtaaaat

SEQ ID NO: 3429693 - DNA, 17 bp, Homo sapiens
aacaaggaaactttcct

SEQ ID NO: 3429694 - DNA, 18 bp, Homo sapiens
aacaataggctgttccca

SEQ ID NO: 3429695 - DNA, 15 bp, Homo sapiens
aacaatagtaactct

SEQ ID NO: 3429696 - DNA, 16 bp, Homo sapiens
aacaatattgtttcta

SEQ ID NO: 3429697 - DNA, 17 bp, Homo sapiens
aacaatcctagtgcttt

SEQ ID NO: 3429698 - DNA, 22 bp, Homo sapiens
aacaatcctagtgctttccttt

SEQ ID NO: 3429699 - DNA, 13 bp, Homo sapiens
aacaattttcaga

SEQ ID NO: 3429700 - DNA, 22 bp, Homo sapiens
aacaattttcagacctgttggt

SEQ ID NO: 3429701 - DNA, 15 bp, Homo sapiens
aacacaaactgtaaa

SEQ ID NO: 3429702 - DNA, 19 bp, Homo sapiens
aacacaaactgtaaataaa

SEQ ID NO: 3429703 - DNA, 20 bp, Homo sapiens
aacacaaagaccaaaatgaa

SEQ ID NO: 3429704 - DNA, 20 bp, Homo sapiens
aacacactgaggcagggaag

SEQ ID NO: 3429705 - DNA, 22 bp, Homo sapiens
aacacattttggttcttctcaa

SEQ ID NO: 3429706 - DNA, 17 bp, Homo sapiens
aacaccaagcacagcag

SEQ ID NO: 3429707 - DNA, 18 bp, Homo sapiens
aacaccaagcacagcagc

SEQ ID NO: 3429708 - DNA, 14 bp, Homo sapiens
aacacgcacctgcc

SEQ ID NO: 3429709 - DNA, 20 bp, Homo sapiens
aacacgcctgcaaacgctgc

SEQ ID NO: 3429710 - DNA, 13 bp, Homo sapiens
aacacggccacat

SEQ ID NO: 3429711 - DNA, 14 bp, Homo sapiens
aacactactcttac

SEQ ID NO: 3429712 - DNA, 21 bp, Homo sapiens
aacactcacatttattctgct

SEQ ID NO: 3429713 - DNA, 12 bp, Homo sapiens
aacactcttttg

SEQ ID NO: 3429714 - DNA, 15 bp, Homo sapiens
aacactgcaagaagt

SEQ ID NO: 3429715 - DNA, 20 bp, Homo sapiens
aacactgtgcacatctgtgt

SEQ ID NO: 3429716 - DNA, 19 bp, Homo sapiens
aacagacagaaagagacac

SEQ ID NO: 3429717 - DNA, 18 bp, Homo sapiens
aacagacctaatgctcct

SEQ ID NO: 3429718 - DNA, 19 bp, Homo sapiens
aacagactggaagcacagc

SEQ ID NO: 3429719 - DNA, 20 bp, Homo sapiens
aacagactggaagcacagct

SEQ ID NO: 3429720 - DNA, 14 bp, Homo sapiens
aacagagcccaggg

SEQ ID NO: 3429721 - DNA, 19 bp, Homo sapiens
aacagatatcttcagttta

SEQ ID NO: 3429722 - DNA, 15 bp, Homo sapiens
aacagatatgttttt

SEQ ID NO: 3429723 - DNA, 21 bp, Homo sapiens
aacagatctggaacctcagcc

SEQ ID NO: 3429724 - DNA, 14 bp, Homo sapiens
aacagatcttttac

SEQ ID NO: 3429725 - DNA, 18 bp, Homo sapiens
aacagcatgacaaaaatt

SEQ ID NO: 3429726 - DNA, 23 bp, Homo sapiens
aacagcatgacaaaaattatttt

SEQ ID NO: 3429727 - DNA, 19 bp, Homo sapiens
aacagccaactagcccctg

SEQ ID NO: 3429728 - DNA, 15 bp, Homo sapiens
aacagccactcccct

SEQ ID NO: 3429729 - DNA, 16 bp, Homo sapiens
aacagcctctttttga

SEQ ID NO: 3429730 - DNA, 14 bp, Homo sapiens
aacagcctttgaat

SEQ ID NO: 3429731 - DNA, 19 bp, Homo sapiens
aacagcctttgaatgtaac

SEQ ID NO: 3429732 - DNA, 13 bp, Homo sapiens
aacagcgctgggt

SEQ ID NO: 3429733 - DNA, 10 bp, Homo sapiens
aacagctgcc

SEQ ID NO: 3429734 - DNA, 12 bp, Homo sapiens
aacagctgcctt

SEQ ID NO: 3429735 - DNA, 22 bp, Homo sapiens
aacagctgccttagcttcagga

SEQ ID NO: 3429736 - DNA, 23 bp, Homo sapiens
aacagctgccttagcttcaggaa

SEQ ID NO: 3429737 - DNA, 13 bp, Homo sapiens
aacagctgtggct

SEQ ID NO: 3429738 - DNA, 13 bp, Homo sapiens
aacagcttgctgt

SEQ ID NO: 3429739 - DNA, 16 bp, Homo sapiens
aacaggaatctcagag

SEQ ID NO: 3429740 - DNA, 13 bp, Homo sapiens
aacaggctgggct

SEQ ID NO: 3429741 - DNA, 15 bp, Homo sapiens
aacaggtaatataaa

SEQ ID NO: 3429742 - DNA, 18 bp, Homo sapiens
aacaggtgttggtgacaa

SEQ ID NO: 3429743 - DNA, 14 bp, Homo sapiens
aacagtaaatgtgc

SEQ ID NO: 3429744 - DNA, 18 bp, Homo sapiens
aacagtcacgcctgaaac

SEQ ID NO: 3429745 - DNA, 17 bp, Homo sapiens
aacagttcaaagaagtc

SEQ ID NO: 3429746 - DNA, 23 bp, Homo sapiens
aacatagaaatggaaattttgct

SEQ ID NO: 3429747 - DNA, 15 bp, Homo sapiens
aacatataaaataat

SEQ ID NO: 3429748 - DNA, 17 bp, Homo sapiens
aacatataaaataatgc

SEQ ID NO: 3429749 - DNA, 15 bp, Homo sapiens
aacatatatatacta

SEQ ID NO: 3429750 - DNA, 13 bp, Homo sapiens
aacatcacacaca

SEQ ID NO: 3429751 - DNA, 18 bp, Homo sapiens
aacatcacacctgcccta

SEQ ID NO: 3429752 - DNA, 19 bp, Homo sapiens
aacatcagttactctgaag

SEQ ID NO: 3429753 - DNA, 11 bp, Homo sapiens
aacatccaaaa

SEQ ID NO: 3429754 - DNA, 16 bp, Homo sapiens
aacatccaaccttccc

SEQ ID NO: 3429755 - DNA, 22 bp, Homo sapiens
aacatcctatcaacaacaaggt

SEQ ID NO: 3429756 - DNA, 17 bp, Homo sapiens
aacatctagcaaatgtt

SEQ ID NO: 3429757 - DNA, 21 bp, Homo sapiens
aacatctttttaacctgcaaa

SEQ ID NO: 3429758 - DNA, 18 bp, Homo sapiens
aacatgaggggacatttt

SEQ ID NO: 3429759 - DNA, 14 bp, Homo sapiens
aacatgatgtacta

SEQ ID NO: 3429760 - DNA, 15 bp, Homo sapiens
aacatgatgtactaa

SEQ ID NO: 3429761 - DNA, 15 bp, Homo sapiens
aacatgcagtttgaa

SEQ ID NO: 3429762 - DNA, 17 bp, Homo sapiens
aacatgcagtttgaaat

SEQ ID NO: 3429763 - DNA, 11 bp, Homo sapiens
aacatgtatgt

SEQ ID NO: 3429764 - DNA, 21 bp, Homo sapiens
aacattaaaacaatattgttt

SEQ ID NO: 3429765 - DNA, 23 bp, Homo sapiens
aacattaaaacaatattgtttct

SEQ ID NO: 3429766 - DNA, 16 bp, Homo sapiens
aacattagttgcacta

SEQ ID NO: 3429767 - DNA, 13 bp, Homo sapiens
aacattcaggagc

SEQ ID NO: 3429768 - DNA, 14 bp, Homo sapiens
aacattcaggagct

SEQ ID NO: 3429769 - DNA, 22 bp, Homo sapiens
aacattctattgactttcttaa

SEQ ID NO: 3429770 - DNA, 22 bp, Homo sapiens
aacatttaatttagatattttc

SEQ ID NO: 3429771 - DNA, 20 bp, Homo sapiens
aacattttgagaacaaagat

SEQ ID NO: 3429772 - DNA, 14 bp, Homo sapiens
aaccaaaggtgaag

SEQ ID NO: 3429773 - DNA, 16 bp, Homo sapiens
aaccaaaggtgaagga

SEQ ID NO: 3429774 - DNA, 19 bp, Homo sapiens
aaccaacaaggaaactttc

SEQ ID NO: 3429775 - DNA, 16 bp, Homo sapiens
aaccaagtcatgtgca

SEQ ID NO: 3429776 - DNA, 22 bp, Homo sapiens
aaccaatcctactaataaacca

SEQ ID NO: 3429777 - DNA, 13 bp, Homo sapiens
aaccaatcctgga

SEQ ID NO: 3429778 - DNA, 21 bp, Homo sapiens
aaccacaccacatctaagcct

SEQ ID NO: 3429779 - DNA, 19 bp, Homo sapiens
aaccaccacacccagccca

SEQ ID NO: 3429780 - DNA, 21 bp, Homo sapiens
aaccaccacacccagcccact

SEQ ID NO: 3429781 - DNA, 15 bp, Homo sapiens
aaccacttcagctga

SEQ ID NO: 3429782 - DNA, 15 bp, Homo sapiens
aaccactttttgcag

SEQ ID NO: 3429783 - DNA, 17 bp, Homo sapiens
aaccactttttgcagct

SEQ ID NO: 3429784 - DNA, 23 bp, Homo sapiens
aaccagatctagtcaatcaagtc

SEQ ID NO: 3429785 - DNA, 14 bp, Homo sapiens
aaccagccggggcc

SEQ ID NO: 3429786 - DNA, 21 bp, Homo sapiens
aaccagcctcaaaaacgccct

SEQ ID NO: 3429787 - DNA, 11 bp, Homo sapiens
aaccagctgct

SEQ ID NO: 3429788 - DNA, 22 bp, Homo sapiens
aaccagtatttttgctgcttct

SEQ ID NO: 3429789 - DNA, 22 bp, Homo sapiens
aaccagtccccccaccctcatt

SEQ ID NO: 3429790 - DNA, 23 bp, Homo sapiens
aacccaagcctcatattttctgt

SEQ ID NO: 3429791 - DNA, 16 bp, Homo sapiens
aacccaagcttagaac

SEQ ID NO: 3429792 - DNA, 23 bp, Homo sapiens
aacccagacctgttagcagacag

SEQ ID NO: 3429793 - DNA, 21 bp, Homo sapiens
aacccagacggctccactagg

SEQ ID NO: 3429794 - DNA, 16 bp, Homo sapiens
aacccagactcagaca

SEQ ID NO: 3429795 - DNA, 13 bp, Homo sapiens
aacccagattttg

SEQ ID NO: 3429796 - DNA, 21 bp, Homo sapiens
aacccagattttgctgtatat

SEQ ID NO: 3429797 - DNA, 15 bp, Homo sapiens
aacccagtcgccctt

SEQ ID NO: 3429798 - DNA, 23 bp, Homo sapiens
aacccagtcgcccttacttcttg

SEQ ID NO: 3429799 - DNA, 13 bp, Homo sapiens
aacccatggctct

SEQ ID NO: 3429800 - DNA, 17 bp, Homo sapiens
aacccatggctctattt

SEQ ID NO: 3429801 - DNA, 15 bp, Homo sapiens
aacttcatggatcag

SEQ ID NO: 3429802 - DNA, 22 bp, Homo sapiens
aacttccaggtgttactgtaat

SEQ ID NO: 3429803 - DNA, 19 bp, Homo sapiens
aacttcttatggaattgat

SEQ ID NO: 3429804 - DNA, 19 bp, Homo sapiens
aacttcttcagagctgaca

SEQ ID NO: 3429805 - DNA, 16 bp, Homo sapiens
aacttgctgctgtctt

SEQ ID NO: 3429806 - DNA, 13 bp, Homo sapiens
aacttggattctc

SEQ ID NO: 3429807 - DNA, 15 bp, Homo sapiens
aacttggatttttga

SEQ ID NO: 3429808 - DNA, 21 bp, Homo sapiens
aacttggggagttaagacctg

SEQ ID NO: 3429809 - DNA, 15 bp, Homo sapiens
aacttgtctcttcat

SEQ ID NO: 3429810 - DNA, 13 bp, Homo sapiens
aactttaagagga

SEQ ID NO: 3429811 - DNA, 21 bp, Homo sapiens
aactttattaaatacaaaact

SEQ ID NO: 3429812 - DNA, 11 bp, Homo sapiens
aactttcattt

SEQ ID NO: 3429813 - DNA, 17 bp, Homo sapiens
aactttcatttttttcc

SEQ ID NO: 3429814 - DNA, 18 bp, Homo sapiens
aactttcctggatgtctg

SEQ ID NO: 3429815 - DNA, 20 bp, Homo sapiens
aactttgaggataacttttt

SEQ ID NO: 3429816 - DNA, 22 bp, Homo sapiens
aactttgaggataactttttaa

SEQ ID NO: 3429817 - DNA, 23 bp, Homo sapiens
aactttttaaaaaaataaaacag

SEQ ID NO: 3429818 - DNA, 22 bp, Homo sapiens
aactttttacattacagaatat

SEQ ID NO: 3429819 - DNA, 16 bp, Homo sapiens
aactttttattgcctt

SEQ ID NO: 3429820 - DNA, 21 bp, Homo sapiens
aactttttcttttccctcaat

SEQ ID NO: 3429821 - DNA, 11 bp, Homo sapiens
aagaaaaactt

SEQ ID NO: 3429822 - DNA, 12 bp, Homo sapiens
aagaaaaacttt

SEQ ID NO: 3429823 - DNA, 13 bp, Homo sapiens
aagaaaaagaaaa

SEQ ID NO: 3429824 - DNA, 18 bp, Homo sapiens
aagaaaaatgagcctggc

SEQ ID NO: 3429825 - DNA, 16 bp, Homo sapiens
aagaaaacatctattc

SEQ ID NO: 3429826 - DNA, 16 bp, Homo sapiens
aagaaaagagctttct

SEQ ID NO: 3429827 - DNA, 14 bp, Homo sapiens
aagaaaatattttg

SEQ ID NO: 3429828 - DNA, 22 bp, Homo sapiens
aagaaacacactgaggcaggga

SEQ ID NO: 3429829 - DNA, 14 bp, Homo sapiens
aagaaagacatctt

SEQ ID NO: 3429830 - DNA, 12 bp, Homo sapiens
aagaaagcaact

SEQ ID NO: 3429831 - DNA, 14 bp, Homo sapiens
aagaaagcaacttt

SEQ ID NO: 3429832 - DNA, 20 bp, Homo sapiens
aagaaagttgcacggctgct

SEQ ID NO: 3429833 - DNA, 21 bp, Homo sapiens
aagaacaaaaaaatctgcaga

SEQ ID NO: 3429834 - DNA, 19 bp, Homo sapiens
aagaacaagctcatctatt

SEQ ID NO: 3429835 - DNA, 16 bp, Homo sapiens
aagaacaccctctaaa

SEQ ID NO: 3429836 - DNA, 12 bp, Homo sapiens
aagaacataaag

SEQ ID NO: 3429837 - DNA, 14 bp, Homo sapiens
aagaacatgcagtt

SEQ ID NO: 3429838 - DNA, 11 bp, Homo sapiens
aagaacatgtg

SEQ ID NO: 3429839 - DNA, 17 bp, Homo sapiens
aagaaccagtcccccca

SEQ ID NO: 3429840 - DNA, 20 bp, Homo sapiens
aagaaccagtccccccaccc

SEQ ID NO: 3429841 - DNA, 14 bp, Homo sapiens
aagaacccctctgc

SEQ ID NO: 3429842 - DNA, 17 bp, Homo sapiens
aagaacccctctgcttt

SEQ ID NO: 3429843 - DNA, 18 bp, Homo sapiens
aagaacggggctcttctc

SEQ ID NO: 3429844 - DNA, 22 bp, Homo sapiens
aagaacggggctcttctcattt

SEQ ID NO: 3429845 - DNA, 23 bp, Homo sapiens
aagaactgcaggccctggcctcc

SEQ ID NO: 3429846 - DNA, 18 bp, Homo sapiens
aagaactttgagctactg

SEQ ID NO: 3429847 - DNA, 20 bp, Homo sapiens
aagaactttgagctactgcc

SEQ ID NO: 3429848 - DNA, 18 bp, Homo sapiens
aagaactttttcttttcc

SEQ ID NO: 3429849 - DNA, 19 bp, Homo sapiens
aagaactttttcttttccc

SEQ ID NO: 3429850 - DNA, 14 bp, Homo sapiens
aagaagagaaagaa

SEQ ID NO: 3429851 - DNA, 16 bp, Homo sapiens
aagaagcccccagcta

SEQ ID NO: 3429852 - DNA, 14 bp, Homo sapiens
aagaagctctctcc

SEQ ID NO: 3429853 - DNA, 22 bp, Homo sapiens
aagaaggaatataccttttttg

SEQ ID NO: 3429854 - DNA, 20 bp, Homo sapiens
aagaagggctgcatgatgtt

SEQ ID NO: 3429855 - DNA, 18 bp, Homo sapiens
aagaataaaatgttgaaa

SEQ ID NO: 3429856 - DNA, 21 bp, Homo sapiens
aagaataaaatgttgaaaagt

SEQ ID NO: 3429857 - DNA, 13 bp, Homo sapiens
aagaataatttat

SEQ ID NO: 3429858 - DNA, 12 bp, Homo sapiens
aagaatacttga

SEQ ID NO: 3429859 - DNA, 18 bp, Homo sapiens
aagaatccctagacttta

SEQ ID NO: 3429860 - DNA, 15 bp, Homo sapiens
aagaatggaaaagag

SEQ ID NO: 3429861 - DNA, 19 bp, Homo sapiens
aagaatgttactgccttaa

SEQ ID NO: 3429862 - DNA, 15 bp, Homo sapiens
aagaattagacatct

SEQ ID NO: 3429863 - DNA, 16 bp, Homo sapiens
aagacaaattctgttt

SEQ ID NO: 3429864 - DNA, 18 bp, Homo sapiens
aagacagagaaacagaca

SEQ ID NO: 3429865 - DNA, 20 bp, Homo sapiens
aagacagagaaacagacaga

SEQ ID NO: 3429866 - DNA, 14 bp, Homo sapiens
aagacatgatttcc

SEQ ID NO: 3429867 - DNA, 20 bp, Homo sapiens
aagacatgatttccttgaat

SEQ ID NO: 3429868 - DNA, 21 bp, Homo sapiens
aagacatgatttccttgaatg

SEQ ID NO: 3429869 - DNA, 18 bp, Homo sapiens
aagaccaccacttcgaaa

SEQ ID NO: 3429870 - DNA, 17 bp, Homo sapiens
aagacctcacctagaaa

SEQ ID NO: 3429871 - DNA, 23 bp, Homo sapiens
aagactggaagctaatttgcatt

SEQ ID NO: 3429872 - DNA, 20 bp, Homo sapiens
aagactgtgaacagcttgct

SEQ ID NO: 3429873 - DNA, 21 bp, Homo sapiens
aagactgtgaacagcttgctg

SEQ ID NO: 3429874 - DNA, 17 bp, Homo sapiens
aagacttaaaagagctc

SEQ ID NO: 3429875 - DNA, 22 bp, Homo sapiens
aagacttcagtatgttgtcaaa

SEQ ID NO: 3429876 - DNA, 12 bp, Homo sapiens
aagagaaaaaag

SEQ ID NO: 3429877 - DNA, 23 bp, Homo sapiens
aagagaaaaaggctgaaaagaag

SEQ ID NO: 3429878 - DNA, 14 bp, Homo sapiens
aagagaacatttta

SEQ ID NO: 3429879 - DNA, 15 bp, Homo sapiens
aagagaacattttac

SEQ ID NO: 3429880 - DNA, 16 bp, Homo sapiens
aagagaagacgaaata

SEQ ID NO: 3429881 - DNA, 20 bp, Homo sapiens
aagagaatattagctttact

SEQ ID NO: 3429882 - DNA, 12 bp, Homo sapiens
aagagaatattt

SEQ ID NO: 3429883 - DNA, 19 bp, Homo sapiens
aagagacactcagaccaga

SEQ ID NO: 3429884 - DNA, 16 bp, Homo sapiens
aagagagaaaaacaaa

SEQ ID NO: 3429885 - DNA, 22 bp, Homo sapiens
aagagatattttgggcatgtgg

SEQ ID NO: 3429886 - DNA, 22 bp, Homo sapiens
aagagcaggactccaggcccaa

SEQ ID NO: 3429887 - DNA, 14 bp, Homo sapiens
aagagcccagtctg

SEQ ID NO: 3429888 - DNA, 23 bp, Homo sapiens
aagagcccagtctgttgagttag

SEQ ID NO: 3429889 - DNA, 17 bp, Homo sapiens
aagagctcagacatttt

SEQ ID NO: 3429890 - DNA, 21 bp, Homo sapiens
aagagcttattacttatttgt

SEQ ID NO: 3429891 - DNA, 17 bp, Homo sapiens
aagaggaagttcagatc

SEQ ID NO: 3429892 - DNA, 22 bp, Homo sapiens
aagaggacataatggggtcctg

SEQ ID NO: 3429893 - DNA, 17 bp, Homo sapiens
aagaggcgttgctttca

SEQ ID NO: 3429894 - DNA, 20 bp, Homo sapiens
aagaggcgttgctttcactc

SEQ ID NO: 3429895 - DNA, 16 bp, Homo sapiens
aagagggacgcctggg

SEQ ID NO: 3429896 - DNA, 23 bp, Homo sapiens
aagagggttttaggtagaaaaac

SEQ ID NO: 3429897 - DNA, 13 bp, Homo sapiens
aagagtagaaact

SEQ ID NO: 3429898 - DNA, 19 bp, Homo sapiens
aagagtagttgatgttgca

SEQ ID NO: 3429899 - DNA, 23 bp, Homo sapiens
aagagtagttgatgttgcatttt

SEQ ID NO: 3429900 - DNA, 23 bp, Homo sapiens
aagagtgtcctaggagtatcctc

SEQ ID NO: 3429901 - DNA, 22 bp, Homo sapiens
aagagttgccccgtctctgttc

SEQ ID NO: 3429902 - DNA, 19 bp, Homo sapiens
aagataatattaaggaaga

SEQ ID NO: 3429903 - DNA, 18 bp, Homo sapiens
aagataatattttacata

SEQ ID NO: 3429904 - DNA, 20 bp, Homo sapiens
aagatacaaatggtggagga

SEQ ID NO: 3429905 - DNA, 20 bp, Homo sapiens
aagatataactattgcccag

SEQ ID NO: 3429906 - DNA, 15 bp, Homo sapiens
aagatataagtgctg

SEQ ID NO: 3429907 - DNA, 17 bp, Homo sapiens
aagatataagtgctgta

SEQ ID NO: 3429908 - DNA, 21 bp, Homo sapiens
aagatattatgtataaaatgt

SEQ ID NO: 3429909 - DNA, 22 bp, Homo sapiens
aagatcctaaaacaaaagctca

SEQ ID NO: 3429910 - DNA, 20 bp, Homo sapiens
aagatctgttttgaaggcaa

SEQ ID NO: 3429911 - DNA, 22 bp, Homo sapiens
aagatctgttttgaaggcaaaa

SEQ ID NO: 3429912 - DNA, 13 bp, Homo sapiens
aagatgacttccc

SEQ ID NO: 3429913 - DNA, 15 bp, Homo sapiens
aagatgccccaggga

SEQ ID NO: 3429914 - DNA, 16 bp, Homo sapiens
aagatgcctgatcaga

SEQ ID NO: 3429915 - DNA, 13 bp, Homo sapiens
aagatgccttgaa

SEQ ID NO: 3429916 - DNA, 18 bp, Homo sapiens
aagatgggggcagggctg

SEQ ID NO: 3429917 - DNA, 21 bp, Homo sapiens
aagatgggggcagggctgtgc

SEQ ID NO: 3429918 - DNA, 15 bp, Homo sapiens
aagatggggtctgta

SEQ ID NO: 3429919 - DNA, 17 bp, Homo sapiens
aagatggggtctgtaaa

SEQ ID NO: 3429920 - DNA, 16 bp, Homo sapiens
aagatggtacaacctt

SEQ ID NO: 3429921 - DNA, 20 bp, Homo sapiens
aagatggtgtgggtgtcctg

SEQ ID NO: 3429922 - DNA, 14 bp, Homo sapiens
aagatgtatatagg

SEQ ID NO: 3429923 - DNA, 18 bp, Homo sapiens
aagatgtctgtttgctga

SEQ ID NO: 3429924 - DNA, 20 bp, Homo sapiens
aagatgtctgtttgctgatg

SEQ ID NO: 3429925 - DNA, 16 bp, Homo sapiens
aagattgcttaaaata

SEQ ID NO: 3429926 - DNA, 18 bp, Homo sapiens
aagatttctaaataaaag

SEQ ID NO: 3429927 - DNA, 13 bp, Homo sapiens
aagatttcttgag

SEQ ID NO: 3429928 - DNA, 14 bp, Homo sapiens
aagcaaaatattat

SEQ ID NO: 3429929 - DNA, 23 bp, Homo sapiens
aagcaaaatcattttatatgtca

SEQ ID NO: 3429930 - DNA, 19 bp, Homo sapiens
aagcaaacccagacggctc

SEQ ID NO: 3429931 - DNA, 21 bp, Homo sapiens
aagcaaaggggacagctgtgt

SEQ ID NO: 3429932 - DNA, 15 bp, Homo sapiens
aagcaagggggtgat

SEQ ID NO: 3429933 - DNA, 18 bp, Homo sapiens
aaggccctgctgagtcat

SEQ ID NO: 3429934 - DNA, 17 bp, Homo sapiens
aaggccgagaagcaaga

SEQ ID NO: 3429935 - DNA, 16 bp, Homo sapiens
aaggccttgcctggcc

SEQ ID NO: 3429936 - DNA, 22 bp, Homo sapiens
aaggcggtggacttgaactttc

SEQ ID NO: 3429937 - DNA, 16 bp, Homo sapiens
aaggcgtggagctgcc

SEQ ID NO: 3429938 - DNA, 17 bp, Homo sapiens
aaggctcgattttgtat

SEQ ID NO: 3429939 - DNA, 19 bp, Homo sapiens
aaggctgaggaaaggccag

SEQ ID NO: 3429940 - DNA, 23 bp, Homo sapiens
aaggctgaggaaaggccagctgg

SEQ ID NO: 3429941 - DNA, 14 bp, Homo sapiens
aaggctgggggaag

SEQ ID NO: 3429942 - DNA, 16 bp, Homo sapiens
aaggctgtgctccctg

SEQ ID NO: 3429943 - DNA, 22 bp, Homo sapiens
aaggctgtgctccctggttctg

SEQ ID NO: 3429944 - DNA, 22 bp, Homo sapiens
aagggaaagcttcattctcctt

SEQ ID NO: 3429945 - DNA, 13 bp, Homo sapiens
aagggaaatatca

SEQ ID NO: 3429946 - DNA, 16 bp, Homo sapiens
aagggaaatatcattt

SEQ ID NO: 3429947 - DNA, 15 bp, Homo sapiens
aagggaacctgtgtc

SEQ ID NO: 3429948 - DNA, 12 bp, Homo sapiens
aagggaatcctc

SEQ ID NO: 3429949 - DNA, 13 bp, Homo sapiens
aagggacaggaga

SEQ ID NO: 3429950 - DNA, 24 bp, Homo sapiens
aagggagcactgggttgactttca

SEQ ID NO: 3429951 - DNA, 17 bp, Homo sapiens
aagggccagacagacct

SEQ ID NO: 3429952 - DNA, 12 bp, Homo sapiens
aagggccagagc

SEQ ID NO: 3429953 - DNA, 15 bp, Homo sapiens
aagggcccagagagg

SEQ ID NO: 3429954 - DNA, 23 bp, Homo sapiens
aagggctgaaccctcagccttga

SEQ ID NO: 3429955 - DNA, 13 bp, Homo sapiens
aagggctgcatga

SEQ ID NO: 3429956 - DNA, 17 bp, Homo sapiens
aagggctgcatgatgtt

SEQ ID NO: 3429957 - DNA, 17 bp, Homo sapiens
aagggctgccgggccag

SEQ ID NO: 3429958 - DNA, 18 bp, Homo sapiens
aagggctttgttttgcac

SEQ ID NO: 3429959 - DNA, 13 bp, Homo sapiens
aaggggaggaccc

SEQ ID NO: 3429960 - DNA, 22 bp, Homo sapiens
aaggggatggagtgagcccatg

SEQ ID NO: 3429961 - DNA, 13 bp, Homo sapiens
aaggggcttcagg

SEQ ID NO: 3429962 - DNA, 13 bp, Homo sapiens
aaggggcttctgg

SEQ ID NO: 3429963 - DNA, 16 bp, Homo sapiens
aaggtaaaattgaaag

SEQ ID NO: 3429964 - DNA, 18 bp, Homo sapiens
aaggtcctgaaagtaact

SEQ ID NO: 3429965 - DNA, 19 bp, Homo sapiens
aaggtctttcagtactttt

SEQ ID NO: 3429966 - DNA, 14 bp, Homo sapiens
aaggtgaaggaata

SEQ ID NO: 3429967 - DNA, 13 bp, Homo sapiens
aaggtgaggcctg

SEQ ID NO: 3429968 - DNA, 17 bp, Homo sapiens
aaggtgaggcctgtctg

SEQ ID NO: 3429969 - DNA, 18 bp, Homo sapiens
aaggtgaggcctgtctgt

SEQ ID NO: 3429970 - DNA, 19 bp, Homo sapiens
aaggtgaggcctgtctgtg

SEQ ID NO: 3429971 - DNA, 17 bp, Homo sapiens
aaggtgccatggaagag

SEQ ID NO: 3429972 - DNA, 12 bp, Homo sapiens
aaggtgcctgcc

SEQ ID NO: 3429973 - DNA, 18 bp, Homo sapiens
aaggtgcctgccatagcc

SEQ ID NO: 3429974 - DNA, 19 bp, Homo sapiens
aaggtgcctgccatagcca

SEQ ID NO: 3429975 - DNA, 19 bp, Homo sapiens
aaggtggatggccccagca

SEQ ID NO: 3429976 - DNA, 11 bp, Homo sapiens
aaggtgggagg

SEQ ID NO: 3429977 - DNA, 16 bp, Homo sapiens
aaggtggggacaggga

SEQ ID NO: 3429978 - DNA, 22 bp, Homo sapiens
aaggtgttcattcacttgcatt

SEQ ID NO: 3429979 - DNA, 13 bp, Homo sapiens
aaggttatgtaga

SEQ ID NO: 3429980 - DNA, 16 bp, Homo sapiens
aaggttccattcagtg

SEQ ID NO: 3429981 - DNA, 21 bp, Homo sapiens
aaggttctctcctccccaagg

SEQ ID NO: 3429982 - DNA, 14 bp, Homo sapiens
aaggttggatggat

SEQ ID NO: 3429983 - DNA, 20 bp, Homo sapiens
aaggttttataaggctgatg

SEQ ID NO: 3429984 - DNA, 11 bp, Homo sapiens
aagtaagaaaa

SEQ ID NO: 3429985 - DNA, 18 bp, Homo sapiens
aagtaagaaatttctagt

SEQ ID NO: 3429986 - DNA, 16 bp, Homo sapiens
aagtaatcctagggaa

SEQ ID NO: 3429987 - DNA, 21 bp, Homo sapiens
aagtacctttcctacattttc

SEQ ID NO: 3429988 - DNA, 23 bp, Homo sapiens
aagtactgtaagaataatttata

SEQ ID NO: 3429989 - DNA, 22 bp, Homo sapiens
aagtacttctccaccctgctct

SEQ ID NO: 3429990 - DNA, 18 bp, Homo sapiens
aagtagacagttttgaga

SEQ ID NO: 3429991 - DNA, 21 bp, Homo sapiens
aagtagagccctttgagaata

SEQ ID NO: 3429992 - DNA, 18 bp, Homo sapiens
aagtagctgctaccttct

SEQ ID NO: 3429993 - DNA, 15 bp, Homo sapiens
aagtataaaatacaa

SEQ ID NO: 3429994 - DNA, 18 bp, Homo sapiens
aagtatactgtattttta

SEQ ID NO: 3429995 - DNA, 13 bp, Homo sapiens
aagtatagaaata

SEQ ID NO: 3429996 - DNA, 19 bp, Homo sapiens
aagtatagaaatatattta

SEQ ID NO: 3429997 - DNA, 17 bp, Homo sapiens
aagtattatcattgctc

SEQ ID NO: 3429998 - DNA, 23 bp, Homo sapiens
aagtattatcattgctcccctga

SEQ ID NO: 3429999 - DNA, 23 bp, Homo sapiens
aagtatttaattagtgctaagtg

SEQ ID NO: 3430000 - DNA, 21 bp, Homo sapiens
aagtatttcaaattggagctt

SEQ ID NO: 3430001 - DNA, 20 bp, Homo sapiens
aagtcaccattctgcattta

SEQ ID NO: 3430002 - DNA, 22 bp, Homo sapiens
aagtcaccctagccctctccct

SEQ ID NO: 3430003 - DNA, 23 bp, Homo sapiens
aagtcaccctagccctctccctc

SEQ ID NO: 3430004 - DNA, 20 bp, Homo sapiens
aagtcagtgcccaactgtta

SEQ ID NO: 3430005 - DNA, 19 bp, Homo sapiens
aagtcatgcaaaggctggg

SEQ ID NO: 3430006 - DNA, 20 bp, Homo sapiens
aagtcatgcaaaggctggga

SEQ ID NO: 3430007 - DNA, 20 bp, Homo sapiens
aagtcattggctttatcctc

SEQ ID NO: 3430008 - DNA, 20 bp, Homo sapiens
aagtccaagcaacagccttt

SEQ ID NO: 3430009 - DNA, 12 bp, Homo sapiens
aagtccaatgtg

SEQ ID NO: 3430010 - DNA, 19 bp, Homo sapiens
aagtccaattttaatttag

SEQ ID NO: 3430011 - DNA, 14 bp, Homo sapiens
aagtccccaggccc

SEQ ID NO: 3430012 - DNA, 22 bp, Homo sapiens
aagtccccaggccccaggaagc

SEQ ID NO: 3430013 - DNA, 23 bp, Homo sapiens
aagtccccaggccccaggaagcc

SEQ ID NO: 3430014 - DNA, 18 bp, Homo sapiens
aagtcctcttttctgaga

SEQ ID NO: 3430015 - DNA, 17 bp, Homo sapiens
aagtccttttgtaaagt

SEQ ID NO: 3430016 - DNA, 15 bp, Homo sapiens
aagtctctgctggcc

SEQ ID NO: 3430017 - DNA, 21 bp, Homo sapiens
aagtctctgctggcccagcca

SEQ ID NO: 3430018 - DNA, 17 bp, Homo sapiens
aagtctgtatggcatga

SEQ ID NO: 3430019 - DNA, 16 bp, Homo sapiens
aagtcttatcaagcag

SEQ ID NO: 3430020 - DNA, 18 bp, Homo sapiens
aagtcttttgttcgcatg

SEQ ID NO: 3430021 - DNA, 23 bp, Homo sapiens
aagtgaagaatccttttgtagaa

SEQ ID NO: 3430022 - DNA, 16 bp, Homo sapiens
aagtgaagactggaag

SEQ ID NO: 3430023 - DNA, 22 bp, Homo sapiens
aagtgaaggtttacaatttaca

SEQ ID NO: 3430024 - DNA, 14 bp, Homo sapiens
aagtgaatttttct

SEQ ID NO: 3430025 - DNA, 13 bp, Homo sapiens
aagtgatcctccc

SEQ ID NO: 3430026 - DNA, 19 bp, Homo sapiens
aagtgatcctcccacctca

SEQ ID NO: 3430027 - DNA, 23 bp, Homo sapiens
aagtgatcctcccacctcagcct

SEQ ID NO: 3430028 - DNA, 13 bp, Homo sapiens
aagtgatgctgtg

SEQ ID NO: 3430029 - DNA, 18 bp, Homo sapiens
aagtgattctcctgcctc

SEQ ID NO: 3430030 - DNA, 19 bp, Homo sapiens
aagtgattctcctgcctca

SEQ ID NO: 3430031 - DNA, 18 bp, Homo sapiens
aagtgattgggacagagg

SEQ ID NO: 3430032 - DNA, 13 bp, Homo sapiens
aagtgccatctca

SEQ ID NO: 3430033 - DNA, 15 bp, Homo sapiens
aagtgccgcaaattg

SEQ ID NO: 3430034 - DNA, 16 bp, Homo sapiens
aagtgccgcaaattgt

SEQ ID NO: 3430035 - DNA, 19 bp, Homo sapiens
aagtgccgcaaattgtacc

SEQ ID NO: 3430036 - DNA, 23 bp, Homo sapiens
aagtgcggcactgcaaagagacg

SEQ ID NO: 3430037 - DNA, 12 bp, Homo sapiens
aagtgctcaggg

SEQ ID NO: 3430038 - DNA, 21 bp, Homo sapiens
aagtgctcagggaaatggcct

SEQ ID NO: 3430039 - DNA, 22 bp, Homo sapiens
aagtgctgggattacaggtgtg

SEQ ID NO: 3430040 - DNA, 16 bp, Homo sapiens
aagtgctgtataaaat

SEQ ID NO: 3430041 - DNA, 21 bp, Homo sapiens
aagtggaaaaatagcctgcct

SEQ ID NO: 3430042 - DNA, 14 bp, Homo sapiens
aagtggcctctttg

SEQ ID NO: 3430043 - DNA, 12 bp, Homo sapiens
aagtgggcttga

SEQ ID NO: 3430044 - DNA, 16 bp, Homo sapiens
aagtgggcttgattct

SEQ ID NO: 3430045 - DNA, 22 bp, Homo sapiens
aagtgggcttgattctgcagta

SEQ ID NO: 3430046 - DNA, 21 bp, Homo sapiens
aagtggtagtaatttccttta

SEQ ID NO: 3430047 - DNA, 19 bp, Homo sapiens
aagtggtgcttagaaaatt

SEQ ID NO: 3430048 - DNA, 17 bp, Homo sapiens
aagtggtggtaaccctg

SEQ ID NO: 3430049 - DNA, 17 bp, Homo sapiens
aagtgtaaacaccatag

SEQ ID NO: 3430050 - DNA, 20 bp, Homo sapiens
aagtgtaggcagacacaggg

SEQ ID NO: 3430051 - DNA, 21 bp, Homo sapiens
aagtgtaggcagacacaggga

SEQ ID NO: 3430052 - DNA, 15 bp, Homo sapiens
aagtgtatttttcaa

SEQ ID NO: 3430053 - DNA, 17 bp, Homo sapiens
aagtgtcttttgacatt

SEQ ID NO: 3430054 - DNA, 15 bp, Homo sapiens
aagtgtttagctgtc

SEQ ID NO: 3430055 - DNA, 18 bp, Homo sapiens
aagtgttttgtaccagtg

SEQ ID NO: 3430056 - DNA, 21 bp, Homo sapiens
aagttacacagaaatgctgct

SEQ ID NO: 3430057 - DNA, 12 bp, Homo sapiens
aagttatatttc

SEQ ID NO: 3430058 - DNA, 17 bp, Homo sapiens
aagttattagtggttta

SEQ ID NO: 3430059 - DNA, 22 bp, Homo sapiens
aagttcacagtgtttcttattc

SEQ ID NO: 3430060 - DNA, 21 bp, Homo sapiens
aagttctattggaaaaaccac

SEQ ID NO: 3430061 - DNA, 19 bp, Homo sapiens
aagttctgctttctcccca

SEQ ID NO: 3430062 - DNA, 23 bp, Homo sapiens
aagttgaattgaggggattaata

SEQ ID NO: 3430063 - DNA, 19 bp, Homo sapiens
aagttgagaaggtgcctgc

SEQ ID NO: 3430064 - DNA, 22 bp, Homo sapiens
aatatgtgaagcccagcatctc

SEQ ID NO: 3430065 - DNA, 18 bp, Homo sapiens
aatattagctttactgtt

SEQ ID NO: 3430066 - DNA, 21 bp, Homo sapiens
aatattagctttactgtttgt

SEQ ID NO: 3430067 - DNA, 18 bp, Homo sapiens
aatattatgagatgctgg

SEQ ID NO: 3430068 - DNA, 17 bp, Homo sapiens
aatattccctagaaact

SEQ ID NO: 3430069 - DNA, 16 bp, Homo sapiens
aatattgaagaatttg

SEQ ID NO: 3430070 - DNA, 18 bp, Homo sapiens
aatattgacaagtgtctt

SEQ ID NO: 3430071 - DNA, 13 bp, Homo sapiens
aatattgtccatt

SEQ ID NO: 3430072 - DNA, 14 bp, Homo sapiens
aatatttaaaaatg

SEQ ID NO: 3430073 - DNA, 18 bp, Homo sapiens
aatatttaacctcttttt

SEQ ID NO: 3430074 - DNA, 16 bp, Homo sapiens
aatatttataaaactt

SEQ ID NO: 3430075 - DNA, 12 bp, Homo sapiens
aatatttattac

SEQ ID NO: 3430076 - DNA, 13 bp, Homo sapiens
aatatttattacc

SEQ ID NO: 3430077 - DNA, 20 bp, Homo sapiens
aatatttattattttcacct

SEQ ID NO: 3430078 - DNA, 14 bp, Homo sapiens
aatatttattcatt

SEQ ID NO: 3430079 - DNA, 20 bp, Homo sapiens
aatatttattcattatttgt

SEQ ID NO: 3430080 - DNA, 12 bp, Homo sapiens
aatatttctatt

SEQ ID NO: 3430081 - DNA, 14 bp, Homo sapiens
aatatttgaatctt

SEQ ID NO: 3430082 - DNA, 20 bp, Homo sapiens
aatatttgaatcttgtctca

SEQ ID NO: 3430083 - DNA, 17 bp, Homo sapiens
aatattttaagtattgc

SEQ ID NO: 3430084 - DNA, 18 bp, Homo sapiens
aatattttaagtattgca

SEQ ID NO: 3430085 - DNA, 15 bp, Homo sapiens
aatattttacataca

SEQ ID NO: 3430086 - DNA, 19 bp, Homo sapiens
aatattttctctgtacttt

SEQ ID NO: 3430087 - DNA, 23 bp, Homo sapiens
aatattttctctgtacttttcat

SEQ ID NO: 3430088 - DNA, 10 bp, Homo sapiens
aatattttgg

SEQ ID NO: 3430089 - DNA, 15 bp, Homo sapiens
aatattttgtctaaa

SEQ ID NO: 3430090 - DNA, 20 bp, Homo sapiens
aatattttgtctaaaatgcc

SEQ ID NO: 3430091 - DNA, 18 bp, Homo sapiens
aatcaactttttattgcc

SEQ ID NO: 3430092 - DNA, 19 bp, Homo sapiens
aatcaactttttattgcct

SEQ ID NO: 3430093 - DNA, 20 bp, Homo sapiens
aatcaactttttattgcctt

SEQ ID NO: 3430094 - DNA, 21 bp, Homo sapiens
aatcaactttttattgccttc

SEQ ID NO: 3430095 - DNA, 17 bp, Homo sapiens
aatcaagtctgtttact

SEQ ID NO: 3430096 - DNA, 23 bp, Homo sapiens
aatcaagttttaagtgaaagtga

SEQ ID NO: 3430097 - DNA, 18 bp, Homo sapiens
aatcaataaaaaacaaat

SEQ ID NO: 3430098 - DNA, 19 bp, Homo sapiens
aatcaatagtgcaactgtt

SEQ ID NO: 3430099 - DNA, 18 bp, Homo sapiens
aatcaccacaaactgtaa

SEQ ID NO: 3430100 - DNA, 11 bp, Homo sapiens
aatcactgcca

SEQ ID NO: 3430101 - DNA, 21 bp, Homo sapiens
aatcagccaattatgttaaac

SEQ ID NO: 3430102 - DNA, 11 bp, Homo sapiens
aatcagcctgc

SEQ ID NO: 3430103 - DNA, 23 bp, Homo sapiens
aatcagctatttactgccaaagg

SEQ ID NO: 3430104 - DNA, 20 bp, Homo sapiens
aatcagctccttcctggaga

SEQ ID NO: 3430105 - DNA, 23 bp, Homo sapiens
aatcagttgtttaataatttaca

SEQ ID NO: 3430106 - DNA, 18 bp, Homo sapiens
aatcatcaagaagggctg

SEQ ID NO: 3430107 - DNA, 16 bp, Homo sapiens
aatcatgaaatatgca

SEQ ID NO: 3430108 - DNA, 17 bp, Homo sapiens
aatcatgagcctgctgg

SEQ ID NO: 3430109 - DNA, 12 bp, Homo sapiens
aatcatgttctg

SEQ ID NO: 3430110 - DNA, 20 bp, Homo sapiens
aatcatttctatttctcctc

SEQ ID NO: 3430111 - DNA, 13 bp, Homo sapiens
aatcattttcatt

SEQ ID NO: 3430112 - DNA, 17 bp, Homo sapiens
aatcattttcattccta

SEQ ID NO: 3430113 - DNA, 14 bp, Homo sapiens
aatccaaacttgga

SEQ ID NO: 3430114 - DNA, 10 bp, Homo sapiens
aatccaaaga

SEQ ID NO: 3430115 - DNA, 11 bp, Homo sapiens
aatccaaagat

SEQ ID NO: 3430116 - DNA, 22 bp, Homo sapiens
aatccaagatattttaaaatct

SEQ ID NO: 3430117 - DNA, 18 bp, Homo sapiens
aatccactcccaggcagc

SEQ ID NO: 3430118 - DNA, 18 bp, Homo sapiens
aatccaggcagatccagg

SEQ ID NO: 3430119 - DNA, 19 bp, Homo sapiens
aatccctttattaccccct

SEQ ID NO: 3430120 - DNA, 23 bp, Homo sapiens
aatccctttattaccccctcctt

SEQ ID NO: 3430121 - DNA, 12 bp, Homo sapiens
aatccgaacctc

SEQ ID NO: 3430122 - DNA, 19 bp, Homo sapiens
aatccgaacctcctctgtg

SEQ ID NO: 3430123 - DNA, 21 bp, Homo sapiens
aatccgaccactaattgccaa

SEQ ID NO: 3430124 - DNA, 15 bp, Homo sapiens
aatcctaaaagaagc

SEQ ID NO: 3430125 - DNA, 13 bp, Homo sapiens
aatcctcctccag

SEQ ID NO: 3430126 - DNA, 20 bp, Homo sapiens
aatcctctcacctcagcctc

SEQ ID NO: 3430127 - DNA, 17 bp, Homo sapiens
aatcctctgtaaaaaga

SEQ ID NO: 3430128 - DNA, 22 bp, Homo sapiens
aatcgggataaaacagcattag

SEQ ID NO: 3430129 - DNA, 17 bp, Homo sapiens
aatctacccaaaggata

SEQ ID NO: 3430130 - DNA, 21 bp, Homo sapiens
aatctagaggaaaagaaagaa

SEQ ID NO: 3430131 - DNA, 22 bp, Homo sapiens
aatctagatatcgacttgtttt

SEQ ID NO: 3430132 - DNA, 11 bp, Homo sapiens
aatctatttaa

SEQ ID NO: 3430133 - DNA, 19 bp, Homo sapiens
aatctcaatgaagccagct

SEQ ID NO: 3430134 - DNA, 19 bp, Homo sapiens
aatctcattactgcttcat

SEQ ID NO: 3430135 - DNA, 23 bp, Homo sapiens
aatctcattactgcttcattttt

SEQ ID NO: 3430136 - DNA, 14 bp, Homo sapiens
aatctctgtaggaa

SEQ ID NO: 3430137 - DNA, 13 bp, Homo sapiens
aatctctgtgcct

SEQ ID NO: 3430138 - DNA, 20 bp, Homo sapiens
aatctctttttgctttcgaa

SEQ ID NO: 3430139 - DNA, 23 bp, Homo sapiens
aatctgacactaccttatcaggc

SEQ ID NO: 3430140 - DNA, 12 bp, Homo sapiens
aatctgacccag

SEQ ID NO: 3430141 - DNA, 19 bp, Homo sapiens
aatctgaggcatcctctga

SEQ ID NO: 3430142 - DNA, 17 bp, Homo sapiens
aatctgaggcctcctct

SEQ ID NO: 3430143 - DNA, 12 bp, Homo sapiens
aatctgcctggg

SEQ ID NO: 3430144 - DNA, 14 bp, Homo sapiens
aatctgctcacttt

SEQ ID NO: 3430145 - DNA, 20 bp, Homo sapiens
aatctgctcactttaaacct

SEQ ID NO: 3430146 - DNA, 15 bp, Homo sapiens
aatctggaagaaaaa

SEQ ID NO: 3430147 - DNA, 21 bp, Homo sapiens
aatctggcttctggccaggaa

SEQ ID NO: 3430148 - DNA, 23 bp, Homo sapiens
aatctggcttctggccaggaagc

SEQ ID NO: 3430149 - DNA, 14 bp, Homo sapiens
aatcttataattta

SEQ ID NO: 3430150 - DNA, 21 bp, Homo sapiens
aatcttatcatggtctcagtc

SEQ ID NO: 3430151 - DNA, 17 bp, Homo sapiens
aatcttgaaattaagaa

SEQ ID NO: 3430152 - DNA, 16 bp, Homo sapiens
aatcttgctttcttta

SEQ ID NO: 3430153 - DNA, 21 bp, Homo sapiens
aatcttgtctcaatgctcata

SEQ ID NO: 3430154 - DNA, 21 bp, Homo sapiens
aatcttgttattgaagtgttc

SEQ ID NO: 3430155 - DNA, 17 bp, Homo sapiens
aatctttaaaagatgct

SEQ ID NO: 3430156 - DNA, 18 bp, Homo sapiens
aatctttctttcttagaa

SEQ ID NO: 3430157 - DNA, 20 bp, Homo sapiens
aatctttctttcttagaaat

SEQ ID NO: 3430158 - DNA, 12 bp, Homo sapiens
aatcttttacaa

SEQ ID NO: 3430159 - DNA, 23 bp, Homo sapiens
aatcttttacaactgcctcgaaa

SEQ ID NO: 3430160 - DNA, 15 bp, Homo sapiens
aatgaaaatgtcttg

SEQ ID NO: 3430161 - DNA, 15 bp, Homo sapiens
aatgaaatgtatgtg

SEQ ID NO: 3430162 - DNA, 16 bp, Homo sapiens
aatgaaatgtatgtgc

SEQ ID NO: 3430163 - DNA, 17 bp, Homo sapiens
aatgaacccctggctcc

SEQ ID NO: 3430164 - DNA, 16 bp, Homo sapiens
aatgaagagccagccc

SEQ ID NO: 3430165 - DNA, 17 bp, Homo sapiens
aatgaagttgtaggtaa

SEQ ID NO: 3430166 - DNA, 19 bp, Homo sapiens
aatgaagtttgaatgttaa

SEQ ID NO: 3430167 - DNA, 20 bp, Homo sapiens
aatgaagtttgaatgttaaa

SEQ ID NO: 3430168 - DNA, 20 bp, Homo sapiens
aatgaatcgtaatgaagttg

SEQ ID NO: 3430169 - DNA, 16 bp, Homo sapiens
aatgaattcctagaat

SEQ ID NO: 3430170 - DNA, 14 bp, Homo sapiens
aatgaattctaaac

SEQ ID NO: 3430171 - DNA, 19 bp, Homo sapiens
aatgacactgtttcctgat

SEQ ID NO: 3430172 - DNA, 22 bp, Homo sapiens
aatgaccaacctgtttctacct

SEQ ID NO: 3430173 - DNA, 17 bp, Homo sapiens
aatgactaaaaaacaaa

SEQ ID NO: 3430174 - DNA, 20 bp, Homo sapiens
aatgactcaggacatccccc

SEQ ID NO: 3430175 - DNA, 16 bp, Homo sapiens
aatgagaatgtgccat

SEQ ID NO: 3430176 - DNA, 17 bp, Homo sapiens
aatgagagcgacacaga

SEQ ID NO: 3430177 - DNA, 22 bp, Homo sapiens
aatgagagcgacacagacgtta

SEQ ID NO: 3430178 - DNA, 11 bp, Homo sapiens
aatgagcctgg

SEQ ID NO: 3430179 - DNA, 21 bp, Homo sapiens
aatgagtttaaaaatcaactt

SEQ ID NO: 3430180 - DNA, 15 bp, Homo sapiens
aatgatagctactgt

SEQ ID NO: 3430181 - DNA, 21 bp, Homo sapiens
aatgatgatcctaggcatttg

SEQ ID NO: 3430182 - DNA, 14 bp, Homo sapiens
aatgattcagtgtt

SEQ ID NO: 3430183 - DNA, 21 bp, Homo sapiens
aatgattcagtgttaaatgtg

SEQ ID NO: 3430184 - DNA, 13 bp, Homo sapiens
aatgcaaagaatc

SEQ ID NO: 3430185 - DNA, 18 bp, Homo sapiens
aatgcaagagaacatttt

SEQ ID NO: 3430186 - DNA, 22 bp, Homo sapiens
aatgcaatagaagtgctcccct

SEQ ID NO: 3430187 - DNA, 23 bp, Homo sapiens
aatgcaatagaagtgctcccctc

SEQ ID NO: 3430188 - DNA, 15 bp, Homo sapiens
aatgcagtatatttc

SEQ ID NO: 3430189 - DNA, 16 bp, Homo sapiens
aatgcagtatggtaca

SEQ ID NO: 3430190 - DNA, 21 bp, Homo sapiens
aatgcatcatcatagaaaaac

SEQ ID NO: 3430191 - DNA, 18 bp, Homo sapiens
aatgcatgttaggaaaat

SEQ ID NO: 3430192 - DNA, 21 bp, Homo sapiens
aatgcattgtatcgatgttat

SEQ ID NO: 3430193 - DNA, 22 bp, Homo sapiens
aatgcattgtatcgatgttatg

SEQ ID NO: 3430194 - DNA, 18 bp, Homo sapiens
aatgcatttatagatcat

SEQ ID NO: 3430195 - DNA, 21 bp, Homo sapiens
aatgcatttatagatcatttc

SEQ ID NO: 3430196 - DNA, 17 bp, Homo sapiens
aattgccatattgcaca

SEQ ID NO: 3430197 - DNA, 19 bp, Homo sapiens
aattgccatattgcacatg

SEQ ID NO: 3430198 - DNA, 22 bp, Homo sapiens
aattgcctatcctgctgttcta

SEQ ID NO: 3430199 - DNA, 23 bp, Homo sapiens
aattgctcttggctgtgaaaaga

SEQ ID NO: 3430200 - DNA, 10 bp, Homo sapiens
aattgctttg

SEQ ID NO: 3430201 - DNA, 12 bp, Homo sapiens
aattgtatattc

SEQ ID NO: 3430202 - DNA, 13 bp, Homo sapiens
aattgtatattca

SEQ ID NO: 3430203 - DNA, 14 bp, Homo sapiens
aattgtatattcac

SEQ ID NO: 3430204 - DNA, 20 bp, Homo sapiens
aattgtctagggtgttctgt

SEQ ID NO: 3430205 - DNA, 20 bp, Homo sapiens
aattgtgccgagaaaagcat

SEQ ID NO: 3430206 - DNA, 13 bp, Homo sapiens
aattgtgctttgt

SEQ ID NO: 3430207 - DNA, 14 bp, Homo sapiens
aattgttgacaaat

SEQ ID NO: 3430208 - DNA, 17 bp, Homo sapiens
aatttaacttcttcata

SEQ ID NO: 3430209 - DNA, 17 bp, Homo sapiens
aatttaataacttttta

SEQ ID NO: 3430210 - DNA, 14 bp, Homo sapiens
aatttaatgcatgt

SEQ ID NO: 3430211 - DNA, 15 bp, Homo sapiens
aatttacaaagtgtg

SEQ ID NO: 3430212 - DNA, 19 bp, Homo sapiens
aatttactggacaaagaat

SEQ ID NO: 3430213 - DNA, 21 bp, Homo sapiens
aatttagaaactaattgactt

SEQ ID NO: 3430214 - DNA, 15 bp, Homo sapiens
aatttagatattttc

SEQ ID NO: 3430215 - DNA, 18 bp, Homo sapiens
aatttagatattttccat

SEQ ID NO: 3430216 - DNA, 18 bp, Homo sapiens
aatttaggtttttattag

SEQ ID NO: 3430217 - DNA, 14 bp, Homo sapiens
aatttagtaaatgt

SEQ ID NO: 3430218 - DNA, 15 bp, Homo sapiens
aatttagtaaatgtt

SEQ ID NO: 3430219 - DNA, 19 bp, Homo sapiens
aatttatcttgtctctggg

SEQ ID NO: 3430220 - DNA, 18 bp, Homo sapiens
aatttattaattgctttg

SEQ ID NO: 3430221 - DNA, 19 bp, Homo sapiens
aatttattaattgctttga

SEQ ID NO: 3430222 - DNA, 16 bp, Homo sapiens
aatttattttataaga

SEQ ID NO: 3430223 - DNA, 17 bp, Homo sapiens
aatttattttataagaa

SEQ ID NO: 3430224 - DNA, 12 bp, Homo sapiens
aatttcaaaatg

SEQ ID NO: 3430225 - DNA, 23 bp, Homo sapiens
aatttcagactcccattcctgaa

SEQ ID NO: 3430226 - DNA, 19 bp, Homo sapiens
aatttcaggctccccagat

SEQ ID NO: 3430227 - DNA, 12 bp, Homo sapiens
aatttcccagga

SEQ ID NO: 3430228 - DNA, 14 bp, Homo sapiens
aatttcccaggacc

SEQ ID NO: 3430229 - DNA, 20 bp, Homo sapiens
aatttcctttattattctgt

SEQ ID NO: 3430230 - DNA, 11 bp, Homo sapiens
aatttctacta

SEQ ID NO: 3430231 - DNA, 12 bp, Homo sapiens
aatttctgtgcc

SEQ ID NO: 3430232 - DNA, 21 bp, Homo sapiens
aatttctgtgttgccaagctc

SEQ ID NO: 3430233 - DNA, 22 bp, Homo sapiens
aatttctttttttcctttttaa

SEQ ID NO: 3430234 - DNA, 13 bp, Homo sapiens
aatttgagtgctc

SEQ ID NO: 3430235 - DNA, 17 bp, Homo sapiens
aatttgataatgacact

SEQ ID NO: 3430236 - DNA, 13 bp, Homo sapiens
aatttgattgatt

SEQ ID NO: 3430237 - DNA, 11 bp, Homo sapiens
aatttgcaaag

SEQ ID NO: 3430238 - DNA, 15 bp, Homo sapiens
aatttgcaaagtact

SEQ ID NO: 3430239 - DNA, 18 bp, Homo sapiens
aatttgcaaagtactgta

SEQ ID NO: 3430240 - DNA, 17 bp, Homo sapiens
aatttgcaccagtttta

SEQ ID NO: 3430241 - DNA, 23 bp, Homo sapiens
aatttgcaccagttttatccata

SEQ ID NO: 3430242 - DNA, 17 bp, Homo sapiens
aatttgcattaaattca

SEQ ID NO: 3430243 - DNA, 18 bp, Homo sapiens
aatttgcattaaattcac

SEQ ID NO: 3430244 - DNA, 23 bp, Homo sapiens
aatttgctggaacacaaagacca

SEQ ID NO: 3430245 - DNA, 22 bp, Homo sapiens
aatttggttctaatagaactca

SEQ ID NO: 3430246 - DNA, 22 bp, Homo sapiens
aatttgtaaagttggttggata

SEQ ID NO: 3430247 - DNA, 12 bp, Homo sapiens
aattttaattta

SEQ ID NO: 3430248 - DNA, 15 bp, Homo sapiens
aattttactttttat

SEQ ID NO: 3430249 - DNA, 20 bp, Homo sapiens
aattttactttttatttcta

SEQ ID NO: 3430250 - DNA, 19 bp, Homo sapiens
aattttagtaatttcctag

SEQ ID NO: 3430251 - DNA, 15 bp, Homo sapiens
aattttataaacaaa

SEQ ID NO: 3430252 - DNA, 18 bp, Homo sapiens
aattttcaaggccttcag

SEQ ID NO: 3430253 - DNA, 21 bp, Homo sapiens
aattttcaaggccttcagttt

SEQ ID NO: 3430254 - DNA, 19 bp, Homo sapiens
aattttctgtggatcattt

SEQ ID NO: 3430255 - DNA, 22 bp, Homo sapiens
aattttgctggaattcctaact

SEQ ID NO: 3430256 - DNA, 22 bp, Homo sapiens
aattttggggattttcaaaaga

SEQ ID NO: 3430257 - DNA, 20 bp, Homo sapiens
aattttgttctagttttcag

SEQ ID NO: 3430258 - DNA, 15 bp, Homo sapiens
aattttgttctctgg

SEQ ID NO: 3430259 - DNA, 17 bp, Homo sapiens
aattttgttctctggga

SEQ ID NO: 3430260 - DNA, 18 bp, Homo sapiens
aattttgttctctgggag

SEQ ID NO: 3430261 - DNA, 19 bp, Homo sapiens
aattttgttctctgggaga

SEQ ID NO: 3430262 - DNA, 18 bp, Homo sapiens
aatttttattttcaccct

SEQ ID NO: 3430263 - DNA, 15 bp, Homo sapiens
aatttttgcaataat

SEQ ID NO: 3430264 - DNA, 17 bp, Homo sapiens
aatttttgcaataatgc

SEQ ID NO: 3430265 - DNA, 18 bp, Homo sapiens
aatttttgcaataatgca

SEQ ID NO: 3430266 - DNA, 19 bp, Homo sapiens
aatttttgcaataatgcag

SEQ ID NO: 3430267 - DNA, 21 bp, Homo sapiens
aatttttgcaataatgcagta

SEQ ID NO: 3430268 - DNA, 14 bp, Homo sapiens
aatttttgtaaatc

SEQ ID NO: 3430269 - DNA, 12 bp, Homo sapiens
aatttttgtatt

SEQ ID NO: 3430270 - DNA, 20 bp, Homo sapiens
aatttttttaaccaaaggtg

SEQ ID NO: 3430271 - DNA, 20 bp, Homo sapiens
aatttttttagaaagcattt

SEQ ID NO: 3430272 - DNA, 21 bp, Homo sapiens
aatttttttcatcttctctgg

SEQ ID NO: 3430273 - DNA, 17 bp, Homo sapiens
aatttttttgagacaga

SEQ ID NO: 3430274 - DNA, 19 bp, Homo sapiens
aattttttttaatgcttaa

SEQ ID NO: 3430275 - DNA, 11 bp, Homo sapiens
acaaaaaagtg

SEQ ID NO: 3430276 - DNA, 14 bp, Homo sapiens
acaaaaaatgtttt

SEQ ID NO: 3430277 - DNA, 16 bp, Homo sapiens
acaaaaagaacaaaaa

SEQ ID NO: 3430278 - DNA, 23 bp, Homo sapiens
acaaaaagtgcttcattctttgc

SEQ ID NO: 3430279 - DNA, 14 bp, Homo sapiens
acaaaaattaggta

SEQ ID NO: 3430280 - DNA, 13 bp, Homo sapiens
acaaaaccagctg

SEQ ID NO: 3430281 - DNA, 14 bp, Homo sapiens
acaaaaccagctgc

SEQ ID NO: 3430282 - DNA, 21 bp, Homo sapiens
acaaaaccagctgctactcat

SEQ ID NO: 3430283 - DNA, 22 bp, Homo sapiens
acaaaatggatacataaagact

SEQ ID NO: 3430284 - DNA, 16 bp, Homo sapiens
acaaaatgtagaatat

SEQ ID NO: 3430285 - DNA, 19 bp, Homo sapiens
acaaaatgtagaatattca

SEQ ID NO: 3430286 - DNA, 21 bp, Homo sapiens
acaaaatgtagaatattcaga

SEQ ID NO: 3430287 - DNA, 13 bp, Homo sapiens
acaaaatttgact

SEQ ID NO: 3430288 - DNA, 16 bp, Homo sapiens
acaaacaaaatttcta

SEQ ID NO: 3430289 - DNA, 14 bp, Homo sapiens
acaaaccacagcag

SEQ ID NO: 3430290 - DNA, 15 bp, Homo sapiens
acaaacgggctcagc

SEQ ID NO: 3430291 - DNA, 20 bp, Homo sapiens
acaaactcttcagttaattc

SEQ ID NO: 3430292 - DNA, 22 bp, Homo sapiens
acaaagacaaattctgtttctt

SEQ ID NO: 3430293 - DNA, 17 bp, Homo sapiens
acaaagaccaaaatgaa

SEQ ID NO: 3430294 - DNA, 13 bp, Homo sapiens
acaaagctcaaga

SEQ ID NO: 3430295 - DNA, 22 bp, Homo sapiens
acaaagctcaagatgacagctc

SEQ ID NO: 3430296 - DNA, 18 bp, Homo sapiens
acaaaggcaaagggtcca

SEQ ID NO: 3430297 - DNA, 22 bp, Homo sapiens
acaaagggcacagcatctgtag

SEQ ID NO: 3430298 - DNA, 18 bp, Homo sapiens
acaaaggggaaagaacat

SEQ ID NO: 3430299 - DNA, 15 bp, Homo sapiens
acaaaggttccattc

SEQ ID NO: 3430300 - DNA, 18 bp, Homo sapiens
acaaaggttccattcagt

SEQ ID NO: 3430301 - DNA, 17 bp, Homo sapiens
acaaagtactagctaaa

SEQ ID NO: 3430302 - DNA, 12 bp, Homo sapiens
acaaagtgtgta

SEQ ID NO: 3430303 - DNA, 16 bp, Homo sapiens
acaaagtgtgtattaa

SEQ ID NO: 3430304 - DNA, 14 bp, Homo sapiens
acaaatacagatga

SEQ ID NO: 3430305 - DNA, 23 bp, Homo sapiens
acaaatactcttaggaagagaaa

SEQ ID NO: 3430306 - DNA, 11 bp, Homo sapiens
acaaatatgca

SEQ ID NO: 3430307 - DNA, 14 bp, Homo sapiens
acaaatctatttaa

SEQ ID NO: 3430308 - DNA, 17 bp, Homo sapiens
acaaatgtaaacatttt

SEQ ID NO: 3430309 - DNA, 17 bp, Homo sapiens
acaacatttacaactca

SEQ ID NO: 3430310 - DNA, 14 bp, Homo sapiens
acaacctgaaccta

SEQ ID NO: 3430311 - DNA, 16 bp, Homo sapiens
acaacgtgcattgtgc

SEQ ID NO: 3430312 - DNA, 17 bp, Homo sapiens
acaacgtgcattgtgct

SEQ ID NO: 3430313 - DNA, 20 bp, Homo sapiens
acaactattttcagatgtga

SEQ ID NO: 3430314 - DNA, 20 bp, Homo sapiens
acaactcctagggccactga

SEQ ID NO: 3430315 - DNA, 17 bp, Homo sapiens
acaactttaagaggaca

SEQ ID NO: 3430316 - DNA, 18 bp, Homo sapiens
acaagacccaagtagctg

SEQ ID NO: 3430317 - DNA, 21 bp, Homo sapiens
acaagacttcagtatgttgtc

SEQ ID NO: 3430318 - DNA, 23 bp, Homo sapiens
acaagagggaatagtatagacaa

SEQ ID NO: 3430319 - DNA, 15 bp, Homo sapiens
acaagatattatgta

SEQ ID NO: 3430320 - DNA, 17 bp, Homo sapiens
acaagatgccccaggga

SEQ ID NO: 3430321 - DNA, 18 bp, Homo sapiens
acaagatgccccagggat

SEQ ID NO: 3430322 - DNA, 19 bp, Homo sapiens
acaagcaaacccagacggc

SEQ ID NO: 3430323 - DNA, 13 bp, Homo sapiens
acaagcaagctcc

SEQ ID NO: 3430324 - DNA, 15 bp, Homo sapiens
acaagcaagctccca

SEQ ID NO: 3430325 - DNA, 12 bp, Homo sapiens
acaagccaagaa

SEQ ID NO: 3430326 - DNA, 14 bp, Homo sapiens
acaagccccccctt

SEQ ID NO: 3430327 - DNA, 18 bp, Homo sapiens
acaagccctaacttctgt

SEQ ID NO: 3430328 - DNA, 19 bp, Homo sapiens
acaagctgcaccctcaggc

SEQ ID NO: 3430329 - DNA, 22 bp, Homo sapiens
acagactggaagcacagcttca

SEQ ID NO: 3430330 - DNA, 14 bp, Homo sapiens
acagagacctcctg

SEQ ID NO: 3430331 - DNA, 14 bp, Homo sapiens
acagagcaggactg

SEQ ID NO: 3430332 - DNA, 21 bp, Homo sapiens
acagaggaggatgtaaggcct

SEQ ID NO: 3430333 - DNA, 23 bp, Homo sapiens
acagaggcagccccattctgcct

SEQ ID NO: 3430334 - DNA, 22 bp, Homo sapiens
acagaggccccagcctccctga

SEQ ID NO: 3430335 - DNA, 20 bp, Homo sapiens
acagagggaagaaaagagct

SEQ ID NO: 3430336 - DNA, 20 bp, Homo sapiens
acagagttttcactcttatt

SEQ ID NO: 3430337 - DNA, 17 bp, Homo sapiens
acagatcgcatttccta

SEQ ID NO: 3430338 - DNA, 18 bp, Homo sapiens
acagatcgcatttcctaa

SEQ ID NO: 3430339 - DNA, 22 bp, Homo sapiens
acagatctggaacctcagcctg

SEQ ID NO: 3430340 - DNA, 18 bp, Homo sapiens
acagatgccacacaagga

SEQ ID NO: 3430341 - DNA, 21 bp, Homo sapiens
acagatgcctacttttggcct

SEQ ID NO: 3430342 - DNA, 12 bp, Homo sapiens
acagatgctcca

SEQ ID NO: 3430343 - DNA, 16 bp, Homo sapiens
acagattcacactgtc

SEQ ID NO: 3430344 - DNA, 19 bp, Homo sapiens
acagattcacactgtctgg

SEQ ID NO: 3430345 - DNA, 19 bp, Homo sapiens
acagattttgatagcaaag

SEQ ID NO: 3430346 - DNA, 21 bp, Homo sapiens
acagcaacaggaatctcagag

SEQ ID NO: 3430347 - DNA, 13 bp, Homo sapiens
acagcaacatttt

SEQ ID NO: 3430348 - DNA, 12 bp, Homo sapiens
acagcacagcca

SEQ ID NO: 3430349 - DNA, 18 bp, Homo sapiens
acagccaactagcccctg

SEQ ID NO: 3430350 - DNA, 17 bp, Homo sapiens
acagccagagcctgtct

SEQ ID NO: 3430351 - DNA, 16 bp, Homo sapiens
acagccagcacctggc

SEQ ID NO: 3430352 - DNA, 16 bp, Homo sapiens
acagcctcccaccccc

SEQ ID NO: 3430353 - DNA, 14 bp, Homo sapiens
acagcctctgcagt

SEQ ID NO: 3430354 - DNA, 13 bp, Homo sapiens
acagcctcttttt

SEQ ID NO: 3430355 - DNA, 22 bp, Homo sapiens
acagcctttgaatgtaaccaat

SEQ ID NO: 3430356 - DNA, 16 bp, Homo sapiens
acagcctttgcccaaa

SEQ ID NO: 3430357 - DNA, 15 bp, Homo sapiens
acagcggaggtgtgg

SEQ ID NO: 3430358 - DNA, 16 bp, Homo sapiens
acagcggaggtgtgga

SEQ ID NO: 3430359 - DNA, 19 bp, Homo sapiens
acagctaacacacagctcc

SEQ ID NO: 3430360 - DNA, 19 bp, Homo sapiens
acagctaatgggacactaa

SEQ ID NO: 3430361 - DNA, 14 bp, Homo sapiens
acagctactctccc

SEQ ID NO: 3430362 - DNA, 21 bp, Homo sapiens
acagctacttggtttgtgttc

SEQ ID NO: 3430363 - DNA, 15 bp, Homo sapiens
acagctccttctgtc

SEQ ID NO: 3430364 - DNA, 16 bp, Homo sapiens
acagctccttctgtcc

SEQ ID NO: 3430365 - DNA, 17 bp, Homo sapiens
acagctctgtcctggga

SEQ ID NO: 3430366 - DNA, 17 bp, Homo sapiens
acagctcttctaaggaa

SEQ ID NO: 3430367 - DNA, 16 bp, Homo sapiens
acagctcttctccagg

SEQ ID NO: 3430368 - DNA, 11 bp, Homo sapiens
acagctgcctt

SEQ ID NO: 3430369 - DNA, 16 bp, Homo sapiens
acagctgccttagctt

SEQ ID NO: 3430370 - DNA, 19 bp, Homo sapiens
acagctgccttagcttcag

SEQ ID NO: 3430371 - DNA, 20 bp, Homo sapiens
acagctgccttagcttcagg

SEQ ID NO: 3430372 - DNA, 10 bp, Homo sapiens
acagctgctc

SEQ ID NO: 3430373 - DNA, 21 bp, Homo sapiens
acagctgctcctagagggagg

SEQ ID NO: 3430374 - DNA, 22 bp, Homo sapiens
acagctgctcctagagggaggg

SEQ ID NO: 3430375 - DNA, 23 bp, Homo sapiens
acagctgtgtgacatttggagag

SEQ ID NO: 3430376 - DNA, 22 bp, Homo sapiens
acagctgtgttattctttgcgt

SEQ ID NO: 3430377 - DNA, 20 bp, Homo sapiens
acagcttcccctctctcctc

SEQ ID NO: 3430378 - DNA, 20 bp, Homo sapiens
acagcttctcatcctgcagg

SEQ ID NO: 3430379 - DNA, 23 bp, Homo sapiens
acagcttgacctgaggctgtggt

SEQ ID NO: 3430380 - DNA, 14 bp, Homo sapiens
acagctttctgacc

SEQ ID NO: 3430381 - DNA, 15 bp, Homo sapiens
acagctttctgacct

SEQ ID NO: 3430382 - DNA, 17 bp, Homo sapiens
acagctttctgaccttc

SEQ ID NO: 3430383 - DNA, 11 bp, Homo sapiens
acagctttgct

SEQ ID NO: 3430384 - DNA, 15 bp, Homo sapiens
acagctttgctgctg

SEQ ID NO: 3430385 - DNA, 15 bp, Homo sapiens
acagcttttccaaaa

SEQ ID NO: 3430386 - DNA, 19 bp, Homo sapiens
acaggaaaagctgctgaca

SEQ ID NO: 3430387 - DNA, 21 bp, Homo sapiens
acaggaaaagctgctgacagt

SEQ ID NO: 3430388 - DNA, 14 bp, Homo sapiens
acaggaatctcaga

SEQ ID NO: 3430389 - DNA, 19 bp, Homo sapiens
acaggacacctggccgcct

SEQ ID NO: 3430390 - DNA, 23 bp, Homo sapiens
acaggagtgtcctcttccctctc

SEQ ID NO: 3430391 - DNA, 15 bp, Homo sapiens
acaggcaagcacctc

SEQ ID NO: 3430392 - DNA, 19 bp, Homo sapiens
acaggcaagcacctcctgc

SEQ ID NO: 3430393 - DNA, 20 bp, Homo sapiens
acaggcaagcacctcctgcc

SEQ ID NO: 3430394 - DNA, 23 bp, Homo sapiens
acaggcaagcacctcctgcctcg

SEQ ID NO: 3430395 - DNA, 15 bp, Homo sapiens
acaggcaatgctggc

SEQ ID NO: 3430396 - DNA, 18 bp, Homo sapiens
acaggcaatgctggctgt

SEQ ID NO: 3430397 - DNA, 19 bp, Homo sapiens
acaggcaatgctggctgtt

SEQ ID NO: 3430398 - DNA, 15 bp, Homo sapiens
acaggcagatacagg

SEQ ID NO: 3430399 - DNA, 13 bp, Homo sapiens
acaggcaggtcca

SEQ ID NO: 3430400 - DNA, 16 bp, Homo sapiens
acaggcaggtccaggg

SEQ ID NO: 3430401 - DNA, 13 bp, Homo sapiens
acaggcagtttca

SEQ ID NO: 3430402 - DNA, 17 bp, Homo sapiens
acaggcagtttcagaga

SEQ ID NO: 3430403 - DNA, 22 bp, Homo sapiens
acaggcatgggtgcaaggaaaa

SEQ ID NO: 3430404 - DNA, 15 bp, Homo sapiens
acaggcatgttctct

SEQ ID NO: 3430405 - DNA, 18 bp, Homo sapiens
acaggcatgttctctgag

SEQ ID NO: 3430406 - DNA, 20 bp, Homo sapiens
acaggcatgttctctgagga

SEQ ID NO: 3430407 - DNA, 22 bp, Homo sapiens
acaggcatgttctctgaggaca

SEQ ID NO: 3430408 - DNA, 24 bp, Homo sapiens
acaggccccccgcagcaccctgca

SEQ ID NO: 3430409 - DNA, 21 bp, Homo sapiens
acaggccctccctgttcccca

SEQ ID NO: 3430410 - DNA, 23 bp, Homo sapiens
acaggccctccctgttccccaga

SEQ ID NO: 3430411 - DNA, 21 bp, Homo sapiens
acaggctgggcttcagtggca

SEQ ID NO: 3430412 - DNA, 19 bp, Homo sapiens
acaggctgtgactcttctc

SEQ ID NO: 3430413 - DNA, 20 bp, Homo sapiens
acaggctgtgactcttctct

SEQ ID NO: 3430414 - DNA, 12 bp, Homo sapiens
acagggagggga

SEQ ID NO: 3430415 - DNA, 13 bp, Homo sapiens
acagggatgagca

SEQ ID NO: 3430416 - DNA, 21 bp, Homo sapiens
acagggatgagcatggagctg

SEQ ID NO: 3430417 - DNA, 23 bp, Homo sapiens
acagggatgagcatggagctggc

SEQ ID NO: 3430418 - DNA, 15 bp, Homo sapiens
acagggattctcaca

SEQ ID NO: 3430419 - DNA, 20 bp, Homo sapiens
acagggcacaccgggcactc

SEQ ID NO: 3430420 - DNA, 15 bp, Homo sapiens
acagggcacctgcca

SEQ ID NO: 3430421 - DNA, 20 bp, Homo sapiens
acagggccctgttgaatttt

SEQ ID NO: 3430422 - DNA, 22 bp, Homo sapiens
acagggtttggctgtgtctaaa

SEQ ID NO: 3430423 - DNA, 19 bp, Homo sapiens
acagggttttgccatgttg

SEQ ID NO: 3430424 - DNA, 15 bp, Homo sapiens
acaggtaatataaaa

SEQ ID NO: 3430425 - DNA, 22 bp, Homo sapiens
acaggtcaatacagtacaggca

SEQ ID NO: 3430426 - DNA, 23 bp, Homo sapiens
acaggtgtgaaccaccacaccca

SEQ ID NO: 3430427 - DNA, 22 bp, Homo sapiens
acaggtgtgagtcaccaagccc

SEQ ID NO: 3430428 - DNA, 11 bp, Homo sapiens
acaggttggga

SEQ ID NO: 3430429 - DNA, 13 bp, Homo sapiens
acagtacaggcag

SEQ ID NO: 3430430 - DNA, 14 bp, Homo sapiens
acagtacaggcagc

SEQ ID NO: 3430431 - DNA, 14 bp, Homo sapiens
acagtagtcttgat

SEQ ID NO: 3430432 - DNA, 21 bp, Homo sapiens
acagtatcactgtctttccta

SEQ ID NO: 3430433 - DNA, 19 bp, Homo sapiens
acagtattacttctgctac

SEQ ID NO: 3430434 - DNA, 14 bp, Homo sapiens
acagtcacgcctga

SEQ ID NO: 3430435 - DNA, 21 bp, Homo sapiens
acagtcagatttccagtctcc

SEQ ID NO: 3430436 - DNA, 15 bp, Homo sapiens
acagtcagctcttca

SEQ ID NO: 3430437 - DNA, 14 bp, Homo sapiens
acagtccagcctgg

SEQ ID NO: 3430438 - DNA, 15 bp, Homo sapiens
acagtccagcctgga

SEQ ID NO: 3430439 - DNA, 20 bp, Homo sapiens
acagtgaaagaaaataacaa

SEQ ID NO: 3430440 - DNA, 14 bp, Homo sapiens
acagtgaagacaga

SEQ ID NO: 3430441 - DNA, 19 bp, Homo sapiens
acagtgaagacagaagttt

SEQ ID NO: 3430442 - DNA, 21 bp, Homo sapiens
acagtgaagacagaagtttgc

SEQ ID NO: 3430443 - DNA, 22 bp, Homo sapiens
acagtgagtcgaggacagggag

SEQ ID NO: 3430444 - DNA, 19 bp, Homo sapiens
acagtgctctaggctgccc

SEQ ID NO: 3430445 - DNA, 20 bp, Homo sapiens
acagtgctgcagctccctgg

SEQ ID NO: 3430446 - DNA, 13 bp, Homo sapiens
acagtgctgtgtg

SEQ ID NO: 3430447 - DNA, 20 bp, Homo sapiens
acagtgcttgccacagagcg

SEQ ID NO: 3430448 - DNA, 15 bp, Homo sapiens
acagtggggaagagt

SEQ ID NO: 3430449 - DNA, 17 bp, Homo sapiens
acagtgtgggacaggct

SEQ ID NO: 3430450 - DNA, 13 bp, Homo sapiens
acagttacataat

SEQ ID NO: 3430451 - DNA, 16 bp, Homo sapiens
acagttatcaaaaagt

SEQ ID NO: 3430452 - DNA, 13 bp, Homo sapiens
acagttctgtcat

SEQ ID NO: 3430453 - DNA, 18 bp, Homo sapiens
acagttctttgggccaga

SEQ ID NO: 3430454 - DNA, 20 bp, Homo sapiens
acagttgaaaaacagctgag

SEQ ID NO: 3430455 - DNA, 23 bp, Homo sapiens
acagttgaccctattttttgaca

SEQ ID NO: 3430456 - DNA, 14 bp, Homo sapiens
acagttgggtgaga

SEQ ID NO: 3430457 - DNA, 20 bp, Homo sapiens
acagttttcctatgctttga

SEQ ID NO: 3430458 - DNA, 13 bp, Homo sapiens
acataaattagag

SEQ ID NO: 3430459 - DNA, 17 bp, Homo sapiens
acataagatcactgcca

SEQ ID NO: 3430460 - DNA, 21 bp, Homo sapiens
acataatgggccactgaaatc

SEQ ID NO: 3430461 - DNA, 15 bp, Homo sapiens
accaagcaggaagct

SEQ ID NO: 3430462 - DNA, 17 bp, Homo sapiens
accaagcaggaagctca

SEQ ID NO: 3430463 - DNA, 14 bp, Homo sapiens
accaagcatcttgg

SEQ ID NO: 3430464 - DNA, 20 bp, Homo sapiens
accaagccaagggaacctgt

SEQ ID NO: 3430465 - DNA, 23 bp, Homo sapiens
accaagccaagggaacctgtgtc

SEQ ID NO: 3430466 - DNA, 11 bp, Homo sapiens
accaaggaaac

SEQ ID NO: 3430467 - DNA, 15 bp, Homo sapiens
accaaggactgagca

SEQ ID NO: 3430468 - DNA, 14 bp, Homo sapiens
accaatgaaaaaat

SEQ ID NO: 3430469 - DNA, 17 bp, Homo sapiens
accaatgaaaaaatgta

SEQ ID NO: 3430470 - DNA, 13 bp, Homo sapiens
accaatttgcacc

SEQ ID NO: 3430471 - DNA, 18 bp, Homo sapiens
accaatttgcaccagttt

SEQ ID NO: 3430472 - DNA, 22 bp, Homo sapiens
accacaaactgtaatacaatga

SEQ ID NO: 3430473 - DNA, 17 bp, Homo sapiens
accacacactgtttttt

SEQ ID NO: 3430474 - DNA, 16 bp, Homo sapiens
accacacatctgtgga

SEQ ID NO: 3430475 - DNA, 17 bp, Homo sapiens
accacagccagcacctg

SEQ ID NO: 3430476 - DNA, 19 bp, Homo sapiens
accacagccagcacctggc

SEQ ID NO: 3430477 - DNA, 20 bp, Homo sapiens
accacagccagcacctggca

SEQ ID NO: 3430478 - DNA, 20 bp, Homo sapiens
accaccacacccagcccact

SEQ ID NO: 3430479 - DNA, 16 bp, Homo sapiens
accaccacacccggct

SEQ ID NO: 3430480 - DNA, 16 bp, Homo sapiens
accaccctgtcttcct

SEQ ID NO: 3430481 - DNA, 20 bp, Homo sapiens
accaccctgtcttcctctgc

SEQ ID NO: 3430482 - DNA, 17 bp, Homo sapiens
accaccttttattacat

SEQ ID NO: 3430483 - DNA, 20 bp, Homo sapiens
accacgcccgtcctgcctgt

SEQ ID NO: 3430484 - DNA, 16 bp, Homo sapiens
accacgctggggtctg

SEQ ID NO: 3430485 - DNA, 14 bp, Homo sapiens
accacgtccagctg

SEQ ID NO: 3430486 - DNA, 17 bp, Homo sapiens
accactgcactccagcc

SEQ ID NO: 3430487 - DNA, 20 bp, Homo sapiens
accactgcactccagcctgg

SEQ ID NO: 3430488 - DNA, 13 bp, Homo sapiens
accacttcagctg

SEQ ID NO: 3430489 - DNA, 13 bp, Homo sapiens
accacttcattct

SEQ ID NO: 3430490 - DNA, 17 bp, Homo sapiens
accacttcattcttgaa

SEQ ID NO: 3430491 - DNA, 13 bp, Homo sapiens
accactttttgca

SEQ ID NO: 3430492 - DNA, 16 bp, Homo sapiens
accactttttgcagct

SEQ ID NO: 3430493 - DNA, 16 bp, Homo sapiens
accagacacccaggac

SEQ ID NO: 3430494 - DNA, 22 bp, Homo sapiens
accagacaccttgacagggcac

SEQ ID NO: 3430495 - DNA, 13 bp, Homo sapiens
accagacccttct

SEQ ID NO: 3430496 - DNA, 17 bp, Homo sapiens
accagagcccaccttgg

SEQ ID NO: 3430497 - DNA, 16 bp, Homo sapiens
accagatggttgtgta

SEQ ID NO: 3430498 - DNA, 13 bp, Homo sapiens
accagcacatcca

SEQ ID NO: 3430499 - DNA, 14 bp, Homo sapiens
accagcagcctgga

SEQ ID NO: 3430500 - DNA, 17 bp, Homo sapiens
accagcagcctggaccc

SEQ ID NO: 3430501 - DNA, 11 bp, Homo sapiens
accagccagcg

SEQ ID NO: 3430502 - DNA, 19 bp, Homo sapiens
accagccccagtgcccaca

SEQ ID NO: 3430503 - DNA, 12 bp, Homo sapiens
accagcctggcc

SEQ ID NO: 3430504 - DNA, 23 bp, Homo sapiens
accagcgaggaggctccagaggg

SEQ ID NO: 3430505 - DNA, 10 bp, Homo sapiens
accagctgca

SEQ ID NO: 3430506 - DNA, 12 bp, Homo sapiens
accagctgcaaa

SEQ ID NO: 3430507 - DNA, 16 bp, Homo sapiens
accagctgcaaagtgt

SEQ ID NO: 3430508 - DNA, 20 bp, Homo sapiens
accagctgcaaagtgttttg

SEQ ID NO: 3430509 - DNA, 18 bp, Homo sapiens
accagctgctactcataa

SEQ ID NO: 3430510 - DNA, 17 bp, Homo sapiens
accagcttaaaggcagt

SEQ ID NO: 3430511 - DNA, 21 bp, Homo sapiens
accaggagaagggctggggcc

SEQ ID NO: 3430512 - DNA, 12 bp, Homo sapiens
accaggccacct

SEQ ID NO: 3430513 - DNA, 17 bp, Homo sapiens
accaggccacctcccca

SEQ ID NO: 3430514 - DNA, 12 bp, Homo sapiens
accaggccctgg

SEQ ID NO: 3430515 - DNA, 10 bp, Homo sapiens
accagggaca

SEQ ID NO: 3430516 - DNA, 16 bp, Homo sapiens
accaggggaggcagtg

SEQ ID NO: 3430517 - DNA, 13 bp, Homo sapiens
accaggtgccttt

SEQ ID NO: 3430518 - DNA, 18 bp, Homo sapiens
accagtatttttgctgct

SEQ ID NO: 3430519 - DNA, 21 bp, Homo sapiens
accagtatttttgctgcttct

SEQ ID NO: 3430520 - DNA, 13 bp, Homo sapiens
accagtccctgtc

SEQ ID NO: 3430521 - DNA, 19 bp, Homo sapiens
accagtgaatttttgcaat

SEQ ID NO: 3430522 - DNA, 22 bp, Homo sapiens
accagtgaatttttgcaataat

SEQ ID NO: 3430523 - DNA, 12 bp, Homo sapiens
accagtggtctc

SEQ ID NO: 3430524 - DNA, 17 bp, Homo sapiens
accagtggtctcacatg

SEQ ID NO: 3430525 - DNA, 19 bp, Homo sapiens
accagtttaacctgatgca

SEQ ID NO: 3430526 - DNA, 21 bp, Homo sapiens
accagtttaacctgatgcagt

SEQ ID NO: 3430527 - DNA, 23 bp, Homo sapiens
accagttttatccataatgatgg

SEQ ID NO: 3430528 - DNA, 18 bp, Homo sapiens
accatccctttttgaagt

SEQ ID NO: 3430529 - DNA, 20 bp, Homo sapiens
accatccctttttgaagtgt

SEQ ID NO: 3430530 - DNA, 21 bp, Homo sapiens
accatccctttttgaagtgta

SEQ ID NO: 3430531 - DNA, 13 bp, Homo sapiens
accatcctggctg

SEQ ID NO: 3430532 - DNA, 12 bp, Homo sapiens
accatctgctgc

SEQ ID NO: 3430533 - DNA, 15 bp, Homo sapiens
accatctgctgcccc

SEQ ID NO: 3430534 - DNA, 22 bp, Homo sapiens
accatctgtcttgccagccaga

SEQ ID NO: 3430535 - DNA, 23 bp, Homo sapiens
accatcttctgtaccaaaaatag

SEQ ID NO: 3430536 - DNA, 14 bp, Homo sapiens
accatgaaacaaag

SEQ ID NO: 3430537 - DNA, 15 bp, Homo sapiens
accatgaaacaaagc

SEQ ID NO: 3430538 - DNA, 20 bp, Homo sapiens
accatgcctcactaattttt

SEQ ID NO: 3430539 - DNA, 19 bp, Homo sapiens
accatgcctggtattttca

SEQ ID NO: 3430540 - DNA, 22 bp, Homo sapiens
accatgcgacactgggaggcca

SEQ ID NO: 3430541 - DNA, 15 bp, Homo sapiens
accatggccagccaa

SEQ ID NO: 3430542 - DNA, 17 bp, Homo sapiens
accatgtaaataatctg

SEQ ID NO: 3430543 - DNA, 17 bp, Homo sapiens
accatgtagaaaatttg

SEQ ID NO: 3430544 - DNA, 13 bp, Homo sapiens
accattctgcatt

SEQ ID NO: 3430545 - DNA, 16 bp, Homo sapiens
accatttatacaaatt

SEQ ID NO: 3430546 - DNA, 21 bp, Homo sapiens
accatttatacaaattagaaa

SEQ ID NO: 3430547 - DNA, 23 bp, Homo sapiens
accatttatacaaattagaaaat

SEQ ID NO: 3430548 - DNA, 22 bp, Homo sapiens
accatttcctcagcttatctct

SEQ ID NO: 3430549 - DNA, 23 bp, Homo sapiens
accatttcttgaggtaaaagcat

SEQ ID NO: 3430550 - DNA, 11 bp, Homo sapiens
accattttaca

SEQ ID NO: 3430551 - DNA, 17 bp, Homo sapiens
accattttacatttcta

SEQ ID NO: 3430552 - DNA, 22 bp, Homo sapiens
accatttttaaagtagaagagg

SEQ ID NO: 3430553 - DNA, 18 bp, Homo sapiens
acccaaaaactgtcttta

SEQ ID NO: 3430554 - DNA, 15 bp, Homo sapiens
acccaaaacaagcct

SEQ ID NO: 3430555 - DNA, 21 bp, Homo sapiens
acccaaaacaagcctggtagg

SEQ ID NO: 3430556 - DNA, 15 bp, Homo sapiens
acccaacggccctgc

SEQ ID NO: 3430557 - DNA, 23 bp, Homo sapiens
acccaacggccctgcagccagct

SEQ ID NO: 3430558 - DNA, 22 bp, Homo sapiens
acccaagcctcatattttctgt

SEQ ID NO: 3430559 - DNA, 17 bp, Homo sapiens
acccaagtagctgctac

SEQ ID NO: 3430560 - DNA, 20 bp, Homo sapiens
acccaagtatacaataaagt

SEQ ID NO: 3430561 - DNA, 21 bp, Homo sapiens
acccaccagcctaagaagctc

SEQ ID NO: 3430562 - DNA, 12 bp, Homo sapiens
acccacccctgc

SEQ ID NO: 3430563 - DNA, 13 bp, Homo sapiens
acccacctcagcc

SEQ ID NO: 3430564 - DNA, 14 bp, Homo sapiens
acccacctcagcct

SEQ ID NO: 3430565 - DNA, 14 bp, Homo sapiens
acccacctccctgc

SEQ ID NO: 3430566 - DNA, 15 bp, Homo sapiens
acccacctccctgcc

SEQ ID NO: 3430567 - DNA, 15 bp, Homo sapiens
acccactcggtccca

SEQ ID NO: 3430568 - DNA, 11 bp, Homo sapiens
acccactgctt

SEQ ID NO: 3430569 - DNA, 15 bp, Homo sapiens
acccagactgtctcc

SEQ ID NO: 3430570 - DNA, 15 bp, Homo sapiens
acccagcccacttct

SEQ ID NO: 3430571 - DNA, 16 bp, Homo sapiens
acccagcccacttctg

SEQ ID NO: 3430572 - DNA, 17 bp, Homo sapiens
acccagcccacttctgc

SEQ ID NO: 3430573 - DNA, 16 bp, Homo sapiens
acccagcgagccctgg

SEQ ID NO: 3430574 - DNA, 19 bp, Homo sapiens
acccagcgagccctggtgg

SEQ ID NO: 3430575 - DNA, 24 bp, Homo sapiens
acccagcgagccctggtggcagtg

SEQ ID NO: 3430576 - DNA, 14 bp, Homo sapiens
acccagctaaataa

SEQ ID NO: 3430577 - DNA, 23 bp, Homo sapiens
acccaggagatggaagttgcagt

SEQ ID NO: 3430578 - DNA, 20 bp, Homo sapiens
acccaggctgggcaaggagg

SEQ ID NO: 3430579 - DNA, 15 bp, Homo sapiens
acccagggcctgcag

SEQ ID NO: 3430580 - DNA, 17 bp, Homo sapiens
acccagggcctgcagga

SEQ ID NO: 3430581 - DNA, 20 bp, Homo sapiens
acccagggtggagtgcagtg

SEQ ID NO: 3430582 - DNA, 21 bp, Homo sapiens
acccagggtggagtgcagtgg

SEQ ID NO: 3430583 - DNA, 21 bp, Homo sapiens
acccagggttcccgcggggct

SEQ ID NO: 3430584 - DNA, 19 bp, Homo sapiens
acccagtcgcccttacttc

SEQ ID NO: 3430585 - DNA, 15 bp, Homo sapiens
acccatcaacaaaaa

SEQ ID NO: 3430586 - DNA, 20 bp, Homo sapiens
acccatctgcacccccctgg

SEQ ID NO: 3430587 - DNA, 17 bp, Homo sapiens
acccattgctgttgtcc

SEQ ID NO: 3430588 - DNA, 16 bp, Homo sapiens
acccatttttgagcca

SEQ ID NO: 3430589 - DNA, 17 bp, Homo sapiens
acccatttttgagccaa

SEQ ID NO: 3430590 - DNA, 23 bp, Homo sapiens
accccagcattctcaggcaccag

SEQ ID NO: 3430591 - DNA, 22 bp, Homo sapiens
accccagctactctgatccctc

SEQ ID NO: 3430592 - DNA, 15 bp, Homo sapiens
accccaggccctgcc

SEQ ID NO: 3430593 - DNA, 20 bp, Homo sapiens
accccaggctgaagcaggtt

SEQ ID NO: 3430594 - DNA, 11 bp, Homo sapiens
accccagggcc

SEQ ID NO: 3430595 - DNA, 24 bp, Homo sapiens
accccagggcctgagcctggccag

SEQ ID NO: 3430596 - DNA, 15 bp, Homo sapiens
acccccagcctgcta

SEQ ID NO: 3430597 - DNA, 18 bp, Homo sapiens
acccccagctccggcctg

SEQ ID NO: 3430598 - DNA, 17 bp, Homo sapiens
accccccagcactgagg

SEQ ID NO: 3430599 - DNA, 19 bp, Homo sapiens
acccccccaccccaggccc

SEQ ID NO: 3430600 - DNA, 15 bp, Homo sapiens
acccccctgggctga

SEQ ID NO: 3430601 - DNA, 16 bp, Homo sapiens
accccctcgcttggac

SEQ ID NO: 3430602 - DNA, 18 bp, Homo sapiens
acccccttctccatccac

SEQ ID NO: 3430603 - DNA, 20 bp, Homo sapiens
accccgcagacaccttggac

SEQ ID NO: 3430604 - DNA, 20 bp, Homo sapiens
acccctcagttgtgcagctt

SEQ ID NO: 3430605 - DNA, 12 bp, Homo sapiens
acccctccccat

SEQ ID NO: 3430606 - DNA, 13 bp, Homo sapiens
acccctccctttc

SEQ ID NO: 3430607 - DNA, 16 bp, Homo sapiens
acccctgcccttgtcc

SEQ ID NO: 3430608 - DNA, 15 bp, Homo sapiens
acccctggctccttc

SEQ ID NO: 3430609 - DNA, 15 bp, Homo sapiens
acccctgggggctct

SEQ ID NO: 3430610 - DNA, 16 bp, Homo sapiens
acccctgggggctctc

SEQ ID NO: 3430611 - DNA, 15 bp, Homo sapiens
acccctggttctcat

SEQ ID NO: 3430612 - DNA, 20 bp, Homo sapiens
acccctggttctcatctttc

SEQ ID NO: 3430613 - DNA, 18 bp, Homo sapiens
accccttaagccctggcc

SEQ ID NO: 3430614 - DNA, 17 bp, Homo sapiens
accccttaatcttgctt

SEQ ID NO: 3430615 - DNA, 15 bp, Homo sapiens
accccttcgctcctg

SEQ ID NO: 3430616 - DNA, 19 bp, Homo sapiens
accccttcgctcctgtgtc

SEQ ID NO: 3430617 - DNA, 21 bp, Homo sapiens
acccgagtcattcgttctgtg

SEQ ID NO: 3430618 - DNA, 15 bp, Homo sapiens
acccggcccctgctg

SEQ ID NO: 3430619 - DNA, 17 bp, Homo sapiens
acccggcccctgctggt

SEQ ID NO: 3430620 - DNA, 22 bp, Homo sapiens
acccgggaacctccccagcctg

SEQ ID NO: 3430621 - DNA, 18 bp, Homo sapiens
acccggtgctccctctgt

SEQ ID NO: 3430622 - DNA, 18 bp, Homo sapiens
accctaaaaagagaagaa

SEQ ID NO: 3430623 - DNA, 22 bp, Homo sapiens
accctacttcattttcagagtg

SEQ ID NO: 3430624 - DNA, 23 bp, Homo sapiens
accctacttcattttcagagtga

SEQ ID NO: 3430625 - DNA, 18 bp, Homo sapiens
accctagccctctccctc

SEQ ID NO: 3430626 - DNA, 19 bp, Homo sapiens
accctattgctgcttgagg

SEQ ID NO: 3430627 - DNA, 13 bp, Homo sapiens
accctcaggcagg

SEQ ID NO: 3430628 - DNA, 15 bp, Homo sapiens
accctcaggcaggtg

SEQ ID NO: 3430629 - DNA, 21 bp, Homo sapiens
accctcctttcaccacatgtg

SEQ ID NO: 3430630 - DNA, 22 bp, Homo sapiens
accctctaacctcgccctctcc

SEQ ID NO: 3430631 - DNA, 20 bp, Homo sapiens
accctctggattctgaatct

SEQ ID NO: 3430632 - DNA, 16 bp, Homo sapiens
accctgaaagccctga

SEQ ID NO: 3430633 - DNA, 22 bp, Homo sapiens
accctgagctgaggcagcagtg

SEQ ID NO: 3430634 - DNA, 18 bp, Homo sapiens
accctgaggtcactgcta

SEQ ID NO: 3430635 - DNA, 17 bp, Homo sapiens
accctgagttttgtttt

SEQ ID NO: 3430636 - DNA, 13 bp, Homo sapiens
accctgcagagca

SEQ ID NO: 3430637 - DNA, 13 bp, Homo sapiens
accctgccatgga

SEQ ID NO: 3430638 - DNA, 11 bp, Homo sapiens
accctgcctcc

SEQ ID NO: 3430639 - DNA, 14 bp, Homo sapiens
accctgcctccctt

SEQ ID NO: 3430640 - DNA, 20 bp, Homo sapiens
accctgcctcccttgacttt

SEQ ID NO: 3430641 - DNA, 20 bp, Homo sapiens
accctggaccagtggtctca

SEQ ID NO: 3430642 - DNA, 18 bp, Homo sapiens
accctggccgagtccaag

SEQ ID NO: 3430643 - DNA, 21 bp, Homo sapiens
accctggccgagtccaagctg

SEQ ID NO: 3430644 - DNA, 20 bp, Homo sapiens
accctgggccctgggctgga

SEQ ID NO: 3430645 - DNA, 22 bp, Homo sapiens
accctgggccctgggctggaat

SEQ ID NO: 3430646 - DNA, 15 bp, Homo sapiens
accctggggaaggag

SEQ ID NO: 3430647 - DNA, 14 bp, Homo sapiens
accctggggcctga

SEQ ID NO: 3430648 - DNA, 23 bp, Homo sapiens
accctgtaaaatggaggtggaaa

SEQ ID NO: 3430649 - DNA, 16 bp, Homo sapiens
accctgtcttcctctg

SEQ ID NO: 3430650 - DNA, 17 bp, Homo sapiens
accctgtcttcctctgc

SEQ ID NO: 3430651 - DNA, 19 bp, Homo sapiens
accctgtcttcctctgcaa

SEQ ID NO: 3430652 - DNA, 21 bp, Homo sapiens
accctgtgccctccttcccaa

SEQ ID NO: 3430653 - DNA, 18 bp, Homo sapiens
accctgttcctggaggtc

SEQ ID NO: 3430654 - DNA, 12 bp, Homo sapiens
accctgttgcta

SEQ ID NO: 3430655 - DNA, 15 bp, Homo sapiens
accctgttgctaagc

SEQ ID NO: 3430656 - DNA, 13 bp, Homo sapiens
acccttagaatcc

SEQ ID NO: 3430657 - DNA, 21 bp, Homo sapiens
acccttcatcttcctgtgtcc

SEQ ID NO: 3430658 - DNA, 17 bp, Homo sapiens
acccttctcctcttgta

SEQ ID NO: 3430659 - DNA, 23 bp, Homo sapiens
acccttctcctcttgtaaataaa

SEQ ID NO: 3430660 - DNA, 23 bp, Homo sapiens
accgagagccaaacagagcccag

SEQ ID NO: 3430661 - DNA, 19 bp, Homo sapiens
accgcaggaagctgctccg

SEQ ID NO: 3430662 - DNA, 14 bp, Homo sapiens
accgctttggcctg

SEQ ID NO: 3430663 - DNA, 16 bp, Homo sapiens
accgctttggcctgag

SEQ ID NO: 3430664 - DNA, 16 bp, Homo sapiens
accggacttttctgca

SEQ ID NO: 3430665 - DNA, 14 bp, Homo sapiens
accggatcctgggt

SEQ ID NO: 3430666 - DNA, 20 bp, Homo sapiens
accgggccacagagaaagta

SEQ ID NO: 3430667 - DNA, 14 bp, Homo sapiens
accggtggggctgg

SEQ ID NO: 3430668 - DNA, 14 bp, Homo sapiens
accgtgggctccct

SEQ ID NO: 3430669 - DNA, 19 bp, Homo sapiens
accgtgtcaagctgctctg

SEQ ID NO: 3430670 - DNA, 15 bp, Homo sapiens
acctaaaaaagatat

SEQ ID NO: 3430671 - DNA, 16 bp, Homo sapiens
acctaaaaaagatata

SEQ ID NO: 3430672 - DNA, 19 bp, Homo sapiens
acctaaaaaagatatatta

SEQ ID NO: 3430673 - DNA, 21 bp, Homo sapiens
acctaaaaggaaatctcaccc

SEQ ID NO: 3430674 - DNA, 15 bp, Homo sapiens
acctaatccaggcag

SEQ ID NO: 3430675 - DNA, 22 bp, Homo sapiens
acctaatccaggcagatccagg

SEQ ID NO: 3430676 - DNA, 20 bp, Homo sapiens
acctaatgctccttgttcct

SEQ ID NO: 3430677 - DNA, 16 bp, Homo sapiens
acctacacactgtcat

SEQ ID NO: 3430678 - DNA, 17 bp, Homo sapiens
acctacatccccaggtc

SEQ ID NO: 3430679 - DNA, 15 bp, Homo sapiens
acctacccatacacc

SEQ ID NO: 3430680 - DNA, 13 bp, Homo sapiens
acctacctcccac

SEQ ID NO: 3430681 - DNA, 15 bp, Homo sapiens
acctagagctttttt

SEQ ID NO: 3430682 - DNA, 21 bp, Homo sapiens
acctagcagcaccgttctgtg

SEQ ID NO: 3430683 - DNA, 22 bp, Homo sapiens
acctagcagcaccgttctgtgc

SEQ ID NO: 3430684 - DNA, 23 bp, Homo sapiens
acctagcagcaccgttctgtgca

SEQ ID NO: 3430685 - DNA, 13 bp, Homo sapiens
acctagccagctg

SEQ ID NO: 3430686 - DNA, 13 bp, Homo sapiens
acctagccttaga

SEQ ID NO: 3430687 - DNA, 16 bp, Homo sapiens
acctatggctgcctgc

SEQ ID NO: 3430688 - DNA, 23 bp, Homo sapiens
acctattatccttctacttgtcc

SEQ ID NO: 3430689 - DNA, 12 bp, Homo sapiens
acctatttccat

SEQ ID NO: 3430690 - DNA, 17 bp, Homo sapiens
acctcaaccatcctggc

SEQ ID NO: 3430691 - DNA, 19 bp, Homo sapiens
acctcaacccccatttcta

SEQ ID NO: 3430692 - DNA, 14 bp, Homo sapiens
acctcacctagaaa

SEQ ID NO: 3430693 - DNA, 15 bp, Homo sapiens
acctcacctagaaat

SEQ ID NO: 3430694 - DNA, 15 bp, Homo sapiens
acctcacgcacctcc

SEQ ID NO: 3430695 - DNA, 19 bp, Homo sapiens
acctcacgcacctcccatc

SEQ ID NO: 3430696 - DNA, 12 bp, Homo sapiens
acctcagcctcc

SEQ ID NO: 3430697 - DNA, 15 bp, Homo sapiens
acctcagcctggcca

SEQ ID NO: 3430698 - DNA, 16 bp, Homo sapiens
acctcagcctggccag

SEQ ID NO: 3430699 - DNA, 17 bp, Homo sapiens
acctcagcctggccaga

SEQ ID NO: 3430700 - DNA, 19 bp, Homo sapiens
acctcagcctggccagaca

SEQ ID NO: 3430701 - DNA, 21 bp, Homo sapiens
acctcagcctggccagacaca

SEQ ID NO: 3430702 - DNA, 18 bp, Homo sapiens
acctcaggtgagaagcag

SEQ ID NO: 3430703 - DNA, 20 bp, Homo sapiens
acctcaggtgatccacccac

SEQ ID NO: 3430704 - DNA, 21 bp, Homo sapiens
acctcaggtgatccacccacc

SEQ ID NO: 3430705 - DNA, 18 bp, Homo sapiens
acctcagttattacatgt

SEQ ID NO: 3430706 - DNA, 15 bp, Homo sapiens
acctcatgacagcca

SEQ ID NO: 3430707 - DNA, 17 bp, Homo sapiens
acctcatgacagccaga

SEQ ID NO: 3430708 - DNA, 19 bp, Homo sapiens
acctcatgacagccagagc

SEQ ID NO: 3430709 - DNA, 13 bp, Homo sapiens
acctcattctgaa

SEQ ID NO: 3430710 - DNA, 14 bp, Homo sapiens
acctcattgttctg

SEQ ID NO: 3430711 - DNA, 11 bp, Homo sapiens
acctccacagc

SEQ ID NO: 3430712 - DNA, 12 bp, Homo sapiens
acctccacagct

SEQ ID NO: 3430713 - DNA, 13 bp, Homo sapiens
acctccacagctt

SEQ ID NO: 3430714 - DNA, 15 bp, Homo sapiens
acctcccatcctaat

SEQ ID NO: 3430715 - DNA, 17 bp, Homo sapiens
acctccccagcctgcgc

SEQ ID NO: 3430716 - DNA, 17 bp, Homo sapiens
acctccctatactgctt

SEQ ID NO: 3430717 - DNA, 20 bp, Homo sapiens
acctccgcctcttgggttca

SEQ ID NO: 3430718 - DNA, 23 bp, Homo sapiens
acctcctcccccctcctctgaaa

SEQ ID NO: 3430719 - DNA, 11 bp, Homo sapiens
acctcctctgt

SEQ ID NO: 3430720 - DNA, 18 bp, Homo sapiens
acctcctctgtgaagcat

SEQ ID NO: 3430721 - DNA, 11 bp, Homo sapiens
acctcctgcct

SEQ ID NO: 3430722 - DNA, 12 bp, Homo sapiens
acctcctgcctc

SEQ ID NO: 3430723 - DNA, 19 bp, Homo sapiens
acctcctttcatcacactg

SEQ ID NO: 3430724 - DNA, 15 bp, Homo sapiens
acctcgagtactgtg

SEQ ID NO: 3430725 - DNA, 15 bp, Homo sapiens
acctcgccctctcct

SEQ ID NO: 3430726 - DNA, 16 bp, Homo sapiens
acctctccagcctcag

SEQ ID NO: 3430727 - DNA, 21 bp, Homo sapiens
acggcaggacaacgaggaagc

SEQ ID NO: 3430728 - DNA, 22 bp, Homo sapiens
acggctccactaggacttcaaa

SEQ ID NO: 3430729 - DNA, 15 bp, Homo sapiens
acggctcccccaggc

SEQ ID NO: 3430730 - DNA, 16 bp, Homo sapiens
acggctcccccaggcc

SEQ ID NO: 3430731 - DNA, 17 bp, Homo sapiens
acggctcccccaggcct

SEQ ID NO: 3430732 - DNA, 19 bp, Homo sapiens
acggctcgatttctccagg

SEQ ID NO: 3430733 - DNA, 11 bp, Homo sapiens
acggctgggca

SEQ ID NO: 3430734 - DNA, 15 bp, Homo sapiens
acggggctcttctca

SEQ ID NO: 3430735 - DNA, 16 bp, Homo sapiens
acgtattagttgccaa

SEQ ID NO: 3430736 - DNA, 18 bp, Homo sapiens
acgtattagttgccaata

SEQ ID NO: 3430737 - DNA, 19 bp, Homo sapiens
acgtattagttgccaatat

SEQ ID NO: 3430738 - DNA, 13 bp, Homo sapiens
acgtcatctcagg

SEQ ID NO: 3430739 - DNA, 17 bp, Homo sapiens
acgtctttttgtttgtt

SEQ ID NO: 3430740 - DNA, 19 bp, Homo sapiens
acgtgacacaaacacacac

SEQ ID NO: 3430741 - DNA, 20 bp, Homo sapiens
acgtgacacaaacacacaca

SEQ ID NO: 3430742 - DNA, 13 bp, Homo sapiens
acgtgcaaagcca

SEQ ID NO: 3430743 - DNA, 12 bp, Homo sapiens
acgtgcattgtg

SEQ ID NO: 3430744 - DNA, 17 bp, Homo sapiens
acgtgcctgtgggcctg

SEQ ID NO: 3430745 - DNA, 17 bp, Homo sapiens
acgtggaggagcagtgc

SEQ ID NO: 3430746 - DNA, 23 bp, Homo sapiens
acgtgggctgggcccacaaaggc

SEQ ID NO: 3430747 - DNA, 18 bp, Homo sapiens
acgtggttggggccctgc

SEQ ID NO: 3430748 - DNA, 16 bp, Homo sapiens
acgtgtttgtgctgtg

SEQ ID NO: 3430749 - DNA, 17 bp, Homo sapiens
acgttaccttgacacat

SEQ ID NO: 3430750 - DNA, 20 bp, Homo sapiens
acgttagaggaaaaatattt

SEQ ID NO: 3430751 - DNA, 20 bp, Homo sapiens
acgttaggcatttcctgctg

SEQ ID NO: 3430752 - DNA, 21 bp, Homo sapiens
acgttaggcatttcctgctga

SEQ ID NO: 3430753 - DNA, 19 bp, Homo sapiens
acgttggagaagcccgtgt

SEQ ID NO: 3430754 - DNA, 20 bp, Homo sapiens
acgtttttaatataaagcct

SEQ ID NO: 3430755 - DNA, 14 bp, Homo sapiens
actaaactcattta

SEQ ID NO: 3430756 - DNA, 15 bp, Homo sapiens
actaaactctctttg

SEQ ID NO: 3430757 - DNA, 18 bp, Homo sapiens
actaaagaagatctgtaa

SEQ ID NO: 3430758 - DNA, 17 bp, Homo sapiens
actaaagcagtagaaat

SEQ ID NO: 3430759 - DNA, 16 bp, Homo sapiens
actaaagccaaacata

SEQ ID NO: 3430760 - DNA, 22 bp, Homo sapiens
actaactaaactctctttggga

SEQ ID NO: 3430761 - DNA, 23 bp, Homo sapiens
actaactatgcatggtgccccag

SEQ ID NO: 3430762 - DNA, 16 bp, Homo sapiens
actaagaattcaaact

SEQ ID NO: 3430763 - DNA, 18 bp, Homo sapiens
actaagaattcaaactgg

SEQ ID NO: 3430764 - DNA, 15 bp, Homo sapiens
actaagcagaggagg

SEQ ID NO: 3430765 - DNA, 14 bp, Homo sapiens
actaataaaccagt

SEQ ID NO: 3430766 - DNA, 13 bp, Homo sapiens
actaatggcatga

SEQ ID NO: 3430767 - DNA, 16 bp, Homo sapiens
actaatggcatgagaa

SEQ ID NO: 3430768 - DNA, 18 bp, Homo sapiens
actaatggggcggtgaga

SEQ ID NO: 3430769 - DNA, 13 bp, Homo sapiens
actaattccacac

SEQ ID NO: 3430770 - DNA, 23 bp, Homo sapiens
actaattccacaccttttattga

SEQ ID NO: 3430771 - DNA, 18 bp, Homo sapiens
actacaaacaaaatttct

SEQ ID NO: 3430772 - DNA, 11 bp, Homo sapiens
actacaggcac

SEQ ID NO: 3430773 - DNA, 20 bp, Homo sapiens
actacccaaaacaagcctgg

SEQ ID NO: 3430774 - DNA, 17 bp, Homo sapiens
actactaaaagtttaga

SEQ ID NO: 3430775 - DNA, 18 bp, Homo sapiens
actactaaaagtttagaa

SEQ ID NO: 3430776 - DNA, 20 bp, Homo sapiens
actactgctaccacaactat

SEQ ID NO: 3430777 - DNA, 19 bp, Homo sapiens
actactttgttaggatttt

SEQ ID NO: 3430778 - DNA, 12 bp, Homo sapiens
actagacaagcc

SEQ ID NO: 3430779 - DNA, 15 bp, Homo sapiens
actagacaagccaga

SEQ ID NO: 3430780 - DNA, 19 bp, Homo sapiens
actagagggacctctccca

SEQ ID NO: 3430781 - DNA, 21 bp, Homo sapiens
actagagggacctctcccagg

SEQ ID NO: 3430782 - DNA, 20 bp, Homo sapiens
actagatcaaggagcccaga

SEQ ID NO: 3430783 - DNA, 13 bp, Homo sapiens
actagcatatctg

SEQ ID NO: 3430784 - DNA, 16 bp, Homo sapiens
actagctctttgagat

SEQ ID NO: 3430785 - DNA, 18 bp, Homo sapiens
actaggagaaccaaatct

SEQ ID NO: 3430786 - DNA, 18 bp, Homo sapiens
actaggcccccacttgcc

SEQ ID NO: 3430787 - DNA, 18 bp, Homo sapiens
actagggagccatgtttc

SEQ ID NO: 3430788 - DNA, 22 bp, Homo sapiens
actagggagccatgtttcacaa

SEQ ID NO: 3430789 - DNA, 15 bp, Homo sapiens
actaggtaacttcat

SEQ ID NO: 3430790 - DNA, 18 bp, Homo sapiens
actaggtcaaaaatctgt

SEQ ID NO: 3430791 - DNA, 13 bp, Homo sapiens
actataaaagctt

SEQ ID NO: 3430792 - DNA, 13 bp, Homo sapiens
actataaagagaa

SEQ ID NO: 3430793 - DNA, 14 bp, Homo sapiens
actataaagagaag

SEQ ID NO: 3430794 - DNA, 18 bp, Homo sapiens
actataagaactttgagc

SEQ ID NO: 3430795 - DNA, 19 bp, Homo sapiens
actataagaactttgagct

SEQ ID NO: 3430796 - DNA, 18 bp, Homo sapiens
actatagcctaggtgaca

SEQ ID NO: 3430797 - DNA, 20 bp, Homo sapiens
actatagcctaggtgacaga

SEQ ID NO: 3430798 - DNA, 15 bp, Homo sapiens
actataggtccagaa

SEQ ID NO: 3430799 - DNA, 22 bp, Homo sapiens
actatatttgggcctgctccag

SEQ ID NO: 3430800 - DNA, 20 bp, Homo sapiens
actatcagcccaagatgctt

SEQ ID NO: 3430801 - DNA, 17 bp, Homo sapiens
actatgatctcaggagc

SEQ ID NO: 3430802 - DNA, 15 bp, Homo sapiens
actatgcagtgtgct

SEQ ID NO: 3430803 - DNA, 16 bp, Homo sapiens
actatgcctgtgtctt

SEQ ID NO: 3430804 - DNA, 18 bp, Homo sapiens
actatgcctgtgtcttct

SEQ ID NO: 3430805 - DNA, 14 bp, Homo sapiens
actatgtaacatgt

SEQ ID NO: 3430806 - DNA, 18 bp, Homo sapiens
actatgtaggtaaattct

SEQ ID NO: 3430807 - DNA, 19 bp, Homo sapiens
actatgttgcccaggcagg

SEQ ID NO: 3430808 - DNA, 23 bp, Homo sapiens
actatgttgcccaggcaggtctt

SEQ ID NO: 3430809 - DNA, 22 bp, Homo sapiens
actattaaaaaggtttacagaa

SEQ ID NO: 3430810 - DNA, 20 bp, Homo sapiens
actatttattgactctgggt

SEQ ID NO: 3430811 - DNA, 12 bp, Homo sapiens
actatttcttca

SEQ ID NO: 3430812 - DNA, 21 bp, Homo sapiens
actattttaatttgtattgaa

SEQ ID NO: 3430813 - DNA, 15 bp, Homo sapiens
actattttattctaa

SEQ ID NO: 3430814 - DNA, 16 bp, Homo sapiens
actattttcaaagaaa

SEQ ID NO: 3430815 - DNA, 20 bp, Homo sapiens
actcaaaacccatctgggct

SEQ ID NO: 3430816 - DNA, 13 bp, Homo sapiens
actcaaaagctgg

SEQ ID NO: 3430817 - DNA, 17 bp, Homo sapiens
actcaaactcttaaaac

SEQ ID NO: 3430818 - DNA, 17 bp, Homo sapiens
actcaaacttctggctc

SEQ ID NO: 3430819 - DNA, 22 bp, Homo sapiens
actcaaacttctggctccctct

SEQ ID NO: 3430820 - DNA, 19 bp, Homo sapiens
actcaaagtttcagagacc

SEQ ID NO: 3430821 - DNA, 23 bp, Homo sapiens
actcaaatgctcagaccagctct

SEQ ID NO: 3430822 - DNA, 23 bp, Homo sapiens
actcaaatggggccagatccagc

SEQ ID NO: 3430823 - DNA, 19 bp, Homo sapiens
actcaagaagcaggctaca

SEQ ID NO: 3430824 - DNA, 11 bp, Homo sapiens
actcaagccaa

SEQ ID NO: 3430825 - DNA, 17 bp, Homo sapiens
actcaagccaagcagcc

SEQ ID NO: 3430826 - DNA, 18 bp, Homo sapiens
actcaaggcggtgcttga

SEQ ID NO: 3430827 - DNA, 21 bp, Homo sapiens
actcacatttattctgctcac

SEQ ID NO: 3430828 - DNA, 12 bp, Homo sapiens
actcacctgggg

SEQ ID NO: 3430829 - DNA, 23 bp, Homo sapiens
actcacctggggctgctggcctg

SEQ ID NO: 3430830 - DNA, 17 bp, Homo sapiens
actcactaggcccccac

SEQ ID NO: 3430831 - DNA, 14 bp, Homo sapiens
actcagaaacatca

SEQ ID NO: 3430832 - DNA, 15 bp, Homo sapiens
actcagaaagccaac

SEQ ID NO: 3430833 - DNA, 12 bp, Homo sapiens
actcagaagcct

SEQ ID NO: 3430834 - DNA, 18 bp, Homo sapiens
actcagacattggcacct

SEQ ID NO: 3430835 - DNA, 19 bp, Homo sapiens
actcagatccagggacaga

SEQ ID NO: 3430836 - DNA, 21 bp, Homo sapiens
actcagatggaaccgcaggaa

SEQ ID NO: 3430837 - DNA, 23 bp, Homo sapiens
actcagatggaaccgcaggaagc

SEQ ID NO: 3430838 - DNA, 15 bp, Homo sapiens
actcagctccccaga

SEQ ID NO: 3430839 - DNA, 22 bp, Homo sapiens
actcagctcttggctccactgg

SEQ ID NO: 3430840 - DNA, 13 bp, Homo sapiens
actcaggaagaac

SEQ ID NO: 3430841 - DNA, 14 bp, Homo sapiens
actcaggctctcca

SEQ ID NO: 3430842 - DNA, 20 bp, Homo sapiens
actcagggcagcgccaggct

SEQ ID NO: 3430843 - DNA, 21 bp, Homo sapiens
actcagggcagcgccaggctg

SEQ ID NO: 3430844 - DNA, 15 bp, Homo sapiens
actcagttttaacta

SEQ ID NO: 3430845 - DNA, 18 bp, Homo sapiens
actcatagatgttatgca

SEQ ID NO: 3430846 - DNA, 16 bp, Homo sapiens
actcatcactgtggct

SEQ ID NO: 3430847 - DNA, 19 bp, Homo sapiens
actcatccctaatgctgca

SEQ ID NO: 3430848 - DNA, 14 bp, Homo sapiens
actcatgaggaggg

SEQ ID NO: 3430849 - DNA, 18 bp, Homo sapiens
actcatggccttgtctaa

SEQ ID NO: 3430850 - DNA, 15 bp, Homo sapiens
actcattccagatcc

SEQ ID NO: 3430851 - DNA, 15 bp, Homo sapiens
actcattctgaagga

SEQ ID NO: 3430852 - DNA, 19 bp, Homo sapiens
actcattctgaaggagccc

SEQ ID NO: 3430853 - DNA, 15 bp, Homo sapiens
actcattgctgagcc

SEQ ID NO: 3430854 - DNA, 19 bp, Homo sapiens
actccaacagaagaactgt

SEQ ID NO: 3430855 - DNA, 17 bp, Homo sapiens
actccaggcccaaggct

SEQ ID NO: 3430856 - DNA, 22 bp, Homo sapiens
actccagtatgacagaggagga

SEQ ID NO: 3430857 - DNA, 15 bp, Homo sapiens
actccagtcctgcca

SEQ ID NO: 3430858 - DNA, 21 bp, Homo sapiens
actccagtgccaacaatccta

SEQ ID NO: 3430859 - DNA, 18 bp, Homo sapiens
actggctttggcttcttg

SEQ ID NO: 3430860 - DNA, 23 bp, Homo sapiens
actgggaccaaccctggggaagg

SEQ ID NO: 3430861 - DNA, 22 bp, Homo sapiens
actgggatgggaggagaggaca

SEQ ID NO: 3430862 - DNA, 21 bp, Homo sapiens
actggggattgggtgggcagg

SEQ ID NO: 3430863 - DNA, 12 bp, Homo sapiens
actggggcctcc

SEQ ID NO: 3430864 - DNA, 18 bp, Homo sapiens
actgggtggtggcctggt

SEQ ID NO: 3430865 - DNA, 22 bp, Homo sapiens
actggtgcactttgtaaattcc

SEQ ID NO: 3430866 - DNA, 13 bp, Homo sapiens
actggtgccctcc

SEQ ID NO: 3430867 - DNA, 22 bp, Homo sapiens
actggtttctcagaatccaaag

SEQ ID NO: 3430868 - DNA, 23 bp, Homo sapiens
actggtttctcagaatccaaaga

SEQ ID NO: 3430869 - DNA, 17 bp, Homo sapiens
actgtaaaataataact

SEQ ID NO: 3430870 - DNA, 18 bp, Homo sapiens
actgtaaataaaaagaaa

SEQ ID NO: 3430871 - DNA, 20 bp, Homo sapiens
actgtaacactttacaatgt

SEQ ID NO: 3430872 - DNA, 20 bp, Homo sapiens
actgtaagaataatttatag

SEQ ID NO: 3430873 - DNA, 22 bp, Homo sapiens
actgtaagaataatttatagta

SEQ ID NO: 3430874 - DNA, 17 bp, Homo sapiens
actgtaattttatatga

SEQ ID NO: 3430875 - DNA, 11 bp, Homo sapiens
actgtacaata

SEQ ID NO: 3430876 - DNA, 18 bp, Homo sapiens
actgtacaataaaaacat

SEQ ID NO: 3430877 - DNA, 22 bp, Homo sapiens
actgtatctaggcaacatagta

SEQ ID NO: 3430878 - DNA, 14 bp, Homo sapiens
actgtatgtgatga

SEQ ID NO: 3430879 - DNA, 12 bp, Homo sapiens
actgtatgttat

SEQ ID NO: 3430880 - DNA, 23 bp, Homo sapiens
actgtcactcattgctgagcctc

SEQ ID NO: 3430881 - DNA, 14 bp, Homo sapiens
actgtcctgggcct

SEQ ID NO: 3430882 - DNA, 16 bp, Homo sapiens
actgtcctgggcctgc

SEQ ID NO: 3430883 - DNA, 21 bp, Homo sapiens
actgtctttttttccctacca

SEQ ID NO: 3430884 - DNA, 18 bp, Homo sapiens
actgtgaacagcttgctg

SEQ ID NO: 3430885 - DNA, 21 bp, Homo sapiens
actgtgacccccagctccggc

SEQ ID NO: 3430886 - DNA, 13 bp, Homo sapiens
actgtgatgaagc

SEQ ID NO: 3430887 - DNA, 18 bp, Homo sapiens
actgtgatgccctgccct

SEQ ID NO: 3430888 - DNA, 19 bp, Homo sapiens
actgtgcacatctgtgtct

SEQ ID NO: 3430889 - DNA, 20 bp, Homo sapiens
actgtgcacatctgtgtctt

SEQ ID NO: 3430890 - DNA, 17 bp, Homo sapiens
actgtgccatgtgccag

SEQ ID NO: 3430891 - DNA, 20 bp, Homo sapiens
actgtgggaaggccagctgc

SEQ ID NO: 3430892 - DNA, 22 bp, Homo sapiens
actgtggggtgtgcacatctct

SEQ ID NO: 3430893 - DNA, 15 bp, Homo sapiens
actgtgggtgtgtga

SEQ ID NO: 3430894 - DNA, 20 bp, Homo sapiens
actgtgggtgtgtgactctt

SEQ ID NO: 3430895 - DNA, 19 bp, Homo sapiens
actgtgtaaaatgtaatgc

SEQ ID NO: 3430896 - DNA, 23 bp, Homo sapiens
actgtgtacagtaaatggcttat

SEQ ID NO: 3430897 - DNA, 16 bp, Homo sapiens
actgtgtgtaattgtt

SEQ ID NO: 3430898 - DNA, 19 bp, Homo sapiens
actgtgtgttgccacagga

SEQ ID NO: 3430899 - DNA, 12 bp, Homo sapiens
actgtgttactg

SEQ ID NO: 3430900 - DNA, 19 bp, Homo sapiens
actgtgttactgctttgca

SEQ ID NO: 3430901 - DNA, 14 bp, Homo sapiens
actgtgtttcaagt

SEQ ID NO: 3430902 - DNA, 14 bp, Homo sapiens
actgtgtttttgcc

SEQ ID NO: 3430903 - DNA, 17 bp, Homo sapiens
actgttaatagttcagg

SEQ ID NO: 3430904 - DNA, 15 bp, Homo sapiens
actgttcaagagcac

SEQ ID NO: 3430905 - DNA, 16 bp, Homo sapiens
actgttcaagagcaca

SEQ ID NO: 3430906 - DNA, 16 bp, Homo sapiens
actgttccccctgtgc

SEQ ID NO: 3430907 - DNA, 22 bp, Homo sapiens
actgttctgggactccaggtct

SEQ ID NO: 3430908 - DNA, 13 bp, Homo sapiens
actgttcttgaat

SEQ ID NO: 3430909 - DNA, 13 bp, Homo sapiens
actgttgcccagg

SEQ ID NO: 3430910 - DNA, 14 bp, Homo sapiens
actgttgcccaggc

SEQ ID NO: 3430911 - DNA, 16 bp, Homo sapiens
actgttgtacaatcat

SEQ ID NO: 3430912 - DNA, 18 bp, Homo sapiens
actgttgtacaatcatgt

SEQ ID NO: 3430913 - DNA, 18 bp, Homo sapiens
actgtttaatgttctgtg

SEQ ID NO: 3430914 - DNA, 20 bp, Homo sapiens
actgtttaatgttctgtgat

SEQ ID NO: 3430915 - DNA, 16 bp, Homo sapiens
acttaacaaatacatt

SEQ ID NO: 3430916 - DNA, 19 bp, Homo sapiens
acttaacaaatacattcaa

SEQ ID NO: 3430917 - DNA, 20 bp, Homo sapiens
acttaacaaatacattcaaa

SEQ ID NO: 3430918 - DNA, 15 bp, Homo sapiens
acttaagagaatatt

SEQ ID NO: 3430919 - DNA, 15 bp, Homo sapiens
acttaagcaaaagaa

SEQ ID NO: 3430920 - DNA, 16 bp, Homo sapiens
acttaagcaaaagaaa

SEQ ID NO: 3430921 - DNA, 21 bp, Homo sapiens
acttaatactaccttgaaaat

SEQ ID NO: 3430922 - DNA, 13 bp, Homo sapiens
acttaatgaatga

SEQ ID NO: 3430923 - DNA, 21 bp, Homo sapiens
acttaattgctttcctgcctc

SEQ ID NO: 3430924 - DNA, 21 bp, Homo sapiens
acttacattctctaataagaa

SEQ ID NO: 3430925 - DNA, 23 bp, Homo sapiens
acttacattgttcaattagaata

SEQ ID NO: 3430926 - DNA, 16 bp, Homo sapiens
acttactgtaagacat

SEQ ID NO: 3430927 - DNA, 15 bp, Homo sapiens
acttacttgcttatt

SEQ ID NO: 3430928 - DNA, 16 bp, Homo sapiens
acttacttgcttattt

SEQ ID NO: 3430929 - DNA, 15 bp, Homo sapiens
acttaggtgtggggg

SEQ ID NO: 3430930 - DNA, 17 bp, Homo sapiens
acttagtagattaaaaa

SEQ ID NO: 3430931 - DNA, 17 bp, Homo sapiens
acttataattttcctaa

SEQ ID NO: 3430932 - DNA, 15 bp, Homo sapiens
acttatagttaatat

SEQ ID NO: 3430933 - DNA, 16 bp, Homo sapiens
acttatattaatagta

SEQ ID NO: 3430934 - DNA, 17 bp, Homo sapiens
acttatccctgcccatt

SEQ ID NO: 3430935 - DNA, 23 bp, Homo sapiens
acttatgacctcttcctttagga

SEQ ID NO: 3430936 - DNA, 16 bp, Homo sapiens
acttatgatttcatgt

SEQ ID NO: 3430937 - DNA, 21 bp, Homo sapiens
acttcagtatgttgtcaaaga

SEQ ID NO: 3430938 - DNA, 14 bp, Homo sapiens
acttcatggaccaa

SEQ ID NO: 3430939 - DNA, 15 bp, Homo sapiens
acttcattcttgaaa

SEQ ID NO: 3430940 - DNA, 19 bp, Homo sapiens
acttcattcttgaaagctg

SEQ ID NO: 3430941 - DNA, 14 bp, Homo sapiens
acttcattttcaga

SEQ ID NO: 3430942 - DNA, 18 bp, Homo sapiens
acttcattttcagagtga

SEQ ID NO: 3430943 - DNA, 19 bp, Homo sapiens
acttcattttcagagtgac

SEQ ID NO: 3430944 - DNA, 21 bp, Homo sapiens
acttccaaatcccctaagcag

SEQ ID NO: 3430945 - DNA, 20 bp, Homo sapiens
acttccatgccttaaaccta

SEQ ID NO: 3430946 - DNA, 17 bp, Homo sapiens
acttccatggccctcat

SEQ ID NO: 3430947 - DNA, 20 bp, Homo sapiens
acttccatggccctcattaa

SEQ ID NO: 3430948 - DNA, 13 bp, Homo sapiens
acttccattgttt

SEQ ID NO: 3430949 - DNA, 23 bp, Homo sapiens
acttcccagctaggaagagcagg

SEQ ID NO: 3430950 - DNA, 16 bp, Homo sapiens
acttcccctgcctcct

SEQ ID NO: 3430951 - DNA, 20 bp, Homo sapiens
acttcccgggccagggctgc

SEQ ID NO: 3430952 - DNA, 17 bp, Homo sapiens
acttccctaacacttac

SEQ ID NO: 3430953 - DNA, 20 bp, Homo sapiens
acttcgggaggtcgaggcag

SEQ ID NO: 3430954 - DNA, 20 bp, Homo sapiens
acttcggggtagaggctggg

SEQ ID NO: 3430955 - DNA, 23 bp, Homo sapiens
acttctacttctgcccttgccaa

SEQ ID NO: 3430956 - DNA, 19 bp, Homo sapiens
acttctgccatattctgtt

SEQ ID NO: 3430957 - DNA, 20 bp, Homo sapiens
acttctgccatattctgttg

SEQ ID NO: 3430958 - DNA, 12 bp, Homo sapiens
acttctgcctga

SEQ ID NO: 3430959 - DNA, 18 bp, Homo sapiens
acttctggctccctcttc

SEQ ID NO: 3430960 - DNA, 16 bp, Homo sapiens
acttctgggtggggca

SEQ ID NO: 3430961 - DNA, 19 bp, Homo sapiens
acttctgtaatttaaaagc

SEQ ID NO: 3430962 - DNA, 20 bp, Homo sapiens
acttcttgaaggtgctgacg

SEQ ID NO: 3430963 - DNA, 16 bp, Homo sapiens
acttctttgctttgcc

SEQ ID NO: 3430964 - DNA, 18 bp, Homo sapiens
acttctttgctttgccca

SEQ ID NO: 3430965 - DNA, 21 bp, Homo sapiens
acttctttgctttgcccagca

SEQ ID NO: 3430966 - DNA, 21 bp, Homo sapiens
acttgaaatctaatatttcta

SEQ ID NO: 3430967 - DNA, 16 bp, Homo sapiens
acttgaacttgcctct

SEQ ID NO: 3430968 - DNA, 12 bp, Homo sapiens
acttgaacttgt

SEQ ID NO: 3430969 - DNA, 14 bp, Homo sapiens
acttgaagggccag

SEQ ID NO: 3430970 - DNA, 20 bp, Homo sapiens
acttgaagggccagagccag

SEQ ID NO: 3430971 - DNA, 22 bp, Homo sapiens
acttgaagggccagagccaggg

SEQ ID NO: 3430972 - DNA, 20 bp, Homo sapiens
acttgaagttgttactaact

SEQ ID NO: 3430973 - DNA, 22 bp, Homo sapiens
acttgaagttgttactaactaa

SEQ ID NO: 3430974 - DNA, 14 bp, Homo sapiens
acttgaccctgagc

SEQ ID NO: 3430975 - DNA, 15 bp, Homo sapiens
acttgaccctgagct

SEQ ID NO: 3430976 - DNA, 23 bp, Homo sapiens
acttgcagactctacagaggcca

SEQ ID NO: 3430977 - DNA, 16 bp, Homo sapiens
acttgcagtgtctttc

SEQ ID NO: 3430978 - DNA, 22 bp, Homo sapiens
acttgccatgtgactctggctt

SEQ ID NO: 3430979 - DNA, 23 bp, Homo sapiens
acttgccgcgtcgccctcccagg

SEQ ID NO: 3430980 - DNA, 21 bp, Homo sapiens
acttgcctcttttacctgctg

SEQ ID NO: 3430981 - DNA, 22 bp, Homo sapiens
acttgcctcttttacctgctgc

SEQ ID NO: 3430982 - DNA, 20 bp, Homo sapiens
acttgctcaggtacttgtaa

SEQ ID NO: 3430983 - DNA, 13 bp, Homo sapiens
acttgctgctgtc

SEQ ID NO: 3430984 - DNA, 15 bp, Homo sapiens
acttgctgctgtctt

SEQ ID NO: 3430985 - DNA, 16 bp, Homo sapiens
acttgcttatttgaca

SEQ ID NO: 3430986 - DNA, 20 bp, Homo sapiens
acttggctcgaatctctgtg

SEQ ID NO: 3430987 - DNA, 21 bp, Homo sapiens
acttggctcgaatctctgtgc

SEQ ID NO: 3430988 - DNA, 23 bp, Homo sapiens
acttggctcgaatctctgtgcct

SEQ ID NO: 3430989 - DNA, 19 bp, Homo sapiens
acttgggaagaggacttcg

SEQ ID NO: 3430990 - DNA, 11 bp, Homo sapiens
agaaattttca

SEQ ID NO: 3430991 - DNA, 13 bp, Homo sapiens
agaaattttcaag

SEQ ID NO: 3430992 - DNA, 10 bp, Homo sapiens
agaacaaaaa

SEQ ID NO: 3430993 - DNA, 21 bp, Homo sapiens
agaacaaaaaaatctgcagaa

SEQ ID NO: 3430994 - DNA, 20 bp, Homo sapiens
agaacaaagtgagacagtcc

SEQ ID NO: 3430995 - DNA, 15 bp, Homo sapiens
agaacaatgtgctat

SEQ ID NO: 3430996 - DNA, 21 bp, Homo sapiens
agaacacagccgattcacctg

SEQ ID NO: 3430997 - DNA, 14 bp, Homo sapiens
agaacacgcgtatt

SEQ ID NO: 3430998 - DNA, 17 bp, Homo sapiens
agaacactgtgaaaaca

SEQ ID NO: 3430999 - DNA, 16 bp, Homo sapiens
agaacagatcttttac

SEQ ID NO: 3431000 - DNA, 11 bp, Homo sapiens
agaacaggact

SEQ ID NO: 3431001 - DNA, 12 bp, Homo sapiens
agaacaggacta

SEQ ID NO: 3431002 - DNA, 22 bp, Homo sapiens
agaacagggaaaataggcagga

SEQ ID NO: 3431003 - DNA, 21 bp, Homo sapiens
agaacagtgcttgccacagag

SEQ ID NO: 3431004 - DNA, 17 bp, Homo sapiens
agaacataaaggtaaaa

SEQ ID NO: 3431005 - DNA, 16 bp, Homo sapiens
agaacatgatgggcct

SEQ ID NO: 3431006 - DNA, 18 bp, Homo sapiens
agaacatgatgggcctga

SEQ ID NO: 3431007 - DNA, 21 bp, Homo sapiens
agaacatgcagtttgaaattc

SEQ ID NO: 3431008 - DNA, 21 bp, Homo sapiens
agaacattttactgttgtaca

SEQ ID NO: 3431009 - DNA, 18 bp, Homo sapiens
agaaccaaatctggaagc

SEQ ID NO: 3431010 - DNA, 19 bp, Homo sapiens
agaaccagtccccccaccc

SEQ ID NO: 3431011 - DNA, 16 bp, Homo sapiens
agaacccctctgcttt

SEQ ID NO: 3431012 - DNA, 23 bp, Homo sapiens
agaaccctgccatggaactgttt

SEQ ID NO: 3431013 - DNA, 21 bp, Homo sapiens
agaacctcacgcacctcccat

SEQ ID NO: 3431014 - DNA, 21 bp, Homo sapiens
agaacctgggttgcagacagg

SEQ ID NO: 3431015 - DNA, 14 bp, Homo sapiens
agaaccttctctat

SEQ ID NO: 3431016 - DNA, 18 bp, Homo sapiens
agaaccttctctatgggg

SEQ ID NO: 3431017 - DNA, 20 bp, Homo sapiens
agaacgttttttcctcagtg

SEQ ID NO: 3431018 - DNA, 16 bp, Homo sapiens
agaactaaactcattt

SEQ ID NO: 3431019 - DNA, 20 bp, Homo sapiens
agaactcaaacttctggctc

SEQ ID NO: 3431020 - DNA, 16 bp, Homo sapiens
agaactcactggggcc

SEQ ID NO: 3431021 - DNA, 23 bp, Homo sapiens
agaactcatccctaatgctgcag

SEQ ID NO: 3431022 - DNA, 14 bp, Homo sapiens
agaactcctagggt

SEQ ID NO: 3431023 - DNA, 15 bp, Homo sapiens
agaactgcatatgtt

SEQ ID NO: 3431024 - DNA, 20 bp, Homo sapiens
agaactgcatatgtttcgct

SEQ ID NO: 3431025 - DNA, 21 bp, Homo sapiens
agaactgcatatgtttcgctg

SEQ ID NO: 3431026 - DNA, 15 bp, Homo sapiens
agaactgctaccttc

SEQ ID NO: 3431027 - DNA, 22 bp, Homo sapiens
agaactgtcatgtaaacatacc

SEQ ID NO: 3431028 - DNA, 16 bp, Homo sapiens
agaactgtgccacaat

SEQ ID NO: 3431029 - DNA, 15 bp, Homo sapiens
agaacttgaccctga

SEQ ID NO: 3431030 - DNA, 14 bp, Homo sapiens
agaacttgcagtgt

SEQ ID NO: 3431031 - DNA, 16 bp, Homo sapiens
agaacttgctgctgtc

SEQ ID NO: 3431032 - DNA, 15 bp, Homo sapiens
agaactttcattttt

SEQ ID NO: 3431033 - DNA, 13 bp, Homo sapiens
agaagacactgat

SEQ ID NO: 3431034 - DNA, 21 bp, Homo sapiens
agaagacactgatgggcaacc

SEQ ID NO: 3431035 - DNA, 19 bp, Homo sapiens
agaagagaggaaataacag

SEQ ID NO: 3431036 - DNA, 22 bp, Homo sapiens
agaagattgttggtgaattttc

SEQ ID NO: 3431037 - DNA, 15 bp, Homo sapiens
agaagcaagaaagaa

SEQ ID NO: 3431038 - DNA, 15 bp, Homo sapiens
agaagcatacaactt

SEQ ID NO: 3431039 - DNA, 19 bp, Homo sapiens
agaagccacaggcctgaga

SEQ ID NO: 3431040 - DNA, 13 bp, Homo sapiens
agaagccaggaat

SEQ ID NO: 3431041 - DNA, 22 bp, Homo sapiens
agaagccaggaatttcccagga

SEQ ID NO: 3431042 - DNA, 21 bp, Homo sapiens
agaagcccaatattataattt

SEQ ID NO: 3431043 - DNA, 20 bp, Homo sapiens
agaagcccgtgtgagaagtg

SEQ ID NO: 3431044 - DNA, 22 bp, Homo sapiens
agaagcctctgggtcagtggtc

SEQ ID NO: 3431045 - DNA, 21 bp, Homo sapiens
agaagccttctttttctgaga

SEQ ID NO: 3431046 - DNA, 16 bp, Homo sapiens
agaagcggctggcagc

SEQ ID NO: 3431047 - DNA, 20 bp, Homo sapiens
agaagctataaattcctctt

SEQ ID NO: 3431048 - DNA, 22 bp, Homo sapiens
agaagctcctctccccagccca

SEQ ID NO: 3431049 - DNA, 18 bp, Homo sapiens
agaagcttccattccaag

SEQ ID NO: 3431050 - DNA, 16 bp, Homo sapiens
agaaggatgtacattt

SEQ ID NO: 3431051 - DNA, 11 bp, Homo sapiens
agaaggcaaaa

SEQ ID NO: 3431052 - DNA, 15 bp, Homo sapiens
agaaggcaaaaatgt

SEQ ID NO: 3431053 - DNA, 16 bp, Homo sapiens
agaaggccgctgcccc

SEQ ID NO: 3431054 - DNA, 22 bp, Homo sapiens
agaaggccgctgccccagcccc

SEQ ID NO: 3431055 - DNA, 15 bp, Homo sapiens
agaagggctgcatga

SEQ ID NO: 3431056 - DNA, 15 bp, Homo sapiens
agaaggtgcctgcca

SEQ ID NO: 3431057 - DNA, 17 bp, Homo sapiens
agaaggttgacacagtt

SEQ ID NO: 3431058 - DNA, 16 bp, Homo sapiens
agaagtagccacagta

SEQ ID NO: 3431059 - DNA, 22 bp, Homo sapiens
agaagtccaagcaacagccttt

SEQ ID NO: 3431060 - DNA, 19 bp, Homo sapiens
agaagtcctgtatgtctgt

SEQ ID NO: 3431061 - DNA, 16 bp, Homo sapiens
agaagtgaatgctggg

SEQ ID NO: 3431062 - DNA, 19 bp, Homo sapiens
agaagtgaatgctgggact

SEQ ID NO: 3431063 - DNA, 11 bp, Homo sapiens
agaagtgccat

SEQ ID NO: 3431064 - DNA, 19 bp, Homo sapiens
agaagttaagcaacatcta

SEQ ID NO: 3431065 - DNA, 13 bp, Homo sapiens
agaagttaccaaa

SEQ ID NO: 3431066 - DNA, 19 bp, Homo sapiens
agaagttgatatagaacag

SEQ ID NO: 3431067 - DNA, 19 bp, Homo sapiens
agaagtttcagttgtcctt

SEQ ID NO: 3431068 - DNA, 13 bp, Homo sapiens
agaataaaatgtt

SEQ ID NO: 3431069 - DNA, 16 bp, Homo sapiens
agaataaaatgttgaa

SEQ ID NO: 3431070 - DNA, 17 bp, Homo sapiens
agaataacctttcagaa

SEQ ID NO: 3431071 - DNA, 13 bp, Homo sapiens
agaataagtgtct

SEQ ID NO: 3431072 - DNA, 17 bp, Homo sapiens
agaataatttatagtaa

SEQ ID NO: 3431073 - DNA, 15 bp, Homo sapiens
agaatacaagatatt

SEQ ID NO: 3431074 - DNA, 16 bp, Homo sapiens
agaatacagctttctg

SEQ ID NO: 3431075 - DNA, 20 bp, Homo sapiens
agaatactgttaaaggaaaa

SEQ ID NO: 3431076 - DNA, 15 bp, Homo sapiens
agaatacttgaactt

SEQ ID NO: 3431077 - DNA, 16 bp, Homo sapiens
agaatacttgaacttg

SEQ ID NO: 3431078 - DNA, 22 bp, Homo sapiens
agaatagaaataaaggatgtga

SEQ ID NO: 3431079 - DNA, 13 bp, Homo sapiens
agaatagcatctg

SEQ ID NO: 3431080 - DNA, 18 bp, Homo sapiens
agaatagcatctgtacaa

SEQ ID NO: 3431081 - DNA, 20 bp, Homo sapiens
agaatagccacatttggaat

SEQ ID NO: 3431082 - DNA, 13 bp, Homo sapiens
agaatataatact

SEQ ID NO: 3431083 - DNA, 16 bp, Homo sapiens
agaatatgacttttta

SEQ ID NO: 3431084 - DNA, 13 bp, Homo sapiens
agaatatgtctgc

SEQ ID NO: 3431085 - DNA, 19 bp, Homo sapiens
agaatattagctttactgt

SEQ ID NO: 3431086 - DNA, 23 bp, Homo sapiens
agaatattagctttactgtttgt

SEQ ID NO: 3431087 - DNA, 14 bp, Homo sapiens
agaatattcagaca

SEQ ID NO: 3431088 - DNA, 23 bp, Homo sapiens
agaatattcagacaaaatggata

SEQ ID NO: 3431089 - DNA, 22 bp, Homo sapiens
agaatatttattacctctgata

SEQ ID NO: 3431090 - DNA, 17 bp, Homo sapiens
agaatatttctattgaa

SEQ ID NO: 3431091 - DNA, 14 bp, Homo sapiens
agaatattttaagt

SEQ ID NO: 3431092 - DNA, 19 bp, Homo sapiens
agaatattttaagtattgc

SEQ ID NO: 3431093 - DNA, 17 bp, Homo sapiens
agaatcagatcatttca

SEQ ID NO: 3431094 - DNA, 21 bp, Homo sapiens
agaatccaaacttggattttt

SEQ ID NO: 3431095 - DNA, 17 bp, Homo sapiens
agaatccaaagatcaca

SEQ ID NO: 3431096 - DNA, 20 bp, Homo sapiens
agaatccacgtattcccctt

SEQ ID NO: 3431097 - DNA, 19 bp, Homo sapiens
agaatcccaaatttgattg

SEQ ID NO: 3431098 - DNA, 13 bp, Homo sapiens
agaatctcattac

SEQ ID NO: 3431099 - DNA, 22 bp, Homo sapiens
agaatctcattactgcttcatt

SEQ ID NO: 3431100 - DNA, 19 bp, Homo sapiens
agaatctgtttcccagcag

SEQ ID NO: 3431101 - DNA, 20 bp, Homo sapiens
agaatcttggtttgccttcc

SEQ ID NO: 3431102 - DNA, 17 bp, Homo sapiens
agaatctttattgagaa

SEQ ID NO: 3431103 - DNA, 24 bp, Homo sapiens
agaatctttattgagaaagagcac

SEQ ID NO: 3431104 - DNA, 17 bp, Homo sapiens
agaatgaaatgtatgtg

SEQ ID NO: 3431105 - DNA, 20 bp, Homo sapiens
agaatgagagcgacacagac

SEQ ID NO: 3431106 - DNA, 15 bp, Homo sapiens
agaatgagctggttt

SEQ ID NO: 3431107 - DNA, 22 bp, Homo sapiens
agaatgctgcaggacttgagaa

SEQ ID NO: 3431108 - DNA, 15 bp, Homo sapiens
agaatgctgtacatc

SEQ ID NO: 3431109 - DNA, 13 bp, Homo sapiens
agaatggaaaaga

SEQ ID NO: 3431110 - DNA, 12 bp, Homo sapiens
agaatgtctcca

SEQ ID NO: 3431111 - DNA, 22 bp, Homo sapiens
agaatgtctccatacgcgttct

SEQ ID NO: 3431112 - DNA, 13 bp, Homo sapiens
agaatgttccaga

SEQ ID NO: 3431113 - DNA, 16 bp, Homo sapiens
agaattagctgcttct

SEQ ID NO: 3431114 - DNA, 11 bp, Homo sapiens
agaattagctt

SEQ ID NO: 3431115 - DNA, 16 bp, Homo sapiens
agaattagctttttca

SEQ ID NO: 3431116 - DNA, 18 bp, Homo sapiens
agaattcagaagacccct

SEQ ID NO: 3431117 - DNA, 12 bp, Homo sapiens
agaattccttcg

SEQ ID NO: 3431118 - DNA, 13 bp, Homo sapiens
agaattccttcga

SEQ ID NO: 3431119 - DNA, 16 bp, Homo sapiens
agaattcttacatgtt

SEQ ID NO: 3431120 - DNA, 19 bp, Homo sapiens
agaattcttacatgttttc

SEQ ID NO: 3431121 - DNA, 20 bp, Homo sapiens
agaattcttacatgttttct

SEQ ID NO: 3431122 - DNA, 19 bp, Homo sapiens
agagcccggagctccggcc

SEQ ID NO: 3431123 - DNA, 17 bp, Homo sapiens
agagcctcttggggaag

SEQ ID NO: 3431124 - DNA, 14 bp, Homo sapiens
agagcctgagggat

SEQ ID NO: 3431125 - DNA, 22 bp, Homo sapiens
agagcctgtctttcagcattca

SEQ ID NO: 3431126 - DNA, 21 bp, Homo sapiens
agagccttgcggaaggttcta

SEQ ID NO: 3431127 - DNA, 15 bp, Homo sapiens
agagccttgggagcc

SEQ ID NO: 3431128 - DNA, 13 bp, Homo sapiens
agagcgacacaga

SEQ ID NO: 3431129 - DNA, 20 bp, Homo sapiens
agagcgcctgcccctcccag

SEQ ID NO: 3431130 - DNA, 13 bp, Homo sapiens
agagctcagacat

SEQ ID NO: 3431131 - DNA, 21 bp, Homo sapiens
agagctctggtgataaggaca

SEQ ID NO: 3431132 - DNA, 23 bp, Homo sapiens
agagctgacacaaacctgcctgg

SEQ ID NO: 3431133 - DNA, 19 bp, Homo sapiens
agagctggagcctggtgcc

SEQ ID NO: 3431134 - DNA, 15 bp, Homo sapiens
agagcttataaaatt

SEQ ID NO: 3431135 - DNA, 12 bp, Homo sapiens
agagcttccctg

SEQ ID NO: 3431136 - DNA, 16 bp, Homo sapiens
agagcttccctgactc

SEQ ID NO: 3431137 - DNA, 17 bp, Homo sapiens
agagcttccctgactca

SEQ ID NO: 3431138 - DNA, 15 bp, Homo sapiens
agagcttcttccagg

SEQ ID NO: 3431139 - DNA, 13 bp, Homo sapiens
agagcttggactg

SEQ ID NO: 3431140 - DNA, 14 bp, Homo sapiens
agagcttttcagat

SEQ ID NO: 3431141 - DNA, 17 bp, Homo sapiens
agagcttttttataaca

SEQ ID NO: 3431142 - DNA, 13 bp, Homo sapiens
agaggaaaaatat

SEQ ID NO: 3431143 - DNA, 17 bp, Homo sapiens
agaggaaataacagaga

SEQ ID NO: 3431144 - DNA, 19 bp, Homo sapiens
agaggaaataacagagaga

SEQ ID NO: 3431145 - DNA, 16 bp, Homo sapiens
agaggaaggagaggag

SEQ ID NO: 3431146 - DNA, 15 bp, Homo sapiens
agaggaagttcagat

SEQ ID NO: 3431147 - DNA, 16 bp, Homo sapiens
agaggacaagggaaat

SEQ ID NO: 3431148 - DNA, 15 bp, Homo sapiens
agaggaccagtgagt

SEQ ID NO: 3431149 - DNA, 22 bp, Homo sapiens
agaggactgtagggagggcggc

SEQ ID NO: 3431150 - DNA, 23 bp, Homo sapiens
agaggagggcagcagaagggggt

SEQ ID NO: 3431151 - DNA, 20 bp, Homo sapiens
agaggaggggccgctgccac

SEQ ID NO: 3431152 - DNA, 23 bp, Homo sapiens
agaggcagccccattctgcctgc

SEQ ID NO: 3431153 - DNA, 13 bp, Homo sapiens
agaggccagaggc

SEQ ID NO: 3431154 - DNA, 12 bp, Homo sapiens
agaggccccagc

SEQ ID NO: 3431155 - DNA, 16 bp, Homo sapiens
agaggcccccagccca

SEQ ID NO: 3431156 - DNA, 17 bp, Homo sapiens
agaggcccccagcccag

SEQ ID NO: 3431157 - DNA, 14 bp, Homo sapiens
agaggccctcgctg

SEQ ID NO: 3431158 - DNA, 20 bp, Homo sapiens
agaggcctgcctccagggct

SEQ ID NO: 3431159 - DNA, 21 bp, Homo sapiens
agaggcctgggggacccctgg

SEQ ID NO: 3431160 - DNA, 22 bp, Homo sapiens
agaggcctgggggacccctggc

SEQ ID NO: 3431161 - DNA, 16 bp, Homo sapiens
agaggctgaggctggc

SEQ ID NO: 3431162 - DNA, 19 bp, Homo sapiens
agaggctgaggctggcaca

SEQ ID NO: 3431163 - DNA, 21 bp, Homo sapiens
agaggctgaggctggcacagg

SEQ ID NO: 3431164 - DNA, 10 bp, Homo sapiens
agaggctgca

SEQ ID NO: 3431165 - DNA, 14 bp, Homo sapiens
agaggctgggagga

SEQ ID NO: 3431166 - DNA, 15 bp, Homo sapiens
agagggacctctccc

SEQ ID NO: 3431167 - DNA, 16 bp, Homo sapiens
agagggacctctccca

SEQ ID NO: 3431168 - DNA, 20 bp, Homo sapiens
agagggaggggcctaggcct

SEQ ID NO: 3431169 - DNA, 15 bp, Homo sapiens
agagggagtgacaga

SEQ ID NO: 3431170 - DNA, 20 bp, Homo sapiens
agagggagtgacagaggcag

SEQ ID NO: 3431171 - DNA, 12 bp, Homo sapiens
agagggctggag

SEQ ID NO: 3431172 - DNA, 18 bp, Homo sapiens
agagggctggaggcccag

SEQ ID NO: 3431173 - DNA, 17 bp, Homo sapiens
agagggctttaattttt

SEQ ID NO: 3431174 - DNA, 22 bp, Homo sapiens
agaggggaacagactggaagca

SEQ ID NO: 3431175 - DNA, 16 bp, Homo sapiens
agaggggacgcaggcc

SEQ ID NO: 3431176 - DNA, 20 bp, Homo sapiens
agaggggacgcaggcccctc

SEQ ID NO: 3431177 - DNA, 22 bp, Homo sapiens
agagggtggtgacctctgcctg

SEQ ID NO: 3431178 - DNA, 21 bp, Homo sapiens
agaggtgggccagtctgtgga

SEQ ID NO: 3431179 - DNA, 20 bp, Homo sapiens
agaggttatctgtcccaggt

SEQ ID NO: 3431180 - DNA, 19 bp, Homo sapiens
agagtaatgccaccagatc

SEQ ID NO: 3431181 - DNA, 21 bp, Homo sapiens
agagtagaataacctttcaga

SEQ ID NO: 3431182 - DNA, 18 bp, Homo sapiens
agagtagaattgcattga

SEQ ID NO: 3431183 - DNA, 13 bp, Homo sapiens
agagtatatgcac

SEQ ID NO: 3431184 - DNA, 13 bp, Homo sapiens
agagtatggagct

SEQ ID NO: 3431185 - DNA, 20 bp, Homo sapiens
agagtctcactgttgcccag

SEQ ID NO: 3431186 - DNA, 16 bp, Homo sapiens
agagtctgaacctatt

SEQ ID NO: 3431187 - DNA, 13 bp, Homo sapiens
agagtctggccct

SEQ ID NO: 3431188 - DNA, 16 bp, Homo sapiens
agagtgactctccagg

SEQ ID NO: 3431189 - DNA, 15 bp, Homo sapiens
agagtgagactctgt

SEQ ID NO: 3431190 - DNA, 17 bp, Homo sapiens
agagtgataatacaagt

SEQ ID NO: 3431191 - DNA, 22 bp, Homo sapiens
agagtgatagtcttttgctttt

SEQ ID NO: 3431192 - DNA, 22 bp, Homo sapiens
agagtgtcttcacggcaggaca

SEQ ID NO: 3431193 - DNA, 15 bp, Homo sapiens
agagtgtctttccac

SEQ ID NO: 3431194 - DNA, 17 bp, Homo sapiens
agagtgtggccttcgga

SEQ ID NO: 3431195 - DNA, 14 bp, Homo sapiens
agagttagactgtt

SEQ ID NO: 3431196 - DNA, 13 bp, Homo sapiens
agagttgagctct

SEQ ID NO: 3431197 - DNA, 20 bp, Homo sapiens
agagttgtaaatatataaat

SEQ ID NO: 3431198 - DNA, 21 bp, Homo sapiens
agagttgtaaatatataaata

SEQ ID NO: 3431199 - DNA, 22 bp, Homo sapiens
agagttgtaaatatataaatat

SEQ ID NO: 3431200 - DNA, 13 bp, Homo sapiens
agataaattataa

SEQ ID NO: 3431201 - DNA, 21 bp, Homo sapiens
agataagatttctgtctacta

SEQ ID NO: 3431202 - DNA, 18 bp, Homo sapiens
agataaggtaaaatgcca

SEQ ID NO: 3431203 - DNA, 15 bp, Homo sapiens
agataatatgagaat

SEQ ID NO: 3431204 - DNA, 22 bp, Homo sapiens
agataatattaaggaagacaat

SEQ ID NO: 3431205 - DNA, 12 bp, Homo sapiens
agataatgtgaa

SEQ ID NO: 3431206 - DNA, 18 bp, Homo sapiens
agataatgtgaaaatggt

SEQ ID NO: 3431207 - DNA, 14 bp, Homo sapiens
agatacatacagaa

SEQ ID NO: 3431208 - DNA, 15 bp, Homo sapiens
agatacatacagaat

SEQ ID NO: 3431209 - DNA, 21 bp, Homo sapiens
agataccagcgaggaggctcc

SEQ ID NO: 3431210 - DNA, 23 bp, Homo sapiens
agataccagcgaggaggctccag

SEQ ID NO: 3431211 - DNA, 14 bp, Homo sapiens
agatagcctgtggc

SEQ ID NO: 3431212 - DNA, 17 bp, Homo sapiens
agatagcctgtggccct

SEQ ID NO: 3431213 - DNA, 21 bp, Homo sapiens
agataggtcagtgcaaatact

SEQ ID NO: 3431214 - DNA, 17 bp, Homo sapiens
agatagtcatgctgcta

SEQ ID NO: 3431215 - DNA, 15 bp, Homo sapiens
agatataagtgctgt

SEQ ID NO: 3431216 - DNA, 18 bp, Homo sapiens
agatataagtgctgtata

SEQ ID NO: 3431217 - DNA, 21 bp, Homo sapiens
agatataagtgctgtataaaa

SEQ ID NO: 3431218 - DNA, 22 bp, Homo sapiens
agatataagtgctgtataaaat

SEQ ID NO: 3431219 - DNA, 20 bp, Homo sapiens
agatatattaaaaatataaa

SEQ ID NO: 3431220 - DNA, 16 bp, Homo sapiens
agatatcgacttgttt

SEQ ID NO: 3431221 - DNA, 20 bp, Homo sapiens
agatatcttcagtttaatgc

SEQ ID NO: 3431222 - DNA, 16 bp, Homo sapiens
agatatgggaacactg

SEQ ID NO: 3431223 - DNA, 16 bp, Homo sapiens
agatattatgtataaa

SEQ ID NO: 3431224 - DNA, 19 bp, Homo sapiens
agatattatgtataaaatg

SEQ ID NO: 3431225 - DNA, 16 bp, Homo sapiens
agatattggacaaaga

SEQ ID NO: 3431226 - DNA, 12 bp, Homo sapiens
agatattttcca

SEQ ID NO: 3431227 - DNA, 19 bp, Homo sapiens
agatattttccatatattg

SEQ ID NO: 3431228 - DNA, 20 bp, Homo sapiens
agatattttccatatattgg

SEQ ID NO: 3431229 - DNA, 22 bp, Homo sapiens
agatattttccatatattggca

SEQ ID NO: 3431230 - DNA, 17 bp, Homo sapiens
agatcacatattctagt

SEQ ID NO: 3431231 - DNA, 16 bp, Homo sapiens
agatcacgccactgca

SEQ ID NO: 3431232 - DNA, 13 bp, Homo sapiens
agatcagactctc

SEQ ID NO: 3431233 - DNA, 15 bp, Homo sapiens
agatcagactctcct

SEQ ID NO: 3431234 - DNA, 13 bp, Homo sapiens
agatcagcctggg

SEQ ID NO: 3431235 - DNA, 23 bp, Homo sapiens
agatcatttctaggcaaaattgt

SEQ ID NO: 3431236 - DNA, 23 bp, Homo sapiens
agatccaaaagaagcccccagct

SEQ ID NO: 3431237 - DNA, 12 bp, Homo sapiens
agatccaggact

SEQ ID NO: 3431238 - DNA, 22 bp, Homo sapiens
agatcccaagtagaatctcagt

SEQ ID NO: 3431239 - DNA, 14 bp, Homo sapiens
agatcctctctggg

SEQ ID NO: 3431240 - DNA, 17 bp, Homo sapiens
agatcctcttctcaaag

SEQ ID NO: 3431241 - DNA, 20 bp, Homo sapiens
agatcctcttctcaaagctg

SEQ ID NO: 3431242 - DNA, 17 bp, Homo sapiens
agatcctgcgggtgggg

SEQ ID NO: 3431243 - DNA, 18 bp, Homo sapiens
agatcctgcgggtggggc

SEQ ID NO: 3431244 - DNA, 13 bp, Homo sapiens
agatcctgtgagg

SEQ ID NO: 3431245 - DNA, 15 bp, Homo sapiens
agatcgcatttccta

SEQ ID NO: 3431246 - DNA, 16 bp, Homo sapiens
agatctcactctgccc

SEQ ID NO: 3431247 - DNA, 16 bp, Homo sapiens
agatctcggtttgcca

SEQ ID NO: 3431248 - DNA, 23 bp, Homo sapiens
agatctgacatgattccttcctg

SEQ ID NO: 3431249 - DNA, 15 bp, Homo sapiens
agatctgtcctcagc

SEQ ID NO: 3431250 - DNA, 17 bp, Homo sapiens
agatctgtcctcagcct

SEQ ID NO: 3431251 - DNA, 18 bp, Homo sapiens
agatctgtcctcagcctt

SEQ ID NO: 3431252 - DNA, 12 bp, Homo sapiens
agatctgtcttg

SEQ ID NO: 3431253 - DNA, 20 bp, Homo sapiens
agatgaaatcttacagctgg

SEQ ID NO: 3431254 - DNA, 20 bp, Homo sapiens
agcagcctcagaacaaagtg

SEQ ID NO: 3431255 - DNA, 15 bp, Homo sapiens
agcagcctctcccca

SEQ ID NO: 3431256 - DNA, 12 bp, Homo sapiens
agcagctgctac

SEQ ID NO: 3431257 - DNA, 21 bp, Homo sapiens
agcaggaaatgaaaatgtctt

SEQ ID NO: 3431258 - DNA, 13 bp, Homo sapiens
agcaggacctctg

SEQ ID NO: 3431259 - DNA, 22 bp, Homo sapiens
agcaggacctctgaaaccctgg

SEQ ID NO: 3431260 - DNA, 18 bp, Homo sapiens
agcaggactccaggccca

SEQ ID NO: 3431261 - DNA, 15 bp, Homo sapiens
agcaggaggccaggc

SEQ ID NO: 3431262 - DNA, 19 bp, Homo sapiens
agcaggatcgaagggtttt

SEQ ID NO: 3431263 - DNA, 14 bp, Homo sapiens
agcaggcacaggac

SEQ ID NO: 3431264 - DNA, 15 bp, Homo sapiens
agcaggcacaggaca

SEQ ID NO: 3431265 - DNA, 21 bp, Homo sapiens
agcaggcgttcagctcactgt

SEQ ID NO: 3431266 - DNA, 16 bp, Homo sapiens
agcaggctacactgac

SEQ ID NO: 3431267 - DNA, 22 bp, Homo sapiens
agcaggctacactgacactggt

SEQ ID NO: 3431268 - DNA, 21 bp, Homo sapiens
agcagggaaaatgcagcaggg

SEQ ID NO: 3431269 - DNA, 15 bp, Homo sapiens
agcagggaaacagct

SEQ ID NO: 3431270 - DNA, 22 bp, Homo sapiens
agcagggatgccctggaggtgg

SEQ ID NO: 3431271 - DNA, 24 bp, Homo sapiens
agcagggatgccctggaggtggct

SEQ ID NO: 3431272 - DNA, 23 bp, Homo sapiens
agcagggctaccctgagctgagg

SEQ ID NO: 3431273 - DNA, 13 bp, Homo sapiens
agcagggctcagc

SEQ ID NO: 3431274 - DNA, 15 bp, Homo sapiens
agcagggctcagcgg

SEQ ID NO: 3431275 - DNA, 21 bp, Homo sapiens
agcagggggacctaggctcct

SEQ ID NO: 3431276 - DNA, 17 bp, Homo sapiens
agcagggtctgggcagg

SEQ ID NO: 3431277 - DNA, 18 bp, Homo sapiens
agcaggtagcctgctggt

SEQ ID NO: 3431278 - DNA, 13 bp, Homo sapiens
agcaggtgctgac

SEQ ID NO: 3431279 - DNA, 17 bp, Homo sapiens
agcaggttcccaagctc

SEQ ID NO: 3431280 - DNA, 18 bp, Homo sapiens
agcaggttcccaagctca

SEQ ID NO: 3431281 - DNA, 19 bp, Homo sapiens
agcagtcctgcctcagcct

SEQ ID NO: 3431282 - DNA, 19 bp, Homo sapiens
agcagtcgtgcctgtgtcc

SEQ ID NO: 3431283 - DNA, 15 bp, Homo sapiens
agcagtctctgcctt

SEQ ID NO: 3431284 - DNA, 22 bp, Homo sapiens
agcagtgaatgattcagtgtta

SEQ ID NO: 3431285 - DNA, 12 bp, Homo sapiens
agcagttctgat

SEQ ID NO: 3431286 - DNA, 18 bp, Homo sapiens
agcagtttctgtcctgct

SEQ ID NO: 3431287 - DNA, 19 bp, Homo sapiens
agcagtttctgtcctgctg

SEQ ID NO: 3431288 - DNA, 17 bp, Homo sapiens
agcagttttcaagtcaa

SEQ ID NO: 3431289 - DNA, 22 bp, Homo sapiens
agcagttttcaagtcaaattaa

SEQ ID NO: 3431290 - DNA, 13 bp, Homo sapiens
agcataaaaacat

SEQ ID NO: 3431291 - DNA, 17 bp, Homo sapiens
agcatactttgtaaata

SEQ ID NO: 3431292 - DNA, 14 bp, Homo sapiens
agcatcacagaatg

SEQ ID NO: 3431293 - DNA, 22 bp, Homo sapiens
agcatcccaggatcgcaagagc

SEQ ID NO: 3431294 - DNA, 23 bp, Homo sapiens
agcatcccttgaccaggcctggg

SEQ ID NO: 3431295 - DNA, 22 bp, Homo sapiens
agcatcctggcacccggcccct

SEQ ID NO: 3431296 - DNA, 15 bp, Homo sapiens
agcatcggcctaggg

SEQ ID NO: 3431297 - DNA, 17 bp, Homo sapiens
agcatctgcattgccca

SEQ ID NO: 3431298 - DNA, 19 bp, Homo sapiens
agcatcttgggggggtggc

SEQ ID NO: 3431299 - DNA, 15 bp, Homo sapiens
agcatctttcatatg

SEQ ID NO: 3431300 - DNA, 20 bp, Homo sapiens
agcatgacagcctgcagcag

SEQ ID NO: 3431301 - DNA, 15 bp, Homo sapiens
agcatgacatttctt

SEQ ID NO: 3431302 - DNA, 21 bp, Homo sapiens
agcatgctgtgattgtgccta

SEQ ID NO: 3431303 - DNA, 17 bp, Homo sapiens
agcatggtcacaagcac

SEQ ID NO: 3431304 - DNA, 20 bp, Homo sapiens
agcatgttgtgatgtacaca

SEQ ID NO: 3431305 - DNA, 20 bp, Homo sapiens
agcattagatagtcatgctg

SEQ ID NO: 3431306 - DNA, 16 bp, Homo sapiens
agcattccagcccctc

SEQ ID NO: 3431307 - DNA, 20 bp, Homo sapiens
agcattccagcccctctggt

SEQ ID NO: 3431308 - DNA, 19 bp, Homo sapiens
agcattcgagacagaacct

SEQ ID NO: 3431309 - DNA, 19 bp, Homo sapiens
agcattctcaggcaccagt

SEQ ID NO: 3431310 - DNA, 15 bp, Homo sapiens
agcattgctggactc

SEQ ID NO: 3431311 - DNA, 14 bp, Homo sapiens
agcatttaggaatg

SEQ ID NO: 3431312 - DNA, 12 bp, Homo sapiens
agcatttgaatg

SEQ ID NO: 3431313 - DNA, 14 bp, Homo sapiens
agcatttgaatgca

SEQ ID NO: 3431314 - DNA, 15 bp, Homo sapiens
agcatttgaatgcat

SEQ ID NO: 3431315 - DNA, 16 bp, Homo sapiens
agcatttgaatgcatt

SEQ ID NO: 3431316 - DNA, 17 bp, Homo sapiens
agcatttgattaacatt

SEQ ID NO: 3431317 - DNA, 15 bp, Homo sapiens
agcattttgctaaat

SEQ ID NO: 3431318 - DNA, 19 bp, Homo sapiens
agcattttttatgatatca

SEQ ID NO: 3431319 - DNA, 22 bp, Homo sapiens
agccaaaatgtaggcttagttt

SEQ ID NO: 3431320 - DNA, 16 bp, Homo sapiens
agccaaaccctgtctg

SEQ ID NO: 3431321 - DNA, 11 bp, Homo sapiens
agccaaagagt

SEQ ID NO: 3431322 - DNA, 12 bp, Homo sapiens
agccaaagccaa

SEQ ID NO: 3431323 - DNA, 23 bp, Homo sapiens
agccaaagctaggcctggccaga

SEQ ID NO: 3431324 - DNA, 15 bp, Homo sapiens
agccaaatggtttaa

SEQ ID NO: 3431325 - DNA, 17 bp, Homo sapiens
agccaactagcccctgg

SEQ ID NO: 3431326 - DNA, 15 bp, Homo sapiens
agccaacttttgcat

SEQ ID NO: 3431327 - DNA, 23 bp, Homo sapiens
agccaagctccttgggaggcccc

SEQ ID NO: 3431328 - DNA, 20 bp, Homo sapiens
agccaagcttcaaccctcag

SEQ ID NO: 3431329 - DNA, 22 bp, Homo sapiens
agccaaggatagaagctgcagt

SEQ ID NO: 3431330 - DNA, 15 bp, Homo sapiens
agccaaggcagcgac

SEQ ID NO: 3431331 - DNA, 19 bp, Homo sapiens
agccaaggcagcgacccca

SEQ ID NO: 3431332 - DNA, 19 bp, Homo sapiens
agccaagggaacctgtgtc

SEQ ID NO: 3431333 - DNA, 18 bp, Homo sapiens
agccaaggtgtcatttat

SEQ ID NO: 3431334 - DNA, 14 bp, Homo sapiens
agccaagtagcctc

SEQ ID NO: 3431335 - DNA, 19 bp, Homo sapiens
agccaagttccaaaataaa

SEQ ID NO: 3431336 - DNA, 20 bp, Homo sapiens
agccaattatgttaaactag

SEQ ID NO: 3431337 - DNA, 14 bp, Homo sapiens
agccacaccaggat

SEQ ID NO: 3431338 - DNA, 24 bp, Homo sapiens
agccacaccaggatagagactgga

SEQ ID NO: 3431339 - DNA, 21 bp, Homo sapiens
agccacactctgggctccaga

SEQ ID NO: 3431340 - DNA, 21 bp, Homo sapiens
agccacaggcctgagatttca

SEQ ID NO: 3431341 - DNA, 23 bp, Homo sapiens
agccacaggcctgagatttcatc

SEQ ID NO: 3431342 - DNA, 20 bp, Homo sapiens
agccacatttggaatacttt

SEQ ID NO: 3431343 - DNA, 15 bp, Homo sapiens
agccaccgaagccgc

SEQ ID NO: 3431344 - DNA, 19 bp, Homo sapiens
agccactaagaacccctct

SEQ ID NO: 3431345 - DNA, 19 bp, Homo sapiens
agccactcccctccactct

SEQ ID NO: 3431346 - DNA, 15 bp, Homo sapiens
agccactcctctgac

SEQ ID NO: 3431347 - DNA, 21 bp, Homo sapiens
agccactcctctgactcaggg

SEQ ID NO: 3431348 - DNA, 16 bp, Homo sapiens
agccactgcaccgggc

SEQ ID NO: 3431349 - DNA, 19 bp, Homo sapiens
agccactgcaccgggccac

SEQ ID NO: 3431350 - DNA, 16 bp, Homo sapiens
agccactgccactcca

SEQ ID NO: 3431351 - DNA, 18 bp, Homo sapiens
agccactggtttctcaga

SEQ ID NO: 3431352 - DNA, 19 bp, Homo sapiens
agccactggtttctcagaa

SEQ ID NO: 3431353 - DNA, 22 bp, Homo sapiens
agccagaacttgaccctgagct

SEQ ID NO: 3431354 - DNA, 12 bp, Homo sapiens
agccagagcctg

SEQ ID NO: 3431355 - DNA, 20 bp, Homo sapiens
agccagagcctgtctttcag

SEQ ID NO: 3431356 - DNA, 14 bp, Homo sapiens
agccagaggctggg

SEQ ID NO: 3431357 - DNA, 15 bp, Homo sapiens
agccagaggctgggt

SEQ ID NO: 3431358 - DNA, 15 bp, Homo sapiens
agccagcacacaggg

SEQ ID NO: 3431359 - DNA, 21 bp, Homo sapiens
agccagcgtcctcctctgtga

SEQ ID NO: 3431360 - DNA, 14 bp, Homo sapiens
agccagctccctct

SEQ ID NO: 3431361 - DNA, 17 bp, Homo sapiens
agccagctccctctatt

SEQ ID NO: 3431362 - DNA, 19 bp, Homo sapiens
agccagctccctctattta

SEQ ID NO: 3431363 - DNA, 17 bp, Homo sapiens
agccagctcctgggcag

SEQ ID NO: 3431364 - DNA, 14 bp, Homo sapiens
agccagctgcctag

SEQ ID NO: 3431365 - DNA, 15 bp, Homo sapiens
agccaggccccaggc

SEQ ID NO: 3431366 - DNA, 11 bp, Homo sapiens
agccagggctg

SEQ ID NO: 3431367 - DNA, 21 bp, Homo sapiens
agccagggctgctagacggag

SEQ ID NO: 3431368 - DNA, 16 bp, Homo sapiens
agccatcaaaatgctt

SEQ ID NO: 3431369 - DNA, 14 bp, Homo sapiens
agccatgatctgca

SEQ ID NO: 3431370 - DNA, 17 bp, Homo sapiens
agccatgatctgcaggg

SEQ ID NO: 3431371 - DNA, 14 bp, Homo sapiens
agccatgtctgcat

SEQ ID NO: 3431372 - DNA, 19 bp, Homo sapiens
agcccaagcttccctccat

SEQ ID NO: 3431373 - DNA, 22 bp, Homo sapiens
agcccaagggatctggtcctac

SEQ ID NO: 3431374 - DNA, 15 bp, Homo sapiens
agcccaatattataa

SEQ ID NO: 3431375 - DNA, 14 bp, Homo sapiens
agcccaccttggct

SEQ ID NO: 3431376 - DNA, 13 bp, Homo sapiens
agcccactctgct

SEQ ID NO: 3431377 - DNA, 18 bp, Homo sapiens
agcccactgtcctgggcc

SEQ ID NO: 3431378 - DNA, 19 bp, Homo sapiens
agcccactgtcctgggcct

SEQ ID NO: 3431379 - DNA, 22 bp, Homo sapiens
agcccacttctgccatattctg

SEQ ID NO: 3431380 - DNA, 18 bp, Homo sapiens
agcccagaaaacctccag

SEQ ID NO: 3431381 - DNA, 19 bp, Homo sapiens
agcccagaaaacctccagt

SEQ ID NO: 3431382 - DNA, 22 bp, Homo sapiens
agcccagagacatacttgaagg

SEQ ID NO: 3431383 - DNA, 12 bp, Homo sapiens
agcccagaggag

SEQ ID NO: 3431384 - DNA, 21 bp, Homo sapiens
agcccagattcccctgtgtca

SEQ ID NO: 3431385 - DNA, 15 bp, Homo sapiens
agcccagcactgctt

SEQ ID NO: 3431386 - DNA, 12 bp, Homo sapiens
agcgactaaact

SEQ ID NO: 3431387 - DNA, 16 bp, Homo sapiens
agcgactccgttggcc

SEQ ID NO: 3431388 - DNA, 17 bp, Homo sapiens
agcgactccgttggcca

SEQ ID NO: 3431389 - DNA, 22 bp, Homo sapiens
agcgagcccctcggctctggag

SEQ ID NO: 3431390 - DNA, 15 bp, Homo sapiens
agcgaggaggctcca

SEQ ID NO: 3431391 - DNA, 14 bp, Homo sapiens
agcgattctcctgc

SEQ ID NO: 3431392 - DNA, 15 bp, Homo sapiens
agcgattcttctgct

SEQ ID NO: 3431393 - DNA, 20 bp, Homo sapiens
agcgcctccatccaaggcca

SEQ ID NO: 3431394 - DNA, 12 bp, Homo sapiens
agcgcctgcccc

SEQ ID NO: 3431395 - DNA, 18 bp, Homo sapiens
agcgcctgcccctcccag

SEQ ID NO: 3431396 - DNA, 19 bp, Homo sapiens
agcgcctgcccctcccaga

SEQ ID NO: 3431397 - DNA, 15 bp, Homo sapiens
agcgcgcccctagcc

SEQ ID NO: 3431398 - DNA, 15 bp, Homo sapiens
agcgcggccctcccg

SEQ ID NO: 3431399 - DNA, 18 bp, Homo sapiens
agcgcggccctcccgagt

SEQ ID NO: 3431400 - DNA, 17 bp, Homo sapiens
agcgctcctgccgcaga

SEQ ID NO: 3431401 - DNA, 14 bp, Homo sapiens
agcggaaagcagct

SEQ ID NO: 3431402 - DNA, 23 bp, Homo sapiens
agcggaaagcagctcaaaggcac

SEQ ID NO: 3431403 - DNA, 11 bp, Homo sapiens
agcggccggcc

SEQ ID NO: 3431404 - DNA, 22 bp, Homo sapiens
agcggccggccagcccctggcc

SEQ ID NO: 3431405 - DNA, 16 bp, Homo sapiens
agcggctgcctccatt

SEQ ID NO: 3431406 - DNA, 13 bp, Homo sapiens
agcggctggcagc

SEQ ID NO: 3431407 - DNA, 14 bp, Homo sapiens
agcgggaaaaggag

SEQ ID NO: 3431408 - DNA, 17 bp, Homo sapiens
agcggggacagctcctt

SEQ ID NO: 3431409 - DNA, 19 bp, Homo sapiens
agcggggacagctccttct

SEQ ID NO: 3431410 - DNA, 22 bp, Homo sapiens
agcgtgaaggccgagaagcaag

SEQ ID NO: 3431411 - DNA, 17 bp, Homo sapiens
agcgtgagccactgcac

SEQ ID NO: 3431412 - DNA, 19 bp, Homo sapiens
agcgtgcaccatccctttt

SEQ ID NO: 3431413 - DNA, 17 bp, Homo sapiens
agctaaaccaaggactg

SEQ ID NO: 3431414 - DNA, 19 bp, Homo sapiens
agctaaaccaaggactgag

SEQ ID NO: 3431415 - DNA, 17 bp, Homo sapiens
agctaaacggattccaa

SEQ ID NO: 3431416 - DNA, 18 bp, Homo sapiens
agctaacacacagctccc

SEQ ID NO: 3431417 - DNA, 14 bp, Homo sapiens
agctaagaaaagat

SEQ ID NO: 3431418 - DNA, 17 bp, Homo sapiens
agctaagaacctggaac

SEQ ID NO: 3431419 - DNA, 21 bp, Homo sapiens
agctaatgaccaacctgtttc

SEQ ID NO: 3431420 - DNA, 13 bp, Homo sapiens
agctaatgggaca

SEQ ID NO: 3431421 - DNA, 14 bp, Homo sapiens
agctaatgggacac

SEQ ID NO: 3431422 - DNA, 13 bp, Homo sapiens
agctaattcaggt

SEQ ID NO: 3431423 - DNA, 14 bp, Homo sapiens
agctaatttgcatt

SEQ ID NO: 3431424 - DNA, 20 bp, Homo sapiens
agctaatttgcattaaattc

SEQ ID NO: 3431425 - DNA, 14 bp, Homo sapiens
agctacctcaacca

SEQ ID NO: 3431426 - DNA, 14 bp, Homo sapiens
agctacttgggagg

SEQ ID NO: 3431427 - DNA, 17 bp, Homo sapiens
agctacttggtttgtgt

SEQ ID NO: 3431428 - DNA, 12 bp, Homo sapiens
agctagaggaac

SEQ ID NO: 3431429 - DNA, 13 bp, Homo sapiens
agctagatgcttt

SEQ ID NO: 3431430 - DNA, 15 bp, Homo sapiens
agctaggagaagggc

SEQ ID NO: 3431431 - DNA, 15 bp, Homo sapiens
agctaggcctggcca

SEQ ID NO: 3431432 - DNA, 16 bp, Homo sapiens
agctagtgtacctcct

SEQ ID NO: 3431433 - DNA, 22 bp, Homo sapiens
agctagtgtacctcctctcagt

SEQ ID NO: 3431434 - DNA, 18 bp, Homo sapiens
agctagttggttgaattt

SEQ ID NO: 3431435 - DNA, 20 bp, Homo sapiens
agctagttggttgaattttt

SEQ ID NO: 3431436 - DNA, 21 bp, Homo sapiens
agctagttggttgaatttttt

SEQ ID NO: 3431437 - DNA, 17 bp, Homo sapiens
agctatagacccgagga

SEQ ID NO: 3431438 - DNA, 15 bp, Homo sapiens
agctatcctggctct

SEQ ID NO: 3431439 - DNA, 13 bp, Homo sapiens
agctatgaagaaa

SEQ ID NO: 3431440 - DNA, 19 bp, Homo sapiens
agctatggtgtcataggct

SEQ ID NO: 3431441 - DNA, 13 bp, Homo sapiens
agctcaaaggcac

SEQ ID NO: 3431442 - DNA, 16 bp, Homo sapiens
agctcaaaggcacagt

SEQ ID NO: 3431443 - DNA, 23 bp, Homo sapiens
agctcaactagtggggtttcctg

SEQ ID NO: 3431444 - DNA, 20 bp, Homo sapiens
agctcaagatgacagctctt

SEQ ID NO: 3431445 - DNA, 19 bp, Homo sapiens
agctcaccagccccagtgc

SEQ ID NO: 3431446 - DNA, 19 bp, Homo sapiens
agctcagaggcgcactgtg

SEQ ID NO: 3431447 - DNA, 22 bp, Homo sapiens
agctcagaggcgcactgtgacc

SEQ ID NO: 3431448 - DNA, 13 bp, Homo sapiens
agctcaggacaga

SEQ ID NO: 3431449 - DNA, 17 bp, Homo sapiens
agctcaggtgtccctgc

SEQ ID NO: 3431450 - DNA, 18 bp, Homo sapiens
agctcaggtgtccctgca

SEQ ID NO: 3431451 - DNA, 21 bp, Homo sapiens
agctcaggtgtccctgcactt

SEQ ID NO: 3431452 - DNA, 22 bp, Homo sapiens
agctccaacctgcaaagatctg

SEQ ID NO: 3431453 - DNA, 17 bp, Homo sapiens
agctccaccctggccga

SEQ ID NO: 3431454 - DNA, 12 bp, Homo sapiens
agctccactctg

SEQ ID NO: 3431455 - DNA, 16 bp, Homo sapiens
agctccactctgcttc

SEQ ID NO: 3431456 - DNA, 23 bp, Homo sapiens
agctccactctgcttctctgact

SEQ ID NO: 3431457 - DNA, 19 bp, Homo sapiens
agctccagctcaccagccc

SEQ ID NO: 3431458 - DNA, 23 bp, Homo sapiens
agctccatactctgtccccccag

SEQ ID NO: 3431459 - DNA, 20 bp, Homo sapiens
agctcccaagggatggtgcc

SEQ ID NO: 3431460 - DNA, 20 bp, Homo sapiens
agctcccaggtgcagccaga

SEQ ID NO: 3431461 - DNA, 10 bp, Homo sapiens
agctccccag

SEQ ID NO: 3431462 - DNA, 12 bp, Homo sapiens
agctccccagga

SEQ ID NO: 3431463 - DNA, 21 bp, Homo sapiens
agctccccgcttctgcctgca

SEQ ID NO: 3431464 - DNA, 20 bp, Homo sapiens
agctccctggcttctgtggg

SEQ ID NO: 3431465 - DNA, 21 bp, Homo sapiens
agctcctcatccagggctctg

SEQ ID NO: 3431466 - DNA, 13 bp, Homo sapiens
agctcctcctccc

SEQ ID NO: 3431467 - DNA, 15 bp, Homo sapiens
agctcctcctccctg

SEQ ID NO: 3431468 - DNA, 17 bp, Homo sapiens
agctcctcctccctgca

SEQ ID NO: 3431469 - DNA, 16 bp, Homo sapiens
agctcctctccccagc

SEQ ID NO: 3431470 - DNA, 20 bp, Homo sapiens
agctcctctccccagcccag

SEQ ID NO: 3431471 - DNA, 16 bp, Homo sapiens
agctcctgggcagctt

SEQ ID NO: 3431472 - DNA, 12 bp, Homo sapiens
agctcctgtggc

SEQ ID NO: 3431473 - DNA, 16 bp, Homo sapiens
agctcctgtggcccca

SEQ ID NO: 3431474 - DNA, 21 bp, Homo sapiens
agctccttctgtcctactctg

SEQ ID NO: 3431475 - DNA, 22 bp, Homo sapiens
agctccttctgtcctactctgt

SEQ ID NO: 3431476 - DNA, 17 bp, Homo sapiens
agctctaagtacctttc

SEQ ID NO: 3431477 - DNA, 15 bp, Homo sapiens
agctctacccagggc

SEQ ID NO: 3431478 - DNA, 21 bp, Homo sapiens
agctctacccagggcctgcag

SEQ ID NO: 3431479 - DNA, 20 bp, Homo sapiens
agctctcacccataataaag

SEQ ID NO: 3431480 - DNA, 21 bp, Homo sapiens
agctctcagttgcagccctgc

SEQ ID NO: 3431481 - DNA, 15 bp, Homo sapiens
agctctcatctgagg

SEQ ID NO: 3431482 - DNA, 18 bp, Homo sapiens
agctctcggaactgcatg

SEQ ID NO: 3431483 - DNA, 20 bp, Homo sapiens
agctctcggaactgcatgct

SEQ ID NO: 3431484 - DNA, 13 bp, Homo sapiens
agctctctgccct

SEQ ID NO: 3431485 - DNA, 18 bp, Homo sapiens
agctctctgccctgtgta

SEQ ID NO: 3431486 - DNA, 17 bp, Homo sapiens
agctctggacagcccca

SEQ ID NO: 3431487 - DNA, 21 bp, Homo sapiens
agctctggacagccccaccct

SEQ ID NO: 3431488 - DNA, 12 bp, Homo sapiens
agctctggaggg

SEQ ID NO: 3431489 - DNA, 19 bp, Homo sapiens
agctctggaggggaggggg

SEQ ID NO: 3431490 - DNA, 20 bp, Homo sapiens
agctctggaggggaggggga

SEQ ID NO: 3431491 - DNA, 12 bp, Homo sapiens
agctctgtatca

SEQ ID NO: 3431492 - DNA, 16 bp, Homo sapiens
agctctgtcctgggag

SEQ ID NO: 3431493 - DNA, 23 bp, Homo sapiens
agctctgtcctgggagtgagctg

SEQ ID NO: 3431494 - DNA, 19 bp, Homo sapiens
agctctgtgggtctctgga

SEQ ID NO: 3431495 - DNA, 17 bp, Homo sapiens
agctcttactctttcct

SEQ ID NO: 3431496 - DNA, 18 bp, Homo sapiens
agctcttactctttccta

SEQ ID NO: 3431497 - DNA, 18 bp, Homo sapiens
agctcttcatctgcccaa

SEQ ID NO: 3431498 - DNA, 14 bp, Homo sapiens
agctcttctaagga

SEQ ID NO: 3431499 - DNA, 16 bp, Homo sapiens
agctcttctccaggct

SEQ ID NO: 3431500 - DNA, 20 bp, Homo sapiens
agctcttctgccggccctgg

SEQ ID NO: 3431501 - DNA, 22 bp, Homo sapiens
agctcttctgccggccctgggg

SEQ ID NO: 3431502 - DNA, 12 bp, Homo sapiens
agctcttgtgag

SEQ ID NO: 3431503 - DNA, 13 bp, Homo sapiens
agctcttgtgagg

SEQ ID NO: 3431504 - DNA, 23 bp, Homo sapiens
agctctttcctccttccatggaa

SEQ ID NO: 3431505 - DNA, 15 bp, Homo sapiens
agctgaacctgggta

SEQ ID NO: 3431506 - DNA, 21 bp, Homo sapiens
agctgacacaaacctgcctgg

SEQ ID NO: 3431507 - DNA, 22 bp, Homo sapiens
agctgacacaaacctgcctggg

SEQ ID NO: 3431508 - DNA, 23 bp, Homo sapiens
agctgacacaaacctgcctgggt

SEQ ID NO: 3431509 - DNA, 16 bp, Homo sapiens
agctgaccagccgtga

SEQ ID NO: 3431510 - DNA, 19 bp, Homo sapiens
agctgaccagccgtgagca

SEQ ID NO: 3431511 - DNA, 17 bp, Homo sapiens
agctgaggcagcagtgt

SEQ ID NO: 3431512 - DNA, 17 bp, Homo sapiens
agctgaggccacactca

SEQ ID NO: 3431513 - DNA, 20 bp, Homo sapiens
agctgagtctccctaaggca

SEQ ID NO: 3431514 - DNA, 12 bp, Homo sapiens
agctgcaaagtg

SEQ ID NO: 3431515 - DNA, 17 bp, Homo sapiens
agctgcaccctcaggca

SEQ ID NO: 3431516 - DNA, 20 bp, Homo sapiens
agctgcaccctcaggcaggt

SEQ ID NO: 3431517 - DNA, 20 bp, Homo sapiens
agctgcactgatgctgcccc

SEQ ID NO: 3431518 - DNA, 20 bp, Homo sapiens
aggaaccgtggtatgtctgc

SEQ ID NO: 3431519 - DNA, 22 bp, Homo sapiens
aggaaccgtggtatgtctgcca

SEQ ID NO: 3431520 - DNA, 16 bp, Homo sapiens
aggaacctcgagtact

SEQ ID NO: 3431521 - DNA, 17 bp, Homo sapiens
aggaacctcgagtactg

SEQ ID NO: 3431522 - DNA, 14 bp, Homo sapiens
aggaacttccaggt

SEQ ID NO: 3431523 - DNA, 18 bp, Homo sapiens
aggaacttgaaaaatact

SEQ ID NO: 3431524 - DNA, 15 bp, Homo sapiens
aggaagaggctgcac

SEQ ID NO: 3431525 - DNA, 15 bp, Homo sapiens
aggaagccaaagagt

SEQ ID NO: 3431526 - DNA, 16 bp, Homo sapiens
aggaagctcagactgg

SEQ ID NO: 3431527 - DNA, 20 bp, Homo sapiens
aggaagctcagactggttga

SEQ ID NO: 3431528 - DNA, 15 bp, Homo sapiens
aggaaggagaggaga

SEQ ID NO: 3431529 - DNA, 19 bp, Homo sapiens
aggaaggcttgttgtgctt

SEQ ID NO: 3431530 - DNA, 20 bp, Homo sapiens
aggaaggggccagaggctcg

SEQ ID NO: 3431531 - DNA, 14 bp, Homo sapiens
aggaaggtggtggg

SEQ ID NO: 3431532 - DNA, 15 bp, Homo sapiens
aggaagtaggaagta

SEQ ID NO: 3431533 - DNA, 16 bp, Homo sapiens
aggaataaagtttttt

SEQ ID NO: 3431534 - DNA, 15 bp, Homo sapiens
aggaataatgggctt

SEQ ID NO: 3431535 - DNA, 17 bp, Homo sapiens
aggaatatatggcagag

SEQ ID NO: 3431536 - DNA, 19 bp, Homo sapiens
aggaatcacgttagaggaa

SEQ ID NO: 3431537 - DNA, 16 bp, Homo sapiens
aggaatccactcccag

SEQ ID NO: 3431538 - DNA, 20 bp, Homo sapiens
aggaatccagacccggctgc

SEQ ID NO: 3431539 - DNA, 16 bp, Homo sapiens
aggaatctcagagaca

SEQ ID NO: 3431540 - DNA, 20 bp, Homo sapiens
aggaatggacagacagagga

SEQ ID NO: 3431541 - DNA, 22 bp, Homo sapiens
aggaatggaggccatatttcca

SEQ ID NO: 3431542 - DNA, 16 bp, Homo sapiens
aggaatgtgtggcctg

SEQ ID NO: 3431543 - DNA, 20 bp, Homo sapiens
aggaatttcccaggaccctg

SEQ ID NO: 3431544 - DNA, 16 bp, Homo sapiens
aggacaacgaggaagc

SEQ ID NO: 3431545 - DNA, 23 bp, Homo sapiens
aggacacagatgaaacacaaaca

SEQ ID NO: 3431546 - DNA, 23 bp, Homo sapiens
aggacacctggccgcctccagga

SEQ ID NO: 3431547 - DNA, 20 bp, Homo sapiens
aggacaggcgggaggaggtg

SEQ ID NO: 3431548 - DNA, 13 bp, Homo sapiens
aggacataatggg

SEQ ID NO: 3431549 - DNA, 18 bp, Homo sapiens
aggacattgcggacagcc

SEQ ID NO: 3431550 - DNA, 19 bp, Homo sapiens
aggacattgcggacagcca

SEQ ID NO: 3431551 - DNA, 19 bp, Homo sapiens
aggaccacaggtgtgagcc

SEQ ID NO: 3431552 - DNA, 14 bp, Homo sapiens
aggaccagctcagg

SEQ ID NO: 3431553 - DNA, 19 bp, Homo sapiens
aggaccagtcaacctgggc

SEQ ID NO: 3431554 - DNA, 12 bp, Homo sapiens
aggacccaagca

SEQ ID NO: 3431555 - DNA, 13 bp, Homo sapiens
aggacccaagcag

SEQ ID NO: 3431556 - DNA, 15 bp, Homo sapiens
aggacccaagcagag

SEQ ID NO: 3431557 - DNA, 20 bp, Homo sapiens
aggacccctccatgtgggct

SEQ ID NO: 3431558 - DNA, 23 bp, Homo sapiens
aggaccctgtgccctccttccca

SEQ ID NO: 3431559 - DNA, 13 bp, Homo sapiens
aggacctatgttg

SEQ ID NO: 3431560 - DNA, 14 bp, Homo sapiens
aggacctgcctgta

SEQ ID NO: 3431561 - DNA, 13 bp, Homo sapiens
aggacctggctgc

SEQ ID NO: 3431562 - DNA, 19 bp, Homo sapiens
aggaccttcgggctgtgcc

SEQ ID NO: 3431563 - DNA, 21 bp, Homo sapiens
aggactaatccaatacctctt

SEQ ID NO: 3431564 - DNA, 12 bp, Homo sapiens
aggactcaccct

SEQ ID NO: 3431565 - DNA, 14 bp, Homo sapiens
aggactcagctccc

SEQ ID NO: 3431566 - DNA, 19 bp, Homo sapiens
aggactcagctccccagag

SEQ ID NO: 3431567 - DNA, 12 bp, Homo sapiens
aggactctggaa

SEQ ID NO: 3431568 - DNA, 13 bp, Homo sapiens
aggactctggaag

SEQ ID NO: 3431569 - DNA, 23 bp, Homo sapiens
aggactctggaagattttcattg

SEQ ID NO: 3431570 - DNA, 14 bp, Homo sapiens
aggactgcagagca

SEQ ID NO: 3431571 - DNA, 19 bp, Homo sapiens
aggactgcagagcagatgg

SEQ ID NO: 3431572 - DNA, 14 bp, Homo sapiens
aggactgtgatgcc

SEQ ID NO: 3431573 - DNA, 20 bp, Homo sapiens
aggactgtgatgccctgccc

SEQ ID NO: 3431574 - DNA, 21 bp, Homo sapiens
aggacttccccggagggctgc

SEQ ID NO: 3431575 - DNA, 23 bp, Homo sapiens
aggacttgccacccccagttcct

SEQ ID NO: 3431576 - DNA, 16 bp, Homo sapiens
aggagaatgaaatgta

SEQ ID NO: 3431577 - DNA, 19 bp, Homo sapiens
aggagacacaacaactcct

SEQ ID NO: 3431578 - DNA, 15 bp, Homo sapiens
aggagagaaaatata

SEQ ID NO: 3431579 - DNA, 15 bp, Homo sapiens
aggagagctagcagc

SEQ ID NO: 3431580 - DNA, 22 bp, Homo sapiens
aggagaggaaactactgccttt

SEQ ID NO: 3431581 - DNA, 15 bp, Homo sapiens
aggagaggagagggg

SEQ ID NO: 3431582 - DNA, 16 bp, Homo sapiens
aggagatcagaaaaat

SEQ ID NO: 3431583 - DNA, 16 bp, Homo sapiens
aggagatgctccttgg

SEQ ID NO: 3431584 - DNA, 17 bp, Homo sapiens
aggagatgctccttggg

SEQ ID NO: 3431585 - DNA, 16 bp, Homo sapiens
aggagcaaaggctgag

SEQ ID NO: 3431586 - DNA, 16 bp, Homo sapiens
aggagcagcctcagaa

SEQ ID NO: 3431587 - DNA, 19 bp, Homo sapiens
aggagcatttttttattca

SEQ ID NO: 3431588 - DNA, 18 bp, Homo sapiens
aggagccccattcctggg

SEQ ID NO: 3431589 - DNA, 19 bp, Homo sapiens
aggagcccctggacatgcc

SEQ ID NO: 3431590 - DNA, 21 bp, Homo sapiens
aggagctgccttggctcagac

SEQ ID NO: 3431591 - DNA, 21 bp, Homo sapiens
aggagctgctatagcctgggg

SEQ ID NO: 3431592 - DNA, 12 bp, Homo sapiens
aggagctgggga

SEQ ID NO: 3431593 - DNA, 21 bp, Homo sapiens
aggagctggggatccctcccc

SEQ ID NO: 3431594 - DNA, 21 bp, Homo sapiens
aggagctgtcaccaaggaaac

SEQ ID NO: 3431595 - DNA, 17 bp, Homo sapiens
aggaggatgtaaggcct

SEQ ID NO: 3431596 - DNA, 20 bp, Homo sapiens
aggaggatgtaaggccttag

SEQ ID NO: 3431597 - DNA, 20 bp, Homo sapiens
aggaggcagaggttgcagtg

SEQ ID NO: 3431598 - DNA, 19 bp, Homo sapiens
aggaggcatctggaaaggg

SEQ ID NO: 3431599 - DNA, 14 bp, Homo sapiens
aggaggccacgtga

SEQ ID NO: 3431600 - DNA, 13 bp, Homo sapiens
aggaggccaggcc

SEQ ID NO: 3431601 - DNA, 16 bp, Homo sapiens
aggaggctccagaggg

SEQ ID NO: 3431602 - DNA, 18 bp, Homo sapiens
aggaggctccagagggca

SEQ ID NO: 3431603 - DNA, 17 bp, Homo sapiens
aggaggggatagagaga

SEQ ID NO: 3431604 - DNA, 21 bp, Homo sapiens
aggaggggcccccctgccctg

SEQ ID NO: 3431605 - DNA, 13 bp, Homo sapiens
aggaggggccgct

SEQ ID NO: 3431606 - DNA, 13 bp, Homo sapiens
aggaggtgtgagg

SEQ ID NO: 3431607 - DNA, 20 bp, Homo sapiens
aggaggtgtgaggaggaggc

SEQ ID NO: 3431608 - DNA, 15 bp, Homo sapiens
aggagtttgaatcca

SEQ ID NO: 3431609 - DNA, 17 bp, Homo sapiens
aggataaattgccataa

SEQ ID NO: 3431610 - DNA, 19 bp, Homo sapiens
aggataaattgccataata

SEQ ID NO: 3431611 - DNA, 20 bp, Homo sapiens
aggatacttaacaaatacat

SEQ ID NO: 3431612 - DNA, 18 bp, Homo sapiens
aggatagatgctggccca

SEQ ID NO: 3431613 - DNA, 19 bp, Homo sapiens
aggatagatgctggcccag

SEQ ID NO: 3431614 - DNA, 20 bp, Homo sapiens
aggatagatgctggcccagg

SEQ ID NO: 3431615 - DNA, 17 bp, Homo sapiens
aggatagctaactgtaa

SEQ ID NO: 3431616 - DNA, 20 bp, Homo sapiens
aggatagctaactgtaaatc

SEQ ID NO: 3431617 - DNA, 16 bp, Homo sapiens
aggatcagattgcatg

SEQ ID NO: 3431618 - DNA, 13 bp, Homo sapiens
aggatcagccagg

SEQ ID NO: 3431619 - DNA, 12 bp, Homo sapiens
aggatcagtctg

SEQ ID NO: 3431620 - DNA, 13 bp, Homo sapiens
aggatcatctgaa

SEQ ID NO: 3431621 - DNA, 15 bp, Homo sapiens
aggatccctctctgg

SEQ ID NO: 3431622 - DNA, 19 bp, Homo sapiens
aggatccctctctggattg

SEQ ID NO: 3431623 - DNA, 23 bp, Homo sapiens
aggatcgaagggtttttagagaa

SEQ ID NO: 3431624 - DNA, 14 bp, Homo sapiens
aggatctaaggctg

SEQ ID NO: 3431625 - DNA, 21 bp, Homo sapiens
aggatctcttgagcctgggag

SEQ ID NO: 3431626 - DNA, 13 bp, Homo sapiens
aggatctttgtgg

SEQ ID NO: 3431627 - DNA, 16 bp, Homo sapiens
aggatctttgtggcca

SEQ ID NO: 3431628 - DNA, 17 bp, Homo sapiens
aggatctttgtggccaa

SEQ ID NO: 3431629 - DNA, 18 bp, Homo sapiens
aggatcttttgaacccag

SEQ ID NO: 3431630 - DNA, 12 bp, Homo sapiens
aggatgagcaga

SEQ ID NO: 3431631 - DNA, 16 bp, Homo sapiens
aggatggcctggccag

SEQ ID NO: 3431632 - DNA, 22 bp, Homo sapiens
aggatggcctggccagggcctg

SEQ ID NO: 3431633 - DNA, 17 bp, Homo sapiens
aggatgggtcagagcta

SEQ ID NO: 3431634 - DNA, 14 bp, Homo sapiens
aggatgtaaggcct

SEQ ID NO: 3431635 - DNA, 19 bp, Homo sapiens
aggatgtagcttttcacct

SEQ ID NO: 3431636 - DNA, 20 bp, Homo sapiens
aggatgtatcgggaagattt

SEQ ID NO: 3431637 - DNA, 19 bp, Homo sapiens
aggatgtcactcagatgga

SEQ ID NO: 3431638 - DNA, 19 bp, Homo sapiens
aggatgtgtttgctttctg

SEQ ID NO: 3431639 - DNA, 16 bp, Homo sapiens
aggatgttctgggaca

SEQ ID NO: 3431640 - DNA, 13 bp, Homo sapiens
aggattgctgcca

SEQ ID NO: 3431641 - DNA, 15 bp, Homo sapiens
aggattgctgccaga

SEQ ID NO: 3431642 - DNA, 19 bp, Homo sapiens
aggattgctgccagagaag

SEQ ID NO: 3431643 - DNA, 19 bp, Homo sapiens
aggattttgatccaagctg

SEQ ID NO: 3431644 - DNA, 16 bp, Homo sapiens
aggcaaaattgtgaag

SEQ ID NO: 3431645 - DNA, 16 bp, Homo sapiens
aggcaaagggtccaga

SEQ ID NO: 3431646 - DNA, 14 bp, Homo sapiens
aggcaaatgcccaa

SEQ ID NO: 3431647 - DNA, 19 bp, Homo sapiens
aggcaaatgtttaaacatt

SEQ ID NO: 3431648 - DNA, 17 bp, Homo sapiens
aggcaactcatcttagg

SEQ ID NO: 3431649 - DNA, 17 bp, Homo sapiens
aggcaagcacctcctgc

SEQ ID NO: 3431650 - DNA, 20 bp, Homo sapiens
aggcaagcacctcctgcctc

SEQ ID NO: 3431651 - DNA, 20 bp, Homo sapiens
aggcgggaggaggtgtgagg

SEQ ID NO: 3431652 - DNA, 14 bp, Homo sapiens
aggcgggcttggaa

SEQ ID NO: 3431653 - DNA, 19 bp, Homo sapiens
aggcggtgcactcactcct

SEQ ID NO: 3431654 - DNA, 21 bp, Homo sapiens
aggcggtgggcacccaccctg

SEQ ID NO: 3431655 - DNA, 21 bp, Homo sapiens
aggctaaacatccaatatttt

SEQ ID NO: 3431656 - DNA, 19 bp, Homo sapiens
aggctaaattactcaggaa

SEQ ID NO: 3431657 - DNA, 18 bp, Homo sapiens
aggctaaggcgtggagct

SEQ ID NO: 3431658 - DNA, 19 bp, Homo sapiens
aggctaaggcgtggagctg

SEQ ID NO: 3431659 - DNA, 14 bp, Homo sapiens
aggctacagggcca

SEQ ID NO: 3431660 - DNA, 23 bp, Homo sapiens
aggctaccaacttgtatccaggc

SEQ ID NO: 3431661 - DNA, 16 bp, Homo sapiens
aggctcaggtccctgg

SEQ ID NO: 3431662 - DNA, 19 bp, Homo sapiens
aggctcatggccctgtagt

SEQ ID NO: 3431663 - DNA, 12 bp, Homo sapiens
aggctcatttta

SEQ ID NO: 3431664 - DNA, 15 bp, Homo sapiens
aggctccagagggca

SEQ ID NO: 3431665 - DNA, 16 bp, Homo sapiens
aggctccagagggcac

SEQ ID NO: 3431666 - DNA, 20 bp, Homo sapiens
aggctcccgaggggaagggg

SEQ ID NO: 3431667 - DNA, 19 bp, Homo sapiens
aggctcctttagcgcccag

SEQ ID NO: 3431668 - DNA, 16 bp, Homo sapiens
aggctcgattttgtat

SEQ ID NO: 3431669 - DNA, 17 bp, Homo sapiens
aggctcgccaaggccta

SEQ ID NO: 3431670 - DNA, 16 bp, Homo sapiens
aggctcgtttggatct

SEQ ID NO: 3431671 - DNA, 14 bp, Homo sapiens
aggctctgccttcg

SEQ ID NO: 3431672 - DNA, 20 bp, Homo sapiens
aggctcttctccttggagga

SEQ ID NO: 3431673 - DNA, 20 bp, Homo sapiens
aggctcttctttcccaaaat

SEQ ID NO: 3431674 - DNA, 13 bp, Homo sapiens
aggctgaccacag

SEQ ID NO: 3431675 - DNA, 21 bp, Homo sapiens
aggctgaccacagcacagcca

SEQ ID NO: 3431676 - DNA, 16 bp, Homo sapiens
aggctgagcacctttg

SEQ ID NO: 3431677 - DNA, 18 bp, Homo sapiens
aggctgaggaaaggccag

SEQ ID NO: 3431678 - DNA, 14 bp, Homo sapiens
aggctgaggctggc

SEQ ID NO: 3431679 - DNA, 21 bp, Homo sapiens
aggctgcaaggtttaggctgg

SEQ ID NO: 3431680 - DNA, 22 bp, Homo sapiens
aggctgcaaggtttaggctggt

SEQ ID NO: 3431681 - DNA, 17 bp, Homo sapiens
aggctgcagtgagccga

SEQ ID NO: 3431682 - DNA, 13 bp, Homo sapiens
aggctgcctccca

SEQ ID NO: 3431683 - DNA, 15 bp, Homo sapiens
aggctggagcccagg

SEQ ID NO: 3431684 - DNA, 18 bp, Homo sapiens
aggctggagtacagtggt

SEQ ID NO: 3431685 - DNA, 23 bp, Homo sapiens
aggctggagttgtcactgctttt

SEQ ID NO: 3431686 - DNA, 17 bp, Homo sapiens
aggctggcacaggacat

SEQ ID NO: 3431687 - DNA, 12 bp, Homo sapiens
aggctggcatga

SEQ ID NO: 3431688 - DNA, 18 bp, Homo sapiens
aggctggcgagagtctgg

SEQ ID NO: 3431689 - DNA, 19 bp, Homo sapiens
aggctggcgagagtctggc

SEQ ID NO: 3431690 - DNA, 13 bp, Homo sapiens
aggctggcgtgca

SEQ ID NO: 3431691 - DNA, 18 bp, Homo sapiens
aggctggcgtgcagtggt

SEQ ID NO: 3431692 - DNA, 19 bp, Homo sapiens
aggctggctccagatgcag

SEQ ID NO: 3431693 - DNA, 22 bp, Homo sapiens
aggctggcttgtcccctcctca

SEQ ID NO: 3431694 - DNA, 18 bp, Homo sapiens
aggctgggaggagcccct

SEQ ID NO: 3431695 - DNA, 18 bp, Homo sapiens
aggctgggcgtagtggct

SEQ ID NO: 3431696 - DNA, 19 bp, Homo sapiens
aggctgggcttcagtggca

SEQ ID NO: 3431697 - DNA, 21 bp, Homo sapiens
aggctgggcttcagtggcagc

SEQ ID NO: 3431698 - DNA, 17 bp, Homo sapiens
aggctgggggagagccg

SEQ ID NO: 3431699 - DNA, 19 bp, Homo sapiens
aggctggtcttgaagtcct

SEQ ID NO: 3431700 - DNA, 13 bp, Homo sapiens
aggctggtggccc

SEQ ID NO: 3431701 - DNA, 14 bp, Homo sapiens
aggctggtggccca

SEQ ID NO: 3431702 - DNA, 16 bp, Homo sapiens
aggctggtggcccagg

SEQ ID NO: 3431703 - DNA, 22 bp, Homo sapiens
aggctggttcggatttggggtg

SEQ ID NO: 3431704 - DNA, 21 bp, Homo sapiens
aggctgtatcccatgagcctc

SEQ ID NO: 3431705 - DNA, 19 bp, Homo sapiens
aggctgtgactcttctctc

SEQ ID NO: 3431706 - DNA, 20 bp, Homo sapiens
aggctgtgctccctggttct

SEQ ID NO: 3431707 - DNA, 24 bp, Homo sapiens
aggctgtgctccctggttctgatg

SEQ ID NO: 3431708 - DNA, 22 bp, Homo sapiens
aggctgtgtttggctttcaggg

SEQ ID NO: 3431709 - DNA, 12 bp, Homo sapiens
aggctgtttgct

SEQ ID NO: 3431710 - DNA, 14 bp, Homo sapiens
aggcttacacccac

SEQ ID NO: 3431711 - DNA, 14 bp, Homo sapiens
aggcttagtttgtg

SEQ ID NO: 3431712 - DNA, 15 bp, Homo sapiens
aggcttagtttgtgt

SEQ ID NO: 3431713 - DNA, 16 bp, Homo sapiens
aggcttctctctgtgg

SEQ ID NO: 3431714 - DNA, 22 bp, Homo sapiens
aggcttgtcactagcagctgca

SEQ ID NO: 3431715 - DNA, 14 bp, Homo sapiens
aggcttgttgtgct

SEQ ID NO: 3431716 - DNA, 19 bp, Homo sapiens
aggctttggatttgacatt

SEQ ID NO: 3431717 - DNA, 16 bp, Homo sapiens
agggaaaaggggctcc

SEQ ID NO: 3431718 - DNA, 18 bp, Homo sapiens
agggaaaataggcaggaa

SEQ ID NO: 3431719 - DNA, 17 bp, Homo sapiens
agggaaaatgcagcagg

SEQ ID NO: 3431720 - DNA, 22 bp, Homo sapiens
agggaaaatgcagcagggatgc

SEQ ID NO: 3431721 - DNA, 19 bp, Homo sapiens
agggaaagaaaaggaaggc

SEQ ID NO: 3431722 - DNA, 15 bp, Homo sapiens
agggaaatggccttc

SEQ ID NO: 3431723 - DNA, 22 bp, Homo sapiens
agggaacccagctctaatacat

SEQ ID NO: 3431724 - DNA, 13 bp, Homo sapiens
agggaagggcctg

SEQ ID NO: 3431725 - DNA, 14 bp, Homo sapiens
agggaagggcctgc

SEQ ID NO: 3431726 - DNA, 18 bp, Homo sapiens
agggaagggcctgccaca

SEQ ID NO: 3431727 - DNA, 14 bp, Homo sapiens
agggaatgcctgag

SEQ ID NO: 3431728 - DNA, 22 bp, Homo sapiens
agggaatgcctgagtgcctggc

SEQ ID NO: 3431729 - DNA, 16 bp, Homo sapiens
agggaattgcagagta

SEQ ID NO: 3431730 - DNA, 17 bp, Homo sapiens
agggacacatttctctg

SEQ ID NO: 3431731 - DNA, 16 bp, Homo sapiens
agggacagaggcccca

SEQ ID NO: 3431732 - DNA, 22 bp, Homo sapiens
agggacagaggccccagcctcc

SEQ ID NO: 3431733 - DNA, 16 bp, Homo sapiens
agggacctctcccagg

SEQ ID NO: 3431734 - DNA, 14 bp, Homo sapiens
agggacgctttgtc

SEQ ID NO: 3431735 - DNA, 14 bp, Homo sapiens
agggactgaagcca

SEQ ID NO: 3431736 - DNA, 16 bp, Homo sapiens
agggacttgaagttgt

SEQ ID NO: 3431737 - DNA, 19 bp, Homo sapiens
agggacttggaagctccgc

SEQ ID NO: 3431738 - DNA, 20 bp, Homo sapiens
agggacttggaagctccgct

SEQ ID NO: 3431739 - DNA, 13 bp, Homo sapiens
agggagaagctcc

SEQ ID NO: 3431740 - DNA, 14 bp, Homo sapiens
agggagacaagagg

SEQ ID NO: 3431741 - DNA, 19 bp, Homo sapiens
agggagacccgtccatttg

SEQ ID NO: 3431742 - DNA, 18 bp, Homo sapiens
agggagactgcatctcaa

SEQ ID NO: 3431743 - DNA, 17 bp, Homo sapiens
agggagcattttcctcc

SEQ ID NO: 3431744 - DNA, 14 bp, Homo sapiens
agggagcctggccc

SEQ ID NO: 3431745 - DNA, 18 bp, Homo sapiens
agggagcctttggttctg

SEQ ID NO: 3431746 - DNA, 19 bp, Homo sapiens
agggagcggccggccagcc

SEQ ID NO: 3431747 - DNA, 17 bp, Homo sapiens
agggagctagccagagg

SEQ ID NO: 3431748 - DNA, 22 bp, Homo sapiens
agggagctccaactcagaaggg

SEQ ID NO: 3431749 - DNA, 21 bp, Homo sapiens
agggagctcttgacagaaagc

SEQ ID NO: 3431750 - DNA, 18 bp, Homo sapiens
agggaggaccacaggtgt

SEQ ID NO: 3431751 - DNA, 14 bp, Homo sapiens
agggaggcaagccc

SEQ ID NO: 3431752 - DNA, 17 bp, Homo sapiens
agggagggcagttttct

SEQ ID NO: 3431753 - DNA, 12 bp, Homo sapiens
agggaggggcct

SEQ ID NO: 3431754 - DNA, 20 bp, Homo sapiens
agggaggggcctaggcctca

SEQ ID NO: 3431755 - DNA, 17 bp, Homo sapiens
agggagtgacagaggca

SEQ ID NO: 3431756 - DNA, 19 bp, Homo sapiens
agggagtgacagaggcagc

SEQ ID NO: 3431757 - DNA, 20 bp, Homo sapiens
agggagtgacagaggcagcc

SEQ ID NO: 3431758 - DNA, 21 bp, Homo sapiens
agggatcaaccagctaagaaa

SEQ ID NO: 3431759 - DNA, 20 bp, Homo sapiens
agggatgagcatggagctgg

SEQ ID NO: 3431760 - DNA, 15 bp, Homo sapiens
agggatgccctggag

SEQ ID NO: 3431761 - DNA, 13 bp, Homo sapiens
agggatttctttg

SEQ ID NO: 3431762 - DNA, 16 bp, Homo sapiens
agggatttgcctcacc

SEQ ID NO: 3431763 - DNA, 20 bp, Homo sapiens
agggatttgcctcaccttgg

SEQ ID NO: 3431764 - DNA, 16 bp, Homo sapiens
agggcaaacccaaaac

SEQ ID NO: 3431765 - DNA, 20 bp, Homo sapiens
agggcaagggttaaggcctg

SEQ ID NO: 3431766 - DNA, 21 bp, Homo sapiens
agggcaagggttaaggcctga

SEQ ID NO: 3431767 - DNA, 21 bp, Homo sapiens
agggcaattgagggactgagc

SEQ ID NO: 3431768 - DNA, 19 bp, Homo sapiens
agggcacattccttgcctg

SEQ ID NO: 3431769 - DNA, 21 bp, Homo sapiens
agggcaccaggggtttctcgc

SEQ ID NO: 3431770 - DNA, 15 bp, Homo sapiens
agggcagaatgaatc

SEQ ID NO: 3431771 - DNA, 14 bp, Homo sapiens
agggcagcagggct

SEQ ID NO: 3431772 - DNA, 16 bp, Homo sapiens
agggcagcgccaggct

SEQ ID NO: 3431773 - DNA, 17 bp, Homo sapiens
agggcagcgccaggctg

SEQ ID NO: 3431774 - DNA, 11 bp, Homo sapiens
agggcaggcat

SEQ ID NO: 3431775 - DNA, 17 bp, Homo sapiens
agggcagggccccaggc

SEQ ID NO: 3431776 - DNA, 17 bp, Homo sapiens
agggcatcatgcatctt

SEQ ID NO: 3431777 - DNA, 19 bp, Homo sapiens
agggcatgggtcgggagag

SEQ ID NO: 3431778 - DNA, 16 bp, Homo sapiens
agggcattgcctgtga

SEQ ID NO: 3431779 - DNA, 22 bp, Homo sapiens
agggcattgcctgtgactgagg

SEQ ID NO: 3431780 - DNA, 19 bp, Homo sapiens
agggccaaacgctgagcca

SEQ ID NO: 3431781 - DNA, 23 bp, Homo sapiens
agggccaaacgctgagccacctg

SEQ ID NO: 3431782 - DNA, 16 bp, Homo sapiens
agggccaacccttctc

SEQ ID NO: 3431783 - DNA, 15 bp, Homo sapiens
aggtgcagccagagg

SEQ ID NO: 3431784 - DNA, 17 bp, Homo sapiens
aggtgcagccagaggca

SEQ ID NO: 3431785 - DNA, 11 bp, Homo sapiens
aggtgcctgcc

SEQ ID NO: 3431786 - DNA, 14 bp, Homo sapiens
aggtgcctgccata

SEQ ID NO: 3431787 - DNA, 18 bp, Homo sapiens
aggtgcctgccatagcca

SEQ ID NO: 3431788 - DNA, 16 bp, Homo sapiens
aggtgccttcttcagg

SEQ ID NO: 3431789 - DNA, 18 bp, Homo sapiens
aggtgccttcttcagggc

SEQ ID NO: 3431790 - DNA, 13 bp, Homo sapiens
aggtgcgcagtgg

SEQ ID NO: 3431791 - DNA, 20 bp, Homo sapiens
aggtgctacacccttttcca

SEQ ID NO: 3431792 - DNA, 17 bp, Homo sapiens
aggtgctgccatccagg

SEQ ID NO: 3431793 - DNA, 21 bp, Homo sapiens
aggtgctggagcactgggctc

SEQ ID NO: 3431794 - DNA, 22 bp, Homo sapiens
aggtgctggagcactgggctcc

SEQ ID NO: 3431795 - DNA, 16 bp, Homo sapiens
aggtgctttccctctt

SEQ ID NO: 3431796 - DNA, 17 bp, Homo sapiens
aggtggaaaaactgaga

SEQ ID NO: 3431797 - DNA, 15 bp, Homo sapiens
aggtggatggcccca

SEQ ID NO: 3431798 - DNA, 16 bp, Homo sapiens
aggtggatggccccag

SEQ ID NO: 3431799 - DNA, 23 bp, Homo sapiens
aggtggatggccccagcacagct

SEQ ID NO: 3431800 - DNA, 18 bp, Homo sapiens
aggtggcaaggctgtgct

SEQ ID NO: 3431801 - DNA, 17 bp, Homo sapiens
aggtggctgagcccctg

SEQ ID NO: 3431802 - DNA, 12 bp, Homo sapiens
aggtgggaggat

SEQ ID NO: 3431803 - DNA, 21 bp, Homo sapiens
aggtgggctgggccctctctt

SEQ ID NO: 3431804 - DNA, 15 bp, Homo sapiens
aggtgggcttcccag

SEQ ID NO: 3431805 - DNA, 13 bp, Homo sapiens
aggtggggacagg

SEQ ID NO: 3431806 - DNA, 14 bp, Homo sapiens
aggtggggacaggg

SEQ ID NO: 3431807 - DNA, 14 bp, Homo sapiens
aggtggggcagctt

SEQ ID NO: 3431808 - DNA, 23 bp, Homo sapiens
aggtggggcagcttgagggttgg

SEQ ID NO: 3431809 - DNA, 19 bp, Homo sapiens
aggtgtagccacaccagga

SEQ ID NO: 3431810 - DNA, 20 bp, Homo sapiens
aggtgtagccacaccaggat

SEQ ID NO: 3431811 - DNA, 20 bp, Homo sapiens
aggtgtatggagagaaaaca

SEQ ID NO: 3431812 - DNA, 23 bp, Homo sapiens
aggtgtcagccattgcacccagc

SEQ ID NO: 3431813 - DNA, 21 bp, Homo sapiens
aggtgtgagtcaccaagccca

SEQ ID NO: 3431814 - DNA, 22 bp, Homo sapiens
aggtgtgagtcaccaagcccag

SEQ ID NO: 3431815 - DNA, 20 bp, Homo sapiens
aggtgtggagccgaggccta

SEQ ID NO: 3431816 - DNA, 15 bp, Homo sapiens
aggtgttggtgacaa

SEQ ID NO: 3431817 - DNA, 16 bp, Homo sapiens
aggtgttggtgacaat

SEQ ID NO: 3431818 - DNA, 16 bp, Homo sapiens
aggtgttgtcccttct

SEQ ID NO: 3431819 - DNA, 21 bp, Homo sapiens
aggtgtttattaaaattctga

SEQ ID NO: 3431820 - DNA, 12 bp, Homo sapiens
aggttaaaaaaa

SEQ ID NO: 3431821 - DNA, 16 bp, Homo sapiens
aggttaaggctgagga

SEQ ID NO: 3431822 - DNA, 17 bp, Homo sapiens
aggttaaggctgaggaa

SEQ ID NO: 3431823 - DNA, 20 bp, Homo sapiens
aggttaataaagatgattga

SEQ ID NO: 3431824 - DNA, 16 bp, Homo sapiens
aggttatatgaatata

SEQ ID NO: 3431825 - DNA, 15 bp, Homo sapiens
aggttcagccaaggt

SEQ ID NO: 3431826 - DNA, 19 bp, Homo sapiens
aggttcagccaaggtttta

SEQ ID NO: 3431827 - DNA, 21 bp, Homo sapiens
aggttcatgccaccatggcca

SEQ ID NO: 3431828 - DNA, 15 bp, Homo sapiens
aggttccagtgagcc

SEQ ID NO: 3431829 - DNA, 16 bp, Homo sapiens
aggttccatcctttac

SEQ ID NO: 3431830 - DNA, 14 bp, Homo sapiens
aggttcccaagctc

SEQ ID NO: 3431831 - DNA, 14 bp, Homo sapiens
aggttcccctgtca

SEQ ID NO: 3431832 - DNA, 19 bp, Homo sapiens
aggttctccgttagctcct

SEQ ID NO: 3431833 - DNA, 20 bp, Homo sapiens
aggttctccgttagctcctg

SEQ ID NO: 3431834 - DNA, 17 bp, Homo sapiens
aggttctctcctcccca

SEQ ID NO: 3431835 - DNA, 14 bp, Homo sapiens
aggttctgcctgct

SEQ ID NO: 3431836 - DNA, 20 bp, Homo sapiens
aggttggaactatgcagtgt

SEQ ID NO: 3431837 - DNA, 15 bp, Homo sapiens
aggttggatggatgg

SEQ ID NO: 3431838 - DNA, 14 bp, Homo sapiens
aggttggtgaattt

SEQ ID NO: 3431839 - DNA, 16 bp, Homo sapiens
aggtttacaatttaca

SEQ ID NO: 3431840 - DNA, 17 bp, Homo sapiens
aggtttacaatttacaa

SEQ ID NO: 3431841 - DNA, 18 bp, Homo sapiens
aggtttacaatttacaaa

SEQ ID NO: 3431842 - DNA, 22 bp, Homo sapiens
aggtttacaatttacaaagtgt

SEQ ID NO: 3431843 - DNA, 14 bp, Homo sapiens
aggtttacagaatt

SEQ ID NO: 3431844 - DNA, 21 bp, Homo sapiens
aggtttaggctggtggcccag

SEQ ID NO: 3431845 - DNA, 23 bp, Homo sapiens
aggtttgtcgggcaccagccagc

SEQ ID NO: 3431846 - DNA, 17 bp, Homo sapiens
aggttttataaggctga

SEQ ID NO: 3431847 - DNA, 14 bp, Homo sapiens
agtaaaacttgctg

SEQ ID NO: 3431848 - DNA, 13 bp, Homo sapiens
agtaaaatccaca

SEQ ID NO: 3431849 - DNA, 19 bp, Homo sapiens
agtaaaattgccatattgc

SEQ ID NO: 3431850 - DNA, 20 bp, Homo sapiens
agtaaaattgccatattgca

SEQ ID NO: 3431851 - DNA, 22 bp, Homo sapiens
agtaaatgttatcttatactgt

SEQ ID NO: 3431852 - DNA, 15 bp, Homo sapiens
agtaacataataaat

SEQ ID NO: 3431853 - DNA, 18 bp, Homo sapiens
agtaacccccactggact

SEQ ID NO: 3431854 - DNA, 19 bp, Homo sapiens
agtaactgccatcaagatg

SEQ ID NO: 3431855 - DNA, 17 bp, Homo sapiens
agtaacttacttaggtg

SEQ ID NO: 3431856 - DNA, 17 bp, Homo sapiens
agtaacttcttatggaa

SEQ ID NO: 3431857 - DNA, 12 bp, Homo sapiens
agtaagaaaata

SEQ ID NO: 3431858 - DNA, 16 bp, Homo sapiens
agtaagaaaatatttt

SEQ ID NO: 3431859 - DNA, 23 bp, Homo sapiens
agtaagagctctaagtacctttc

SEQ ID NO: 3431860 - DNA, 17 bp, Homo sapiens
agtaagcctcatcatca

SEQ ID NO: 3431861 - DNA, 20 bp, Homo sapiens
agtaattgacatgtgccagg

SEQ ID NO: 3431862 - DNA, 14 bp, Homo sapiens
agtaccatttatac

SEQ ID NO: 3431863 - DNA, 21 bp, Homo sapiens
agtaccatttatacaaattag

SEQ ID NO: 3431864 - DNA, 13 bp, Homo sapiens
agtaccttgcttc

SEQ ID NO: 3431865 - DNA, 19 bp, Homo sapiens
agtacctttcctacatttt

SEQ ID NO: 3431866 - DNA, 20 bp, Homo sapiens
agtacctttcctacattttc

SEQ ID NO: 3431867 - DNA, 20 bp, Homo sapiens
agtactggctgatggagtaa

SEQ ID NO: 3431868 - DNA, 23 bp, Homo sapiens
agtactgtaagaataatttatag

SEQ ID NO: 3431869 - DNA, 17 bp, Homo sapiens
agtactgtgggcaattt

SEQ ID NO: 3431870 - DNA, 21 bp, Homo sapiens
agtactgtgggcaatttagaa

SEQ ID NO: 3431871 - DNA, 17 bp, Homo sapiens
agtacttctccaccctg

SEQ ID NO: 3431872 - DNA, 12 bp, Homo sapiens
agtacttctttt

SEQ ID NO: 3431873 - DNA, 15 bp, Homo sapiens
agtacttgtcatatg

SEQ ID NO: 3431874 - DNA, 17 bp, Homo sapiens
agtacttgtcatatgta

SEQ ID NO: 3431875 - DNA, 17 bp, Homo sapiens
agtactttggaggcccc

SEQ ID NO: 3431876 - DNA, 22 bp, Homo sapiens
agtactttggaggcccctatgt

SEQ ID NO: 3431877 - DNA, 14 bp, Homo sapiens
agtagaaaggcctt

SEQ ID NO: 3431878 - DNA, 18 bp, Homo sapiens
agtagaaataatatgcat

SEQ ID NO: 3431879 - DNA, 19 bp, Homo sapiens
agtagaataacctttcaga

SEQ ID NO: 3431880 - DNA, 14 bp, Homo sapiens
agtagaattgcatt

SEQ ID NO: 3431881 - DNA, 19 bp, Homo sapiens
agtagaccaaatcttgtta

SEQ ID NO: 3431882 - DNA, 23 bp, Homo sapiens
agtagaccttgttacttctgagg

SEQ ID NO: 3431883 - DNA, 11 bp, Homo sapiens
agtagagacag

SEQ ID NO: 3431884 - DNA, 17 bp, Homo sapiens
agtagattaaaaattat

SEQ ID NO: 3431885 - DNA, 18 bp, Homo sapiens
agtagattaaaaattata

SEQ ID NO: 3431886 - DNA, 15 bp, Homo sapiens
agtagattttccaaa

SEQ ID NO: 3431887 - DNA, 22 bp, Homo sapiens
agtagcctctcctgtatttaac

SEQ ID NO: 3431888 - DNA, 19 bp, Homo sapiens
agtagctagtttgcttttt

SEQ ID NO: 3431889 - DNA, 16 bp, Homo sapiens
agtagctgaaatgcaa

SEQ ID NO: 3431890 - DNA, 17 bp, Homo sapiens
agtagctgctaccttct

SEQ ID NO: 3431891 - DNA, 18 bp, Homo sapiens
agtagctgctaccttctt

SEQ ID NO: 3431892 - DNA, 21 bp, Homo sapiens
agtagggaggaccacaggtgt

SEQ ID NO: 3431893 - DNA, 15 bp, Homo sapiens
agtagtatggcactt

SEQ ID NO: 3431894 - DNA, 13 bp, Homo sapiens
agtagtcctgtga

SEQ ID NO: 3431895 - DNA, 14 bp, Homo sapiens
agtagtcctgtgaa

SEQ ID NO: 3431896 - DNA, 19 bp, Homo sapiens
agtagtttgagaccagcct

SEQ ID NO: 3431897 - DNA, 16 bp, Homo sapiens
agtataaacaaagtta

SEQ ID NO: 3431898 - DNA, 19 bp, Homo sapiens
agtatcatgccctgtgcaa

SEQ ID NO: 3431899 - DNA, 15 bp, Homo sapiens
agtatctcagggcct

SEQ ID NO: 3431900 - DNA, 14 bp, Homo sapiens
agtatgacagagga

SEQ ID NO: 3431901 - DNA, 22 bp, Homo sapiens
agtatgctgtggagtcccaacc

SEQ ID NO: 3431902 - DNA, 19 bp, Homo sapiens
agtatggagctcagagagg

SEQ ID NO: 3431903 - DNA, 23 bp, Homo sapiens
agtatggtacatttttcaacttt

SEQ ID NO: 3431904 - DNA, 15 bp, Homo sapiens
agtatggtggctggg

SEQ ID NO: 3431905 - DNA, 16 bp, Homo sapiens
agtatggtggctgggt

SEQ ID NO: 3431906 - DNA, 18 bp, Homo sapiens
agtatgtgggggcttcat

SEQ ID NO: 3431907 - DNA, 14 bp, Homo sapiens
agtatgttgtcaaa

SEQ ID NO: 3431908 - DNA, 13 bp, Homo sapiens
agtattattttcc

SEQ ID NO: 3431909 - DNA, 14 bp, Homo sapiens
agtattattttcca

SEQ ID NO: 3431910 - DNA, 14 bp, Homo sapiens
agtattcgttacat

SEQ ID NO: 3431911 - DNA, 20 bp, Homo sapiens
agtattgcatctgtataagt

SEQ ID NO: 3431912 - DNA, 13 bp, Homo sapiens
agtattgtaaatt

SEQ ID NO: 3431913 - DNA, 16 bp, Homo sapiens
agtattgtaaattata

SEQ ID NO: 3431914 - DNA, 15 bp, Homo sapiens
agtattgtttcctga

SEQ ID NO: 3431915 - DNA, 17 bp, Homo sapiens
agtatttaattagtgct

SEQ ID NO: 3431916 - DNA, 17 bp, Homo sapiens
agttgatctggaaccca

SEQ ID NO: 3431917 - DNA, 19 bp, Homo sapiens
agttgatctggaacccaga

SEQ ID NO: 3431918 - DNA, 23 bp, Homo sapiens
agttgatctggaacccagactca

SEQ ID NO: 3431919 - DNA, 16 bp, Homo sapiens
agttgatgttgcattt

SEQ ID NO: 3431920 - DNA, 13 bp, Homo sapiens
agttgattcagct

SEQ ID NO: 3431921 - DNA, 15 bp, Homo sapiens
agttgattcagctct

SEQ ID NO: 3431922 - DNA, 18 bp, Homo sapiens
agttgattcagctctgca

SEQ ID NO: 3431923 - DNA, 23 bp, Homo sapiens
agttgattttacaattgaaatga

SEQ ID NO: 3431924 - DNA, 16 bp, Homo sapiens
agttgattttctggat

SEQ ID NO: 3431925 - DNA, 17 bp, Homo sapiens
agttgcaatagaacaga

SEQ ID NO: 3431926 - DNA, 16 bp, Homo sapiens
agttgcacggctgctg

SEQ ID NO: 3431927 - DNA, 16 bp, Homo sapiens
agttgcactaactgct

SEQ ID NO: 3431928 - DNA, 18 bp, Homo sapiens
agttgccaatatgccagc

SEQ ID NO: 3431929 - DNA, 21 bp, Homo sapiens
agttgccaatatgccagcttg

SEQ ID NO: 3431930 - DNA, 21 bp, Homo sapiens
agttgccattattctatgtag

SEQ ID NO: 3431931 - DNA, 17 bp, Homo sapiens
agttggtacacaactag

SEQ ID NO: 3431932 - DNA, 16 bp, Homo sapiens
agttggtccacagcat

SEQ ID NO: 3431933 - DNA, 15 bp, Homo sapiens
agttgtaaatatata

SEQ ID NO: 3431934 - DNA, 16 bp, Homo sapiens
agttgtaaatatataa

SEQ ID NO: 3431935 - DNA, 22 bp, Homo sapiens
agttgtaaatatataaatatat

SEQ ID NO: 3431936 - DNA, 23 bp, Homo sapiens
agttgtcactgcttttggcctgg

SEQ ID NO: 3431937 - DNA, 14 bp, Homo sapiens
agttgtgcagcttt

SEQ ID NO: 3431938 - DNA, 20 bp, Homo sapiens
agttgtgcagcttttggtca

SEQ ID NO: 3431939 - DNA, 19 bp, Homo sapiens
agttgttactaactaaact

SEQ ID NO: 3431940 - DNA, 20 bp, Homo sapiens
agttgttactaactaaactc

SEQ ID NO: 3431941 - DNA, 14 bp, Homo sapiens
agtttaaaaaaatt

SEQ ID NO: 3431942 - DNA, 17 bp, Homo sapiens
agtttaaattgtaatag

SEQ ID NO: 3431943 - DNA, 22 bp, Homo sapiens
agtttaatgcaagagaacattt

SEQ ID NO: 3431944 - DNA, 23 bp, Homo sapiens
agtttaatgcaagagaacatttt

SEQ ID NO: 3431945 - DNA, 15 bp, Homo sapiens
agtttactccttctg

SEQ ID NO: 3431946 - DNA, 17 bp, Homo sapiens
agtttactccttctgtt

SEQ ID NO: 3431947 - DNA, 12 bp, Homo sapiens
agtttagaactt

SEQ ID NO: 3431948 - DNA, 13 bp, Homo sapiens
agtttagaacttg

SEQ ID NO: 3431949 - DNA, 22 bp, Homo sapiens
agtttattgacaataatttcag

SEQ ID NO: 3431950 - DNA, 17 bp, Homo sapiens
agtttcagagatggaca

SEQ ID NO: 3431951 - DNA, 15 bp, Homo sapiens
agtttcatgtacaag

SEQ ID NO: 3431952 - DNA, 18 bp, Homo sapiens
agtttcatgtacaagatg

SEQ ID NO: 3431953 - DNA, 21 bp, Homo sapiens
agtttcatgtacaagatgaag

SEQ ID NO: 3431954 - DNA, 19 bp, Homo sapiens
agtttccttggctggtgca

SEQ ID NO: 3431955 - DNA, 19 bp, Homo sapiens
agtttccttttctgtctct

SEQ ID NO: 3431956 - DNA, 19 bp, Homo sapiens
agtttgaaattctgaattt

SEQ ID NO: 3431957 - DNA, 20 bp, Homo sapiens
agtttgaaattctgaatttg

SEQ ID NO: 3431958 - DNA, 23 bp, Homo sapiens
agtttgaaattctgaatttgcaa

SEQ ID NO: 3431959 - DNA, 16 bp, Homo sapiens
agtttgaatgttaaat

SEQ ID NO: 3431960 - DNA, 19 bp, Homo sapiens
agtttgagatcagcctggg

SEQ ID NO: 3431961 - DNA, 13 bp, Homo sapiens
agtttggagacaa

SEQ ID NO: 3431962 - DNA, 21 bp, Homo sapiens
agtttgggatccctgtctttc

SEQ ID NO: 3431963 - DNA, 23 bp, Homo sapiens
agtttgggatccctgtctttcct

SEQ ID NO: 3431964 - DNA, 16 bp, Homo sapiens
agttttatccataatg

SEQ ID NO: 3431965 - DNA, 22 bp, Homo sapiens
agttttatgcgacagctttact

SEQ ID NO: 3431966 - DNA, 11 bp, Homo sapiens
agttttcagtt

SEQ ID NO: 3431967 - DNA, 17 bp, Homo sapiens
agttttcagtttgtata

SEQ ID NO: 3431968 - DNA, 22 bp, Homo sapiens
agttttccatggcaggaaggct

SEQ ID NO: 3431969 - DNA, 20 bp, Homo sapiens
agttttcccttgaggaaaca

SEQ ID NO: 3431970 - DNA, 22 bp, Homo sapiens
agttttccttctcatctgtgat

SEQ ID NO: 3431971 - DNA, 15 bp, Homo sapiens
agttttcttccatga

SEQ ID NO: 3431972 - DNA, 14 bp, Homo sapiens
agttttcttctgtg

SEQ ID NO: 3431973 - DNA, 21 bp, Homo sapiens
agttttcttgttgctttgttg

SEQ ID NO: 3431974 - DNA, 15 bp, Homo sapiens
agttttggatgcagt

SEQ ID NO: 3431975 - DNA, 17 bp, Homo sapiens
agttttggatgcagtgc

SEQ ID NO: 3431976 - DNA, 18 bp, Homo sapiens
agttttgttttaaaatta

SEQ ID NO: 3431977 - DNA, 22 bp, Homo sapiens
agtttttcccagctacaccttt

SEQ ID NO: 3431978 - DNA, 23 bp, Homo sapiens
agtttttcccagctacacctttc

SEQ ID NO: 3431979 - DNA, 22 bp, Homo sapiens
agtttttggagtgttatgtatt

SEQ ID NO: 3431980 - DNA, 23 bp, Homo sapiens
agtttttggagtgttatgtattt

SEQ ID NO: 3431981 - DNA, 15 bp, Homo sapiens
agttttttgtaccaa

SEQ ID NO: 3431982 - DNA, 16 bp, Homo sapiens
agttttttttctgggt

SEQ ID NO: 3431983 - DNA, 13 bp, Homo sapiens
ataaaaaacaaat

SEQ ID NO: 3431984 - DNA, 13 bp, Homo sapiens
ataaaaaatatgt

SEQ ID NO: 3431985 - DNA, 17 bp, Homo sapiens
ataaaaaatatgtattt

SEQ ID NO: 3431986 - DNA, 23 bp, Homo sapiens
ataaaaacattgcctttgaatgt

SEQ ID NO: 3431987 - DNA, 17 bp, Homo sapiens
ataaaaaccaagaagat

SEQ ID NO: 3431988 - DNA, 14 bp, Homo sapiens
ataaaaaccttcca

SEQ ID NO: 3431989 - DNA, 17 bp, Homo sapiens
ataaaaaccttccaaac

SEQ ID NO: 3431990 - DNA, 12 bp, Homo sapiens
ataaaaaggcac

SEQ ID NO: 3431991 - DNA, 21 bp, Homo sapiens
ataaaaaggcacctataaaac

SEQ ID NO: 3431992 - DNA, 22 bp, Homo sapiens
ataaaaataaatttggttctaa

SEQ ID NO: 3431993 - DNA, 16 bp, Homo sapiens
ataaaacaggtcaata

SEQ ID NO: 3431994 - DNA, 12 bp, Homo sapiens
ataaaacagtat

SEQ ID NO: 3431995 - DNA, 16 bp, Homo sapiens
ataaaacagtatctct

SEQ ID NO: 3431996 - DNA, 22 bp, Homo sapiens
ataaaacattaagaaaatcata

SEQ ID NO: 3431997 - DNA, 16 bp, Homo sapiens
ataaaagacagtgaaa

SEQ ID NO: 3431998 - DNA, 10 bp, Homo sapiens
ataaaagatg

SEQ ID NO: 3431999 - DNA, 19 bp, Homo sapiens
ataaaagatggggtctgta

SEQ ID NO: 3432000 - DNA, 22 bp, Homo sapiens
ataaaagatggggtctgtaaaa

SEQ ID NO: 3432001 - DNA, 23 bp, Homo sapiens
ataaaatcagccaattatgttaa

SEQ ID NO: 3432002 - DNA, 13 bp, Homo sapiens
ataaaatgttgaa

SEQ ID NO: 3432003 - DNA, 19 bp, Homo sapiens
ataaacagacaatatgtga

SEQ ID NO: 3432004 - DNA, 16 bp, Homo sapiens
ataaacatcacacaca

SEQ ID NO: 3432005 - DNA, 13 bp, Homo sapiens
ataaacatttgag

SEQ ID NO: 3432006 - DNA, 17 bp, Homo sapiens
ataaacctaaaaaagat

SEQ ID NO: 3432007 - DNA, 19 bp, Homo sapiens
ataaacctaaaaaagatat

SEQ ID NO: 3432008 - DNA, 17 bp, Homo sapiens
ataaacttggattctct

SEQ ID NO: 3432009 - DNA, 15 bp, Homo sapiens
ataaagagagaaaaa

SEQ ID NO: 3432010 - DNA, 20 bp, Homo sapiens
ataaagatttcttgagtttt

SEQ ID NO: 3432011 - DNA, 18 bp, Homo sapiens
ataaagcatttataaatt

SEQ ID NO: 3432012 - DNA, 14 bp, Homo sapiens
ataaagctgttctc

SEQ ID NO: 3432013 - DNA, 17 bp, Homo sapiens
ataaaggatgtgattgt

SEQ ID NO: 3432014 - DNA, 13 bp, Homo sapiens
ataaagtagaaat

SEQ ID NO: 3432015 - DNA, 14 bp, Homo sapiens
ataaagtagaaatg

SEQ ID NO: 3432016 - DNA, 17 bp, Homo sapiens
ataaagtagtcctgtga

SEQ ID NO: 3432017 - DNA, 21 bp, Homo sapiens
ataaatatatatatatataaa

SEQ ID NO: 3432018 - DNA, 22 bp, Homo sapiens
ataaatatatatatatataaaa

SEQ ID NO: 3432019 - DNA, 17 bp, Homo sapiens
ataaatctctccagcta

SEQ ID NO: 3432020 - DNA, 16 bp, Homo sapiens
ataaatctgacccagt

SEQ ID NO: 3432021 - DNA, 18 bp, Homo sapiens
ataaatgtatcttattca

SEQ ID NO: 3432022 - DNA, 15 bp, Homo sapiens
ataaattcactttca

SEQ ID NO: 3432023 - DNA, 13 bp, Homo sapiens
ataaattgccata

SEQ ID NO: 3432024 - DNA, 21 bp, Homo sapiens
ataaattgccataatatgatg

SEQ ID NO: 3432025 - DNA, 19 bp, Homo sapiens
ataaattgctaatgttgct

SEQ ID NO: 3432026 - DNA, 19 bp, Homo sapiens
ataaattgtatattcactt

SEQ ID NO: 3432027 - DNA, 17 bp, Homo sapiens
ataacaacgtctttttg

SEQ ID NO: 3432028 - DNA, 18 bp, Homo sapiens
ataacaacgtctttttgt

SEQ ID NO: 3432029 - DNA, 21 bp, Homo sapiens
ataacaacgtctttttgtttg

SEQ ID NO: 3432030 - DNA, 22 bp, Homo sapiens
ataacaacgtctttttgtttgt

SEQ ID NO: 3432031 - DNA, 14 bp, Homo sapiens
ataacaatgaaagt

SEQ ID NO: 3432032 - DNA, 14 bp, Homo sapiens
ataacatttaattt

SEQ ID NO: 3432033 - DNA, 18 bp, Homo sapiens
ataacatttaatttagat

SEQ ID NO: 3432034 - DNA, 20 bp, Homo sapiens
ataacggatcagaaatacag

SEQ ID NO: 3432035 - DNA, 19 bp, Homo sapiens
ataactagatggtgctgag

SEQ ID NO: 3432036 - DNA, 19 bp, Homo sapiens
ataactagtgttgcttgga

SEQ ID NO: 3432037 - DNA, 17 bp, Homo sapiens
ataactttgactttctt

SEQ ID NO: 3432038 - DNA, 12 bp, Homo sapiens
ataagaaaaact

SEQ ID NO: 3432039 - DNA, 14 bp, Homo sapiens
ataagaaagacatc

SEQ ID NO: 3432040 - DNA, 13 bp, Homo sapiens
ataagaattagac

SEQ ID NO: 3432041 - DNA, 22 bp, Homo sapiens
ataagaattagacatcttcaga

SEQ ID NO: 3432042 - DNA, 22 bp, Homo sapiens
ataagaccaccacctcagagta

SEQ ID NO: 3432043 - DNA, 19 bp, Homo sapiens
ataagagggcacacactgt

SEQ ID NO: 3432044 - DNA, 16 bp, Homo sapiens
ataagagtagaaactg

SEQ ID NO: 3432045 - DNA, 21 bp, Homo sapiens
ataagctaacaccagacagac

SEQ ID NO: 3432046 - DNA, 20 bp, Homo sapiens
ataaggaaatcaacttgctt

SEQ ID NO: 3432047 - DNA, 23 bp, Homo sapiens
atagtaatgagtttaaaaatcaa

SEQ ID NO: 3432048 - DNA, 14 bp, Homo sapiens
atagtaccatttat

SEQ ID NO: 3432049 - DNA, 22 bp, Homo sapiens
atagtagagtgatatggagcaa

SEQ ID NO: 3432050 - DNA, 19 bp, Homo sapiens
atagtatagacaataagga

SEQ ID NO: 3432051 - DNA, 22 bp, Homo sapiens
atagtatttgattcaaaatatt

SEQ ID NO: 3432052 - DNA, 16 bp, Homo sapiens
atagtgaaataaattc

SEQ ID NO: 3432053 - DNA, 22 bp, Homo sapiens
atagttggctaggacccctcca

SEQ ID NO: 3432054 - DNA, 13 bp, Homo sapiens
atagtttattgac

SEQ ID NO: 3432055 - DNA, 13 bp, Homo sapiens
atataaaactgcg

SEQ ID NO: 3432056 - DNA, 21 bp, Homo sapiens
atataaaataaatatatataa

SEQ ID NO: 3432057 - DNA, 13 bp, Homo sapiens
atataaaataatg

SEQ ID NO: 3432058 - DNA, 19 bp, Homo sapiens
atataaacctaaaaaagat

SEQ ID NO: 3432059 - DNA, 20 bp, Homo sapiens
atataaacctaaaaaagata

SEQ ID NO: 3432060 - DNA, 19 bp, Homo sapiens
atataaagtagtcctgtga

SEQ ID NO: 3432061 - DNA, 14 bp, Homo sapiens
atataaatatatat

SEQ ID NO: 3432062 - DNA, 23 bp, Homo sapiens
atataaatatatatatatataaa

SEQ ID NO: 3432063 - DNA, 18 bp, Homo sapiens
atataactattgcccagg

SEQ ID NO: 3432064 - DNA, 14 bp, Homo sapiens
atataagaaagaca

SEQ ID NO: 3432065 - DNA, 14 bp, Homo sapiens
atataagaataaaa

SEQ ID NO: 3432066 - DNA, 17 bp, Homo sapiens
atataagtgctgtataa

SEQ ID NO: 3432067 - DNA, 20 bp, Homo sapiens
atataagtgctgtataaaat

SEQ ID NO: 3432068 - DNA, 22 bp, Homo sapiens
atatactattaaaaaggtttac

SEQ ID NO: 3432069 - DNA, 17 bp, Homo sapiens
atatactgcttgtcatc

SEQ ID NO: 3432070 - DNA, 15 bp, Homo sapiens
atatagaacagtgct

SEQ ID NO: 3432071 - DNA, 17 bp, Homo sapiens
atatagaattagctttt

SEQ ID NO: 3432072 - DNA, 20 bp, Homo sapiens
atatagacagtccttaaaaa

SEQ ID NO: 3432073 - DNA, 16 bp, Homo sapiens
atatataaaataaata

SEQ ID NO: 3432074 - DNA, 13 bp, Homo sapiens
atatataaatata

SEQ ID NO: 3432075 - DNA, 13 bp, Homo sapiens
atatataagaaag

SEQ ID NO: 3432076 - DNA, 22 bp, Homo sapiens
atatataagaaagacatctttc

SEQ ID NO: 3432077 - DNA, 14 bp, Homo sapiens
atatatactattaa

SEQ ID NO: 3432078 - DNA, 11 bp, Homo sapiens
atatatataaa

SEQ ID NO: 3432079 - DNA, 12 bp, Homo sapiens
atatatataaac

SEQ ID NO: 3432080 - DNA, 14 bp, Homo sapiens
atatatataaacct

SEQ ID NO: 3432081 - DNA, 14 bp, Homo sapiens
atatatatatataa

SEQ ID NO: 3432082 - DNA, 15 bp, Homo sapiens
atatatatgtatgta

SEQ ID NO: 3432083 - DNA, 14 bp, Homo sapiens
atatatggcagagt

SEQ ID NO: 3432084 - DNA, 19 bp, Homo sapiens
atatatggcagagttgtaa

SEQ ID NO: 3432085 - DNA, 13 bp, Homo sapiens
atatatgtatttt

SEQ ID NO: 3432086 - DNA, 13 bp, Homo sapiens
atatatgtgtttt

SEQ ID NO: 3432087 - DNA, 23 bp, Homo sapiens
atatatgtgtttttcacatttgc

SEQ ID NO: 3432088 - DNA, 22 bp, Homo sapiens
atatatgttttaagaggcaggg

SEQ ID NO: 3432089 - DNA, 22 bp, Homo sapiens
atatattaaaaatataaaactg

SEQ ID NO: 3432090 - DNA, 15 bp, Homo sapiens
atatattattctcat

SEQ ID NO: 3432091 - DNA, 16 bp, Homo sapiens
atatattattctcatt

SEQ ID NO: 3432092 - DNA, 19 bp, Homo sapiens
atatattggcactgctaaa

SEQ ID NO: 3432093 - DNA, 20 bp, Homo sapiens
atatatttaagcaacatctt

SEQ ID NO: 3432094 - DNA, 17 bp, Homo sapiens
atatatttctattatta

SEQ ID NO: 3432095 - DNA, 23 bp, Homo sapiens
atatatttctattattaattgca

SEQ ID NO: 3432096 - DNA, 17 bp, Homo sapiens
atatatttgtgtattta

SEQ ID NO: 3432097 - DNA, 21 bp, Homo sapiens
atatatttgtgtatttaacag

SEQ ID NO: 3432098 - DNA, 18 bp, Homo sapiens
atatcactcttgagtaaa

SEQ ID NO: 3432099 - DNA, 13 bp, Homo sapiens
atatcatatgtat

SEQ ID NO: 3432100 - DNA, 23 bp, Homo sapiens
atatcatttattttttacattat

SEQ ID NO: 3432101 - DNA, 14 bp, Homo sapiens
atatcccaaactgt

SEQ ID NO: 3432102 - DNA, 14 bp, Homo sapiens
atatccttttcttc

SEQ ID NO: 3432103 - DNA, 14 bp, Homo sapiens
atatctaaagttat

SEQ ID NO: 3432104 - DNA, 16 bp, Homo sapiens
atatctaaagttatat

SEQ ID NO: 3432105 - DNA, 19 bp, Homo sapiens
atatctaaagttatatttc

SEQ ID NO: 3432106 - DNA, 21 bp, Homo sapiens
atatctaaagttatatttcag

SEQ ID NO: 3432107 - DNA, 14 bp, Homo sapiens
atatctgcctttat

SEQ ID NO: 3432108 - DNA, 23 bp, Homo sapiens
atatctgcctttattgtgtttgt

SEQ ID NO: 3432109 - DNA, 13 bp, Homo sapiens
atatcttcagttt

SEQ ID NO: 3432110 - DNA, 19 bp, Homo sapiens
atatcttcagtttaatgca

SEQ ID NO: 3432111 - DNA, 23 bp, Homo sapiens
atatcttggcctaaacctcagtt

SEQ ID NO: 3432112 - DNA, 16 bp, Homo sapiens
atatgaatatatagtg

SEQ ID NO: 3432113 - DNA, 14 bp, Homo sapiens
atatgaattgtaca

SEQ ID NO: 3432114 - DNA, 19 bp, Homo sapiens
atatgacattcatgcctgg

SEQ ID NO: 3432115 - DNA, 15 bp, Homo sapiens
atatgactttttata

SEQ ID NO: 3432116 - DNA, 16 bp, Homo sapiens
atatgcactatgtata

SEQ ID NO: 3432117 - DNA, 13 bp, Homo sapiens
atatgcacttata

SEQ ID NO: 3432118 - DNA, 14 bp, Homo sapiens
atatgcacttataa

SEQ ID NO: 3432119 - DNA, 14 bp, Homo sapiens
atatgccagcttgg

SEQ ID NO: 3432120 - DNA, 19 bp, Homo sapiens
atatggaacttacattgtt

SEQ ID NO: 3432121 - DNA, 15 bp, Homo sapiens
atatggacacttaat

SEQ ID NO: 3432122 - DNA, 17 bp, Homo sapiens
atatggcagagttgtaa

SEQ ID NO: 3432123 - DNA, 23 bp, Homo sapiens
atatggcagagttgtaaatatat

SEQ ID NO: 3432124 - DNA, 13 bp, Homo sapiens
atatgtaaaataa

SEQ ID NO: 3432125 - DNA, 15 bp, Homo sapiens
atatgtaaaataaaa

SEQ ID NO: 3432126 - DNA, 16 bp, Homo sapiens
atatgtaaaataaaat

SEQ ID NO: 3432127 - DNA, 18 bp, Homo sapiens
atatgtagccttcacaca

SEQ ID NO: 3432128 - DNA, 15 bp, Homo sapiens
atatgtatttaccaa

SEQ ID NO: 3432129 - DNA, 18 bp, Homo sapiens
atatgtatttaccaaaaa

SEQ ID NO: 3432130 - DNA, 16 bp, Homo sapiens
atatgtctgctccttt

SEQ ID NO: 3432131 - DNA, 14 bp, Homo sapiens
atatgttgaatact

SEQ ID NO: 3432132 - DNA, 15 bp, Homo sapiens
atatgttgaatactt

SEQ ID NO: 3432133 - DNA, 18 bp, Homo sapiens
atatgttgaatacttttt

SEQ ID NO: 3432134 - DNA, 15 bp, Homo sapiens
atattaaaaatataa

SEQ ID NO: 3432135 - DNA, 18 bp, Homo sapiens
atattaatgtacttgttt

SEQ ID NO: 3432136 - DNA, 14 bp, Homo sapiens
atattatgagatgc

SEQ ID NO: 3432137 - DNA, 19 bp, Homo sapiens
atattatgtataaaatgta

SEQ ID NO: 3432138 - DNA, 13 bp, Homo sapiens
atattattctcat

SEQ ID NO: 3432139 - DNA, 19 bp, Homo sapiens
atattattctcatttagtg

SEQ ID NO: 3432140 - DNA, 18 bp, Homo sapiens
atattcagacaaaatgga

SEQ ID NO: 3432141 - DNA, 19 bp, Homo sapiens
atattcagacaaaatggat

SEQ ID NO: 3432142 - DNA, 17 bp, Homo sapiens
atattccaaaataaaag

SEQ ID NO: 3432143 - DNA, 19 bp, Homo sapiens
atattgaagaatttgtttt

SEQ ID NO: 3432144 - DNA, 16 bp, Homo sapiens
atattgattgtccttt

SEQ ID NO: 3432145 - DNA, 16 bp, Homo sapiens
atattgcacatgtctt

SEQ ID NO: 3432146 - DNA, 17 bp, Homo sapiens
atattgcacatgtctta

SEQ ID NO: 3432147 - DNA, 19 bp, Homo sapiens
atattgcacatgtcttaat

SEQ ID NO: 3432148 - DNA, 13 bp, Homo sapiens
atattgcatttct

SEQ ID NO: 3432149 - DNA, 17 bp, Homo sapiens
atattgcccaggctggt

SEQ ID NO: 3432150 - DNA, 20 bp, Homo sapiens
atattggtgtactgtaatgt

SEQ ID NO: 3432151 - DNA, 12 bp, Homo sapiens
atattgtttcta

SEQ ID NO: 3432152 - DNA, 17 bp, Homo sapiens
atatttaaaaatgtctt

SEQ ID NO: 3432153 - DNA, 20 bp, Homo sapiens
atatttaatgttttaaatgt

SEQ ID NO: 3432154 - DNA, 21 bp, Homo sapiens
atatttaatgttttaaatgta

SEQ ID NO: 3432155 - DNA, 13 bp, Homo sapiens
atatttacaaatg

SEQ ID NO: 3432156 - DNA, 23 bp, Homo sapiens
atatttattattttcacctgttt

SEQ ID NO: 3432157 - DNA, 15 bp, Homo sapiens
atatttcagatgtaa

SEQ ID NO: 3432158 - DNA, 22 bp, Homo sapiens
atatttcttagcaacattttct

SEQ ID NO: 3432159 - DNA, 19 bp, Homo sapiens
atatttcttcgttcttttt

SEQ ID NO: 3432160 - DNA, 13 bp, Homo sapiens
atatttgaatctt

SEQ ID NO: 3432161 - DNA, 15 bp, Homo sapiens
atatttgaatcttgt

SEQ ID NO: 3432162 - DNA, 17 bp, Homo sapiens
atatttgaatcttgtct

SEQ ID NO: 3432163 - DNA, 19 bp, Homo sapiens
atatttgaatcttgtctca

SEQ ID NO: 3432164 - DNA, 12 bp, Homo sapiens
atatttgacatg

SEQ ID NO: 3432165 - DNA, 22 bp, Homo sapiens
atatttgtactgtttaatgttc

SEQ ID NO: 3432166 - DNA, 17 bp, Homo sapiens
atattttccatatattg

SEQ ID NO: 3432167 - DNA, 13 bp, Homo sapiens
atattttcctgcc

SEQ ID NO: 3432168 - DNA, 13 bp, Homo sapiens
atattttctctgt

SEQ ID NO: 3432169 - DNA, 18 bp, Homo sapiens
atattttctctgtacttt

SEQ ID NO: 3432170 - DNA, 21 bp, Homo sapiens
atattttctttaaaagacaaa

SEQ ID NO: 3432171 - DNA, 14 bp, Homo sapiens
atattttgtctaaa

SEQ ID NO: 3432172 - DNA, 17 bp, Homo sapiens
atattttgtctaaaatg

SEQ ID NO: 3432173 - DNA, 22 bp, Homo sapiens
atcaaaatgctttttatttctg

SEQ ID NO: 3432174 - DNA, 20 bp, Homo sapiens
atcaaagttctgctttctcc

SEQ ID NO: 3432175 - DNA, 15 bp, Homo sapiens
atcaaataaagagag

SEQ ID NO: 3432176 - DNA, 17 bp, Homo sapiens
atcaaatgcagtatatt

SEQ ID NO: 3432177 - DNA, 19 bp, Homo sapiens
atcaacaccttaatatgct

SEQ ID NO: 3432178 - DNA, 19 bp, Homo sapiens
atcaaccccttcgctcctg

SEQ ID NO: 3432179 - DNA, 22 bp, Homo sapiens
atcaaccccttcgctcctgtgt

SEQ ID NO: 3432180 - DNA, 17 bp, Homo sapiens
atcctcaaacactgcag

SEQ ID NO: 3432181 - DNA, 19 bp, Homo sapiens
atcctcaaacactgcaggc

SEQ ID NO: 3432182 - DNA, 19 bp, Homo sapiens
atcctccacgttctgctca

SEQ ID NO: 3432183 - DNA, 11 bp, Homo sapiens
atcctccagca

SEQ ID NO: 3432184 - DNA, 15 bp, Homo sapiens
atcctccagcaggga

SEQ ID NO: 3432185 - DNA, 20 bp, Homo sapiens
atcctccagtaccttgcttc

SEQ ID NO: 3432186 - DNA, 13 bp, Homo sapiens
atcctcctccagg

SEQ ID NO: 3432187 - DNA, 11 bp, Homo sapiens
atcctcctccc

SEQ ID NO: 3432188 - DNA, 13 bp, Homo sapiens
atcctctcacctc

SEQ ID NO: 3432189 - DNA, 12 bp, Homo sapiens
atcctctctggg

SEQ ID NO: 3432190 - DNA, 20 bp, Homo sapiens
atcctctctggggctgtgtt

SEQ ID NO: 3432191 - DNA, 13 bp, Homo sapiens
atcctctgactcc

SEQ ID NO: 3432192 - DNA, 15 bp, Homo sapiens
atcctctttagagtt

SEQ ID NO: 3432193 - DNA, 23 bp, Homo sapiens
atcctctttagagttagactgtt

SEQ ID NO: 3432194 - DNA, 15 bp, Homo sapiens
atcctctttttccaa

SEQ ID NO: 3432195 - DNA, 21 bp, Homo sapiens
atcctgaaatagaggctaaat

SEQ ID NO: 3432196 - DNA, 16 bp, Homo sapiens
atcctgcgggtggggc

SEQ ID NO: 3432197 - DNA, 14 bp, Homo sapiens
atcctgctgttcta

SEQ ID NO: 3432198 - DNA, 15 bp, Homo sapiens
atcctgctgttctag

SEQ ID NO: 3432199 - DNA, 16 bp, Homo sapiens
atcctggaggcccagt

SEQ ID NO: 3432200 - DNA, 14 bp, Homo sapiens
atcctggaggtctt

SEQ ID NO: 3432201 - DNA, 21 bp, Homo sapiens
atcctgggctgggtggcccct

SEQ ID NO: 3432202 - DNA, 16 bp, Homo sapiens
atcctgtattcagaca

SEQ ID NO: 3432203 - DNA, 18 bp, Homo sapiens
atcctgtattcagacaga

SEQ ID NO: 3432204 - DNA, 20 bp, Homo sapiens
atcctgtattcagacagatg

SEQ ID NO: 3432205 - DNA, 14 bp, Homo sapiens
atccttagatctgg

SEQ ID NO: 3432206 - DNA, 19 bp, Homo sapiens
atccttcatcttttaaaga

SEQ ID NO: 3432207 - DNA, 12 bp, Homo sapiens
atccttcccaag

SEQ ID NO: 3432208 - DNA, 20 bp, Homo sapiens
atcctttcctcattaaatta

SEQ ID NO: 3432209 - DNA, 16 bp, Homo sapiens
atccttttcttctatg

SEQ ID NO: 3432210 - DNA, 18 bp, Homo sapiens
atccttttgtagaatgaa

SEQ ID NO: 3432211 - DNA, 15 bp, Homo sapiens
atcgaaccgttttga

SEQ ID NO: 3432212 - DNA, 18 bp, Homo sapiens
atcgaatctactaattcc

SEQ ID NO: 3432213 - DNA, 20 bp, Homo sapiens
atcgaatctactaattccac

SEQ ID NO: 3432214 - DNA, 21 bp, Homo sapiens
atcgacttgtttttgcacatg

SEQ ID NO: 3432215 - DNA, 15 bp, Homo sapiens
atcgatgttatgtaa

SEQ ID NO: 3432216 - DNA, 18 bp, Homo sapiens
atcgattcaaactgctcc

SEQ ID NO: 3432217 - DNA, 17 bp, Homo sapiens
atcgcaccattctgact

SEQ ID NO: 3432218 - DNA, 15 bp, Homo sapiens
atcgcatttcctaag

SEQ ID NO: 3432219 - DNA, 20 bp, Homo sapiens
atcgcggcggagctggcccc

SEQ ID NO: 3432220 - DNA, 21 bp, Homo sapiens
atcggatctggggctctggga

SEQ ID NO: 3432221 - DNA, 14 bp, Homo sapiens
atcgtaaagctgtt

SEQ ID NO: 3432222 - DNA, 19 bp, Homo sapiens
atcgtcagcgacagcctgg

SEQ ID NO: 3432223 - DNA, 15 bp, Homo sapiens
atcgtgacaacactt

SEQ ID NO: 3432224 - DNA, 14 bp, Homo sapiens
atctaaagttatat

SEQ ID NO: 3432225 - DNA, 16 bp, Homo sapiens
atctaaagttatattt

SEQ ID NO: 3432226 - DNA, 14 bp, Homo sapiens
atctaacctcatct

SEQ ID NO: 3432227 - DNA, 15 bp, Homo sapiens
atctaacctcatctt

SEQ ID NO: 3432228 - DNA, 16 bp, Homo sapiens
atctaatatggccaca

SEQ ID NO: 3432229 - DNA, 20 bp, Homo sapiens
atctaatatgtaacaagcca

SEQ ID NO: 3432230 - DNA, 14 bp, Homo sapiens
atctacccaaagga

SEQ ID NO: 3432231 - DNA, 19 bp, Homo sapiens
atctactaattccacacct

SEQ ID NO: 3432232 - DNA, 23 bp, Homo sapiens
atctactttttgaacttttcatt

SEQ ID NO: 3432233 - DNA, 19 bp, Homo sapiens
atctagattatggagcttt

SEQ ID NO: 3432234 - DNA, 18 bp, Homo sapiens
atctagcaaatgttatgc

SEQ ID NO: 3432235 - DNA, 18 bp, Homo sapiens
atctagctctagttcaaa

SEQ ID NO: 3432236 - DNA, 13 bp, Homo sapiens
atctatttaagta

SEQ ID NO: 3432237 - DNA, 14 bp, Homo sapiens
atctcaccccatcc

SEQ ID NO: 3432238 - DNA, 12 bp, Homo sapiens
atctcactctgc

SEQ ID NO: 3432239 - DNA, 16 bp, Homo sapiens
atctcactctgccccc

SEQ ID NO: 3432240 - DNA, 13 bp, Homo sapiens
atctcacttgtgc

SEQ ID NO: 3432241 - DNA, 18 bp, Homo sapiens
atctcacttgtgccaaca

SEQ ID NO: 3432242 - DNA, 19 bp, Homo sapiens
atctcagagacaggtggcc

SEQ ID NO: 3432243 - DNA, 20 bp, Homo sapiens
atctcagatcagtgtaccat

SEQ ID NO: 3432244 - DNA, 16 bp, Homo sapiens
atctcaggagcttgca

SEQ ID NO: 3432245 - DNA, 18 bp, Homo sapiens
atctcatgaggggagagg

SEQ ID NO: 3432246 - DNA, 20 bp, Homo sapiens
atctcattactgcttcattt

SEQ ID NO: 3432247 - DNA, 22 bp, Homo sapiens
atctcattactgcttcattttt

SEQ ID NO: 3432248 - DNA, 15 bp, Homo sapiens
atctcattggaccct

SEQ ID NO: 3432249 - DNA, 18 bp, Homo sapiens
atctccaagaccagagat

SEQ ID NO: 3432250 - DNA, 22 bp, Homo sapiens
atctcccccatcccccactgcc

SEQ ID NO: 3432251 - DNA, 14 bp, Homo sapiens
atctcccctcagct

SEQ ID NO: 3432252 - DNA, 16 bp, Homo sapiens
atctcccctcagctcg

SEQ ID NO: 3432253 - DNA, 16 bp, Homo sapiens
atctccggctcccagc

SEQ ID NO: 3432254 - DNA, 18 bp, Homo sapiens
atctccggctcccagcct

SEQ ID NO: 3432255 - DNA, 19 bp, Homo sapiens
atctccggctcccagcctc

SEQ ID NO: 3432256 - DNA, 22 bp, Homo sapiens
atctccggctcccagcctcagc

SEQ ID NO: 3432257 - DNA, 15 bp, Homo sapiens
atctctaccccctca

SEQ ID NO: 3432258 - DNA, 16 bp, Homo sapiens
atctctcatcctccag

SEQ ID NO: 3432259 - DNA, 14 bp, Homo sapiens
atctctctgcccaa

SEQ ID NO: 3432260 - DNA, 15 bp, Homo sapiens
atctctgcctgacaa

SEQ ID NO: 3432261 - DNA, 20 bp, Homo sapiens
atctctgcctgacaaggcca

SEQ ID NO: 3432262 - DNA, 21 bp, Homo sapiens
atctctgcctgacaaggccag

SEQ ID NO: 3432263 - DNA, 22 bp, Homo sapiens
atctctgcctgacaaggccagc

SEQ ID NO: 3432264 - DNA, 18 bp, Homo sapiens
atctcttagcattttaat

SEQ ID NO: 3432265 - DNA, 18 bp, Homo sapiens
atctcttagctcccctcc

SEQ ID NO: 3432266 - DNA, 23 bp, Homo sapiens
atctcttagctcccctccaacct

SEQ ID NO: 3432267 - DNA, 11 bp, Homo sapiens
atctcttcctt

SEQ ID NO: 3432268 - DNA, 14 bp, Homo sapiens
atctctttagagaa

SEQ ID NO: 3432269 - DNA, 19 bp, Homo sapiens
atctcttttatatttgtag

SEQ ID NO: 3432270 - DNA, 18 bp, Homo sapiens
atctgaaggggcaaattc

SEQ ID NO: 3432271 - DNA, 20 bp, Homo sapiens
atctgacatgattccttcct

SEQ ID NO: 3432272 - DNA, 12 bp, Homo sapiens
atctgacccagt

SEQ ID NO: 3432273 - DNA, 23 bp, Homo sapiens
atctgaggcatccagcagtctct

SEQ ID NO: 3432274 - DNA, 15 bp, Homo sapiens
atctgaggcatcctc

SEQ ID NO: 3432275 - DNA, 20 bp, Homo sapiens
atctgaggcatcctctgact

SEQ ID NO: 3432276 - DNA, 19 bp, Homo sapiens
atctgcacccccctgggct

SEQ ID NO: 3432277 - DNA, 13 bp, Homo sapiens
atctgcagaagga

SEQ ID NO: 3432278 - DNA, 20 bp, Homo sapiens
atctgcagaaggaaaaatgt

SEQ ID NO: 3432279 - DNA, 23 bp, Homo sapiens
atctgcagaaggaaaaatgtgta

SEQ ID NO: 3432280 - DNA, 17 bp, Homo sapiens
atctgcattgcccagtc

SEQ ID NO: 3432281 - DNA, 14 bp, Homo sapiens
atctgcccaactgt

SEQ ID NO: 3432282 - DNA, 22 bp, Homo sapiens
atctgcctgacaggctgtgact

SEQ ID NO: 3432283 - DNA, 19 bp, Homo sapiens
atctgcctttattgtgttt

SEQ ID NO: 3432284 - DNA, 13 bp, Homo sapiens
atctgctcacttt

SEQ ID NO: 3432285 - DNA, 20 bp, Homo sapiens
atctgctctccttcctggag

SEQ ID NO: 3432286 - DNA, 21 bp, Homo sapiens
atctgctctccttcctggagc

SEQ ID NO: 3432287 - DNA, 13 bp, Homo sapiens
atctgctgccccg

SEQ ID NO: 3432288 - DNA, 12 bp, Homo sapiens
atctggaaaggg

SEQ ID NO: 3432289 - DNA, 14 bp, Homo sapiens
atctggaacccaga

SEQ ID NO: 3432290 - DNA, 16 bp, Homo sapiens
atctggaacctcagcc

SEQ ID NO: 3432291 - DNA, 20 bp, Homo sapiens
atctggaacctcagcctggc

SEQ ID NO: 3432292 - DNA, 23 bp, Homo sapiens
atctggccgttgatgttggctgg

SEQ ID NO: 3432293 - DNA, 16 bp, Homo sapiens
atctggctgcctttgc

SEQ ID NO: 3432294 - DNA, 14 bp, Homo sapiens
atctggctgtgaca

SEQ ID NO: 3432295 - DNA, 18 bp, Homo sapiens
atctgggcatagatgcag

SEQ ID NO: 3432296 - DNA, 23 bp, Homo sapiens
atctggggcagcaccctataaat

SEQ ID NO: 3432297 - DNA, 19 bp, Homo sapiens
atctgggttcactgcaacc

SEQ ID NO: 3432298 - DNA, 14 bp, Homo sapiens
atctggtcctaccc

SEQ ID NO: 3432299 - DNA, 17 bp, Homo sapiens
atctggtcctacccatc

SEQ ID NO: 3432300 - DNA, 17 bp, Homo sapiens
atctggttaggatggca

SEQ ID NO: 3432301 - DNA, 14 bp, Homo sapiens
atctgtatatacaa

SEQ ID NO: 3432302 - DNA, 21 bp, Homo sapiens
atctgtatatacaataacata

SEQ ID NO: 3432303 - DNA, 17 bp, Homo sapiens
atctgtatcttttctct

SEQ ID NO: 3432304 - DNA, 22 bp, Homo sapiens
atctgtcatttgagcagggctc

SEQ ID NO: 3432305 - DNA, 14 bp, Homo sapiens
atctgtcctcagcc

SEQ ID NO: 3432306 - DNA, 16 bp, Homo sapiens
atctgtcctcagcctt

SEQ ID NO: 3432307 - DNA, 18 bp, Homo sapiens
atctgtcctcagccttgc

SEQ ID NO: 3432308 - DNA, 17 bp, Homo sapiens
atctgtcttgccagcca

SEQ ID NO: 3432309 - DNA, 23 bp, Homo sapiens
atctgtcttgccagccagaagcc

SEQ ID NO: 3432310 - DNA, 16 bp, Homo sapiens
atctgtgagtgaaagt

SEQ ID NO: 3432311 - DNA, 23 bp, Homo sapiens
atctgtgagtgaaagttgccatt

SEQ ID NO: 3432312 - DNA, 15 bp, Homo sapiens
atctgtgtcttgttt

SEQ ID NO: 3432313 - DNA, 18 bp, Homo sapiens
atgatcacggctcactgc

SEQ ID NO: 3432314 - DNA, 23 bp, Homo sapiens
atgatcacggctcactgcagcct

SEQ ID NO: 3432315 - DNA, 20 bp, Homo sapiens
atgatcagtgttgttgctct

SEQ ID NO: 3432316 - DNA, 17 bp, Homo sapiens
atgatccaagcaagact

SEQ ID NO: 3432317 - DNA, 12 bp, Homo sapiens
atgatctcagga

SEQ ID NO: 3432318 - DNA, 13 bp, Homo sapiens
atgatctcaggag

SEQ ID NO: 3432319 - DNA, 15 bp, Homo sapiens
atgatctcaggagct

SEQ ID NO: 3432320 - DNA, 18 bp, Homo sapiens
atgatctttgcagacagg

SEQ ID NO: 3432321 - DNA, 21 bp, Homo sapiens
atgatctttgcagacaggcaa

SEQ ID NO: 3432322 - DNA, 22 bp, Homo sapiens
atgatgctcaaaatctttccaa

SEQ ID NO: 3432323 - DNA, 16 bp, Homo sapiens
atgatgcttttactga

SEQ ID NO: 3432324 - DNA, 21 bp, Homo sapiens
atgatgtagtgcctctttcat

SEQ ID NO: 3432325 - DNA, 16 bp, Homo sapiens
atgatgtttgcccaaa

SEQ ID NO: 3432326 - DNA, 19 bp, Homo sapiens
atgatgtttgcccaaaatt

SEQ ID NO: 3432327 - DNA, 19 bp, Homo sapiens
atgattaaccacttcagct

SEQ ID NO: 3432328 - DNA, 14 bp, Homo sapiens
atgattcaagccat

SEQ ID NO: 3432329 - DNA, 14 bp, Homo sapiens
atgattcaggtgca

SEQ ID NO: 3432330 - DNA, 15 bp, Homo sapiens
atgattccttcctgt

SEQ ID NO: 3432331 - DNA, 23 bp, Homo sapiens
atgattctaatttttaagcaaaa

SEQ ID NO: 3432332 - DNA, 22 bp, Homo sapiens
atgattctatttatatgtacat

SEQ ID NO: 3432333 - DNA, 11 bp, Homo sapiens
atgatttgtca

SEQ ID NO: 3432334 - DNA, 14 bp, Homo sapiens
atgcaaagaggcaa

SEQ ID NO: 3432335 - DNA, 15 bp, Homo sapiens
atgcaaagaggcaag

SEQ ID NO: 3432336 - DNA, 13 bp, Homo sapiens
atgcaaaggctgg

SEQ ID NO: 3432337 - DNA, 11 bp, Homo sapiens
atgcaaatcct

SEQ ID NO: 3432338 - DNA, 19 bp, Homo sapiens
atgcaaatcctatgtgatt

SEQ ID NO: 3432339 - DNA, 16 bp, Homo sapiens
atgcaagagaacattt

SEQ ID NO: 3432340 - DNA, 18 bp, Homo sapiens
atgcaagagaacatttta

SEQ ID NO: 3432341 - DNA, 15 bp, Homo sapiens
atgcaagatacagga

SEQ ID NO: 3432342 - DNA, 13 bp, Homo sapiens
atgcaagggactg

SEQ ID NO: 3432343 - DNA, 15 bp, Homo sapiens
atgcacaagatgccc

SEQ ID NO: 3432344 - DNA, 13 bp, Homo sapiens
atgcaccagccct

SEQ ID NO: 3432345 - DNA, 14 bp, Homo sapiens
atgcaccagccctt

SEQ ID NO: 3432346 - DNA, 14 bp, Homo sapiens
atgcactcagctct

SEQ ID NO: 3432347 - DNA, 19 bp, Homo sapiens
atgcacttataattttcct

SEQ ID NO: 3432348 - DNA, 12 bp, Homo sapiens
atgcagaatgtt

SEQ ID NO: 3432349 - DNA, 22 bp, Homo sapiens
atgcagacatgagtgcgtgctc

SEQ ID NO: 3432350 - DNA, 20 bp, Homo sapiens
atgcagcagggatgccctgg

SEQ ID NO: 3432351 - DNA, 15 bp, Homo sapiens
atgcagggcagtcat

SEQ ID NO: 3432352 - DNA, 19 bp, Homo sapiens
atgcagggcctcacacggt

SEQ ID NO: 3432353 - DNA, 18 bp, Homo sapiens
atgcagtctgtccaggct

SEQ ID NO: 3432354 - DNA, 20 bp, Homo sapiens
atgcagtctgtccaggctcg

SEQ ID NO: 3432355 - DNA, 20 bp, Homo sapiens
atgcagtgctcgctgttgct

SEQ ID NO: 3432356 - DNA, 18 bp, Homo sapiens
atgcagtttgaaattctg

SEQ ID NO: 3432357 - DNA, 20 bp, Homo sapiens
atgcatctgtttattctata

SEQ ID NO: 3432358 - DNA, 16 bp, Homo sapiens
atgcatcttactgaag

SEQ ID NO: 3432359 - DNA, 19 bp, Homo sapiens
atgcatggtgccccaggac

SEQ ID NO: 3432360 - DNA, 22 bp, Homo sapiens
atgcatgttgaccatgtctatg

SEQ ID NO: 3432361 - DNA, 15 bp, Homo sapiens
atgcattgctctgga

SEQ ID NO: 3432362 - DNA, 19 bp, Homo sapiens
atgcatttatagatcattt

SEQ ID NO: 3432363 - DNA, 22 bp, Homo sapiens
atgcatttatagatcatttcta

SEQ ID NO: 3432364 - DNA, 23 bp, Homo sapiens
atgcattttgtttggtattgtat

SEQ ID NO: 3432365 - DNA, 15 bp, Homo sapiens
atgccactgccttcg

SEQ ID NO: 3432366 - DNA, 18 bp, Homo sapiens
atgccactgccttcgctt

SEQ ID NO: 3432367 - DNA, 12 bp, Homo sapiens
atgcccaaggga

SEQ ID NO: 3432368 - DNA, 15 bp, Homo sapiens
atgcccaagggaaag

SEQ ID NO: 3432369 - DNA, 14 bp, Homo sapiens
atgccctcctctcc

SEQ ID NO: 3432370 - DNA, 13 bp, Homo sapiens
atgccctgtgcaa

SEQ ID NO: 3432371 - DNA, 23 bp, Homo sapiens
atgccctgtgcaacctcttggcc

SEQ ID NO: 3432372 - DNA, 13 bp, Homo sapiens
atgcctacttttg

SEQ ID NO: 3432373 - DNA, 17 bp, Homo sapiens
atgcctacttttggcct

SEQ ID NO: 3432374 - DNA, 19 bp, Homo sapiens
atgcctacttttggcctca

SEQ ID NO: 3432375 - DNA, 20 bp, Homo sapiens
atgcctcactaatttttgta

SEQ ID NO: 3432376 - DNA, 20 bp, Homo sapiens
atgcctcagccctgaccctg

SEQ ID NO: 3432377 - DNA, 24 bp, Homo sapiens
atgcctcagccctgaccctgtgga

SEQ ID NO: 3432378 - DNA, 19 bp, Homo sapiens
atgcctgagtgcctggcca

SEQ ID NO: 3432379 - DNA, 20 bp, Homo sapiens
atgcctgagtgcctggccaa

SEQ ID NO: 3432380 - DNA, 17 bp, Homo sapiens
atgcctgggttgctgct

SEQ ID NO: 3432381 - DNA, 18 bp, Homo sapiens
atgcctggtattttcaac

SEQ ID NO: 3432382 - DNA, 18 bp, Homo sapiens
atgcctggtggcagctgc

SEQ ID NO: 3432383 - DNA, 15 bp, Homo sapiens
atgccttgaataata

SEQ ID NO: 3432384 - DNA, 23 bp, Homo sapiens
atgccttgaataataagcaggat

SEQ ID NO: 3432385 - DNA, 16 bp, Homo sapiens
atgccttttttgtagt

SEQ ID NO: 3432386 - DNA, 20 bp, Homo sapiens
atgcgacactgggaggccag

SEQ ID NO: 3432387 - DNA, 23 bp, Homo sapiens
atgcgcagccccatctgtgcatt

SEQ ID NO: 3432388 - DNA, 22 bp, Homo sapiens
atgcgcattctaacctggaggt

SEQ ID NO: 3432389 - DNA, 18 bp, Homo sapiens
atgcgccccctccgccct

SEQ ID NO: 3432390 - DNA, 15 bp, Homo sapiens
atgcgctcagggcca

SEQ ID NO: 3432391 - DNA, 21 bp, Homo sapiens
atgcggtagccagcacacagg

SEQ ID NO: 3432392 - DNA, 18 bp, Homo sapiens
atgctacaggatttgaaa

SEQ ID NO: 3432393 - DNA, 14 bp, Homo sapiens
atgctcagaccagc

SEQ ID NO: 3432394 - DNA, 16 bp, Homo sapiens
atgctcataacggatc

SEQ ID NO: 3432395 - DNA, 16 bp, Homo sapiens
atgctccttgggccct

SEQ ID NO: 3432396 - DNA, 18 bp, Homo sapiens
atgctccttgttcctaga

SEQ ID NO: 3432397 - DNA, 19 bp, Homo sapiens
atgctctccaaaccacttt

SEQ ID NO: 3432398 - DNA, 16 bp, Homo sapiens
atgctcttttgtttgg

SEQ ID NO: 3432399 - DNA, 14 bp, Homo sapiens
atgctgaggcctgg

SEQ ID NO: 3432400 - DNA, 15 bp, Homo sapiens
atgctgaggcctggg

SEQ ID NO: 3432401 - DNA, 18 bp, Homo sapiens
atgctgaggcctgggccg

SEQ ID NO: 3432402 - DNA, 22 bp, Homo sapiens
atgctgaggcctgggccgctgc

SEQ ID NO: 3432403 - DNA, 14 bp, Homo sapiens
atgctgatcatcgc

SEQ ID NO: 3432404 - DNA, 19 bp, Homo sapiens
atgctgatcatcgccagag

SEQ ID NO: 3432405 - DNA, 16 bp, Homo sapiens
atgctgcaacaaaatg

SEQ ID NO: 3432406 - DNA, 20 bp, Homo sapiens
atgctgcaacaaaatgtaga

SEQ ID NO: 3432407 - DNA, 20 bp, Homo sapiens
atgctgcagatttgggctgg

SEQ ID NO: 3432408 - DNA, 18 bp, Homo sapiens
atgctgcaggacttgaga

SEQ ID NO: 3432409 - DNA, 19 bp, Homo sapiens
atgctgcaggacttgagaa

SEQ ID NO: 3432410 - DNA, 13 bp, Homo sapiens
atgctgccggcac

SEQ ID NO: 3432411 - DNA, 20 bp, Homo sapiens
atgctgccggcacagctggg

SEQ ID NO: 3432412 - DNA, 21 bp, Homo sapiens
atgctgccggcacagctggga

SEQ ID NO: 3432413 - DNA, 16 bp, Homo sapiens
atgctgctagatcttt

SEQ ID NO: 3432414 - DNA, 15 bp, Homo sapiens
atgctggcccagggc

SEQ ID NO: 3432415 - DNA, 19 bp, Homo sapiens
atgctggcccagggcccag

SEQ ID NO: 3432416 - DNA, 20 bp, Homo sapiens
atgctggctgttggctgggg

SEQ ID NO: 3432417 - DNA, 9 bp, Homo sapiens
atgctggga

SEQ ID NO: 3432418 - DNA, 22 bp, Homo sapiens
atgctgtacatctattttggat

SEQ ID NO: 3432419 - DNA, 14 bp, Homo sapiens
atgctgtgatacct

SEQ ID NO: 3432420 - DNA, 23 bp, Homo sapiens
atgcttacatctggaatctgagg

SEQ ID NO: 3432421 - DNA, 17 bp, Homo sapiens
atgcttagatgttccag

SEQ ID NO: 3432422 - DNA, 19 bp, Homo sapiens
atgcttgcaaaaactacaa

SEQ ID NO: 3432423 - DNA, 20 bp, Homo sapiens
atgctttccaaaccttatct

SEQ ID NO: 3432424 - DNA, 17 bp, Homo sapiens
atgctttttgagtttca

SEQ ID NO: 3432425 - DNA, 11 bp, Homo sapiens
atggaaaaaaa

SEQ ID NO: 3432426 - DNA, 15 bp, Homo sapiens
atggaaaaacttgtg

SEQ ID NO: 3432427 - DNA, 22 bp, Homo sapiens
atggaaaacatttcaagtttac

SEQ ID NO: 3432428 - DNA, 14 bp, Homo sapiens
atggaaaagagata

SEQ ID NO: 3432429 - DNA, 15 bp, Homo sapiens
atggaaactggccag

SEQ ID NO: 3432430 - DNA, 20 bp, Homo sapiens
atggaaactggccaggggtc

SEQ ID NO: 3432431 - DNA, 16 bp, Homo sapiens
atggaaattttgctat

SEQ ID NO: 3432432 - DNA, 16 bp, Homo sapiens
atggaaccaggcttgg

SEQ ID NO: 3432433 - DNA, 17 bp, Homo sapiens
atggaaccgcaggaagc

SEQ ID NO: 3432434 - DNA, 14 bp, Homo sapiens
atggaacttagcca

SEQ ID NO: 3432435 - DNA, 18 bp, Homo sapiens
atggaattgatttgcatt

SEQ ID NO: 3432436 - DNA, 19 bp, Homo sapiens
atggaattgatttgcattg

SEQ ID NO: 3432437 - DNA, 21 bp, Homo sapiens
atggacccaatatttaccaga

SEQ ID NO: 3432438 - DNA, 17 bp, Homo sapiens
atggacggtgctccagg

SEQ ID NO: 3432439 - DNA, 22 bp, Homo sapiens
atggacggtgctccaggcaggc

SEQ ID NO: 3432440 - DNA, 13 bp, Homo sapiens
atggactatctgt

SEQ ID NO: 3432441 - DNA, 13 bp, Homo sapiens
atggagagctgga

SEQ ID NO: 3432442 - DNA, 18 bp, Homo sapiens
atggagccagctccctct

SEQ ID NO: 3432443 - DNA, 14 bp, Homo sapiens
atggagctcagaga

SEQ ID NO: 3432444 - DNA, 21 bp, Homo sapiens
atggagtcatttgagtctctt

SEQ ID NO: 3432445 - DNA, 19 bp, Homo sapiens
atgtgggggcttcatctct

SEQ ID NO: 3432446 - DNA, 13 bp, Homo sapiens
atgtggtgatgat

SEQ ID NO: 3432447 - DNA, 16 bp, Homo sapiens
atgtggttgaagagca

SEQ ID NO: 3432448 - DNA, 22 bp, Homo sapiens
atgtgtatatatatgtgaggat

SEQ ID NO: 3432449 - DNA, 21 bp, Homo sapiens
atgtgtcagtggggctctctg

SEQ ID NO: 3432450 - DNA, 22 bp, Homo sapiens
atgtgtcagtggggctctctga

SEQ ID NO: 3432451 - DNA, 22 bp, Homo sapiens
atgtgtgtccacgactgtctcc

SEQ ID NO: 3432452 - DNA, 12 bp, Homo sapiens
atgtgtttcaaa

SEQ ID NO: 3432453 - DNA, 12 bp, Homo sapiens
atgtgtttgctt

SEQ ID NO: 3432454 - DNA, 20 bp, Homo sapiens
atgtgttttgtttattaaat

SEQ ID NO: 3432455 - DNA, 15 bp, Homo sapiens
atgttaaactagcat

SEQ ID NO: 3432456 - DNA, 14 bp, Homo sapiens
atgttaaataaatt

SEQ ID NO: 3432457 - DNA, 19 bp, Homo sapiens
atgttaaataaattgtata

SEQ ID NO: 3432458 - DNA, 15 bp, Homo sapiens
atgttaactttgtgg

SEQ ID NO: 3432459 - DNA, 19 bp, Homo sapiens
atgttaagtcctccctgac

SEQ ID NO: 3432460 - DNA, 24 bp, Homo sapiens
atgttagactcatggtgtgttaca

SEQ ID NO: 3432461 - DNA, 16 bp, Homo sapiens
atgttatatcatatgt

SEQ ID NO: 3432462 - DNA, 19 bp, Homo sapiens
atgttatatcatatgtata

SEQ ID NO: 3432463 - DNA, 23 bp, Homo sapiens
atgttatttaacagctgaattat

SEQ ID NO: 3432464 - DNA, 12 bp, Homo sapiens
atgttcaaagac

SEQ ID NO: 3432465 - DNA, 14 bp, Homo sapiens
atgttcaactggag

SEQ ID NO: 3432466 - DNA, 18 bp, Homo sapiens
atgttcacttttgacaaa

SEQ ID NO: 3432467 - DNA, 19 bp, Homo sapiens
atgttcatcccatgatgta

SEQ ID NO: 3432468 - DNA, 18 bp, Homo sapiens
atgttctaagtctttcca

SEQ ID NO: 3432469 - DNA, 18 bp, Homo sapiens
atgttctctatcatttaa

SEQ ID NO: 3432470 - DNA, 13 bp, Homo sapiens
atgttctctgagg

SEQ ID NO: 3432471 - DNA, 18 bp, Homo sapiens
atgttctgtcttcccaaa

SEQ ID NO: 3432472 - DNA, 22 bp, Homo sapiens
atgttgagaatcccaaatttga

SEQ ID NO: 3432473 - DNA, 13 bp, Homo sapiens
atgttgaggtgga

SEQ ID NO: 3432474 - DNA, 23 bp, Homo sapiens
atgttgatccatccagcttgcca

SEQ ID NO: 3432475 - DNA, 12 bp, Homo sapiens
atgttgcccagg

SEQ ID NO: 3432476 - DNA, 16 bp, Homo sapiens
atgttgcccaggcagg

SEQ ID NO: 3432477 - DNA, 17 bp, Homo sapiens
atgttgcccaggcaggt

SEQ ID NO: 3432478 - DNA, 20 bp, Homo sapiens
atgttgcccaggcaggtctt

SEQ ID NO: 3432479 - DNA, 22 bp, Homo sapiens
atgttgcccctttctcttttcc

SEQ ID NO: 3432480 - DNA, 19 bp, Homo sapiens
atgttggaggagagagcct

SEQ ID NO: 3432481 - DNA, 20 bp, Homo sapiens
atgttgtaattttacttttt

SEQ ID NO: 3432482 - DNA, 15 bp, Homo sapiens
atgttgtcaaagaga

SEQ ID NO: 3432483 - DNA, 20 bp, Homo sapiens
atgttgtgtttggatttgta

SEQ ID NO: 3432484 - DNA, 14 bp, Homo sapiens
atgtttaaaacatc

SEQ ID NO: 3432485 - DNA, 16 bp, Homo sapiens
atgtttacaaatggac

SEQ ID NO: 3432486 - DNA, 15 bp, Homo sapiens
atgtttccagacttc

SEQ ID NO: 3432487 - DNA, 13 bp, Homo sapiens
atgtttccagcag

SEQ ID NO: 3432488 - DNA, 20 bp, Homo sapiens
atgtttcctctagttctttg

SEQ ID NO: 3432489 - DNA, 18 bp, Homo sapiens
atgtttcttttgtatgta

SEQ ID NO: 3432490 - DNA, 17 bp, Homo sapiens
atgtttgcctctgcctc

SEQ ID NO: 3432491 - DNA, 15 bp, Homo sapiens
atgtttgtaactttt

SEQ ID NO: 3432492 - DNA, 12 bp, Homo sapiens
atgttttaaaga

SEQ ID NO: 3432493 - DNA, 13 bp, Homo sapiens
atgttttaaagaa

SEQ ID NO: 3432494 - DNA, 14 bp, Homo sapiens
atgttttaaatgta

SEQ ID NO: 3432495 - DNA, 15 bp, Homo sapiens
atgttttaaatgtac

SEQ ID NO: 3432496 - DNA, 19 bp, Homo sapiens
atgttttccagctcctcat

SEQ ID NO: 3432497 - DNA, 18 bp, Homo sapiens
atgttttctttgcaaagt

SEQ ID NO: 3432498 - DNA, 18 bp, Homo sapiens
atgttttctttgctttaa

SEQ ID NO: 3432499 - DNA, 18 bp, Homo sapiens
atgttttgtgggaacaga

SEQ ID NO: 3432500 - DNA, 22 bp, Homo sapiens
atgttttttaaaatatttatct

SEQ ID NO: 3432501 - DNA, 15 bp, Homo sapiens
atgttttttcatgtg

SEQ ID NO: 3432502 - DNA, 14 bp, Homo sapiens
attaaaaaaaacaa

SEQ ID NO: 3432503 - DNA, 19 bp, Homo sapiens
attaaaaaaaacaaaaaga

SEQ ID NO: 3432504 - DNA, 15 bp, Homo sapiens
attaaaaatataaaa

SEQ ID NO: 3432505 - DNA, 16 bp, Homo sapiens
attaaaaatataaaac

SEQ ID NO: 3432506 - DNA, 14 bp, Homo sapiens
attaaaatattttg

SEQ ID NO: 3432507 - DNA, 15 bp, Homo sapiens
attaaaatattttgg

SEQ ID NO: 3432508 - DNA, 14 bp, Homo sapiens
attaaaatcctcaa

SEQ ID NO: 3432509 - DNA, 17 bp, Homo sapiens
attaaagctaaagtatc

SEQ ID NO: 3432510 - DNA, 17 bp, Homo sapiens
attaaatacaaaacttc

SEQ ID NO: 3432511 - DNA, 13 bp, Homo sapiens
attaaattcacaa

SEQ ID NO: 3432512 - DNA, 19 bp, Homo sapiens
attaacaattaggcagact

SEQ ID NO: 3432513 - DNA, 13 bp, Homo sapiens
attaacacaaagg

SEQ ID NO: 3432514 - DNA, 11 bp, Homo sapiens
attaacatgat

SEQ ID NO: 3432515 - DNA, 23 bp, Homo sapiens
attaacatgatgtactaaagtag

SEQ ID NO: 3432516 - DNA, 17 bp, Homo sapiens
attaaccacttcagctg

SEQ ID NO: 3432517 - DNA, 17 bp, Homo sapiens
attaaccttactaatta

SEQ ID NO: 3432518 - DNA, 20 bp, Homo sapiens
attaagaaaatcatattgct

SEQ ID NO: 3432519 - DNA, 19 bp, Homo sapiens
attaagaaggcaaaaatgt

SEQ ID NO: 3432520 - DNA, 19 bp, Homo sapiens
attaagatgccttgaattg

SEQ ID NO: 3432521 - DNA, 20 bp, Homo sapiens
attaagccacttaaaatgtt

SEQ ID NO: 3432522 - DNA, 13 bp, Homo sapiens
attaaggaagaca

SEQ ID NO: 3432523 - DNA, 23 bp, Homo sapiens
attaaggatgtagcttttcacct

SEQ ID NO: 3432524 - DNA, 13 bp, Homo sapiens
attaagttcttta

SEQ ID NO: 3432525 - DNA, 12 bp, Homo sapiens
attaataatctt

SEQ ID NO: 3432526 - DNA, 13 bp, Homo sapiens
attaataatctta

SEQ ID NO: 3432527 - DNA, 16 bp, Homo sapiens
attaatagtaatttgt

SEQ ID NO: 3432528 - DNA, 19 bp, Homo sapiens
attaatctaccttgcagtg

SEQ ID NO: 3432529 - DNA, 16 bp, Homo sapiens
attaatgacacttgtc

SEQ ID NO: 3432530 - DNA, 22 bp, Homo sapiens
attaatgtagctgctagctatt

SEQ ID NO: 3432531 - DNA, 13 bp, Homo sapiens
attaattgctttg

SEQ ID NO: 3432532 - DNA, 17 bp, Homo sapiens
attaatttatgcagaat

SEQ ID NO: 3432533 - DNA, 22 bp, Homo sapiens
attacaaatatatagcacatca

SEQ ID NO: 3432534 - DNA, 14 bp, Homo sapiens
attacaattttatc

SEQ ID NO: 3432535 - DNA, 15 bp, Homo sapiens
attacaattttatct

SEQ ID NO: 3432536 - DNA, 14 bp, Homo sapiens
attacacttggtaa

SEQ ID NO: 3432537 - DNA, 15 bp, Homo sapiens
attacaggcttgagc

SEQ ID NO: 3432538 - DNA, 16 bp, Homo sapiens
attacatctttcacat

SEQ ID NO: 3432539 - DNA, 19 bp, Homo sapiens
attacatgtaaaacattat

SEQ ID NO: 3432540 - DNA, 14 bp, Homo sapiens
attaccatgtaaat

SEQ ID NO: 3432541 - DNA, 17 bp, Homo sapiens
attaccatgtaaataat

SEQ ID NO: 3432542 - DNA, 19 bp, Homo sapiens
attacccagctaaataatc

SEQ ID NO: 3432543 - DNA, 20 bp, Homo sapiens
attaccccctccttcagaca

SEQ ID NO: 3432544 - DNA, 16 bp, Homo sapiens
attaccgcgttgtaaa

SEQ ID NO: 3432545 - DNA, 19 bp, Homo sapiens
attaccgcgttgtaaaata

SEQ ID NO: 3432546 - DNA, 20 bp, Homo sapiens
attaccgcgttgtaaaatat

SEQ ID NO: 3432547 - DNA, 13 bp, Homo sapiens
attacctctgata

SEQ ID NO: 3432548 - DNA, 20 bp, Homo sapiens
attacgtagcaggccatggc

SEQ ID NO: 3432549 - DNA, 18 bp, Homo sapiens
attacttatccctgccca

SEQ ID NO: 3432550 - DNA, 22 bp, Homo sapiens
attacttatccctgcccatttc

SEQ ID NO: 3432551 - DNA, 16 bp, Homo sapiens
attacttctctataaa

SEQ ID NO: 3432552 - DNA, 14 bp, Homo sapiens
attacttctgctac

SEQ ID NO: 3432553 - DNA, 18 bp, Homo sapiens
attagaaaatgttattta

SEQ ID NO: 3432554 - DNA, 22 bp, Homo sapiens
attagaaaatgttatttaacag

SEQ ID NO: 3432555 - DNA, 13 bp, Homo sapiens
attagaatagtgt

SEQ ID NO: 3432556 - DNA, 20 bp, Homo sapiens
attagagattacctcctgag

SEQ ID NO: 3432557 - DNA, 13 bp, Homo sapiens
attagagcaggcg

SEQ ID NO: 3432558 - DNA, 20 bp, Homo sapiens
attagatagtcatgctgcta

SEQ ID NO: 3432559 - DNA, 13 bp, Homo sapiens
attagatgcatgt

SEQ ID NO: 3432560 - DNA, 20 bp, Homo sapiens
attagatgcatgttgaccat

SEQ ID NO: 3432561 - DNA, 14 bp, Homo sapiens
attagatgttctct

SEQ ID NO: 3432562 - DNA, 12 bp, Homo sapiens
attagctgcttc

SEQ ID NO: 3432563 - DNA, 13 bp, Homo sapiens
attagctgcttct

SEQ ID NO: 3432564 - DNA, 21 bp, Homo sapiens
attagctgcttctatgtttca

SEQ ID NO: 3432565 - DNA, 15 bp, Homo sapiens
attagctttactgtt

SEQ ID NO: 3432566 - DNA, 20 bp, Homo sapiens
attagctttactgtttgtta

SEQ ID NO: 3432567 - DNA, 16 bp, Homo sapiens
attagctttttcatcc

SEQ ID NO: 3432568 - DNA, 14 bp, Homo sapiens
attaggcagactct

SEQ ID NO: 3432569 - DNA, 21 bp, Homo sapiens
attaggcagactctttatgct

SEQ ID NO: 3432570 - DNA, 17 bp, Homo sapiens
attagggagaaaattca

SEQ ID NO: 3432571 - DNA, 16 bp, Homo sapiens
attagtaaatgcttat

SEQ ID NO: 3432572 - DNA, 22 bp, Homo sapiens
attagtaccatagtaccattta

SEQ ID NO: 3432573 - DNA, 17 bp, Homo sapiens
attagtgctaagtgtga

SEQ ID NO: 3432574 - DNA, 20 bp, Homo sapiens
attagtgctaagtgtgaact

SEQ ID NO: 3432575 - DNA, 22 bp, Homo sapiens
attagtgctaagtgtgaactgg

SEQ ID NO: 3432576 - DNA, 19 bp, Homo sapiens
attagttgcactaactgct

SEQ ID NO: 3432577 - DNA, 19 bp, Homo sapiens
attagttgccaatatgcca

SEQ ID NO: 3432578 - DNA, 15 bp, Homo sapiens
attctttctgataac

SEQ ID NO: 3432579 - DNA, 22 bp, Homo sapiens
attctttgtaccatctgtcttg

SEQ ID NO: 3432580 - DNA, 22 bp, Homo sapiens
attcttttaaaagacaagactt

SEQ ID NO: 3432581 - DNA, 13 bp, Homo sapiens
attcttttgtaat

SEQ ID NO: 3432582 - DNA, 18 bp, Homo sapiens
attgaaaaaatagagcct

SEQ ID NO: 3432583 - DNA, 22 bp, Homo sapiens
attgaaaaaatagagcctgagg

SEQ ID NO: 3432584 - DNA, 15 bp, Homo sapiens
attgaaagtataatt

SEQ ID NO: 3432585 - DNA, 16 bp, Homo sapiens
attgaaagttctggaa

SEQ ID NO: 3432586 - DNA, 16 bp, Homo sapiens
attgaaatattataga

SEQ ID NO: 3432587 - DNA, 16 bp, Homo sapiens
attgaaatgactaaaa

SEQ ID NO: 3432588 - DNA, 14 bp, Homo sapiens
attgaacacaaact

SEQ ID NO: 3432589 - DNA, 19 bp, Homo sapiens
attgaacacaaactgtaaa

SEQ ID NO: 3432590 - DNA, 13 bp, Homo sapiens
attgaatcagtat

SEQ ID NO: 3432591 - DNA, 10 bp, Homo sapiens
attgaatcta

SEQ ID NO: 3432592 - DNA, 16 bp, Homo sapiens
attgaatctatttaag

SEQ ID NO: 3432593 - DNA, 22 bp, Homo sapiens
attgaattcttggttgaggaaa

SEQ ID NO: 3432594 - DNA, 17 bp, Homo sapiens
attgaatttttcctatg

SEQ ID NO: 3432595 - DNA, 16 bp, Homo sapiens
attgacaagtgtcttt

SEQ ID NO: 3432596 - DNA, 17 bp, Homo sapiens
attgacaagtgtctttt

SEQ ID NO: 3432597 - DNA, 20 bp, Homo sapiens
attgacaataaaatattatt

SEQ ID NO: 3432598 - DNA, 18 bp, Homo sapiens
attgacaataatttcagg

SEQ ID NO: 3432599 - DNA, 16 bp, Homo sapiens
attgacagctttgctg

SEQ ID NO: 3432600 - DNA, 18 bp, Homo sapiens
attgacagctttgctgct

SEQ ID NO: 3432601 - DNA, 15 bp, Homo sapiens
attgaccaccagtta

SEQ ID NO: 3432602 - DNA, 13 bp, Homo sapiens
attgactctgggt

SEQ ID NO: 3432603 - DNA, 22 bp, Homo sapiens
attgactctgggtccttcctga

SEQ ID NO: 3432604 - DNA, 21 bp, Homo sapiens
attgagaaagagcacttaaga

SEQ ID NO: 3432605 - DNA, 22 bp, Homo sapiens
attgagaactgcatatgtttcg

SEQ ID NO: 3432606 - DNA, 17 bp, Homo sapiens
attgaggggattaatat

SEQ ID NO: 3432607 - DNA, 22 bp, Homo sapiens
attgaggggattaatatgaaaa

SEQ ID NO: 3432608 - DNA, 20 bp, Homo sapiens
attgagggtcattctttatt

SEQ ID NO: 3432609 - DNA, 15 bp, Homo sapiens
attgagttttcagtg

SEQ ID NO: 3432610 - DNA, 22 bp, Homo sapiens
attgataagagggcacacactg

SEQ ID NO: 3432611 - DNA, 13 bp, Homo sapiens
attgatttcctgt

SEQ ID NO: 3432612 - DNA, 15 bp, Homo sapiens
attgatttcctgtgt

SEQ ID NO: 3432613 - DNA, 16 bp, Homo sapiens
attgatttcctgtgtc

SEQ ID NO: 3432614 - DNA, 16 bp, Homo sapiens
attgatttgcattgaa

SEQ ID NO: 3432615 - DNA, 15 bp, Homo sapiens
attgcaacaggctgg

SEQ ID NO: 3432616 - DNA, 12 bp, Homo sapiens
attgcaccactg

SEQ ID NO: 3432617 - DNA, 17 bp, Homo sapiens
attgcacccagcccaga

SEQ ID NO: 3432618 - DNA, 23 bp, Homo sapiens
attgcacgtgcctgtgggcctgg

SEQ ID NO: 3432619 - DNA, 20 bp, Homo sapiens
attgcactccagcctgggtg

SEQ ID NO: 3432620 - DNA, 20 bp, Homo sapiens
attgcagaactaaactcatt

SEQ ID NO: 3432621 - DNA, 20 bp, Homo sapiens
attgcagataactttgactt

SEQ ID NO: 3432622 - DNA, 14 bp, Homo sapiens
attgcaggatggtg

SEQ ID NO: 3432623 - DNA, 15 bp, Homo sapiens
attgcatctcccaga

SEQ ID NO: 3432624 - DNA, 13 bp, Homo sapiens
attgcatctgtat

SEQ ID NO: 3432625 - DNA, 23 bp, Homo sapiens
attgcattaaatataatatgcac

SEQ ID NO: 3432626 - DNA, 11 bp, Homo sapiens
attgcattgac

SEQ ID NO: 3432627 - DNA, 14 bp, Homo sapiens
attgccaagggctt

SEQ ID NO: 3432628 - DNA, 12 bp, Homo sapiens
attgccataata

SEQ ID NO: 3432629 - DNA, 15 bp, Homo sapiens
attgccataatatga

SEQ ID NO: 3432630 - DNA, 12 bp, Homo sapiens
attgccatattg

SEQ ID NO: 3432631 - DNA, 17 bp, Homo sapiens
attgccatattgcacat

SEQ ID NO: 3432632 - DNA, 16 bp, Homo sapiens
attgcccagtctttca

SEQ ID NO: 3432633 - DNA, 19 bp, Homo sapiens
attgcctgtgactgaggcg

SEQ ID NO: 3432634 - DNA, 15 bp, Homo sapiens
attgccttctcacca

SEQ ID NO: 3432635 - DNA, 21 bp, Homo sapiens
attgccttctcaccagctgca

SEQ ID NO: 3432636 - DNA, 18 bp, Homo sapiens
attgcggacagccacggc

SEQ ID NO: 3432637 - DNA, 20 bp, Homo sapiens
attgcgttggtctctgcatt

SEQ ID NO: 3432638 - DNA, 14 bp, Homo sapiens
attgctaatgttgc

SEQ ID NO: 3432639 - DNA, 18 bp, Homo sapiens
attgctaatgttgctgga

SEQ ID NO: 3432640 - DNA, 21 bp, Homo sapiens
attgctactacttacctacca

SEQ ID NO: 3432641 - DNA, 20 bp, Homo sapiens
attgctactgtcctacccac

SEQ ID NO: 3432642 - DNA, 22 bp, Homo sapiens
attgctactgtcctacccaccc

SEQ ID NO: 3432643 - DNA, 22 bp, Homo sapiens
attgctgagagaaatatggaac

SEQ ID NO: 3432644 - DNA, 23 bp, Homo sapiens
attgctgagagaaatatggaact

SEQ ID NO: 3432645 - DNA, 16 bp, Homo sapiens
attgctgagcctctgc

SEQ ID NO: 3432646 - DNA, 23 bp, Homo sapiens
attgctgcaaggacattcttgta

SEQ ID NO: 3432647 - DNA, 16 bp, Homo sapiens
attgctgccagagaag

SEQ ID NO: 3432648 - DNA, 17 bp, Homo sapiens
attgctgccagagaagt

SEQ ID NO: 3432649 - DNA, 20 bp, Homo sapiens
attgctgccagagaagtctg

SEQ ID NO: 3432650 - DNA, 20 bp, Homo sapiens
attgctgccccatcagtgct

SEQ ID NO: 3432651 - DNA, 22 bp, Homo sapiens
attgctgtaggatctaaggctg

SEQ ID NO: 3432652 - DNA, 22 bp, Homo sapiens
attgcttcttctcctatgtgta

SEQ ID NO: 3432653 - DNA, 23 bp, Homo sapiens
attgcttcttctcctatgtgtaa

SEQ ID NO: 3432654 - DNA, 10 bp, Homo sapiens
attgctttga

SEQ ID NO: 3432655 - DNA, 15 bp, Homo sapiens
attggaacagtgaat

SEQ ID NO: 3432656 - DNA, 17 bp, Homo sapiens
attggacaaagaacctt

SEQ ID NO: 3432657 - DNA, 17 bp, Homo sapiens
attggagatagggaaag

SEQ ID NO: 3432658 - DNA, 16 bp, Homo sapiens
attggagatgcaaata

SEQ ID NO: 3432659 - DNA, 22 bp, Homo sapiens
attggcactgctaaaatagaat

SEQ ID NO: 3432660 - DNA, 15 bp, Homo sapiens
attggcctcccaaaa

SEQ ID NO: 3432661 - DNA, 13 bp, Homo sapiens
attggctcacact

SEQ ID NO: 3432662 - DNA, 21 bp, Homo sapiens
attggctttatcctctttaga

SEQ ID NO: 3432663 - DNA, 11 bp, Homo sapiens
attgtaaaaaa

SEQ ID NO: 3432664 - DNA, 21 bp, Homo sapiens
attgtaaattatatttgtgct

SEQ ID NO: 3432665 - DNA, 17 bp, Homo sapiens
attgtaaattgaatcag

SEQ ID NO: 3432666 - DNA, 15 bp, Homo sapiens
attgtaactgttctt

SEQ ID NO: 3432667 - DNA, 23 bp, Homo sapiens
attgtaataggcgtaactaattt

SEQ ID NO: 3432668 - DNA, 22 bp, Homo sapiens
attgtactaaagccaaacatat

SEQ ID NO: 3432669 - DNA, 23 bp, Homo sapiens
attgtaggataattagcagtatc

SEQ ID NO: 3432670 - DNA, 16 bp, Homo sapiens
attgtattcagataat

SEQ ID NO: 3432671 - DNA, 18 bp, Homo sapiens
attgtatttattcaataa

SEQ ID NO: 3432672 - DNA, 12 bp, Homo sapiens
attgtccctctg

SEQ ID NO: 3432673 - DNA, 22 bp, Homo sapiens
attgtcctgtgaaatattctta

SEQ ID NO: 3432674 - DNA, 22 bp, Homo sapiens
attgtcgtataggcatgtaaac

SEQ ID NO: 3432675 - DNA, 14 bp, Homo sapiens
attgtctcttcatg

SEQ ID NO: 3432676 - DNA, 23 bp, Homo sapiens
attgtgaaataaaactggctttg

SEQ ID NO: 3432677 - DNA, 21 bp, Homo sapiens
attgtgaagctaatgaccaac

SEQ ID NO: 3432678 - DNA, 14 bp, Homo sapiens
attgtgatgtatat

SEQ ID NO: 3432679 - DNA, 20 bp, Homo sapiens
attgtggaatgttggataag

SEQ ID NO: 3432680 - DNA, 19 bp, Homo sapiens
attgtgtgtgctctgcttc

SEQ ID NO: 3432681 - DNA, 20 bp, Homo sapiens
attgtgtgtgctctgcttca

SEQ ID NO: 3432682 - DNA, 18 bp, Homo sapiens
attgttcacctttgtagc

SEQ ID NO: 3432683 - DNA, 21 bp, Homo sapiens
attgttggtgaattttcaagg

SEQ ID NO: 3432684 - DNA, 18 bp, Homo sapiens
attgttggtgttaattga

SEQ ID NO: 3432685 - DNA, 14 bp, Homo sapiens
attgtttacaggat

SEQ ID NO: 3432686 - DNA, 15 bp, Homo sapiens
attgtttacaggata

SEQ ID NO: 3432687 - DNA, 16 bp, Homo sapiens
attgtttacaggatat

SEQ ID NO: 3432688 - DNA, 12 bp, Homo sapiens
attgtttatgta

SEQ ID NO: 3432689 - DNA, 19 bp, Homo sapiens
attgtttcaaaataaaaac

SEQ ID NO: 3432690 - DNA, 18 bp, Homo sapiens
atttaaaaatatttttgg

SEQ ID NO: 3432691 - DNA, 13 bp, Homo sapiens
atttaaaaatgtc

SEQ ID NO: 3432692 - DNA, 17 bp, Homo sapiens
atttaaaagcagagcat

SEQ ID NO: 3432693 - DNA, 13 bp, Homo sapiens
atttaaacacaca

SEQ ID NO: 3432694 - DNA, 21 bp, Homo sapiens
atttaaatacagtcttccatt

SEQ ID NO: 3432695 - DNA, 21 bp, Homo sapiens
atttaaattacaattttatct

SEQ ID NO: 3432696 - DNA, 18 bp, Homo sapiens
atttaacagcatgacaaa

SEQ ID NO: 3432697 - DNA, 15 bp, Homo sapiens
atttaacagctgaat

SEQ ID NO: 3432698 - DNA, 17 bp, Homo sapiens
atttaacagggagggga

SEQ ID NO: 3432699 - DNA, 19 bp, Homo sapiens
atttaacccatttgtctct

SEQ ID NO: 3432700 - DNA, 18 bp, Homo sapiens
atttaactggtgcacttt

SEQ ID NO: 3432701 - DNA, 23 bp, Homo sapiens
atttaactggtgcactttgtaaa

SEQ ID NO: 3432702 - DNA, 17 bp, Homo sapiens
atttaacttcttcataa

SEQ ID NO: 3432703 - DNA, 19 bp, Homo sapiens
atttaataatatacttgtg

SEQ ID NO: 3432704 - DNA, 15 bp, Homo sapiens
atttaataatctgta

SEQ ID NO: 3432705 - DNA, 12 bp, Homo sapiens
atttaatgtttt

SEQ ID NO: 3432706 - DNA, 18 bp, Homo sapiens
atttaatgttttaaatgt

SEQ ID NO: 3432707 - DNA, 20 bp, Homo sapiens
atttaatgttttaaatgtac

SEQ ID NO: 3432708 - DNA, 21 bp, Homo sapiens
atttaattaggaaaaaaacta

SEQ ID NO: 3432709 - DNA, 16 bp, Homo sapiens
atttaattagtgctaa

SEQ ID NO: 3432710 - DNA, 15 bp, Homo sapiens
attttaatttagtaa

SEQ ID NO: 3432711 - DNA, 17 bp, Homo sapiens
attttaatttgtattga

SEQ ID NO: 3432712 - DNA, 18 bp, Homo sapiens
attttaatttgtattgaa

SEQ ID NO: 3432713 - DNA, 13 bp, Homo sapiens
attttacaattga

SEQ ID NO: 3432714 - DNA, 18 bp, Homo sapiens
attttagtaatttcctag

SEQ ID NO: 3432715 - DNA, 19 bp, Homo sapiens
attttagtaatttcctaga

SEQ ID NO: 3432716 - DNA, 23 bp, Homo sapiens
attttagtcacacgtggtctttc

SEQ ID NO: 3432717 - DNA, 14 bp, Homo sapiens
attttataagaaaa

SEQ ID NO: 3432718 - DNA, 15 bp, Homo sapiens
attttataagaaaaa

SEQ ID NO: 3432719 - DNA, 16 bp, Homo sapiens
attttataagaaaaac

SEQ ID NO: 3432720 - DNA, 15 bp, Homo sapiens
attttcaaaagataa

SEQ ID NO: 3432721 - DNA, 14 bp, Homo sapiens
attttcaaggcctt

SEQ ID NO: 3432722 - DNA, 15 bp, Homo sapiens
attttcaaggccttc

SEQ ID NO: 3432723 - DNA, 16 bp, Homo sapiens
attttcaaggccttca

SEQ ID NO: 3432724 - DNA, 20 bp, Homo sapiens
attttcaaggccttcagttt

SEQ ID NO: 3432725 - DNA, 20 bp, Homo sapiens
attttcacattcttggctta

SEQ ID NO: 3432726 - DNA, 16 bp, Homo sapiens
attttcaccccaccct

SEQ ID NO: 3432727 - DNA, 22 bp, Homo sapiens
attttcataagtatttcaaatt

SEQ ID NO: 3432728 - DNA, 13 bp, Homo sapiens
attttccatatat

SEQ ID NO: 3432729 - DNA, 15 bp, Homo sapiens
attttccatatattg

SEQ ID NO: 3432730 - DNA, 21 bp, Homo sapiens
attttcctaataaagttctgt

SEQ ID NO: 3432731 - DNA, 17 bp, Homo sapiens
attttctctgtactttt

SEQ ID NO: 3432732 - DNA, 18 bp, Homo sapiens
attttctgtggatcattt

SEQ ID NO: 3432733 - DNA, 15 bp, Homo sapiens
attttcttgaatttt

SEQ ID NO: 3432734 - DNA, 16 bp, Homo sapiens
attttcttgaattttt

SEQ ID NO: 3432735 - DNA, 19 bp, Homo sapiens
attttctttaatgctttta

SEQ ID NO: 3432736 - DNA, 17 bp, Homo sapiens
attttcttttgtaaatg

SEQ ID NO: 3432737 - DNA, 12 bp, Homo sapiens
attttgaaactt

SEQ ID NO: 3432738 - DNA, 17 bp, Homo sapiens
attttgataccagaagg

SEQ ID NO: 3432739 - DNA, 20 bp, Homo sapiens
attttgatataatctttcaa

SEQ ID NO: 3432740 - DNA, 18 bp, Homo sapiens
attttgatccaagctggt

SEQ ID NO: 3432741 - DNA, 11 bp, Homo sapiens
attttgcactg

SEQ ID NO: 3432742 - DNA, 20 bp, Homo sapiens
attttgctaaatgtgaatga

SEQ ID NO: 3432743 - DNA, 20 bp, Homo sapiens
attttggagagtttcctgaa

SEQ ID NO: 3432744 - DNA, 19 bp, Homo sapiens
attttgggttttgggtctt

SEQ ID NO: 3432745 - DNA, 15 bp, Homo sapiens
attttggtgagaaat

SEQ ID NO: 3432746 - DNA, 16 bp, Homo sapiens
attttgtaatgaattc

SEQ ID NO: 3432747 - DNA, 15 bp, Homo sapiens
attttgtatctgcag

SEQ ID NO: 3432748 - DNA, 19 bp, Homo sapiens
attttgtattgtttcaatt

SEQ ID NO: 3432749 - DNA, 20 bp, Homo sapiens
attttgtcaccagaacacaa

SEQ ID NO: 3432750 - DNA, 21 bp, Homo sapiens
attttgtcccatctctacccc

SEQ ID NO: 3432751 - DNA, 12 bp, Homo sapiens
attttgtgtcct

SEQ ID NO: 3432752 - DNA, 21 bp, Homo sapiens
attttgtgtcctccaggagct

SEQ ID NO: 3432753 - DNA, 15 bp, Homo sapiens
attttgttctctggg

SEQ ID NO: 3432754 - DNA, 15 bp, Homo sapiens
atttttaaaataaac

SEQ ID NO: 3432755 - DNA, 15 bp, Homo sapiens
atttttaaagataga

SEQ ID NO: 3432756 - DNA, 12 bp, Homo sapiens
atttttaaataa

SEQ ID NO: 3432757 - DNA, 15 bp, Homo sapiens
atttttaaataattt

SEQ ID NO: 3432758 - DNA, 21 bp, Homo sapiens
atttttaagcaaaatattatt

SEQ ID NO: 3432759 - DNA, 19 bp, Homo sapiens
atttttacatggagaaaac

SEQ ID NO: 3432760 - DNA, 23 bp, Homo sapiens
atttttagaggcagggctgcatt

SEQ ID NO: 3432761 - DNA, 17 bp, Homo sapiens
atttttatataatatct

SEQ ID NO: 3432762 - DNA, 14 bp, Homo sapiens
atttttcaaagcaa

SEQ ID NO: 3432763 - DNA, 15 bp, Homo sapiens
atttttcaaagcaat

SEQ ID NO: 3432764 - DNA, 17 bp, Homo sapiens
atttttcaactttgaat

SEQ ID NO: 3432765 - DNA, 17 bp, Homo sapiens
atttttccgtttgcttt

SEQ ID NO: 3432766 - DNA, 23 bp, Homo sapiens
atttttgagccaagcttcaaccc

SEQ ID NO: 3432767 - DNA, 21 bp, Homo sapiens
atttttgtaataacatttaat

SEQ ID NO: 3432768 - DNA, 12 bp, Homo sapiens
atttttgtaatt

SEQ ID NO: 3432769 - DNA, 17 bp, Homo sapiens
attttttgacacttcca

SEQ ID NO: 3432770 - DNA, 18 bp, Homo sapiens
attttttgacacttccat

SEQ ID NO: 3432771 - DNA, 18 bp, Homo sapiens
attttttgggcggcccct

SEQ ID NO: 3432772 - DNA, 15 bp, Homo sapiens
atttttttaaccaaa

SEQ ID NO: 3432773 - DNA, 19 bp, Homo sapiens
atttttttaaccaaaggtg

SEQ ID NO: 3432774 - DNA, 21 bp, Homo sapiens
atttttttaaccaaaggtgaa

SEQ ID NO: 3432775 - DNA, 13 bp, Homo sapiens
atttttttattca

SEQ ID NO: 3432776 - DNA, 22 bp, Homo sapiens
atttttttctgcacagcttttc

SEQ ID NO: 3432777 - DNA, 14 bp, Homo sapiens
atttttttgcaagt

SEQ ID NO: 3432778 - DNA, 15 bp, Homo sapiens
attttttttaaacaa

SEQ ID NO: 3432779 - DNA, 18 bp, Homo sapiens
attttttttaatgcttaa

SEQ ID NO: 3432780 - DNA, 14 bp, Homo sapiens
attttttttcatgt

SEQ ID NO: 3432781 - DNA, 18 bp, Homo sapiens
atttttttttggatgaag

SEQ ID NO: 3432782 - DNA, 14 bp, Homo sapiens
caaaaaaagccttt

SEQ ID NO: 3432783 - DNA, 16 bp, Homo sapiens
caaaaaaatctgcaga

SEQ ID NO: 3432784 - DNA, 17 bp, Homo sapiens
caaaaaaatctgcagaa

SEQ ID NO: 3432785 - DNA, 21 bp, Homo sapiens
caaaaaaattaaaatggatgc

SEQ ID NO: 3432786 - DNA, 17 bp, Homo sapiens
caaaaaagtccaatttt

SEQ ID NO: 3432787 - DNA, 22 bp, Homo sapiens
caaaaaagtccaattttaattt

SEQ ID NO: 3432788 - DNA, 16 bp, Homo sapiens
caaaaaatgttttaaa

SEQ ID NO: 3432789 - DNA, 17 bp, Homo sapiens
caaaaacaaaaccagct

SEQ ID NO: 3432790 - DNA, 23 bp, Homo sapiens
caaaaacatgtatgtgcatttca

SEQ ID NO: 3432791 - DNA, 21 bp, Homo sapiens
caaaaacgccctcaagaacat

SEQ ID NO: 3432792 - DNA, 12 bp, Homo sapiens
caaaaagaacaa

SEQ ID NO: 3432793 - DNA, 15 bp, Homo sapiens
caaaaagcaaaatca

SEQ ID NO: 3432794 - DNA, 13 bp, Homo sapiens
caaaaaggcagga

SEQ ID NO: 3432795 - DNA, 14 bp, Homo sapiens
caaaaagtattatc

SEQ ID NO: 3432796 - DNA, 15 bp, Homo sapiens
caaaaagtgcttcat

SEQ ID NO: 3432797 - DNA, 10 bp, Homo sapiens
caaaaataaa

SEQ ID NO: 3432798 - DNA, 22 bp, Homo sapiens
caaaaatatttataaaacttct

SEQ ID NO: 3432799 - DNA, 20 bp, Homo sapiens
caaaaattagccggacgtgg

SEQ ID NO: 3432800 - DNA, 15 bp, Homo sapiens
caaaaattagccggg

SEQ ID NO: 3432801 - DNA, 22 bp, Homo sapiens
caaaaattatttttttttttgt

SEQ ID NO: 3432802 - DNA, 14 bp, Homo sapiens
caaaaattttgtga

SEQ ID NO: 3432803 - DNA, 13 bp, Homo sapiens
caaaaccagctgc

SEQ ID NO: 3432804 - DNA, 19 bp, Homo sapiens
caaaacctcatgacagcca

SEQ ID NO: 3432805 - DNA, 19 bp, Homo sapiens
caaaactctacttaatcca

SEQ ID NO: 3432806 - DNA, 18 bp, Homo sapiens
caaaactttttaaatttt

SEQ ID NO: 3432807 - DNA, 18 bp, Homo sapiens
caaaagaagcccccagct

SEQ ID NO: 3432808 - DNA, 19 bp, Homo sapiens
caaaagaagcccccagcta

SEQ ID NO: 3432809 - DNA, 18 bp, Homo sapiens
caaaagatgcttctcact

SEQ ID NO: 3432810 - DNA, 17 bp, Homo sapiens
caaaagcgcttttcctt

SEQ ID NO: 3432811 - DNA, 22 bp, Homo sapiens
caaaaggatctttgtggccaag

SEQ ID NO: 3432812 - DNA, 20 bp, Homo sapiens
caaaaggttcactaaagcag

SEQ ID NO: 3432813 - DNA, 14 bp, Homo sapiens
caaaagtggcctct

SEQ ID NO: 3432814 - DNA, 17 bp, Homo sapiens
caaaagttctgacttga

SEQ ID NO: 3432815 - DNA, 18 bp, Homo sapiens
caaaataaaaaccttcca

SEQ ID NO: 3432816 - DNA, 13 bp, Homo sapiens
caaaatactccaa

SEQ ID NO: 3432817 - DNA, 17 bp, Homo sapiens
caaaatactccaaagat

SEQ ID NO: 3432818 - DNA, 19 bp, Homo sapiens
caaaatactccaaagatga

SEQ ID NO: 3432819 - DNA, 14 bp, Homo sapiens
caaaatagaaaagt

SEQ ID NO: 3432820 - DNA, 14 bp, Homo sapiens
caaaatatttaaaa

SEQ ID NO: 3432821 - DNA, 17 bp, Homo sapiens
caaaatatttaaaaatg

SEQ ID NO: 3432822 - DNA, 20 bp, Homo sapiens
caaaatatttaaaaatgtct

SEQ ID NO: 3432823 - DNA, 21 bp, Homo sapiens
caaaatatttaaaaatgtctt

SEQ ID NO: 3432824 - DNA, 20 bp, Homo sapiens
caaaatgaaagttttttcct

SEQ ID NO: 3432825 - DNA, 18 bp, Homo sapiens
caaaatgaggaatgtata

SEQ ID NO: 3432826 - DNA, 22 bp, Homo sapiens
caaaatgaggaatgtatatgtt

SEQ ID NO: 3432827 - DNA, 16 bp, Homo sapiens
caaaattctaaatgta

SEQ ID NO: 3432828 - DNA, 21 bp, Homo sapiens
caaaatttattttataagaaa

SEQ ID NO: 3432829 - DNA, 23 bp, Homo sapiens
caaaatttattttataagaaaaa

SEQ ID NO: 3432830 - DNA, 23 bp, Homo sapiens
caaaatttgactaattttacatg

SEQ ID NO: 3432831 - DNA, 13 bp, Homo sapiens
caaacaaagccag

SEQ ID NO: 3432832 - DNA, 20 bp, Homo sapiens
caaacaaagccagaagctga

SEQ ID NO: 3432833 - DNA, 15 bp, Homo sapiens
caaacaaatatgcaa

SEQ ID NO: 3432834 - DNA, 12 bp, Homo sapiens
caaacaatgaaa

SEQ ID NO: 3432835 - DNA, 20 bp, Homo sapiens
caaacactgcaggcatcaca

SEQ ID NO: 3432836 - DNA, 22 bp, Homo sapiens
caaacagacaggtggaaaaact

SEQ ID NO: 3432837 - DNA, 16 bp, Homo sapiens
caaacatatgcacatt

SEQ ID NO: 3432838 - DNA, 21 bp, Homo sapiens
caaacatgaccctaaatcttg

SEQ ID NO: 3432839 - DNA, 21 bp, Homo sapiens
caaacccaaaacctcatgaca

SEQ ID NO: 3432840 - DNA, 20 bp, Homo sapiens
caaacccagtctcctctcca

SEQ ID NO: 3432841 - DNA, 16 bp, Homo sapiens
caaacccatggctcta

SEQ ID NO: 3432842 - DNA, 11 bp, Homo sapiens
caaacctccaa

SEQ ID NO: 3432843 - DNA, 11 bp, Homo sapiens
caaacctctgt

SEQ ID NO: 3432844 - DNA, 12 bp, Homo sapiens
caaacctctgtt

SEQ ID NO: 3432845 - DNA, 17 bp, Homo sapiens
caaaccttatctccaca

SEQ ID NO: 3432846 - DNA, 20 bp, Homo sapiens
caaacgccctttcctcctca

SEQ ID NO: 3432847 - DNA, 17 bp, Homo sapiens
caaacgcctcccctgcc

SEQ ID NO: 3432848 - DNA, 20 bp, Homo sapiens
caaacgctgagccacctgcc

SEQ ID NO: 3432849 - DNA, 13 bp, Homo sapiens
caaacgctgcctg

SEQ ID NO: 3432850 - DNA, 15 bp, Homo sapiens
caaacgctgcctgcc

SEQ ID NO: 3432851 - DNA, 16 bp, Homo sapiens
caaacgctgcctgccc

SEQ ID NO: 3432852 - DNA, 16 bp, Homo sapiens
caaactacttgatttt

SEQ ID NO: 3432853 - DNA, 14 bp, Homo sapiens
caaactctctgaac

SEQ ID NO: 3432854 - DNA, 22 bp, Homo sapiens
caaactcttcagttaattctta

SEQ ID NO: 3432855 - DNA, 16 bp, Homo sapiens
caaactggtattctgt

SEQ ID NO: 3432856 - DNA, 12 bp, Homo sapiens
caaactgtaaat

SEQ ID NO: 3432857 - DNA, 14 bp, Homo sapiens
caaactgtaaataa

SEQ ID NO: 3432858 - DNA, 21 bp, Homo sapiens
caaactgtaaataaaaagaaa

SEQ ID NO: 3432859 - DNA, 17 bp, Homo sapiens
caaacttggatttttga

SEQ ID NO: 3432860 - DNA, 22 bp, Homo sapiens
caaagaaggcatttgcagggtc

SEQ ID NO: 3432861 - DNA, 19 bp, Homo sapiens
caaagaatccctagacttt

SEQ ID NO: 3432862 - DNA, 14 bp, Homo sapiens
caaagaccaaaatg

SEQ ID NO: 3432863 - DNA, 19 bp, Homo sapiens
caaagacccgggagctggc

SEQ ID NO: 3432864 - DNA, 20 bp, Homo sapiens
caaagaggctgaggctggca

SEQ ID NO: 3432865 - DNA, 15 bp, Homo sapiens
caaagagggtgaggg

SEQ ID NO: 3432866 - DNA, 20 bp, Homo sapiens
caaagagggtgagggccttc

SEQ ID NO: 3432867 - DNA, 21 bp, Homo sapiens
caaagaggttttaaaaaaatc

SEQ ID NO: 3432868 - DNA, 18 bp, Homo sapiens
caaagcaattgaaatgca

SEQ ID NO: 3432869 - DNA, 17 bp, Homo sapiens
caaagcagacagctcca

SEQ ID NO: 3432870 - DNA, 12 bp, Homo sapiens
caaagcagccac

SEQ ID NO: 3432871 - DNA, 22 bp, Homo sapiens
caaagcaggggagtatgcaaaa

SEQ ID NO: 3432872 - DNA, 21 bp, Homo sapiens
caaagccaaagctaggcctgg

SEQ ID NO: 3432873 - DNA, 22 bp, Homo sapiens
caaagccagcgtcctcctctgt

SEQ ID NO: 3432874 - DNA, 19 bp, Homo sapiens
caaagctaggcctggccag

SEQ ID NO: 3432875 - DNA, 20 bp, Homo sapiens
caaagcttttagaaatactg

SEQ ID NO: 3432876 - DNA, 16 bp, Homo sapiens
caaaggaacactgaca

SEQ ID NO: 3432877 - DNA, 17 bp, Homo sapiens
caaaggaaggtggatgg

SEQ ID NO: 3432878 - DNA, 20 bp, Homo sapiens
caaaggattaattgctgcaa

SEQ ID NO: 3432879 - DNA, 20 bp, Homo sapiens
caaaggcacagtgaaggctg

SEQ ID NO: 3432880 - DNA, 19 bp, Homo sapiens
caaaggccatggagagctg

SEQ ID NO: 3432881 - DNA, 20 bp, Homo sapiens
caaaggccatggagagctgg

SEQ ID NO: 3432882 - DNA, 14 bp, Homo sapiens
caaaggctgagaac

SEQ ID NO: 3432883 - DNA, 23 bp, Homo sapiens
caaaggctgagaacactgtgaaa

SEQ ID NO: 3432884 - DNA, 17 bp, Homo sapiens
caaagggaaatatcatt

SEQ ID NO: 3432885 - DNA, 22 bp, Homo sapiens
caaagggagcactgggttgact

SEQ ID NO: 3432886 - DNA, 20 bp, Homo sapiens
caaagggcacagcatctgta

SEQ ID NO: 3432887 - DNA, 23 bp, Homo sapiens
caaagggcacagcatctgtagtc

SEQ ID NO: 3432888 - DNA, 17 bp, Homo sapiens
caaaggggaaagaacat

SEQ ID NO: 3432889 - DNA, 19 bp, Homo sapiens
caaagggtatcaggtgctg

SEQ ID NO: 3432890 - DNA, 20 bp, Homo sapiens
caaagggtatcaggtgctgc

SEQ ID NO: 3432891 - DNA, 16 bp, Homo sapiens
caaagggtccagaagg

SEQ ID NO: 3432892 - DNA, 16 bp, Homo sapiens
caaaggtgaaggaata

SEQ ID NO: 3432893 - DNA, 13 bp, Homo sapiens
caaagtaaaagaa

SEQ ID NO: 3432894 - DNA, 15 bp, Homo sapiens
caaagtaaaagaaac

SEQ ID NO: 3432895 - DNA, 23 bp, Homo sapiens
caaagtaaaagaaaccacttctg

SEQ ID NO: 3432896 - DNA, 14 bp, Homo sapiens
caaagtactgtaag

SEQ ID NO: 3432897 - DNA, 12 bp, Homo sapiens
caaagtgtgtat

SEQ ID NO: 3432898 - DNA, 13 bp, Homo sapiens
caaagtgtgtatt

SEQ ID NO: 3432899 - DNA, 14 bp, Homo sapiens
caaagtgtgtatta

SEQ ID NO: 3432900 - DNA, 23 bp, Homo sapiens
caaataaagagagaacaggacta

SEQ ID NO: 3432901 - DNA, 16 bp, Homo sapiens
caaataatgtctctgt

SEQ ID NO: 3432902 - DNA, 23 bp, Homo sapiens
caaataatgtctctgtgagactc

SEQ ID NO: 3432903 - DNA, 14 bp, Homo sapiens
caaatataagaata

SEQ ID NO: 3432904 - DNA, 19 bp, Homo sapiens
caaatatatatatgtatat

SEQ ID NO: 3432905 - DNA, 16 bp, Homo sapiens
caaatattggtgttgt

SEQ ID NO: 3432906 - DNA, 14 bp, Homo sapiens
caaatcaaagcaga

SEQ ID NO: 3432907 - DNA, 15 bp, Homo sapiens
caaatccagtgtgca

SEQ ID NO: 3432908 - DNA, 13 bp, Homo sapiens
caaatcctatgtg

SEQ ID NO: 3432909 - DNA, 16 bp, Homo sapiens
caaatcctatgtgatt

SEQ ID NO: 3432910 - DNA, 22 bp, Homo sapiens
caaatcctatgtgattttaact

SEQ ID NO: 3432911 - DNA, 23 bp, Homo sapiens
caaatcctatgtgattttaactc

SEQ ID NO: 3432912 - DNA, 21 bp, Homo sapiens
caaatccttagatctggcatg

SEQ ID NO: 3432913 - DNA, 13 bp, Homo sapiens
caaatctgggctc

SEQ ID NO: 3432914 - DNA, 12 bp, Homo sapiens
caaatcttgaaa

SEQ ID NO: 3432915 - DNA, 19 bp, Homo sapiens
caaatgagccttaagaaat

SEQ ID NO: 3432916 - DNA, 18 bp, Homo sapiens
caaatgcccaagggaaag

SEQ ID NO: 3432917 - DNA, 18 bp, Homo sapiens
caaatgctctctcttctt

SEQ ID NO: 3432918 - DNA, 21 bp, Homo sapiens
caaatggcgtctggaagtcca

SEQ ID NO: 3432919 - DNA, 23 bp, Homo sapiens
caaatggggccagatccagcctg

SEQ ID NO: 3432920 - DNA, 15 bp, Homo sapiens
caaatggtaggcatt

SEQ ID NO: 3432921 - DNA, 23 bp, Homo sapiens
caaatggtggaggattgctgcca

SEQ ID NO: 3432922 - DNA, 17 bp, Homo sapiens
caaatgtaaacattttc

SEQ ID NO: 3432923 - DNA, 21 bp, Homo sapiens
caaatgttatgcataaagtca

SEQ ID NO: 3432924 - DNA, 15 bp, Homo sapiens
caaattaataatctt

SEQ ID NO: 3432925 - DNA, 16 bp, Homo sapiens
caaattaataatctta

SEQ ID NO: 3432926 - DNA, 11 bp, Homo sapiens
caaattagaaa

SEQ ID NO: 3432927 - DNA, 13 bp, Homo sapiens
caaattagaaaat

SEQ ID NO: 3432928 - DNA, 19 bp, Homo sapiens
caaattagaaaatgttatt

SEQ ID NO: 3432929 - DNA, 14 bp, Homo sapiens
caaattcttttgaa

SEQ ID NO: 3432930 - DNA, 17 bp, Homo sapiens
caaattcttttgaattg

SEQ ID NO: 3432931 - DNA, 18 bp, Homo sapiens
caaattcttttgaattgt

SEQ ID NO: 3432932 - DNA, 21 bp, Homo sapiens
caaattcttttgaattgttac

SEQ ID NO: 3432933 - DNA, 22 bp, Homo sapiens
caaattctttttttattattat

SEQ ID NO: 3432934 - DNA, 21 bp, Homo sapiens
caaattggagcttcatggcag

SEQ ID NO: 3432935 - DNA, 17 bp, Homo sapiens
caaatttgattgatttg

SEQ ID NO: 3432936 - DNA, 13 bp, Homo sapiens
caacaaaaacaaa

SEQ ID NO: 3432937 - DNA, 16 bp, Homo sapiens
caacaaggaaactttc

SEQ ID NO: 3432938 - DNA, 19 bp, Homo sapiens
caacaaggttatatgaata

SEQ ID NO: 3432939 - DNA, 16 bp, Homo sapiens
caacaataaaattttt

SEQ ID NO: 3432940 - DNA, 15 bp, Homo sapiens
caacaatcctagtgc

SEQ ID NO: 3432941 - DNA, 13 bp, Homo sapiens
caacaatttctac

SEQ ID NO: 3432942 - DNA, 14 bp, Homo sapiens
caacacagaggcag

SEQ ID NO: 3432943 - DNA, 20 bp, Homo sapiens
caacacctctgcacaagctg

SEQ ID NO: 3432944 - DNA, 22 bp, Homo sapiens
caacactcacatttattctgct

SEQ ID NO: 3432945 - DNA, 14 bp, Homo sapiens
caacactgagcaag

SEQ ID NO: 3432946 - DNA, 20 bp, Homo sapiens
caacactgggaaacagaggc

SEQ ID NO: 3432947 - DNA, 13 bp, Homo sapiens
caacagatctgga

SEQ ID NO: 3432948 - DNA, 15 bp, Homo sapiens
caacaggagctggga

SEQ ID NO: 3432949 - DNA, 21 bp, Homo sapiens
caacaggagctgggatcctaa

SEQ ID NO: 3432950 - DNA, 12 bp, Homo sapiens
caacaggctggg

SEQ ID NO: 3432951 - DNA, 13 bp, Homo sapiens
caacaggctgggc

SEQ ID NO: 3432952 - DNA, 14 bp, Homo sapiens
caacaggctgggct

SEQ ID NO: 3432953 - DNA, 20 bp, Homo sapiens
caacaggcttatgaatatat

SEQ ID NO: 3432954 - DNA, 16 bp, Homo sapiens
caacagtgaagacaga

SEQ ID NO: 3432955 - DNA, 20 bp, Homo sapiens
caacagttttcctatgcttt

SEQ ID NO: 3432956 - DNA, 13 bp, Homo sapiens
caacatataaaat

SEQ ID NO: 3432957 - DNA, 13 bp, Homo sapiens
caacatcttttct

SEQ ID NO: 3432958 - DNA, 23 bp, Homo sapiens
caacatgcctgccccaaacaaat

SEQ ID NO: 3432959 - DNA, 23 bp, Homo sapiens
caacatgttgggaaacttggctc

SEQ ID NO: 3432960 - DNA, 23 bp, Homo sapiens
caacattgttcacctttgtagca

SEQ ID NO: 3432961 - DNA, 15 bp, Homo sapiens
caacatttattttga

SEQ ID NO: 3432962 - DNA, 13 bp, Homo sapiens
caacattttcttg

SEQ ID NO: 3432963 - DNA, 20 bp, Homo sapiens
caacattttgagaacaaaga

SEQ ID NO: 3432964 - DNA, 21 bp, Homo sapiens
caacattttgagaacaaagat

SEQ ID NO: 3432965 - DNA, 20 bp, Homo sapiens
caaccaagtcatgtgcattt

SEQ ID NO: 3432966 - DNA, 21 bp, Homo sapiens
caaccacctaggcaatgaaga

SEQ ID NO: 3432967 - DNA, 13 bp, Homo sapiens
caaccccagggcc

SEQ ID NO: 3432968 - DNA, 16 bp, Homo sapiens
caacccccatttctat

SEQ ID NO: 3432969 - DNA, 19 bp, Homo sapiens
caaccccccagcactgagg

SEQ ID NO: 3432970 - DNA, 20 bp, Homo sapiens
caaccccccagcactgagga

SEQ ID NO: 3432971 - DNA, 17 bp, Homo sapiens
caaccccttcgctcctg

SEQ ID NO: 3432972 - DNA, 18 bp, Homo sapiens
caaccccttcgctcctgt

SEQ ID NO: 3432973 - DNA, 21 bp, Homo sapiens
caaccccttcgctcctgtgtc

SEQ ID NO: 3432974 - DNA, 14 bp, Homo sapiens
caaggttggagccc

SEQ ID NO: 3432975 - DNA, 17 bp, Homo sapiens
caaggtttaggctggtg

SEQ ID NO: 3432976 - DNA, 20 bp, Homo sapiens
caaggtttaggctggtggcc

SEQ ID NO: 3432977 - DNA, 20 bp, Homo sapiens
caagtaagaggctggagttg

SEQ ID NO: 3432978 - DNA, 13 bp, Homo sapiens
caagtagaatctc

SEQ ID NO: 3432979 - DNA, 16 bp, Homo sapiens
caagtagaatctcagt

SEQ ID NO: 3432980 - DNA, 13 bp, Homo sapiens
caagtagctgcta

SEQ ID NO: 3432981 - DNA, 20 bp, Homo sapiens
caagtagctgctaccttctt

SEQ ID NO: 3432982 - DNA, 22 bp, Homo sapiens
caagtatttgggaagtgaagac

SEQ ID NO: 3432983 - DNA, 15 bp, Homo sapiens
caagtcaaattaata

SEQ ID NO: 3432984 - DNA, 13 bp, Homo sapiens
caagtcaagtgaa

SEQ ID NO: 3432985 - DNA, 18 bp, Homo sapiens
caagtcccccagcagaac

SEQ ID NO: 3432986 - DNA, 17 bp, Homo sapiens
caagtccttttgtaaag

SEQ ID NO: 3432987 - DNA, 18 bp, Homo sapiens
caagtctctgctggccca

SEQ ID NO: 3432988 - DNA, 19 bp, Homo sapiens
caagtctctgctggcccag

SEQ ID NO: 3432989 - DNA, 13 bp, Homo sapiens
caagtctgtgttc

SEQ ID NO: 3432990 - DNA, 14 bp, Homo sapiens
caagtctgtttact

SEQ ID NO: 3432991 - DNA, 20 bp, Homo sapiens
caagtctttaggtctttgta

SEQ ID NO: 3432992 - DNA, 19 bp, Homo sapiens
caagtgaatttttctctaa

SEQ ID NO: 3432993 - DNA, 14 bp, Homo sapiens
caagtgagaccctg

SEQ ID NO: 3432994 - DNA, 14 bp, Homo sapiens
caagtgagagctgg

SEQ ID NO: 3432995 - DNA, 15 bp, Homo sapiens
caagtgagagctggg

SEQ ID NO: 3432996 - DNA, 18 bp, Homo sapiens
caagtgagagctgggtgt

SEQ ID NO: 3432997 - DNA, 17 bp, Homo sapiens
caagtgattctcctgcc

SEQ ID NO: 3432998 - DNA, 18 bp, Homo sapiens
caagtgccaagacacagc

SEQ ID NO: 3432999 - DNA, 18 bp, Homo sapiens
caagtggactcagggcag

SEQ ID NO: 3433000 - DNA, 23 bp, Homo sapiens
caagtggactcagggcagcgcca

SEQ ID NO: 3433001 - DNA, 21 bp, Homo sapiens
caagtgtgggccactgtggtg

SEQ ID NO: 3433002 - DNA, 15 bp, Homo sapiens
caagttgaattgagg

SEQ ID NO: 3433003 - DNA, 17 bp, Homo sapiens
caataaaatattattga

SEQ ID NO: 3433004 - DNA, 17 bp, Homo sapiens
caataaagcactgagca

SEQ ID NO: 3433005 - DNA, 19 bp, Homo sapiens
caataaagcatttataaat

SEQ ID NO: 3433006 - DNA, 13 bp, Homo sapiens
caataaagtattt

SEQ ID NO: 3433007 - DNA, 16 bp, Homo sapiens
caataaagtatttaat

SEQ ID NO: 3433008 - DNA, 20 bp, Homo sapiens
caataaattgctaatgttgc

SEQ ID NO: 3433009 - DNA, 22 bp, Homo sapiens
caataaattgctaatgttgctg

SEQ ID NO: 3433010 - DNA, 23 bp, Homo sapiens
caataatgcagtatggtacattt

SEQ ID NO: 3433011 - DNA, 14 bp, Homo sapiens
caatagcaccccta

SEQ ID NO: 3433012 - DNA, 15 bp, Homo sapiens
caataggctgttccc

SEQ ID NO: 3433013 - DNA, 13 bp, Homo sapiens
caatatagcaaga

SEQ ID NO: 3433014 - DNA, 19 bp, Homo sapiens
caatattcaatcaaaattt

SEQ ID NO: 3433015 - DNA, 12 bp, Homo sapiens
caatattgaatt

SEQ ID NO: 3433016 - DNA, 21 bp, Homo sapiens
caatattgaatttttcctatg

SEQ ID NO: 3433017 - DNA, 12 bp, Homo sapiens
caatatttatta

SEQ ID NO: 3433018 - DNA, 14 bp, Homo sapiens
caatatttattatt

SEQ ID NO: 3433019 - DNA, 14 bp, Homo sapiens
caatatttttagat

SEQ ID NO: 3433020 - DNA, 12 bp, Homo sapiens
caatcaacacta

SEQ ID NO: 3433021 - DNA, 14 bp, Homo sapiens
caatcaacactacc

SEQ ID NO: 3433022 - DNA, 19 bp, Homo sapiens
caatcagagaccaggccct

SEQ ID NO: 3433023 - DNA, 15 bp, Homo sapiens
caatccaagagtctg

SEQ ID NO: 3433024 - DNA, 14 bp, Homo sapiens
caatcctatgtttt

SEQ ID NO: 3433025 - DNA, 15 bp, Homo sapiens
caatcttctttttca

SEQ ID NO: 3433026 - DNA, 15 bp, Homo sapiens
caatgaaaaaatgta

SEQ ID NO: 3433027 - DNA, 19 bp, Homo sapiens
caatgaaatattgctgtat

SEQ ID NO: 3433028 - DNA, 19 bp, Homo sapiens
caatgatcctgtattcaga

SEQ ID NO: 3433029 - DNA, 14 bp, Homo sapiens
caatgatgaatgag

SEQ ID NO: 3433030 - DNA, 16 bp, Homo sapiens
caatgccatcctcaaa

SEQ ID NO: 3433031 - DNA, 16 bp, Homo sapiens
caatgctgatttggtg

SEQ ID NO: 3433032 - DNA, 20 bp, Homo sapiens
caatgctggctgttggctgg

SEQ ID NO: 3433033 - DNA, 21 bp, Homo sapiens
caatgctggctgttggctggg

SEQ ID NO: 3433034 - DNA, 12 bp, Homo sapiens
caatggcagcct

SEQ ID NO: 3433035 - DNA, 19 bp, Homo sapiens
caatggctacctaaaaaga

SEQ ID NO: 3433036 - DNA, 21 bp, Homo sapiens
caatgggagctgaggccacac

SEQ ID NO: 3433037 - DNA, 22 bp, Homo sapiens
caatggggatgttgtgtttctg

SEQ ID NO: 3433038 - DNA, 23 bp, Homo sapiens
caatgggtttttccctgtacagt

SEQ ID NO: 3433039 - DNA, 20 bp, Homo sapiens
caatggtgttatttgaaact

SEQ ID NO: 3433040 - DNA, 17 bp, Homo sapiens
caatggtttttaaattt

SEQ ID NO: 3433041 - DNA, 21 bp, Homo sapiens
caatggtttttaaattttgta

SEQ ID NO: 3433042 - DNA, 20 bp, Homo sapiens
caatgtattgataagagggc

SEQ ID NO: 3433043 - DNA, 15 bp, Homo sapiens
caatgtctgagtgaa

SEQ ID NO: 3433044 - DNA, 13 bp, Homo sapiens
caatgtctgcagc

SEQ ID NO: 3433045 - DNA, 18 bp, Homo sapiens
caatgtctgcagccctga

SEQ ID NO: 3433046 - DNA, 11 bp, Homo sapiens
caatgtcttga

SEQ ID NO: 3433047 - DNA, 22 bp, Homo sapiens
caatgtgaaaagaaaaatgagc

SEQ ID NO: 3433048 - DNA, 19 bp, Homo sapiens
caatgtgaactttattaaa

SEQ ID NO: 3433049 - DNA, 17 bp, Homo sapiens
caatgtgataaaacccc

SEQ ID NO: 3433050 - DNA, 14 bp, Homo sapiens
caatgttcatccca

SEQ ID NO: 3433051 - DNA, 23 bp, Homo sapiens
caattaggcagactctttatgct

SEQ ID NO: 3433052 - DNA, 13 bp, Homo sapiens
caattatttttac

SEQ ID NO: 3433053 - DNA, 14 bp, Homo sapiens
caattcaacactcc

SEQ ID NO: 3433054 - DNA, 21 bp, Homo sapiens
caattccactctgatagaatt

SEQ ID NO: 3433055 - DNA, 14 bp, Homo sapiens
caattcctctggga

SEQ ID NO: 3433056 - DNA, 15 bp, Homo sapiens
caattctcctgcctt

SEQ ID NO: 3433057 - DNA, 17 bp, Homo sapiens
caattctcctgcctttg

SEQ ID NO: 3433058 - DNA, 17 bp, Homo sapiens
caattctcgagcttggg

SEQ ID NO: 3433059 - DNA, 14 bp, Homo sapiens
caattgaaatgcat

SEQ ID NO: 3433060 - DNA, 14 bp, Homo sapiens
caattgacaacagt

SEQ ID NO: 3433061 - DNA, 21 bp, Homo sapiens
caattgacaacagttacataa

SEQ ID NO: 3433062 - DNA, 22 bp, Homo sapiens
caattgacataggcaataataa

SEQ ID NO: 3433063 - DNA, 17 bp, Homo sapiens
caattgcatctcccaga

SEQ ID NO: 3433064 - DNA, 14 bp, Homo sapiens
caattgtaaattga

SEQ ID NO: 3433065 - DNA, 17 bp, Homo sapiens
caatttaaacaccagtc

SEQ ID NO: 3433066 - DNA, 20 bp, Homo sapiens
caatttacaaagtgtgtatt

SEQ ID NO: 3433067 - DNA, 16 bp, Homo sapiens
caatttctactttgaa

SEQ ID NO: 3433068 - DNA, 20 bp, Homo sapiens
caatttctactttgaagtca

SEQ ID NO: 3433069 - DNA, 21 bp, Homo sapiens
caatttctactttgaagtcat

SEQ ID NO: 3433070 - DNA, 19 bp, Homo sapiens
caattttaatttagtaaat

SEQ ID NO: 3433071 - DNA, 22 bp, Homo sapiens
caattttaatttagtaaatgtt

SEQ ID NO: 3433072 - DNA, 22 bp, Homo sapiens
caattttaccctgaggtcactg

SEQ ID NO: 3433073 - DNA, 18 bp, Homo sapiens
cacaaaagtttctctttt

SEQ ID NO: 3433074 - DNA, 15 bp, Homo sapiens
cacaaacctgcctgg

SEQ ID NO: 3433075 - DNA, 17 bp, Homo sapiens
cacaaacgggctcagca

SEQ ID NO: 3433076 - DNA, 12 bp, Homo sapiens
cacaaactgtaa

SEQ ID NO: 3433077 - DNA, 23 bp, Homo sapiens
cacaaactgtaaataaaaagaaa

SEQ ID NO: 3433078 - DNA, 19 bp, Homo sapiens
cacaaacttttatactctt

SEQ ID NO: 3433079 - DNA, 15 bp, Homo sapiens
cacaaagaccaaaat

SEQ ID NO: 3433080 - DNA, 16 bp, Homo sapiens
cacaaagaccaaaatg

SEQ ID NO: 3433081 - DNA, 14 bp, Homo sapiens
cacaaagcccaagg

SEQ ID NO: 3433082 - DNA, 13 bp, Homo sapiens
cacaaaggagagc

SEQ ID NO: 3433083 - DNA, 18 bp, Homo sapiens
cacaactagttttgttta

SEQ ID NO: 3433084 - DNA, 12 bp, Homo sapiens
cacaacttgttt

SEQ ID NO: 3433085 - DNA, 20 bp, Homo sapiens
cacaagacccaagtagctgc

SEQ ID NO: 3433086 - DNA, 13 bp, Homo sapiens
cacaagagctgga

SEQ ID NO: 3433087 - DNA, 18 bp, Homo sapiens
cacaagatgccccaggga

SEQ ID NO: 3433088 - DNA, 13 bp, Homo sapiens
cacaagcacaaag

SEQ ID NO: 3433089 - DNA, 17 bp, Homo sapiens
cacaagcacaaagctca

SEQ ID NO: 3433090 - DNA, 18 bp, Homo sapiens
cacaaggactgccgcctt

SEQ ID NO: 3433091 - DNA, 22 bp, Homo sapiens
cacaaggatagatgctggccca

SEQ ID NO: 3433092 - DNA, 12 bp, Homo sapiens
cacaagtgaaaa

SEQ ID NO: 3433093 - DNA, 19 bp, Homo sapiens
cacaagtgccgcaaattgt

SEQ ID NO: 3433094 - DNA, 20 bp, Homo sapiens
cacaatagccgatatcagaa

SEQ ID NO: 3433095 - DNA, 22 bp, Homo sapiens
cacaatggtttttaaattttgt

SEQ ID NO: 3433096 - DNA, 18 bp, Homo sapiens
cacacaaaccttctgcct

SEQ ID NO: 3433097 - DNA, 13 bp, Homo sapiens
cacacacaaacct

SEQ ID NO: 3433098 - DNA, 10 bp, Homo sapiens
cacacacaca

SEQ ID NO: 3433099 - DNA, 15 bp, Homo sapiens
cacacacacaaacct

SEQ ID NO: 3433100 - DNA, 13 bp, Homo sapiens
cacacacacacaa

SEQ ID NO: 3433101 - DNA, 14 bp, Homo sapiens
cacacacacacaca

SEQ ID NO: 3433102 - DNA, 15 bp, Homo sapiens
cacacacacacacaa

SEQ ID NO: 3433103 - DNA, 14 bp, Homo sapiens
cacacacctagcca

SEQ ID NO: 3433104 - DNA, 18 bp, Homo sapiens
cacacagatacacacaca

SEQ ID NO: 3433105 - DNA, 13 bp, Homo sapiens
cacacagctccca

SEQ ID NO: 3433106 - DNA, 13 bp, Homo sapiens
cacacagctctgt

SEQ ID NO: 3433107 - DNA, 18 bp, Homo sapiens
cactactaaaagtttaga

SEQ ID NO: 3433108 - DNA, 21 bp, Homo sapiens
cactactgctaccacaactat

SEQ ID NO: 3433109 - DNA, 17 bp, Homo sapiens
cactaggcccccacttg

SEQ ID NO: 3433110 - DNA, 21 bp, Homo sapiens
cactaggcccccacttgcctc

SEQ ID NO: 3433111 - DNA, 22 bp, Homo sapiens
cactaggcccccacttgcctct

SEQ ID NO: 3433112 - DNA, 14 bp, Homo sapiens
cactatctttcagc

SEQ ID NO: 3433113 - DNA, 15 bp, Homo sapiens
cactatgttgcccag

SEQ ID NO: 3433114 - DNA, 17 bp, Homo sapiens
cactatgttgcccaggc

SEQ ID NO: 3433115 - DNA, 19 bp, Homo sapiens
cactatgttgcccaggcag

SEQ ID NO: 3433116 - DNA, 15 bp, Homo sapiens
cactattcctaggag

SEQ ID NO: 3433117 - DNA, 15 bp, Homo sapiens
cactcaaaagctggg

SEQ ID NO: 3433118 - DNA, 19 bp, Homo sapiens
cactcaaaagctgggcagg

SEQ ID NO: 3433119 - DNA, 23 bp, Homo sapiens
cactcaaagagggtgagggcctt

SEQ ID NO: 3433120 - DNA, 11 bp, Homo sapiens
cactcaaggcg

SEQ ID NO: 3433121 - DNA, 17 bp, Homo sapiens
cactcagaagacactga

SEQ ID NO: 3433122 - DNA, 22 bp, Homo sapiens
cactcagcacaaggccatctgg

SEQ ID NO: 3433123 - DNA, 20 bp, Homo sapiens
cactcaggctggagtacagt

SEQ ID NO: 3433124 - DNA, 19 bp, Homo sapiens
cactcattgctgagcctct

SEQ ID NO: 3433125 - DNA, 19 bp, Homo sapiens
cactccagtcctgccacca

SEQ ID NO: 3433126 - DNA, 18 bp, Homo sapiens
cactcccacctgcatctg

SEQ ID NO: 3433127 - DNA, 14 bp, Homo sapiens
cactcccaggcagc

SEQ ID NO: 3433128 - DNA, 15 bp, Homo sapiens
cactcccaggcagcc

SEQ ID NO: 3433129 - DNA, 18 bp, Homo sapiens
cactccccgaagtctttt

SEQ ID NO: 3433130 - DNA, 13 bp, Homo sapiens
cactccctcctgg

SEQ ID NO: 3433131 - DNA, 23 bp, Homo sapiens
cactccctcctggagctctgtgg

SEQ ID NO: 3433132 - DNA, 20 bp, Homo sapiens
cactcccttgggctccctgt

SEQ ID NO: 3433133 - DNA, 19 bp, Homo sapiens
cactccgagaggtgggcca

SEQ ID NO: 3433134 - DNA, 12 bp, Homo sapiens
cactcctctgac

SEQ ID NO: 3433135 - DNA, 13 bp, Homo sapiens
cactcctgccaag

SEQ ID NO: 3433136 - DNA, 17 bp, Homo sapiens
cactccttctctcactg

SEQ ID NO: 3433137 - DNA, 20 bp, Homo sapiens
cactctcccccaccccctcc

SEQ ID NO: 3433138 - DNA, 23 bp, Homo sapiens
cactctgccccccccccccatct

SEQ ID NO: 3433139 - DNA, 18 bp, Homo sapiens
cactctgctcgccttagc

SEQ ID NO: 3433140 - DNA, 14 bp, Homo sapiens
cactctgcttctct

SEQ ID NO: 3433141 - DNA, 17 bp, Homo sapiens
cactctgcttctctgac

SEQ ID NO: 3433142 - DNA, 18 bp, Homo sapiens
cactctgcttctctgact

SEQ ID NO: 3433143 - DNA, 21 bp, Homo sapiens
cactctgcttctctgacttct

SEQ ID NO: 3433144 - DNA, 14 bp, Homo sapiens
cactctgggctcca

SEQ ID NO: 3433145 - DNA, 16 bp, Homo sapiens
cactctgggctccaga

SEQ ID NO: 3433146 - DNA, 17 bp, Homo sapiens
cactctgggctccagag

SEQ ID NO: 3433147 - DNA, 15 bp, Homo sapiens
cactctgtcgcccag

SEQ ID NO: 3433148 - DNA, 17 bp, Homo sapiens
cactcttattgcccacg

SEQ ID NO: 3433149 - DNA, 17 bp, Homo sapiens
cactgaaatctgtcaag

SEQ ID NO: 3433150 - DNA, 19 bp, Homo sapiens
cactgacacaaaaagtaga

SEQ ID NO: 3433151 - DNA, 20 bp, Homo sapiens
cactgacactggtattcctg

SEQ ID NO: 3433152 - DNA, 16 bp, Homo sapiens
cactgagaatgtaaga

SEQ ID NO: 3433153 - DNA, 23 bp, Homo sapiens
cactgagataccagcgaggaggc

SEQ ID NO: 3433154 - DNA, 13 bp, Homo sapiens
cactgaggaagaa

SEQ ID NO: 3433155 - DNA, 14 bp, Homo sapiens
cactgagggcagtc

SEQ ID NO: 3433156 - DNA, 14 bp, Homo sapiens
cactgagtgaagga

SEQ ID NO: 3433157 - DNA, 15 bp, Homo sapiens
cactgagtgaaggaa

SEQ ID NO: 3433158 - DNA, 19 bp, Homo sapiens
cactgatgctgcccctcat

SEQ ID NO: 3433159 - DNA, 23 bp, Homo sapiens
cactgcaacctccgcctcttggg

SEQ ID NO: 3433160 - DNA, 17 bp, Homo sapiens
cactgcaagaagtcttg

SEQ ID NO: 3433161 - DNA, 19 bp, Homo sapiens
cactgcaagtccttttgta

SEQ ID NO: 3433162 - DNA, 21 bp, Homo sapiens
cactgcaagtccttttgtaaa

SEQ ID NO: 3433163 - DNA, 18 bp, Homo sapiens
cactgcaccgggccacag

SEQ ID NO: 3433164 - DNA, 15 bp, Homo sapiens
cactgcactccagcc

SEQ ID NO: 3433165 - DNA, 20 bp, Homo sapiens
cactgcactccagcctgggt

SEQ ID NO: 3433166 - DNA, 12 bp, Homo sapiens
cactgcagcctc

SEQ ID NO: 3433167 - DNA, 16 bp, Homo sapiens
cactgcataccaacct

SEQ ID NO: 3433168 - DNA, 14 bp, Homo sapiens
cactgccacaccct

SEQ ID NO: 3433169 - DNA, 22 bp, Homo sapiens
cactgccactccagtcctgcca

SEQ ID NO: 3433170 - DNA, 21 bp, Homo sapiens
cactgccataaaacattaaga

SEQ ID NO: 3433171 - DNA, 22 bp, Homo sapiens
cactgccatgcaccaggactgg

SEQ ID NO: 3433172 - DNA, 17 bp, Homo sapiens
cactgcccatggacagg

SEQ ID NO: 3433173 - DNA, 12 bp, Homo sapiens
cactgccgctgc

SEQ ID NO: 3433174 - DNA, 14 bp, Homo sapiens
cactgccggcagga

SEQ ID NO: 3433175 - DNA, 21 bp, Homo sapiens
cactgctagagacgctgatcc

SEQ ID NO: 3433176 - DNA, 12 bp, Homo sapiens
cactgctctggt

SEQ ID NO: 3433177 - DNA, 13 bp, Homo sapiens
cactgcttgagga

SEQ ID NO: 3433178 - DNA, 20 bp, Homo sapiens
cactgcttgaggaaaacaag

SEQ ID NO: 3433179 - DNA, 13 bp, Homo sapiens
cactgcttttggc

SEQ ID NO: 3433180 - DNA, 17 bp, Homo sapiens
cactggaccccagcaag

SEQ ID NO: 3433181 - DNA, 16 bp, Homo sapiens
cactggactgacctgg

SEQ ID NO: 3433182 - DNA, 23 bp, Homo sapiens
cactggatgcaaagaaaatcaga

SEQ ID NO: 3433183 - DNA, 15 bp, Homo sapiens
cactggatgcagaaa

SEQ ID NO: 3433184 - DNA, 18 bp, Homo sapiens
cactggcagactgtgtaa

SEQ ID NO: 3433185 - DNA, 22 bp, Homo sapiens
cactgggatcacaggtgtcagc

SEQ ID NO: 3433186 - DNA, 19 bp, Homo sapiens
cactgggccctgagccaga

SEQ ID NO: 3433187 - DNA, 16 bp, Homo sapiens
cactgggctcccgggc

SEQ ID NO: 3433188 - DNA, 19 bp, Homo sapiens
cactggggtccagggagca

SEQ ID NO: 3433189 - DNA, 15 bp, Homo sapiens
cactggggtctgttt

SEQ ID NO: 3433190 - DNA, 20 bp, Homo sapiens
cactgggtggtggcctggtc

SEQ ID NO: 3433191 - DNA, 15 bp, Homo sapiens
cactgggttgacttt

SEQ ID NO: 3433192 - DNA, 16 bp, Homo sapiens
cactggtttctcagaa

SEQ ID NO: 3433193 - DNA, 22 bp, Homo sapiens
cactgtatgatttataaacaga

SEQ ID NO: 3433194 - DNA, 20 bp, Homo sapiens
cactgtatgttatagaactt

SEQ ID NO: 3433195 - DNA, 15 bp, Homo sapiens
cactgtcctgggcct

SEQ ID NO: 3433196 - DNA, 18 bp, Homo sapiens
cactgtcctgggcctgca

SEQ ID NO: 3433197 - DNA, 19 bp, Homo sapiens
cactgtgacccccagctcc

SEQ ID NO: 3433198 - DNA, 16 bp, Homo sapiens
cactgtgagctcccag

SEQ ID NO: 3433199 - DNA, 17 bp, Homo sapiens
cactgtgagctcccagg

SEQ ID NO: 3433200 - DNA, 14 bp, Homo sapiens
cactgtgccatgtg

SEQ ID NO: 3433201 - DNA, 15 bp, Homo sapiens
cactgtgccatgtgc

SEQ ID NO: 3433202 - DNA, 15 bp, Homo sapiens
cactgtggctgtctg

SEQ ID NO: 3433203 - DNA, 14 bp, Homo sapiens
cactgtgggaaggc

SEQ ID NO: 3433204 - DNA, 15 bp, Homo sapiens
cactgtgggtgtgtg

SEQ ID NO: 3433205 - DNA, 19 bp, Homo sapiens
cactgtgggtgtgtgactc

SEQ ID NO: 3433206 - DNA, 20 bp, Homo sapiens
cactgtgggtgtgtgactct

SEQ ID NO: 3433207 - DNA, 18 bp, Homo sapiens
cactgtgtgctgactgaa

SEQ ID NO: 3433208 - DNA, 21 bp, Homo sapiens
cactgtgtgctgactgaacat

SEQ ID NO: 3433209 - DNA, 22 bp, Homo sapiens
cactgtgtgctgactgaacatt

SEQ ID NO: 3433210 - DNA, 18 bp, Homo sapiens
cactgtgttactgctttg

SEQ ID NO: 3433211 - DNA, 19 bp, Homo sapiens
cactgttcatgctggcgag

SEQ ID NO: 3433212 - DNA, 19 bp, Homo sapiens
cactgttccccctgtgcag

SEQ ID NO: 3433213 - DNA, 21 bp, Homo sapiens
cactgttctgggactccaggt

SEQ ID NO: 3433214 - DNA, 17 bp, Homo sapiens
cactgttgcccaggctg

SEQ ID NO: 3433215 - DNA, 19 bp, Homo sapiens
cactgttgcccaggctggc

SEQ ID NO: 3433216 - DNA, 13 bp, Homo sapiens
cactgtttcctga

SEQ ID NO: 3433217 - DNA, 14 bp, Homo sapiens
cactgtttcctgat

SEQ ID NO: 3433218 - DNA, 18 bp, Homo sapiens
cactgtttgtttttattt

SEQ ID NO: 3433219 - DNA, 19 bp, Homo sapiens
cactgttttttggcttgct

SEQ ID NO: 3433220 - DNA, 13 bp, Homo sapiens
cacttaagagaat

SEQ ID NO: 3433221 - DNA, 14 bp, Homo sapiens
cacttcaccctgga

SEQ ID NO: 3433222 - DNA, 18 bp, Homo sapiens
cacttcaggtcaggagtt

SEQ ID NO: 3433223 - DNA, 11 bp, Homo sapiens
cacttccattg

SEQ ID NO: 3433224 - DNA, 15 bp, Homo sapiens
cacttccattgttta

SEQ ID NO: 3433225 - DNA, 15 bp, Homo sapiens
cacttccctgctgcc

SEQ ID NO: 3433226 - DNA, 18 bp, Homo sapiens
cacttccctgctgcctgt

SEQ ID NO: 3433227 - DNA, 20 bp, Homo sapiens
cacttcgttcgcagagcttt

SEQ ID NO: 3433228 - DNA, 20 bp, Homo sapiens
cacttctagggtatgggaaa

SEQ ID NO: 3433229 - DNA, 19 bp, Homo sapiens
cacttcttcacctcttcca

SEQ ID NO: 3433230 - DNA, 18 bp, Homo sapiens
cacttgcagactctacag

SEQ ID NO: 3433231 - DNA, 22 bp, Homo sapiens
cacttgcagactctacagaggc

SEQ ID NO: 3433232 - DNA, 12 bp, Homo sapiens
cacttgcatttc

SEQ ID NO: 3433233 - DNA, 17 bp, Homo sapiens
cacttggcatcagctgg

SEQ ID NO: 3433234 - DNA, 19 bp, Homo sapiens
cacttggcccaagtggcag

SEQ ID NO: 3433235 - DNA, 22 bp, Homo sapiens
cacttggcccaagtggcagagc

SEQ ID NO: 3433236 - DNA, 20 bp, Homo sapiens
cacttgggggttcaggcccg

SEQ ID NO: 3433237 - DNA, 17 bp, Homo sapiens
cacttgtgattatttat

SEQ ID NO: 3433238 - DNA, 22 bp, Homo sapiens
cacttgtgggtttttgttttgt

SEQ ID NO: 3433239 - DNA, 18 bp, Homo sapiens
cagctctcatctgaggca

SEQ ID NO: 3433240 - DNA, 14 bp, Homo sapiens
cagctctctgccct

SEQ ID NO: 3433241 - DNA, 21 bp, Homo sapiens
cagctctctgccctgtgtact

SEQ ID NO: 3433242 - DNA, 18 bp, Homo sapiens
cagctctgaaaccagtgt

SEQ ID NO: 3433243 - DNA, 19 bp, Homo sapiens
cagctctgaaaccagtgtt

SEQ ID NO: 3433244 - DNA, 15 bp, Homo sapiens
cagctctgcaagaat

SEQ ID NO: 3433245 - DNA, 16 bp, Homo sapiens
cagctctgcaagaatt

SEQ ID NO: 3433246 - DNA, 23 bp, Homo sapiens
cagctctggacagccccaccctg

SEQ ID NO: 3433247 - DNA, 19 bp, Homo sapiens
cagctctgggccattctcc

SEQ ID NO: 3433248 - DNA, 18 bp, Homo sapiens
cagctctgtcctgggagt

SEQ ID NO: 3433249 - DNA, 18 bp, Homo sapiens
cagctcttcatctgccca

SEQ ID NO: 3433250 - DNA, 23 bp, Homo sapiens
cagctcttctgccggccctgggg

SEQ ID NO: 3433251 - DNA, 16 bp, Homo sapiens
cagctcttggctccac

SEQ ID NO: 3433252 - DNA, 16 bp, Homo sapiens
cagctctttcctcctt

SEQ ID NO: 3433253 - DNA, 19 bp, Homo sapiens
cagctgaaatatgctggct

SEQ ID NO: 3433254 - DNA, 22 bp, Homo sapiens
cagctgaaatatgctggctgga

SEQ ID NO: 3433255 - DNA, 14 bp, Homo sapiens
cagctgagcgccag

SEQ ID NO: 3433256 - DNA, 16 bp, Homo sapiens
cagctgagcgccagga

SEQ ID NO: 3433257 - DNA, 18 bp, Homo sapiens
cagctgagcgccaggatg

SEQ ID NO: 3433258 - DNA, 11 bp, Homo sapiens
cagctgcaaag

SEQ ID NO: 3433259 - DNA, 13 bp, Homo sapiens
cagctgcaaagtg

SEQ ID NO: 3433260 - DNA, 16 bp, Homo sapiens
cagctgcaaagtgttt

SEQ ID NO: 3433261 - DNA, 22 bp, Homo sapiens
cagctgcagtcaacagttcaaa

SEQ ID NO: 3433262 - DNA, 19 bp, Homo sapiens
cagctgccccggcccctcc

SEQ ID NO: 3433263 - DNA, 21 bp, Homo sapiens
cagctgcctaggtcccccaag

SEQ ID NO: 3433264 - DNA, 22 bp, Homo sapiens
cagctgcctaggtcccccaagc

SEQ ID NO: 3433265 - DNA, 22 bp, Homo sapiens
cagctgccttagcttcaggaac

SEQ ID NO: 3433266 - DNA, 23 bp, Homo sapiens
cagctgccttagcttcaggaacc

SEQ ID NO: 3433267 - DNA, 22 bp, Homo sapiens
cagctgcggtccacccaggagc

SEQ ID NO: 3433268 - DNA, 24 bp, Homo sapiens
cagctgcggtccacccaggagccc

SEQ ID NO: 3433269 - DNA, 23 bp, Homo sapiens
cagctgctcctagagggaggggc

SEQ ID NO: 3433270 - DNA, 18 bp, Homo sapiens
cagctgctggagactcct

SEQ ID NO: 3433271 - DNA, 23 bp, Homo sapiens
cagctgctggagactcctaggca

SEQ ID NO: 3433272 - DNA, 17 bp, Homo sapiens
cagctggaattatgctg

SEQ ID NO: 3433273 - DNA, 18 bp, Homo sapiens
cagctggcagcagagtgt

SEQ ID NO: 3433274 - DNA, 24 bp, Homo sapiens
cagctgggctagaggctgagcacc

SEQ ID NO: 3433275 - DNA, 16 bp, Homo sapiens
cagctgggtggcactg

SEQ ID NO: 3433276 - DNA, 21 bp, Homo sapiens
cagctgggtggcactgccatg

SEQ ID NO: 3433277 - DNA, 22 bp, Homo sapiens
cagctgggtggcactgccatgc

SEQ ID NO: 3433278 - DNA, 18 bp, Homo sapiens
cagctggttgaggtttca

SEQ ID NO: 3433279 - DNA, 14 bp, Homo sapiens
cagctgtcaagggc

SEQ ID NO: 3433280 - DNA, 19 bp, Homo sapiens
cagctgtgctctggacagg

SEQ ID NO: 3433281 - DNA, 20 bp, Homo sapiens
cagctgtgctctggacaggc

SEQ ID NO: 3433282 - DNA, 23 bp, Homo sapiens
cagctgtgtgacatttggagagg

SEQ ID NO: 3433283 - DNA, 18 bp, Homo sapiens
cagcttacacaaatctat

SEQ ID NO: 3433284 - DNA, 16 bp, Homo sapiens
cagcttatctctttta

SEQ ID NO: 3433285 - DNA, 22 bp, Homo sapiens
cagcttatctcttttatatttg

SEQ ID NO: 3433286 - DNA, 15 bp, Homo sapiens
cagcttcatttcctg

SEQ ID NO: 3433287 - DNA, 20 bp, Homo sapiens
cagcttcatttcctgtgtct

SEQ ID NO: 3433288 - DNA, 21 bp, Homo sapiens
cagcttcatttcctgtgtctt

SEQ ID NO: 3433289 - DNA, 22 bp, Homo sapiens
cagcttcccctctctcctcctg

SEQ ID NO: 3433290 - DNA, 21 bp, Homo sapiens
cagcttcctgtccccatctgt

SEQ ID NO: 3433291 - DNA, 15 bp, Homo sapiens
cagcttcgagctaca

SEQ ID NO: 3433292 - DNA, 15 bp, Homo sapiens
cagcttctcctgtgt

SEQ ID NO: 3433293 - DNA, 16 bp, Homo sapiens
cagcttctcctgtgtg

SEQ ID NO: 3433294 - DNA, 15 bp, Homo sapiens
cagcttgacctgagg

SEQ ID NO: 3433295 - DNA, 19 bp, Homo sapiens
cagcttgacctgaggctgt

SEQ ID NO: 3433296 - DNA, 21 bp, Homo sapiens
cagcttgacctgaggctgtgg

SEQ ID NO: 3433297 - DNA, 23 bp, Homo sapiens
cagcttgacctgaggctgtggtc

SEQ ID NO: 3433298 - DNA, 19 bp, Homo sapiens
cagcttgagggttgggctg

SEQ ID NO: 3433299 - DNA, 17 bp, Homo sapiens
cagcttgccagatgctg

SEQ ID NO: 3433300 - DNA, 13 bp, Homo sapiens
cagcttgctgtca

SEQ ID NO: 3433301 - DNA, 18 bp, Homo sapiens
cagcttggacatcagtgt

SEQ ID NO: 3433302 - DNA, 19 bp, Homo sapiens
cagcttgtaaatagctcag

SEQ ID NO: 3433303 - DNA, 17 bp, Homo sapiens
cagctttactttaaaat

SEQ ID NO: 3433304 - DNA, 15 bp, Homo sapiens
cagctttctgacctt

SEQ ID NO: 3433305 - DNA, 22 bp, Homo sapiens
cagctttctgaccttcagctca

SEQ ID NO: 3433306 - DNA, 20 bp, Homo sapiens
cagctttgatccctgacatc

SEQ ID NO: 3433307 - DNA, 13 bp, Homo sapiens
cagctttgctgct

SEQ ID NO: 3433308 - DNA, 14 bp, Homo sapiens
cagctttgctgctg

SEQ ID NO: 3433309 - DNA, 22 bp, Homo sapiens
cagctttgtttgttgtcagctg

SEQ ID NO: 3433310 - DNA, 20 bp, Homo sapiens
caggaaaagctgctgacagt

SEQ ID NO: 3433311 - DNA, 15 bp, Homo sapiens
caggaaaggaatcat

SEQ ID NO: 3433312 - DNA, 18 bp, Homo sapiens
caggaaaggcccagccac

SEQ ID NO: 3433313 - DNA, 16 bp, Homo sapiens
caggaaccacaccaca

SEQ ID NO: 3433314 - DNA, 19 bp, Homo sapiens
caggaaccacaccacatct

SEQ ID NO: 3433315 - DNA, 14 bp, Homo sapiens
caggaagaaagaat

SEQ ID NO: 3433316 - DNA, 21 bp, Homo sapiens
caggaagccgtgccctgcccc

SEQ ID NO: 3433317 - DNA, 17 bp, Homo sapiens
caggaatattttccaaa

SEQ ID NO: 3433318 - DNA, 14 bp, Homo sapiens
caggaatctcagag

SEQ ID NO: 3433319 - DNA, 14 bp, Homo sapiens
caggaatcttaagg

SEQ ID NO: 3433320 - DNA, 15 bp, Homo sapiens
caggacacagtcaga

SEQ ID NO: 3433321 - DNA, 15 bp, Homo sapiens
caggacacctggccg

SEQ ID NO: 3433322 - DNA, 19 bp, Homo sapiens
caggacacctggccgcctc

SEQ ID NO: 3433323 - DNA, 21 bp, Homo sapiens
caggacatgcggtagccagca

SEQ ID NO: 3433324 - DNA, 23 bp, Homo sapiens
caggacatgcggtagccagcaca

SEQ ID NO: 3433325 - DNA, 17 bp, Homo sapiens
caggacatgctgaagcc

SEQ ID NO: 3433326 - DNA, 12 bp, Homo sapiens
caggacatttct

SEQ ID NO: 3433327 - DNA, 18 bp, Homo sapiens
caggacatttctctaaga

SEQ ID NO: 3433328 - DNA, 15 bp, Homo sapiens
caggaccagctcagg

SEQ ID NO: 3433329 - DNA, 17 bp, Homo sapiens
caggaccagctcaggac

SEQ ID NO: 3433330 - DNA, 16 bp, Homo sapiens
caggacccagaggaag

SEQ ID NO: 3433331 - DNA, 16 bp, Homo sapiens
caggaccctcgccgga

SEQ ID NO: 3433332 - DNA, 18 bp, Homo sapiens
caggaccctgaaggggcc

SEQ ID NO: 3433333 - DNA, 16 bp, Homo sapiens
caggacctcaggtgag

SEQ ID NO: 3433334 - DNA, 23 bp, Homo sapiens
caggacctcaggtgagaagcaga

SEQ ID NO: 3433335 - DNA, 21 bp, Homo sapiens
caggacctctgaaaccctgga

SEQ ID NO: 3433336 - DNA, 14 bp, Homo sapiens
caggacctggctgc

SEQ ID NO: 3433337 - DNA, 16 bp, Homo sapiens
caggacctggctgcca

SEQ ID NO: 3433338 - DNA, 22 bp, Homo sapiens
caggaccttcgggctgtgcccg

SEQ ID NO: 3433339 - DNA, 20 bp, Homo sapiens
caggactatatttgggcctg

SEQ ID NO: 3433340 - DNA, 12 bp, Homo sapiens
caggactcaccc

SEQ ID NO: 3433341 - DNA, 14 bp, Homo sapiens
caggactcaccctc

SEQ ID NO: 3433342 - DNA, 21 bp, Homo sapiens
caggactcagaagcctctggg

SEQ ID NO: 3433343 - DNA, 17 bp, Homo sapiens
caggactccaggcccaa

SEQ ID NO: 3433344 - DNA, 19 bp, Homo sapiens
caggactccaggcccaagg

SEQ ID NO: 3433345 - DNA, 14 bp, Homo sapiens
caggactctgaccc

SEQ ID NO: 3433346 - DNA, 20 bp, Homo sapiens
caggactgggccacttctgg

SEQ ID NO: 3433347 - DNA, 22 bp, Homo sapiens
caggacttccccggagggctgc

SEQ ID NO: 3433348 - DNA, 19 bp, Homo sapiens
caggactttgaggcaagtg

SEQ ID NO: 3433349 - DNA, 15 bp, Homo sapiens
caggagaagggctgg

SEQ ID NO: 3433350 - DNA, 16 bp, Homo sapiens
caggagactgggctct

SEQ ID NO: 3433351 - DNA, 21 bp, Homo sapiens
caggagcacacccagccccca

SEQ ID NO: 3433352 - DNA, 20 bp, Homo sapiens
caggagcagcctcagaacaa

SEQ ID NO: 3433353 - DNA, 16 bp, Homo sapiens
caggagccccgaggcc

SEQ ID NO: 3433354 - DNA, 20 bp, Homo sapiens
caggagccccgaggccttct

SEQ ID NO: 3433355 - DNA, 12 bp, Homo sapiens
caggagcttcct

SEQ ID NO: 3433356 - DNA, 17 bp, Homo sapiens
caggaggagttagccaa

SEQ ID NO: 3433357 - DNA, 15 bp, Homo sapiens
caggaggcaggacct

SEQ ID NO: 3433358 - DNA, 13 bp, Homo sapiens
caggaggccctgg

SEQ ID NO: 3433359 - DNA, 20 bp, Homo sapiens
caggaggccctggtcctggc

SEQ ID NO: 3433360 - DNA, 12 bp, Homo sapiens
caggagtgagca

SEQ ID NO: 3433361 - DNA, 17 bp, Homo sapiens
caggagtgtcctcttcc

SEQ ID NO: 3433362 - DNA, 19 bp, Homo sapiens
caggagtgtcctcttccct

SEQ ID NO: 3433363 - DNA, 23 bp, Homo sapiens
caggagttcgagaccagcctggc

SEQ ID NO: 3433364 - DNA, 21 bp, Homo sapiens
caggagtttgagaccaacctg

SEQ ID NO: 3433365 - DNA, 16 bp, Homo sapiens
caggatagagactgga

SEQ ID NO: 3433366 - DNA, 14 bp, Homo sapiens
caggatattccaaa

SEQ ID NO: 3433367 - DNA, 23 bp, Homo sapiens
caggatcagattgcatgtgactc

SEQ ID NO: 3433368 - DNA, 12 bp, Homo sapiens
caggatcagcca

SEQ ID NO: 3433369 - DNA, 23 bp, Homo sapiens
caggatggccgggcgcggtggct

SEQ ID NO: 3433370 - DNA, 18 bp, Homo sapiens
cagtctctgccttgcctt

SEQ ID NO: 3433371 - DNA, 19 bp, Homo sapiens
cagtctctgccttgccttt

SEQ ID NO: 3433372 - DNA, 19 bp, Homo sapiens
cagtctctttattttacta

SEQ ID NO: 3433373 - DNA, 22 bp, Homo sapiens
cagtctgattcccaagctctgc

SEQ ID NO: 3433374 - DNA, 23 bp, Homo sapiens
cagtctgattcccaagctctgct

SEQ ID NO: 3433375 - DNA, 19 bp, Homo sapiens
cagtctggaatgcagtggt

SEQ ID NO: 3433376 - DNA, 21 bp, Homo sapiens
cagtctgggtaacagggagac

SEQ ID NO: 3433377 - DNA, 18 bp, Homo sapiens
cagtcttgacgagtgtga

SEQ ID NO: 3433378 - DNA, 15 bp, Homo sapiens
cagtcttgcagcagg

SEQ ID NO: 3433379 - DNA, 14 bp, Homo sapiens
cagtgaagacagaa

SEQ ID NO: 3433380 - DNA, 17 bp, Homo sapiens
cagtgaatgattcagtg

SEQ ID NO: 3433381 - DNA, 18 bp, Homo sapiens
cagtgaatgattcagtgt

SEQ ID NO: 3433382 - DNA, 20 bp, Homo sapiens
cagtgaatttttgcaataat

SEQ ID NO: 3433383 - DNA, 22 bp, Homo sapiens
cagtgaatttttgcaataatgc

SEQ ID NO: 3433384 - DNA, 23 bp, Homo sapiens
cagtgaatttttgcaataatgca

SEQ ID NO: 3433385 - DNA, 14 bp, Homo sapiens
cagtgacaaaccat

SEQ ID NO: 3433386 - DNA, 17 bp, Homo sapiens
cagtgagccgagatggc

SEQ ID NO: 3433387 - DNA, 18 bp, Homo sapiens
cagtgatgctggatgctc

SEQ ID NO: 3433388 - DNA, 20 bp, Homo sapiens
cagtgatgctggatgctcct

SEQ ID NO: 3433389 - DNA, 14 bp, Homo sapiens
cagtgcaacctctg

SEQ ID NO: 3433390 - DNA, 15 bp, Homo sapiens
cagtgcaacctctgc

SEQ ID NO: 3433391 - DNA, 22 bp, Homo sapiens
cagtgcaatggtataaatttca

SEQ ID NO: 3433392 - DNA, 20 bp, Homo sapiens
cagtgccatgtaaatcccca

SEQ ID NO: 3433393 - DNA, 17 bp, Homo sapiens
cagtgcccacaggatca

SEQ ID NO: 3433394 - DNA, 21 bp, Homo sapiens
cagtgcccccactgaccagaa

SEQ ID NO: 3433395 - DNA, 22 bp, Homo sapiens
cagtgcccccactgaccagaac

SEQ ID NO: 3433396 - DNA, 23 bp, Homo sapiens
cagtgcctacatcccgggcctca

SEQ ID NO: 3433397 - DNA, 17 bp, Homo sapiens
cagtgctcgctgttgct

SEQ ID NO: 3433398 - DNA, 18 bp, Homo sapiens
cagtgctcgctgttgctg

SEQ ID NO: 3433399 - DNA, 20 bp, Homo sapiens
cagtgctcgctgttgctgaa

SEQ ID NO: 3433400 - DNA, 21 bp, Homo sapiens
cagtgctcgctgttgctgaat

SEQ ID NO: 3433401 - DNA, 18 bp, Homo sapiens
cagtgctctaggctgccc

SEQ ID NO: 3433402 - DNA, 15 bp, Homo sapiens
cagtgctgcagctcc

SEQ ID NO: 3433403 - DNA, 19 bp, Homo sapiens
cagtgctgcagctccctgg

SEQ ID NO: 3433404 - DNA, 17 bp, Homo sapiens
cagtgctggagaaatct

SEQ ID NO: 3433405 - DNA, 21 bp, Homo sapiens
cagtgctggagaaatcttgaa

SEQ ID NO: 3433406 - DNA, 22 bp, Homo sapiens
cagtgctggagaaatcttgaat

SEQ ID NO: 3433407 - DNA, 15 bp, Homo sapiens
cagtgcttgccacag

SEQ ID NO: 3433408 - DNA, 18 bp, Homo sapiens
cagtgcttgccacagagc

SEQ ID NO: 3433409 - DNA, 20 bp, Homo sapiens
cagtggactcagaaagccaa

SEQ ID NO: 3433410 - DNA, 23 bp, Homo sapiens
cagtggcatgtccacgtgtgtgt

SEQ ID NO: 3433411 - DNA, 15 bp, Homo sapiens
cagtgggagatgtta

SEQ ID NO: 3433412 - DNA, 11 bp, Homo sapiens
cagtgggagct

SEQ ID NO: 3433413 - DNA, 16 bp, Homo sapiens
cagtgggagctgcctg

SEQ ID NO: 3433414 - DNA, 15 bp, Homo sapiens
cagtggggcagtcat

SEQ ID NO: 3433415 - DNA, 21 bp, Homo sapiens
cagtggggctctctgagtcct

SEQ ID NO: 3433416 - DNA, 23 bp, Homo sapiens
cagtggggtttcgcagcctgagt

SEQ ID NO: 3433417 - DNA, 20 bp, Homo sapiens
cagtggtatgatcacggctc

SEQ ID NO: 3433418 - DNA, 15 bp, Homo sapiens
cagtggtgccatcat

SEQ ID NO: 3433419 - DNA, 19 bp, Homo sapiens
cagtggtgcgatctcggct

SEQ ID NO: 3433420 - DNA, 21 bp, Homo sapiens
cagtggtgcgatctgggttca

SEQ ID NO: 3433421 - DNA, 20 bp, Homo sapiens
cagtgtacccacgctgggta

SEQ ID NO: 3433422 - DNA, 16 bp, Homo sapiens
cagtgtccaaagcagg

SEQ ID NO: 3433423 - DNA, 16 bp, Homo sapiens
cagtgtgaggccaggg

SEQ ID NO: 3433424 - DNA, 19 bp, Homo sapiens
cagtgtgaggccagggcag

SEQ ID NO: 3433425 - DNA, 19 bp, Homo sapiens
cagtgtgcacccctcccca

SEQ ID NO: 3433426 - DNA, 15 bp, Homo sapiens
cagtgtgcactaagg

SEQ ID NO: 3433427 - DNA, 17 bp, Homo sapiens
cagtgtgggacaggctc

SEQ ID NO: 3433428 - DNA, 19 bp, Homo sapiens
cagtgtgggacaggctctt

SEQ ID NO: 3433429 - DNA, 21 bp, Homo sapiens
cagtgtgggacaggctcttct

SEQ ID NO: 3433430 - DNA, 19 bp, Homo sapiens
cagtgttaaatgtgatgaa

SEQ ID NO: 3433431 - DNA, 14 bp, Homo sapiens
cagtgtttgttgga

SEQ ID NO: 3433432 - DNA, 15 bp, Homo sapiens
cagtgtttgttggat

SEQ ID NO: 3433433 - DNA, 22 bp, Homo sapiens
cagtgttttggactccatctct

SEQ ID NO: 3433434 - DNA, 19 bp, Homo sapiens
cagttaaaaaaaattttaa

SEQ ID NO: 3433435 - DNA, 16 bp, Homo sapiens
cagttaacgtattagt

SEQ ID NO: 3433436 - DNA, 23 bp, Homo sapiens
cagttaacgtattagttgccaat

SEQ ID NO: 3433437 - DNA, 17 bp, Homo sapiens
cagttaaggaatataat

SEQ ID NO: 3433438 - DNA, 21 bp, Homo sapiens
cagttacccactcggtcccag

SEQ ID NO: 3433439 - DNA, 15 bp, Homo sapiens
cagttactctgaagg

SEQ ID NO: 3433440 - DNA, 18 bp, Homo sapiens
cagttattacatgtaatt

SEQ ID NO: 3433441 - DNA, 17 bp, Homo sapiens
cagttattatatttaca

SEQ ID NO: 3433442 - DNA, 21 bp, Homo sapiens
cagttattatatttacaaatg

SEQ ID NO: 3433443 - DNA, 18 bp, Homo sapiens
cagttattggtggaatct

SEQ ID NO: 3433444 - DNA, 21 bp, Homo sapiens
cagttattggtggaatcttta

SEQ ID NO: 3433445 - DNA, 21 bp, Homo sapiens
cagttcaaaattctaaatgta

SEQ ID NO: 3433446 - DNA, 13 bp, Homo sapiens
cagttcaccctga

SEQ ID NO: 3433447 - DNA, 18 bp, Homo sapiens
cagttcctatgacacagt

SEQ ID NO: 3433448 - DNA, 20 bp, Homo sapiens
cagttcgcctggagccctcc

SEQ ID NO: 3433449 - DNA, 21 bp, Homo sapiens
cagttctggatggtgtgcctt

SEQ ID NO: 3433450 - DNA, 23 bp, Homo sapiens
cagttctggatggtgtgccttcc

SEQ ID NO: 3433451 - DNA, 16 bp, Homo sapiens
cagttctttgggccag

SEQ ID NO: 3433452 - DNA, 18 bp, Homo sapiens
cagttctttgggccagac

SEQ ID NO: 3433453 - DNA, 20 bp, Homo sapiens
cagttctttgggccagacat

SEQ ID NO: 3433454 - DNA, 22 bp, Homo sapiens
cagttctttgggccagacatgc

SEQ ID NO: 3433455 - DNA, 12 bp, Homo sapiens
cagttgaaaaac

SEQ ID NO: 3433456 - DNA, 18 bp, Homo sapiens
cagttgaaaaacagctga

SEQ ID NO: 3433457 - DNA, 11 bp, Homo sapiens
cagttgcagcc

SEQ ID NO: 3433458 - DNA, 22 bp, Homo sapiens
cagttggagttttttgtaccaa

SEQ ID NO: 3433459 - DNA, 22 bp, Homo sapiens
cagttggtgttcaaatagcact

SEQ ID NO: 3433460 - DNA, 23 bp, Homo sapiens
cagttgtagggttacagagacct

SEQ ID NO: 3433461 - DNA, 16 bp, Homo sapiens
cagtttaaaaaaattg

SEQ ID NO: 3433462 - DNA, 15 bp, Homo sapiens
cagtttaatgcaaga

SEQ ID NO: 3433463 - DNA, 19 bp, Homo sapiens
cagtttctgtcctgctggt

SEQ ID NO: 3433464 - DNA, 16 bp, Homo sapiens
cagtttgaaattctga

SEQ ID NO: 3433465 - DNA, 17 bp, Homo sapiens
cagtttgaaattctgaa

SEQ ID NO: 3433466 - DNA, 21 bp, Homo sapiens
cagtttgaaattctgaatttg

SEQ ID NO: 3433467 - DNA, 16 bp, Homo sapiens
cagtttgagacaggag

SEQ ID NO: 3433468 - DNA, 21 bp, Homo sapiens
cagtttgccggatacaaactg

SEQ ID NO: 3433469 - DNA, 16 bp, Homo sapiens
cagtttgtcacatgaa

SEQ ID NO: 3433470 - DNA, 17 bp, Homo sapiens
cagtttttggagtgtta

SEQ ID NO: 3433471 - DNA, 17 bp, Homo sapiens
cataaaacattaagaaa

SEQ ID NO: 3433472 - DNA, 18 bp, Homo sapiens
cataaaacattaagaaaa

SEQ ID NO: 3433473 - DNA, 19 bp, Homo sapiens
cataaaacattaagaaaat

SEQ ID NO: 3433474 - DNA, 18 bp, Homo sapiens
cataaagacaatcactgc

SEQ ID NO: 3433475 - DNA, 19 bp, Homo sapiens
cataaagacaatcactgcc

SEQ ID NO: 3433476 - DNA, 20 bp, Homo sapiens
cataaataagaaaaaccaaa

SEQ ID NO: 3433477 - DNA, 17 bp, Homo sapiens
cataacggatcagaaat

SEQ ID NO: 3433478 - DNA, 17 bp, Homo sapiens
cataagatcactgccag

SEQ ID NO: 3433479 - DNA, 22 bp, Homo sapiens
cataagctatagacccgaggaa

SEQ ID NO: 3433480 - DNA, 15 bp, Homo sapiens
cataagtatttcaaa

SEQ ID NO: 3433481 - DNA, 19 bp, Homo sapiens
cataagttggaccagagga

SEQ ID NO: 3433482 - DNA, 18 bp, Homo sapiens
cataataaaaggctttga

SEQ ID NO: 3433483 - DNA, 21 bp, Homo sapiens
cataataaacgatgttgtgat

SEQ ID NO: 3433484 - DNA, 17 bp, Homo sapiens
cataatatgatgcaaac

SEQ ID NO: 3433485 - DNA, 14 bp, Homo sapiens
cataatgatggatt

SEQ ID NO: 3433486 - DNA, 15 bp, Homo sapiens
cataatgatggattt

SEQ ID NO: 3433487 - DNA, 19 bp, Homo sapiens
cataatgggccactgaaat

SEQ ID NO: 3433488 - DNA, 22 bp, Homo sapiens
cataatgggccactgaaatctg

SEQ ID NO: 3433489 - DNA, 23 bp, Homo sapiens
cataatgggccactgaaatctgt

SEQ ID NO: 3433490 - DNA, 14 bp, Homo sapiens
cataatggggtcct

SEQ ID NO: 3433491 - DNA, 22 bp, Homo sapiens
cataatggggtcctggccatcc

SEQ ID NO: 3433492 - DNA, 14 bp, Homo sapiens
cataattcactctg

SEQ ID NO: 3433493 - DNA, 21 bp, Homo sapiens
cataattcactctgagtgttt

SEQ ID NO: 3433494 - DNA, 23 bp, Homo sapiens
cataatttgtacatatgtaaaat

SEQ ID NO: 3433495 - DNA, 22 bp, Homo sapiens
catacaccccctcttctgagca

SEQ ID NO: 3433496 - DNA, 14 bp, Homo sapiens
catacttgaagggc

SEQ ID NO: 3433497 - DNA, 17 bp, Homo sapiens
catacttgaagggccag

SEQ ID NO: 3433498 - DNA, 17 bp, Homo sapiens
catactttaagtaggga

SEQ ID NO: 3433499 - DNA, 15 bp, Homo sapiens
catactttgtaaata

SEQ ID NO: 3433500 - DNA, 17 bp, Homo sapiens
catctgtagtcagccga

SEQ ID NO: 3433501 - DNA, 21 bp, Homo sapiens
catctgtataagtaagaaaat

SEQ ID NO: 3433502 - DNA, 18 bp, Homo sapiens
catctgtcttgccagcca

SEQ ID NO: 3433503 - DNA, 19 bp, Homo sapiens
catctgtcttgccagccag

SEQ ID NO: 3433504 - DNA, 13 bp, Homo sapiens
catctgtgtcttg

SEQ ID NO: 3433505 - DNA, 14 bp, Homo sapiens
catctgtgtcttgt

SEQ ID NO: 3433506 - DNA, 21 bp, Homo sapiens
catcttaggttggcaaaaagg

SEQ ID NO: 3433507 - DNA, 18 bp, Homo sapiens
catcttcacccaggccta

SEQ ID NO: 3433508 - DNA, 14 bp, Homo sapiens
catcttcccaaccc

SEQ ID NO: 3433509 - DNA, 18 bp, Homo sapiens
catcttgaccaagcagga

SEQ ID NO: 3433510 - DNA, 21 bp, Homo sapiens
catcttgaccaagcaggaagc

SEQ ID NO: 3433511 - DNA, 24 bp, Homo sapiens
catcttgaccaagcaggaagctca

SEQ ID NO: 3433512 - DNA, 19 bp, Homo sapiens
catcttgccaagggtccct

SEQ ID NO: 3433513 - DNA, 14 bp, Homo sapiens
catcttgctctgct

SEQ ID NO: 3433514 - DNA, 16 bp, Homo sapiens
catcttgctctgctga

SEQ ID NO: 3433515 - DNA, 19 bp, Homo sapiens
catcttgctctgctgacag

SEQ ID NO: 3433516 - DNA, 15 bp, Homo sapiens
catcttgcttcccta

SEQ ID NO: 3433517 - DNA, 11 bp, Homo sapiens
catcttggggg

SEQ ID NO: 3433518 - DNA, 12 bp, Homo sapiens
catctttcacat

SEQ ID NO: 3433519 - DNA, 13 bp, Homo sapiens
catctttcacatt

SEQ ID NO: 3433520 - DNA, 11 bp, Homo sapiens
catctttctct

SEQ ID NO: 3433521 - DNA, 19 bp, Homo sapiens
catcttttattttggaact

SEQ ID NO: 3433522 - DNA, 14 bp, Homo sapiens
catcttttcttgcc

SEQ ID NO: 3433523 - DNA, 15 bp, Homo sapiens
catgaaactccacct

SEQ ID NO: 3433524 - DNA, 24 bp, Homo sapiens
catgaaagtagacagttttgagaa

SEQ ID NO: 3433525 - DNA, 13 bp, Homo sapiens
catgaaatatgca

SEQ ID NO: 3433526 - DNA, 14 bp, Homo sapiens
catgaaatatgcat

SEQ ID NO: 3433527 - DNA, 15 bp, Homo sapiens
catgaaatatgcatc

SEQ ID NO: 3433528 - DNA, 18 bp, Homo sapiens
catgaagattctttccca

SEQ ID NO: 3433529 - DNA, 15 bp, Homo sapiens
catgaatctgcaatg

SEQ ID NO: 3433530 - DNA, 17 bp, Homo sapiens
catgaatgaacccctgg

SEQ ID NO: 3433531 - DNA, 21 bp, Homo sapiens
catgaatgaacccctggctcc

SEQ ID NO: 3433532 - DNA, 18 bp, Homo sapiens
catgaatttattgcacat

SEQ ID NO: 3433533 - DNA, 14 bp, Homo sapiens
catgacaaaaatta

SEQ ID NO: 3433534 - DNA, 14 bp, Homo sapiens
catgacagccagag

SEQ ID NO: 3433535 - DNA, 15 bp, Homo sapiens
catgacagccagagc

SEQ ID NO: 3433536 - DNA, 16 bp, Homo sapiens
catgacagccagagcc

SEQ ID NO: 3433537 - DNA, 14 bp, Homo sapiens
catgacagcctgca

SEQ ID NO: 3433538 - DNA, 16 bp, Homo sapiens
catgacccaggctggg

SEQ ID NO: 3433539 - DNA, 18 bp, Homo sapiens
catgaccttatccttcct

SEQ ID NO: 3433540 - DNA, 14 bp, Homo sapiens
catgactatggata

SEQ ID NO: 3433541 - DNA, 13 bp, Homo sapiens
catgagaaataca

SEQ ID NO: 3433542 - DNA, 23 bp, Homo sapiens
catgagcctcagcatcctggcac

SEQ ID NO: 3433543 - DNA, 12 bp, Homo sapiens
catgagcctgct

SEQ ID NO: 3433544 - DNA, 22 bp, Homo sapiens
catgagcctgctggaagcccag

SEQ ID NO: 3433545 - DNA, 15 bp, Homo sapiens
catgaggggagagga

SEQ ID NO: 3433546 - DNA, 18 bp, Homo sapiens
catgagtgcgtgctcagt

SEQ ID NO: 3433547 - DNA, 17 bp, Homo sapiens
catgatactcatttctt

SEQ ID NO: 3433548 - DNA, 18 bp, Homo sapiens
catgatgcttttactgaa

SEQ ID NO: 3433549 - DNA, 19 bp, Homo sapiens
catgatggcaacagatctg

SEQ ID NO: 3433550 - DNA, 13 bp, Homo sapiens
catgatgttaact

SEQ ID NO: 3433551 - DNA, 14 bp, Homo sapiens
catgatgttaactt

SEQ ID NO: 3433552 - DNA, 12 bp, Homo sapiens
catgatgtttgc

SEQ ID NO: 3433553 - DNA, 19 bp, Homo sapiens
catgattccttcctgttct

SEQ ID NO: 3433554 - DNA, 17 bp, Homo sapiens
catgatttccttgaatg

SEQ ID NO: 3433555 - DNA, 18 bp, Homo sapiens
catgatttccttgaatgt

SEQ ID NO: 3433556 - DNA, 14 bp, Homo sapiens
catgcaaaggctgg

SEQ ID NO: 3433557 - DNA, 16 bp, Homo sapiens
catgcaaaggctggga

SEQ ID NO: 3433558 - DNA, 16 bp, Homo sapiens
catgcaaatgctgtat

SEQ ID NO: 3433559 - DNA, 22 bp, Homo sapiens
catgcacaagatgccccaggga

SEQ ID NO: 3433560 - DNA, 20 bp, Homo sapiens
catgcaccaggactggctgt

SEQ ID NO: 3433561 - DNA, 23 bp, Homo sapiens
catgcactgttccccctgtgcag

SEQ ID NO: 3433562 - DNA, 12 bp, Homo sapiens
catgcagtttga

SEQ ID NO: 3433563 - DNA, 13 bp, Homo sapiens
catgcagtttgaa

SEQ ID NO: 3433564 - DNA, 17 bp, Homo sapiens
catgcagtttgaaattc

SEQ ID NO: 3433565 - DNA, 13 bp, Homo sapiens
catgcatctgttt

SEQ ID NO: 3433566 - DNA, 15 bp, Homo sapiens
catgcatctgtttat

SEQ ID NO: 3433567 - DNA, 22 bp, Homo sapiens
catgcatctgtttattctatag

SEQ ID NO: 3433568 - DNA, 17 bp, Homo sapiens
catgccacaaggacttc

SEQ ID NO: 3433569 - DNA, 20 bp, Homo sapiens
catgccagcttatctcaggg

SEQ ID NO: 3433570 - DNA, 16 bp, Homo sapiens
catgcccctggctggg

SEQ ID NO: 3433571 - DNA, 17 bp, Homo sapiens
catgccctcctctccca

SEQ ID NO: 3433572 - DNA, 14 bp, Homo sapiens
catgccctgtgcaa

SEQ ID NO: 3433573 - DNA, 19 bp, Homo sapiens
catgccctgtgcaacctct

SEQ ID NO: 3433574 - DNA, 16 bp, Homo sapiens
catgcctcagccctga

SEQ ID NO: 3433575 - DNA, 19 bp, Homo sapiens
catgcctcagccctgaccc

SEQ ID NO: 3433576 - DNA, 13 bp, Homo sapiens
catgcctggcttc

SEQ ID NO: 3433577 - DNA, 12 bp, Homo sapiens
catgcctgtcct

SEQ ID NO: 3433578 - DNA, 16 bp, Homo sapiens
catgcctgtcctgaaa

SEQ ID NO: 3433579 - DNA, 18 bp, Homo sapiens
catgcctgtcctgaaagc

SEQ ID NO: 3433580 - DNA, 22 bp, Homo sapiens
catgcctgtcctgaaagcggct

SEQ ID NO: 3433581 - DNA, 23 bp, Homo sapiens
catgcctgtcctgaaagcggctg

SEQ ID NO: 3433582 - DNA, 23 bp, Homo sapiens
catgcgccccctccgccctgcca

SEQ ID NO: 3433583 - DNA, 15 bp, Homo sapiens
catgcgctcagggcc

SEQ ID NO: 3433584 - DNA, 23 bp, Homo sapiens
catgcgctcagggccatgctgag

SEQ ID NO: 3433585 - DNA, 16 bp, Homo sapiens
catgcggagaacaaat

SEQ ID NO: 3433586 - DNA, 23 bp, Homo sapiens
catgcggagaacaaatgtgaagg

SEQ ID NO: 3433587 - DNA, 15 bp, Homo sapiens
catgcggtagccagc

SEQ ID NO: 3433588 - DNA, 12 bp, Homo sapiens
catgctatgttc

SEQ ID NO: 3433589 - DNA, 18 bp, Homo sapiens
catgctatgttctgtctt

SEQ ID NO: 3433590 - DNA, 19 bp, Homo sapiens
catgctcatctgctggtcc

SEQ ID NO: 3433591 - DNA, 21 bp, Homo sapiens
catgctcttgaccttgtagag

SEQ ID NO: 3433592 - DNA, 15 bp, Homo sapiens
catgctgaagccaaa

SEQ ID NO: 3433593 - DNA, 20 bp, Homo sapiens
catgctgaagccaaagccaa

SEQ ID NO: 3433594 - DNA, 15 bp, Homo sapiens
catgctgaggcctgg

SEQ ID NO: 3433595 - DNA, 19 bp, Homo sapiens
catgctgctggacagtatc

SEQ ID NO: 3433596 - DNA, 18 bp, Homo sapiens
catgctggaacctgcaaa

SEQ ID NO: 3433597 - DNA, 23 bp, Homo sapiens
catgctggaacctgcaaaaaata

SEQ ID NO: 3433598 - DNA, 22 bp, Homo sapiens
catgcttcaatagttcaaggaa

SEQ ID NO: 3433599 - DNA, 11 bp, Homo sapiens
catggaaaaaa

SEQ ID NO: 3433600 - DNA, 14 bp, Homo sapiens
catggaaagactgg

SEQ ID NO: 3433601 - DNA, 16 bp, Homo sapiens
catggacaggctggct

SEQ ID NO: 3433602 - DNA, 14 bp, Homo sapiens
catggaccaagaat

SEQ ID NO: 3433603 - DNA, 14 bp, Homo sapiens
catggagagctgga

SEQ ID NO: 3433604 - DNA, 18 bp, Homo sapiens
catggaggcactgaagcc

SEQ ID NO: 3433605 - DNA, 18 bp, Homo sapiens
catggcatcacctccacc

SEQ ID NO: 3433606 - DNA, 19 bp, Homo sapiens
catggcatcacctccacca

SEQ ID NO: 3433607 - DNA, 15 bp, Homo sapiens
catggcccctgtgag

SEQ ID NO: 3433608 - DNA, 15 bp, Homo sapiens
catggccctcattaa

SEQ ID NO: 3433609 - DNA, 22 bp, Homo sapiens
catggccctcattaatgacact

SEQ ID NO: 3433610 - DNA, 22 bp, Homo sapiens
catggccctgtagttaggcctg

SEQ ID NO: 3433611 - DNA, 16 bp, Homo sapiens
catggcctctgcaact

SEQ ID NO: 3433612 - DNA, 20 bp, Homo sapiens
catggcctcttgaagagaaa

SEQ ID NO: 3433613 - DNA, 23 bp, Homo sapiens
catggcctcttgaagagaaaaaa

SEQ ID NO: 3433614 - DNA, 12 bp, Homo sapiens
catggctctatt

SEQ ID NO: 3433615 - DNA, 13 bp, Homo sapiens
catgggaagggga

SEQ ID NO: 3433616 - DNA, 17 bp, Homo sapiens
catgggaccacaactat

SEQ ID NO: 3433617 - DNA, 22 bp, Homo sapiens
catgggagccgggtctgcctct

SEQ ID NO: 3433618 - DNA, 23 bp, Homo sapiens
catggggagggattctggttcca

SEQ ID NO: 3433619 - DNA, 17 bp, Homo sapiens
catgggggaccccttcc

SEQ ID NO: 3433620 - DNA, 18 bp, Homo sapiens
catgggggaccccttccc

SEQ ID NO: 3433621 - DNA, 16 bp, Homo sapiens
catggtcagccctagg

SEQ ID NO: 3433622 - DNA, 19 bp, Homo sapiens
catggtcagccctagggtg

SEQ ID NO: 3433623 - DNA, 17 bp, Homo sapiens
catggtgaaaagctcca

SEQ ID NO: 3433624 - DNA, 22 bp, Homo sapiens
catggtgccccaggaccagctc

SEQ ID NO: 3433625 - DNA, 16 bp, Homo sapiens
catggtggacccagcg

SEQ ID NO: 3433626 - DNA, 21 bp, Homo sapiens
catggtgggtccatgggcaga

SEQ ID NO: 3433627 - DNA, 18 bp, Homo sapiens
catggtgtgatcgtctga

SEQ ID NO: 3433628 - DNA, 14 bp, Homo sapiens
catggtgtgttaca

SEQ ID NO: 3433629 - DNA, 15 bp, Homo sapiens
catggtgtgttacac

SEQ ID NO: 3433630 - DNA, 22 bp, Homo sapiens
catgtaaccggcatgtttccag

SEQ ID NO: 3433631 - DNA, 19 bp, Homo sapiens
catgtaactatttcttcag

SEQ ID NO: 3433632 - DNA, 19 bp, Homo sapiens
catgtaatgttaatgttat

SEQ ID NO: 3433633 - DNA, 13 bp, Homo sapiens
ccacgctggagtg

SEQ ID NO: 3433634 - DNA, 16 bp, Homo sapiens
ccacgctggagtgcag

SEQ ID NO: 3433635 - DNA, 19 bp, Homo sapiens
ccacgctggagtgcagtga

SEQ ID NO: 3433636 - DNA, 14 bp, Homo sapiens
ccacggccaggcca

SEQ ID NO: 3433637 - DNA, 15 bp, Homo sapiens
ccacggccaggccag

SEQ ID NO: 3433638 - DNA, 18 bp, Homo sapiens
ccacgtggctgcgtgccc

SEQ ID NO: 3433639 - DNA, 20 bp, Homo sapiens
ccacgttggagaagcccgtg

SEQ ID NO: 3433640 - DNA, 20 bp, Homo sapiens
ccactaagaacccctctgct

SEQ ID NO: 3433641 - DNA, 21 bp, Homo sapiens
ccactaagaacccctctgctt

SEQ ID NO: 3433642 - DNA, 18 bp, Homo sapiens
ccactaagcagaggaggg

SEQ ID NO: 3433643 - DNA, 21 bp, Homo sapiens
ccactaagcagaggaggggcc

SEQ ID NO: 3433644 - DNA, 22 bp, Homo sapiens
ccactacggaatagttggctag

SEQ ID NO: 3433645 - DNA, 20 bp, Homo sapiens
ccactataaaatgtcttcaa

SEQ ID NO: 3433646 - DNA, 18 bp, Homo sapiens
ccactcaagccaagcagc

SEQ ID NO: 3433647 - DNA, 14 bp, Homo sapiens
ccactccagtcctg

SEQ ID NO: 3433648 - DNA, 15 bp, Homo sapiens
ccactccagtcctgc

SEQ ID NO: 3433649 - DNA, 17 bp, Homo sapiens
ccactccagtcctgcca

SEQ ID NO: 3433650 - DNA, 19 bp, Homo sapiens
ccactccagtcctgccacc

SEQ ID NO: 3433651 - DNA, 16 bp, Homo sapiens
ccactccgagaggtgg

SEQ ID NO: 3433652 - DNA, 12 bp, Homo sapiens
ccactcctctga

SEQ ID NO: 3433653 - DNA, 17 bp, Homo sapiens
ccactccttctctcact

SEQ ID NO: 3433654 - DNA, 20 bp, Homo sapiens
ccactctcccccaccccctc

SEQ ID NO: 3433655 - DNA, 14 bp, Homo sapiens
ccactctgcctgcc

SEQ ID NO: 3433656 - DNA, 15 bp, Homo sapiens
ccactctgcctgcct

SEQ ID NO: 3433657 - DNA, 21 bp, Homo sapiens
ccactctgctcgccttagcac

SEQ ID NO: 3433658 - DNA, 14 bp, Homo sapiens
ccactctgcttctc

SEQ ID NO: 3433659 - DNA, 18 bp, Homo sapiens
ccactcttcctttctcct

SEQ ID NO: 3433660 - DNA, 14 bp, Homo sapiens
ccactgaaatctgt

SEQ ID NO: 3433661 - DNA, 17 bp, Homo sapiens
ccactgacagcctccca

SEQ ID NO: 3433662 - DNA, 13 bp, Homo sapiens
ccactgagggcag

SEQ ID NO: 3433663 - DNA, 15 bp, Homo sapiens
ccactgatttagcca

SEQ ID NO: 3433664 - DNA, 17 bp, Homo sapiens
ccactgcaccgggccac

SEQ ID NO: 3433665 - DNA, 20 bp, Homo sapiens
ccactgcactatagcctagg

SEQ ID NO: 3433666 - DNA, 19 bp, Homo sapiens
ccactgcactccagcctgg

SEQ ID NO: 3433667 - DNA, 21 bp, Homo sapiens
ccactgcatcgtttcatcttc

SEQ ID NO: 3433668 - DNA, 23 bp, Homo sapiens
ccactgcatcgtttcatcttcca

SEQ ID NO: 3433669 - DNA, 15 bp, Homo sapiens
ccactgccactccag

SEQ ID NO: 3433670 - DNA, 12 bp, Homo sapiens
ccactgccttcg

SEQ ID NO: 3433671 - DNA, 18 bp, Homo sapiens
ccactgccttcgcttctt

SEQ ID NO: 3433672 - DNA, 15 bp, Homo sapiens
ccactgctctcagcc

SEQ ID NO: 3433673 - DNA, 22 bp, Homo sapiens
ccactgcttttggtctgtgtga

SEQ ID NO: 3433674 - DNA, 13 bp, Homo sapiens
ccactggactgac

SEQ ID NO: 3433675 - DNA, 22 bp, Homo sapiens
ccactggggtccagggagcagg

SEQ ID NO: 3433676 - DNA, 15 bp, Homo sapiens
ccactgtcctgggcc

SEQ ID NO: 3433677 - DNA, 15 bp, Homo sapiens
ccactgtgaagagaa

SEQ ID NO: 3433678 - DNA, 13 bp, Homo sapiens
ccacttaaaatgt

SEQ ID NO: 3433679 - DNA, 18 bp, Homo sapiens
ccacttctggtcaatcaa

SEQ ID NO: 3433680 - DNA, 13 bp, Homo sapiens
ccacttctgtcca

SEQ ID NO: 3433681 - DNA, 17 bp, Homo sapiens
ccacttctgtccatatt

SEQ ID NO: 3433682 - DNA, 19 bp, Homo sapiens
ccacttgcctcttccttga

SEQ ID NO: 3433683 - DNA, 13 bp, Homo sapiens
ccactttttgcag

SEQ ID NO: 3433684 - DNA, 14 bp, Homo sapiens
ccactttttgcagc

SEQ ID NO: 3433685 - DNA, 13 bp, Homo sapiens
ccagaaaacaaaa

SEQ ID NO: 3433686 - DNA, 24 bp, Homo sapiens
ccagaaactgttcccacctgctgg

SEQ ID NO: 3433687 - DNA, 19 bp, Homo sapiens
ccagaacacactccatcag

SEQ ID NO: 3433688 - DNA, 20 bp, Homo sapiens
ccagaacacggctcacgctt

SEQ ID NO: 3433689 - DNA, 13 bp, Homo sapiens
ccagaacagtatg

SEQ ID NO: 3433690 - DNA, 20 bp, Homo sapiens
ccagaagcagagagcacagc

SEQ ID NO: 3433691 - DNA, 14 bp, Homo sapiens
ccagaaggagacag

SEQ ID NO: 3433692 - DNA, 22 bp, Homo sapiens
ccagaagtttgagatcagcctg

SEQ ID NO: 3433693 - DNA, 14 bp, Homo sapiens
ccagaatctcatta

SEQ ID NO: 3433694 - DNA, 17 bp, Homo sapiens
ccagaatgctgtacatc

SEQ ID NO: 3433695 - DNA, 15 bp, Homo sapiens
ccagacacaggccct

SEQ ID NO: 3433696 - DNA, 19 bp, Homo sapiens
ccagacaccttgacagggc

SEQ ID NO: 3433697 - DNA, 17 bp, Homo sapiens
ccagacagaccttcaca

SEQ ID NO: 3433698 - DNA, 23 bp, Homo sapiens
ccagacagaccttcacagatgcc

SEQ ID NO: 3433699 - DNA, 17 bp, Homo sapiens
ccagacccggctgcgtg

SEQ ID NO: 3433700 - DNA, 21 bp, Homo sapiens
ccagaccctgaagatttcaga

SEQ ID NO: 3433701 - DNA, 23 bp, Homo sapiens
ccagacctgatcctggaggccca

SEQ ID NO: 3433702 - DNA, 24 bp, Homo sapiens
ccagacctgatcctggaggcccag

SEQ ID NO: 3433703 - DNA, 20 bp, Homo sapiens
ccagacctgttagcagacag

SEQ ID NO: 3433704 - DNA, 23 bp, Homo sapiens
ccagacctgttagcagacaggcc

SEQ ID NO: 3433705 - DNA, 15 bp, Homo sapiens
ccagacggctccact

SEQ ID NO: 3433706 - DNA, 20 bp, Homo sapiens
ccagacggctccactaggac

SEQ ID NO: 3433707 - DNA, 19 bp, Homo sapiens
ccagactccgcctgaggcc

SEQ ID NO: 3433708 - DNA, 18 bp, Homo sapiens
ccagactgtctccacggc

SEQ ID NO: 3433709 - DNA, 13 bp, Homo sapiens
ccagacttccttg

SEQ ID NO: 3433710 - DNA, 14 bp, Homo sapiens
ccagacttccttga

SEQ ID NO: 3433711 - DNA, 15 bp, Homo sapiens
ccagacttccttgag

SEQ ID NO: 3433712 - DNA, 12 bp, Homo sapiens
ccagagaagcta

SEQ ID NO: 3433713 - DNA, 18 bp, Homo sapiens
ccagagaagtctggtcag

SEQ ID NO: 3433714 - DNA, 21 bp, Homo sapiens
ccagagaagtctggtcagagc

SEQ ID NO: 3433715 - DNA, 23 bp, Homo sapiens
ccagagaagtctggtcagagcca

SEQ ID NO: 3433716 - DNA, 18 bp, Homo sapiens
ccagagacatacttgaag

SEQ ID NO: 3433717 - DNA, 23 bp, Homo sapiens
ccagagacatacttgaagggcca

SEQ ID NO: 3433718 - DNA, 21 bp, Homo sapiens
ccagagagggtggtgacctct

SEQ ID NO: 3433719 - DNA, 20 bp, Homo sapiens
ccagagatccaaaagaagcc

SEQ ID NO: 3433720 - DNA, 17 bp, Homo sapiens
ccagagattcattttct

SEQ ID NO: 3433721 - DNA, 23 bp, Homo sapiens
ccagagcacccagatcagactct

SEQ ID NO: 3433722 - DNA, 12 bp, Homo sapiens
ccagagcagggg

SEQ ID NO: 3433723 - DNA, 22 bp, Homo sapiens
ccagagccaggggggtgaggag

SEQ ID NO: 3433724 - DNA, 11 bp, Homo sapiens
ccagagcccag

SEQ ID NO: 3433725 - DNA, 12 bp, Homo sapiens
ccagagcccagc

SEQ ID NO: 3433726 - DNA, 14 bp, Homo sapiens
ccagagcccagctc

SEQ ID NO: 3433727 - DNA, 15 bp, Homo sapiens
ccagagcccagctcc

SEQ ID NO: 3433728 - DNA, 17 bp, Homo sapiens
ccagagcccagctccaa

SEQ ID NO: 3433729 - DNA, 12 bp, Homo sapiens
ccagaggaagcc

SEQ ID NO: 3433730 - DNA, 17 bp, Homo sapiens
ccagaggaaggggccag

SEQ ID NO: 3433731 - DNA, 20 bp, Homo sapiens
ccagaggactgtgatgccct

SEQ ID NO: 3433732 - DNA, 22 bp, Homo sapiens
ccagaggactgtgatgccctgc

SEQ ID NO: 3433733 - DNA, 16 bp, Homo sapiens
ccagaggctgggttca

SEQ ID NO: 3433734 - DNA, 16 bp, Homo sapiens
ccagagggagtgacag

SEQ ID NO: 3433735 - DNA, 17 bp, Homo sapiens
ccagagggagtgacaga

SEQ ID NO: 3433736 - DNA, 12 bp, Homo sapiens
ccagaggtgctt

SEQ ID NO: 3433737 - DNA, 16 bp, Homo sapiens
ccagataactgaggag

SEQ ID NO: 3433738 - DNA, 20 bp, Homo sapiens
ccagatcatgttttggtgaa

SEQ ID NO: 3433739 - DNA, 18 bp, Homo sapiens
ccagatcccaggcccctg

SEQ ID NO: 3433740 - DNA, 22 bp, Homo sapiens
ccagatcccaggcccctggagg

SEQ ID NO: 3433741 - DNA, 15 bp, Homo sapiens
ccagatcctcttctc

SEQ ID NO: 3433742 - DNA, 23 bp, Homo sapiens
ccagatctacttggttgtcaagt

SEQ ID NO: 3433743 - DNA, 14 bp, Homo sapiens
ccagatgcaccagc

SEQ ID NO: 3433744 - DNA, 15 bp, Homo sapiens
ccagatgcaccagcc

SEQ ID NO: 3433745 - DNA, 17 bp, Homo sapiens
ccagatgcaccagccct

SEQ ID NO: 3433746 - DNA, 18 bp, Homo sapiens
ccagatgcaccagccctt

SEQ ID NO: 3433747 - DNA, 15 bp, Homo sapiens
ccagatgcagggcag

SEQ ID NO: 3433748 - DNA, 18 bp, Homo sapiens
ccagatgcagggcagtca

SEQ ID NO: 3433749 - DNA, 18 bp, Homo sapiens
ccagattcccctgtgtca

SEQ ID NO: 3433750 - DNA, 16 bp, Homo sapiens
ccagattgcaacaggc

SEQ ID NO: 3433751 - DNA, 19 bp, Homo sapiens
ccagattgcaacaggctgg

SEQ ID NO: 3433752 - DNA, 21 bp, Homo sapiens
ccagattgcaacaggctgggc

SEQ ID NO: 3433753 - DNA, 23 bp, Homo sapiens
ccagattgcaacaggctgggctt

SEQ ID NO: 3433754 - DNA, 19 bp, Homo sapiens
ccagattggctcacactga

SEQ ID NO: 3433755 - DNA, 21 bp, Homo sapiens
ccagattggctcacactgaga

SEQ ID NO: 3433756 - DNA, 12 bp, Homo sapiens
ccagatttgtct

SEQ ID NO: 3433757 - DNA, 16 bp, Homo sapiens
ccagcaagtgagagct

SEQ ID NO: 3433758 - DNA, 17 bp, Homo sapiens
ccagcaagtgagagctg

SEQ ID NO: 3433759 - DNA, 14 bp, Homo sapiens
ccagcacccaaagg

SEQ ID NO: 3433760 - DNA, 17 bp, Homo sapiens
ccagcacccaaagggtt

SEQ ID NO: 3433761 - DNA, 15 bp, Homo sapiens
ccagcacctggcatc

SEQ ID NO: 3433762 - DNA, 20 bp, Homo sapiens
ccagcactatgctttccttc

SEQ ID NO: 3433763 - DNA, 13 bp, Homo sapiens
ccagcactgagga

SEQ ID NO: 3433764 - DNA, 12 bp, Homo sapiens
ccagcactgctt

SEQ ID NO: 3433765 - DNA, 18 bp, Homo sapiens
ccatgtaaataatctgtg

SEQ ID NO: 3433766 - DNA, 15 bp, Homo sapiens
ccatgtagaagctgc

SEQ ID NO: 3433767 - DNA, 18 bp, Homo sapiens
ccatgtagaagctgcatc

SEQ ID NO: 3433768 - DNA, 17 bp, Homo sapiens
ccatgtcagcaaaaagc

SEQ ID NO: 3433769 - DNA, 22 bp, Homo sapiens
ccatgtgactctggcttggcct

SEQ ID NO: 3433770 - DNA, 18 bp, Homo sapiens
ccatgttggccaggctgg

SEQ ID NO: 3433771 - DNA, 19 bp, Homo sapiens
ccattagctttcaattccg

SEQ ID NO: 3433772 - DNA, 14 bp, Homo sapiens
ccattattctatgt

SEQ ID NO: 3433773 - DNA, 17 bp, Homo sapiens
ccattcccaagatgcct

SEQ ID NO: 3433774 - DNA, 15 bp, Homo sapiens
ccattcccttcggcc

SEQ ID NO: 3433775 - DNA, 15 bp, Homo sapiens
ccattctccacagca

SEQ ID NO: 3433776 - DNA, 14 bp, Homo sapiens
ccattctgcattta

SEQ ID NO: 3433777 - DNA, 16 bp, Homo sapiens
ccattctgcatttagc

SEQ ID NO: 3433778 - DNA, 15 bp, Homo sapiens
ccattctgcctgccc

SEQ ID NO: 3433779 - DNA, 17 bp, Homo sapiens
ccattctgcctgcccag

SEQ ID NO: 3433780 - DNA, 20 bp, Homo sapiens
ccattctgcctgcccaggcc

SEQ ID NO: 3433781 - DNA, 22 bp, Homo sapiens
ccattctggattttgtcaagca

SEQ ID NO: 3433782 - DNA, 21 bp, Homo sapiens
ccattctttataatcctctgt

SEQ ID NO: 3433783 - DNA, 13 bp, Homo sapiens
ccattctttctga

SEQ ID NO: 3433784 - DNA, 15 bp, Homo sapiens
ccattcttttgtaat

SEQ ID NO: 3433785 - DNA, 13 bp, Homo sapiens
ccattgaattctt

SEQ ID NO: 3433786 - DNA, 16 bp, Homo sapiens
ccattgcacccagccc

SEQ ID NO: 3433787 - DNA, 20 bp, Homo sapiens
ccattgcactccagcctggg

SEQ ID NO: 3433788 - DNA, 18 bp, Homo sapiens
ccattgtctcttcatgtc

SEQ ID NO: 3433789 - DNA, 20 bp, Homo sapiens
ccattgtttaaaaatacaca

SEQ ID NO: 3433790 - DNA, 20 bp, Homo sapiens
ccatttatatatctaagttc

SEQ ID NO: 3433791 - DNA, 15 bp, Homo sapiens
ccatttccagttcat

SEQ ID NO: 3433792 - DNA, 19 bp, Homo sapiens
ccatttcctcagcttatct

SEQ ID NO: 3433793 - DNA, 22 bp, Homo sapiens
ccatttcgtgagccccatcttc

SEQ ID NO: 3433794 - DNA, 20 bp, Homo sapiens
ccattttaagtccctgtcac

SEQ ID NO: 3433795 - DNA, 18 bp, Homo sapiens
ccatttttcaaagcaatt

SEQ ID NO: 3433796 - DNA, 21 bp, Homo sapiens
ccattttttaaaaaagcaagg

SEQ ID NO: 3433797 - DNA, 13 bp, Homo sapiens
cccaaaaaagaac

SEQ ID NO: 3433798 - DNA, 13 bp, Homo sapiens
cccaaaagactcc

SEQ ID NO: 3433799 - DNA, 21 bp, Homo sapiens
cccaaaattagggagctcttg

SEQ ID NO: 3433800 - DNA, 17 bp, Homo sapiens
cccaaacaaatatgcaa

SEQ ID NO: 3433801 - DNA, 15 bp, Homo sapiens
cccaaacccatggct

SEQ ID NO: 3433802 - DNA, 22 bp, Homo sapiens
cccaaacccatggctctatttc

SEQ ID NO: 3433803 - DNA, 12 bp, Homo sapiens
cccaaactgtga

SEQ ID NO: 3433804 - DNA, 14 bp, Homo sapiens
cccaaatgagccat

SEQ ID NO: 3433805 - DNA, 19 bp, Homo sapiens
cccaaatgctctctcttct

SEQ ID NO: 3433806 - DNA, 14 bp, Homo sapiens
cccaacatataaaa

SEQ ID NO: 3433807 - DNA, 17 bp, Homo sapiens
cccaacccttccctcac

SEQ ID NO: 3433808 - DNA, 15 bp, Homo sapiens
cccaactctagctgg

SEQ ID NO: 3433809 - DNA, 20 bp, Homo sapiens
cccaactctcccctgacctg

SEQ ID NO: 3433810 - DNA, 11 bp, Homo sapiens
cccaactgtct

SEQ ID NO: 3433811 - DNA, 13 bp, Homo sapiens
cccaactgtcttt

SEQ ID NO: 3433812 - DNA, 16 bp, Homo sapiens
cccaactgtgtagcat

SEQ ID NO: 3433813 - DNA, 17 bp, Homo sapiens
cccaagatgcctgatca

SEQ ID NO: 3433814 - DNA, 14 bp, Homo sapiens
cccaagccagaggc

SEQ ID NO: 3433815 - DNA, 12 bp, Homo sapiens
cccaagctcaga

SEQ ID NO: 3433816 - DNA, 12 bp, Homo sapiens
cccaagctctgc

SEQ ID NO: 3433817 - DNA, 19 bp, Homo sapiens
cccaagtatacaataaagt

SEQ ID NO: 3433818 - DNA, 12 bp, Homo sapiens
cccaatagctgc

SEQ ID NO: 3433819 - DNA, 16 bp, Homo sapiens
cccaatgtaggagctg

SEQ ID NO: 3433820 - DNA, 23 bp, Homo sapiens
cccacaagtggtggtaaccctgg

SEQ ID NO: 3433821 - DNA, 13 bp, Homo sapiens
cccacacacagat

SEQ ID NO: 3433822 - DNA, 14 bp, Homo sapiens
cccacagaactgct

SEQ ID NO: 3433823 - DNA, 13 bp, Homo sapiens
cccacaggatcag

SEQ ID NO: 3433824 - DNA, 17 bp, Homo sapiens
cccacaggatcagtctg

SEQ ID NO: 3433825 - DNA, 16 bp, Homo sapiens
cccaccagcctaagaa

SEQ ID NO: 3433826 - DNA, 20 bp, Homo sapiens
cccaccagcctaagaagctc

SEQ ID NO: 3433827 - DNA, 17 bp, Homo sapiens
cccaccccaggccctgc

SEQ ID NO: 3433828 - DNA, 12 bp, Homo sapiens
cccacccccatc

SEQ ID NO: 3433829 - DNA, 12 bp, Homo sapiens
cccacccctggg

SEQ ID NO: 3433830 - DNA, 15 bp, Homo sapiens
cccaccctgctgctg

SEQ ID NO: 3433831 - DNA, 14 bp, Homo sapiens
cccaccctgggacc

SEQ ID NO: 3433832 - DNA, 14 bp, Homo sapiens
cccaccctgggccc

SEQ ID NO: 3433833 - DNA, 12 bp, Homo sapiens
cccacctcagcc

SEQ ID NO: 3433834 - DNA, 15 bp, Homo sapiens
cccaccttggctcaa

SEQ ID NO: 3433835 - DNA, 14 bp, Homo sapiens
cccaccttggctgc

SEQ ID NO: 3433836 - DNA, 18 bp, Homo sapiens
cccacgaaactgccctgg

SEQ ID NO: 3433837 - DNA, 13 bp, Homo sapiens
cccacgagggctg

SEQ ID NO: 3433838 - DNA, 20 bp, Homo sapiens
cccactcaagccaagcagcc

SEQ ID NO: 3433839 - DNA, 18 bp, Homo sapiens
cccactcagctccgtgaa

SEQ ID NO: 3433840 - DNA, 16 bp, Homo sapiens
cccactgacagcctcc

SEQ ID NO: 3433841 - DNA, 13 bp, Homo sapiens
cccactgctctgg

SEQ ID NO: 3433842 - DNA, 19 bp, Homo sapiens
cccactgggaccaaccctg

SEQ ID NO: 3433843 - DNA, 19 bp, Homo sapiens
cccactgtatctaggcaac

SEQ ID NO: 3433844 - DNA, 14 bp, Homo sapiens
cccacttgcctctt

SEQ ID NO: 3433845 - DNA, 21 bp, Homo sapiens
cccacttgcctcttccttgaa

SEQ ID NO: 3433846 - DNA, 16 bp, Homo sapiens
cccactttcttctacc

SEQ ID NO: 3433847 - DNA, 13 bp, Homo sapiens
cccagaccggctt

SEQ ID NO: 3433848 - DNA, 21 bp, Homo sapiens
cccagacctgttagcagacag

SEQ ID NO: 3433849 - DNA, 21 bp, Homo sapiens
cccagacggctccactaggac

SEQ ID NO: 3433850 - DNA, 16 bp, Homo sapiens
cccagactcagacatt

SEQ ID NO: 3433851 - DNA, 20 bp, Homo sapiens
cccagactcagacattggca

SEQ ID NO: 3433852 - DNA, 21 bp, Homo sapiens
cccagactgtctccacggcct

SEQ ID NO: 3433853 - DNA, 13 bp, Homo sapiens
cccagagcccagc

SEQ ID NO: 3433854 - DNA, 17 bp, Homo sapiens
cccagagcccagctcca

SEQ ID NO: 3433855 - DNA, 20 bp, Homo sapiens
cccagagctggtggacccag

SEQ ID NO: 3433856 - DNA, 23 bp, Homo sapiens
cccagagctggtggacccaggga

SEQ ID NO: 3433857 - DNA, 21 bp, Homo sapiens
cccagaggaaggggccagagg

SEQ ID NO: 3433858 - DNA, 12 bp, Homo sapiens
cccagatctcat

SEQ ID NO: 3433859 - DNA, 22 bp, Homo sapiens
cccagattgcaacaggctgggc

SEQ ID NO: 3433860 - DNA, 17 bp, Homo sapiens
cccagattggctcacac

SEQ ID NO: 3433861 - DNA, 19 bp, Homo sapiens
cccagattggctcacactg

SEQ ID NO: 3433862 - DNA, 16 bp, Homo sapiens
cccagcaagtgagagc

SEQ ID NO: 3433863 - DNA, 23 bp, Homo sapiens
cccagcaagtgagagctgggtgt

SEQ ID NO: 3433864 - DNA, 14 bp, Homo sapiens
cccagcactgagga

SEQ ID NO: 3433865 - DNA, 15 bp, Homo sapiens
cccagcactgaggaa

SEQ ID NO: 3433866 - DNA, 21 bp, Homo sapiens
cccagcactgcttgaggaaaa

SEQ ID NO: 3433867 - DNA, 15 bp, Homo sapiens
cccagcactttggga

SEQ ID NO: 3433868 - DNA, 14 bp, Homo sapiens
cccagcagaaccag

SEQ ID NO: 3433869 - DNA, 17 bp, Homo sapiens
cccagcattctcaggca

SEQ ID NO: 3433870 - DNA, 19 bp, Homo sapiens
cccagcattctcaggcacc

SEQ ID NO: 3433871 - DNA, 20 bp, Homo sapiens
cccagcattttactgattca

SEQ ID NO: 3433872 - DNA, 16 bp, Homo sapiens
cccagcccagagacat

SEQ ID NO: 3433873 - DNA, 20 bp, Homo sapiens
cccagccccggtggctgggc

SEQ ID NO: 3433874 - DNA, 15 bp, Homo sapiens
cccagcccctactgc

SEQ ID NO: 3433875 - DNA, 16 bp, Homo sapiens
cccagccctcatcccg

SEQ ID NO: 3433876 - DNA, 15 bp, Homo sapiens
cccagcctcagcgcg

SEQ ID NO: 3433877 - DNA, 20 bp, Homo sapiens
cccagcctcagcgcggccct

SEQ ID NO: 3433878 - DNA, 22 bp, Homo sapiens
cccagcctgcgcctgctgcatg

SEQ ID NO: 3433879 - DNA, 12 bp, Homo sapiens
cccagcctgcta

SEQ ID NO: 3433880 - DNA, 16 bp, Homo sapiens
cccagcctgctagcta

SEQ ID NO: 3433881 - DNA, 22 bp, Homo sapiens
cccagcgggcaggttctgcctg

SEQ ID NO: 3433882 - DNA, 15 bp, Homo sapiens
cccagcgtggcctcc

SEQ ID NO: 3433883 - DNA, 15 bp, Homo sapiens
cccagctaaataatc

SEQ ID NO: 3433884 - DNA, 18 bp, Homo sapiens
cccagctaagaacctgga

SEQ ID NO: 3433885 - DNA, 22 bp, Homo sapiens
cccagctaagaacctggaactt

SEQ ID NO: 3433886 - DNA, 14 bp, Homo sapiens
cccagctacctcaa

SEQ ID NO: 3433887 - DNA, 17 bp, Homo sapiens
cccagctatacctgtgc

SEQ ID NO: 3433888 - DNA, 12 bp, Homo sapiens
cccagctcagca

SEQ ID NO: 3433889 - DNA, 14 bp, Homo sapiens
cccagctccccagg

SEQ ID NO: 3433890 - DNA, 15 bp, Homo sapiens
cccagctccccagga

SEQ ID NO: 3433891 - DNA, 12 bp, Homo sapiens
cccagctctgaa

SEQ ID NO: 3433892 - DNA, 12 bp, Homo sapiens
cccaggaccagc

SEQ ID NO: 3433893 - DNA, 14 bp, Homo sapiens
cccaggaccagctc

SEQ ID NO: 3433894 - DNA, 16 bp, Homo sapiens
cccaggaccagctcag

SEQ ID NO: 3433895 - DNA, 20 bp, Homo sapiens
cccaggaccagctcaggaca

SEQ ID NO: 3433896 - DNA, 12 bp, Homo sapiens
cccaggaccctg

SEQ ID NO: 3433897 - DNA, 18 bp, Homo sapiens
cccaggacctggctgcca

SEQ ID NO: 3433898 - DNA, 22 bp, Homo sapiens
cccaggatttgactcgggcctt

SEQ ID NO: 3433899 - DNA, 12 bp, Homo sapiens
ccctccactctc

SEQ ID NO: 3433900 - DNA, 15 bp, Homo sapiens
ccctcccaagctggc

SEQ ID NO: 3433901 - DNA, 21 bp, Homo sapiens
ccctcccaagctggctggggt

SEQ ID NO: 3433902 - DNA, 14 bp, Homo sapiens
ccctcccaggactc

SEQ ID NO: 3433903 - DNA, 16 bp, Homo sapiens
ccctccccaaagtccc

SEQ ID NO: 3433904 - DNA, 14 bp, Homo sapiens
ccctccccatggag

SEQ ID NO: 3433905 - DNA, 18 bp, Homo sapiens
ccctccccattcagacac

SEQ ID NO: 3433906 - DNA, 15 bp, Homo sapiens
ccctcccccccatgc

SEQ ID NO: 3433907 - DNA, 15 bp, Homo sapiens
ccctcccctggggac

SEQ ID NO: 3433908 - DNA, 20 bp, Homo sapiens
ccctccctgttccccagaga

SEQ ID NO: 3433909 - DNA, 13 bp, Homo sapiens
ccctccctttctc

SEQ ID NO: 3433910 - DNA, 19 bp, Homo sapiens
ccctccggactggtgccct

SEQ ID NO: 3433911 - DNA, 23 bp, Homo sapiens
ccctccgtggcatcaccttaggc

SEQ ID NO: 3433912 - DNA, 13 bp, Homo sapiens
ccctcctctgaaa

SEQ ID NO: 3433913 - DNA, 20 bp, Homo sapiens
ccctcctctgaaacagctgc

SEQ ID NO: 3433914 - DNA, 16 bp, Homo sapiens
ccctccttcccaatct

SEQ ID NO: 3433915 - DNA, 13 bp, Homo sapiens
ccctcggctctgg

SEQ ID NO: 3433916 - DNA, 15 bp, Homo sapiens
ccctctaggctctgc

SEQ ID NO: 3433917 - DNA, 16 bp, Homo sapiens
ccctctcatctcaggt

SEQ ID NO: 3433918 - DNA, 19 bp, Homo sapiens
ccctctcctccgtggcaca

SEQ ID NO: 3433919 - DNA, 20 bp, Homo sapiens
ccctctcctccgtggcacat

SEQ ID NO: 3433920 - DNA, 17 bp, Homo sapiens
ccctctccttcctgtgt

SEQ ID NO: 3433921 - DNA, 13 bp, Homo sapiens
ccctctctcctcc

SEQ ID NO: 3433922 - DNA, 14 bp, Homo sapiens
ccctctctgggcct

SEQ ID NO: 3433923 - DNA, 14 bp, Homo sapiens
ccctctcttgtcag

SEQ ID NO: 3433924 - DNA, 21 bp, Homo sapiens
ccctctcttttgaggctctct

SEQ ID NO: 3433925 - DNA, 11 bp, Homo sapiens
ccctctgaccc

SEQ ID NO: 3433926 - DNA, 15 bp, Homo sapiens
ccctctgccccatcc

SEQ ID NO: 3433927 - DNA, 15 bp, Homo sapiens
ccctctgctgaagac

SEQ ID NO: 3433928 - DNA, 21 bp, Homo sapiens
ccctctggagtggccactaag

SEQ ID NO: 3433929 - DNA, 22 bp, Homo sapiens
ccctctggagtggccactaagc

SEQ ID NO: 3433930 - DNA, 19 bp, Homo sapiens
ccctctggattctgaatct

SEQ ID NO: 3433931 - DNA, 16 bp, Homo sapiens
ccctctgggggctctg

SEQ ID NO: 3433932 - DNA, 20 bp, Homo sapiens
ccctctggtcgctcctgccc

SEQ ID NO: 3433933 - DNA, 22 bp, Homo sapiens
ccctctggtcgctcctgcccac

SEQ ID NO: 3433934 - DNA, 15 bp, Homo sapiens
ccctctgtcatcctc

SEQ ID NO: 3433935 - DNA, 18 bp, Homo sapiens
ccctctgtgtatttgctt

SEQ ID NO: 3433936 - DNA, 20 bp, Homo sapiens
ccctctgtgtatttgctttt

SEQ ID NO: 3433937 - DNA, 20 bp, Homo sapiens
ccctcttcctaccctgcctc

SEQ ID NO: 3433938 - DNA, 20 bp, Homo sapiens
ccctcttctttcagacttgc

SEQ ID NO: 3433939 - DNA, 24 bp, Homo sapiens
ccctcttctttcagacttgccatg

SEQ ID NO: 3433940 - DNA, 19 bp, Homo sapiens
ccctctttgctgcagagaa

SEQ ID NO: 3433941 - DNA, 16 bp, Homo sapiens
ccctgaaagccctgag

SEQ ID NO: 3433942 - DNA, 19 bp, Homo sapiens
ccctgaagatttcagaggc

SEQ ID NO: 3433943 - DNA, 12 bp, Homo sapiens
ccctgaccctgt

SEQ ID NO: 3433944 - DNA, 20 bp, Homo sapiens
ccctgacctgtgagcccagc

SEQ ID NO: 3433945 - DNA, 21 bp, Homo sapiens
ccctgactcattctgaaggag

SEQ ID NO: 3433946 - DNA, 20 bp, Homo sapiens
ccctgagaaacccaccagcc

SEQ ID NO: 3433947 - DNA, 22 bp, Homo sapiens
ccctgagaaacccaccagccta

SEQ ID NO: 3433948 - DNA, 14 bp, Homo sapiens
ccctgagctgacca

SEQ ID NO: 3433949 - DNA, 14 bp, Homo sapiens
ccctgagctgaggc

SEQ ID NO: 3433950 - DNA, 22 bp, Homo sapiens
ccctgaggatgggtcagagcta

SEQ ID NO: 3433951 - DNA, 16 bp, Homo sapiens
ccctgaggtcactgct

SEQ ID NO: 3433952 - DNA, 17 bp, Homo sapiens
ccctgaggtcactgcta

SEQ ID NO: 3433953 - DNA, 17 bp, Homo sapiens
ccctgatagaagattgt

SEQ ID NO: 3433954 - DNA, 21 bp, Homo sapiens
ccctgatttaggagaagccag

SEQ ID NO: 3433955 - DNA, 23 bp, Homo sapiens
ccctgatttaggagaagccagga

SEQ ID NO: 3433956 - DNA, 13 bp, Homo sapiens
ccctgcacagttg

SEQ ID NO: 3433957 - DNA, 19 bp, Homo sapiens
ccctgcacttgcagactct

SEQ ID NO: 3433958 - DNA, 16 bp, Homo sapiens
ccctgcatctgaccag

SEQ ID NO: 3433959 - DNA, 21 bp, Homo sapiens
ccctgcatctgaccagcagcg

SEQ ID NO: 3433960 - DNA, 14 bp, Homo sapiens
ccctgccaccaggc

SEQ ID NO: 3433961 - DNA, 18 bp, Homo sapiens
ccctgccaccctggggag

SEQ ID NO: 3433962 - DNA, 14 bp, Homo sapiens
ccctgccacctcct

SEQ ID NO: 3433963 - DNA, 19 bp, Homo sapiens
ccctgccactcactaggcc

SEQ ID NO: 3433964 - DNA, 20 bp, Homo sapiens
ccctgccactcactaggccc

SEQ ID NO: 3433965 - DNA, 20 bp, Homo sapiens
ccctgcccccaggactgggc

SEQ ID NO: 3433966 - DNA, 15 bp, Homo sapiens
ccctgccccttgcca

SEQ ID NO: 3433967 - DNA, 17 bp, Homo sapiens
ccctgccctcacctccc

SEQ ID NO: 3433968 - DNA, 12 bp, Homo sapiens
ccctgccctgtg

SEQ ID NO: 3433969 - DNA, 13 bp, Homo sapiens
ccctgccctgtgg

SEQ ID NO: 3433970 - DNA, 14 bp, Homo sapiens
ccctgcgcctttcc

SEQ ID NO: 3433971 - DNA, 19 bp, Homo sapiens
ccctgctgctgctcctccc

SEQ ID NO: 3433972 - DNA, 18 bp, Homo sapiens
ccctgctgtctctctggg

SEQ ID NO: 3433973 - DNA, 20 bp, Homo sapiens
ccctgctgtctctctgggct

SEQ ID NO: 3433974 - DNA, 15 bp, Homo sapiens
ccctggaagagccca

SEQ ID NO: 3433975 - DNA, 15 bp, Homo sapiens
ccctggacatgcctg

SEQ ID NO: 3433976 - DNA, 19 bp, Homo sapiens
ccctggacatgcctgtcct

SEQ ID NO: 3433977 - DNA, 23 bp, Homo sapiens
ccctggaccagtggtctcacatg

SEQ ID NO: 3433978 - DNA, 12 bp, Homo sapiens
ccctggagccca

SEQ ID NO: 3433979 - DNA, 17 bp, Homo sapiens
ccctggaggctgcctcc

SEQ ID NO: 3433980 - DNA, 13 bp, Homo sapiens
ccctggcctcccc

SEQ ID NO: 3433981 - DNA, 14 bp, Homo sapiens
ccctggcctcccct

SEQ ID NO: 3433982 - DNA, 19 bp, Homo sapiens
ccctggctccttcaccacc

SEQ ID NO: 3433983 - DNA, 22 bp, Homo sapiens
ccctggcttctgtggggcccct

SEQ ID NO: 3433984 - DNA, 16 bp, Homo sapiens
ccctgggccctgggct

SEQ ID NO: 3433985 - DNA, 14 bp, Homo sapiens
ccctggggcctgac

SEQ ID NO: 3433986 - DNA, 17 bp, Homo sapiens
ccctggggtggccacca

SEQ ID NO: 3433987 - DNA, 16 bp, Homo sapiens
ccctggtggcagtggg

SEQ ID NO: 3433988 - DNA, 16 bp, Homo sapiens
ccctggtggttgctgt

SEQ ID NO: 3433989 - DNA, 15 bp, Homo sapiens
ccctggttctcatct

SEQ ID NO: 3433990 - DNA, 17 bp, Homo sapiens
ccctggttctcatcttt

SEQ ID NO: 3433991 - DNA, 15 bp, Homo sapiens
ccctgtatatagccc

SEQ ID NO: 3433992 - DNA, 22 bp, Homo sapiens
ccctgtcaaatatcagttaccc

SEQ ID NO: 3433993 - DNA, 13 bp, Homo sapiens
ccctgtcacctct

SEQ ID NO: 3433994 - DNA, 13 bp, Homo sapiens
ccctgtcctgcca

SEQ ID NO: 3433995 - DNA, 12 bp, Homo sapiens
ccctgtctagag

SEQ ID NO: 3433996 - DNA, 20 bp, Homo sapiens
ccctgtctagagagggaggc

SEQ ID NO: 3433997 - DNA, 13 bp, Homo sapiens
ccctgtcttcctc

SEQ ID NO: 3433998 - DNA, 16 bp, Homo sapiens
ccctgtcttcctctgc

SEQ ID NO: 3433999 - DNA, 18 bp, Homo sapiens
ccctgtcttcctctgcaa

SEQ ID NO: 3434000 - DNA, 20 bp, Homo sapiens
ccctgtcttcctctgcaagt

SEQ ID NO: 3434001 - DNA, 17 bp, Homo sapiens
ccctgtgccctccttcc

SEQ ID NO: 3434002 - DNA, 21 bp, Homo sapiens
ccctgtggatgagccctcaga

SEQ ID NO: 3434003 - DNA, 12 bp, Homo sapiens
ccctgtgtcttt

SEQ ID NO: 3434004 - DNA, 14 bp, Homo sapiens
ccctgttcctggag

SEQ ID NO: 3434005 - DNA, 15 bp, Homo sapiens
ccctgttcctggagg

SEQ ID NO: 3434006 - DNA, 15 bp, Homo sapiens
cccttaagccctggc

SEQ ID NO: 3434007 - DNA, 23 bp, Homo sapiens
cccttaagtccttaatgaagagc

SEQ ID NO: 3434008 - DNA, 20 bp, Homo sapiens
cccttactatgatctcagga

SEQ ID NO: 3434009 - DNA, 20 bp, Homo sapiens
cccttcacaaagcccaaggg

SEQ ID NO: 3434010 - DNA, 14 bp, Homo sapiens
cccttcatcttcct

SEQ ID NO: 3434011 - DNA, 15 bp, Homo sapiens
cccttcatcttcctg

SEQ ID NO: 3434012 - DNA, 17 bp, Homo sapiens
cccttcatcttcctgtg

SEQ ID NO: 3434013 - DNA, 20 bp, Homo sapiens
cccttcatcttcctgtgtcc

SEQ ID NO: 3434014 - DNA, 16 bp, Homo sapiens
cccttccactgagggc

SEQ ID NO: 3434015 - DNA, 23 bp, Homo sapiens
cccttcccacaggacatttctct

SEQ ID NO: 3434016 - DNA, 13 bp, Homo sapiens
cccttccctcacc

SEQ ID NO: 3434017 - DNA, 18 bp, Homo sapiens
cccttcgctcctgtgtct

SEQ ID NO: 3434018 - DNA, 21 bp, Homo sapiens
cccttcggccaaacagacagg

SEQ ID NO: 3434019 - DNA, 15 bp, Homo sapiens
cccttctcagaatct

SEQ ID NO: 3434020 - DNA, 17 bp, Homo sapiens
cccttctcctcttgtaa

SEQ ID NO: 3434021 - DNA, 12 bp, Homo sapiens
cccttgaactct

SEQ ID NO: 3434022 - DNA, 20 bp, Homo sapiens
cccttgcctttcgaggcctg

SEQ ID NO: 3434023 - DNA, 21 bp, Homo sapiens
cccttgcctttcgaggcctga

SEQ ID NO: 3434024 - DNA, 15 bp, Homo sapiens
cccttggaggccagc

SEQ ID NO: 3434025 - DNA, 9 bp, Homo sapiens
ccctttcct

SEQ ID NO: 3434026 - DNA, 14 bp, Homo sapiens
ccctttcctcctca

SEQ ID NO: 3434027 - DNA, 14 bp, Homo sapiens
ccctttcctgtccc

SEQ ID NO: 3434028 - DNA, 15 bp, Homo sapiens
ccctttcctgtccca

SEQ ID NO: 3434029 - DNA, 14 bp, Homo sapiens
ccctttgccttcat

SEQ ID NO: 3434030 - DNA, 16 bp, Homo sapiens
cccttttccagcctca

SEQ ID NO: 3434031 - DNA, 23 bp, Homo sapiens
ccctttttgaagtgtaggcagac

SEQ ID NO: 3434032 - DNA, 15 bp, Homo sapiens
cctccggactggtgc

SEQ ID NO: 3434033 - DNA, 19 bp, Homo sapiens
cctcctcaggcacacagct

SEQ ID NO: 3434034 - DNA, 20 bp, Homo sapiens
cctcctccagggtgatttta

SEQ ID NO: 3434035 - DNA, 16 bp, Homo sapiens
cctcctcccacccggc

SEQ ID NO: 3434036 - DNA, 19 bp, Homo sapiens
cctcctcccacccggctgc

SEQ ID NO: 3434037 - DNA, 17 bp, Homo sapiens
cctcctccctgcatctg

SEQ ID NO: 3434038 - DNA, 21 bp, Homo sapiens
cctcctctgaaacagctgcct

SEQ ID NO: 3434039 - DNA, 12 bp, Homo sapiens
cctcctctgtga

SEQ ID NO: 3434040 - DNA, 12 bp, Homo sapiens
cctcctgagaaa

SEQ ID NO: 3434041 - DNA, 12 bp, Homo sapiens
cctcctgcccac

SEQ ID NO: 3434042 - DNA, 15 bp, Homo sapiens
cctcctgctactctg

SEQ ID NO: 3434043 - DNA, 21 bp, Homo sapiens
cctcctgggccctctctgctc

SEQ ID NO: 3434044 - DNA, 13 bp, Homo sapiens
cctcctgggctaa

SEQ ID NO: 3434045 - DNA, 14 bp, Homo sapiens
cctcctgggctaag

SEQ ID NO: 3434046 - DNA, 15 bp, Homo sapiens
cctcctgtgtgtgcg

SEQ ID NO: 3434047 - DNA, 12 bp, Homo sapiens
cctccttcagac

SEQ ID NO: 3434048 - DNA, 15 bp, Homo sapiens
cctccttcagacacc

SEQ ID NO: 3434049 - DNA, 20 bp, Homo sapiens
cctccttccctgtgtctttt

SEQ ID NO: 3434050 - DNA, 15 bp, Homo sapiens
cctccttctcccttt

SEQ ID NO: 3434051 - DNA, 15 bp, Homo sapiens
cctcctttcctcctc

SEQ ID NO: 3434052 - DNA, 21 bp, Homo sapiens
cctcctttcctcctctgactt

SEQ ID NO: 3434053 - DNA, 16 bp, Homo sapiens
cctcgaaacacagaaa

SEQ ID NO: 3434054 - DNA, 20 bp, Homo sapiens
cctcgaaacacagaaacctt

SEQ ID NO: 3434055 - DNA, 15 bp, Homo sapiens
cctcgaactggctgc

SEQ ID NO: 3434056 - DNA, 18 bp, Homo sapiens
cctcgaggtgccttcttc

SEQ ID NO: 3434057 - DNA, 18 bp, Homo sapiens
cctcgagtactgtgggca

SEQ ID NO: 3434058 - DNA, 21 bp, Homo sapiens
cctcgagtactgtgggcaatt

SEQ ID NO: 3434059 - DNA, 21 bp, Homo sapiens
cctcgctctgttacccagggt

SEQ ID NO: 3434060 - DNA, 19 bp, Homo sapiens
cctcggcttttctcagctg

SEQ ID NO: 3434061 - DNA, 19 bp, Homo sapiens
cctctactttgattctgat

SEQ ID NO: 3434062 - DNA, 16 bp, Homo sapiens
cctctagaaataggtt

SEQ ID NO: 3434063 - DNA, 14 bp, Homo sapiens
cctctagagccttc

SEQ ID NO: 3434064 - DNA, 16 bp, Homo sapiens
cctctaggctctgcct

SEQ ID NO: 3434065 - DNA, 17 bp, Homo sapiens
cctctaggctctgcctt

SEQ ID NO: 3434066 - DNA, 21 bp, Homo sapiens
cctctatttatgtttgcactt

SEQ ID NO: 3434067 - DNA, 22 bp, Homo sapiens
cctctccattttagcccagtgt

SEQ ID NO: 3434068 - DNA, 18 bp, Homo sapiens
cctctccccagcccagag

SEQ ID NO: 3434069 - DNA, 21 bp, Homo sapiens
cctctccccagcccagagaca

SEQ ID NO: 3434070 - DNA, 18 bp, Homo sapiens
cctctcctcatgttctgc

SEQ ID NO: 3434071 - DNA, 14 bp, Homo sapiens
cctctcctttgttc

SEQ ID NO: 3434072 - DNA, 11 bp, Homo sapiens
cctctctctgt

SEQ ID NO: 3434073 - DNA, 15 bp, Homo sapiens
cctctctgctctgcg

SEQ ID NO: 3434074 - DNA, 13 bp, Homo sapiens
cctctctgggcct

SEQ ID NO: 3434075 - DNA, 17 bp, Homo sapiens
cctctctgtcccttgct

SEQ ID NO: 3434076 - DNA, 22 bp, Homo sapiens
cctctcttgaaccccaaatgct

SEQ ID NO: 3434077 - DNA, 13 bp, Homo sapiens
cctctgaaacagc

SEQ ID NO: 3434078 - DNA, 15 bp, Homo sapiens
cctctgaaacagctg

SEQ ID NO: 3434079 - DNA, 17 bp, Homo sapiens
cctctgaaagttgtaca

SEQ ID NO: 3434080 - DNA, 19 bp, Homo sapiens
cctctgaaagttgtacatg

SEQ ID NO: 3434081 - DNA, 14 bp, Homo sapiens
cctctgacacacag

SEQ ID NO: 3434082 - DNA, 20 bp, Homo sapiens
cctctgacacacagctctgt

SEQ ID NO: 3434083 - DNA, 12 bp, Homo sapiens
cctctgactcag

SEQ ID NO: 3434084 - DNA, 17 bp, Homo sapiens
cctctgactcagggctc

SEQ ID NO: 3434085 - DNA, 14 bp, Homo sapiens
cctctgatacctca

SEQ ID NO: 3434086 - DNA, 19 bp, Homo sapiens
cctctgcaagtgctcaggg

SEQ ID NO: 3434087 - DNA, 15 bp, Homo sapiens
cctctgcacaagctg

SEQ ID NO: 3434088 - DNA, 19 bp, Homo sapiens
cctctgcacaagctgcacc

SEQ ID NO: 3434089 - DNA, 22 bp, Homo sapiens
cctctgccccatcctccagcag

SEQ ID NO: 3434090 - DNA, 20 bp, Homo sapiens
cctctgcctctgacacacag

SEQ ID NO: 3434091 - DNA, 23 bp, Homo sapiens
cctctgcctctgacacacagctc

SEQ ID NO: 3434092 - DNA, 20 bp, Homo sapiens
cctctgctgaagacttgccc

SEQ ID NO: 3434093 - DNA, 13 bp, Homo sapiens
cctctgcttccca

SEQ ID NO: 3434094 - DNA, 16 bp, Homo sapiens
cctctggagtggccac

SEQ ID NO: 3434095 - DNA, 18 bp, Homo sapiens
cctctgggggctctggcc

SEQ ID NO: 3434096 - DNA, 19 bp, Homo sapiens
cctctgtcagtcacagcca

SEQ ID NO: 3434097 - DNA, 19 bp, Homo sapiens
cctctgtccaggcactgag

SEQ ID NO: 3434098 - DNA, 14 bp, Homo sapiens
cctctgtccccttc

SEQ ID NO: 3434099 - DNA, 21 bp, Homo sapiens
cctctgtccccttctctcatc

SEQ ID NO: 3434100 - DNA, 21 bp, Homo sapiens
cctctgtgaccaatgtcttga

SEQ ID NO: 3434101 - DNA, 18 bp, Homo sapiens
cctctgtgtatttgcttt

SEQ ID NO: 3434102 - DNA, 14 bp, Homo sapiens
cctcttagaaaaac

SEQ ID NO: 3434103 - DNA, 16 bp, Homo sapiens
cctcttcagaggccct

SEQ ID NO: 3434104 - DNA, 18 bp, Homo sapiens
cctcttcatggatggggg

SEQ ID NO: 3434105 - DNA, 17 bp, Homo sapiens
cctcttccgactctttc

SEQ ID NO: 3434106 - DNA, 12 bp, Homo sapiens
cctcttctgagc

SEQ ID NO: 3434107 - DNA, 21 bp, Homo sapiens
cctcttctggagatggaagct

SEQ ID NO: 3434108 - DNA, 21 bp, Homo sapiens
cctcttctttcagacttgcca

SEQ ID NO: 3434109 - DNA, 21 bp, Homo sapiens
cctcttgaagagaaaaaagtc

SEQ ID NO: 3434110 - DNA, 13 bp, Homo sapiens
cctcttggcctga

SEQ ID NO: 3434111 - DNA, 14 bp, Homo sapiens
cctcttggggaagg

SEQ ID NO: 3434112 - DNA, 21 bp, Homo sapiens
cctcttggggaaggggcacct

SEQ ID NO: 3434113 - DNA, 22 bp, Homo sapiens
cctcttggggaaggggcacctc

SEQ ID NO: 3434114 - DNA, 13 bp, Homo sapiens
cctcttgggttca

SEQ ID NO: 3434115 - DNA, 20 bp, Homo sapiens
cctcttgtaaataaagccct

SEQ ID NO: 3434116 - DNA, 14 bp, Homo sapiens
cctctttcctctgt

SEQ ID NO: 3434117 - DNA, 16 bp, Homo sapiens
cctctttcgtctactg

SEQ ID NO: 3434118 - DNA, 14 bp, Homo sapiens
cctctttgctgcag

SEQ ID NO: 3434119 - DNA, 11 bp, Homo sapiens
cctctttgctt

SEQ ID NO: 3434120 - DNA, 14 bp, Homo sapiens
cctctttgtctaaa

SEQ ID NO: 3434121 - DNA, 19 bp, Homo sapiens
cctctttttaaggacactg

SEQ ID NO: 3434122 - DNA, 23 bp, Homo sapiens
cctctttttccaacttggctgca

SEQ ID NO: 3434123 - DNA, 13 bp, Homo sapiens
cctgaaagccctg

SEQ ID NO: 3434124 - DNA, 18 bp, Homo sapiens
cctgaaagcggctgcctc

SEQ ID NO: 3434125 - DNA, 20 bp, Homo sapiens
cctgaaagcggctgcctcca

SEQ ID NO: 3434126 - DNA, 21 bp, Homo sapiens
cctgaaagcggctgcctccat

SEQ ID NO: 3434127 - DNA, 13 bp, Homo sapiens
cctgaacctagga

SEQ ID NO: 3434128 - DNA, 13 bp, Homo sapiens
cctgaagaaccag

SEQ ID NO: 3434129 - DNA, 21 bp, Homo sapiens
cctgaagagtcctctgaatga

SEQ ID NO: 3434130 - DNA, 23 bp, Homo sapiens
cctgaagatttcagaggctgcag

SEQ ID NO: 3434131 - DNA, 14 bp, Homo sapiens
cctgaaggggcgtc

SEQ ID NO: 3434132 - DNA, 16 bp, Homo sapiens
cctgaaggggcgtctg

SEQ ID NO: 3434133 - DNA, 22 bp, Homo sapiens
cctgaaggggcgtctgttcccc

SEQ ID NO: 3434134 - DNA, 16 bp, Homo sapiens
cctgaagtcacacagt

SEQ ID NO: 3434135 - DNA, 19 bp, Homo sapiens
cctgaagtcacacagtgag

SEQ ID NO: 3434136 - DNA, 20 bp, Homo sapiens
cctgaagtcacacagtgagt

SEQ ID NO: 3434137 - DNA, 16 bp, Homo sapiens
cctgaatcatgagcct

SEQ ID NO: 3434138 - DNA, 14 bp, Homo sapiens
cctgacaaggccag

SEQ ID NO: 3434139 - DNA, 13 bp, Homo sapiens
cctgacattgtct

SEQ ID NO: 3434140 - DNA, 16 bp, Homo sapiens
cctgactcatcatttg

SEQ ID NO: 3434141 - DNA, 16 bp, Homo sapiens
cctgactgcccagcat

SEQ ID NO: 3434142 - DNA, 18 bp, Homo sapiens
cctgacttttctgtggat

SEQ ID NO: 3434143 - DNA, 20 bp, Homo sapiens
cctgagagtcagctctctgc

SEQ ID NO: 3434144 - DNA, 17 bp, Homo sapiens
cctgagattcagatgtc

SEQ ID NO: 3434145 - DNA, 16 bp, Homo sapiens
cctgagatttcatctg

SEQ ID NO: 3434146 - DNA, 23 bp, Homo sapiens
cctgagatttcatctgctctcct

SEQ ID NO: 3434147 - DNA, 13 bp, Homo sapiens
cctgagcaactct

SEQ ID NO: 3434148 - DNA, 14 bp, Homo sapiens
cctgagcctggcca

SEQ ID NO: 3434149 - DNA, 15 bp, Homo sapiens
cctgagcctggccag

SEQ ID NO: 3434150 - DNA, 16 bp, Homo sapiens
cctgagcctggccagc

SEQ ID NO: 3434151 - DNA, 12 bp, Homo sapiens
cctgagcgctcc

SEQ ID NO: 3434152 - DNA, 15 bp, Homo sapiens
cctgagctgaggcag

SEQ ID NO: 3434153 - DNA, 16 bp, Homo sapiens
cctgagctgaggcagc

SEQ ID NO: 3434154 - DNA, 16 bp, Homo sapiens
cctgagctgcttcact

SEQ ID NO: 3434155 - DNA, 21 bp, Homo sapiens
cctgagctgcttcactaggga

SEQ ID NO: 3434156 - DNA, 14 bp, Homo sapiens
cctgagctttctgc

SEQ ID NO: 3434157 - DNA, 19 bp, Homo sapiens
cctgaggatgggtcagagc

SEQ ID NO: 3434158 - DNA, 20 bp, Homo sapiens
cctgaggccagcctgcggga

SEQ ID NO: 3434159 - DNA, 13 bp, Homo sapiens
cctgagggagctc

SEQ ID NO: 3434160 - DNA, 14 bp, Homo sapiens
cctgagtagaaagg

SEQ ID NO: 3434161 - DNA, 21 bp, Homo sapiens
cctgagtagaaaggcctttaa

SEQ ID NO: 3434162 - DNA, 18 bp, Homo sapiens
cctgataaagcacagctg

SEQ ID NO: 3434163 - DNA, 20 bp, Homo sapiens
cctgatcagaaaccaaccat

SEQ ID NO: 3434164 - DNA, 21 bp, Homo sapiens
cctgatcagaaaccaaccatg

SEQ ID NO: 3434165 - DNA, 18 bp, Homo sapiens
cgatcacaacgtgcattg

SEQ ID NO: 3434166 - DNA, 22 bp, Homo sapiens
cgatcacaacgtgcattgtgct

SEQ ID NO: 3434167 - DNA, 23 bp, Homo sapiens
cgatcacaacgtgcattgtgctt

SEQ ID NO: 3434168 - DNA, 24 bp, Homo sapiens
cgatcacaacgtgcattgtgcttc

SEQ ID NO: 3434169 - DNA, 20 bp, Homo sapiens
cgatccacctgtctcagcct

SEQ ID NO: 3434170 - DNA, 19 bp, Homo sapiens
cgatctgggttcactgcaa

SEQ ID NO: 3434171 - DNA, 13 bp, Homo sapiens
cgatgacagtgct

SEQ ID NO: 3434172 - DNA, 21 bp, Homo sapiens
cgatgattcaggtgcagagga

SEQ ID NO: 3434173 - DNA, 12 bp, Homo sapiens
cgatgggtcagg

SEQ ID NO: 3434174 - DNA, 13 bp, Homo sapiens
cgatgttgtgatg

SEQ ID NO: 3434175 - DNA, 17 bp, Homo sapiens
cgattcaaactgctcca

SEQ ID NO: 3434176 - DNA, 22 bp, Homo sapiens
cgattcacctgagcaggacctc

SEQ ID NO: 3434177 - DNA, 13 bp, Homo sapiens
cgattttgtatct

SEQ ID NO: 3434178 - DNA, 16 bp, Homo sapiens
cgcaaaccacactgga

SEQ ID NO: 3434179 - DNA, 18 bp, Homo sapiens
cgcaaaccacactggact

SEQ ID NO: 3434180 - DNA, 12 bp, Homo sapiens
cgcaaagggcat

SEQ ID NO: 3434181 - DNA, 15 bp, Homo sapiens
cgcaccattctgact

SEQ ID NO: 3434182 - DNA, 15 bp, Homo sapiens
cgcacctgcctcagg

SEQ ID NO: 3434183 - DNA, 15 bp, Homo sapiens
cgcagacctctggat

SEQ ID NO: 3434184 - DNA, 19 bp, Homo sapiens
cgcagacctctggattagg

SEQ ID NO: 3434185 - DNA, 19 bp, Homo sapiens
cgcagagcgcgcccctagc

SEQ ID NO: 3434186 - DNA, 21 bp, Homo sapiens
cgcagagcgcgcccctagccg

SEQ ID NO: 3434187 - DNA, 16 bp, Homo sapiens
cgcagagcttttcaga

SEQ ID NO: 3434188 - DNA, 13 bp, Homo sapiens
cgcaggaagctgc

SEQ ID NO: 3434189 - DNA, 22 bp, Homo sapiens
cgcagtgtgcactaaggggccc

SEQ ID NO: 3434190 - DNA, 18 bp, Homo sapiens
cgcattctaacctggagg

SEQ ID NO: 3434191 - DNA, 15 bp, Homo sapiens
cgccaaactgtctct

SEQ ID NO: 3434192 - DNA, 16 bp, Homo sapiens
cgccaaactgtctctg

SEQ ID NO: 3434193 - DNA, 16 bp, Homo sapiens
cgccaaggctggggga

SEQ ID NO: 3434194 - DNA, 23 bp, Homo sapiens
cgccaaggctgggggaagaagct

SEQ ID NO: 3434195 - DNA, 21 bp, Homo sapiens
cgccaggatggaacacggcca

SEQ ID NO: 3434196 - DNA, 21 bp, Homo sapiens
cgccaggctgaccacagcaca

SEQ ID NO: 3434197 - DNA, 23 bp, Homo sapiens
cgccaggctgaccacagcacagc

SEQ ID NO: 3434198 - DNA, 15 bp, Homo sapiens
cgccagtacttgtca

SEQ ID NO: 3434199 - DNA, 17 bp, Homo sapiens
cgcccaggatcagattg

SEQ ID NO: 3434200 - DNA, 14 bp, Homo sapiens
cgcccagtccttcc

SEQ ID NO: 3434201 - DNA, 13 bp, Homo sapiens
cgcccagtctgga

SEQ ID NO: 3434202 - DNA, 23 bp, Homo sapiens
cgcccagttgggtggatgcctgg

SEQ ID NO: 3434203 - DNA, 12 bp, Homo sapiens
cgccccacccag

SEQ ID NO: 3434204 - DNA, 12 bp, Homo sapiens
cgcccgtcctgc

SEQ ID NO: 3434205 - DNA, 14 bp, Homo sapiens
cgcccgtcctgcct

SEQ ID NO: 3434206 - DNA, 15 bp, Homo sapiens
cgcccgtcctgcctg

SEQ ID NO: 3434207 - DNA, 12 bp, Homo sapiens
cgccctcccagg

SEQ ID NO: 3434208 - DNA, 13 bp, Homo sapiens
cgccctcccaggc

SEQ ID NO: 3434209 - DNA, 20 bp, Homo sapiens
cgccctctcctttgttcccg

SEQ ID NO: 3434210 - DNA, 11 bp, Homo sapiens
cgccctgccac

SEQ ID NO: 3434211 - DNA, 20 bp, Homo sapiens
cgcccttacttcttgccctg

SEQ ID NO: 3434212 - DNA, 12 bp, Homo sapiens
cgccgcctcttt

SEQ ID NO: 3434213 - DNA, 14 bp, Homo sapiens
cgccgcctggtact

SEQ ID NO: 3434214 - DNA, 15 bp, Homo sapiens
cgccggaggccagct

SEQ ID NO: 3434215 - DNA, 16 bp, Homo sapiens
cgccggaggccagcta

SEQ ID NO: 3434216 - DNA, 19 bp, Homo sapiens
cgcctccaggagcctaccc

SEQ ID NO: 3434217 - DNA, 16 bp, Homo sapiens
cgcctcccactggggt

SEQ ID NO: 3434218 - DNA, 15 bp, Homo sapiens
cgcctctttcaagca

SEQ ID NO: 3434219 - DNA, 14 bp, Homo sapiens
cgcctgaaactttg

SEQ ID NO: 3434220 - DNA, 18 bp, Homo sapiens
cgcctgcaaacgctgcct

SEQ ID NO: 3434221 - DNA, 19 bp, Homo sapiens
cgcctgcaaacgctgcctg

SEQ ID NO: 3434222 - DNA, 21 bp, Homo sapiens
cgcctgcaaacgctgcctgcc

SEQ ID NO: 3434223 - DNA, 14 bp, Homo sapiens
cgcctggagccctc

SEQ ID NO: 3434224 - DNA, 14 bp, Homo sapiens
cgcctggccggctc

SEQ ID NO: 3434225 - DNA, 17 bp, Homo sapiens
cgcctggccggctccag

SEQ ID NO: 3434226 - DNA, 19 bp, Homo sapiens
cgcctggctgcagcctgcg

SEQ ID NO: 3434227 - DNA, 16 bp, Homo sapiens
cgcctgtaatcccagc

SEQ ID NO: 3434228 - DNA, 19 bp, Homo sapiens
cgcctgtaatcccagcact

SEQ ID NO: 3434229 - DNA, 15 bp, Homo sapiens
cgcctgtgatgctgg

SEQ ID NO: 3434230 - DNA, 15 bp, Homo sapiens
cgcgactaatttcaa

SEQ ID NO: 3434231 - DNA, 17 bp, Homo sapiens
cgcggcggagctggccc

SEQ ID NO: 3434232 - DNA, 15 bp, Homo sapiens
cgcggggacattggg

SEQ ID NO: 3434233 - DNA, 20 bp, Homo sapiens
cgcggggctgtcggcgctgc

SEQ ID NO: 3434234 - DNA, 16 bp, Homo sapiens
cgcgttgtaaaatata

SEQ ID NO: 3434235 - DNA, 23 bp, Homo sapiens
cgctacaaaataaagctgttctc

SEQ ID NO: 3434236 - DNA, 12 bp, Homo sapiens
cgctacctccct

SEQ ID NO: 3434237 - DNA, 13 bp, Homo sapiens
cgctacctccctc

SEQ ID NO: 3434238 - DNA, 14 bp, Homo sapiens
cgctacctccctcc

SEQ ID NO: 3434239 - DNA, 17 bp, Homo sapiens
cgctacctctctgtccc

SEQ ID NO: 3434240 - DNA, 15 bp, Homo sapiens
cgctattgcactcca

SEQ ID NO: 3434241 - DNA, 15 bp, Homo sapiens
cgctcagcccagctg

SEQ ID NO: 3434242 - DNA, 18 bp, Homo sapiens
cgctccagctgccccggc

SEQ ID NO: 3434243 - DNA, 13 bp, Homo sapiens
cgctccctcccag

SEQ ID NO: 3434244 - DNA, 19 bp, Homo sapiens
cgctcctgccgcagagctg

SEQ ID NO: 3434245 - DNA, 15 bp, Homo sapiens
cgctgagccacctgc

SEQ ID NO: 3434246 - DNA, 13 bp, Homo sapiens
cgctgagtggcag

SEQ ID NO: 3434247 - DNA, 16 bp, Homo sapiens
cgctgagtggcagggg

SEQ ID NO: 3434248 - DNA, 20 bp, Homo sapiens
cgctgagtggcaggggacag

SEQ ID NO: 3434249 - DNA, 16 bp, Homo sapiens
cgctgattctcagggt

SEQ ID NO: 3434250 - DNA, 23 bp, Homo sapiens
cgctgattctcagggtctctgct

SEQ ID NO: 3434251 - DNA, 17 bp, Homo sapiens
cgctgccacccacctcc

SEQ ID NO: 3434252 - DNA, 15 bp, Homo sapiens
cgctgccagctctgt

SEQ ID NO: 3434253 - DNA, 20 bp, Homo sapiens
cgctgcccgctcagcccagc

SEQ ID NO: 3434254 - DNA, 15 bp, Homo sapiens
cgctgcctgcccaca

SEQ ID NO: 3434255 - DNA, 15 bp, Homo sapiens
cgctgcttccaggct

SEQ ID NO: 3434256 - DNA, 16 bp, Homo sapiens
cgctgcttccaggctg

SEQ ID NO: 3434257 - DNA, 17 bp, Homo sapiens
cgctgcttccaggctgg

SEQ ID NO: 3434258 - DNA, 14 bp, Homo sapiens
cgctgggcacttcc

SEQ ID NO: 3434259 - DNA, 16 bp, Homo sapiens
cgctgtcctttctaga

SEQ ID NO: 3434260 - DNA, 15 bp, Homo sapiens
cgcttcttgcctctg

SEQ ID NO: 3434261 - DNA, 22 bp, Homo sapiens
cgcttcttgcctctgtgctgtg

SEQ ID NO: 3434262 - DNA, 12 bp, Homo sapiens
cgcttgctctgt

SEQ ID NO: 3434263 - DNA, 16 bp, Homo sapiens
cgctttctacccagcg

SEQ ID NO: 3434264 - DNA, 22 bp, Homo sapiens
cgctttctagctgttgagctgt

SEQ ID NO: 3434265 - DNA, 11 bp, Homo sapiens
cgctttggcct

SEQ ID NO: 3434266 - DNA, 15 bp, Homo sapiens
cgctttggcctgagt

SEQ ID NO: 3434267 - DNA, 17 bp, Homo sapiens
cgcttttccttggcatt

SEQ ID NO: 3434268 - DNA, 13 bp, Homo sapiens
cggaaagcagctc

SEQ ID NO: 3434269 - DNA, 15 bp, Homo sapiens
cggaacaagcctaaa

SEQ ID NO: 3434270 - DNA, 16 bp, Homo sapiens
cggaactgcatgctgc

SEQ ID NO: 3434271 - DNA, 18 bp, Homo sapiens
cggaactgcatgctgctg

SEQ ID NO: 3434272 - DNA, 17 bp, Homo sapiens
cggaatagttggctagg

SEQ ID NO: 3434273 - DNA, 16 bp, Homo sapiens
cggacaagacccccag

SEQ ID NO: 3434274 - DNA, 12 bp, Homo sapiens
cggacaccccct

SEQ ID NO: 3434275 - DNA, 18 bp, Homo sapiens
cggacagccacggccagg

SEQ ID NO: 3434276 - DNA, 22 bp, Homo sapiens
cggacagccacggccaggccag

SEQ ID NO: 3434277 - DNA, 16 bp, Homo sapiens
cggaccctctaacctc

SEQ ID NO: 3434278 - DNA, 15 bp, Homo sapiens
cggactggtgccctc

SEQ ID NO: 3434279 - DNA, 14 bp, Homo sapiens
cggacttttctgca

SEQ ID NO: 3434280 - DNA, 18 bp, Homo sapiens
cggagaaggccgctgccc

SEQ ID NO: 3434281 - DNA, 23 bp, Homo sapiens
cggagagcgcctgcccctcccag

SEQ ID NO: 3434282 - DNA, 19 bp, Homo sapiens
cggagaggaagagacactc

SEQ ID NO: 3434283 - DNA, 11 bp, Homo sapiens
cggagccactc

SEQ ID NO: 3434284 - DNA, 13 bp, Homo sapiens
cggagccactcct

SEQ ID NO: 3434285 - DNA, 14 bp, Homo sapiens
cggagccggcacct

SEQ ID NO: 3434286 - DNA, 12 bp, Homo sapiens
cggagctccggc

SEQ ID NO: 3434287 - DNA, 16 bp, Homo sapiens
cggagctccggcctgc

SEQ ID NO: 3434288 - DNA, 17 bp, Homo sapiens
cggagctgcccctctct

SEQ ID NO: 3434289 - DNA, 19 bp, Homo sapiens
cggagctgcccctctctgg

SEQ ID NO: 3434290 - DNA, 23 bp, Homo sapiens
cggagctgcccctctctgggcct

SEQ ID NO: 3434291 - DNA, 18 bp, Homo sapiens
cggagtcccaccttggct

SEQ ID NO: 3434292 - DNA, 15 bp, Homo sapiens
cggagtcgtggggtg

SEQ ID NO: 3434293 - DNA, 22 bp, Homo sapiens
cggagtcgtggggtgtgctggg

SEQ ID NO: 3434294 - DNA, 23 bp, Homo sapiens
cggagtcgtggggtgtgctggga

SEQ ID NO: 3434295 - DNA, 14 bp, Homo sapiens
cggatcctgggtgg

SEQ ID NO: 3434296 - DNA, 14 bp, Homo sapiens
cggatctgagaatc

SEQ ID NO: 3434297 - DNA, 16 bp, Homo sapiens
cggatggatggaaggt

SEQ ID NO: 3434298 - DNA, 15 bp, Homo sapiens
cggatttggggtgga

SEQ ID NO: 3434299 - DNA, 18 bp, Homo sapiens
ctacccagcgtggcctcc

SEQ ID NO: 3434300 - DNA, 16 bp, Homo sapiens
ctacccagggcctgca

SEQ ID NO: 3434301 - DNA, 19 bp, Homo sapiens
ctacccagggcctgcagga

SEQ ID NO: 3434302 - DNA, 17 bp, Homo sapiens
ctacccccagctgtgct

SEQ ID NO: 3434303 - DNA, 19 bp, Homo sapiens
ctacccccagctgtgctta

SEQ ID NO: 3434304 - DNA, 14 bp, Homo sapiens
ctacctctctgtcc

SEQ ID NO: 3434305 - DNA, 21 bp, Homo sapiens
ctacctgttgagcatcacaga

SEQ ID NO: 3434306 - DNA, 14 bp, Homo sapiens
ctaccttatcaggc

SEQ ID NO: 3434307 - DNA, 19 bp, Homo sapiens
ctaccttgcttttgcttct

SEQ ID NO: 3434308 - DNA, 18 bp, Homo sapiens
ctacgaaaggatgagcag

SEQ ID NO: 3434309 - DNA, 14 bp, Homo sapiens
ctacgcctgcatgt

SEQ ID NO: 3434310 - DNA, 21 bp, Homo sapiens
ctactaaaagtttagaacttg

SEQ ID NO: 3434311 - DNA, 15 bp, Homo sapiens
ctactaataaaccag

SEQ ID NO: 3434312 - DNA, 16 bp, Homo sapiens
ctactaataaaccagt

SEQ ID NO: 3434313 - DNA, 18 bp, Homo sapiens
ctactaataaaccagttc

SEQ ID NO: 3434314 - DNA, 12 bp, Homo sapiens
ctactaattcca

SEQ ID NO: 3434315 - DNA, 19 bp, Homo sapiens
ctactcataagttggacca

SEQ ID NO: 3434316 - DNA, 21 bp, Homo sapiens
ctactcgggaggctgaggcgg

SEQ ID NO: 3434317 - DNA, 12 bp, Homo sapiens
ctactctcctca

SEQ ID NO: 3434318 - DNA, 11 bp, Homo sapiens
ctactctgatc

SEQ ID NO: 3434319 - DNA, 14 bp, Homo sapiens
ctactctgatccct

SEQ ID NO: 3434320 - DNA, 13 bp, Homo sapiens
ctactctgtgtca

SEQ ID NO: 3434321 - DNA, 15 bp, Homo sapiens
ctactctgttccttc

SEQ ID NO: 3434322 - DNA, 16 bp, Homo sapiens
ctactctgttccttca

SEQ ID NO: 3434323 - DNA, 21 bp, Homo sapiens
ctactgccgtcagtgctgtgc

SEQ ID NO: 3434324 - DNA, 16 bp, Homo sapiens
ctactgtaattttata

SEQ ID NO: 3434325 - DNA, 19 bp, Homo sapiens
ctactgtcctacccaccct

SEQ ID NO: 3434326 - DNA, 17 bp, Homo sapiens
ctacttacccaggtggg

SEQ ID NO: 3434327 - DNA, 19 bp, Homo sapiens
ctacttcattttcagagtg

SEQ ID NO: 3434328 - DNA, 22 bp, Homo sapiens
ctacttctttgctttgcccagc

SEQ ID NO: 3434329 - DNA, 14 bp, Homo sapiens
ctacttggtttgtg

SEQ ID NO: 3434330 - DNA, 15 bp, Homo sapiens
ctactttagccactg

SEQ ID NO: 3434331 - DNA, 20 bp, Homo sapiens
ctactttgttaggattttca

SEQ ID NO: 3434332 - DNA, 14 bp, Homo sapiens
ctagaaacttccaa

SEQ ID NO: 3434333 - DNA, 12 bp, Homo sapiens
ctagaaattttc

SEQ ID NO: 3434334 - DNA, 13 bp, Homo sapiens
ctagaaattttca

SEQ ID NO: 3434335 - DNA, 18 bp, Homo sapiens
ctagaacatccctgccag

SEQ ID NO: 3434336 - DNA, 17 bp, Homo sapiens
ctagaataatcttgctc

SEQ ID NO: 3434337 - DNA, 13 bp, Homo sapiens
ctagaatttattc

SEQ ID NO: 3434338 - DNA, 13 bp, Homo sapiens
ctagactcggggt

SEQ ID NO: 3434339 - DNA, 16 bp, Homo sapiens
ctagactcggggtgct

SEQ ID NO: 3434340 - DNA, 21 bp, Homo sapiens
ctagactttaggctttcagct

SEQ ID NO: 3434341 - DNA, 16 bp, Homo sapiens
ctagagaacaggtggt

SEQ ID NO: 3434342 - DNA, 12 bp, Homo sapiens
ctagagagggag

SEQ ID NO: 3434343 - DNA, 21 bp, Homo sapiens
ctagagagggaggcaagccct

SEQ ID NO: 3434344 - DNA, 18 bp, Homo sapiens
ctagagcactgccaccag

SEQ ID NO: 3434345 - DNA, 13 bp, Homo sapiens
ctagagcctcttg

SEQ ID NO: 3434346 - DNA, 21 bp, Homo sapiens
ctagagcctcttggggaaggg

SEQ ID NO: 3434347 - DNA, 16 bp, Homo sapiens
ctagagccttcagcct

SEQ ID NO: 3434348 - DNA, 20 bp, Homo sapiens
ctagaggccctttgctgtcc

SEQ ID NO: 3434349 - DNA, 16 bp, Homo sapiens
ctagagggaggggcct

SEQ ID NO: 3434350 - DNA, 22 bp, Homo sapiens
ctagagggaggggcctaggcct

SEQ ID NO: 3434351 - DNA, 17 bp, Homo sapiens
ctagagtgaacttgggc

SEQ ID NO: 3434352 - DNA, 21 bp, Homo sapiens
ctagagtgaacttgggccact

SEQ ID NO: 3434353 - DNA, 16 bp, Homo sapiens
ctagatacaataaatt

SEQ ID NO: 3434354 - DNA, 17 bp, Homo sapiens
ctagatacaataaattg

SEQ ID NO: 3434355 - DNA, 23 bp, Homo sapiens
ctagatacaataaattgctaatg

SEQ ID NO: 3434356 - DNA, 14 bp, Homo sapiens
ctagatatcgactt

SEQ ID NO: 3434357 - DNA, 17 bp, Homo sapiens
ctagatgaagttttaca

SEQ ID NO: 3434358 - DNA, 16 bp, Homo sapiens
ctagatggctcctctc

SEQ ID NO: 3434359 - DNA, 16 bp, Homo sapiens
ctagatggtgctgaga

SEQ ID NO: 3434360 - DNA, 22 bp, Homo sapiens
ctagatggtgctgagaagcttt

SEQ ID NO: 3434361 - DNA, 14 bp, Homo sapiens
ctagcacatgcttc

SEQ ID NO: 3434362 - DNA, 15 bp, Homo sapiens
ctagcacatgcttca

SEQ ID NO: 3434363 - DNA, 13 bp, Homo sapiens
ctagcagctgcag

SEQ ID NO: 3434364 - DNA, 16 bp, Homo sapiens
ctagcaggcacaggac

SEQ ID NO: 3434365 - DNA, 17 bp, Homo sapiens
ctagcaggcacaggaca

SEQ ID NO: 3434366 - DNA, 18 bp, Homo sapiens
ctagcaggcacaggacac

SEQ ID NO: 3434367 - DNA, 14 bp, Homo sapiens
ctagcatatctgcc

SEQ ID NO: 3434368 - DNA, 15 bp, Homo sapiens
ctagcccctggggtg

SEQ ID NO: 3434369 - DNA, 16 bp, Homo sapiens
ctagccctctccctct

SEQ ID NO: 3434370 - DNA, 16 bp, Homo sapiens
ctagccggttcctgtc

SEQ ID NO: 3434371 - DNA, 22 bp, Homo sapiens
ctagccttagaagtcacacagt

SEQ ID NO: 3434372 - DNA, 23 bp, Homo sapiens
ctagccttagaagtcacacagta

SEQ ID NO: 3434373 - DNA, 16 bp, Homo sapiens
ctagctagctcaacta

SEQ ID NO: 3434374 - DNA, 19 bp, Homo sapiens
ctagctgggggtgggccag

SEQ ID NO: 3434375 - DNA, 20 bp, Homo sapiens
ctagctgggggtgggccagg

SEQ ID NO: 3434376 - DNA, 18 bp, Homo sapiens
ctagctgttgagctgttt

SEQ ID NO: 3434377 - DNA, 17 bp, Homo sapiens
ctaggaaaaaaggaata

SEQ ID NO: 3434378 - DNA, 19 bp, Homo sapiens
ctaggaagagcaggactcc

SEQ ID NO: 3434379 - DNA, 23 bp, Homo sapiens
ctaggaagatctctgcagggccg

SEQ ID NO: 3434380 - DNA, 17 bp, Homo sapiens
ctaggacctatgttgta

SEQ ID NO: 3434381 - DNA, 22 bp, Homo sapiens
ctaggacgccacccagcaaaag

SEQ ID NO: 3434382 - DNA, 17 bp, Homo sapiens
ctaggacttcaaattgg

SEQ ID NO: 3434383 - DNA, 18 bp, Homo sapiens
ctaggagaaccaaatctg

SEQ ID NO: 3434384 - DNA, 16 bp, Homo sapiens
ctaggaggaaaaagaa

SEQ ID NO: 3434385 - DNA, 22 bp, Homo sapiens
ctaggatagctaactgtaaatc

SEQ ID NO: 3434386 - DNA, 13 bp, Homo sapiens
ctaggcaggacat

SEQ ID NO: 3434387 - DNA, 16 bp, Homo sapiens
ctaggcagtgggaggc

SEQ ID NO: 3434388 - DNA, 17 bp, Homo sapiens
ctaggcagtgggaggca

SEQ ID NO: 3434389 - DNA, 19 bp, Homo sapiens
ctaggcccccacttgcctc

SEQ ID NO: 3434390 - DNA, 13 bp, Homo sapiens
ctaggcctcagcc

SEQ ID NO: 3434391 - DNA, 15 bp, Homo sapiens
ctaggcctcagccag

SEQ ID NO: 3434392 - DNA, 17 bp, Homo sapiens
ctaggcctcagccagag

SEQ ID NO: 3434393 - DNA, 19 bp, Homo sapiens
ctaggcctcagccagagaa

SEQ ID NO: 3434394 - DNA, 14 bp, Homo sapiens
ctaggcctggccag

SEQ ID NO: 3434395 - DNA, 15 bp, Homo sapiens
ctaggcctggccaga

SEQ ID NO: 3434396 - DNA, 13 bp, Homo sapiens
ctaggcctgggga

SEQ ID NO: 3434397 - DNA, 23 bp, Homo sapiens
ctaggctgccccgggtccccagc

SEQ ID NO: 3434398 - DNA, 13 bp, Homo sapiens
ctaggctggggaa

SEQ ID NO: 3434399 - DNA, 22 bp, Homo sapiens
ctaggctggggaagtcctctgg

SEQ ID NO: 3434400 - DNA, 14 bp, Homo sapiens
ctagggagccatgt

SEQ ID NO: 3434401 - DNA, 17 bp, Homo sapiens
ctagggatccctcatct

SEQ ID NO: 3434402 - DNA, 23 bp, Homo sapiens
ctagggatccctcatctgtccct

SEQ ID NO: 3434403 - DNA, 15 bp, Homo sapiens
ctaggtagggtttaa

SEQ ID NO: 3434404 - DNA, 14 bp, Homo sapiens
ctaggtgacagagt

SEQ ID NO: 3434405 - DNA, 17 bp, Homo sapiens
ctaggtggcaaggctgt

SEQ ID NO: 3434406 - DNA, 16 bp, Homo sapiens
ctagtaaaaatacaaa

SEQ ID NO: 3434407 - DNA, 16 bp, Homo sapiens
ctagtcaagctcctcc

SEQ ID NO: 3434408 - DNA, 23 bp, Homo sapiens
ctagtcaagctcctcctccctgc

SEQ ID NO: 3434409 - DNA, 20 bp, Homo sapiens
ctagtcaatcaagtctgttt

SEQ ID NO: 3434410 - DNA, 21 bp, Homo sapiens
ctagtcaatcaagtctgttta

SEQ ID NO: 3434411 - DNA, 17 bp, Homo sapiens
ctagtgccttctaaagg

SEQ ID NO: 3434412 - DNA, 22 bp, Homo sapiens
ctagtgctttccttttttaaaa

SEQ ID NO: 3434413 - DNA, 23 bp, Homo sapiens
ctagtgctttccttttttaaaaa

SEQ ID NO: 3434414 - DNA, 19 bp, Homo sapiens
ctagtggggtttcctggca

SEQ ID NO: 3434415 - DNA, 19 bp, Homo sapiens
ctagtgtacctcctctcag

SEQ ID NO: 3434416 - DNA, 18 bp, Homo sapiens
ctagtgttctgtttgtta

SEQ ID NO: 3434417 - DNA, 14 bp, Homo sapiens
ctagtgttgcttgg

SEQ ID NO: 3434418 - DNA, 15 bp, Homo sapiens
ctagttctgtagaaa

SEQ ID NO: 3434419 - DNA, 16 bp, Homo sapiens
ctagttctgtagaaat

SEQ ID NO: 3434420 - DNA, 22 bp, Homo sapiens
ctagttctttgttcatagccca

SEQ ID NO: 3434421 - DNA, 15 bp, Homo sapiens
ctagtttgctttttg

SEQ ID NO: 3434422 - DNA, 20 bp, Homo sapiens
ctagttttcagtttgtatat

SEQ ID NO: 3434423 - DNA, 12 bp, Homo sapiens
ctataaaagctt

SEQ ID NO: 3434424 - DNA, 16 bp, Homo sapiens
ctataaaatgtcttca

SEQ ID NO: 3434425 - DNA, 19 bp, Homo sapiens
ctataaaatgtcttcaagg

SEQ ID NO: 3434426 - DNA, 13 bp, Homo sapiens
ctataaagagaag

SEQ ID NO: 3434427 - DNA, 19 bp, Homo sapiens
ctataaagagaagacgaaa

SEQ ID NO: 3434428 - DNA, 19 bp, Homo sapiens
ctataaagctagatgcttt

SEQ ID NO: 3434429 - DNA, 22 bp, Homo sapiens
ctataaatcaacaccttaatat

SEQ ID NO: 3434430 - DNA, 15 bp, Homo sapiens
ctataaattcctctt

SEQ ID NO: 3434431 - DNA, 22 bp, Homo sapiens
ctataaattcctctttgctttg

SEQ ID NO: 3434432 - DNA, 15 bp, Homo sapiens
ctcatgttctgcttt

SEQ ID NO: 3434433 - DNA, 16 bp, Homo sapiens
ctcatgttttcaactg

SEQ ID NO: 3434434 - DNA, 18 bp, Homo sapiens
ctcatgttttcaactgcc

SEQ ID NO: 3434435 - DNA, 19 bp, Homo sapiens
ctcattcaaaagttgaaat

SEQ ID NO: 3434436 - DNA, 18 bp, Homo sapiens
ctcattccctccccagaa

SEQ ID NO: 3434437 - DNA, 15 bp, Homo sapiens
ctcattcctgttctt

SEQ ID NO: 3434438 - DNA, 11 bp, Homo sapiens
ctcattctgaa

SEQ ID NO: 3434439 - DNA, 17 bp, Homo sapiens
ctcattctgaaggagcc

SEQ ID NO: 3434440 - DNA, 14 bp, Homo sapiens
ctcattcttctgta

SEQ ID NO: 3434441 - DNA, 15 bp, Homo sapiens
ctcattgctgagcct

SEQ ID NO: 3434442 - DNA, 18 bp, Homo sapiens
ctcattgctgagcctctg

SEQ ID NO: 3434443 - DNA, 20 bp, Homo sapiens
ctcattgctgagcctctgct

SEQ ID NO: 3434444 - DNA, 13 bp, Homo sapiens
ctcattggaccct

SEQ ID NO: 3434445 - DNA, 17 bp, Homo sapiens
ctcatttcacccctccc

SEQ ID NO: 3434446 - DNA, 19 bp, Homo sapiens
ctcatttcacccctccctt

SEQ ID NO: 3434447 - DNA, 23 bp, Homo sapiens
ctccaaactgaagcagcctctcc

SEQ ID NO: 3434448 - DNA, 14 bp, Homo sapiens
ctccaaactgatta

SEQ ID NO: 3434449 - DNA, 15 bp, Homo sapiens
ctccaaagatgactt

SEQ ID NO: 3434450 - DNA, 22 bp, Homo sapiens
ctccaaagatgacttcccctgc

SEQ ID NO: 3434451 - DNA, 17 bp, Homo sapiens
ctccaaccccccagcac

SEQ ID NO: 3434452 - DNA, 18 bp, Homo sapiens
ctccaaccccccagcact

SEQ ID NO: 3434453 - DNA, 19 bp, Homo sapiens
ctccaaccccccagcactg

SEQ ID NO: 3434454 - DNA, 18 bp, Homo sapiens
ctccaacctggggggcag

SEQ ID NO: 3434455 - DNA, 16 bp, Homo sapiens
ctccaactcagaaggg

SEQ ID NO: 3434456 - DNA, 13 bp, Homo sapiens
ctccaagccagcg

SEQ ID NO: 3434457 - DNA, 17 bp, Homo sapiens
ctccacaacctcttccc

SEQ ID NO: 3434458 - DNA, 22 bp, Homo sapiens
ctccacaacctcttccccccaa

SEQ ID NO: 3434459 - DNA, 19 bp, Homo sapiens
ctccacagcaaccccaggc

SEQ ID NO: 3434460 - DNA, 13 bp, Homo sapiens
ctccacatcctcc

SEQ ID NO: 3434461 - DNA, 13 bp, Homo sapiens
ctccaccaggaac

SEQ ID NO: 3434462 - DNA, 14 bp, Homo sapiens
ctccaccaggaacc

SEQ ID NO: 3434463 - DNA, 15 bp, Homo sapiens
ctccacgttctgctc

SEQ ID NO: 3434464 - DNA, 17 bp, Homo sapiens
ctccacgttctgctcat

SEQ ID NO: 3434465 - DNA, 18 bp, Homo sapiens
ctccacgttctgctcatc

SEQ ID NO: 3434466 - DNA, 15 bp, Homo sapiens
ctccactctccccca

SEQ ID NO: 3434467 - DNA, 16 bp, Homo sapiens
ctccactctcccccac

SEQ ID NO: 3434468 - DNA, 14 bp, Homo sapiens
ctccactctctacc

SEQ ID NO: 3434469 - DNA, 13 bp, Homo sapiens
ctccactctgctt

SEQ ID NO: 3434470 - DNA, 14 bp, Homo sapiens
ctccactctgcttc

SEQ ID NO: 3434471 - DNA, 16 bp, Homo sapiens
ctccactctgcttctc

SEQ ID NO: 3434472 - DNA, 15 bp, Homo sapiens
ctccactgctctcag

SEQ ID NO: 3434473 - DNA, 19 bp, Homo sapiens
ctccactgctctcagcctc

SEQ ID NO: 3434474 - DNA, 14 bp, Homo sapiens
ctccagacctgatc

SEQ ID NO: 3434475 - DNA, 19 bp, Homo sapiens
ctccagacctgatcctgga

SEQ ID NO: 3434476 - DNA, 20 bp, Homo sapiens
ctccagagggcactctgctt

SEQ ID NO: 3434477 - DNA, 21 bp, Homo sapiens
ctccagagggcactctgcttg

SEQ ID NO: 3434478 - DNA, 20 bp, Homo sapiens
ctccagagtggggatgacat

SEQ ID NO: 3434479 - DNA, 18 bp, Homo sapiens
ctccagatgcagggcagt

SEQ ID NO: 3434480 - DNA, 19 bp, Homo sapiens
ctccagccaaacgggagct

SEQ ID NO: 3434481 - DNA, 23 bp, Homo sapiens
ctccagccaaacgggagcttttg

SEQ ID NO: 3434482 - DNA, 19 bp, Homo sapiens
ctccagccccttctcagaa

SEQ ID NO: 3434483 - DNA, 14 bp, Homo sapiens
ctccagcctcagct

SEQ ID NO: 3434484 - DNA, 11 bp, Homo sapiens
ctccagcctga

SEQ ID NO: 3434485 - DNA, 17 bp, Homo sapiens
ctccagcctgcctggca

SEQ ID NO: 3434486 - DNA, 18 bp, Homo sapiens
ctccagctcaccagcccc

SEQ ID NO: 3434487 - DNA, 15 bp, Homo sapiens
ctccagctctttcct

SEQ ID NO: 3434488 - DNA, 14 bp, Homo sapiens
ctccagctgccccg

SEQ ID NO: 3434489 - DNA, 13 bp, Homo sapiens
ctccagctgttca

SEQ ID NO: 3434490 - DNA, 18 bp, Homo sapiens
ctccagctgttcagctgg

SEQ ID NO: 3434491 - DNA, 12 bp, Homo sapiens
ctccaggaacca

SEQ ID NO: 3434492 - DNA, 15 bp, Homo sapiens
ctccaggaagaaaga

SEQ ID NO: 3434493 - DNA, 17 bp, Homo sapiens
ctccaggagcctacccc

SEQ ID NO: 3434494 - DNA, 13 bp, Homo sapiens
ctccaggagctgc

SEQ ID NO: 3434495 - DNA, 11 bp, Homo sapiens
ctccaggccca

SEQ ID NO: 3434496 - DNA, 23 bp, Homo sapiens
ctccaggctcctttagcgcccag

SEQ ID NO: 3434497 - DNA, 23 bp, Homo sapiens
ctccaggctgtatcccatgagcc

SEQ ID NO: 3434498 - DNA, 22 bp, Homo sapiens
ctccagggatgattcaagccat

SEQ ID NO: 3434499 - DNA, 17 bp, Homo sapiens
ctccagggctggactga

SEQ ID NO: 3434500 - DNA, 18 bp, Homo sapiens
ctccagggctggactgag

SEQ ID NO: 3434501 - DNA, 20 bp, Homo sapiens
ctccagggctggactgaggc

SEQ ID NO: 3434502 - DNA, 14 bp, Homo sapiens
ctccaggggctgct

SEQ ID NO: 3434503 - DNA, 18 bp, Homo sapiens
ctccaggggctgcttcct

SEQ ID NO: 3434504 - DNA, 22 bp, Homo sapiens
ctccaggggctgcttcctcctg

SEQ ID NO: 3434505 - DNA, 19 bp, Homo sapiens
ctccaggggggacaatatg

SEQ ID NO: 3434506 - DNA, 22 bp, Homo sapiens
ctccaggggtcctaggcctcaa

SEQ ID NO: 3434507 - DNA, 20 bp, Homo sapiens
ctccagggtcagaaacagga

SEQ ID NO: 3434508 - DNA, 12 bp, Homo sapiens
ctccaggtacct

SEQ ID NO: 3434509 - DNA, 17 bp, Homo sapiens
ctccaggtaccttgacc

SEQ ID NO: 3434510 - DNA, 19 bp, Homo sapiens
ctccaggtaccttgacctt

SEQ ID NO: 3434511 - DNA, 23 bp, Homo sapiens
ctccagtagtggacaacaggttt

SEQ ID NO: 3434512 - DNA, 15 bp, Homo sapiens
ctccagtttccccat

SEQ ID NO: 3434513 - DNA, 19 bp, Homo sapiens
ctccatcagttagagctga

SEQ ID NO: 3434514 - DNA, 13 bp, Homo sapiens
ctccatccaaggc

SEQ ID NO: 3434515 - DNA, 14 bp, Homo sapiens
ctccatccaaggcc

SEQ ID NO: 3434516 - DNA, 20 bp, Homo sapiens
ctccatccacatgggagccg

SEQ ID NO: 3434517 - DNA, 23 bp, Homo sapiens
ctccatccccctttaccctcttt

SEQ ID NO: 3434518 - DNA, 21 bp, Homo sapiens
ctccatcctgtttgtatgaaa

SEQ ID NO: 3434519 - DNA, 21 bp, Homo sapiens
ctccatctctcatcctccagt

SEQ ID NO: 3434520 - DNA, 15 bp, Homo sapiens
ctccatggccctgcc

SEQ ID NO: 3434521 - DNA, 20 bp, Homo sapiens
ctccattatccattcccaag

SEQ ID NO: 3434522 - DNA, 21 bp, Homo sapiens
ctccattttagcccagtgttt

SEQ ID NO: 3434523 - DNA, 18 bp, Homo sapiens
ctcccaaacgccctttcc

SEQ ID NO: 3434524 - DNA, 18 bp, Homo sapiens
ctcccaaagtgctgggat

SEQ ID NO: 3434525 - DNA, 21 bp, Homo sapiens
ctcccaacatgcttgatgttt

SEQ ID NO: 3434526 - DNA, 19 bp, Homo sapiens
ctcccaagctggctggggt

SEQ ID NO: 3434527 - DNA, 14 bp, Homo sapiens
ctcccaagggatgg

SEQ ID NO: 3434528 - DNA, 18 bp, Homo sapiens
ctcccaaggttggagccc

SEQ ID NO: 3434529 - DNA, 19 bp, Homo sapiens
ctcccaatttcagactccc

SEQ ID NO: 3434530 - DNA, 15 bp, Homo sapiens
ctcccacactcccaa

SEQ ID NO: 3434531 - DNA, 19 bp, Homo sapiens
ctcccacccccatctctcc

SEQ ID NO: 3434532 - DNA, 19 bp, Homo sapiens
ctcccacccggctgcagag

SEQ ID NO: 3434533 - DNA, 18 bp, Homo sapiens
ctcccacctagcagcacc

SEQ ID NO: 3434534 - DNA, 13 bp, Homo sapiens
ctcccacctcagc

SEQ ID NO: 3434535 - DNA, 16 bp, Homo sapiens
ctcccagaacacactc

SEQ ID NO: 3434536 - DNA, 22 bp, Homo sapiens
ctcccagagctggtggacccag

SEQ ID NO: 3434537 - DNA, 11 bp, Homo sapiens
ctcccagcctc

SEQ ID NO: 3434538 - DNA, 21 bp, Homo sapiens
ctcccaggactctgaccccag

SEQ ID NO: 3434539 - DNA, 17 bp, Homo sapiens
ctcccaggtgcagccag

SEQ ID NO: 3434540 - DNA, 23 bp, Homo sapiens
ctcccaggtgcagccagaggcac

SEQ ID NO: 3434541 - DNA, 14 bp, Homo sapiens
ctcccattcctgaa

SEQ ID NO: 3434542 - DNA, 19 bp, Homo sapiens
ctcccattcctgaagaacc

SEQ ID NO: 3434543 - DNA, 20 bp, Homo sapiens
ctccccaatgagacttgcct

SEQ ID NO: 3434544 - DNA, 12 bp, Homo sapiens
ctccccagcaag

SEQ ID NO: 3434545 - DNA, 20 bp, Homo sapiens
ctccccagcaagtgagagct

SEQ ID NO: 3434546 - DNA, 21 bp, Homo sapiens
ctccccagcattccagcccct

SEQ ID NO: 3434547 - DNA, 13 bp, Homo sapiens
ctccccagcccag

SEQ ID NO: 3434548 - DNA, 18 bp, Homo sapiens
ctccccaggactcaccct

SEQ ID NO: 3434549 - DNA, 19 bp, Homo sapiens
ctccccaggtccagctctg

SEQ ID NO: 3434550 - DNA, 12 bp, Homo sapiens
ctccccatggag

SEQ ID NO: 3434551 - DNA, 19 bp, Homo sapiens
ctccccattcacagagcct

SEQ ID NO: 3434552 - DNA, 13 bp, Homo sapiens
ctcccccaggcct

SEQ ID NO: 3434553 - DNA, 15 bp, Homo sapiens
ctcccccaggcctga

SEQ ID NO: 3434554 - DNA, 18 bp, Homo sapiens
ctcccccaggcctgagct

SEQ ID NO: 3434555 - DNA, 13 bp, Homo sapiens
ctcccccccatgc

SEQ ID NO: 3434556 - DNA, 18 bp, Homo sapiens
ctcccccccatgcactgt

SEQ ID NO: 3434557 - DNA, 21 bp, Homo sapiens
ctcccccccatgcactgtgaa

SEQ ID NO: 3434558 - DNA, 15 bp, Homo sapiens
ctcccccgccctgcc

SEQ ID NO: 3434559 - DNA, 15 bp, Homo sapiens
ctcccctcttctgag

SEQ ID NO: 3434560 - DNA, 22 bp, Homo sapiens
ctcccctcttctgagctagttg

SEQ ID NO: 3434561 - DNA, 12 bp, Homo sapiens
ctcccctgccac

SEQ ID NO: 3434562 - DNA, 13 bp, Homo sapiens
ctcccctgccacc

SEQ ID NO: 3434563 - DNA, 18 bp, Homo sapiens
ctcccctgccaccaggcc

SEQ ID NO: 3434564 - DNA, 16 bp, Homo sapiens
ctcccctgccagggca

SEQ ID NO: 3434565 - DNA, 14 bp, Homo sapiens
ctctgcacaagctg

SEQ ID NO: 3434566 - DNA, 15 bp, Homo sapiens
ctctgcacaagctgc

SEQ ID NO: 3434567 - DNA, 18 bp, Homo sapiens
ctctgcaccgtactgtgg

SEQ ID NO: 3434568 - DNA, 20 bp, Homo sapiens
ctctgcagtccgtgggctgg

SEQ ID NO: 3434569 - DNA, 16 bp, Homo sapiens
ctctgcatttttctgc

SEQ ID NO: 3434570 - DNA, 14 bp, Homo sapiens
ctctgccctgtgta

SEQ ID NO: 3434571 - DNA, 15 bp, Homo sapiens
ctctgccgctacctc

SEQ ID NO: 3434572 - DNA, 15 bp, Homo sapiens
ctctgcctccctagc

SEQ ID NO: 3434573 - DNA, 14 bp, Homo sapiens
ctctgcctgacaag

SEQ ID NO: 3434574 - DNA, 18 bp, Homo sapiens
ctctgcctgacaaggcca

SEQ ID NO: 3434575 - DNA, 19 bp, Homo sapiens
ctctgcctgacaaggccag

SEQ ID NO: 3434576 - DNA, 13 bp, Homo sapiens
ctctgccttgcct

SEQ ID NO: 3434577 - DNA, 13 bp, Homo sapiens
ctctgctcctctc

SEQ ID NO: 3434578 - DNA, 13 bp, Homo sapiens
ctctgctgaagac

SEQ ID NO: 3434579 - DNA, 16 bp, Homo sapiens
ctctgctgaagacttg

SEQ ID NO: 3434580 - DNA, 17 bp, Homo sapiens
ctctgctgacagacaca

SEQ ID NO: 3434581 - DNA, 19 bp, Homo sapiens
ctctgctgacagacacagg

SEQ ID NO: 3434582 - DNA, 20 bp, Homo sapiens
ctctgctgacagacacaggc

SEQ ID NO: 3434583 - DNA, 18 bp, Homo sapiens
ctctgctggcccagccaa

SEQ ID NO: 3434584 - DNA, 14 bp, Homo sapiens
ctctgcttcccagg

SEQ ID NO: 3434585 - DNA, 15 bp, Homo sapiens
ctctgcttctctgac

SEQ ID NO: 3434586 - DNA, 19 bp, Homo sapiens
ctctgcttgacaacatctg

SEQ ID NO: 3434587 - DNA, 18 bp, Homo sapiens
ctctgcttgagtcaggtt

SEQ ID NO: 3434588 - DNA, 16 bp, Homo sapiens
ctctggacaaagcgtt

SEQ ID NO: 3434589 - DNA, 14 bp, Homo sapiens
ctctggacaggcat

SEQ ID NO: 3434590 - DNA, 14 bp, Homo sapiens
ctctggaggggagg

SEQ ID NO: 3434591 - DNA, 14 bp, Homo sapiens
ctctggagtggcca

SEQ ID NO: 3434592 - DNA, 15 bp, Homo sapiens
ctctggccaagggcc

SEQ ID NO: 3434593 - DNA, 16 bp, Homo sapiens
ctctggcgacagtttt

SEQ ID NO: 3434594 - DNA, 14 bp, Homo sapiens
ctctggcttggcct

SEQ ID NO: 3434595 - DNA, 16 bp, Homo sapiens
ctctggcttggcctat

SEQ ID NO: 3434596 - DNA, 14 bp, Homo sapiens
ctctgggagaaaat

SEQ ID NO: 3434597 - DNA, 20 bp, Homo sapiens
ctctgggccgggcctggggc

SEQ ID NO: 3434598 - DNA, 14 bp, Homo sapiens
ctctgggggctctg

SEQ ID NO: 3434599 - DNA, 15 bp, Homo sapiens
ctctgggggctctgg

SEQ ID NO: 3434600 - DNA, 17 bp, Homo sapiens
ctctgggtccttcctga

SEQ ID NO: 3434601 - DNA, 19 bp, Homo sapiens
ctctgtcagtcacagccac

SEQ ID NO: 3434602 - DNA, 19 bp, Homo sapiens
ctctgtccaggcactgaga

SEQ ID NO: 3434603 - DNA, 18 bp, Homo sapiens
ctctgtccccttctctca

SEQ ID NO: 3434604 - DNA, 13 bp, Homo sapiens
ctctgtcctggga

SEQ ID NO: 3434605 - DNA, 22 bp, Homo sapiens
ctctgtctgagtaagaaacaga

SEQ ID NO: 3434606 - DNA, 17 bp, Homo sapiens
ctctgtcttcacctgat

SEQ ID NO: 3434607 - DNA, 17 bp, Homo sapiens
ctctgtcttctggactg

SEQ ID NO: 3434608 - DNA, 17 bp, Homo sapiens
ctctgtgaccaatgtct

SEQ ID NO: 3434609 - DNA, 18 bp, Homo sapiens
ctctgtgaccaatgtctt

SEQ ID NO: 3434610 - DNA, 16 bp, Homo sapiens
ctctgtgccttctttt

SEQ ID NO: 3434611 - DNA, 17 bp, Homo sapiens
ctctgtgggtctctgga

SEQ ID NO: 3434612 - DNA, 17 bp, Homo sapiens
ctctgtgggtgatgggg

SEQ ID NO: 3434613 - DNA, 23 bp, Homo sapiens
ctctgtgtcaggtggggcagctt

SEQ ID NO: 3434614 - DNA, 18 bp, Homo sapiens
ctctgttcagtgtaaata

SEQ ID NO: 3434615 - DNA, 15 bp, Homo sapiens
ctctgttccatgtct

SEQ ID NO: 3434616 - DNA, 22 bp, Homo sapiens
ctctgttccttcacatcctgtg

SEQ ID NO: 3434617 - DNA, 19 bp, Homo sapiens
ctctgttgactggctgtgt

SEQ ID NO: 3434618 - DNA, 20 bp, Homo sapiens
ctctgttgcaagtgcaataa

SEQ ID NO: 3434619 - DNA, 22 bp, Homo sapiens
ctctgtttataaaaacaaaaac

SEQ ID NO: 3434620 - DNA, 16 bp, Homo sapiens
ctctgtttgtggggtg

SEQ ID NO: 3434621 - DNA, 14 bp, Homo sapiens
ctcttactctttcc

SEQ ID NO: 3434622 - DNA, 18 bp, Homo sapiens
ctcttactctttcctatt

SEQ ID NO: 3434623 - DNA, 18 bp, Homo sapiens
ctcttagcaaaaacatgt

SEQ ID NO: 3434624 - DNA, 18 bp, Homo sapiens
ctcttagctcccctccaa

SEQ ID NO: 3434625 - DNA, 17 bp, Homo sapiens
ctcttatagaatattta

SEQ ID NO: 3434626 - DNA, 19 bp, Homo sapiens
ctcttattgcccacgctgg

SEQ ID NO: 3434627 - DNA, 17 bp, Homo sapiens
ctcttcagttaattctt

SEQ ID NO: 3434628 - DNA, 18 bp, Homo sapiens
ctcttcagttaattctta

SEQ ID NO: 3434629 - DNA, 23 bp, Homo sapiens
ctcttcatgtctattccattccc

SEQ ID NO: 3434630 - DNA, 17 bp, Homo sapiens
ctcttccctcagtccca

SEQ ID NO: 3434631 - DNA, 18 bp, Homo sapiens
ctcttccgactctttctg

SEQ ID NO: 3434632 - DNA, 18 bp, Homo sapiens
ctcttccgggcagaaaca

SEQ ID NO: 3434633 - DNA, 16 bp, Homo sapiens
ctcttcctatttttgt

SEQ ID NO: 3434634 - DNA, 12 bp, Homo sapiens
ctcttctcattt

SEQ ID NO: 3434635 - DNA, 19 bp, Homo sapiens
ctcttctcatttcacccct

SEQ ID NO: 3434636 - DNA, 20 bp, Homo sapiens
ctcttctgccggccctgggg

SEQ ID NO: 3434637 - DNA, 20 bp, Homo sapiens
ctcttctggagatggaagct

SEQ ID NO: 3434638 - DNA, 11 bp, Homo sapiens
ctcttctggct

SEQ ID NO: 3434639 - DNA, 21 bp, Homo sapiens
ctcttcttattacccaaaccc

SEQ ID NO: 3434640 - DNA, 20 bp, Homo sapiens
ctcttctttcagacttgcca

SEQ ID NO: 3434641 - DNA, 22 bp, Homo sapiens
ctcttctttcagacttgccatg

SEQ ID NO: 3434642 - DNA, 18 bp, Homo sapiens
ctcttgacagaaagcagt

SEQ ID NO: 3434643 - DNA, 23 bp, Homo sapiens
ctcttgagtttgtcgctcatgtg

SEQ ID NO: 3434644 - DNA, 17 bp, Homo sapiens
ctcttgggccaagccag

SEQ ID NO: 3434645 - DNA, 18 bp, Homo sapiens
ctcttgggccaagccagc

SEQ ID NO: 3434646 - DNA, 19 bp, Homo sapiens
ctcttgggccaagccagct

SEQ ID NO: 3434647 - DNA, 20 bp, Homo sapiens
ctcttggggaaggggcacct

SEQ ID NO: 3434648 - DNA, 18 bp, Homo sapiens
ctcttgtaaataaagccc

SEQ ID NO: 3434649 - DNA, 24 bp, Homo sapiens
ctcttgtaaataaagccctgggat

SEQ ID NO: 3434650 - DNA, 20 bp, Homo sapiens
ctcttgtgaggaaagtcatt

SEQ ID NO: 3434651 - DNA, 20 bp, Homo sapiens
ctctttaatgtcacaggcag

SEQ ID NO: 3434652 - DNA, 22 bp, Homo sapiens
ctctttaatgtcacaggcaggt

SEQ ID NO: 3434653 - DNA, 19 bp, Homo sapiens
ctctttagagttagactgt

SEQ ID NO: 3434654 - DNA, 22 bp, Homo sapiens
ctctttcaagcagtcgtgcctg

SEQ ID NO: 3434655 - DNA, 15 bp, Homo sapiens
ctctttcacattgtt

SEQ ID NO: 3434656 - DNA, 19 bp, Homo sapiens
ctctttctgagtgccttct

SEQ ID NO: 3434657 - DNA, 13 bp, Homo sapiens
ctctttctgtata

SEQ ID NO: 3434658 - DNA, 15 bp, Homo sapiens
ctctttctgtatata

SEQ ID NO: 3434659 - DNA, 13 bp, Homo sapiens
ctctttgctttgc

SEQ ID NO: 3434660 - DNA, 15 bp, Homo sapiens
ctctttgctttgctt

SEQ ID NO: 3434661 - DNA, 16 bp, Homo sapiens
ctctttgctttgcttt

SEQ ID NO: 3434662 - DNA, 15 bp, Homo sapiens
ctctttggacactca

SEQ ID NO: 3434663 - DNA, 21 bp, Homo sapiens
ctctttgggaatgtttgtctc

SEQ ID NO: 3434664 - DNA, 17 bp, Homo sapiens
ctctttgtctaaaacaa

SEQ ID NO: 3434665 - DNA, 18 bp, Homo sapiens
ctctttgtctaaaacaat

SEQ ID NO: 3434666 - DNA, 14 bp, Homo sapiens
ctcttttacctgct

SEQ ID NO: 3434667 - DNA, 18 bp, Homo sapiens
ctcttttacctgctgctt

SEQ ID NO: 3434668 - DNA, 15 bp, Homo sapiens
ctcttttatatttgt

SEQ ID NO: 3434669 - DNA, 22 bp, Homo sapiens
ctcttttatatttgtaggagaa

SEQ ID NO: 3434670 - DNA, 13 bp, Homo sapiens
ctcttttcacagc

SEQ ID NO: 3434671 - DNA, 15 bp, Homo sapiens
ctcttttcacagcaa

SEQ ID NO: 3434672 - DNA, 20 bp, Homo sapiens
ctcttttcccctttcctgtc

SEQ ID NO: 3434673 - DNA, 17 bp, Homo sapiens
ctcttttctaaaagact

SEQ ID NO: 3434674 - DNA, 11 bp, Homo sapiens
ctctttttaag

SEQ ID NO: 3434675 - DNA, 22 bp, Homo sapiens
ctctttttaaggacactggggt

SEQ ID NO: 3434676 - DNA, 17 bp, Homo sapiens
ctgaaaacctctcctca

SEQ ID NO: 3434677 - DNA, 18 bp, Homo sapiens
ctgaaaagaaggaatata

SEQ ID NO: 3434678 - DNA, 16 bp, Homo sapiens
ctgaaacaacttggaa

SEQ ID NO: 3434679 - DNA, 11 bp, Homo sapiens
ctgaaacagct

SEQ ID NO: 3434680 - DNA, 16 bp, Homo sapiens
ctgaaagccctgagct

SEQ ID NO: 3434681 - DNA, 17 bp, Homo sapiens
ctgaaagccctgagctt

SEQ ID NO: 3434682 - DNA, 19 bp, Homo sapiens
ctgaaagccctgagctttc

SEQ ID NO: 3434683 - DNA, 17 bp, Homo sapiens
ctgaaagcggctgcctc

SEQ ID NO: 3434684 - DNA, 19 bp, Homo sapiens
ctgaaagtgaaagtccaga

SEQ ID NO: 3434685 - DNA, 23 bp, Homo sapiens
ctgaaagtgaaagtccagaaact

SEQ ID NO: 3434686 - DNA, 16 bp, Homo sapiens
ctgaaagtgacagaga

SEQ ID NO: 3434687 - DNA, 15 bp, Homo sapiens
ctgaaattctcctgg

SEQ ID NO: 3434688 - DNA, 17 bp, Homo sapiens
ctgaaattctcctggag

SEQ ID NO: 3434689 - DNA, 20 bp, Homo sapiens
ctgaacattagttgcactaa

SEQ ID NO: 3434690 - DNA, 13 bp, Homo sapiens
ctgaactcacttt

SEQ ID NO: 3434691 - DNA, 12 bp, Homo sapiens
ctgaactgagcc

SEQ ID NO: 3434692 - DNA, 19 bp, Homo sapiens
ctgaactgatgggtttctc

SEQ ID NO: 3434693 - DNA, 20 bp, Homo sapiens
ctgaactgtgtgtaattgtt

SEQ ID NO: 3434694 - DNA, 16 bp, Homo sapiens
ctgaactttgggaagc

SEQ ID NO: 3434695 - DNA, 15 bp, Homo sapiens
ctgaagaaccagtcc

SEQ ID NO: 3434696 - DNA, 16 bp, Homo sapiens
ctgaagagtcctctga

SEQ ID NO: 3434697 - DNA, 18 bp, Homo sapiens
ctgaagagtcctctgaat

SEQ ID NO: 3434698 - DNA, 20 bp, Homo sapiens
ctgcggtccacccaggagcc

SEQ ID NO: 3434699 - DNA, 15 bp, Homo sapiens
ctgcgtgcacttccc

SEQ ID NO: 3434700 - DNA, 20 bp, Homo sapiens
ctgcgtgccagtcaagaaga

SEQ ID NO: 3434701 - DNA, 21 bp, Homo sapiens
ctgctaaaatagaatatagca

SEQ ID NO: 3434702 - DNA, 22 bp, Homo sapiens
ctgctaaaatagaatatagcat

SEQ ID NO: 3434703 - DNA, 16 bp, Homo sapiens
ctgctaattccccaga

SEQ ID NO: 3434704 - DNA, 23 bp, Homo sapiens
ctgctacaaatactcttaggaag

SEQ ID NO: 3434705 - DNA, 21 bp, Homo sapiens
ctgctaccgttgacttccagg

SEQ ID NO: 3434706 - DNA, 19 bp, Homo sapiens
ctgctacctcccttgcctt

SEQ ID NO: 3434707 - DNA, 17 bp, Homo sapiens
ctgctactggcaaaagg

SEQ ID NO: 3434708 - DNA, 18 bp, Homo sapiens
ctgctactgtaattttat

SEQ ID NO: 3434709 - DNA, 14 bp, Homo sapiens
ctgctagctagctc

SEQ ID NO: 3434710 - DNA, 18 bp, Homo sapiens
ctgctagctagctcaact

SEQ ID NO: 3434711 - DNA, 16 bp, Homo sapiens
ctgctatcctgccaaa

SEQ ID NO: 3434712 - DNA, 17 bp, Homo sapiens
ctgctcagaacttgctg

SEQ ID NO: 3434713 - DNA, 16 bp, Homo sapiens
ctgctcagctctgggc

SEQ ID NO: 3434714 - DNA, 23 bp, Homo sapiens
ctgctcagctctggtccaggccc

SEQ ID NO: 3434715 - DNA, 18 bp, Homo sapiens
ctgctcagcttctcctgt

SEQ ID NO: 3434716 - DNA, 23 bp, Homo sapiens
ctgctcagggaaaagcagctctc

SEQ ID NO: 3434717 - DNA, 12 bp, Homo sapiens
ctgctcatcatt

SEQ ID NO: 3434718 - DNA, 16 bp, Homo sapiens
ctgctcatcattctct

SEQ ID NO: 3434719 - DNA, 22 bp, Homo sapiens
ctgctcatcattctctgtctca

SEQ ID NO: 3434720 - DNA, 22 bp, Homo sapiens
ctgctccagacctgatcctgga

SEQ ID NO: 3434721 - DNA, 22 bp, Homo sapiens
ctgctcctagagggaggggcct

SEQ ID NO: 3434722 - DNA, 14 bp, Homo sapiens
ctgctcctccctct

SEQ ID NO: 3434723 - DNA, 16 bp, Homo sapiens
ctgctcctctccccag

SEQ ID NO: 3434724 - DNA, 18 bp, Homo sapiens
ctgctcctctccccagca

SEQ ID NO: 3434725 - DNA, 22 bp, Homo sapiens
ctgctctagatgagctgggccg

SEQ ID NO: 3434726 - DNA, 14 bp, Homo sapiens
ctgctctcagcctc

SEQ ID NO: 3434727 - DNA, 17 bp, Homo sapiens
ctgctctcagcctccca

SEQ ID NO: 3434728 - DNA, 18 bp, Homo sapiens
ctgctctcagcctcccaa

SEQ ID NO: 3434729 - DNA, 15 bp, Homo sapiens
ctgctctccgaccag

SEQ ID NO: 3434730 - DNA, 13 bp, Homo sapiens
ctgctctccttcc

SEQ ID NO: 3434731 - DNA, 15 bp, Homo sapiens
ctgctctccttcctg

SEQ ID NO: 3434732 - DNA, 17 bp, Homo sapiens
ctgctctccttcctgga

SEQ ID NO: 3434733 - DNA, 12 bp, Homo sapiens
ctgctctggtta

SEQ ID NO: 3434734 - DNA, 12 bp, Homo sapiens
ctgctgacagtg

SEQ ID NO: 3434735 - DNA, 18 bp, Homo sapiens
ctgctgactgttttctct

SEQ ID NO: 3434736 - DNA, 21 bp, Homo sapiens
ctgctgactgttttctcttga

SEQ ID NO: 3434737 - DNA, 16 bp, Homo sapiens
ctgctgcatgccctct

SEQ ID NO: 3434738 - DNA, 17 bp, Homo sapiens
ctgctgcatgccctctc

SEQ ID NO: 3434739 - DNA, 15 bp, Homo sapiens
ctgctgccagggctt

SEQ ID NO: 3434740 - DNA, 17 bp, Homo sapiens
ctgctgccagggcttcc

SEQ ID NO: 3434741 - DNA, 19 bp, Homo sapiens
ctgctgctcctccctctga

SEQ ID NO: 3434742 - DNA, 14 bp, Homo sapiens
ctgctgctgcctgc

SEQ ID NO: 3434743 - DNA, 15 bp, Homo sapiens
ctgctggaaacagac

SEQ ID NO: 3434744 - DNA, 15 bp, Homo sapiens
ctgctggaagcccag

SEQ ID NO: 3434745 - DNA, 17 bp, Homo sapiens
ctgctggaggcctcagg

SEQ ID NO: 3434746 - DNA, 20 bp, Homo sapiens
ctgctggagtttcatgtaca

SEQ ID NO: 3434747 - DNA, 12 bp, Homo sapiens
ctgctggccaaa

SEQ ID NO: 3434748 - DNA, 16 bp, Homo sapiens
ctgctggtccgtggga

SEQ ID NO: 3434749 - DNA, 21 bp, Homo sapiens
ctgctggttaacttgtttggc

SEQ ID NO: 3434750 - DNA, 18 bp, Homo sapiens
ctgctgtcacctctccca

SEQ ID NO: 3434751 - DNA, 14 bp, Homo sapiens
ctgctgtccagtgc

SEQ ID NO: 3434752 - DNA, 19 bp, Homo sapiens
ctgctgtccagtgcctaca

SEQ ID NO: 3434753 - DNA, 15 bp, Homo sapiens
ctgctgtgaaccctg

SEQ ID NO: 3434754 - DNA, 22 bp, Homo sapiens
ctgctgtgaaccctggggcctg

SEQ ID NO: 3434755 - DNA, 22 bp, Homo sapiens
ctgctgttggtcctctctctgt

SEQ ID NO: 3434756 - DNA, 15 bp, Homo sapiens
ctgcttaaaaatgta

SEQ ID NO: 3434757 - DNA, 20 bp, Homo sapiens
ctgcttagaatccaaacttg

SEQ ID NO: 3434758 - DNA, 21 bp, Homo sapiens
ctgcttcactagggaatcctg

SEQ ID NO: 3434759 - DNA, 13 bp, Homo sapiens
ctgcttcagcctc

SEQ ID NO: 3434760 - DNA, 16 bp, Homo sapiens
ctgcttcagcctcccg

SEQ ID NO: 3434761 - DNA, 17 bp, Homo sapiens
ctgcttccaggctgggc

SEQ ID NO: 3434762 - DNA, 12 bp, Homo sapiens
ctgcttcccagg

SEQ ID NO: 3434763 - DNA, 18 bp, Homo sapiens
ctgcttcccatgcctgca

SEQ ID NO: 3434764 - DNA, 14 bp, Homo sapiens
ctgcttcctcctgg

SEQ ID NO: 3434765 - DNA, 18 bp, Homo sapiens
ctgcttcctcctggaaat

SEQ ID NO: 3434766 - DNA, 22 bp, Homo sapiens
ctgcttctccaaaaatctgcct

SEQ ID NO: 3434767 - DNA, 13 bp, Homo sapiens
ctgcttctctgac

SEQ ID NO: 3434768 - DNA, 15 bp, Homo sapiens
ctgcttctctgactt

SEQ ID NO: 3434769 - DNA, 23 bp, Homo sapiens
ctgcttctctgacttctgcctgg

SEQ ID NO: 3434770 - DNA, 13 bp, Homo sapiens
ctgcttgaggaaa

SEQ ID NO: 3434771 - DNA, 23 bp, Homo sapiens
ctgcttgatgggattctggacag

SEQ ID NO: 3434772 - DNA, 14 bp, Homo sapiens
ctgctttggcagtg

SEQ ID NO: 3434773 - DNA, 16 bp, Homo sapiens
ctgctttggcagtgcc

SEQ ID NO: 3434774 - DNA, 21 bp, Homo sapiens
ctgcttttccttggggcaggc

SEQ ID NO: 3434775 - DNA, 17 bp, Homo sapiens
ctgcttttggtctgtgt

SEQ ID NO: 3434776 - DNA, 22 bp, Homo sapiens
ctggaacactagacaagccaga

SEQ ID NO: 3434777 - DNA, 14 bp, Homo sapiens
ctggaacagattca

SEQ ID NO: 3434778 - DNA, 16 bp, Homo sapiens
ctggaacccagactca

SEQ ID NO: 3434779 - DNA, 19 bp, Homo sapiens
ctggaacccagactcagac

SEQ ID NO: 3434780 - DNA, 22 bp, Homo sapiens
ctggaacccagactcagacatt

SEQ ID NO: 3434781 - DNA, 15 bp, Homo sapiens
ctggaacctcagcct

SEQ ID NO: 3434782 - DNA, 17 bp, Homo sapiens
ctggaacctcagcctgg

SEQ ID NO: 3434783 - DNA, 16 bp, Homo sapiens
ctggaacctgcaaaaa

SEQ ID NO: 3434784 - DNA, 14 bp, Homo sapiens
ctggaacttgggga

SEQ ID NO: 3434785 - DNA, 18 bp, Homo sapiens
ctggaagaaaaaaaccac

SEQ ID NO: 3434786 - DNA, 22 bp, Homo sapiens
ctggaagagcccagtctgttga

SEQ ID NO: 3434787 - DNA, 12 bp, Homo sapiens
ctggaagcccag

SEQ ID NO: 3434788 - DNA, 14 bp, Homo sapiens
ctggaagcccagcc

SEQ ID NO: 3434789 - DNA, 17 bp, Homo sapiens
ctggaagctaatttgca

SEQ ID NO: 3434790 - DNA, 18 bp, Homo sapiens
ctggaagctaatttgcat

SEQ ID NO: 3434791 - DNA, 17 bp, Homo sapiens
ctggaaggggcccgtgg

SEQ ID NO: 3434792 - DNA, 20 bp, Homo sapiens
ctggaaggtggggacaggga

SEQ ID NO: 3434793 - DNA, 19 bp, Homo sapiens
ctggaagtccaatgtggca

SEQ ID NO: 3434794 - DNA, 15 bp, Homo sapiens
ctggaatctgaggca

SEQ ID NO: 3434795 - DNA, 16 bp, Homo sapiens
ctggaatctgaggcat

SEQ ID NO: 3434796 - DNA, 23 bp, Homo sapiens
ctggaatctgaggcatcctctga

SEQ ID NO: 3434797 - DNA, 17 bp, Homo sapiens
ctggaatctggagacca

SEQ ID NO: 3434798 - DNA, 18 bp, Homo sapiens
ctggaatctggagaccag

SEQ ID NO: 3434799 - DNA, 13 bp, Homo sapiens
ctggacaaagaat

SEQ ID NO: 3434800 - DNA, 19 bp, Homo sapiens
ctggacagtatcactgtct

SEQ ID NO: 3434801 - DNA, 23 bp, Homo sapiens
ctggacatgaagattctttccca

SEQ ID NO: 3434802 - DNA, 17 bp, Homo sapiens
ctggaccagacaatgtt

SEQ ID NO: 3434803 - DNA, 17 bp, Homo sapiens
ctggaccctgttgctaa

SEQ ID NO: 3434804 - DNA, 18 bp, Homo sapiens
ctggaccctgttgctaag

SEQ ID NO: 3434805 - DNA, 21 bp, Homo sapiens
ctggaccttgaactgggtact

SEQ ID NO: 3434806 - DNA, 13 bp, Homo sapiens
ctggactccggcc

SEQ ID NO: 3434807 - DNA, 15 bp, Homo sapiens
ctggactccggccct

SEQ ID NO: 3434808 - DNA, 18 bp, Homo sapiens
ctggactccggccctcct

SEQ ID NO: 3434809 - DNA, 19 bp, Homo sapiens
ctggactcctgccaccagc

SEQ ID NO: 3434810 - DNA, 20 bp, Homo sapiens
ctggactctcagtctctgag

SEQ ID NO: 3434811 - DNA, 12 bp, Homo sapiens
ctggactgaggc

SEQ ID NO: 3434812 - DNA, 17 bp, Homo sapiens
ctggagaccagggagcc

SEQ ID NO: 3434813 - DNA, 18 bp, Homo sapiens
ctggagactcctaggcag

SEQ ID NO: 3434814 - DNA, 16 bp, Homo sapiens
ctggagatcctcctgc

SEQ ID NO: 3434815 - DNA, 22 bp, Homo sapiens
ctggagatggaagcttgttgaa

SEQ ID NO: 3434816 - DNA, 23 bp, Homo sapiens
ctggagatggaagcttgttgaaa

SEQ ID NO: 3434817 - DNA, 19 bp, Homo sapiens
ctggagcaatcacagatga

SEQ ID NO: 3434818 - DNA, 17 bp, Homo sapiens
ctggagcactgggctcc

SEQ ID NO: 3434819 - DNA, 23 bp, Homo sapiens
ctggagcactgggctcccgggcc

SEQ ID NO: 3434820 - DNA, 16 bp, Homo sapiens
ctggagcccagaggag

SEQ ID NO: 3434821 - DNA, 17 bp, Homo sapiens
ctggagcccagaggagg

SEQ ID NO: 3434822 - DNA, 23 bp, Homo sapiens
ctggagcctccgacgctgcctct

SEQ ID NO: 3434823 - DNA, 15 bp, Homo sapiens
ctggagcctggtgcc

SEQ ID NO: 3434824 - DNA, 18 bp, Homo sapiens
ctggaggaaagggaggag

SEQ ID NO: 3434825 - DNA, 20 bp, Homo sapiens
ctggaggaaagggaggagtg

SEQ ID NO: 3434826 - DNA, 21 bp, Homo sapiens
ctggaggcccagttcaccctg

SEQ ID NO: 3434827 - DNA, 14 bp, Homo sapiens
ctggaggcctcagg

SEQ ID NO: 3434828 - DNA, 18 bp, Homo sapiens
ctggaggcctcaggtgct

SEQ ID NO: 3434829 - DNA, 13 bp, Homo sapiens
ctggaggggaggg

SEQ ID NO: 3434830 - DNA, 17 bp, Homo sapiens
ctggggaaggagccagt

SEQ ID NO: 3434831 - DNA, 16 bp, Homo sapiens
ctggggacagcaaggg

SEQ ID NO: 3434832 - DNA, 12 bp, Homo sapiens
ctggggacccac

SEQ ID NO: 3434833 - DNA, 16 bp, Homo sapiens
ctggggccggggctga

SEQ ID NO: 3434834 - DNA, 12 bp, Homo sapiens
ctggggcctcca

SEQ ID NO: 3434835 - DNA, 15 bp, Homo sapiens
ctggggctggcctcc

SEQ ID NO: 3434836 - DNA, 15 bp, Homo sapiens
ctgggggaagaagct

SEQ ID NO: 3434837 - DNA, 20 bp, Homo sapiens
ctgggggacccaatgtagga

SEQ ID NO: 3434838 - DNA, 19 bp, Homo sapiens
ctgggggacccctggctct

SEQ ID NO: 3434839 - DNA, 23 bp, Homo sapiens
ctgggggacccctggctctgggc

SEQ ID NO: 3434840 - DNA, 13 bp, Homo sapiens
ctgggggcctcag

SEQ ID NO: 3434841 - DNA, 22 bp, Homo sapiens
ctgggggctctggccaagggcc

SEQ ID NO: 3434842 - DNA, 14 bp, Homo sapiens
ctgggggtgccagg

SEQ ID NO: 3434843 - DNA, 17 bp, Homo sapiens
ctgggggtgggccaggc

SEQ ID NO: 3434844 - DNA, 21 bp, Homo sapiens
ctggggtaccaagagactcct

SEQ ID NO: 3434845 - DNA, 16 bp, Homo sapiens
ctggggtcacttggga

SEQ ID NO: 3434846 - DNA, 13 bp, Homo sapiens
ctggggtctggag

SEQ ID NO: 3434847 - DNA, 15 bp, Homo sapiens
ctggggtggccacca

SEQ ID NO: 3434848 - DNA, 18 bp, Homo sapiens
ctggggtggcctgtgtgg

SEQ ID NO: 3434849 - DNA, 20 bp, Homo sapiens
ctggggtggggatagggagc

SEQ ID NO: 3434850 - DNA, 14 bp, Homo sapiens
ctggggtggggtca

SEQ ID NO: 3434851 - DNA, 20 bp, Homo sapiens
ctggggtggggtcatgccct

SEQ ID NO: 3434852 - DNA, 16 bp, Homo sapiens
ctggggtgtgggaggc

SEQ ID NO: 3434853 - DNA, 15 bp, Homo sapiens
ctggggttgtcagct

SEQ ID NO: 3434854 - DNA, 18 bp, Homo sapiens
ctggggttgtcagctctc

SEQ ID NO: 3434855 - DNA, 14 bp, Homo sapiens
ctgggtacttgtgg

SEQ ID NO: 3434856 - DNA, 20 bp, Homo sapiens
ctgggtacttgtggacacag

SEQ ID NO: 3434857 - DNA, 21 bp, Homo sapiens
ctgggtccaggggatgggagg

SEQ ID NO: 3434858 - DNA, 22 bp, Homo sapiens
ctgggtccaggggatgggaggt

SEQ ID NO: 3434859 - DNA, 15 bp, Homo sapiens
ctgggtccttcctga

SEQ ID NO: 3434860 - DNA, 20 bp, Homo sapiens
ctgggtggcaccagcagcct

SEQ ID NO: 3434861 - DNA, 21 bp, Homo sapiens
ctgggtggcaccagcagcctg

SEQ ID NO: 3434862 - DNA, 21 bp, Homo sapiens
ctgggtggtctgcaggcaggg

SEQ ID NO: 3434863 - DNA, 20 bp, Homo sapiens
ctgggttcactgcaacctcc

SEQ ID NO: 3434864 - DNA, 20 bp, Homo sapiens
ctgggttgctgctgtccagt

SEQ ID NO: 3434865 - DNA, 18 bp, Homo sapiens
ctgggtttctctgtatag

SEQ ID NO: 3434866 - DNA, 15 bp, Homo sapiens
ctgggtttgaagctg

SEQ ID NO: 3434867 - DNA, 23 bp, Homo sapiens
ctgggtttgaagctgctgtctct

SEQ ID NO: 3434868 - DNA, 14 bp, Homo sapiens
ctgggttttctgaa

SEQ ID NO: 3434869 - DNA, 20 bp, Homo sapiens
ctgggttttgtattctctga

SEQ ID NO: 3434870 - DNA, 15 bp, Homo sapiens
ctggtaatcttgctc

SEQ ID NO: 3434871 - DNA, 17 bp, Homo sapiens
ctggtagcctgcagaag

SEQ ID NO: 3434872 - DNA, 20 bp, Homo sapiens
ctggtattctgttctggagg

SEQ ID NO: 3434873 - DNA, 17 bp, Homo sapiens
ctggtcaaacaaactct

SEQ ID NO: 3434874 - DNA, 13 bp, Homo sapiens
ctggtcagagcca

SEQ ID NO: 3434875 - DNA, 21 bp, Homo sapiens
ctggtcagagccacagggtct

SEQ ID NO: 3434876 - DNA, 22 bp, Homo sapiens
ctggtccacagggcacctgcca

SEQ ID NO: 3434877 - DNA, 14 bp, Homo sapiens
ctggtcccactcag

SEQ ID NO: 3434878 - DNA, 15 bp, Homo sapiens
ctggtcccactcagt

SEQ ID NO: 3434879 - DNA, 15 bp, Homo sapiens
ctggtccgtgggacg

SEQ ID NO: 3434880 - DNA, 16 bp, Homo sapiens
ctggtccgtgggacgg

SEQ ID NO: 3434881 - DNA, 19 bp, Homo sapiens
ctggtccgtgggacggtgc

SEQ ID NO: 3434882 - DNA, 14 bp, Homo sapiens
ctggtcgctcctgc

SEQ ID NO: 3434883 - DNA, 18 bp, Homo sapiens
ctggtcgctcctgcccac

SEQ ID NO: 3434884 - DNA, 14 bp, Homo sapiens
ctggtctctaggct

SEQ ID NO: 3434885 - DNA, 16 bp, Homo sapiens
ctggtctctaggctgg

SEQ ID NO: 3434886 - DNA, 17 bp, Homo sapiens
ctggtcttcctttttgg

SEQ ID NO: 3434887 - DNA, 16 bp, Homo sapiens
ctggtcttgaagtcct

SEQ ID NO: 3434888 - DNA, 21 bp, Homo sapiens
ctggtcttgaagtcctggctt

SEQ ID NO: 3434889 - DNA, 17 bp, Homo sapiens
ctggtgcactttgtaaa

SEQ ID NO: 3434890 - DNA, 20 bp, Homo sapiens
ctggtgccccccacccctgg

SEQ ID NO: 3434891 - DNA, 14 bp, Homo sapiens
ctggtgctgcctct

SEQ ID NO: 3434892 - DNA, 14 bp, Homo sapiens
ctggtggcacagga

SEQ ID NO: 3434893 - DNA, 13 bp, Homo sapiens
ctggtggcagctg

SEQ ID NO: 3434894 - DNA, 22 bp, Homo sapiens
ctggtggcaggggcttctagct

SEQ ID NO: 3434895 - DNA, 14 bp, Homo sapiens
ctggtggcagtggg

SEQ ID NO: 3434896 - DNA, 18 bp, Homo sapiens
ctggtggcagtgggagct

SEQ ID NO: 3434897 - DNA, 13 bp, Homo sapiens
ctggtggcccagg

SEQ ID NO: 3434898 - DNA, 20 bp, Homo sapiens
ctggtggccccgtttctggt

SEQ ID NO: 3434899 - DNA, 21 bp, Homo sapiens
ctggtggccccgtttctggtg

SEQ ID NO: 3434900 - DNA, 15 bp, Homo sapiens
ctggtggcctctgca

SEQ ID NO: 3434901 - DNA, 13 bp, Homo sapiens
ctggtgggccaac

SEQ ID NO: 3434902 - DNA, 20 bp, Homo sapiens
ctggtggttgctgttttcct

SEQ ID NO: 3434903 - DNA, 18 bp, Homo sapiens
ctggtggtttgattgttt

SEQ ID NO: 3434904 - DNA, 20 bp, Homo sapiens
ctggtggtttgattgtttac

SEQ ID NO: 3434905 - DNA, 19 bp, Homo sapiens
ctggttaggatggcaggac

SEQ ID NO: 3434906 - DNA, 16 bp, Homo sapiens
ctggttataagcagca

SEQ ID NO: 3434907 - DNA, 13 bp, Homo sapiens
ctggttccagggt

SEQ ID NO: 3434908 - DNA, 22 bp, Homo sapiens
ctggttccagggtccctctgtg

SEQ ID NO: 3434909 - DNA, 21 bp, Homo sapiens
ctggttcggatttggggtgga

SEQ ID NO: 3434910 - DNA, 14 bp, Homo sapiens
ctggttctcatctt

SEQ ID NO: 3434911 - DNA, 21 bp, Homo sapiens
ctggttggctcccgcggtgcc

SEQ ID NO: 3434912 - DNA, 23 bp, Homo sapiens
ctggtttctcagaatccaaagat

SEQ ID NO: 3434913 - DNA, 22 bp, Homo sapiens
ctggtttgtggggcacagatgc

SEQ ID NO: 3434914 - DNA, 17 bp, Homo sapiens
ctggttttcacattaga

SEQ ID NO: 3434915 - DNA, 22 bp, Homo sapiens
ctgtaacctcttcagaggccct

SEQ ID NO: 3434916 - DNA, 19 bp, Homo sapiens
ctgtaagacgtatgtaaca

SEQ ID NO: 3434917 - DNA, 15 bp, Homo sapiens
ctgtaagatgtctgt

SEQ ID NO: 3434918 - DNA, 16 bp, Homo sapiens
ctgtaagatgtctgtt

SEQ ID NO: 3434919 - DNA, 18 bp, Homo sapiens
ctgtaagatgtctgtttg

SEQ ID NO: 3434920 - DNA, 21 bp, Homo sapiens
ctgtaagatgtctgtttgctg

SEQ ID NO: 3434921 - DNA, 22 bp, Homo sapiens
ctgtaagatgtctgtttgctga

SEQ ID NO: 3434922 - DNA, 13 bp, Homo sapiens
ctgtaatcccagc

SEQ ID NO: 3434923 - DNA, 19 bp, Homo sapiens
ctgtaatcctagcactttg

SEQ ID NO: 3434924 - DNA, 20 bp, Homo sapiens
ctgtaatcctagcactttgg

SEQ ID NO: 3434925 - DNA, 23 bp, Homo sapiens
ctgtaatttttattttcaccctc

SEQ ID NO: 3434926 - DNA, 17 bp, Homo sapiens
ctgtacaaatataagaa

SEQ ID NO: 3434927 - DNA, 20 bp, Homo sapiens
ctgtacaaatataagaataa

SEQ ID NO: 3434928 - DNA, 15 bp, Homo sapiens
ctgtacgtctgacag

SEQ ID NO: 3434929 - DNA, 13 bp, Homo sapiens
ctgtagagtggga

SEQ ID NO: 3434930 - DNA, 15 bp, Homo sapiens
ctgtagcctcagatg

SEQ ID NO: 3434931 - DNA, 18 bp, Homo sapiens
ctgtagggaattcttctg

SEQ ID NO: 3434932 - DNA, 20 bp, Homo sapiens
ctgtagggagggcggcaggg

SEQ ID NO: 3434933 - DNA, 21 bp, Homo sapiens
ctgtagggagggcggcagggg

SEQ ID NO: 3434934 - DNA, 20 bp, Homo sapiens
ctgtagtgtcactcaaggcg

SEQ ID NO: 3434935 - DNA, 15 bp, Homo sapiens
ctgtagttaggcctg

SEQ ID NO: 3434936 - DNA, 18 bp, Homo sapiens
ctgtagttgacaattctg

SEQ ID NO: 3434937 - DNA, 11 bp, Homo sapiens
ctgtataaaat

SEQ ID NO: 3434938 - DNA, 12 bp, Homo sapiens
ctgtataagtaa

SEQ ID NO: 3434939 - DNA, 17 bp, Homo sapiens
ctgtataagtaagaaaa

SEQ ID NO: 3434940 - DNA, 18 bp, Homo sapiens
ctgtataagtaagaaaat

SEQ ID NO: 3434941 - DNA, 19 bp, Homo sapiens
ctgtataagtaagaaaata

SEQ ID NO: 3434942 - DNA, 23 bp, Homo sapiens
ctgtatatacaataacataattt

SEQ ID NO: 3434943 - DNA, 13 bp, Homo sapiens
ctgtatatacttt

SEQ ID NO: 3434944 - DNA, 23 bp, Homo sapiens
ctgtatatttgtgatagcacttt

SEQ ID NO: 3434945 - DNA, 16 bp, Homo sapiens
ctgtatcaggacccag

SEQ ID NO: 3434946 - DNA, 22 bp, Homo sapiens
ctgtatcaggacccagaggaag

SEQ ID NO: 3434947 - DNA, 15 bp, Homo sapiens
ctgtatcccatgagc

SEQ ID NO: 3434948 - DNA, 18 bp, Homo sapiens
ctgtatcccatgagcctc

SEQ ID NO: 3434949 - DNA, 21 bp, Homo sapiens
ctgtatctactaaaaatacaa

SEQ ID NO: 3434950 - DNA, 19 bp, Homo sapiens
ctgtatcttgatgtttaga

SEQ ID NO: 3434951 - DNA, 18 bp, Homo sapiens
ctgtatcttgtttttcca

SEQ ID NO: 3434952 - DNA, 15 bp, Homo sapiens
ctgtatgctgatcat

SEQ ID NO: 3434953 - DNA, 20 bp, Homo sapiens
ctgtattcatatattgcatt

SEQ ID NO: 3434954 - DNA, 16 bp, Homo sapiens
ctgtatttgagaatat

SEQ ID NO: 3434955 - DNA, 18 bp, Homo sapiens
ctgtatttttaaagcatg

SEQ ID NO: 3434956 - DNA, 17 bp, Homo sapiens
ctgtcaaggctgcttag

SEQ ID NO: 3434957 - DNA, 15 bp, Homo sapiens
ctgtcaccctgcagg

SEQ ID NO: 3434958 - DNA, 16 bp, Homo sapiens
ctgtcacctctcccac

SEQ ID NO: 3434959 - DNA, 13 bp, Homo sapiens
ctgtcacctcttc

SEQ ID NO: 3434960 - DNA, 16 bp, Homo sapiens
ctgtcactcaggctgg

SEQ ID NO: 3434961 - DNA, 18 bp, Homo sapiens
ctgtcactcaggctggag

SEQ ID NO: 3434962 - DNA, 19 bp, Homo sapiens
cttatggaattgatttgca

SEQ ID NO: 3434963 - DNA, 20 bp, Homo sapiens
cttatggaattgatttgcat

SEQ ID NO: 3434964 - DNA, 13 bp, Homo sapiens
cttatggtaccag

SEQ ID NO: 3434965 - DNA, 19 bp, Homo sapiens
cttatggtaccagatgcag

SEQ ID NO: 3434966 - DNA, 24 bp, Homo sapiens
cttattacccaaacccatggctct

SEQ ID NO: 3434967 - DNA, 17 bp, Homo sapiens
cttattagagtgtcttt

SEQ ID NO: 3434968 - DNA, 18 bp, Homo sapiens
cttattgcccacgctgga

SEQ ID NO: 3434969 - DNA, 18 bp, Homo sapiens
cttattgtacctctctta

SEQ ID NO: 3434970 - DNA, 13 bp, Homo sapiens
cttcaaatgcctg

SEQ ID NO: 3434971 - DNA, 16 bp, Homo sapiens
cttcaaatgcctgact

SEQ ID NO: 3434972 - DNA, 14 bp, Homo sapiens
cttcaaccctcagc

SEQ ID NO: 3434973 - DNA, 15 bp, Homo sapiens
cttcaaccctcagcc

SEQ ID NO: 3434974 - DNA, 17 bp, Homo sapiens
cttcaatcggcttgtgg

SEQ ID NO: 3434975 - DNA, 15 bp, Homo sapiens
cttcacaaagcccaa

SEQ ID NO: 3434976 - DNA, 23 bp, Homo sapiens
cttcacaaagcccaagggatctg

SEQ ID NO: 3434977 - DNA, 17 bp, Homo sapiens
cttcacagatgcctact

SEQ ID NO: 3434978 - DNA, 23 bp, Homo sapiens
cttcacagtgatcgatgattcag

SEQ ID NO: 3434979 - DNA, 22 bp, Homo sapiens
cttcacatccattgtctcttca

SEQ ID NO: 3434980 - DNA, 21 bp, Homo sapiens
cttcacattcccctggggacc

SEQ ID NO: 3434981 - DNA, 15 bp, Homo sapiens
cttcaccaacactgt

SEQ ID NO: 3434982 - DNA, 14 bp, Homo sapiens
cttcacccaggcct

SEQ ID NO: 3434983 - DNA, 21 bp, Homo sapiens
cttcacccaggcctatgttga

SEQ ID NO: 3434984 - DNA, 15 bp, Homo sapiens
cttcaccctgagttt

SEQ ID NO: 3434985 - DNA, 15 bp, Homo sapiens
cttcaccctggagcc

SEQ ID NO: 3434986 - DNA, 16 bp, Homo sapiens
cttcacctcttccact

SEQ ID NO: 3434987 - DNA, 19 bp, Homo sapiens
cttcacctcttccactcct

SEQ ID NO: 3434988 - DNA, 20 bp, Homo sapiens
cttcacctttcccactttct

SEQ ID NO: 3434989 - DNA, 15 bp, Homo sapiens
cttcacggaagagcc

SEQ ID NO: 3434990 - DNA, 13 bp, Homo sapiens
cttcacggcagga

SEQ ID NO: 3434991 - DNA, 16 bp, Homo sapiens
cttcacggcaggacaa

SEQ ID NO: 3434992 - DNA, 17 bp, Homo sapiens
cttcacggcaggacaac

SEQ ID NO: 3434993 - DNA, 14 bp, Homo sapiens
cttcactagggaat

SEQ ID NO: 3434994 - DNA, 20 bp, Homo sapiens
cttcagaaagtgtgctttat

SEQ ID NO: 3434995 - DNA, 18 bp, Homo sapiens
cttcagacacatgctatg

SEQ ID NO: 3434996 - DNA, 12 bp, Homo sapiens
cttcagagctga

SEQ ID NO: 3434997 - DNA, 23 bp, Homo sapiens
cttcagagtttgtcatatactgc

SEQ ID NO: 3434998 - DNA, 16 bp, Homo sapiens
cttcagccctcacccc

SEQ ID NO: 3434999 - DNA, 17 bp, Homo sapiens
cttcagccctcacccct

SEQ ID NO: 3435000 - DNA, 17 bp, Homo sapiens
cttcagcctagtggctt

SEQ ID NO: 3435001 - DNA, 14 bp, Homo sapiens
cttcagcctcccga

SEQ ID NO: 3435002 - DNA, 16 bp, Homo sapiens
cttcagcctcccgagt

SEQ ID NO: 3435003 - DNA, 20 bp, Homo sapiens
cttcagcctctttctgtccc

SEQ ID NO: 3435004 - DNA, 20 bp, Homo sapiens
cttcagctcacgcttcacag

SEQ ID NO: 3435005 - DNA, 15 bp, Homo sapiens
cttcagctgactttt

SEQ ID NO: 3435006 - DNA, 19 bp, Homo sapiens
cttcagctgacttttctgt

SEQ ID NO: 3435007 - DNA, 21 bp, Homo sapiens
cttcaggaacctcgagtactg

SEQ ID NO: 3435008 - DNA, 18 bp, Homo sapiens
cttcaggcaattctcctg

SEQ ID NO: 3435009 - DNA, 22 bp, Homo sapiens
cttcaggcaattctcctgcctt

SEQ ID NO: 3435010 - DNA, 23 bp, Homo sapiens
cttcaggcaattctcctgccttt

SEQ ID NO: 3435011 - DNA, 9 bp, Homo sapiens
cttcagggc

SEQ ID NO: 3435012 - DNA, 18 bp, Homo sapiens
cttcaggtcaggagttcg

SEQ ID NO: 3435013 - DNA, 23 bp, Homo sapiens
cttcagtaagccgtgattttcat

SEQ ID NO: 3435014 - DNA, 14 bp, Homo sapiens
cttcagtggcagct

SEQ ID NO: 3435015 - DNA, 18 bp, Homo sapiens
cttcagtggcagctgctt

SEQ ID NO: 3435016 - DNA, 17 bp, Homo sapiens
cttcagttattggtgga

SEQ ID NO: 3435017 - DNA, 19 bp, Homo sapiens
cttcagttattggtggaat

SEQ ID NO: 3435018 - DNA, 13 bp, Homo sapiens
cttcagtttaatg

SEQ ID NO: 3435019 - DNA, 15 bp, Homo sapiens
cttcatagaaacctc

SEQ ID NO: 3435020 - DNA, 23 bp, Homo sapiens
cttcatatgaaaggtgccatgga

SEQ ID NO: 3435021 - DNA, 19 bp, Homo sapiens
cttcatcattccctctcat

SEQ ID NO: 3435022 - DNA, 16 bp, Homo sapiens
cttcatctaatatgat

SEQ ID NO: 3435023 - DNA, 20 bp, Homo sapiens
cttcatctcccacctagcag

SEQ ID NO: 3435024 - DNA, 20 bp, Homo sapiens
cttcatctggctgcctttgc

SEQ ID NO: 3435025 - DNA, 13 bp, Homo sapiens
cttcatcttcctg

SEQ ID NO: 3435026 - DNA, 15 bp, Homo sapiens
cttcatcttcctgtg

SEQ ID NO: 3435027 - DNA, 16 bp, Homo sapiens
cttcatcttcctgtgt

SEQ ID NO: 3435028 - DNA, 21 bp, Homo sapiens
cttcatcttcctgtgtcctga

SEQ ID NO: 3435029 - DNA, 22 bp, Homo sapiens
cttcatgcaggtgaaacccagt

SEQ ID NO: 3435030 - DNA, 18 bp, Homo sapiens
cttcatggaccaagaatg

SEQ ID NO: 3435031 - DNA, 13 bp, Homo sapiens
cttcatggatggg

SEQ ID NO: 3435032 - DNA, 23 bp, Homo sapiens
cttcatggatgggggaactcaga

SEQ ID NO: 3435033 - DNA, 15 bp, Homo sapiens
cttcatggcagaagg

SEQ ID NO: 3435034 - DNA, 22 bp, Homo sapiens
cttcatgtctattccattccct

SEQ ID NO: 3435035 - DNA, 13 bp, Homo sapiens
cttcattctcctt

SEQ ID NO: 3435036 - DNA, 21 bp, Homo sapiens
cttcattcttgaaagctgtgg

SEQ ID NO: 3435037 - DNA, 21 bp, Homo sapiens
cttcattgatttcctgtgtca

SEQ ID NO: 3435038 - DNA, 18 bp, Homo sapiens
cttcatttcctgtgtctt

SEQ ID NO: 3435039 - DNA, 16 bp, Homo sapiens
cttcattttcagagtg

SEQ ID NO: 3435040 - DNA, 15 bp, Homo sapiens
cttcatttttgtaat

SEQ ID NO: 3435041 - DNA, 19 bp, Homo sapiens
cttccaaatcccctaagca

SEQ ID NO: 3435042 - DNA, 16 bp, Homo sapiens
cttccacaaagaaaat

SEQ ID NO: 3435043 - DNA, 17 bp, Homo sapiens
cttccactccttctctc

SEQ ID NO: 3435044 - DNA, 20 bp, Homo sapiens
cttccacttttttttgtatg

SEQ ID NO: 3435045 - DNA, 21 bp, Homo sapiens
cttccacttttttttgtatgt

SEQ ID NO: 3435046 - DNA, 19 bp, Homo sapiens
cttccagatcctctctggg

SEQ ID NO: 3435047 - DNA, 21 bp, Homo sapiens
cttccagatcctctctggggc

SEQ ID NO: 3435048 - DNA, 21 bp, Homo sapiens
cttccagggatttgcctcacc

SEQ ID NO: 3435049 - DNA, 14 bp, Homo sapiens
cttccatgatttta

SEQ ID NO: 3435050 - DNA, 13 bp, Homo sapiens
cttccatgcctta

SEQ ID NO: 3435051 - DNA, 16 bp, Homo sapiens
cttccatggccctcat

SEQ ID NO: 3435052 - DNA, 14 bp, Homo sapiens
cttccattgtttaa

SEQ ID NO: 3435053 - DNA, 14 bp, Homo sapiens
cttccatttgcaag

SEQ ID NO: 3435054 - DNA, 23 bp, Homo sapiens
cttcccaagtaagaggctggagt

SEQ ID NO: 3435055 - DNA, 15 bp, Homo sapiens
cttcccagtggctgc

SEQ ID NO: 3435056 - DNA, 22 bp, Homo sapiens
cttcccatgacccaggctgggc

SEQ ID NO: 3435057 - DNA, 14 bp, Homo sapiens
cttccccacagaac

SEQ ID NO: 3435058 - DNA, 18 bp, Homo sapiens
cttccccatcttctaaac

SEQ ID NO: 3435059 - DNA, 20 bp, Homo sapiens
cttccccccaaaacccggga

SEQ ID NO: 3435060 - DNA, 14 bp, Homo sapiens
cttcccctgcctcc

SEQ ID NO: 3435061 - DNA, 22 bp, Homo sapiens
cttcccctgcctcctactccag

SEQ ID NO: 3435062 - DNA, 22 bp, Homo sapiens
cttcccgccggaggccagctat

SEQ ID NO: 3435063 - DNA, 19 bp, Homo sapiens
cttcccgggccagggctgc

SEQ ID NO: 3435064 - DNA, 16 bp, Homo sapiens
cttccctaacacttac

SEQ ID NO: 3435065 - DNA, 17 bp, Homo sapiens
cttccctcaccttggca

SEQ ID NO: 3435066 - DNA, 15 bp, Homo sapiens
cttccctcagtccca

SEQ ID NO: 3435067 - DNA, 18 bp, Homo sapiens
cttccctgcgcctgtgat

SEQ ID NO: 3435068 - DNA, 16 bp, Homo sapiens
cttccctgtgtctttt

SEQ ID NO: 3435069 - DNA, 14 bp, Homo sapiens
cttcccttttacat

SEQ ID NO: 3435070 - DNA, 22 bp, Homo sapiens
cttcctaaatattatgagatgc

SEQ ID NO: 3435071 - DNA, 20 bp, Homo sapiens
cttcctaagcctgtggctgt

SEQ ID NO: 3435072 - DNA, 17 bp, Homo sapiens
cttcctagatgtttccc

SEQ ID NO: 3435073 - DNA, 20 bp, Homo sapiens
cttcctccgaggccagtacc

SEQ ID NO: 3435074 - DNA, 12 bp, Homo sapiens
cttcctcctgga

SEQ ID NO: 3435075 - DNA, 14 bp, Homo sapiens
cttcctcctgggcc

SEQ ID NO: 3435076 - DNA, 15 bp, Homo sapiens
cttcctcctgggccc

SEQ ID NO: 3435077 - DNA, 20 bp, Homo sapiens
cttcctctgcaagtgctcag

SEQ ID NO: 3435078 - DNA, 17 bp, Homo sapiens
cttcctggagcccagag

SEQ ID NO: 3435079 - DNA, 12 bp, Homo sapiens
cttcctggcctg

SEQ ID NO: 3435080 - DNA, 14 bp, Homo sapiens
cttcctggcctgag

SEQ ID NO: 3435081 - DNA, 15 bp, Homo sapiens
cttcctggcctgaga

SEQ ID NO: 3435082 - DNA, 18 bp, Homo sapiens
cttcctgtccccatctgt

SEQ ID NO: 3435083 - DNA, 19 bp, Homo sapiens
cttcctgtccccatctgtc

SEQ ID NO: 3435084 - DNA, 12 bp, Homo sapiens
cttcctgtgtcc

SEQ ID NO: 3435085 - DNA, 15 bp, Homo sapiens
cttcctgtgtcctga

SEQ ID NO: 3435086 - DNA, 15 bp, Homo sapiens
cttccttatgcttct

SEQ ID NO: 3435087 - DNA, 20 bp, Homo sapiens
cttccttgagacacggagcc

SEQ ID NO: 3435088 - DNA, 13 bp, Homo sapiens
cttccttggcttt

SEQ ID NO: 3435089 - DNA, 15 bp, Homo sapiens
cttcctttaaaaaac

SEQ ID NO: 3435090 - DNA, 14 bp, Homo sapiens
cttcgaaaatctag

SEQ ID NO: 3435091 - DNA, 15 bp, Homo sapiens
cttcgaaacctggga

SEQ ID NO: 3435092 - DNA, 14 bp, Homo sapiens
cttcgaaaggcctt

SEQ ID NO: 3435093 - DNA, 20 bp, Homo sapiens
cttcgaaaggccttcagaca

SEQ ID NO: 3435094 - DNA, 15 bp, Homo sapiens
ctttaccttcctgat

SEQ ID NO: 3435095 - DNA, 22 bp, Homo sapiens
ctttacgcccatctcaggacac

SEQ ID NO: 3435096 - DNA, 21 bp, Homo sapiens
ctttacgtgtttaaaaaaaag

SEQ ID NO: 3435097 - DNA, 22 bp, Homo sapiens
ctttacgtgtttaaaaaaaagc

SEQ ID NO: 3435098 - DNA, 18 bp, Homo sapiens
ctttactcctcacactta

SEQ ID NO: 3435099 - DNA, 15 bp, Homo sapiens
ctttactgtttgtta

SEQ ID NO: 3435100 - DNA, 17 bp, Homo sapiens
ctttactttagaagcac

SEQ ID NO: 3435101 - DNA, 13 bp, Homo sapiens
ctttagaaaatat

SEQ ID NO: 3435102 - DNA, 19 bp, Homo sapiens
ctttagaatttttacccaa

SEQ ID NO: 3435103 - DNA, 20 bp, Homo sapiens
ctttagagttagactgttgg

SEQ ID NO: 3435104 - DNA, 22 bp, Homo sapiens
ctttagccactggtttctcaga

SEQ ID NO: 3435105 - DNA, 18 bp, Homo sapiens
ctttagcccctcccaagc

SEQ ID NO: 3435106 - DNA, 23 bp, Homo sapiens
ctttagcccctcccaagctggct

SEQ ID NO: 3435107 - DNA, 13 bp, Homo sapiens
ctttaggctttca

SEQ ID NO: 3435108 - DNA, 17 bp, Homo sapiens
ctttaggctttcagctt

SEQ ID NO: 3435109 - DNA, 18 bp, Homo sapiens
ctttaggctttcagctta

SEQ ID NO: 3435110 - DNA, 15 bp, Homo sapiens
ctttagtctgcaaaa

SEQ ID NO: 3435111 - DNA, 12 bp, Homo sapiens
ctttatcacctc

SEQ ID NO: 3435112 - DNA, 14 bp, Homo sapiens
ctttatcctcttta

SEQ ID NO: 3435113 - DNA, 16 bp, Homo sapiens
ctttatcctctttaga

SEQ ID NO: 3435114 - DNA, 21 bp, Homo sapiens
ctttattaaatacaaaacttc

SEQ ID NO: 3435115 - DNA, 22 bp, Homo sapiens
ctttattaccccctccttcaga

SEQ ID NO: 3435116 - DNA, 21 bp, Homo sapiens
ctttattgaaaaaataaaaaa

SEQ ID NO: 3435117 - DNA, 15 bp, Homo sapiens
ctttattgagaaaga

SEQ ID NO: 3435118 - DNA, 16 bp, Homo sapiens
ctttattgtgtttgtc

SEQ ID NO: 3435119 - DNA, 13 bp, Homo sapiens
ctttattttacta

SEQ ID NO: 3435120 - DNA, 14 bp, Homo sapiens
ctttattttactag

SEQ ID NO: 3435121 - DNA, 19 bp, Homo sapiens
ctttcaaaaccttttgaaa

SEQ ID NO: 3435122 - DNA, 15 bp, Homo sapiens
ctttcaaaccagctt

SEQ ID NO: 3435123 - DNA, 11 bp, Homo sapiens
ctttcaaattt

SEQ ID NO: 3435124 - DNA, 14 bp, Homo sapiens
ctttcaaatttaga

SEQ ID NO: 3435125 - DNA, 21 bp, Homo sapiens
ctttcaaatttagaaactaat

SEQ ID NO: 3435126 - DNA, 13 bp, Homo sapiens
ctttcaattctgt

SEQ ID NO: 3435127 - DNA, 17 bp, Homo sapiens
ctttcacaaaattttat

SEQ ID NO: 3435128 - DNA, 15 bp, Homo sapiens
ctttcaccaccccct

SEQ ID NO: 3435129 - DNA, 17 bp, Homo sapiens
ctttcaccaccccctcc

SEQ ID NO: 3435130 - DNA, 15 bp, Homo sapiens
ctttcaccccagggc

SEQ ID NO: 3435131 - DNA, 23 bp, Homo sapiens
ctttcaccccagggcctgagcct

SEQ ID NO: 3435132 - DNA, 17 bp, Homo sapiens
ctttcagcagactgatc

SEQ ID NO: 3435133 - DNA, 17 bp, Homo sapiens
ctttcataatctttgct

SEQ ID NO: 3435134 - DNA, 13 bp, Homo sapiens
ctttcatatggta

SEQ ID NO: 3435135 - DNA, 14 bp, Homo sapiens
ctttcatatggtag

SEQ ID NO: 3435136 - DNA, 16 bp, Homo sapiens
ctttcatatggtagga

SEQ ID NO: 3435137 - DNA, 17 bp, Homo sapiens
ctttcatccactagtgc

SEQ ID NO: 3435138 - DNA, 22 bp, Homo sapiens
ctttcatgagtttttcccagct

SEQ ID NO: 3435139 - DNA, 13 bp, Homo sapiens
ctttcatgctaca

SEQ ID NO: 3435140 - DNA, 16 bp, Homo sapiens
ctttcatttttttcca

SEQ ID NO: 3435141 - DNA, 22 bp, Homo sapiens
ctttccaaatgcccagcttaaa

SEQ ID NO: 3435142 - DNA, 17 bp, Homo sapiens
ctttccaccacagccag

SEQ ID NO: 3435143 - DNA, 21 bp, Homo sapiens
ctttccaccacagccagcacc

SEQ ID NO: 3435144 - DNA, 21 bp, Homo sapiens
ctttccacggagccactcctc

SEQ ID NO: 3435145 - DNA, 18 bp, Homo sapiens
ctttccattggatctcat

SEQ ID NO: 3435146 - DNA, 14 bp, Homo sapiens
ctttcccaaaatta

SEQ ID NO: 3435147 - DNA, 16 bp, Homo sapiens
ctttcccaactctagc

SEQ ID NO: 3435148 - DNA, 16 bp, Homo sapiens
ctttcccatggggagg

SEQ ID NO: 3435149 - DNA, 17 bp, Homo sapiens
ctttccgtggcactgca

SEQ ID NO: 3435150 - DNA, 20 bp, Homo sapiens
ctttcctaagacctggggtt

SEQ ID NO: 3435151 - DNA, 13 bp, Homo sapiens
ctttcctcctctg

SEQ ID NO: 3435152 - DNA, 17 bp, Homo sapiens
ctttcctcctctgactt

SEQ ID NO: 3435153 - DNA, 18 bp, Homo sapiens
ctttcctctctatatttc

SEQ ID NO: 3435154 - DNA, 19 bp, Homo sapiens
ctttcctgatggcaggatg

SEQ ID NO: 3435155 - DNA, 12 bp, Homo sapiens
ctttcctgcctc

SEQ ID NO: 3435156 - DNA, 23 bp, Homo sapiens
ctttcctggatgtctgaactttg

SEQ ID NO: 3435157 - DNA, 9 bp, Homo sapiens
ctttcctgt

SEQ ID NO: 3435158 - DNA, 20 bp, Homo sapiens
ctttcctttaactccctttt

SEQ ID NO: 3435159 - DNA, 19 bp, Homo sapiens
ctttcgtccacagcttcct

SEQ ID NO: 3435160 - DNA, 15 bp, Homo sapiens
ctttctacccagcga

SEQ ID NO: 3435161 - DNA, 17 bp, Homo sapiens
ctttctacccagcgagc

SEQ ID NO: 3435162 - DNA, 23 bp, Homo sapiens
ctttctagctgttgagctgtttt

SEQ ID NO: 3435163 - DNA, 16 bp, Homo sapiens
ctttctcacttttgga

SEQ ID NO: 3435164 - DNA, 23 bp, Homo sapiens
ctttctcccctgcccccaggact

SEQ ID NO: 3435165 - DNA, 23 bp, Homo sapiens
ctttctcttttcccctttcctgt

SEQ ID NO: 3435166 - DNA, 17 bp, Homo sapiens
ctttctgatcaaggcct

SEQ ID NO: 3435167 - DNA, 18 bp, Homo sapiens
ctttctgatcaaggcctt

SEQ ID NO: 3435168 - DNA, 20 bp, Homo sapiens
ctttctgatcaaggccttat

SEQ ID NO: 3435169 - DNA, 11 bp, Homo sapiens
ctttctgcctg

SEQ ID NO: 3435170 - DNA, 12 bp, Homo sapiens
ctttctgcctgg

SEQ ID NO: 3435171 - DNA, 15 bp, Homo sapiens
ctttctgcctggagt

SEQ ID NO: 3435172 - DNA, 13 bp, Homo sapiens
ctttctgctcagc

SEQ ID NO: 3435173 - DNA, 14 bp, Homo sapiens
ctttctgctcagct

SEQ ID NO: 3435174 - DNA, 17 bp, Homo sapiens
ctttctgctcagcttct

SEQ ID NO: 3435175 - DNA, 19 bp, Homo sapiens
ctttctgtatatacttttt

SEQ ID NO: 3435176 - DNA, 20 bp, Homo sapiens
ctttctgtatatactttttt

SEQ ID NO: 3435177 - DNA, 23 bp, Homo sapiens
ctttctgtcccttctgtccctca

SEQ ID NO: 3435178 - DNA, 22 bp, Homo sapiens
ctttcttacaaggaaggtggtg

SEQ ID NO: 3435179 - DNA, 15 bp, Homo sapiens
ctttcttctaccaga

SEQ ID NO: 3435180 - DNA, 15 bp, Homo sapiens
ctttcttctatttta

SEQ ID NO: 3435181 - DNA, 22 bp, Homo sapiens
ctttcttgatcaacatcttttc

SEQ ID NO: 3435182 - DNA, 17 bp, Homo sapiens
ctttctttcttagaaat

SEQ ID NO: 3435183 - DNA, 13 bp, Homo sapiens
ctttgaaacagaa

SEQ ID NO: 3435184 - DNA, 16 bp, Homo sapiens
ctttgaatgtaaccaa

SEQ ID NO: 3435185 - DNA, 23 bp, Homo sapiens
ctttgagaatacaagatattatg

SEQ ID NO: 3435186 - DNA, 17 bp, Homo sapiens
ctttgagactgggtctc

SEQ ID NO: 3435187 - DNA, 21 bp, Homo sapiens
ctttgagataatacattccga

SEQ ID NO: 3435188 - DNA, 21 bp, Homo sapiens
ctttgagtgcagtcctgatca

SEQ ID NO: 3435189 - DNA, 20 bp, Homo sapiens
ctttgattagttttcttgtt

SEQ ID NO: 3435190 - DNA, 21 bp, Homo sapiens
ctttgattcatagtaacttct

SEQ ID NO: 3435191 - DNA, 15 bp, Homo sapiens
ctttgattctccttc

SEQ ID NO: 3435192 - DNA, 19 bp, Homo sapiens
ctttgattctccttcagcc

SEQ ID NO: 3435193 - DNA, 15 bp, Homo sapiens
ctttgcaaagacccg

SEQ ID NO: 3435194 - DNA, 15 bp, Homo sapiens
ctttgcaaagtattg

SEQ ID NO: 3435195 - DNA, 14 bp, Homo sapiens
ctttgcatttggaa

SEQ ID NO: 3435196 - DNA, 15 bp, Homo sapiens
ctttgcatttggaat

SEQ ID NO: 3435197 - DNA, 12 bp, Homo sapiens
ctttgcctccag

SEQ ID NO: 3435198 - DNA, 13 bp, Homo sapiens
ctttgctgtaaga

SEQ ID NO: 3435199 - DNA, 20 bp, Homo sapiens
ctttgctgtaagatgtctgt

SEQ ID NO: 3435200 - DNA, 22 bp, Homo sapiens
ctttgctgtaagatgtctgttt

SEQ ID NO: 3435201 - DNA, 11 bp, Homo sapiens
ctttgctttgc

SEQ ID NO: 3435202 - DNA, 19 bp, Homo sapiens
ctttggaaaatgcattgta

SEQ ID NO: 3435203 - DNA, 21 bp, Homo sapiens
ctttggacctaaatggcctca

SEQ ID NO: 3435204 - DNA, 18 bp, Homo sapiens
ctttggagatgctgaggg

SEQ ID NO: 3435205 - DNA, 13 bp, Homo sapiens
ctttggatttgac

SEQ ID NO: 3435206 - DNA, 14 bp, Homo sapiens
ctttggcctgagtt

SEQ ID NO: 3435207 - DNA, 19 bp, Homo sapiens
ctttgggaatatttgaatc

SEQ ID NO: 3435208 - DNA, 19 bp, Homo sapiens
ctttgggagagcaggaatg

SEQ ID NO: 3435209 - DNA, 13 bp, Homo sapiens
ctttgggaggcca

SEQ ID NO: 3435210 - DNA, 23 bp, Homo sapiens
ctttggtgccaactggtgtttga

SEQ ID NO: 3435211 - DNA, 15 bp, Homo sapiens
ctttggtttggcctc

SEQ ID NO: 3435212 - DNA, 16 bp, Homo sapiens
ctttggtttggcctcc

SEQ ID NO: 3435213 - DNA, 15 bp, Homo sapiens
ctttgtaagaactaa

SEQ ID NO: 3435214 - DNA, 18 bp, Homo sapiens
ctttgtaagaactaaaga

SEQ ID NO: 3435215 - DNA, 16 bp, Homo sapiens
ctttgtacagcccaga

SEQ ID NO: 3435216 - DNA, 16 bp, Homo sapiens
ctttgtaccatctgtc

SEQ ID NO: 3435217 - DNA, 14 bp, Homo sapiens
ctttgtactttgtg

SEQ ID NO: 3435218 - DNA, 15 bp, Homo sapiens
ctttgtagcactcag

SEQ ID NO: 3435219 - DNA, 20 bp, Homo sapiens
ctttgtatcagtcagtgctg

SEQ ID NO: 3435220 - DNA, 18 bp, Homo sapiens
ctttgtcatctttcttct

SEQ ID NO: 3435221 - DNA, 18 bp, Homo sapiens
ctttgtggccaaggagct

SEQ ID NO: 3435222 - DNA, 13 bp, Homo sapiens
ctttgtggcttcc

SEQ ID NO: 3435223 - DNA, 15 bp, Homo sapiens
ctttgtgtgtgtgtc

SEQ ID NO: 3435224 - DNA, 16 bp, Homo sapiens
ctttgttgcccaggct

SEQ ID NO: 3435225 - DNA, 17 bp, Homo sapiens
ctttgtttcgtggggag

SEQ ID NO: 3435226 - DNA, 20 bp, Homo sapiens
ctttgtttgttgtcagctga

SEQ ID NO: 3435227 - DNA, 14 bp, Homo sapiens
gaagaactgcaggc

SEQ ID NO: 3435228 - DNA, 19 bp, Homo sapiens
gaagaatccttttgtagaa

SEQ ID NO: 3435229 - DNA, 15 bp, Homo sapiens
gaagacaaaaagaca

SEQ ID NO: 3435230 - DNA, 16 bp, Homo sapiens
gaagacactgatgggc

SEQ ID NO: 3435231 - DNA, 17 bp, Homo sapiens
gaagacagaagtttgca

SEQ ID NO: 3435232 - DNA, 22 bp, Homo sapiens
gaagaccatgtggagacttcat

SEQ ID NO: 3435233 - DNA, 19 bp, Homo sapiens
gaagacccctgactcatca

SEQ ID NO: 3435234 - DNA, 19 bp, Homo sapiens
gaagacctcacctagaaat

SEQ ID NO: 3435235 - DNA, 20 bp, Homo sapiens
gaagacctcacctagaaatt

SEQ ID NO: 3435236 - DNA, 16 bp, Homo sapiens
gaagactggaagctaa

SEQ ID NO: 3435237 - DNA, 18 bp, Homo sapiens
gaagacttaaaagagctc

SEQ ID NO: 3435238 - DNA, 14 bp, Homo sapiens
gaagagaaggggag

SEQ ID NO: 3435239 - DNA, 16 bp, Homo sapiens
gaagagcccagtctgt

SEQ ID NO: 3435240 - DNA, 15 bp, Homo sapiens
gaagaggctgcactg

SEQ ID NO: 3435241 - DNA, 14 bp, Homo sapiens
gaagagtcctctga

SEQ ID NO: 3435242 - DNA, 17 bp, Homo sapiens
gaagagtgggtttcaca

SEQ ID NO: 3435243 - DNA, 22 bp, Homo sapiens
gaagagttgccccgtctctgtt

SEQ ID NO: 3435244 - DNA, 15 bp, Homo sapiens
gaagatcctgtgagg

SEQ ID NO: 3435245 - DNA, 21 bp, Homo sapiens
gaagatctcactctgcccccc

SEQ ID NO: 3435246 - DNA, 14 bp, Homo sapiens
gaagattaagacag

SEQ ID NO: 3435247 - DNA, 20 bp, Homo sapiens
gaagattttcattgaggata

SEQ ID NO: 3435248 - DNA, 19 bp, Homo sapiens
gaagcagatgcaaagaggc

SEQ ID NO: 3435249 - DNA, 21 bp, Homo sapiens
gaagcagatgcaaagaggcaa

SEQ ID NO: 3435250 - DNA, 20 bp, Homo sapiens
gaagccaattcagacaggca

SEQ ID NO: 3435251 - DNA, 17 bp, Homo sapiens
gaagccacaggcctgag

SEQ ID NO: 3435252 - DNA, 18 bp, Homo sapiens
gaagccacaggcctgaga

SEQ ID NO: 3435253 - DNA, 12 bp, Homo sapiens
gaagccagctgc

SEQ ID NO: 3435254 - DNA, 13 bp, Homo sapiens
gaagccagctgcc

SEQ ID NO: 3435255 - DNA, 23 bp, Homo sapiens
gaagccaggaatttcccaggacc

SEQ ID NO: 3435256 - DNA, 24 bp, Homo sapiens
gaagccaggaatttcccaggaccc

SEQ ID NO: 3435257 - DNA, 23 bp, Homo sapiens
gaagcccagcccctactgctgtg

SEQ ID NO: 3435258 - DNA, 14 bp, Homo sapiens
gaagcccccagcta

SEQ ID NO: 3435259 - DNA, 22 bp, Homo sapiens
gaagcccccagctaagaacctg

SEQ ID NO: 3435260 - DNA, 20 bp, Homo sapiens
gaagccgccagtacttgtca

SEQ ID NO: 3435261 - DNA, 19 bp, Homo sapiens
gaagccgtgccctgccccc

SEQ ID NO: 3435262 - DNA, 20 bp, Homo sapiens
gaagccgtgctcgccccagc

SEQ ID NO: 3435263 - DNA, 15 bp, Homo sapiens
gaagcctctgcctcc

SEQ ID NO: 3435264 - DNA, 19 bp, Homo sapiens
gaagcctctgcctccctag

SEQ ID NO: 3435265 - DNA, 14 bp, Homo sapiens
gaagcggctggcag

SEQ ID NO: 3435266 - DNA, 16 bp, Homo sapiens
gaagctaatgaccaac

SEQ ID NO: 3435267 - DNA, 17 bp, Homo sapiens
gaagctaatgaccaacc

SEQ ID NO: 3435268 - DNA, 14 bp, Homo sapiens
gaagctaatttgca

SEQ ID NO: 3435269 - DNA, 15 bp, Homo sapiens
gaagctaatttgcat

SEQ ID NO: 3435270 - DNA, 15 bp, Homo sapiens
gaagctactgtgtgt

SEQ ID NO: 3435271 - DNA, 22 bp, Homo sapiens
gaagctactgtgtgtgtgaatg

SEQ ID NO: 3435272 - DNA, 22 bp, Homo sapiens
gaagctccgctttctacccagc

SEQ ID NO: 3435273 - DNA, 22 bp, Homo sapiens
gaagctcctctccccagcccag

SEQ ID NO: 3435274 - DNA, 17 bp, Homo sapiens
gaagctctggccccagg

SEQ ID NO: 3435275 - DNA, 16 bp, Homo sapiens
gaagctgctgtctcta

SEQ ID NO: 3435276 - DNA, 23 bp, Homo sapiens
gaagcttctgtctccagcttccc

SEQ ID NO: 3435277 - DNA, 14 bp, Homo sapiens
gaagctttctgtct

SEQ ID NO: 3435278 - DNA, 18 bp, Homo sapiens
gaaggaaaagaaagaaga

SEQ ID NO: 3435279 - DNA, 20 bp, Homo sapiens
gaaggaatatatggcagagt

SEQ ID NO: 3435280 - DNA, 19 bp, Homo sapiens
gaaggacattgcggacagc

SEQ ID NO: 3435281 - DNA, 17 bp, Homo sapiens
gaaggaccctgtgccct

SEQ ID NO: 3435282 - DNA, 15 bp, Homo sapiens
gaaggagacaggcag

SEQ ID NO: 3435283 - DNA, 17 bp, Homo sapiens
gaaggagatagggaaaa

SEQ ID NO: 3435284 - DNA, 20 bp, Homo sapiens
gaaggagccccattcctggg

SEQ ID NO: 3435285 - DNA, 22 bp, Homo sapiens
gaaggccgagaagcaagaaaga

SEQ ID NO: 3435286 - DNA, 20 bp, Homo sapiens
gaaggccgctgccccagccc

SEQ ID NO: 3435287 - DNA, 14 bp, Homo sapiens
gaaggctaaaaagc

SEQ ID NO: 3435288 - DNA, 16 bp, Homo sapiens
gaaggctaaaaagcaa

SEQ ID NO: 3435289 - DNA, 12 bp, Homo sapiens
gaaggctgtcct

SEQ ID NO: 3435290 - DNA, 17 bp, Homo sapiens
gaagggccagagccagg

SEQ ID NO: 3435291 - DNA, 13 bp, Homo sapiens
gaagggctgcatg

SEQ ID NO: 3435292 - DNA, 18 bp, Homo sapiens
gaaggggacccccgcccc

SEQ ID NO: 3435293 - DNA, 12 bp, Homo sapiens
gaagggggtggt

SEQ ID NO: 3435294 - DNA, 13 bp, Homo sapiens
gaaggtaaaattg

SEQ ID NO: 3435295 - DNA, 22 bp, Homo sapiens
gaaggtggatggccccagcaca

SEQ ID NO: 3435296 - DNA, 19 bp, Homo sapiens
gaaggtgttggacagggga

SEQ ID NO: 3435297 - DNA, 15 bp, Homo sapiens
gaaggttgctgtggg

SEQ ID NO: 3435298 - DNA, 18 bp, Homo sapiens
gaagtcataccaatgaaa

SEQ ID NO: 3435299 - DNA, 16 bp, Homo sapiens
gaagtgcatctacttg

SEQ ID NO: 3435300 - DNA, 20 bp, Homo sapiens
gaagtgctcccctctgaaag

SEQ ID NO: 3435301 - DNA, 16 bp, Homo sapiens
gaagtgtaggcagaca

SEQ ID NO: 3435302 - DNA, 17 bp, Homo sapiens
gaagtgtaggcagacac

SEQ ID NO: 3435303 - DNA, 22 bp, Homo sapiens
gaagttacacagaaatgctgct

SEQ ID NO: 3435304 - DNA, 14 bp, Homo sapiens
gaagttattttcca

SEQ ID NO: 3435305 - DNA, 17 bp, Homo sapiens
gaagttgaagtttagga

SEQ ID NO: 3435306 - DNA, 21 bp, Homo sapiens
gaagttgatatagaacagtgc

SEQ ID NO: 3435307 - DNA, 17 bp, Homo sapiens
gaagttgcagtgagctg

SEQ ID NO: 3435308 - DNA, 21 bp, Homo sapiens
gaagttgttactaactaaact

SEQ ID NO: 3435309 - DNA, 13 bp, Homo sapiens
gaagttttacatt

SEQ ID NO: 3435310 - DNA, 23 bp, Homo sapiens
gaagttttcaatgatgggcgagc

SEQ ID NO: 3435311 - DNA, 17 bp, Homo sapiens
gaataaaatgttgaaaa

SEQ ID NO: 3435312 - DNA, 15 bp, Homo sapiens
gaataaagaatactt

SEQ ID NO: 3435313 - DNA, 17 bp, Homo sapiens
gaataaagaatacttga

SEQ ID NO: 3435314 - DNA, 15 bp, Homo sapiens
gaataacctttcaga

SEQ ID NO: 3435315 - DNA, 21 bp, Homo sapiens
gaataactctgtggcattatt

SEQ ID NO: 3435316 - DNA, 14 bp, Homo sapiens
gaataataagcagg

SEQ ID NO: 3435317 - DNA, 23 bp, Homo sapiens
gaataataagcaggatgttggcc

SEQ ID NO: 3435318 - DNA, 20 bp, Homo sapiens
gaataatcctaaacatatga

SEQ ID NO: 3435319 - DNA, 22 bp, Homo sapiens
gaataatttatagtaatgagtt

SEQ ID NO: 3435320 - DNA, 19 bp, Homo sapiens
gaatacttttgccctttga

SEQ ID NO: 3435321 - DNA, 18 bp, Homo sapiens
gaatagcatctgtacaaa

SEQ ID NO: 3435322 - DNA, 23 bp, Homo sapiens
gaatagccacatttggaatactt

SEQ ID NO: 3435323 - DNA, 14 bp, Homo sapiens
gaatagctgggact

SEQ ID NO: 3435324 - DNA, 22 bp, Homo sapiens
gaatagctgggactacaggtgt

SEQ ID NO: 3435325 - DNA, 12 bp, Homo sapiens
gaatataatgga

SEQ ID NO: 3435326 - DNA, 17 bp, Homo sapiens
gaatataccttttttgt

SEQ ID NO: 3435327 - DNA, 17 bp, Homo sapiens
gaatatagcatctttca

SEQ ID NO: 3435328 - DNA, 21 bp, Homo sapiens
gaatatatagtgtatagaagc

SEQ ID NO: 3435329 - DNA, 20 bp, Homo sapiens
gaatatatggcagagttgta

SEQ ID NO: 3435330 - DNA, 22 bp, Homo sapiens
gaatatatggcagagttgtaaa

SEQ ID NO: 3435331 - DNA, 23 bp, Homo sapiens
gaatatatggcagagttgtaaat

SEQ ID NO: 3435332 - DNA, 15 bp, Homo sapiens
gaatatcaatataat

SEQ ID NO: 3435333 - DNA, 12 bp, Homo sapiens
gaatattagctt

SEQ ID NO: 3435334 - DNA, 21 bp, Homo sapiens
gaatattagctttactgtttg

SEQ ID NO: 3435335 - DNA, 15 bp, Homo sapiens
gaatatttattacct

SEQ ID NO: 3435336 - DNA, 16 bp, Homo sapiens
gaatatttcaagctct

SEQ ID NO: 3435337 - DNA, 12 bp, Homo sapiens
gaatatttgaat

SEQ ID NO: 3435338 - DNA, 18 bp, Homo sapiens
gaatatttgaatcttgtc

SEQ ID NO: 3435339 - DNA, 18 bp, Homo sapiens
gaatattttaagtattgc

SEQ ID NO: 3435340 - DNA, 21 bp, Homo sapiens
gaatcacgttagaggaaaaat

SEQ ID NO: 3435341 - DNA, 13 bp, Homo sapiens
gaatcagaactca

SEQ ID NO: 3435342 - DNA, 19 bp, Homo sapiens
gaatcagatcatttcaaaa

SEQ ID NO: 3435343 - DNA, 23 bp, Homo sapiens
gaatcaggaatattttccaaaga

SEQ ID NO: 3435344 - DNA, 22 bp, Homo sapiens
gaatcatggcctcttgaagaga

SEQ ID NO: 3435345 - DNA, 23 bp, Homo sapiens
gaatccacgtattccccttccca

SEQ ID NO: 3435346 - DNA, 17 bp, Homo sapiens
gaatccactcccaggca

SEQ ID NO: 3435347 - DNA, 18 bp, Homo sapiens
gaatccagctgggctaga

SEQ ID NO: 3435348 - DNA, 10 bp, Homo sapiens
gaatcctcct

SEQ ID NO: 3435349 - DNA, 19 bp, Homo sapiens
gaatcctgcggcaggactg

SEQ ID NO: 3435350 - DNA, 21 bp, Homo sapiens
gaatcctgcggcaggactgca

SEQ ID NO: 3435351 - DNA, 13 bp, Homo sapiens
gaatccttttgta

SEQ ID NO: 3435352 - DNA, 18 bp, Homo sapiens
gaatctacccccagatcc

SEQ ID NO: 3435353 - DNA, 15 bp, Homo sapiens
gaatctactaattcc

SEQ ID NO: 3435354 - DNA, 15 bp, Homo sapiens
gaatctatttaagta

SEQ ID NO: 3435355 - DNA, 16 bp, Homo sapiens
gaatctatttaagtaa

SEQ ID NO: 3435356 - DNA, 20 bp, Homo sapiens
gaatctctcaaacggcaaca

SEQ ID NO: 3435357 - DNA, 13 bp, Homo sapiens
gaatctctgtgcc

SEQ ID NO: 3435358 - DNA, 12 bp, Homo sapiens
gaatctgaggca

SEQ ID NO: 3435359 - DNA, 14 bp, Homo sapiens
gacagccccaccct

SEQ ID NO: 3435360 - DNA, 15 bp, Homo sapiens
gacagccccaccctg

SEQ ID NO: 3435361 - DNA, 18 bp, Homo sapiens
gacagcctgcagcaggaa

SEQ ID NO: 3435362 - DNA, 15 bp, Homo sapiens
gacagctccttctgt

SEQ ID NO: 3435363 - DNA, 17 bp, Homo sapiens
gacagctgctcctagag

SEQ ID NO: 3435364 - DNA, 20 bp, Homo sapiens
gacagctgctcctagaggga

SEQ ID NO: 3435365 - DNA, 20 bp, Homo sapiens
gacagctttactttaaaatt

SEQ ID NO: 3435366 - DNA, 14 bp, Homo sapiens
gacaggagaagaga

SEQ ID NO: 3435367 - DNA, 14 bp, Homo sapiens
gacaggatgtgttt

SEQ ID NO: 3435368 - DNA, 20 bp, Homo sapiens
gacaggatgtgtttgctttc

SEQ ID NO: 3435369 - DNA, 13 bp, Homo sapiens
gacaggcaagcac

SEQ ID NO: 3435370 - DNA, 20 bp, Homo sapiens
gacaggcaagcacctcctgc

SEQ ID NO: 3435371 - DNA, 14 bp, Homo sapiens
gacaggcaatgctg

SEQ ID NO: 3435372 - DNA, 19 bp, Homo sapiens
gacaggcaatgctggctgt

SEQ ID NO: 3435373 - DNA, 24 bp, Homo sapiens
gacaggcaatgctggctgttggct

SEQ ID NO: 3435374 - DNA, 22 bp, Homo sapiens
gacaggcatgttctctgaggac

SEQ ID NO: 3435375 - DNA, 13 bp, Homo sapiens
gacaggctcttct

SEQ ID NO: 3435376 - DNA, 14 bp, Homo sapiens
gacaggctgtgact

SEQ ID NO: 3435377 - DNA, 19 bp, Homo sapiens
gacaggctgtgactcttct

SEQ ID NO: 3435378 - DNA, 14 bp, Homo sapiens
gacagggatgagca

SEQ ID NO: 3435379 - DNA, 21 bp, Homo sapiens
gacagggtttggctgtgtcta

SEQ ID NO: 3435380 - DNA, 20 bp, Homo sapiens
gacagggttttgccatgttg

SEQ ID NO: 3435381 - DNA, 21 bp, Homo sapiens
gacagtatcactgtctttcct

SEQ ID NO: 3435382 - DNA, 14 bp, Homo sapiens
gacagtcaccccag

SEQ ID NO: 3435383 - DNA, 15 bp, Homo sapiens
gacagtccagcctgg

SEQ ID NO: 3435384 - DNA, 12 bp, Homo sapiens
gacagtctgctc

SEQ ID NO: 3435385 - DNA, 14 bp, Homo sapiens
gacagtgaaagaaa

SEQ ID NO: 3435386 - DNA, 22 bp, Homo sapiens
gacagttttccttctcatctgt

SEQ ID NO: 3435387 - DNA, 21 bp, Homo sapiens
gacatacgcttttaatgaaaa

SEQ ID NO: 3435388 - DNA, 18 bp, Homo sapiens
gacatacttgaagggcca

SEQ ID NO: 3435389 - DNA, 19 bp, Homo sapiens
gacatacttgaagggccag

SEQ ID NO: 3435390 - DNA, 22 bp, Homo sapiens
gacatacttgaagggccagagc

SEQ ID NO: 3435391 - DNA, 11 bp, Homo sapiens
gacatatttaa

SEQ ID NO: 3435392 - DNA, 12 bp, Homo sapiens
gacatatttaat

SEQ ID NO: 3435393 - DNA, 16 bp, Homo sapiens
gacatatttaatgttt

SEQ ID NO: 3435394 - DNA, 17 bp, Homo sapiens
gacatatttaatgtttt

SEQ ID NO: 3435395 - DNA, 18 bp, Homo sapiens
gacatatttaatgtttta

SEQ ID NO: 3435396 - DNA, 22 bp, Homo sapiens
gacatatttaatgttttaaatg

SEQ ID NO: 3435397 - DNA, 11 bp, Homo sapiens
gacatcactgt

SEQ ID NO: 3435398 - DNA, 16 bp, Homo sapiens
gacatcaggagactgg

SEQ ID NO: 3435399 - DNA, 13 bp, Homo sapiens
gacatcagtgttt

SEQ ID NO: 3435400 - DNA, 15 bp, Homo sapiens
gacatcagtgtttgt

SEQ ID NO: 3435401 - DNA, 18 bp, Homo sapiens
gacatcctcctcccaccc

SEQ ID NO: 3435402 - DNA, 21 bp, Homo sapiens
gacatctgtttctaaatgttt

SEQ ID NO: 3435403 - DNA, 14 bp, Homo sapiens
gacatgattccttc

SEQ ID NO: 3435404 - DNA, 14 bp, Homo sapiens
gacatgatttcctt

SEQ ID NO: 3435405 - DNA, 22 bp, Homo sapiens
gacatgatttccttgaatgtgg

SEQ ID NO: 3435406 - DNA, 14 bp, Homo sapiens
gacatgcactcagc

SEQ ID NO: 3435407 - DNA, 21 bp, Homo sapiens
gacatgcctgtcctgaaagcg

SEQ ID NO: 3435408 - DNA, 14 bp, Homo sapiens
gacatgctgaagcc

SEQ ID NO: 3435409 - DNA, 15 bp, Homo sapiens
gacattcacctgccc

SEQ ID NO: 3435410 - DNA, 22 bp, Homo sapiens
gacattctgccaggcccccaag

SEQ ID NO: 3435411 - DNA, 16 bp, Homo sapiens
gacatttctttgtgct

SEQ ID NO: 3435412 - DNA, 20 bp, Homo sapiens
gaccaaccctggggaaggag

SEQ ID NO: 3435413 - DNA, 12 bp, Homo sapiens
gaccaagcagga

SEQ ID NO: 3435414 - DNA, 14 bp, Homo sapiens
gaccaagcaggaag

SEQ ID NO: 3435415 - DNA, 17 bp, Homo sapiens
gaccaagcaggaagctc

SEQ ID NO: 3435416 - DNA, 20 bp, Homo sapiens
gaccaagcaggaagctcaga

SEQ ID NO: 3435417 - DNA, 15 bp, Homo sapiens
gaccaagcatcttgg

SEQ ID NO: 3435418 - DNA, 19 bp, Homo sapiens
gaccaatttgcaccagttt

SEQ ID NO: 3435419 - DNA, 20 bp, Homo sapiens
gaccaatttgcaccagtttt

SEQ ID NO: 3435420 - DNA, 16 bp, Homo sapiens
gaccaccacctcagag

SEQ ID NO: 3435421 - DNA, 12 bp, Homo sapiens
gaccaccagtta

SEQ ID NO: 3435422 - DNA, 24 bp, Homo sapiens
gaccagacaccttgacagggcaca

SEQ ID NO: 3435423 - DNA, 13 bp, Homo sapiens
gaccagcagcgcc

SEQ ID NO: 3435424 - DNA, 16 bp, Homo sapiens
gaccagcagcgccttt

SEQ ID NO: 3435425 - DNA, 20 bp, Homo sapiens
gaccagcagcgcctttccca

SEQ ID NO: 3435426 - DNA, 12 bp, Homo sapiens
gaccagccagca

SEQ ID NO: 3435427 - DNA, 22 bp, Homo sapiens
gaccagccgtgagcatgtttgg

SEQ ID NO: 3435428 - DNA, 14 bp, Homo sapiens
gaccagctcaggac

SEQ ID NO: 3435429 - DNA, 13 bp, Homo sapiens
gaccaggcctggg

SEQ ID NO: 3435430 - DNA, 15 bp, Homo sapiens
gaccagggagccttt

SEQ ID NO: 3435431 - DNA, 19 bp, Homo sapiens
gaccagtttaacctgatgc

SEQ ID NO: 3435432 - DNA, 22 bp, Homo sapiens
gaccatgctcatctgctggtcc

SEQ ID NO: 3435433 - DNA, 21 bp, Homo sapiens
gaccattcagaatatcatctt

SEQ ID NO: 3435434 - DNA, 22 bp, Homo sapiens
gacccagccccttgagaaacct

SEQ ID NO: 3435435 - DNA, 15 bp, Homo sapiens
gacccaggctgggca

SEQ ID NO: 3435436 - DNA, 22 bp, Homo sapiens
gacccagggaacagccactccc

SEQ ID NO: 3435437 - DNA, 15 bp, Homo sapiens
gacccagtgccccca

SEQ ID NO: 3435438 - DNA, 17 bp, Homo sapiens
gacccagtgcccccact

SEQ ID NO: 3435439 - DNA, 20 bp, Homo sapiens
gacccattctacacagagca

SEQ ID NO: 3435440 - DNA, 15 bp, Homo sapiens
gacccattgctgttg

SEQ ID NO: 3435441 - DNA, 21 bp, Homo sapiens
gaccccaaaggaacactgaca

SEQ ID NO: 3435442 - DNA, 23 bp, Homo sapiens
gacccccagctccggcctgtcct

SEQ ID NO: 3435443 - DNA, 15 bp, Homo sapiens
gacccccgccccctg

SEQ ID NO: 3435444 - DNA, 19 bp, Homo sapiens
gacccccgccccctgccct

SEQ ID NO: 3435445 - DNA, 21 bp, Homo sapiens
gacccctccatgtgggctagt

SEQ ID NO: 3435446 - DNA, 13 bp, Homo sapiens
gacccctggctct

SEQ ID NO: 3435447 - DNA, 14 bp, Homo sapiens
gaccctctaacctc

SEQ ID NO: 3435448 - DNA, 16 bp, Homo sapiens
gaccctctgctgaaga

SEQ ID NO: 3435449 - DNA, 16 bp, Homo sapiens
gaccctgagctgacca

SEQ ID NO: 3435450 - DNA, 19 bp, Homo sapiens
gaccctgtatatagcccag

SEQ ID NO: 3435451 - DNA, 16 bp, Homo sapiens
gaccgtcccctgccca

SEQ ID NO: 3435452 - DNA, 16 bp, Homo sapiens
gacctaaatggcctca

SEQ ID NO: 3435453 - DNA, 15 bp, Homo sapiens
gacctaatgctcctt

SEQ ID NO: 3435454 - DNA, 16 bp, Homo sapiens
gacctaggcagtaggc

SEQ ID NO: 3435455 - DNA, 16 bp, Homo sapiens
gacctatgttgtaatt

SEQ ID NO: 3435456 - DNA, 20 bp, Homo sapiens
gacctcaggtgatccaccca

SEQ ID NO: 3435457 - DNA, 16 bp, Homo sapiens
gacctccaagccactg

SEQ ID NO: 3435458 - DNA, 12 bp, Homo sapiens
gacctctcccag

SEQ ID NO: 3435459 - DNA, 14 bp, Homo sapiens
gacctctcccaggg

SEQ ID NO: 3435460 - DNA, 23 bp, Homo sapiens
gacctctggattaggtctctgtt

SEQ ID NO: 3435461 - DNA, 14 bp, Homo sapiens
gacctgaggaagcg

SEQ ID NO: 3435462 - DNA, 14 bp, Homo sapiens
gacctgaggctgtg

SEQ ID NO: 3435463 - DNA, 18 bp, Homo sapiens
gacctggacacaggcctg

SEQ ID NO: 3435464 - DNA, 18 bp, Homo sapiens
gacctggcaaggacacag

SEQ ID NO: 3435465 - DNA, 22 bp, Homo sapiens
gacctggcactggatgcagaaa

SEQ ID NO: 3435466 - DNA, 16 bp, Homo sapiens
gacctggcagctctgg

SEQ ID NO: 3435467 - DNA, 21 bp, Homo sapiens
gacctggggttgtcagctctc

SEQ ID NO: 3435468 - DNA, 18 bp, Homo sapiens
gacctggtccacagggca

SEQ ID NO: 3435469 - DNA, 19 bp, Homo sapiens
gacctgtgagcccagctgg

SEQ ID NO: 3435470 - DNA, 18 bp, Homo sapiens
gacctgttagcagacagg

SEQ ID NO: 3435471 - DNA, 15 bp, Homo sapiens
gaccttaggccttcc

SEQ ID NO: 3435472 - DNA, 21 bp, Homo sapiens
gaccttaggccttcctctctc

SEQ ID NO: 3435473 - DNA, 19 bp, Homo sapiens
gaccttcgggctgtgcccg

SEQ ID NO: 3435474 - DNA, 23 bp, Homo sapiens
gaccttctaggacgccacccagc

SEQ ID NO: 3435475 - DNA, 17 bp, Homo sapiens
gaccttgttacttctga

SEQ ID NO: 3435476 - DNA, 22 bp, Homo sapiens
gacctttaattcaggtatgtaa

SEQ ID NO: 3435477 - DNA, 23 bp, Homo sapiens
gacctttccaccacagccagcac

SEQ ID NO: 3435478 - DNA, 19 bp, Homo sapiens
gacctttgtacagcccaga

SEQ ID NO: 3435479 - DNA, 12 bp, Homo sapiens
gacgccacccag

SEQ ID NO: 3435480 - DNA, 13 bp, Homo sapiens
gacgccacccagc

SEQ ID NO: 3435481 - DNA, 14 bp, Homo sapiens
gacgccacccagca

SEQ ID NO: 3435482 - DNA, 21 bp, Homo sapiens
gacgcctgggggtgccaggac

SEQ ID NO: 3435483 - DNA, 12 bp, Homo sapiens
gacggaggggag

SEQ ID NO: 3435484 - DNA, 21 bp, Homo sapiens
gacggaggggagtagagaagt

SEQ ID NO: 3435485 - DNA, 18 bp, Homo sapiens
gacggagtcccaccttgg

SEQ ID NO: 3435486 - DNA, 21 bp, Homo sapiens
gacggagtcccaccttggctg

SEQ ID NO: 3435487 - DNA, 18 bp, Homo sapiens
gacggtgcccaagccaga

SEQ ID NO: 3435488 - DNA, 17 bp, Homo sapiens
gacggtgctccaggcag

SEQ ID NO: 3435489 - DNA, 18 bp, Homo sapiens
gacgtcccttttttctct

SEQ ID NO: 3435490 - DNA, 15 bp, Homo sapiens
gacgtggctcagcca

SEQ ID NO: 3435491 - DNA, 14 bp, Homo sapiens
gacgtgtttgtgtt

SEQ ID NO: 3435492 - DNA, 21 bp, Homo sapiens
gagggaggggaagcttctgtc

SEQ ID NO: 3435493 - DNA, 18 bp, Homo sapiens
gagggattctggttccag

SEQ ID NO: 3435494 - DNA, 21 bp, Homo sapiens
gagggattctggttccagggt

SEQ ID NO: 3435495 - DNA, 20 bp, Homo sapiens
gagggcacattccttgcctg

SEQ ID NO: 3435496 - DNA, 19 bp, Homo sapiens
gagggcagcagaagggggt

SEQ ID NO: 3435497 - DNA, 14 bp, Homo sapiens
gagggcagcagggc

SEQ ID NO: 3435498 - DNA, 14 bp, Homo sapiens
gagggcctgctgga

SEQ ID NO: 3435499 - DNA, 20 bp, Homo sapiens
gagggcctgctggaggcctc

SEQ ID NO: 3435500 - DNA, 12 bp, Homo sapiens
gagggccttctt

SEQ ID NO: 3435501 - DNA, 19 bp, Homo sapiens
gagggcggcaggggcctgg

SEQ ID NO: 3435502 - DNA, 17 bp, Homo sapiens
gagggctggaggcccag

SEQ ID NO: 3435503 - DNA, 16 bp, Homo sapiens
gaggggacgcaggccc

SEQ ID NO: 3435504 - DNA, 22 bp, Homo sapiens
gaggggacgcaggcccctctcc

SEQ ID NO: 3435505 - DNA, 21 bp, Homo sapiens
gaggggtcgacttcgggctgg

SEQ ID NO: 3435506 - DNA, 14 bp, Homo sapiens
gagggtctgaggaa

SEQ ID NO: 3435507 - DNA, 15 bp, Homo sapiens
gagggtgagaggaag

SEQ ID NO: 3435508 - DNA, 16 bp, Homo sapiens
gagggtgagggccttc

SEQ ID NO: 3435509 - DNA, 17 bp, Homo sapiens
gagggtgagggccttct

SEQ ID NO: 3435510 - DNA, 12 bp, Homo sapiens
gagggtggaata

SEQ ID NO: 3435511 - DNA, 15 bp, Homo sapiens
gagggttgggctggt

SEQ ID NO: 3435512 - DNA, 13 bp, Homo sapiens
gagggttgtgcta

SEQ ID NO: 3435513 - DNA, 22 bp, Homo sapiens
gaggtattcaatatcctttgcc

SEQ ID NO: 3435514 - DNA, 17 bp, Homo sapiens
gaggtcaaggctgcagt

SEQ ID NO: 3435515 - DNA, 12 bp, Homo sapiens
gaggtcagagcc

SEQ ID NO: 3435516 - DNA, 17 bp, Homo sapiens
gaggtcagagcctgcag

SEQ ID NO: 3435517 - DNA, 17 bp, Homo sapiens
gaggtcagcatttgatc

SEQ ID NO: 3435518 - DNA, 23 bp, Homo sapiens
gaggtcggtaggttcagccaagg

SEQ ID NO: 3435519 - DNA, 15 bp, Homo sapiens
gaggtgccttcttca

SEQ ID NO: 3435520 - DNA, 20 bp, Homo sapiens
gaggtgccttcttcagggcc

SEQ ID NO: 3435521 - DNA, 15 bp, Homo sapiens
gaggttaaggctgag

SEQ ID NO: 3435522 - DNA, 20 bp, Homo sapiens
gaggttgatcagatctgaca

SEQ ID NO: 3435523 - DNA, 22 bp, Homo sapiens
gaggtttcaccatgatggccag

SEQ ID NO: 3435524 - DNA, 16 bp, Homo sapiens
gagtacaggtgaagca

SEQ ID NO: 3435525 - DNA, 17 bp, Homo sapiens
gagtactgtgggcaatt

SEQ ID NO: 3435526 - DNA, 17 bp, Homo sapiens
gagtagaattgcattga

SEQ ID NO: 3435527 - DNA, 17 bp, Homo sapiens
gagtagatgcgcagccc

SEQ ID NO: 3435528 - DNA, 17 bp, Homo sapiens
gagtagctagtttgctt

SEQ ID NO: 3435529 - DNA, 14 bp, Homo sapiens
gagtattggtctcc

SEQ ID NO: 3435530 - DNA, 17 bp, Homo sapiens
gagtcacattctgctta

SEQ ID NO: 3435531 - DNA, 13 bp, Homo sapiens
gagtcaccaagcc

SEQ ID NO: 3435532 - DNA, 14 bp, Homo sapiens
gagtcaccaagccc

SEQ ID NO: 3435533 - DNA, 15 bp, Homo sapiens
gagtcactacaactg

SEQ ID NO: 3435534 - DNA, 14 bp, Homo sapiens
gagtcagccaggag

SEQ ID NO: 3435535 - DNA, 21 bp, Homo sapiens
gagtcagccccgacttcctga

SEQ ID NO: 3435536 - DNA, 14 bp, Homo sapiens
gagtcagctctctg

SEQ ID NO: 3435537 - DNA, 18 bp, Homo sapiens
gagtcagctctctgccct

SEQ ID NO: 3435538 - DNA, 22 bp, Homo sapiens
gagtcatctgttagggccttgg

SEQ ID NO: 3435539 - DNA, 18 bp, Homo sapiens
gagtcattcgttctgtgg

SEQ ID NO: 3435540 - DNA, 14 bp, Homo sapiens
gagtccaagctggg

SEQ ID NO: 3435541 - DNA, 16 bp, Homo sapiens
gagtcccaccttggct

SEQ ID NO: 3435542 - DNA, 20 bp, Homo sapiens
gagtcccaccttggctgcag

SEQ ID NO: 3435543 - DNA, 13 bp, Homo sapiens
gagtcctctgaat

SEQ ID NO: 3435544 - DNA, 19 bp, Homo sapiens
gagtctaatagtctttgcc

SEQ ID NO: 3435545 - DNA, 17 bp, Homo sapiens
gagtctatgttcaaaga

SEQ ID NO: 3435546 - DNA, 21 bp, Homo sapiens
gagtctcactctcgtcgccca

SEQ ID NO: 3435547 - DNA, 23 bp, Homo sapiens
gagtctcactgttgcccaggctg

SEQ ID NO: 3435548 - DNA, 14 bp, Homo sapiens
gagtctgaagcaga

SEQ ID NO: 3435549 - DNA, 21 bp, Homo sapiens
gagtgaactggtcttcctttt

SEQ ID NO: 3435550 - DNA, 21 bp, Homo sapiens
gagtgacacccaagagggctg

SEQ ID NO: 3435551 - DNA, 19 bp, Homo sapiens
gagtgacagtggattgcat

SEQ ID NO: 3435552 - DNA, 12 bp, Homo sapiens
gagtgagctggt

SEQ ID NO: 3435553 - DNA, 19 bp, Homo sapiens
gagtgatagtcttttgctt

SEQ ID NO: 3435554 - DNA, 23 bp, Homo sapiens
gagtgcagccgtttgagaagaaa

SEQ ID NO: 3435555 - DNA, 17 bp, Homo sapiens
gagtgcagtcctgatca

SEQ ID NO: 3435556 - DNA, 11 bp, Homo sapiens
gagtgcagtga

SEQ ID NO: 3435557 - DNA, 12 bp, Homo sapiens
gagtgcagtgag

SEQ ID NO: 3435558 - DNA, 13 bp, Homo sapiens
gagtgcagtgagc

SEQ ID NO: 3435559 - DNA, 14 bp, Homo sapiens
gagtgccttttgca

SEQ ID NO: 3435560 - DNA, 11 bp, Homo sapiens
gagtgctaagt

SEQ ID NO: 3435561 - DNA, 18 bp, Homo sapiens
gagtggatgatgtttcgt

SEQ ID NO: 3435562 - DNA, 19 bp, Homo sapiens
gagtggcaggggacaggag

SEQ ID NO: 3435563 - DNA, 15 bp, Homo sapiens
gagtgggggaggggg

SEQ ID NO: 3435564 - DNA, 23 bp, Homo sapiens
gagtgggggatcacagcctctga

SEQ ID NO: 3435565 - DNA, 13 bp, Homo sapiens
gagtgggtgaata

SEQ ID NO: 3435566 - DNA, 15 bp, Homo sapiens
gagtgtctttccacg

SEQ ID NO: 3435567 - DNA, 19 bp, Homo sapiens
gagtgtctttccacggagc

SEQ ID NO: 3435568 - DNA, 22 bp, Homo sapiens
gagtgtctttccacggagccac

SEQ ID NO: 3435569 - DNA, 11 bp, Homo sapiens
gagtgtgaatg

SEQ ID NO: 3435570 - DNA, 18 bp, Homo sapiens
gagtgtgagccacctaag

SEQ ID NO: 3435571 - DNA, 12 bp, Homo sapiens
gagttaagacct

SEQ ID NO: 3435572 - DNA, 21 bp, Homo sapiens
gagttaagacctggcagctct

SEQ ID NO: 3435573 - DNA, 13 bp, Homo sapiens
gagttaaggtggg

SEQ ID NO: 3435574 - DNA, 16 bp, Homo sapiens
gagttatctaaaagaa

SEQ ID NO: 3435575 - DNA, 18 bp, Homo sapiens
gagttatctaaaagaaat

SEQ ID NO: 3435576 - DNA, 22 bp, Homo sapiens
gagttcaggtagctgcccctgg

SEQ ID NO: 3435577 - DNA, 20 bp, Homo sapiens
gagttcataccctgttacca

SEQ ID NO: 3435578 - DNA, 12 bp, Homo sapiens
gagttccagtca

SEQ ID NO: 3435579 - DNA, 18 bp, Homo sapiens
gagttccccatgcagaca

SEQ ID NO: 3435580 - DNA, 18 bp, Homo sapiens
gagttcgagaccagcctg

SEQ ID NO: 3435581 - DNA, 14 bp, Homo sapiens
gagttgatctggaa

SEQ ID NO: 3435582 - DNA, 16 bp, Homo sapiens
gagttgatctggaacc

SEQ ID NO: 3435583 - DNA, 17 bp, Homo sapiens
gagttgatctggaaccc

SEQ ID NO: 3435584 - DNA, 21 bp, Homo sapiens
gagttgatctggaacccagac

SEQ ID NO: 3435585 - DNA, 14 bp, Homo sapiens
gagttgtaaatata

SEQ ID NO: 3435586 - DNA, 15 bp, Homo sapiens
gagttgtaaatatat

SEQ ID NO: 3435587 - DNA, 13 bp, Homo sapiens
gagtttaaaaatc

SEQ ID NO: 3435588 - DNA, 15 bp, Homo sapiens
gagtttcatgtacaa

SEQ ID NO: 3435589 - DNA, 18 bp, Homo sapiens
gagtttcatgtacaagat

SEQ ID NO: 3435590 - DNA, 22 bp, Homo sapiens
gagtttgtcgctcatgtgtgca

SEQ ID NO: 3435591 - DNA, 12 bp, Homo sapiens
gagttttgtagc

SEQ ID NO: 3435592 - DNA, 13 bp, Homo sapiens
gagttttgtagca

SEQ ID NO: 3435593 - DNA, 13 bp, Homo sapiens
gagttttgtttta

SEQ ID NO: 3435594 - DNA, 22 bp, Homo sapiens
gagtttttcccagctacacctt

SEQ ID NO: 3435595 - DNA, 20 bp, Homo sapiens
gataaatcagtcaagctgtt

SEQ ID NO: 3435596 - DNA, 18 bp, Homo sapiens
gataaatcagtggttatt

SEQ ID NO: 3435597 - DNA, 13 bp, Homo sapiens
gataaattataag

SEQ ID NO: 3435598 - DNA, 13 bp, Homo sapiens
gataaattgccat

SEQ ID NO: 3435599 - DNA, 18 bp, Homo sapiens
gataaattgccataatat

SEQ ID NO: 3435600 - DNA, 21 bp, Homo sapiens
gataaattgccataatatgat

SEQ ID NO: 3435601 - DNA, 17 bp, Homo sapiens
gataactagatggtgct

SEQ ID NO: 3435602 - DNA, 20 bp, Homo sapiens
gataactagatggtgctgag

SEQ ID NO: 3435603 - DNA, 14 bp, Homo sapiens
gataaggacatgat

SEQ ID NO: 3435604 - DNA, 20 bp, Homo sapiens
gataaggacatgatgctttt

SEQ ID NO: 3435605 - DNA, 12 bp, Homo sapiens
gataataaagga

SEQ ID NO: 3435606 - DNA, 14 bp, Homo sapiens
gataatacattccg

SEQ ID NO: 3435607 - DNA, 17 bp, Homo sapiens
gataatatattttcaag

SEQ ID NO: 3435608 - DNA, 18 bp, Homo sapiens
gataatattgtggtgcca

SEQ ID NO: 3435609 - DNA, 21 bp, Homo sapiens
gataatattttacatacactg

SEQ ID NO: 3435610 - DNA, 20 bp, Homo sapiens
gataatgacactgtttcctg

SEQ ID NO: 3435611 - DNA, 15 bp, Homo sapiens
gataattacaataca

SEQ ID NO: 3435612 - DNA, 19 bp, Homo sapiens
gatacaggaaaaatgaaaa

SEQ ID NO: 3435613 - DNA, 18 bp, Homo sapiens
gatacaggaaaagctgct

SEQ ID NO: 3435614 - DNA, 17 bp, Homo sapiens
gatacagtcaacaagcc

SEQ ID NO: 3435615 - DNA, 19 bp, Homo sapiens
gatacagtcaacaagcctg

SEQ ID NO: 3435616 - DNA, 21 bp, Homo sapiens
gatacatacaccagcattcct

SEQ ID NO: 3435617 - DNA, 20 bp, Homo sapiens
gatacatccaaagcagacag

SEQ ID NO: 3435618 - DNA, 14 bp, Homo sapiens
gataccagaaggga

SEQ ID NO: 3435619 - DNA, 12 bp, Homo sapiens
gatactctcttc

SEQ ID NO: 3435620 - DNA, 18 bp, Homo sapiens
gatactgcgactttctgc

SEQ ID NO: 3435621 - DNA, 20 bp, Homo sapiens
gatactgcgactttctgcct

SEQ ID NO: 3435622 - DNA, 23 bp, Homo sapiens
gatactgcgactttctgcctgga

SEQ ID NO: 3435623 - DNA, 17 bp, Homo sapiens
gatactgtctctttcat

SEQ ID NO: 3435624 - DNA, 16 bp, Homo sapiens
gatacttaacaaatac

SEQ ID NO: 3435625 - DNA, 19 bp, Homo sapiens
gcactactaaaagtttaga

SEQ ID NO: 3435626 - DNA, 23 bp, Homo sapiens
gcactactaaaagtttagaactt

SEQ ID NO: 3435627 - DNA, 17 bp, Homo sapiens
gcactcaggctctccat

SEQ ID NO: 3435628 - DNA, 17 bp, Homo sapiens
gcactccagcctgggtg

SEQ ID NO: 3435629 - DNA, 12 bp, Homo sapiens
gcactgacattg

SEQ ID NO: 3435630 - DNA, 16 bp, Homo sapiens
gcactgactgggcata

SEQ ID NO: 3435631 - DNA, 17 bp, Homo sapiens
gcactgactgggcatag

SEQ ID NO: 3435632 - DNA, 19 bp, Homo sapiens
gcactgatgctgcccctca

SEQ ID NO: 3435633 - DNA, 14 bp, Homo sapiens
gcactgcagccaca

SEQ ID NO: 3435634 - DNA, 20 bp, Homo sapiens
gcactgcagccacaggggat

SEQ ID NO: 3435635 - DNA, 15 bp, Homo sapiens
gcactgggatcacag

SEQ ID NO: 3435636 - DNA, 14 bp, Homo sapiens
gcactgggctcccg

SEQ ID NO: 3435637 - DNA, 16 bp, Homo sapiens
gcactgtgaaggaccc

SEQ ID NO: 3435638 - DNA, 17 bp, Homo sapiens
gcactgtgaaggaccct

SEQ ID NO: 3435639 - DNA, 14 bp, Homo sapiens
gcactgtgctcagg

SEQ ID NO: 3435640 - DNA, 16 bp, Homo sapiens
gcactgtgctcagggc

SEQ ID NO: 3435641 - DNA, 18 bp, Homo sapiens
gcactgttccccctgtgc

SEQ ID NO: 3435642 - DNA, 22 bp, Homo sapiens
gcactgttctgggactccaggt

SEQ ID NO: 3435643 - DNA, 16 bp, Homo sapiens
gcacttatgatttcat

SEQ ID NO: 3435644 - DNA, 18 bp, Homo sapiens
gcacttcatctggctgcc

SEQ ID NO: 3435645 - DNA, 20 bp, Homo sapiens
gcacttcccagagcatcttg

SEQ ID NO: 3435646 - DNA, 12 bp, Homo sapiens
gcacttccctgc

SEQ ID NO: 3435647 - DNA, 14 bp, Homo sapiens
gcacttccctgctg

SEQ ID NO: 3435648 - DNA, 15 bp, Homo sapiens
gcacttgaagaatat

SEQ ID NO: 3435649 - DNA, 17 bp, Homo sapiens
gcacttgtgattattta

SEQ ID NO: 3435650 - DNA, 20 bp, Homo sapiens
gcacttgtgattatttatta

SEQ ID NO: 3435651 - DNA, 21 bp, Homo sapiens
gcactttctacaatgtgaact

SEQ ID NO: 3435652 - DNA, 14 bp, Homo sapiens
gcactttgtaaatt

SEQ ID NO: 3435653 - DNA, 12 bp, Homo sapiens
gcagaaccagcc

SEQ ID NO: 3435654 - DNA, 19 bp, Homo sapiens
gcagaactaaactcattta

SEQ ID NO: 3435655 - DNA, 14 bp, Homo sapiens
gcagaagagggtgt

SEQ ID NO: 3435656 - DNA, 21 bp, Homo sapiens
gcagaagcaagggggtgatgt

SEQ ID NO: 3435657 - DNA, 13 bp, Homo sapiens
gcagaaggaaaaa

SEQ ID NO: 3435658 - DNA, 15 bp, Homo sapiens
gcagaagggggtggt

SEQ ID NO: 3435659 - DNA, 15 bp, Homo sapiens
gcagaagtaagcctc

SEQ ID NO: 3435660 - DNA, 23 bp, Homo sapiens
gcagacacagggacttgaagttg

SEQ ID NO: 3435661 - DNA, 23 bp, Homo sapiens
gcagacacggatctgagaatctt

SEQ ID NO: 3435662 - DNA, 15 bp, Homo sapiens
gcagacagctccacc

SEQ ID NO: 3435663 - DNA, 20 bp, Homo sapiens
gcagacaggccccgtgaggc

SEQ ID NO: 3435664 - DNA, 12 bp, Homo sapiens
gcagacctctgg

SEQ ID NO: 3435665 - DNA, 21 bp, Homo sapiens
gcagacctgtcaccctgcagg

SEQ ID NO: 3435666 - DNA, 15 bp, Homo sapiens
gcagactctacagag

SEQ ID NO: 3435667 - DNA, 18 bp, Homo sapiens
gcagactctacagaggcc

SEQ ID NO: 3435668 - DNA, 22 bp, Homo sapiens
gcagactctacagaggccatgg

SEQ ID NO: 3435669 - DNA, 20 bp, Homo sapiens
gcagactctttatgcttgca

SEQ ID NO: 3435670 - DNA, 18 bp, Homo sapiens
gcagactgatcaggacct

SEQ ID NO: 3435671 - DNA, 15 bp, Homo sapiens
gcagacttcccagct

SEQ ID NO: 3435672 - DNA, 18 bp, Homo sapiens
gcagacttcccagctagg

SEQ ID NO: 3435673 - DNA, 20 bp, Homo sapiens
gcagagaaacttaagcaaag

SEQ ID NO: 3435674 - DNA, 19 bp, Homo sapiens
gcagagaatgaaagggccc

SEQ ID NO: 3435675 - DNA, 22 bp, Homo sapiens
gcagagaatgaaagggcccaga

SEQ ID NO: 3435676 - DNA, 22 bp, Homo sapiens
gcagagattggaatgggcagct

SEQ ID NO: 3435677 - DNA, 14 bp, Homo sapiens
gcagagcacacagg

SEQ ID NO: 3435678 - DNA, 19 bp, Homo sapiens
gcagagcccggagctccgg

SEQ ID NO: 3435679 - DNA, 23 bp, Homo sapiens
gcagagctggctctgagcgcctc

SEQ ID NO: 3435680 - DNA, 16 bp, Homo sapiens
gcagagcttcttccag

SEQ ID NO: 3435681 - DNA, 22 bp, Homo sapiens
gcagagcttcttccaggtgccc

SEQ ID NO: 3435682 - DNA, 16 bp, Homo sapiens
gcagagcttttcagat

SEQ ID NO: 3435683 - DNA, 12 bp, Homo sapiens
gcagaggagggg

SEQ ID NO: 3435684 - DNA, 15 bp, Homo sapiens
gcagaggaggggccg

SEQ ID NO: 3435685 - DNA, 13 bp, Homo sapiens
gcagaggcctggg

SEQ ID NO: 3435686 - DNA, 13 bp, Homo sapiens
gcagagggctgga

SEQ ID NO: 3435687 - DNA, 14 bp, Homo sapiens
gcagagggctggag

SEQ ID NO: 3435688 - DNA, 14 bp, Homo sapiens
gcagaggtctccaa

SEQ ID NO: 3435689 - DNA, 18 bp, Homo sapiens
gcagagtcacaagcctcg

SEQ ID NO: 3435690 - DNA, 14 bp, Homo sapiens
gcagagtcacacgg

SEQ ID NO: 3435691 - DNA, 13 bp, Homo sapiens
gcagagttgtaaa

SEQ ID NO: 3435692 - DNA, 23 bp, Homo sapiens
gcagagttgtaaatatataaata

SEQ ID NO: 3435693 - DNA, 14 bp, Homo sapiens
gcagatgacaagat

SEQ ID NO: 3435694 - DNA, 13 bp, Homo sapiens
gcagatgcaatga

SEQ ID NO: 3435695 - DNA, 19 bp, Homo sapiens
gcagatgcaatgactcagg

SEQ ID NO: 3435696 - DNA, 18 bp, Homo sapiens
gcagatgcacatgttgga

SEQ ID NO: 3435697 - DNA, 18 bp, Homo sapiens
gcagatggcagatgcaca

SEQ ID NO: 3435698 - DNA, 17 bp, Homo sapiens
gcagcaccctataaatc

SEQ ID NO: 3435699 - DNA, 17 bp, Homo sapiens
gcagcaccctgcagagc

SEQ ID NO: 3435700 - DNA, 17 bp, Homo sapiens
gcagcaccgttctgtgc

SEQ ID NO: 3435701 - DNA, 18 bp, Homo sapiens
gcagcaccgttctgtgca

SEQ ID NO: 3435702 - DNA, 13 bp, Homo sapiens
gcagcagaagggg

SEQ ID NO: 3435703 - DNA, 15 bp, Homo sapiens
gcagcagaagggggt

SEQ ID NO: 3435704 - DNA, 16 bp, Homo sapiens
gcagcaggaggccagg

SEQ ID NO: 3435705 - DNA, 20 bp, Homo sapiens
gcagcagggctaccctgagc

SEQ ID NO: 3435706 - DNA, 20 bp, Homo sapiens
gcagcagtgtgaggccaggg

SEQ ID NO: 3435707 - DNA, 22 bp, Homo sapiens
gcagcagtgtgaggccagggca

SEQ ID NO: 3435708 - DNA, 17 bp, Homo sapiens
gcagccaagctccttgg

SEQ ID NO: 3435709 - DNA, 15 bp, Homo sapiens
gcagcccaagcttcc

SEQ ID NO: 3435710 - DNA, 13 bp, Homo sapiens
gcagccccagcct

SEQ ID NO: 3435711 - DNA, 17 bp, Homo sapiens
gcagccccattctgcct

SEQ ID NO: 3435712 - DNA, 21 bp, Homo sapiens
gcagccctgctgctgcctgcc

SEQ ID NO: 3435713 - DNA, 17 bp, Homo sapiens
gcagccgctgagcgagg

SEQ ID NO: 3435714 - DNA, 18 bp, Homo sapiens
gcagccgtttgagaagaa

SEQ ID NO: 3435715 - DNA, 20 bp, Homo sapiens
gcagcctcaacctcctgggc

SEQ ID NO: 3435716 - DNA, 21 bp, Homo sapiens
gcagcctcccatccagggccc

SEQ ID NO: 3435717 - DNA, 20 bp, Homo sapiens
gcagcctctccccaggtcca

SEQ ID NO: 3435718 - DNA, 14 bp, Homo sapiens
gcagcctggggctg

SEQ ID NO: 3435719 - DNA, 13 bp, Homo sapiens
gcagcgaccccag

SEQ ID NO: 3435720 - DNA, 14 bp, Homo sapiens
gcagcgaccccagg

SEQ ID NO: 3435721 - DNA, 18 bp, Homo sapiens
gcagcgccgtgtcctctc

SEQ ID NO: 3435722 - DNA, 14 bp, Homo sapiens
gcagctcaaaggca

SEQ ID NO: 3435723 - DNA, 15 bp, Homo sapiens
gcagctcaaaggcac

SEQ ID NO: 3435724 - DNA, 19 bp, Homo sapiens
gcagctcaggttgtagtgg

SEQ ID NO: 3435725 - DNA, 13 bp, Homo sapiens
gcagctcctcagc

SEQ ID NO: 3435726 - DNA, 13 bp, Homo sapiens
gcagctctctttc

SEQ ID NO: 3435727 - DNA, 16 bp, Homo sapiens
gcagctgatacaaatt

SEQ ID NO: 3435728 - DNA, 19 bp, Homo sapiens
gcagctgcggtccacccag

SEQ ID NO: 3435729 - DNA, 14 bp, Homo sapiens
gcaggaagctcaga

SEQ ID NO: 3435730 - DNA, 15 bp, Homo sapiens
gcaggaagctgctcc

SEQ ID NO: 3435731 - DNA, 11 bp, Homo sapiens
gcaggaaggct

SEQ ID NO: 3435732 - DNA, 19 bp, Homo sapiens
gcaggaatatatgtgtgcc

SEQ ID NO: 3435733 - DNA, 17 bp, Homo sapiens
gcaggaatgaaaacatt

SEQ ID NO: 3435734 - DNA, 18 bp, Homo sapiens
gcaggacaacgaggaagc

SEQ ID NO: 3435735 - DNA, 15 bp, Homo sapiens
gcaggacctgcctgt

SEQ ID NO: 3435736 - DNA, 13 bp, Homo sapiens
gcaggactccagg

SEQ ID NO: 3435737 - DNA, 14 bp, Homo sapiens
gcaggactccaggc

SEQ ID NO: 3435738 - DNA, 19 bp, Homo sapiens
gcaggactgcacagcgtcc

SEQ ID NO: 3435739 - DNA, 13 bp, Homo sapiens
gcaggactgcaga

SEQ ID NO: 3435740 - DNA, 22 bp, Homo sapiens
gcaggacttccccggagggctg

SEQ ID NO: 3435741 - DNA, 15 bp, Homo sapiens
gcaggagagcagtga

SEQ ID NO: 3435742 - DNA, 17 bp, Homo sapiens
gcaggagcacacccagc

SEQ ID NO: 3435743 - DNA, 14 bp, Homo sapiens
gcaggaggccaggc

SEQ ID NO: 3435744 - DNA, 20 bp, Homo sapiens
gcaggatcgaagggttttta

SEQ ID NO: 3435745 - DNA, 20 bp, Homo sapiens
gcaggcagacacggatctga

SEQ ID NO: 3435746 - DNA, 18 bp, Homo sapiens
gcaggcccctctcctccg

SEQ ID NO: 3435747 - DNA, 14 bp, Homo sapiens
gcaggccctggcct

SEQ ID NO: 3435748 - DNA, 15 bp, Homo sapiens
gcaggccctggcctc

SEQ ID NO: 3435749 - DNA, 16 bp, Homo sapiens
gcaggccctggcctcc

SEQ ID NO: 3435750 - DNA, 13 bp, Homo sapiens
gcaggcctaggtg

SEQ ID NO: 3435751 - DNA, 22 bp, Homo sapiens
gcaggctaaggcgtggagctgc

SEQ ID NO: 3435752 - DNA, 23 bp, Homo sapiens
gcaggctcccagggacacctggg

SEQ ID NO: 3435753 - DNA, 21 bp, Homo sapiens
gcagggaaaattatttgcata

SEQ ID NO: 3435754 - DNA, 19 bp, Homo sapiens
gcagggccaacccttctcc

SEQ ID NO: 3435755 - DNA, 23 bp, Homo sapiens
gcagggccgccagggagacctgg

SEQ ID NO: 3435756 - DNA, 23 bp, Homo sapiens
gcagggctgtgcttgaaggccct

SEQ ID NO: 3435757 - DNA, 13 bp, Homo sapiens
gcaggggcctgga

SEQ ID NO: 3435758 - DNA, 18 bp, Homo sapiens
gccccggtcacctagcaa

SEQ ID NO: 3435759 - DNA, 17 bp, Homo sapiens
gccccggtggctgggca

SEQ ID NO: 3435760 - DNA, 19 bp, Homo sapiens
gccccggtggctgggcaga

SEQ ID NO: 3435761 - DNA, 15 bp, Homo sapiens
gcccctaatctctgt

SEQ ID NO: 3435762 - DNA, 19 bp, Homo sapiens
gcccctaatctctgtagga

SEQ ID NO: 3435763 - DNA, 18 bp, Homo sapiens
gcccctagccggttcctg

SEQ ID NO: 3435764 - DNA, 20 bp, Homo sapiens
gcccctagccggttcctgtc

SEQ ID NO: 3435765 - DNA, 20 bp, Homo sapiens
gcccctatgtagtccgtgct

SEQ ID NO: 3435766 - DNA, 21 bp, Homo sapiens
gcccctcatctctctgcccaa

SEQ ID NO: 3435767 - DNA, 19 bp, Homo sapiens
gcccctcccaagctggctg

SEQ ID NO: 3435768 - DNA, 13 bp, Homo sapiens
gcccctcggctct

SEQ ID NO: 3435769 - DNA, 14 bp, Homo sapiens
gcccctctcctccg

SEQ ID NO: 3435770 - DNA, 15 bp, Homo sapiens
gcccctctctgggcc

SEQ ID NO: 3435771 - DNA, 14 bp, Homo sapiens
gcccctctggtcgc

SEQ ID NO: 3435772 - DNA, 20 bp, Homo sapiens
gcccctctggtcgctcctgc

SEQ ID NO: 3435773 - DNA, 23 bp, Homo sapiens
gcccctgccacctcctgcctcag

SEQ ID NO: 3435774 - DNA, 20 bp, Homo sapiens
gcccctgctgctgtcacctc

SEQ ID NO: 3435775 - DNA, 16 bp, Homo sapiens
gcccctgctggttcag

SEQ ID NO: 3435776 - DNA, 21 bp, Homo sapiens
gcccctgctggttcagggttg

SEQ ID NO: 3435777 - DNA, 14 bp, Homo sapiens
gcccctggacatgc

SEQ ID NO: 3435778 - DNA, 16 bp, Homo sapiens
gcccctggacatgcct

SEQ ID NO: 3435779 - DNA, 17 bp, Homo sapiens
gcccctggacatgcctg

SEQ ID NO: 3435780 - DNA, 21 bp, Homo sapiens
gcccctggacatgcctgtcct

SEQ ID NO: 3435781 - DNA, 11 bp, Homo sapiens
gcccctggagg

SEQ ID NO: 3435782 - DNA, 20 bp, Homo sapiens
gcccctggaggctgcctccc

SEQ ID NO: 3435783 - DNA, 11 bp, Homo sapiens
gcccctggccc

SEQ ID NO: 3435784 - DNA, 14 bp, Homo sapiens
gcccctggccccag

SEQ ID NO: 3435785 - DNA, 20 bp, Homo sapiens
gcccctggccccgcctgcct

SEQ ID NO: 3435786 - DNA, 15 bp, Homo sapiens
gcccctggggtggcc

SEQ ID NO: 3435787 - DNA, 20 bp, Homo sapiens
gccccttactatgatctcag

SEQ ID NO: 3435788 - DNA, 23 bp, Homo sapiens
gccccttcattgatttcctgtgt

SEQ ID NO: 3435789 - DNA, 14 bp, Homo sapiens
gccccttcctttaa

SEQ ID NO: 3435790 - DNA, 17 bp, Homo sapiens
gccccttctcagaatct

SEQ ID NO: 3435791 - DNA, 18 bp, Homo sapiens
gccccttctcagaatcta

SEQ ID NO: 3435792 - DNA, 17 bp, Homo sapiens
gccccttctgctcagct

SEQ ID NO: 3435793 - DNA, 23 bp, Homo sapiens
gccccttctgctcagctctgggc

SEQ ID NO: 3435794 - DNA, 19 bp, Homo sapiens
gccccttgacaactggcag

SEQ ID NO: 3435795 - DNA, 20 bp, Homo sapiens
gcccctttacggacaccccc

SEQ ID NO: 3435796 - DNA, 14 bp, Homo sapiens
gcccgacatttctt

SEQ ID NO: 3435797 - DNA, 13 bp, Homo sapiens
gcccgcacacctg

SEQ ID NO: 3435798 - DNA, 15 bp, Homo sapiens
gcccgcagacctctg

SEQ ID NO: 3435799 - DNA, 18 bp, Homo sapiens
gcccgcagacctctggat

SEQ ID NO: 3435800 - DNA, 23 bp, Homo sapiens
gcccgcagagcgcgcccctagcc

SEQ ID NO: 3435801 - DNA, 16 bp, Homo sapiens
gcccgcgccacaggac

SEQ ID NO: 3435802 - DNA, 15 bp, Homo sapiens
gcccggagctccggc

SEQ ID NO: 3435803 - DNA, 18 bp, Homo sapiens
gcccggagctccggcctg

SEQ ID NO: 3435804 - DNA, 19 bp, Homo sapiens
gcccggagctgcccctctc

SEQ ID NO: 3435805 - DNA, 23 bp, Homo sapiens
gcccggagctgcccctctctggg

SEQ ID NO: 3435806 - DNA, 14 bp, Homo sapiens
gcccggctccaggc

SEQ ID NO: 3435807 - DNA, 17 bp, Homo sapiens
gcccggctccaggctcc

SEQ ID NO: 3435808 - DNA, 18 bp, Homo sapiens
gcccggctccaggctcct

SEQ ID NO: 3435809 - DNA, 19 bp, Homo sapiens
gcccgtgtacatagtgcat

SEQ ID NO: 3435810 - DNA, 15 bp, Homo sapiens
gccctaaaagcacac

SEQ ID NO: 3435811 - DNA, 23 bp, Homo sapiens
gccctaattcagccatgtacaga

SEQ ID NO: 3435812 - DNA, 14 bp, Homo sapiens
gccctactattcag

SEQ ID NO: 3435813 - DNA, 13 bp, Homo sapiens
gccctatgggcct

SEQ ID NO: 3435814 - DNA, 14 bp, Homo sapiens
gccctatgggcctg

SEQ ID NO: 3435815 - DNA, 15 bp, Homo sapiens
gccctatgggcctgc

SEQ ID NO: 3435816 - DNA, 19 bp, Homo sapiens
gccctatgggcctgccggg

SEQ ID NO: 3435817 - DNA, 14 bp, Homo sapiens
gccctcaagaacat

SEQ ID NO: 3435818 - DNA, 23 bp, Homo sapiens
gccctcaagaacatgatgggcct

SEQ ID NO: 3435819 - DNA, 13 bp, Homo sapiens
gccctcacctccc

SEQ ID NO: 3435820 - DNA, 17 bp, Homo sapiens
gccctccagctctttcc

SEQ ID NO: 3435821 - DNA, 12 bp, Homo sapiens
gccctcccaggc

SEQ ID NO: 3435822 - DNA, 15 bp, Homo sapiens
gccctccgccttcac

SEQ ID NO: 3435823 - DNA, 20 bp, Homo sapiens
gccctcctctcccattgtcc

SEQ ID NO: 3435824 - DNA, 15 bp, Homo sapiens
gccctcgctgccagc

SEQ ID NO: 3435825 - DNA, 12 bp, Homo sapiens
gccctctctttt

SEQ ID NO: 3435826 - DNA, 17 bp, Homo sapiens
gccctctggagtggcca

SEQ ID NO: 3435827 - DNA, 18 bp, Homo sapiens
gccctctggagtggccac

SEQ ID NO: 3435828 - DNA, 14 bp, Homo sapiens
gccctgagctttct

SEQ ID NO: 3435829 - DNA, 18 bp, Homo sapiens
gccctgcaaaaggactct

SEQ ID NO: 3435830 - DNA, 19 bp, Homo sapiens
gccctgccactcactaggc

SEQ ID NO: 3435831 - DNA, 20 bp, Homo sapiens
gccctgccactcactaggcc

SEQ ID NO: 3435832 - DNA, 18 bp, Homo sapiens
gccctgccagagcagggg

SEQ ID NO: 3435833 - DNA, 17 bp, Homo sapiens
gccctgccctggcaggg

SEQ ID NO: 3435834 - DNA, 20 bp, Homo sapiens
gccctgcggagccggcacct

SEQ ID NO: 3435835 - DNA, 19 bp, Homo sapiens
gccctgctgagtcatctgt

SEQ ID NO: 3435836 - DNA, 18 bp, Homo sapiens
gccctgctgctgcctgcc

SEQ ID NO: 3435837 - DNA, 17 bp, Homo sapiens
gccctggcctcccctgc

SEQ ID NO: 3435838 - DNA, 20 bp, Homo sapiens
gccctggcctcccctgccac

SEQ ID NO: 3435839 - DNA, 19 bp, Homo sapiens
gccctggctccagtgaaac

SEQ ID NO: 3435840 - DNA, 14 bp, Homo sapiens
gccctgggctggaa

SEQ ID NO: 3435841 - DNA, 14 bp, Homo sapiens
gccctggtcctggc

SEQ ID NO: 3435842 - DNA, 19 bp, Homo sapiens
gccctggtggcagtgggag

SEQ ID NO: 3435843 - DNA, 19 bp, Homo sapiens
gccctgtagttaggcctgg

SEQ ID NO: 3435844 - DNA, 15 bp, Homo sapiens
gccctgtcctgccat

SEQ ID NO: 3435845 - DNA, 19 bp, Homo sapiens
gccctgtcgggctttgtgt

SEQ ID NO: 3435846 - DNA, 16 bp, Homo sapiens
gccctgttgacacagg

SEQ ID NO: 3435847 - DNA, 18 bp, Homo sapiens
gcccttatctgtgctcag

SEQ ID NO: 3435848 - DNA, 18 bp, Homo sapiens
gccctttgagtgcagtcc

SEQ ID NO: 3435849 - DNA, 14 bp, Homo sapiens
gccctttgctgtcc

SEQ ID NO: 3435850 - DNA, 17 bp, Homo sapiens
gcccttttttctgcctc

SEQ ID NO: 3435851 - DNA, 13 bp, Homo sapiens
gccgaccttagat

SEQ ID NO: 3435852 - DNA, 14 bp, Homo sapiens
gccgagaagcaaga

SEQ ID NO: 3435853 - DNA, 18 bp, Homo sapiens
gccgagatcacgccactg

SEQ ID NO: 3435854 - DNA, 20 bp, Homo sapiens
gccgagatcacgccactgca

SEQ ID NO: 3435855 - DNA, 17 bp, Homo sapiens
gccgattcacctgagca

SEQ ID NO: 3435856 - DNA, 16 bp, Homo sapiens
gccgcaaaccacactg

SEQ ID NO: 3435857 - DNA, 13 bp, Homo sapiens
gccgcctccagga

SEQ ID NO: 3435858 - DNA, 18 bp, Homo sapiens
gccgcctggtactcaagc

SEQ ID NO: 3435859 - DNA, 14 bp, Homo sapiens
gccgctgcccgctc

SEQ ID NO: 3435860 - DNA, 18 bp, Homo sapiens
gccgctgcccgctcagcc

SEQ ID NO: 3435861 - DNA, 19 bp, Homo sapiens
gccgctgcttccaggctgg

SEQ ID NO: 3435862 - DNA, 21 bp, Homo sapiens
gccggcacctacatccccagg

SEQ ID NO: 3435863 - DNA, 22 bp, Homo sapiens
gccggcacctacatccccaggt

SEQ ID NO: 3435864 - DNA, 14 bp, Homo sapiens
gccggcagccccag

SEQ ID NO: 3435865 - DNA, 18 bp, Homo sapiens
gccggcagccccagcctg

SEQ ID NO: 3435866 - DNA, 20 bp, Homo sapiens
gccggcagccccagcctgct

SEQ ID NO: 3435867 - DNA, 14 bp, Homo sapiens
gccggccctggggc

SEQ ID NO: 3435868 - DNA, 20 bp, Homo sapiens
gccggccctggggctaggct

SEQ ID NO: 3435869 - DNA, 17 bp, Homo sapiens
gccggcgagccctgtgg

SEQ ID NO: 3435870 - DNA, 18 bp, Homo sapiens
gccggcgagccctgtgga

SEQ ID NO: 3435871 - DNA, 18 bp, Homo sapiens
gccgggctgagggcctgc

SEQ ID NO: 3435872 - DNA, 12 bp, Homo sapiens
gccggttcctgt

SEQ ID NO: 3435873 - DNA, 17 bp, Homo sapiens
gccggttcctgtccctg

SEQ ID NO: 3435874 - DNA, 17 bp, Homo sapiens
gccgtccttgtctctgg

SEQ ID NO: 3435875 - DNA, 17 bp, Homo sapiens
gccgtgctcgccccagc

SEQ ID NO: 3435876 - DNA, 21 bp, Homo sapiens
gccgtgctcgccccagcaggt

SEQ ID NO: 3435877 - DNA, 20 bp, Homo sapiens
gccgtggggccgccgcctct

SEQ ID NO: 3435878 - DNA, 14 bp, Homo sapiens
gccgtggtccctga

SEQ ID NO: 3435879 - DNA, 16 bp, Homo sapiens
gccgtggtcctttggg

SEQ ID NO: 3435880 - DNA, 20 bp, Homo sapiens
gccgtgtaaccatggaccca

SEQ ID NO: 3435881 - DNA, 17 bp, Homo sapiens
gccgttgatgttggctg

SEQ ID NO: 3435882 - DNA, 14 bp, Homo sapiens
gcctaaaaatgcaa

SEQ ID NO: 3435883 - DNA, 17 bp, Homo sapiens
gcctaaaaatgcaactt

SEQ ID NO: 3435884 - DNA, 22 bp, Homo sapiens
gcctaaaagtgggcttgattct

SEQ ID NO: 3435885 - DNA, 12 bp, Homo sapiens
gcctaaggccct

SEQ ID NO: 3435886 - DNA, 16 bp, Homo sapiens
gcctacaggagtgagc

SEQ ID NO: 3435887 - DNA, 15 bp, Homo sapiens
gcctaccccctgaaa

SEQ ID NO: 3435888 - DNA, 19 bp, Homo sapiens
gcctactcgcttgctagaa

SEQ ID NO: 3435889 - DNA, 18 bp, Homo sapiens
gcctacttttggcctcat

SEQ ID NO: 3435890 - DNA, 12 bp, Homo sapiens
gcctaggaccta

SEQ ID NO: 3435891 - DNA, 16 bp, Homo sapiens
gctcgctgttgctgaa

SEQ ID NO: 3435892 - DNA, 17 bp, Homo sapiens
gctcggtacccggggcc

SEQ ID NO: 3435893 - DNA, 23 bp, Homo sapiens
gctcggtacccggggcccagggc

SEQ ID NO: 3435894 - DNA, 15 bp, Homo sapiens
gctctacccagggcc

SEQ ID NO: 3435895 - DNA, 12 bp, Homo sapiens
gctctcagcctc

SEQ ID NO: 3435896 - DNA, 17 bp, Homo sapiens
gctctcagcctcccaac

SEQ ID NO: 3435897 - DNA, 21 bp, Homo sapiens
gctctcagcctcccaacccca

SEQ ID NO: 3435898 - DNA, 17 bp, Homo sapiens
gctctccaaaccacttt

SEQ ID NO: 3435899 - DNA, 22 bp, Homo sapiens
gctctccaaaccactttttgca

SEQ ID NO: 3435900 - DNA, 19 bp, Homo sapiens
gctctccgaccagacacct

SEQ ID NO: 3435901 - DNA, 14 bp, Homo sapiens
gctctcctgacttt

SEQ ID NO: 3435902 - DNA, 22 bp, Homo sapiens
gctctccttcctggagcccaga

SEQ ID NO: 3435903 - DNA, 21 bp, Homo sapiens
gctctcggaactgcatgctgc

SEQ ID NO: 3435904 - DNA, 18 bp, Homo sapiens
gctctctgagtcctggcc

SEQ ID NO: 3435905 - DNA, 18 bp, Homo sapiens
gctctctgccctgtgtac

SEQ ID NO: 3435906 - DNA, 17 bp, Homo sapiens
gctctgagcgcctccat

SEQ ID NO: 3435907 - DNA, 17 bp, Homo sapiens
gctctgatcatccactg

SEQ ID NO: 3435908 - DNA, 21 bp, Homo sapiens
gctctgatcatccactgtgcc

SEQ ID NO: 3435909 - DNA, 22 bp, Homo sapiens
gctctgccaacttcttcagagc

SEQ ID NO: 3435910 - DNA, 22 bp, Homo sapiens
gctctgcgtgtcacctgtgctt

SEQ ID NO: 3435911 - DNA, 13 bp, Homo sapiens
gctctgctcctct

SEQ ID NO: 3435912 - DNA, 21 bp, Homo sapiens
gctctgctcctctccccagca

SEQ ID NO: 3435913 - DNA, 18 bp, Homo sapiens
gctctgctgacagacaca

SEQ ID NO: 3435914 - DNA, 20 bp, Homo sapiens
gctctgctgacagacacagg

SEQ ID NO: 3435915 - DNA, 23 bp, Homo sapiens
gctctgctgacagacacaggccc

SEQ ID NO: 3435916 - DNA, 19 bp, Homo sapiens
gctctggacagccccaccc

SEQ ID NO: 3435917 - DNA, 15 bp, Homo sapiens
gctctggacaggcat

SEQ ID NO: 3435918 - DNA, 21 bp, Homo sapiens
gctctggacaggcatgttctc

SEQ ID NO: 3435919 - DNA, 22 bp, Homo sapiens
gctctggacaggcatgttctct

SEQ ID NO: 3435920 - DNA, 13 bp, Homo sapiens
gctctggagggga

SEQ ID NO: 3435921 - DNA, 19 bp, Homo sapiens
gctctggccaagggccaga

SEQ ID NO: 3435922 - DNA, 20 bp, Homo sapiens
gctctggccaagggccagac

SEQ ID NO: 3435923 - DNA, 23 bp, Homo sapiens
gctctggccaagggccagacaga

SEQ ID NO: 3435924 - DNA, 14 bp, Homo sapiens
gctctggccccagg

SEQ ID NO: 3435925 - DNA, 20 bp, Homo sapiens
gctctgggccattctccaca

SEQ ID NO: 3435926 - DNA, 23 bp, Homo sapiens
gctctgggccattctccacagca

SEQ ID NO: 3435927 - DNA, 23 bp, Homo sapiens
gctctggtccaggccctgtggca

SEQ ID NO: 3435928 - DNA, 19 bp, Homo sapiens
gctctggtgataaggacat

SEQ ID NO: 3435929 - DNA, 18 bp, Homo sapiens
gctctgtatcaggaccca

SEQ ID NO: 3435930 - DNA, 13 bp, Homo sapiens
gctctgtctactt

SEQ ID NO: 3435931 - DNA, 18 bp, Homo sapiens
gctctgtgggtctctgga

SEQ ID NO: 3435932 - DNA, 21 bp, Homo sapiens
gctctgtttgtggggtgacgg

SEQ ID NO: 3435933 - DNA, 13 bp, Homo sapiens
gctcttcatctgc

SEQ ID NO: 3435934 - DNA, 20 bp, Homo sapiens
gctcttccgaaaaccaggcc

SEQ ID NO: 3435935 - DNA, 13 bp, Homo sapiens
gctcttctaagga

SEQ ID NO: 3435936 - DNA, 14 bp, Homo sapiens
gctcttctcatttc

SEQ ID NO: 3435937 - DNA, 15 bp, Homo sapiens
gctcttctcatttca

SEQ ID NO: 3435938 - DNA, 14 bp, Homo sapiens
gctcttctccaggc

SEQ ID NO: 3435939 - DNA, 15 bp, Homo sapiens
gctcttgacagaaag

SEQ ID NO: 3435940 - DNA, 19 bp, Homo sapiens
gctcttgacagaaagcagt

SEQ ID NO: 3435941 - DNA, 20 bp, Homo sapiens
gctcttgacagaaagcagtt

SEQ ID NO: 3435942 - DNA, 23 bp, Homo sapiens
gctcttgacagaaagcagttctg

SEQ ID NO: 3435943 - DNA, 20 bp, Homo sapiens
gctcttgtgaggaaagtcat

SEQ ID NO: 3435944 - DNA, 15 bp, Homo sapiens
gctctttcctccttc

SEQ ID NO: 3435945 - DNA, 19 bp, Homo sapiens
gctgaaagctggtggcaga

SEQ ID NO: 3435946 - DNA, 14 bp, Homo sapiens
gctgaaattctcct

SEQ ID NO: 3435947 - DNA, 15 bp, Homo sapiens
gctgaaattctcctg

SEQ ID NO: 3435948 - DNA, 18 bp, Homo sapiens
gctgaaattctcctggag

SEQ ID NO: 3435949 - DNA, 14 bp, Homo sapiens
gctgaaccctcagc

SEQ ID NO: 3435950 - DNA, 17 bp, Homo sapiens
gctgaatacagaggcaa

SEQ ID NO: 3435951 - DNA, 19 bp, Homo sapiens
gctgaataggcgatcacaa

SEQ ID NO: 3435952 - DNA, 17 bp, Homo sapiens
gctgacacaaacctgcc

SEQ ID NO: 3435953 - DNA, 19 bp, Homo sapiens
gctgacacaaacctgcctg

SEQ ID NO: 3435954 - DNA, 20 bp, Homo sapiens
gctgacacaaacctgcctgg

SEQ ID NO: 3435955 - DNA, 13 bp, Homo sapiens
gctgacagacaca

SEQ ID NO: 3435956 - DNA, 18 bp, Homo sapiens
gctgacagacacaggccc

SEQ ID NO: 3435957 - DNA, 15 bp, Homo sapiens
gctgacagctcttca

SEQ ID NO: 3435958 - DNA, 13 bp, Homo sapiens
gctgacagctgct

SEQ ID NO: 3435959 - DNA, 14 bp, Homo sapiens
gctgacagctgctc

SEQ ID NO: 3435960 - DNA, 15 bp, Homo sapiens
gctgacagctgctcc

SEQ ID NO: 3435961 - DNA, 19 bp, Homo sapiens
gctgacagtttgtggcatc

SEQ ID NO: 3435962 - DNA, 16 bp, Homo sapiens
gctgacattcacctgc

SEQ ID NO: 3435963 - DNA, 21 bp, Homo sapiens
gctgaccatgctcatctgctg

SEQ ID NO: 3435964 - DNA, 17 bp, Homo sapiens
gctgacctccacagctt

SEQ ID NO: 3435965 - DNA, 17 bp, Homo sapiens
gctgacgaacttccatg

SEQ ID NO: 3435966 - DNA, 14 bp, Homo sapiens
gctgagaacactgt

SEQ ID NO: 3435967 - DNA, 18 bp, Homo sapiens
gctgagaagcttttgaat

SEQ ID NO: 3435968 - DNA, 22 bp, Homo sapiens
gctgagaggcagacttccctga

SEQ ID NO: 3435969 - DNA, 13 bp, Homo sapiens
gctgagcagcttt

SEQ ID NO: 3435970 - DNA, 15 bp, Homo sapiens
gctgagccacctgcc

SEQ ID NO: 3435971 - DNA, 14 bp, Homo sapiens
gctgagctggggaa

SEQ ID NO: 3435972 - DNA, 16 bp, Homo sapiens
gctgaggaaaggccag

SEQ ID NO: 3435973 - DNA, 23 bp, Homo sapiens
gctgaggcctgggccgctgccac

SEQ ID NO: 3435974 - DNA, 18 bp, Homo sapiens
gctgaggctggcacagga

SEQ ID NO: 3435975 - DNA, 13 bp, Homo sapiens
gctgagggcctgc

SEQ ID NO: 3435976 - DNA, 14 bp, Homo sapiens
gctgagggcctgct

SEQ ID NO: 3435977 - DNA, 17 bp, Homo sapiens
gctgagggcctgctgga

SEQ ID NO: 3435978 - DNA, 18 bp, Homo sapiens
gctgagggcctgctggag

SEQ ID NO: 3435979 - DNA, 19 bp, Homo sapiens
gctgagggtgtttcttcct

SEQ ID NO: 3435980 - DNA, 15 bp, Homo sapiens
gctgaggtgggagga

SEQ ID NO: 3435981 - DNA, 17 bp, Homo sapiens
gctgagtggcaggggac

SEQ ID NO: 3435982 - DNA, 21 bp, Homo sapiens
gctgagtggcaggggacagga

SEQ ID NO: 3435983 - DNA, 23 bp, Homo sapiens
gctgagtgggggatcacagcctc

SEQ ID NO: 3435984 - DNA, 21 bp, Homo sapiens
gctgattctcagggtctctgc

SEQ ID NO: 3435985 - DNA, 15 bp, Homo sapiens
gctgcaaaggacaga

SEQ ID NO: 3435986 - DNA, 22 bp, Homo sapiens
gctgcaaagggtatcaggtgct

SEQ ID NO: 3435987 - DNA, 11 bp, Homo sapiens
gctgcaaagtg

SEQ ID NO: 3435988 - DNA, 21 bp, Homo sapiens
gctgcaaagtgttttgtacca

SEQ ID NO: 3435989 - DNA, 15 bp, Homo sapiens
gctgcaacaaaatgt

SEQ ID NO: 3435990 - DNA, 20 bp, Homo sapiens
gctgcaaggacattcttgta

SEQ ID NO: 3435991 - DNA, 15 bp, Homo sapiens
gctgcaccctcaggc

SEQ ID NO: 3435992 - DNA, 20 bp, Homo sapiens
gctgcagagaaacttaagca

SEQ ID NO: 3435993 - DNA, 17 bp, Homo sapiens
gctgcagatttgggctg

SEQ ID NO: 3435994 - DNA, 21 bp, Homo sapiens
gctgcagatttgggctggaac

SEQ ID NO: 3435995 - DNA, 16 bp, Homo sapiens
gctgcagcctgcgcca

SEQ ID NO: 3435996 - DNA, 19 bp, Homo sapiens
gctgcagctccctggcttc

SEQ ID NO: 3435997 - DNA, 17 bp, Homo sapiens
gctgcaggacttgagaa

SEQ ID NO: 3435998 - DNA, 20 bp, Homo sapiens
gctgcagtcaacagttcaaa

SEQ ID NO: 3435999 - DNA, 13 bp, Homo sapiens
gctgcatgatgtt

SEQ ID NO: 3436000 - DNA, 19 bp, Homo sapiens
gctgcatgatgtttgccca

SEQ ID NO: 3436001 - DNA, 15 bp, Homo sapiens
gctgcatgccctctc

SEQ ID NO: 3436002 - DNA, 16 bp, Homo sapiens
gctgcatgccctctca

SEQ ID NO: 3436003 - DNA, 18 bp, Homo sapiens
gctgcatgccctctcagg

SEQ ID NO: 3436004 - DNA, 19 bp, Homo sapiens
gctgcatgccctctcaggc

SEQ ID NO: 3436005 - DNA, 20 bp, Homo sapiens
gctgcatgccctctcaggcc

SEQ ID NO: 3436006 - DNA, 14 bp, Homo sapiens
gctgccacccacct

SEQ ID NO: 3436007 - DNA, 20 bp, Homo sapiens
gctgccacccacctccctgc

SEQ ID NO: 3436008 - DNA, 21 bp, Homo sapiens
gctgccacccacctccctgcc

SEQ ID NO: 3436009 - DNA, 13 bp, Homo sapiens
gctgccatccagg

SEQ ID NO: 3436010 - DNA, 23 bp, Homo sapiens
gctgccatccaggttcagcttgt

SEQ ID NO: 3436011 - DNA, 12 bp, Homo sapiens
gctgcccaggcc

SEQ ID NO: 3436012 - DNA, 21 bp, Homo sapiens
gctgcccatttcgtgagcccc

SEQ ID NO: 3436013 - DNA, 15 bp, Homo sapiens
gctgccccagccccg

SEQ ID NO: 3436014 - DNA, 21 bp, Homo sapiens
gctgccccatctcccctcagc

SEQ ID NO: 3436015 - DNA, 23 bp, Homo sapiens
gctgccccatctcccctcagctc

SEQ ID NO: 3436016 - DNA, 21 bp, Homo sapiens
gctgccccgcttccccacaga

SEQ ID NO: 3436017 - DNA, 23 bp, Homo sapiens
gctgccccgcttccccacagaac

SEQ ID NO: 3436018 - DNA, 16 bp, Homo sapiens
gctgccccggcccctc

SEQ ID NO: 3436019 - DNA, 23 bp, Homo sapiens
gctgccccggcccctccccctga

SEQ ID NO: 3436020 - DNA, 23 bp, Homo sapiens
gctgccccgggtccccagctccc

SEQ ID NO: 3436021 - DNA, 22 bp, Homo sapiens
gctgcccctcatctctctgccc

SEQ ID NO: 3436022 - DNA, 22 bp, Homo sapiens
ggagcccttatctgtgctcagg

SEQ ID NO: 3436023 - DNA, 17 bp, Homo sapiens
ggagccgggtctgcctc

SEQ ID NO: 3436024 - DNA, 23 bp, Homo sapiens
ggagcctaccccctgaaagtgac

SEQ ID NO: 3436025 - DNA, 16 bp, Homo sapiens
ggagcggaaagcagct

SEQ ID NO: 3436026 - DNA, 23 bp, Homo sapiens
ggagctacgaaaggatgagcaga

SEQ ID NO: 3436027 - DNA, 12 bp, Homo sapiens
ggagctagccag

SEQ ID NO: 3436028 - DNA, 16 bp, Homo sapiens
ggagctgagtggggga

SEQ ID NO: 3436029 - DNA, 21 bp, Homo sapiens
ggagctgcagtcccatgcaca

SEQ ID NO: 3436030 - DNA, 12 bp, Homo sapiens
ggagctgcctgt

SEQ ID NO: 3436031 - DNA, 22 bp, Homo sapiens
ggagctgcctgttcagctccag

SEQ ID NO: 3436032 - DNA, 17 bp, Homo sapiens
ggagctgccttggctca

SEQ ID NO: 3436033 - DNA, 15 bp, Homo sapiens
ggagctggccccgcc

SEQ ID NO: 3436034 - DNA, 21 bp, Homo sapiens
ggagctggccgtgggcctggg

SEQ ID NO: 3436035 - DNA, 15 bp, Homo sapiens
ggagcttgcaagaag

SEQ ID NO: 3436036 - DNA, 15 bp, Homo sapiens
ggaggaaagggagga

SEQ ID NO: 3436037 - DNA, 10 bp, Homo sapiens
ggaggacagt

SEQ ID NO: 3436038 - DNA, 16 bp, Homo sapiens
ggaggagagagccttg

SEQ ID NO: 3436039 - DNA, 12 bp, Homo sapiens
ggaggagcaaag

SEQ ID NO: 3436040 - DNA, 22 bp, Homo sapiens
ggaggagcccctggacatgcct

SEQ ID NO: 3436041 - DNA, 17 bp, Homo sapiens
ggaggatctcttgagcc

SEQ ID NO: 3436042 - DNA, 19 bp, Homo sapiens
ggaggattgctgccagaga

SEQ ID NO: 3436043 - DNA, 17 bp, Homo sapiens
ggaggcaaatggcactg

SEQ ID NO: 3436044 - DNA, 18 bp, Homo sapiens
ggaggcaaatgggatggt

SEQ ID NO: 3436045 - DNA, 14 bp, Homo sapiens
ggaggcaagccctg

SEQ ID NO: 3436046 - DNA, 13 bp, Homo sapiens
ggaggcactgaag

SEQ ID NO: 3436047 - DNA, 20 bp, Homo sapiens
ggaggccaaggtgggaggat

SEQ ID NO: 3436048 - DNA, 11 bp, Homo sapiens
ggaggccagct

SEQ ID NO: 3436049 - DNA, 19 bp, Homo sapiens
ggaggccagctatctgcct

SEQ ID NO: 3436050 - DNA, 14 bp, Homo sapiens
ggaggccaggccgg

SEQ ID NO: 3436051 - DNA, 14 bp, Homo sapiens
ggaggcccaacctc

SEQ ID NO: 3436052 - DNA, 20 bp, Homo sapiens
ggaggcccaggctgggaact

SEQ ID NO: 3436053 - DNA, 22 bp, Homo sapiens
ggaggcccaggctgggaactca

SEQ ID NO: 3436054 - DNA, 15 bp, Homo sapiens
ggaggccctgtgccc

SEQ ID NO: 3436055 - DNA, 23 bp, Homo sapiens
ggaggccctgtgccccttgacaa

SEQ ID NO: 3436056 - DNA, 16 bp, Homo sapiens
ggaggcctcaggtgct

SEQ ID NO: 3436057 - DNA, 17 bp, Homo sapiens
ggaggcctcaggtgctg

SEQ ID NO: 3436058 - DNA, 15 bp, Homo sapiens
ggaggctcaggtccc

SEQ ID NO: 3436059 - DNA, 16 bp, Homo sapiens
ggaggctccagagggc

SEQ ID NO: 3436060 - DNA, 10 bp, Homo sapiens
ggaggctgcg

SEQ ID NO: 3436061 - DNA, 17 bp, Homo sapiens
ggaggctgcgtgccagt

SEQ ID NO: 3436062 - DNA, 22 bp, Homo sapiens
ggagggattctggttccagggt

SEQ ID NO: 3436063 - DNA, 19 bp, Homo sapiens
ggagggccacatgggaggc

SEQ ID NO: 3436064 - DNA, 20 bp, Homo sapiens
ggagggcggcaggggcctgg

SEQ ID NO: 3436065 - DNA, 13 bp, Homo sapiens
ggaggggcctagg

SEQ ID NO: 3436066 - DNA, 21 bp, Homo sapiens
ggaggggcctaggcctcagcc

SEQ ID NO: 3436067 - DNA, 23 bp, Homo sapiens
ggaggtgaacaagcaaacccaga

SEQ ID NO: 3436068 - DNA, 12 bp, Homo sapiens
ggaggtgtgagg

SEQ ID NO: 3436069 - DNA, 17 bp, Homo sapiens
ggaggttaaggctgagg

SEQ ID NO: 3436070 - DNA, 19 bp, Homo sapiens
ggaggttaaggctgaggaa

SEQ ID NO: 3436071 - DNA, 21 bp, Homo sapiens
ggaggttaaggctgaggaaag

SEQ ID NO: 3436072 - DNA, 19 bp, Homo sapiens
ggagtcagccaggagctgt

SEQ ID NO: 3436073 - DNA, 13 bp, Homo sapiens
ggagtcaggcccg

SEQ ID NO: 3436074 - DNA, 14 bp, Homo sapiens
ggagtcaggcccgg

SEQ ID NO: 3436075 - DNA, 22 bp, Homo sapiens
ggagtcccaccttggctgcagg

SEQ ID NO: 3436076 - DNA, 16 bp, Homo sapiens
ggagtccgccaaaggc

SEQ ID NO: 3436077 - DNA, 15 bp, Homo sapiens
ggagtctgaagcaga

SEQ ID NO: 3436078 - DNA, 11 bp, Homo sapiens
ggagtgacaga

SEQ ID NO: 3436079 - DNA, 19 bp, Homo sapiens
ggagtgacagaggcagccc

SEQ ID NO: 3436080 - DNA, 12 bp, Homo sapiens
ggagtgcagtga

SEQ ID NO: 3436081 - DNA, 19 bp, Homo sapiens
ggagtgtgagccacctaag

SEQ ID NO: 3436082 - DNA, 14 bp, Homo sapiens
ggagtgttatgtat

SEQ ID NO: 3436083 - DNA, 19 bp, Homo sapiens
ggagtgtttctaataaact

SEQ ID NO: 3436084 - DNA, 16 bp, Homo sapiens
ggagttaagacctggc

SEQ ID NO: 3436085 - DNA, 12 bp, Homo sapiens
ggagttatctaa

SEQ ID NO: 3436086 - DNA, 22 bp, Homo sapiens
ggagttcatggaagagttccct

SEQ ID NO: 3436087 - DNA, 23 bp, Homo sapiens
ggagttgatcgcctttcccaggt

SEQ ID NO: 3436088 - DNA, 17 bp, Homo sapiens
ggataaattgccataat

SEQ ID NO: 3436089 - DNA, 23 bp, Homo sapiens
ggatcaaagttctgctttctccc

SEQ ID NO: 3436090 - DNA, 16 bp, Homo sapiens
ggatcacagcctctga

SEQ ID NO: 3436091 - DNA, 18 bp, Homo sapiens
ggatcacaggtgtcagcc

SEQ ID NO: 3436092 - DNA, 20 bp, Homo sapiens
ggatcagggcattgcctgtg

SEQ ID NO: 3436093 - DNA, 21 bp, Homo sapiens
ggatcagtctgattcccaagc

SEQ ID NO: 3436094 - DNA, 22 bp, Homo sapiens
ggatccctcatctgtccctccg

SEQ ID NO: 3436095 - DNA, 17 bp, Homo sapiens
ggatccctcccccccat

SEQ ID NO: 3436096 - DNA, 19 bp, Homo sapiens
ggatccgactgctttggac

SEQ ID NO: 3436097 - DNA, 24 bp, Homo sapiens
ggatctcattggacccttccatgg

SEQ ID NO: 3436098 - DNA, 18 bp, Homo sapiens
ggatctcttgagcctggg

SEQ ID NO: 3436099 - DNA, 17 bp, Homo sapiens
ggatctggtcctaccca

SEQ ID NO: 3436100 - DNA, 22 bp, Homo sapiens
ggatgagaaaggttgaagcacc

SEQ ID NO: 3436101 - DNA, 23 bp, Homo sapiens
ggatgagaatttgagtgctctga

SEQ ID NO: 3436102 - DNA, 17 bp, Homo sapiens
ggatgagcatggagctg

SEQ ID NO: 3436103 - DNA, 19 bp, Homo sapiens
ggatgagcatggagctggc

SEQ ID NO: 3436104 - DNA, 15 bp, Homo sapiens
ggatgccctggaggt

SEQ ID NO: 3436105 - DNA, 19 bp, Homo sapiens
ggatgcctggtggcagctg

SEQ ID NO: 3436106 - DNA, 16 bp, Homo sapiens
ggatgcgcagtgcctt

SEQ ID NO: 3436107 - DNA, 18 bp, Homo sapiens
ggatggatttccagccaa

SEQ ID NO: 3436108 - DNA, 13 bp, Homo sapiens
ggatggccccagc

SEQ ID NO: 3436109 - DNA, 11 bp, Homo sapiens
ggatgggcctt

SEQ ID NO: 3436110 - DNA, 15 bp, Homo sapiens
ggatgggtcagagct

SEQ ID NO: 3436111 - DNA, 13 bp, Homo sapiens
ggatggtgccctg

SEQ ID NO: 3436112 - DNA, 15 bp, Homo sapiens
ggatggtgggcttca

SEQ ID NO: 3436113 - DNA, 17 bp, Homo sapiens
ggatggtgtgccttcca

SEQ ID NO: 3436114 - DNA, 15 bp, Homo sapiens
ggatgtactgtttgc

SEQ ID NO: 3436115 - DNA, 13 bp, Homo sapiens
ggatgtccagagc

SEQ ID NO: 3436116 - DNA, 16 bp, Homo sapiens
ggatgttctgggacac

SEQ ID NO: 3436117 - DNA, 21 bp, Homo sapiens
ggattaggtttcagcagagct

SEQ ID NO: 3436118 - DNA, 20 bp, Homo sapiens
ggattctcatgggaagggga

SEQ ID NO: 3436119 - DNA, 12 bp, Homo sapiens
ggattctttaaa

SEQ ID NO: 3436120 - DNA, 17 bp, Homo sapiens
ggattgctactgtccta

SEQ ID NO: 3436121 - DNA, 16 bp, Homo sapiens
ggattgctgccagaga

SEQ ID NO: 3436122 - DNA, 16 bp, Homo sapiens
ggattggaatgcagag

SEQ ID NO: 3436123 - DNA, 18 bp, Homo sapiens
ggatttgcctcaccttgg

SEQ ID NO: 3436124 - DNA, 18 bp, Homo sapiens
ggatttgtaactgttttt

SEQ ID NO: 3436125 - DNA, 13 bp, Homo sapiens
ggcaaacaggcag

SEQ ID NO: 3436126 - DNA, 19 bp, Homo sapiens
ggcaaaggaaggtggatgg

SEQ ID NO: 3436127 - DNA, 19 bp, Homo sapiens
ggcaaagggtccagaagga

SEQ ID NO: 3436128 - DNA, 15 bp, Homo sapiens
ggcaacagatctgga

SEQ ID NO: 3436129 - DNA, 19 bp, Homo sapiens
ggcaacagatctggaacct

SEQ ID NO: 3436130 - DNA, 19 bp, Homo sapiens
ggcaaccactaagaattca

SEQ ID NO: 3436131 - DNA, 19 bp, Homo sapiens
ggcaactgcattggctttg

SEQ ID NO: 3436132 - DNA, 16 bp, Homo sapiens
ggcaagcatgtaactt

SEQ ID NO: 3436133 - DNA, 14 bp, Homo sapiens
ggcaagctccgcag

SEQ ID NO: 3436134 - DNA, 18 bp, Homo sapiens
ggcaagctccgcaggact

SEQ ID NO: 3436135 - DNA, 11 bp, Homo sapiens
ggcaaggaaag

SEQ ID NO: 3436136 - DNA, 17 bp, Homo sapiens
ggcaagggttaaggcct

SEQ ID NO: 3436137 - DNA, 14 bp, Homo sapiens
ggcacacagctact

SEQ ID NO: 3436138 - DNA, 17 bp, Homo sapiens
ggcacagcatctgtagt

SEQ ID NO: 3436139 - DNA, 22 bp, Homo sapiens
ggcacagcggagtctgtcctgt

SEQ ID NO: 3436140 - DNA, 20 bp, Homo sapiens
ggcacaggagtgtcctcttc

SEQ ID NO: 3436141 - DNA, 12 bp, Homo sapiens
ggcacattcctt

SEQ ID NO: 3436142 - DNA, 17 bp, Homo sapiens
ggcacattcctttgggt

SEQ ID NO: 3436143 - DNA, 18 bp, Homo sapiens
ggcacatttaagagacag

SEQ ID NO: 3436144 - DNA, 15 bp, Homo sapiens
ggcaccagcagcctg

SEQ ID NO: 3436145 - DNA, 14 bp, Homo sapiens
ggcaccagccagcg

SEQ ID NO: 3436146 - DNA, 15 bp, Homo sapiens
ggcaccagtccctgt

SEQ ID NO: 3436147 - DNA, 17 bp, Homo sapiens
ggcaccagtccctgtcc

SEQ ID NO: 3436148 - DNA, 22 bp, Homo sapiens
ggcacccaagacctcagggcac

SEQ ID NO: 3436149 - DNA, 16 bp, Homo sapiens
ggcacccggcccctgc

SEQ ID NO: 3436150 - DNA, 15 bp, Homo sapiens
ggcacctaatccagg

SEQ ID NO: 3436151 - DNA, 17 bp, Homo sapiens
ggcacctacatccccag

SEQ ID NO: 3436152 - DNA, 20 bp, Homo sapiens
ggcacctacatccccaggtc

SEQ ID NO: 3436153 - DNA, 21 bp, Homo sapiens
ggcacctacatccccaggtct

SEQ ID NO: 3436154 - DNA, 19 bp, Homo sapiens
ggcactcagaagacactga

SEQ ID NO: 3436155 - DNA, 17 bp, Homo sapiens
ggggaaacaggttggga

SEQ ID NO: 3436156 - DNA, 22 bp, Homo sapiens
ggggaatgtttgcctctgcctc

SEQ ID NO: 3436157 - DNA, 14 bp, Homo sapiens
ggggacagctcctt

SEQ ID NO: 3436158 - DNA, 14 bp, Homo sapiens
ggggacagctgtgt

SEQ ID NO: 3436159 - DNA, 11 bp, Homo sapiens
ggggacccacg

SEQ ID NO: 3436160 - DNA, 15 bp, Homo sapiens
ggggacccccgcccc

SEQ ID NO: 3436161 - DNA, 18 bp, Homo sapiens
ggggacccccgccccctg

SEQ ID NO: 3436162 - DNA, 16 bp, Homo sapiens
ggggacgcaggcccct

SEQ ID NO: 3436163 - DNA, 18 bp, Homo sapiens
ggggagactgggctgagg

SEQ ID NO: 3436164 - DNA, 22 bp, Homo sapiens
ggggagccccttctgctcagct

SEQ ID NO: 3436165 - DNA, 21 bp, Homo sapiens
ggggaggaagaggctgcactg

SEQ ID NO: 3436166 - DNA, 14 bp, Homo sapiens
ggggagggattctg

SEQ ID NO: 3436167 - DNA, 15 bp, Homo sapiens
ggggagggattctgg

SEQ ID NO: 3436168 - DNA, 14 bp, Homo sapiens
ggggagggctgcga

SEQ ID NO: 3436169 - DNA, 21 bp, Homo sapiens
ggggagttaagacctggcagc

SEQ ID NO: 3436170 - DNA, 21 bp, Homo sapiens
ggggatttccagccagggctg

SEQ ID NO: 3436171 - DNA, 23 bp, Homo sapiens
ggggcacctctcttgaaccccaa

SEQ ID NO: 3436172 - DNA, 18 bp, Homo sapiens
ggggcagcaccctataaa

SEQ ID NO: 3436173 - DNA, 20 bp, Homo sapiens
ggggcagctgatacaaattg

SEQ ID NO: 3436174 - DNA, 11 bp, Homo sapiens
ggggcaggcag

SEQ ID NO: 3436175 - DNA, 12 bp, Homo sapiens
ggggcaggcagt

SEQ ID NO: 3436176 - DNA, 12 bp, Homo sapiens
ggggcagggctg

SEQ ID NO: 3436177 - DNA, 17 bp, Homo sapiens
ggggccagatccagcct

SEQ ID NO: 3436178 - DNA, 19 bp, Homo sapiens
ggggccagatccagcctgg

SEQ ID NO: 3436179 - DNA, 13 bp, Homo sapiens
ggggcccggccag

SEQ ID NO: 3436180 - DNA, 14 bp, Homo sapiens
ggggcctgactgct

SEQ ID NO: 3436181 - DNA, 22 bp, Homo sapiens
ggggcgccgcaaaccacactgg

SEQ ID NO: 3436182 - DNA, 20 bp, Homo sapiens
ggggcgtctgttcccccttc

SEQ ID NO: 3436183 - DNA, 16 bp, Homo sapiens
ggggctctggccaagg

SEQ ID NO: 3436184 - DNA, 18 bp, Homo sapiens
ggggctgcttcctcctgg

SEQ ID NO: 3436185 - DNA, 14 bp, Homo sapiens
ggggcttcatctct

SEQ ID NO: 3436186 - DNA, 20 bp, Homo sapiens
ggggctttcgtccacagctt

SEQ ID NO: 3436187 - DNA, 22 bp, Homo sapiens
ggggctttcgtccacagcttcc

SEQ ID NO: 3436188 - DNA, 17 bp, Homo sapiens
gggggagtctgaagcag

SEQ ID NO: 3436189 - DNA, 22 bp, Homo sapiens
gggggagtctgaagcagatgca

SEQ ID NO: 3436190 - DNA, 12 bp, Homo sapiens
gggggcctcagt

SEQ ID NO: 3436191 - DNA, 17 bp, Homo sapiens
gggggcctcagtgccac

SEQ ID NO: 3436192 - DNA, 18 bp, Homo sapiens
gggggcctcagtgccact

SEQ ID NO: 3436193 - DNA, 11 bp, Homo sapiens
ggggtcctggc

SEQ ID NO: 3436194 - DNA, 14 bp, Homo sapiens
ggggtcctggccat

SEQ ID NO: 3436195 - DNA, 15 bp, Homo sapiens
ggggtctgtaaaatc

SEQ ID NO: 3436196 - DNA, 14 bp, Homo sapiens
ggggtgaggagctg

SEQ ID NO: 3436197 - DNA, 23 bp, Homo sapiens
gggtaaagggcgcaaagggcatg

SEQ ID NO: 3436198 - DNA, 15 bp, Homo sapiens
gggtacccactgctc

SEQ ID NO: 3436199 - DNA, 18 bp, Homo sapiens
gggtacccactgctctgg

SEQ ID NO: 3436200 - DNA, 22 bp, Homo sapiens
gggtagaggctgggaggagccc

SEQ ID NO: 3436201 - DNA, 21 bp, Homo sapiens
gggtagatttcagggagacaa

SEQ ID NO: 3436202 - DNA, 19 bp, Homo sapiens
gggtcagacgcctgaggaa

SEQ ID NO: 3436203 - DNA, 21 bp, Homo sapiens
gggtcatcctgtgctcggagg

SEQ ID NO: 3436204 - DNA, 14 bp, Homo sapiens
gggtcatgccctcc

SEQ ID NO: 3436205 - DNA, 21 bp, Homo sapiens
gggtcatgccctcctctccca

SEQ ID NO: 3436206 - DNA, 17 bp, Homo sapiens
gggtccagaaggagaca

SEQ ID NO: 3436207 - DNA, 12 bp, Homo sapiens
gggtccatgggc

SEQ ID NO: 3436208 - DNA, 18 bp, Homo sapiens
gggtccccagctccccag

SEQ ID NO: 3436209 - DNA, 12 bp, Homo sapiens
gggtccttcctg

SEQ ID NO: 3436210 - DNA, 13 bp, Homo sapiens
gggtccttcctga

SEQ ID NO: 3436211 - DNA, 14 bp, Homo sapiens
gggtcggctgacca

SEQ ID NO: 3436212 - DNA, 15 bp, Homo sapiens
gggtcgggagagggg

SEQ ID NO: 3436213 - DNA, 19 bp, Homo sapiens
gggtcgggggcaggtgctg

SEQ ID NO: 3436214 - DNA, 23 bp, Homo sapiens
gggtctcactatgttgcccaggc

SEQ ID NO: 3436215 - DNA, 13 bp, Homo sapiens
gggtctctgctgc

SEQ ID NO: 3436216 - DNA, 12 bp, Homo sapiens
gggtctctggaa

SEQ ID NO: 3436217 - DNA, 12 bp, Homo sapiens
gggtctgcctcc

SEQ ID NO: 3436218 - DNA, 20 bp, Homo sapiens
gggtctgtaaaatctttctt

SEQ ID NO: 3436219 - DNA, 12 bp, Homo sapiens
gggtgaaggctg

SEQ ID NO: 3436220 - DNA, 13 bp, Homo sapiens
gggtgaaggctgg

SEQ ID NO: 3436221 - DNA, 14 bp, Homo sapiens
gggtgaggagctgg

SEQ ID NO: 3436222 - DNA, 12 bp, Homo sapiens
gggtgagggcct

SEQ ID NO: 3436223 - DNA, 23 bp, Homo sapiens
gggtgcagtatcatgccctgtgc

SEQ ID NO: 3436224 - DNA, 17 bp, Homo sapiens
gggtggatgcctggtgg

SEQ ID NO: 3436225 - DNA, 17 bp, Homo sapiens
gggtggccgctgagtgg

SEQ ID NO: 3436226 - DNA, 21 bp, Homo sapiens
gggtggccgctgagtggcagg

SEQ ID NO: 3436227 - DNA, 15 bp, Homo sapiens
gggtgggcaggaaaa

SEQ ID NO: 3436228 - DNA, 13 bp, Homo sapiens
gggtgggccaggc

SEQ ID NO: 3436229 - DNA, 15 bp, Homo sapiens
gggtggtggcctggt

SEQ ID NO: 3436230 - DNA, 19 bp, Homo sapiens
gggtgtcctgcctgtctgc

SEQ ID NO: 3436231 - DNA, 23 bp, Homo sapiens
gggtgtcttgggcagagctggct

SEQ ID NO: 3436232 - DNA, 17 bp, Homo sapiens
gggtgtgcacatctctg

SEQ ID NO: 3436233 - DNA, 22 bp, Homo sapiens
gggttaacccttcatcttcctg

SEQ ID NO: 3436234 - DNA, 23 bp, Homo sapiens
gggttcaagcgattcttctgctt

SEQ ID NO: 3436235 - DNA, 20 bp, Homo sapiens
gggttgctgtataagttatt

SEQ ID NO: 3436236 - DNA, 19 bp, Homo sapiens
gggtttaatccccagtaaa

SEQ ID NO: 3436237 - DNA, 22 bp, Homo sapiens
gggtttaatccccagtaaaatt

SEQ ID NO: 3436238 - DNA, 21 bp, Homo sapiens
gggtttggctgtgtctaaact

SEQ ID NO: 3436239 - DNA, 18 bp, Homo sapiens
gggttttgtattctctga

SEQ ID NO: 3436240 - DNA, 13 bp, Homo sapiens
ggtaaaatgccat

SEQ ID NO: 3436241 - DNA, 14 bp, Homo sapiens
ggtaaattcttaat

SEQ ID NO: 3436242 - DNA, 14 bp, Homo sapiens
ggtaacaggcagat

SEQ ID NO: 3436243 - DNA, 20 bp, Homo sapiens
ggtaacaggcagatacagga

SEQ ID NO: 3436244 - DNA, 20 bp, Homo sapiens
ggtaagcacttaatgaatga

SEQ ID NO: 3436245 - DNA, 19 bp, Homo sapiens
ggtacaaaaataaatttat

SEQ ID NO: 3436246 - DNA, 23 bp, Homo sapiens
ggtacatttttcaactttgaata

SEQ ID NO: 3436247 - DNA, 14 bp, Homo sapiens
ggtaccagatgcag

SEQ ID NO: 3436248 - DNA, 11 bp, Homo sapiens
ggtacccactg

SEQ ID NO: 3436249 - DNA, 17 bp, Homo sapiens
ggtacccactgctctgg

SEQ ID NO: 3436250 - DNA, 13 bp, Homo sapiens
ggtacgtgaccct

SEQ ID NO: 3436251 - DNA, 19 bp, Homo sapiens
ggtacttcttgaaggtgct

SEQ ID NO: 3436252 - DNA, 21 bp, Homo sapiens
ggtacttgtggacacagctct

SEQ ID NO: 3436253 - DNA, 22 bp, Homo sapiens
ggtacttgtggacacagctctt

SEQ ID NO: 3436254 - DNA, 13 bp, Homo sapiens
ggtagaaaaacat

SEQ ID NO: 3436255 - DNA, 17 bp, Homo sapiens
ggtaggttcagccaagg

SEQ ID NO: 3436256 - DNA, 20 bp, Homo sapiens
ggtataatggttgactgggt

SEQ ID NO: 3436257 - DNA, 12 bp, Homo sapiens
ggtataggaatg

SEQ ID NO: 3436258 - DNA, 16 bp, Homo sapiens
ggtatgggctgggggc

SEQ ID NO: 3436259 - DNA, 18 bp, Homo sapiens
ggtatgttaacctaggca

SEQ ID NO: 3436260 - DNA, 19 bp, Homo sapiens
ggtatgttaacctaggcag

SEQ ID NO: 3436261 - DNA, 18 bp, Homo sapiens
ggtattaccatgtaaata

SEQ ID NO: 3436262 - DNA, 12 bp, Homo sapiens
ggtattgtattt

SEQ ID NO: 3436263 - DNA, 23 bp, Homo sapiens
ggtattgtatttattcaataaag

SEQ ID NO: 3436264 - DNA, 22 bp, Homo sapiens
ggtcaacagttttcctatgctt

SEQ ID NO: 3436265 - DNA, 23 bp, Homo sapiens
ggtcaacatcttttacattctgc

SEQ ID NO: 3436266 - DNA, 13 bp, Homo sapiens
ggtcagagcctgc

SEQ ID NO: 3436267 - DNA, 14 bp, Homo sapiens
ggtcagagcctgca

SEQ ID NO: 3436268 - DNA, 14 bp, Homo sapiens
ggtcagtgcaaata

SEQ ID NO: 3436269 - DNA, 24 bp, Homo sapiens
ggtcagtgtccaaagcagggtctg

SEQ ID NO: 3436270 - DNA, 22 bp, Homo sapiens
ggtcatactatctactctcctc

SEQ ID NO: 3436271 - DNA, 21 bp, Homo sapiens
ggtcatcgattcaaactgctc

SEQ ID NO: 3436272 - DNA, 15 bp, Homo sapiens
ggtcatgccctcctc

SEQ ID NO: 3436273 - DNA, 20 bp, Homo sapiens
ggtccaattctcgagcttgg

SEQ ID NO: 3436274 - DNA, 20 bp, Homo sapiens
ggtccacccaggagccccga

SEQ ID NO: 3436275 - DNA, 14 bp, Homo sapiens
ggtccaccccatgt

SEQ ID NO: 3436276 - DNA, 21 bp, Homo sapiens
ggtccagaaggagacaggcag

SEQ ID NO: 3436277 - DNA, 12 bp, Homo sapiens
ggtccagctctg

SEQ ID NO: 3436278 - DNA, 15 bp, Homo sapiens
ggtccagctctggag

SEQ ID NO: 3436279 - DNA, 22 bp, Homo sapiens
ggtccagctctggaggggaggg

SEQ ID NO: 3436280 - DNA, 13 bp, Homo sapiens
ggtccaggctgtg

SEQ ID NO: 3436281 - DNA, 16 bp, Homo sapiens
ggtccagggagcaggc

SEQ ID NO: 3436282 - DNA, 13 bp, Homo sapiens
ggtccatgggcag

SEQ ID NO: 3436283 - DNA, 17 bp, Homo sapiens
ggtccatgggcagagcc

SEQ ID NO: 3436284 - DNA, 18 bp, Homo sapiens
ggtccatgggcagagccc

SEQ ID NO: 3436285 - DNA, 22 bp, Homo sapiens
ggtcccactcagtccatagcag

SEQ ID NO: 3436286 - DNA, 17 bp, Homo sapiens
ggtccccagctccccag

SEQ ID NO: 3436287 - DNA, 18 bp, Homo sapiens
ggtccccagctccccagg

SEQ ID NO: 3436288 - DNA, 11 bp, Homo sapiens
gtcagttgaac

SEQ ID NO: 3436289 - DNA, 20 bp, Homo sapiens
gtcatacctggaatgtgtca

SEQ ID NO: 3436290 - DNA, 21 bp, Homo sapiens
gtcatactatctactctcctc

SEQ ID NO: 3436291 - DNA, 22 bp, Homo sapiens
gtcatatcaaataaagagagaa

SEQ ID NO: 3436292 - DNA, 17 bp, Homo sapiens
gtcatcaggagaaaaag

SEQ ID NO: 3436293 - DNA, 17 bp, Homo sapiens
gtcatcctcaggaacca

SEQ ID NO: 3436294 - DNA, 17 bp, Homo sapiens
gtcatcgagatggagct

SEQ ID NO: 3436295 - DNA, 12 bp, Homo sapiens
gtcatctcaggg

SEQ ID NO: 3436296 - DNA, 20 bp, Homo sapiens
gtcatctcagggtccagacc

SEQ ID NO: 3436297 - DNA, 20 bp, Homo sapiens
gtcatcttgaccaagcagga

SEQ ID NO: 3436298 - DNA, 16 bp, Homo sapiens
gtcatgcaaaggctgg

SEQ ID NO: 3436299 - DNA, 14 bp, Homo sapiens
gtcattggctttat

SEQ ID NO: 3436300 - DNA, 15 bp, Homo sapiens
gtcattgtatgttat

SEQ ID NO: 3436301 - DNA, 17 bp, Homo sapiens
gtcatttgagcagggct

SEQ ID NO: 3436302 - DNA, 17 bp, Homo sapiens
gtcatttgagtctctta

SEQ ID NO: 3436303 - DNA, 14 bp, Homo sapiens
gtcattttgcactg

SEQ ID NO: 3436304 - DNA, 15 bp, Homo sapiens
gtcattttgcactgt

SEQ ID NO: 3436305 - DNA, 19 bp, Homo sapiens
gtcattttgcactgtaaat

SEQ ID NO: 3436306 - DNA, 15 bp, Homo sapiens
gtccaagctgggaga

SEQ ID NO: 3436307 - DNA, 17 bp, Homo sapiens
gtccaaggaaaccacag

SEQ ID NO: 3436308 - DNA, 22 bp, Homo sapiens
gtccaaggaaaccacagctgct

SEQ ID NO: 3436309 - DNA, 19 bp, Homo sapiens
gtccacacccaattccact

SEQ ID NO: 3436310 - DNA, 13 bp, Homo sapiens
gtccacagggcac

SEQ ID NO: 3436311 - DNA, 14 bp, Homo sapiens
gtccacccaggagc

SEQ ID NO: 3436312 - DNA, 15 bp, Homo sapiens
gtccacccaggagcc

SEQ ID NO: 3436313 - DNA, 16 bp, Homo sapiens
gtccacccaggagccc

SEQ ID NO: 3436314 - DNA, 15 bp, Homo sapiens
gtccacgactgtctc

SEQ ID NO: 3436315 - DNA, 14 bp, Homo sapiens
gtccagaaggagac

SEQ ID NO: 3436316 - DNA, 17 bp, Homo sapiens
gtccagaaggagacagg

SEQ ID NO: 3436317 - DNA, 13 bp, Homo sapiens
gtccagagctggc

SEQ ID NO: 3436318 - DNA, 14 bp, Homo sapiens
gtccagcagtcact

SEQ ID NO: 3436319 - DNA, 21 bp, Homo sapiens
gtccagcattgctggactctg

SEQ ID NO: 3436320 - DNA, 22 bp, Homo sapiens
gtccagccagctcctgggcagc

SEQ ID NO: 3436321 - DNA, 23 bp, Homo sapiens
gtccagctcccgctgtggccgca

SEQ ID NO: 3436322 - DNA, 17 bp, Homo sapiens
gtccagctgagcgccag

SEQ ID NO: 3436323 - DNA, 14 bp, Homo sapiens
gtccaggctgccgt

SEQ ID NO: 3436324 - DNA, 18 bp, Homo sapiens
gtccatgggcagagccca

SEQ ID NO: 3436325 - DNA, 23 bp, Homo sapiens
gtccatgggcagagcccaaggga

SEQ ID NO: 3436326 - DNA, 21 bp, Homo sapiens
gtccattgtccaatcctatgt

SEQ ID NO: 3436327 - DNA, 19 bp, Homo sapiens
gtcccaaatccttcccaag

SEQ ID NO: 3436328 - DNA, 21 bp, Homo sapiens
gtcccaaggtgaaatgaagca

SEQ ID NO: 3436329 - DNA, 18 bp, Homo sapiens
gtcccaccctgctgctgc

SEQ ID NO: 3436330 - DNA, 15 bp, Homo sapiens
gtcccaccttggctg

SEQ ID NO: 3436331 - DNA, 20 bp, Homo sapiens
gtcccaccttggctgcaggg

SEQ ID NO: 3436332 - DNA, 21 bp, Homo sapiens
gtcccaccttggctgcaggga

SEQ ID NO: 3436333 - DNA, 16 bp, Homo sapiens
gtcccactcaagccaa

SEQ ID NO: 3436334 - DNA, 18 bp, Homo sapiens
gtcccactcaagccaagc

SEQ ID NO: 3436335 - DNA, 14 bp, Homo sapiens
gtcccactcagtcc

SEQ ID NO: 3436336 - DNA, 19 bp, Homo sapiens
gtcccacttggcatcagct

SEQ ID NO: 3436337 - DNA, 17 bp, Homo sapiens
gtcccagattggctcac

SEQ ID NO: 3436338 - DNA, 22 bp, Homo sapiens
gtccccaaatccgaacctcctc

SEQ ID NO: 3436339 - DNA, 14 bp, Homo sapiens
gtccccagctcccc

SEQ ID NO: 3436340 - DNA, 21 bp, Homo sapiens
gtccccaggccccaggaagcc

SEQ ID NO: 3436341 - DNA, 22 bp, Homo sapiens
gtccccccaccctcattctact

SEQ ID NO: 3436342 - DNA, 21 bp, Homo sapiens
gtccccctctgtccaggcact

SEQ ID NO: 3436343 - DNA, 13 bp, Homo sapiens
gtccccttctctc

SEQ ID NO: 3436344 - DNA, 20 bp, Homo sapiens
gtccccttctctcatctctt

SEQ ID NO: 3436345 - DNA, 17 bp, Homo sapiens
gtcccggctctgtgggt

SEQ ID NO: 3436346 - DNA, 22 bp, Homo sapiens
gtcccggggccagcacttccat

SEQ ID NO: 3436347 - DNA, 23 bp, Homo sapiens
gtccctccgggacctggtgctgc

SEQ ID NO: 3436348 - DNA, 21 bp, Homo sapiens
gtccctgcgcctttccttttc

SEQ ID NO: 3436349 - DNA, 22 bp, Homo sapiens
gtccctgctgctgccagggctt

SEQ ID NO: 3436350 - DNA, 23 bp, Homo sapiens
gtccctgctgctgccagggcttc

SEQ ID NO: 3436351 - DNA, 14 bp, Homo sapiens
gtccctgtcacctc

SEQ ID NO: 3436352 - DNA, 12 bp, Homo sapiens
gtccctgttaga

SEQ ID NO: 3436353 - DNA, 19 bp, Homo sapiens
gtccgtgctgacagctgct

SEQ ID NO: 3436354 - DNA, 16 bp, Homo sapiens
gtcctacccatccccg

SEQ ID NO: 3436355 - DNA, 12 bp, Homo sapiens
gtcctactctgt

SEQ ID NO: 3436356 - DNA, 19 bp, Homo sapiens
gtcctaggagtatcctcat

SEQ ID NO: 3436357 - DNA, 20 bp, Homo sapiens
gtcctatgaatgctttgcat

SEQ ID NO: 3436358 - DNA, 12 bp, Homo sapiens
gtcctcagcctt

SEQ ID NO: 3436359 - DNA, 14 bp, Homo sapiens
gtcctcagccttgc

SEQ ID NO: 3436360 - DNA, 15 bp, Homo sapiens
gtcctcaggtggcca

SEQ ID NO: 3436361 - DNA, 21 bp, Homo sapiens
gtcctccaacaccaagcacag

SEQ ID NO: 3436362 - DNA, 15 bp, Homo sapiens
gtcctcccagctcct

SEQ ID NO: 3436363 - DNA, 14 bp, Homo sapiens
gtcctcccctctct

SEQ ID NO: 3436364 - DNA, 15 bp, Homo sapiens
gtcctccctgacttt

SEQ ID NO: 3436365 - DNA, 14 bp, Homo sapiens
gtcctctctctgtg

SEQ ID NO: 3436366 - DNA, 17 bp, Homo sapiens
gtcctctgaatgaacct

SEQ ID NO: 3436367 - DNA, 18 bp, Homo sapiens
gtcctcttccctctctgc

SEQ ID NO: 3436368 - DNA, 13 bp, Homo sapiens
gtcctcttctggg

SEQ ID NO: 3436369 - DNA, 16 bp, Homo sapiens
gtcctgaaagcggctg

SEQ ID NO: 3436370 - DNA, 17 bp, Homo sapiens
gtcctgaaagcggctgc

SEQ ID NO: 3436371 - DNA, 19 bp, Homo sapiens
gtcctgaaagcggctgcct

SEQ ID NO: 3436372 - DNA, 20 bp, Homo sapiens
gtcctgaaagcggctgcctc

SEQ ID NO: 3436373 - DNA, 15 bp, Homo sapiens
gtcctgatcagagcc

SEQ ID NO: 3436374 - DNA, 17 bp, Homo sapiens
gtcctgccaccaccctg

SEQ ID NO: 3436375 - DNA, 24 bp, Homo sapiens
gtcctgccaccaccctgtcttcct

SEQ ID NO: 3436376 - DNA, 11 bp, Homo sapiens
gtcctgcctgt

SEQ ID NO: 3436377 - DNA, 16 bp, Homo sapiens
gtcctgcctgtctgcc

SEQ ID NO: 3436378 - DNA, 18 bp, Homo sapiens
gtcctgcctgtctgcccc

SEQ ID NO: 3436379 - DNA, 21 bp, Homo sapiens
gtcctgcctgtctgccccagc

SEQ ID NO: 3436380 - DNA, 13 bp, Homo sapiens
gtcctgcctgtgg

SEQ ID NO: 3436381 - DNA, 17 bp, Homo sapiens
gtcctggagcaatcaca

SEQ ID NO: 3436382 - DNA, 18 bp, Homo sapiens
gtcctgtccacacccagc

SEQ ID NO: 3436383 - DNA, 18 bp, Homo sapiens
gtcctgtgaatgccactg

SEQ ID NO: 3436384 - DNA, 19 bp, Homo sapiens
gtcctgtgaatgccactgc

SEQ ID NO: 3436385 - DNA, 19 bp, Homo sapiens
gtccttaaaaatcacactg

SEQ ID NO: 3436386 - DNA, 15 bp, Homo sapiens
gtccttagaacattt

SEQ ID NO: 3436387 - DNA, 15 bp, Homo sapiens
gtccttatgttaagc

SEQ ID NO: 3436388 - DNA, 21 bp, Homo sapiens
gtccttgtctctgggccactt

SEQ ID NO: 3436389 - DNA, 18 bp, Homo sapiens
gtcctttgcgcctgtgac

SEQ ID NO: 3436390 - DNA, 18 bp, Homo sapiens
gtcgacttcgggctggcc

SEQ ID NO: 3436391 - DNA, 15 bp, Homo sapiens
gtcgctcctgcccac

SEQ ID NO: 3436392 - DNA, 14 bp, Homo sapiens
gtcggctgaccatg

SEQ ID NO: 3436393 - DNA, 15 bp, Homo sapiens
gtcgggagaggggac

SEQ ID NO: 3436394 - DNA, 20 bp, Homo sapiens
gtcgggagaggggacgcagg

SEQ ID NO: 3436395 - DNA, 22 bp, Homo sapiens
gtcgggagaggggacgcaggcc

SEQ ID NO: 3436396 - DNA, 14 bp, Homo sapiens
gtcgggcaccagcc

SEQ ID NO: 3436397 - DNA, 18 bp, Homo sapiens
gtcgtcaaagctgaaatg

SEQ ID NO: 3436398 - DNA, 14 bp, Homo sapiens
gtcgtgcctgtgtc

SEQ ID NO: 3436399 - DNA, 21 bp, Homo sapiens
gtcgtggggtgtgctgggagc

SEQ ID NO: 3436400 - DNA, 14 bp, Homo sapiens
gtctaaaacaataa

SEQ ID NO: 3436401 - DNA, 16 bp, Homo sapiens
gtctaaacaatgctga

SEQ ID NO: 3436402 - DNA, 21 bp, Homo sapiens
gtctaaacaatgctgatttgg

SEQ ID NO: 3436403 - DNA, 18 bp, Homo sapiens
gtctagatggctcctctc

SEQ ID NO: 3436404 - DNA, 21 bp, Homo sapiens
gtctagatggctcctctcagt

SEQ ID NO: 3436405 - DNA, 15 bp, Homo sapiens
gtctatgggactcaa

SEQ ID NO: 3436406 - DNA, 22 bp, Homo sapiens
gtctatgtcgagagctggccaa

SEQ ID NO: 3436407 - DNA, 15 bp, Homo sapiens
gtctatgttcaaaga

SEQ ID NO: 3436408 - DNA, 16 bp, Homo sapiens
gtctatgttcaaagac

SEQ ID NO: 3436409 - DNA, 15 bp, Homo sapiens
gtctatgttccgaat

SEQ ID NO: 3436410 - DNA, 22 bp, Homo sapiens
gtctatgttccgaattgagcac

SEQ ID NO: 3436411 - DNA, 14 bp, Homo sapiens
gtctcaaaaaaaca

SEQ ID NO: 3436412 - DNA, 16 bp, Homo sapiens
gtctcaaactcctggg

SEQ ID NO: 3436413 - DNA, 14 bp, Homo sapiens
gtctcaatgctcat

SEQ ID NO: 3436414 - DNA, 19 bp, Homo sapiens
gtctcactatgttgcccag

SEQ ID NO: 3436415 - DNA, 20 bp, Homo sapiens
gtctcactatgttgcccagg

SEQ ID NO: 3436416 - DNA, 22 bp, Homo sapiens
gtctcactctgtcgcccagtct

SEQ ID NO: 3436417 - DNA, 22 bp, Homo sapiens
gtctcactgtgggaaggccagc

SEQ ID NO: 3436418 - DNA, 18 bp, Homo sapiens
gtctcactgttgcccagg

SEQ ID NO: 3436419 - DNA, 19 bp, Homo sapiens
gtctcactgttgcccaggc

SEQ ID NO: 3436420 - DNA, 15 bp, Homo sapiens
gtgttttatttccta

SEQ ID NO: 3436421 - DNA, 11 bp, Homo sapiens
gttaaaaataa

SEQ ID NO: 3436422 - DNA, 13 bp, Homo sapiens
gttaaaggaaaaa

SEQ ID NO: 3436423 - DNA, 17 bp, Homo sapiens
gttaaataaattgtata

SEQ ID NO: 3436424 - DNA, 18 bp, Homo sapiens
gttaacatcatgaattta

SEQ ID NO: 3436425 - DNA, 16 bp, Homo sapiens
gttaacctaggcagtg

SEQ ID NO: 3436426 - DNA, 14 bp, Homo sapiens
gttaagacctggca

SEQ ID NO: 3436427 - DNA, 16 bp, Homo sapiens
gttaaggctgaggaaa

SEQ ID NO: 3436428 - DNA, 17 bp, Homo sapiens
gttaaggctgaggaaag

SEQ ID NO: 3436429 - DNA, 13 bp, Homo sapiens
gttaataccagct

SEQ ID NO: 3436430 - DNA, 20 bp, Homo sapiens
gttaatgtaatctgatggct

SEQ ID NO: 3436431 - DNA, 20 bp, Homo sapiens
gttacacagaaatgctgctg

SEQ ID NO: 3436432 - DNA, 21 bp, Homo sapiens
gttacacagaaatgctgctgg

SEQ ID NO: 3436433 - DNA, 16 bp, Homo sapiens
gttacccactgccatg

SEQ ID NO: 3436434 - DNA, 22 bp, Homo sapiens
gttacctgaaaacactgtgcac

SEQ ID NO: 3436435 - DNA, 21 bp, Homo sapiens
gttacctgtcattttgcactg

SEQ ID NO: 3436436 - DNA, 16 bp, Homo sapiens
gttactaggtaacttc

SEQ ID NO: 3436437 - DNA, 18 bp, Homo sapiens
gttactatgtatgttttt

SEQ ID NO: 3436438 - DNA, 16 bp, Homo sapiens
gttactccagtgccaa

SEQ ID NO: 3436439 - DNA, 22 bp, Homo sapiens
gttactccagtgccaacaatcc

SEQ ID NO: 3436440 - DNA, 11 bp, Homo sapiens
gttactctgaa

SEQ ID NO: 3436441 - DNA, 14 bp, Homo sapiens
gttactctgaaggg

SEQ ID NO: 3436442 - DNA, 12 bp, Homo sapiens
gttactgctttg

SEQ ID NO: 3436443 - DNA, 13 bp, Homo sapiens
gttagacagccaa

SEQ ID NO: 3436444 - DNA, 17 bp, Homo sapiens
gttagaggaaaaatatt

SEQ ID NO: 3436445 - DNA, 13 bp, Homo sapiens
gttagcagacagg

SEQ ID NO: 3436446 - DNA, 11 bp, Homo sapiens
gttagccaaac

SEQ ID NO: 3436447 - DNA, 15 bp, Homo sapiens
gttagctcctgtggc

SEQ ID NO: 3436448 - DNA, 17 bp, Homo sapiens
gttaggcatttcctgct

SEQ ID NO: 3436449 - DNA, 18 bp, Homo sapiens
gttagtcgtgagctcttg

SEQ ID NO: 3436450 - DNA, 22 bp, Homo sapiens
gttagtctcttgtattaaactc

SEQ ID NO: 3436451 - DNA, 14 bp, Homo sapiens
gttataaagataca

SEQ ID NO: 3436452 - DNA, 15 bp, Homo sapiens
gttataaagatacag

SEQ ID NO: 3436453 - DNA, 19 bp, Homo sapiens
gttatagaacttcatggat

SEQ ID NO: 3436454 - DNA, 16 bp, Homo sapiens
gttatatcatatgtat

SEQ ID NO: 3436455 - DNA, 12 bp, Homo sapiens
gttatatttcag

SEQ ID NO: 3436456 - DNA, 22 bp, Homo sapiens
gttatcaccgtgggctccctga

SEQ ID NO: 3436457 - DNA, 18 bp, Homo sapiens
gttatgaacacttaaatt

SEQ ID NO: 3436458 - DNA, 12 bp, Homo sapiens
gttatgtatttc

SEQ ID NO: 3436459 - DNA, 14 bp, Homo sapiens
gttattgaagtgtt

SEQ ID NO: 3436460 - DNA, 14 bp, Homo sapiens
gttattgttttgtt

SEQ ID NO: 3436461 - DNA, 23 bp, Homo sapiens
gttatttgagcaagtaacattaa

SEQ ID NO: 3436462 - DNA, 14 bp, Homo sapiens
gttatttttgtaca

SEQ ID NO: 3436463 - DNA, 15 bp, Homo sapiens
gttatttttgtacat

SEQ ID NO: 3436464 - DNA, 14 bp, Homo sapiens
gttcaaaattctaa

SEQ ID NO: 3436465 - DNA, 19 bp, Homo sapiens
gttcaagcgattcttctgc

SEQ ID NO: 3436466 - DNA, 12 bp, Homo sapiens
gttcaagttttg

SEQ ID NO: 3436467 - DNA, 19 bp, Homo sapiens
gttcacagtgtttcttatt

SEQ ID NO: 3436468 - DNA, 16 bp, Homo sapiens
gttcacatagtgaaat

SEQ ID NO: 3436469 - DNA, 19 bp, Homo sapiens
gttcacatagtgaaataaa

SEQ ID NO: 3436470 - DNA, 22 bp, Homo sapiens
gttcaccttgaagaacctctca

SEQ ID NO: 3436471 - DNA, 14 bp, Homo sapiens
gttcacctttgtag

SEQ ID NO: 3436472 - DNA, 17 bp, Homo sapiens
gttcacctttgtagcac

SEQ ID NO: 3436473 - DNA, 15 bp, Homo sapiens
gttcactaaagcagt

SEQ ID NO: 3436474 - DNA, 20 bp, Homo sapiens
gttcacttttgacaaaggca

SEQ ID NO: 3436475 - DNA, 20 bp, Homo sapiens
gttcagatcttaatataaat

SEQ ID NO: 3436476 - DNA, 13 bp, Homo sapiens
gttcagctccagc

SEQ ID NO: 3436477 - DNA, 16 bp, Homo sapiens
gttcagctccagctca

SEQ ID NO: 3436478 - DNA, 23 bp, Homo sapiens
gttcagcttgtaaatagctcagg

SEQ ID NO: 3436479 - DNA, 19 bp, Homo sapiens
gttcaggcccggcagggcg

SEQ ID NO: 3436480 - DNA, 17 bp, Homo sapiens
gttcagggttggcccct

SEQ ID NO: 3436481 - DNA, 19 bp, Homo sapiens
gttcagggttggcccctgc

SEQ ID NO: 3436482 - DNA, 21 bp, Homo sapiens
gttcagggttggcccctgccc

SEQ ID NO: 3436483 - DNA, 16 bp, Homo sapiens
gttcatgccaccatgg

SEQ ID NO: 3436484 - DNA, 13 bp, Homo sapiens
gttcatttgtgta

SEQ ID NO: 3436485 - DNA, 20 bp, Homo sapiens
gttcattttgagtattttta

SEQ ID NO: 3436486 - DNA, 14 bp, Homo sapiens
gttccaaggccagg

SEQ ID NO: 3436487 - DNA, 15 bp, Homo sapiens
gttccacttgtttgc

SEQ ID NO: 3436488 - DNA, 18 bp, Homo sapiens
gttccacttgtttgcact

SEQ ID NO: 3436489 - DNA, 22 bp, Homo sapiens
gttccacttgtttgcactgtgt

SEQ ID NO: 3436490 - DNA, 17 bp, Homo sapiens
gttccagggtccctctg

SEQ ID NO: 3436491 - DNA, 19 bp, Homo sapiens
gttccagggtccctctgtg

SEQ ID NO: 3436492 - DNA, 19 bp, Homo sapiens
gttcccaagctcagaggcg

SEQ ID NO: 3436493 - DNA, 18 bp, Homo sapiens
gttcccatgtagccccct

SEQ ID NO: 3436494 - DNA, 19 bp, Homo sapiens
gttcccatgtagccccctg

SEQ ID NO: 3436495 - DNA, 20 bp, Homo sapiens
gttccccactgtatctaggc

SEQ ID NO: 3436496 - DNA, 12 bp, Homo sapiens
gttcccccatct

SEQ ID NO: 3436497 - DNA, 23 bp, Homo sapiens
gttcccctcagaaaaaaattcat

SEQ ID NO: 3436498 - DNA, 22 bp, Homo sapiens
gttccccttccactgagggcag

SEQ ID NO: 3436499 - DNA, 16 bp, Homo sapiens
gttcccgcggggctgt

SEQ ID NO: 3436500 - DNA, 14 bp, Homo sapiens
gttcccggctggac

SEQ ID NO: 3436501 - DNA, 17 bp, Homo sapiens
gttccctctccctgttg

SEQ ID NO: 3436502 - DNA, 23 bp, Homo sapiens
gttccctgagaaacccaccagcc

SEQ ID NO: 3436503 - DNA, 23 bp, Homo sapiens
gttcctggcagtttaaaaaaatt

SEQ ID NO: 3436504 - DNA, 13 bp, Homo sapiens
gttcctgtccctg

SEQ ID NO: 3436505 - DNA, 21 bp, Homo sapiens
gttcctttccaacgtttggaa

SEQ ID NO: 3436506 - DNA, 16 bp, Homo sapiens
gttcgagaccagcctg

SEQ ID NO: 3436507 - DNA, 23 bp, Homo sapiens
gttctagcacttcatctggctgc

SEQ ID NO: 3436508 - DNA, 15 bp, Homo sapiens
gttctagttttcagt

SEQ ID NO: 3436509 - DNA, 19 bp, Homo sapiens
gttctccgttagctcctgt

SEQ ID NO: 3436510 - DNA, 14 bp, Homo sapiens
gttctctgaggaca

SEQ ID NO: 3436511 - DNA, 16 bp, Homo sapiens
gttctctgtccagcag

SEQ ID NO: 3436512 - DNA, 16 bp, Homo sapiens
gttctcttaaaaggta

SEQ ID NO: 3436513 - DNA, 19 bp, Homo sapiens
gttctgatgcttacatctg

SEQ ID NO: 3436514 - DNA, 22 bp, Homo sapiens
gttctgcaaaaatatttataaa

SEQ ID NO: 3436515 - DNA, 13 bp, Homo sapiens
gttctgcctctcc

SEQ ID NO: 3436516 - DNA, 15 bp, Homo sapiens
gttctgcctgccagc

SEQ ID NO: 3436517 - DNA, 17 bp, Homo sapiens
gttctgcctgccagctg

SEQ ID NO: 3436518 - DNA, 20 bp, Homo sapiens
gttctggaggaaagggagga

SEQ ID NO: 3436519 - DNA, 17 bp, Homo sapiens
gttctggatggtgtgcc

SEQ ID NO: 3436520 - DNA, 16 bp, Homo sapiens
gttctggccagaatgc

SEQ ID NO: 3436521 - DNA, 11 bp, Homo sapiens
gttctgggaca

SEQ ID NO: 3436522 - DNA, 12 bp, Homo sapiens
gttctgggacac

SEQ ID NO: 3436523 - DNA, 16 bp, Homo sapiens
gttctggtggtttgat

SEQ ID NO: 3436524 - DNA, 14 bp, Homo sapiens
gttctgtcttccca

SEQ ID NO: 3436525 - DNA, 14 bp, Homo sapiens
gttctgtttgttat

SEQ ID NO: 3436526 - DNA, 21 bp, Homo sapiens
gttcttaaccagatggttgtg

SEQ ID NO: 3436527 - DNA, 15 bp, Homo sapiens
gttcttaggctgctg

SEQ ID NO: 3436528 - DNA, 18 bp, Homo sapiens
gttcttaggctgctggga

SEQ ID NO: 3436529 - DNA, 21 bp, Homo sapiens
gttcttatttgccagagccaa

SEQ ID NO: 3436530 - DNA, 22 bp, Homo sapiens
gttcttcttgttctgagattca

SEQ ID NO: 3436531 - DNA, 16 bp, Homo sapiens
gttcttgatggagatt

SEQ ID NO: 3436532 - DNA, 22 bp, Homo sapiens
gttcttgatggagattaagatg

SEQ ID NO: 3436533 - DNA, 20 bp, Homo sapiens
gttctttgttcatagcccag

SEQ ID NO: 3436534 - DNA, 21 bp, Homo sapiens
gttctttgttcatagcccagt

SEQ ID NO: 3436535 - DNA, 17 bp, Homo sapiens
gttctttttaagttaat

SEQ ID NO: 3436536 - DNA, 17 bp, Homo sapiens
gttgaaaaacagctgag

SEQ ID NO: 3436537 - DNA, 22 bp, Homo sapiens
gttgaattttgttctctgggag

SEQ ID NO: 3436538 - DNA, 16 bp, Homo sapiens
gttgacaattctgcat

SEQ ID NO: 3436539 - DNA, 19 bp, Homo sapiens
gttgacacagttgtagggt

SEQ ID NO: 3436540 - DNA, 16 bp, Homo sapiens
gttgacacctgagaaa

SEQ ID NO: 3436541 - DNA, 15 bp, Homo sapiens
gttgaccccagagga

SEQ ID NO: 3436542 - DNA, 22 bp, Homo sapiens
gttgacttccaggcacggtttg

SEQ ID NO: 3436543 - DNA, 14 bp, Homo sapiens
gttgactttcaggt

SEQ ID NO: 3436544 - DNA, 19 bp, Homo sapiens
gttgagaaggtgcctgcca

SEQ ID NO: 3436545 - DNA, 21 bp, Homo sapiens
gttgagcatgacagcctgcag

SEQ ID NO: 3436546 - DNA, 13 bp, Homo sapiens
gttgagctgtttt

SEQ ID NO: 3436547 - DNA, 23 bp, Homo sapiens
gttgatagcaagtgaatttttct

SEQ ID NO: 3436548 - DNA, 14 bp, Homo sapiens
gttgatcagatctg

SEQ ID NO: 3436549 - DNA, 15 bp, Homo sapiens
gttgatctggaaccc

SEQ ID NO: 3436550 - DNA, 17 bp, Homo sapiens
gttgatctggaacccag

SEQ ID NO: 3436551 - DNA, 16 bp, Homo sapiens
gttgatgttggctggg

SEQ ID NO: 3436552 - DNA, 17 bp, Homo sapiens
gttgcactaactgctgg

SEQ ID NO: 3436553 - DNA, 14 bp, Homo sapiens
taaggcctgaatca

SEQ ID NO: 3436554 - DNA, 14 bp, Homo sapiens
taaggccttagcca

SEQ ID NO: 3436555 - DNA, 20 bp, Homo sapiens
taaggcgtggagctgcctga

SEQ ID NO: 3436556 - DNA, 20 bp, Homo sapiens
taaggctgaggaaaggccag

SEQ ID NO: 3436557 - DNA, 21 bp, Homo sapiens
taaggctgcaaggtttaggct

SEQ ID NO: 3436558 - DNA, 15 bp, Homo sapiens
taaggtgctaaatct

SEQ ID NO: 3436559 - DNA, 12 bp, Homo sapiens
taagtaaagtga

SEQ ID NO: 3436560 - DNA, 14 bp, Homo sapiens
taagtaagaaattt

SEQ ID NO: 3436561 - DNA, 17 bp, Homo sapiens
taagtacctcagcattt

SEQ ID NO: 3436562 - DNA, 18 bp, Homo sapiens
taagtattgcatctgtat

SEQ ID NO: 3436563 - DNA, 13 bp, Homo sapiens
taagtccaaatct

SEQ ID NO: 3436564 - DNA, 18 bp, Homo sapiens
taagtccaaatctccaag

SEQ ID NO: 3436565 - DNA, 16 bp, Homo sapiens
taagtccctgtcacct

SEQ ID NO: 3436566 - DNA, 19 bp, Homo sapiens
taagtccctgtcacctctt

SEQ ID NO: 3436567 - DNA, 20 bp, Homo sapiens
taagtcttatcaagcagcca

SEQ ID NO: 3436568 - DNA, 20 bp, Homo sapiens
taagtgctgtataaaatcag

SEQ ID NO: 3436569 - DNA, 22 bp, Homo sapiens
taagtgctgtataaaatcagcc

SEQ ID NO: 3436570 - DNA, 17 bp, Homo sapiens
taagtggtgcttagaaa

SEQ ID NO: 3436571 - DNA, 23 bp, Homo sapiens
taagtgtatttttcaataaagca

SEQ ID NO: 3436572 - DNA, 18 bp, Homo sapiens
taagttattttacctgtt

SEQ ID NO: 3436573 - DNA, 17 bp, Homo sapiens
taagttatttttgtaca

SEQ ID NO: 3436574 - DNA, 17 bp, Homo sapiens
taagttgagaaggtgcc

SEQ ID NO: 3436575 - DNA, 21 bp, Homo sapiens
taagttgagaaggtgcctgcc

SEQ ID NO: 3436576 - DNA, 20 bp, Homo sapiens
taagttggaccagaggaagc

SEQ ID NO: 3436577 - DNA, 11 bp, Homo sapiens
taataaaccag

SEQ ID NO: 3436578 - DNA, 16 bp, Homo sapiens
taataaacgatgttgt

SEQ ID NO: 3436579 - DNA, 18 bp, Homo sapiens
taataaacgatgttgtga

SEQ ID NO: 3436580 - DNA, 13 bp, Homo sapiens
taataacatttaa

SEQ ID NO: 3436581 - DNA, 15 bp, Homo sapiens
taataacatttaatt

SEQ ID NO: 3436582 - DNA, 19 bp, Homo sapiens
taataacatttaatttaga

SEQ ID NO: 3436583 - DNA, 13 bp, Homo sapiens
taataatatactt

SEQ ID NO: 3436584 - DNA, 16 bp, Homo sapiens
taataatatacttgtg

SEQ ID NO: 3436585 - DNA, 20 bp, Homo sapiens
taatacattccaactcgtat

SEQ ID NO: 3436586 - DNA, 15 bp, Homo sapiens
taatacccagagcac

SEQ ID NO: 3436587 - DNA, 14 bp, Homo sapiens
taatactaccttga

SEQ ID NO: 3436588 - DNA, 19 bp, Homo sapiens
taatactgctgagatacat

SEQ ID NO: 3436589 - DNA, 14 bp, Homo sapiens
taatactgtatttg

SEQ ID NO: 3436590 - DNA, 15 bp, Homo sapiens
taatagggaatatat

SEQ ID NO: 3436591 - DNA, 17 bp, Homo sapiens
taatagtaatttgtaaa

SEQ ID NO: 3436592 - DNA, 14 bp, Homo sapiens
taatataaattcac

SEQ ID NO: 3436593 - DNA, 21 bp, Homo sapiens
taatataaattcactttcatt

SEQ ID NO: 3436594 - DNA, 13 bp, Homo sapiens
taatatacttgtg

SEQ ID NO: 3436595 - DNA, 17 bp, Homo sapiens
taatatacttgtggact

SEQ ID NO: 3436596 - DNA, 21 bp, Homo sapiens
taatatacttgtggactaaaa

SEQ ID NO: 3436597 - DNA, 19 bp, Homo sapiens
taatatatttgtgtattta

SEQ ID NO: 3436598 - DNA, 20 bp, Homo sapiens
taatatatttgtgtatttaa

SEQ ID NO: 3436599 - DNA, 15 bp, Homo sapiens
taatatctaaagtta

SEQ ID NO: 3436600 - DNA, 16 bp, Homo sapiens
taatatgaaaacttat

SEQ ID NO: 3436601 - DNA, 12 bp, Homo sapiens
taatatgagaat

SEQ ID NO: 3436602 - DNA, 20 bp, Homo sapiens
taatattaaggaagacaatg

SEQ ID NO: 3436603 - DNA, 16 bp, Homo sapiens
taatattgtggtgcca

SEQ ID NO: 3436604 - DNA, 14 bp, Homo sapiens
taatattttgttct

SEQ ID NO: 3436605 - DNA, 13 bp, Homo sapiens
taatcatttgttt

SEQ ID NO: 3436606 - DNA, 14 bp, Homo sapiens
taatcatttgttta

SEQ ID NO: 3436607 - DNA, 12 bp, Homo sapiens
taatcattttca

SEQ ID NO: 3436608 - DNA, 14 bp, Homo sapiens
taatcattttcatt

SEQ ID NO: 3436609 - DNA, 22 bp, Homo sapiens
taatccaggcagatccaggact

SEQ ID NO: 3436610 - DNA, 23 bp, Homo sapiens
taatccaggcagatccaggacta

SEQ ID NO: 3436611 - DNA, 17 bp, Homo sapiens
taatccccagtaaaatt

SEQ ID NO: 3436612 - DNA, 21 bp, Homo sapiens
taatccgaatctctttttgct

SEQ ID NO: 3436613 - DNA, 20 bp, Homo sapiens
taatctgatggcttctccag

SEQ ID NO: 3436614 - DNA, 20 bp, Homo sapiens
taatctgttatgtactagtg

SEQ ID NO: 3436615 - DNA, 14 bp, Homo sapiens
taatcttgctctgc

SEQ ID NO: 3436616 - DNA, 15 bp, Homo sapiens
taatcttgctttctt

SEQ ID NO: 3436617 - DNA, 18 bp, Homo sapiens
taatcttgctttctttag

SEQ ID NO: 3436618 - DNA, 16 bp, Homo sapiens
taatgaagaaagtgga

SEQ ID NO: 3436619 - DNA, 22 bp, Homo sapiens
taatgaagaaagtggaaaacaa

SEQ ID NO: 3436620 - DNA, 20 bp, Homo sapiens
taatgaagtttgaatgttaa

SEQ ID NO: 3436621 - DNA, 15 bp, Homo sapiens
taatgacacttgtcc

SEQ ID NO: 3436622 - DNA, 20 bp, Homo sapiens
taatgaccaacctgtttcta

SEQ ID NO: 3436623 - DNA, 13 bp, Homo sapiens
taatgagtttaaa

SEQ ID NO: 3436624 - DNA, 19 bp, Homo sapiens
taatgcaagagaacatttt

SEQ ID NO: 3436625 - DNA, 18 bp, Homo sapiens
taatgcaatagaagtgct

SEQ ID NO: 3436626 - DNA, 16 bp, Homo sapiens
taatgcagtatggtac

SEQ ID NO: 3436627 - DNA, 22 bp, Homo sapiens
taatgcatctagattatggagc

SEQ ID NO: 3436628 - DNA, 17 bp, Homo sapiens
taatgctatttgaacaa

SEQ ID NO: 3436629 - DNA, 13 bp, Homo sapiens
taatgctccttgt

SEQ ID NO: 3436630 - DNA, 14 bp, Homo sapiens
taatgcttaagatt

SEQ ID NO: 3436631 - DNA, 14 bp, Homo sapiens
taatgcttttatat

SEQ ID NO: 3436632 - DNA, 23 bp, Homo sapiens
taatgctttttgagtttcatgtt

SEQ ID NO: 3436633 - DNA, 15 bp, Homo sapiens
taatggcatgagaaa

SEQ ID NO: 3436634 - DNA, 17 bp, Homo sapiens
taatggcatgagaaata

SEQ ID NO: 3436635 - DNA, 18 bp, Homo sapiens
taatgggcttagagcagt

SEQ ID NO: 3436636 - DNA, 15 bp, Homo sapiens
taatggggtcctggc

SEQ ID NO: 3436637 - DNA, 22 bp, Homo sapiens
taatggggtcctggccatccca

SEQ ID NO: 3436638 - DNA, 18 bp, Homo sapiens
taatggtccacacccaat

SEQ ID NO: 3436639 - DNA, 17 bp, Homo sapiens
taatgtaatttagtcta

SEQ ID NO: 3436640 - DNA, 20 bp, Homo sapiens
taatgtaatttagtctaaca

SEQ ID NO: 3436641 - DNA, 15 bp, Homo sapiens
taatgtcacaggcag

SEQ ID NO: 3436642 - DNA, 18 bp, Homo sapiens
taatgtcacaggcaggtc

SEQ ID NO: 3436643 - DNA, 19 bp, Homo sapiens
taatgtctttaaaaagcat

SEQ ID NO: 3436644 - DNA, 24 bp, Homo sapiens
taatgtgaatctatgctggtgaaa

SEQ ID NO: 3436645 - DNA, 22 bp, Homo sapiens
taatgttgctggatcaggaagc

SEQ ID NO: 3436646 - DNA, 15 bp, Homo sapiens
taatgttttaaatgt

SEQ ID NO: 3436647 - DNA, 16 bp, Homo sapiens
taatgttttaaatgta

SEQ ID NO: 3436648 - DNA, 17 bp, Homo sapiens
taatgttttaaatgtac

SEQ ID NO: 3436649 - DNA, 13 bp, Homo sapiens
taatgttttcttt

SEQ ID NO: 3436650 - DNA, 20 bp, Homo sapiens
taatgttttctttgcaaagt

SEQ ID NO: 3436651 - DNA, 16 bp, Homo sapiens
taatgtttttaatatt

SEQ ID NO: 3436652 - DNA, 18 bp, Homo sapiens
taattaaccttactaatt

SEQ ID NO: 3436653 - DNA, 19 bp, Homo sapiens
taattaaccttactaatta

SEQ ID NO: 3436654 - DNA, 15 bp, Homo sapiens
taattagtgctaagt

SEQ ID NO: 3436655 - DNA, 20 bp, Homo sapiens
taattagtgctaagtgtgaa

SEQ ID NO: 3436656 - DNA, 18 bp, Homo sapiens
taattcagccatgtacag

SEQ ID NO: 3436657 - DNA, 13 bp, Homo sapiens
taattcaggtatg

SEQ ID NO: 3436658 - DNA, 22 bp, Homo sapiens
taattccgtaggttattttcag

SEQ ID NO: 3436659 - DNA, 15 bp, Homo sapiens
taattctcaggccat

SEQ ID NO: 3436660 - DNA, 12 bp, Homo sapiens
taattgctgcaa

SEQ ID NO: 3436661 - DNA, 20 bp, Homo sapiens
taattgttgaacaggtgttt

SEQ ID NO: 3436662 - DNA, 14 bp, Homo sapiens
taatttaaagagac

SEQ ID NO: 3436663 - DNA, 19 bp, Homo sapiens
taatttagatattttccat

SEQ ID NO: 3436664 - DNA, 16 bp, Homo sapiens
taatttagattgtaaa

SEQ ID NO: 3436665 - DNA, 17 bp, Homo sapiens
taatttagtaaatgtta

SEQ ID NO: 3436666 - DNA, 18 bp, Homo sapiens
taatttagtctaacacag

SEQ ID NO: 3436667 - DNA, 22 bp, Homo sapiens
taatttatagtaatgagtttaa

SEQ ID NO: 3436668 - DNA, 20 bp, Homo sapiens
taatttcaaaatgcttttta

SEQ ID NO: 3436669 - DNA, 20 bp, Homo sapiens
taatttgatgaggtattttt

SEQ ID NO: 3436670 - DNA, 17 bp, Homo sapiens
taatttgcattaaattc

SEQ ID NO: 3436671 - DNA, 12 bp, Homo sapiens
taatttgtaaag

SEQ ID NO: 3436672 - DNA, 21 bp, Homo sapiens
taatttgtacatatgtaaaat

SEQ ID NO: 3436673 - DNA, 14 bp, Homo sapiens
taatttgtattgaa

SEQ ID NO: 3436674 - DNA, 15 bp, Homo sapiens
taattttgaataaat

SEQ ID NO: 3436675 - DNA, 15 bp, Homo sapiens
taattttttggtaca

SEQ ID NO: 3436676 - DNA, 21 bp, Homo sapiens
taatttttttaaccaaaggtg

SEQ ID NO: 3436677 - DNA, 22 bp, Homo sapiens
taatttttttcaatatttatta

SEQ ID NO: 3436678 - DNA, 16 bp, Homo sapiens
taatttttttcttgta

SEQ ID NO: 3436679 - DNA, 18 bp, Homo sapiens
taatttttttgagacaga

SEQ ID NO: 3436680 - DNA, 20 bp, Homo sapiens
tacaaaaagcataaaaatta

SEQ ID NO: 3436681 - DNA, 14 bp, Homo sapiens
tacaaaaataaatt

SEQ ID NO: 3436682 - DNA, 16 bp, Homo sapiens
tacaaactggtattct

SEQ ID NO: 3436683 - DNA, 19 bp, Homo sapiens
tacaaaggggaaagaacat

SEQ ID NO: 3436684 - DNA, 13 bp, Homo sapiens
tacaaagtgtgta

SEQ ID NO: 3436685 - DNA, 14 bp, Homo sapiens
tacaaatataagaa

SEQ ID NO: 3436686 - DNA, 20 bp, Homo sapiens
tatagaattagctttttcat

SEQ ID NO: 3436687 - DNA, 13 bp, Homo sapiens
tatagcatctttc

SEQ ID NO: 3436688 - DNA, 15 bp, Homo sapiens
tatagtaatgagttt

SEQ ID NO: 3436689 - DNA, 18 bp, Homo sapiens
tatagtgatgtaatcttg

SEQ ID NO: 3436690 - DNA, 22 bp, Homo sapiens
tatagttattaagttctttaaa

SEQ ID NO: 3436691 - DNA, 18 bp, Homo sapiens
tatagttgttttatatgt

SEQ ID NO: 3436692 - DNA, 15 bp, Homo sapiens
tatagtttgggcttc

SEQ ID NO: 3436693 - DNA, 22 bp, Homo sapiens
tatataaaataaatatatataa

SEQ ID NO: 3436694 - DNA, 14 bp, Homo sapiens
tatataaacctaaa

SEQ ID NO: 3436695 - DNA, 15 bp, Homo sapiens
tatataaacctaaaa

SEQ ID NO: 3436696 - DNA, 23 bp, Homo sapiens
tatataaagcacagatttgcatt

SEQ ID NO: 3436697 - DNA, 23 bp, Homo sapiens
tatataatactgactgagaatat

SEQ ID NO: 3436698 - DNA, 12 bp, Homo sapiens
tatataatatct

SEQ ID NO: 3436699 - DNA, 16 bp, Homo sapiens
tatatacaataacata

SEQ ID NO: 3436700 - DNA, 16 bp, Homo sapiens
tatatataaacctaaa

SEQ ID NO: 3436701 - DNA, 15 bp, Homo sapiens
tatatataagaaaga

SEQ ID NO: 3436702 - DNA, 20 bp, Homo sapiens
tatatatctaagttcacagt

SEQ ID NO: 3436703 - DNA, 14 bp, Homo sapiens
tatatatgtatata

SEQ ID NO: 3436704 - DNA, 14 bp, Homo sapiens
tatatatgtgagga

SEQ ID NO: 3436705 - DNA, 21 bp, Homo sapiens
tatatattattctcatttagt

SEQ ID NO: 3436706 - DNA, 21 bp, Homo sapiens
tatatctaagttcacagtgtt

SEQ ID NO: 3436707 - DNA, 15 bp, Homo sapiens
tatatctctatttga

SEQ ID NO: 3436708 - DNA, 21 bp, Homo sapiens
tatatgcacttataattttcc

SEQ ID NO: 3436709 - DNA, 11 bp, Homo sapiens
tatatgtattt

SEQ ID NO: 3436710 - DNA, 12 bp, Homo sapiens
tatatgtcaaag

SEQ ID NO: 3436711 - DNA, 18 bp, Homo sapiens
tatatgtgtttttcacat

SEQ ID NO: 3436712 - DNA, 13 bp, Homo sapiens
tatattaaaaata

SEQ ID NO: 3436713 - DNA, 17 bp, Homo sapiens
tatattaaaaatataaa

SEQ ID NO: 3436714 - DNA, 13 bp, Homo sapiens
tatattaatagta

SEQ ID NO: 3436715 - DNA, 23 bp, Homo sapiens
tatattaatagtaatttgtaaag

SEQ ID NO: 3436716 - DNA, 20 bp, Homo sapiens
tatattatcatgcaaatgct

SEQ ID NO: 3436717 - DNA, 17 bp, Homo sapiens
tatattattctcattta

SEQ ID NO: 3436718 - DNA, 21 bp, Homo sapiens
tatattattctcatttagtgc

SEQ ID NO: 3436719 - DNA, 14 bp, Homo sapiens
tatattcatatatt

SEQ ID NO: 3436720 - DNA, 15 bp, Homo sapiens
tatattgcatttctg

SEQ ID NO: 3436721 - DNA, 17 bp, Homo sapiens
tatattgcatttctgta

SEQ ID NO: 3436722 - DNA, 19 bp, Homo sapiens
tatattgtgtttgtgtatt

SEQ ID NO: 3436723 - DNA, 13 bp, Homo sapiens
tatattgttttct

SEQ ID NO: 3436724 - DNA, 20 bp, Homo sapiens
tatatttaagcaacatcttt

SEQ ID NO: 3436725 - DNA, 14 bp, Homo sapiens
tatatttacaaatg

SEQ ID NO: 3436726 - DNA, 12 bp, Homo sapiens
tatatttgacat

SEQ ID NO: 3436727 - DNA, 13 bp, Homo sapiens
tatatttgacatg

SEQ ID NO: 3436728 - DNA, 13 bp, Homo sapiens
tatatttgtagga

SEQ ID NO: 3436729 - DNA, 17 bp, Homo sapiens
tatatttgtgctatagt

SEQ ID NO: 3436730 - DNA, 21 bp, Homo sapiens
tatatttgtgctatagtattt

SEQ ID NO: 3436731 - DNA, 16 bp, Homo sapiens
tatatttgtgtattta

SEQ ID NO: 3436732 - DNA, 23 bp, Homo sapiens
tatcaaatgcagtatatttcttc

SEQ ID NO: 3436733 - DNA, 14 bp, Homo sapiens
tatcaacttcctaa

SEQ ID NO: 3436734 - DNA, 16 bp, Homo sapiens
tatcacctcattctga

SEQ ID NO: 3436735 - DNA, 19 bp, Homo sapiens
tatcacctcattctgaacc

SEQ ID NO: 3436736 - DNA, 20 bp, Homo sapiens
tatcagaatttgtgttgaag

SEQ ID NO: 3436737 - DNA, 21 bp, Homo sapiens
tatcagtcaatatttttagat

SEQ ID NO: 3436738 - DNA, 16 bp, Homo sapiens
tatcagttacccactc

SEQ ID NO: 3436739 - DNA, 17 bp, Homo sapiens
tatcatgcaaatgctgt

SEQ ID NO: 3436740 - DNA, 20 bp, Homo sapiens
tatcatttattttttacatt

SEQ ID NO: 3436741 - DNA, 18 bp, Homo sapiens
tatccaaaatgtgtattt

SEQ ID NO: 3436742 - DNA, 22 bp, Homo sapiens
tatccaaaatgtgtatttctta

SEQ ID NO: 3436743 - DNA, 23 bp, Homo sapiens
tatccaccaaaagggctccctga

SEQ ID NO: 3436744 - DNA, 16 bp, Homo sapiens
tatccataatgatgga

SEQ ID NO: 3436745 - DNA, 23 bp, Homo sapiens
tatccataatgatggatttaaca

SEQ ID NO: 3436746 - DNA, 17 bp, Homo sapiens
tatccatattgagtcaa

SEQ ID NO: 3436747 - DNA, 22 bp, Homo sapiens
tatccatattgagtcaaatggt

SEQ ID NO: 3436748 - DNA, 20 bp, Homo sapiens
tatccatgtacttgtttgca

SEQ ID NO: 3436749 - DNA, 16 bp, Homo sapiens
tatccattctttctga

SEQ ID NO: 3436750 - DNA, 19 bp, Homo sapiens
tatccccccatcttgcttc

SEQ ID NO: 3436751 - DNA, 20 bp, Homo sapiens
tatccccccatcttgcttcc

SEQ ID NO: 3436752 - DNA, 13 bp, Homo sapiens
tatccctgcccat

SEQ ID NO: 3436753 - DNA, 19 bp, Homo sapiens
tatcctagcacatgcttca

SEQ ID NO: 3436754 - DNA, 22 bp, Homo sapiens
tatcctagcacatgcttcaata

SEQ ID NO: 3436755 - DNA, 22 bp, Homo sapiens
tatcctcctgttctgaaacctt

SEQ ID NO: 3436756 - DNA, 15 bp, Homo sapiens
tatcctgctgttcta

SEQ ID NO: 3436757 - DNA, 22 bp, Homo sapiens
tatcctgggggacccaatgtag

SEQ ID NO: 3436758 - DNA, 14 bp, Homo sapiens
tatccttctacttg

SEQ ID NO: 3436759 - DNA, 16 bp, Homo sapiens
tatcgatctcttattt

SEQ ID NO: 3436760 - DNA, 19 bp, Homo sapiens
tatcgatgttatgtaaaag

SEQ ID NO: 3436761 - DNA, 14 bp, Homo sapiens
tatctaaaccatat

SEQ ID NO: 3436762 - DNA, 16 bp, Homo sapiens
tatctaaatcaccaga

SEQ ID NO: 3436763 - DNA, 19 bp, Homo sapiens
tatctaagaatacagcttt

SEQ ID NO: 3436764 - DNA, 20 bp, Homo sapiens
tatctaagaatacagctttc

SEQ ID NO: 3436765 - DNA, 21 bp, Homo sapiens
tatctactctcctcatctcta

SEQ ID NO: 3436766 - DNA, 17 bp, Homo sapiens
tatctaggcaacatagt

SEQ ID NO: 3436767 - DNA, 18 bp, Homo sapiens
tatctatacatatcttta

SEQ ID NO: 3436768 - DNA, 23 bp, Homo sapiens
tatctcaactttggttcctgtga

SEQ ID NO: 3436769 - DNA, 15 bp, Homo sapiens
tatctcagggcctgg

SEQ ID NO: 3436770 - DNA, 19 bp, Homo sapiens
tatctccggctcccagcct

SEQ ID NO: 3436771 - DNA, 20 bp, Homo sapiens
tatctccggctcccagcctc

SEQ ID NO: 3436772 - DNA, 15 bp, Homo sapiens
tatctgcaggcagac

SEQ ID NO: 3436773 - DNA, 17 bp, Homo sapiens
tatctgcaggcagacac

SEQ ID NO: 3436774 - DNA, 19 bp, Homo sapiens
tatctgcaggcagacacgg

SEQ ID NO: 3436775 - DNA, 15 bp, Homo sapiens
tatctgcctgacagg

SEQ ID NO: 3436776 - DNA, 18 bp, Homo sapiens
tatctgcctttattgtgt

SEQ ID NO: 3436777 - DNA, 23 bp, Homo sapiens
tatctgtcatttgagcagggctc

SEQ ID NO: 3436778 - DNA, 14 bp, Homo sapiens
tatctgtgctcagg

SEQ ID NO: 3436779 - DNA, 19 bp, Homo sapiens
tatcttagatgtttcacac

SEQ ID NO: 3436780 - DNA, 13 bp, Homo sapiens
tatcttcagttta

SEQ ID NO: 3436781 - DNA, 17 bp, Homo sapiens
tatcttgatgtttagaa

SEQ ID NO: 3436782 - DNA, 11 bp, Homo sapiens
tatcttggcct

SEQ ID NO: 3436783 - DNA, 15 bp, Homo sapiens
tatcttgtctctggg

SEQ ID NO: 3436784 - DNA, 17 bp, Homo sapiens
tatcttgtctctgggct

SEQ ID NO: 3436785 - DNA, 14 bp, Homo sapiens
tatcttgtttttcc

SEQ ID NO: 3436786 - DNA, 18 bp, Homo sapiens
tatcttgtttttccacta

SEQ ID NO: 3436787 - DNA, 22 bp, Homo sapiens
tatcttttgtttccttttttcc

SEQ ID NO: 3436788 - DNA, 13 bp, Homo sapiens
tatgaaaacttat

SEQ ID NO: 3436789 - DNA, 23 bp, Homo sapiens
tatgaatctgctcactttaaacc

SEQ ID NO: 3436790 - DNA, 22 bp, Homo sapiens
tatgaatgagaatgtgccatgt

SEQ ID NO: 3436791 - DNA, 23 bp, Homo sapiens
tatgaatgatttgcatatgaaag

SEQ ID NO: 3436792 - DNA, 18 bp, Homo sapiens
tatgacaagcctttgtgc

SEQ ID NO: 3436793 - DNA, 11 bp, Homo sapiens
tatgacacagt

SEQ ID NO: 3436794 - DNA, 20 bp, Homo sapiens
tatgacattcatgcctggct

SEQ ID NO: 3436795 - DNA, 21 bp, Homo sapiens
tatgacattggatagaacatg

SEQ ID NO: 3436796 - DNA, 19 bp, Homo sapiens
tatgactttttataaaatg

SEQ ID NO: 3436797 - DNA, 18 bp, Homo sapiens
tatgagtggaaaaagcca

SEQ ID NO: 3436798 - DNA, 18 bp, Homo sapiens
tatgataattacaataca

SEQ ID NO: 3436799 - DNA, 20 bp, Homo sapiens
tatgataattacaatacaaa

SEQ ID NO: 3436800 - DNA, 13 bp, Homo sapiens
tatgatatcattg

SEQ ID NO: 3436801 - DNA, 14 bp, Homo sapiens
tatgatatcattgt

SEQ ID NO: 3436802 - DNA, 13 bp, Homo sapiens
tatgatctcagga

SEQ ID NO: 3436803 - DNA, 17 bp, Homo sapiens
tatgatttataaacaga

SEQ ID NO: 3436804 - DNA, 22 bp, Homo sapiens
tatgcacttataattttcctaa

SEQ ID NO: 3436805 - DNA, 23 bp, Homo sapiens
tatgcagtctctttattttacta

SEQ ID NO: 3436806 - DNA, 20 bp, Homo sapiens
tatgcatggtgccccaggac

SEQ ID NO: 3436807 - DNA, 21 bp, Homo sapiens
tatgcatggtgccccaggacc

SEQ ID NO: 3436808 - DNA, 23 bp, Homo sapiens
tatgcatggtgccccaggaccag

SEQ ID NO: 3436809 - DNA, 21 bp, Homo sapiens
tatgcatttaaatacagtctt

SEQ ID NO: 3436810 - DNA, 21 bp, Homo sapiens
tatgccaccaacttacaaaaa

SEQ ID NO: 3436811 - DNA, 14 bp, Homo sapiens
tatgctcttttgtt

SEQ ID NO: 3436812 - DNA, 21 bp, Homo sapiens
tatgctttccaaaccttatct

SEQ ID NO: 3436813 - DNA, 21 bp, Homo sapiens
tatgctttccttctttgggat

SEQ ID NO: 3436814 - DNA, 15 bp, Homo sapiens
tatgctttgaaacag

SEQ ID NO: 3436815 - DNA, 17 bp, Homo sapiens
tatggaaaacatttcaa

SEQ ID NO: 3436816 - DNA, 18 bp, Homo sapiens
tatggaagttgcataatt

SEQ ID NO: 3436817 - DNA, 14 bp, Homo sapiens
tcagggctcctggg

SEQ ID NO: 3436818 - DNA, 17 bp, Homo sapiens
tcagggttggcccctgc

SEQ ID NO: 3436819 - DNA, 16 bp, Homo sapiens
tcaggtaacaggcaga

SEQ ID NO: 3436820 - DNA, 22 bp, Homo sapiens
tcaggtaacaggcagatacagg

SEQ ID NO: 3436821 - DNA, 13 bp, Homo sapiens
tcaggtagctgcc

SEQ ID NO: 3436822 - DNA, 16 bp, Homo sapiens
tcaggtcaggagttcg

SEQ ID NO: 3436823 - DNA, 23 bp, Homo sapiens
tcaggtgatccacccacctcagc

SEQ ID NO: 3436824 - DNA, 14 bp, Homo sapiens
tcaggtgcagagga

SEQ ID NO: 3436825 - DNA, 15 bp, Homo sapiens
tcaggtgcagaggaa

SEQ ID NO: 3436826 - DNA, 16 bp, Homo sapiens
tcaggtgcagaggaag

SEQ ID NO: 3436827 - DNA, 20 bp, Homo sapiens
tcaggtgctgccatccaggt

SEQ ID NO: 3436828 - DNA, 16 bp, Homo sapiens
tcaggtgctgtccatg

SEQ ID NO: 3436829 - DNA, 11 bp, Homo sapiens
tcaggtggcca

SEQ ID NO: 3436830 - DNA, 13 bp, Homo sapiens
tcaggtggccatg

SEQ ID NO: 3436831 - DNA, 15 bp, Homo sapiens
tcaggtggggcagct

SEQ ID NO: 3436832 - DNA, 16 bp, Homo sapiens
tcaggtggggcagctt

SEQ ID NO: 3436833 - DNA, 19 bp, Homo sapiens
tcaggtggggcagcttgag

SEQ ID NO: 3436834 - DNA, 21 bp, Homo sapiens
tcaggtggggcagcttgaggg

SEQ ID NO: 3436835 - DNA, 18 bp, Homo sapiens
tcaggtgtccctgcactt

SEQ ID NO: 3436836 - DNA, 13 bp, Homo sapiens
tcagtaagacgac

SEQ ID NO: 3436837 - DNA, 18 bp, Homo sapiens
tcagtagtttgagaccag

SEQ ID NO: 3436838 - DNA, 15 bp, Homo sapiens
tcagtataaacaaag

SEQ ID NO: 3436839 - DNA, 20 bp, Homo sapiens
tcagtatccatgctcttgac

SEQ ID NO: 3436840 - DNA, 16 bp, Homo sapiens
tcagtatgttgtcaaa

SEQ ID NO: 3436841 - DNA, 17 bp, Homo sapiens
tcagtatgttgtcaaag

SEQ ID NO: 3436842 - DNA, 18 bp, Homo sapiens
tcagtatgttgtcaaaga

SEQ ID NO: 3436843 - DNA, 15 bp, Homo sapiens
tcagtcacagccacc

SEQ ID NO: 3436844 - DNA, 15 bp, Homo sapiens
tcagtccatagcaga

SEQ ID NO: 3436845 - DNA, 16 bp, Homo sapiens
tcagtccgcctggccg

SEQ ID NO: 3436846 - DNA, 19 bp, Homo sapiens
tcagtccgcctggccggct

SEQ ID NO: 3436847 - DNA, 22 bp, Homo sapiens
tcagtccgcctggccggctcca

SEQ ID NO: 3436848 - DNA, 13 bp, Homo sapiens
tcagtctctgagc

SEQ ID NO: 3436849 - DNA, 15 bp, Homo sapiens
tcagtctctgagcag

SEQ ID NO: 3436850 - DNA, 17 bp, Homo sapiens
tcagtctctgagcagtg

SEQ ID NO: 3436851 - DNA, 23 bp, Homo sapiens
tcagtctgattcccaagctctgc

SEQ ID NO: 3436852 - DNA, 19 bp, Homo sapiens
tcagtgatgtaccatgaaa

SEQ ID NO: 3436853 - DNA, 17 bp, Homo sapiens
tcagtgcaacctctgct

SEQ ID NO: 3436854 - DNA, 20 bp, Homo sapiens
tcagtgcagcatatacaata

SEQ ID NO: 3436855 - DNA, 14 bp, Homo sapiens
tcagtgcatttgtg

SEQ ID NO: 3436856 - DNA, 12 bp, Homo sapiens
tcagtgccacta

SEQ ID NO: 3436857 - DNA, 16 bp, Homo sapiens
tcagtgcccaactgtt

SEQ ID NO: 3436858 - DNA, 22 bp, Homo sapiens
tcagtgccccattctcactgct

SEQ ID NO: 3436859 - DNA, 22 bp, Homo sapiens
tcagtgctggagaaatcttgaa

SEQ ID NO: 3436860 - DNA, 22 bp, Homo sapiens
tcagtgctgtgctgtgctatgg

SEQ ID NO: 3436861 - DNA, 15 bp, Homo sapiens
tcagtggcagctgct

SEQ ID NO: 3436862 - DNA, 17 bp, Homo sapiens
tcagtggcgagaaataa

SEQ ID NO: 3436863 - DNA, 16 bp, Homo sapiens
tcagtgttacctgtgt

SEQ ID NO: 3436864 - DNA, 18 bp, Homo sapiens
tcagttagagctgacaca

SEQ ID NO: 3436865 - DNA, 20 bp, Homo sapiens
tcagttcaccgctaaggaaa

SEQ ID NO: 3436866 - DNA, 17 bp, Homo sapiens
tcagttctgccttatct

SEQ ID NO: 3436867 - DNA, 17 bp, Homo sapiens
tcagttgattttctgga

SEQ ID NO: 3436868 - DNA, 16 bp, Homo sapiens
tcagtttaatgcaaga

SEQ ID NO: 3436869 - DNA, 15 bp, Homo sapiens
tcagtttttgtgaaa

SEQ ID NO: 3436870 - DNA, 18 bp, Homo sapiens
tcagttttttgttttaca

SEQ ID NO: 3436871 - DNA, 14 bp, Homo sapiens
tcataacctagcct

SEQ ID NO: 3436872 - DNA, 16 bp, Homo sapiens
tcataacggatcagaa

SEQ ID NO: 3436873 - DNA, 21 bp, Homo sapiens
tcataacggatcagaaataca

SEQ ID NO: 3436874 - DNA, 22 bp, Homo sapiens
tcataacggatcagaaatacag

SEQ ID NO: 3436875 - DNA, 17 bp, Homo sapiens
tcataacttcctgtact

SEQ ID NO: 3436876 - DNA, 23 bp, Homo sapiens
tcataagttggaccagaggaagc

SEQ ID NO: 3436877 - DNA, 16 bp, Homo sapiens
tcataataagttgcat

SEQ ID NO: 3436878 - DNA, 12 bp, Homo sapiens
tcataatgaaaa

SEQ ID NO: 3436879 - DNA, 14 bp, Homo sapiens
tcataccatctgct

SEQ ID NO: 3436880 - DNA, 17 bp, Homo sapiens
tcataccatctgctgcc

SEQ ID NO: 3436881 - DNA, 17 bp, Homo sapiens
tcatagaaattctttat

SEQ ID NO: 3436882 - DNA, 15 bp, Homo sapiens
tcatagatgtttcct

SEQ ID NO: 3436883 - DNA, 14 bp, Homo sapiens
tcatagtaacttct

SEQ ID NO: 3436884 - DNA, 16 bp, Homo sapiens
tcatagtaacttctta

SEQ ID NO: 3436885 - DNA, 14 bp, Homo sapiens
tcatagtagttttt

SEQ ID NO: 3436886 - DNA, 16 bp, Homo sapiens
tcatagtagtttttac

SEQ ID NO: 3436887 - DNA, 18 bp, Homo sapiens
tcatagtatggtggctgg

SEQ ID NO: 3436888 - DNA, 19 bp, Homo sapiens
tcatagtatggtggctggg

SEQ ID NO: 3436889 - DNA, 14 bp, Homo sapiens
tcatatattgcatt

SEQ ID NO: 3436890 - DNA, 16 bp, Homo sapiens
tcatatgaaaggtgcc

SEQ ID NO: 3436891 - DNA, 21 bp, Homo sapiens
tcatatgaaaggtgccatgga

SEQ ID NO: 3436892 - DNA, 22 bp, Homo sapiens
tcatatggttgaataaataatt

SEQ ID NO: 3436893 - DNA, 20 bp, Homo sapiens
tcatatgtagccttcacaca

SEQ ID NO: 3436894 - DNA, 16 bp, Homo sapiens
tcatattctttcaatt

SEQ ID NO: 3436895 - DNA, 19 bp, Homo sapiens
tcatcaaatggaagacaca

SEQ ID NO: 3436896 - DNA, 13 bp, Homo sapiens
tcatcaagaaggg

SEQ ID NO: 3436897 - DNA, 19 bp, Homo sapiens
tcatcaagactggaaggtg

SEQ ID NO: 3436898 - DNA, 17 bp, Homo sapiens
tcatcaaggcactgcct

SEQ ID NO: 3436899 - DNA, 18 bp, Homo sapiens
tcatcaaggcactgcctg

SEQ ID NO: 3436900 - DNA, 14 bp, Homo sapiens
tcatcacactgggt

SEQ ID NO: 3436901 - DNA, 15 bp, Homo sapiens
tcatcagtggagcca

SEQ ID NO: 3436902 - DNA, 14 bp, Homo sapiens
tcatcattccctct

SEQ ID NO: 3436903 - DNA, 17 bp, Homo sapiens
tcatcattccttgagaa

SEQ ID NO: 3436904 - DNA, 13 bp, Homo sapiens
tcatcattctctg

SEQ ID NO: 3436905 - DNA, 19 bp, Homo sapiens
tcatccactagtgcaaatc

SEQ ID NO: 3436906 - DNA, 14 bp, Homo sapiens
tcatccagggctct

SEQ ID NO: 3436907 - DNA, 11 bp, Homo sapiens
tcatccatcat

SEQ ID NO: 3436908 - DNA, 15 bp, Homo sapiens
tcatccatcatcatg

SEQ ID NO: 3436909 - DNA, 17 bp, Homo sapiens
tcatccatcatcatgtg

SEQ ID NO: 3436910 - DNA, 18 bp, Homo sapiens
tcatcccattctgcgtca

SEQ ID NO: 3436911 - DNA, 14 bp, Homo sapiens
tcatcgccagaggt

SEQ ID NO: 3436912 - DNA, 17 bp, Homo sapiens
tcatctatggcagtcca

SEQ ID NO: 3436913 - DNA, 16 bp, Homo sapiens
tcatctcaggtagaag

SEQ ID NO: 3436914 - DNA, 20 bp, Homo sapiens
tcatctcattacccttttct

SEQ ID NO: 3436915 - DNA, 15 bp, Homo sapiens
tcatctcctgccttc

SEQ ID NO: 3436916 - DNA, 18 bp, Homo sapiens
tcatctcctgccttcctc

SEQ ID NO: 3436917 - DNA, 23 bp, Homo sapiens
tcatctcctgccttcctcctggg

SEQ ID NO: 3436918 - DNA, 14 bp, Homo sapiens
tcatctctctgccc

SEQ ID NO: 3436919 - DNA, 21 bp, Homo sapiens
tcatctctgcctgacaaggcc

SEQ ID NO: 3436920 - DNA, 22 bp, Homo sapiens
tcatctctgcctgacaaggcca

SEQ ID NO: 3436921 - DNA, 13 bp, Homo sapiens
tcatctcttagct

SEQ ID NO: 3436922 - DNA, 14 bp, Homo sapiens
tcatctcttagctc

SEQ ID NO: 3436923 - DNA, 21 bp, Homo sapiens
tcatctcttagctcccctcca

SEQ ID NO: 3436924 - DNA, 15 bp, Homo sapiens
tcatctctttagaga

SEQ ID NO: 3436925 - DNA, 16 bp, Homo sapiens
tcatctctttagagaa

SEQ ID NO: 3436926 - DNA, 13 bp, Homo sapiens
tcatctgccgtgc

SEQ ID NO: 3436927 - DNA, 12 bp, Homo sapiens
tcatctgctctc

SEQ ID NO: 3436928 - DNA, 14 bp, Homo sapiens
tcatctgctctcct

SEQ ID NO: 3436929 - DNA, 15 bp, Homo sapiens
tcatctgctctcctt

SEQ ID NO: 3436930 - DNA, 16 bp, Homo sapiens
tcatctgctctccttc

SEQ ID NO: 3436931 - DNA, 14 bp, Homo sapiens
tcatctgctggtcc

SEQ ID NO: 3436932 - DNA, 23 bp, Homo sapiens
tcatctggttgaactctggtggc

SEQ ID NO: 3436933 - DNA, 19 bp, Homo sapiens
tcatctgttagggccttgg

SEQ ID NO: 3436934 - DNA, 19 bp, Homo sapiens
tcatcttcctgtgtcctga

SEQ ID NO: 3436935 - DNA, 21 bp, Homo sapiens
tcatcttgaccaagcaggaag

SEQ ID NO: 3436936 - DNA, 22 bp, Homo sapiens
tcatcttgaccaagcaggaagc

SEQ ID NO: 3436937 - DNA, 14 bp, Homo sapiens
tcatgaaatatgca

SEQ ID NO: 3436938 - DNA, 16 bp, Homo sapiens
tcatgaatctgcaatg

SEQ ID NO: 3436939 - DNA, 17 bp, Homo sapiens
tcatgaccattagaata

SEQ ID NO: 3436940 - DNA, 19 bp, Homo sapiens
tcatgagcctgctggaagc

SEQ ID NO: 3436941 - DNA, 15 bp, Homo sapiens
tcatgagttctgctg

SEQ ID NO: 3436942 - DNA, 19 bp, Homo sapiens
tcatgccaccatggccagc

SEQ ID NO: 3436943 - DNA, 14 bp, Homo sapiens
tcatgccctcctct

SEQ ID NO: 3436944 - DNA, 15 bp, Homo sapiens
tcatgccctcctctc

SEQ ID NO: 3436945 - DNA, 22 bp, Homo sapiens
tcatgctggaacctgcaaaaaa

SEQ ID NO: 3436946 - DNA, 18 bp, Homo sapiens
tcatgcttgtgttataac

SEQ ID NO: 3436947 - DNA, 22 bp, Homo sapiens
tcatggattacttctctataaa

SEQ ID NO: 3436948 - DNA, 15 bp, Homo sapiens
tcatggccctgtagt

SEQ ID NO: 3436949 - DNA, 13 bp, Homo sapiens
tcatgtaaactgt

SEQ ID NO: 3436950 - DNA, 23 bp, Homo sapiens
tcctggatgggcctttgagcctg

SEQ ID NO: 3436951 - DNA, 16 bp, Homo sapiens
tcctggcacccggccc

SEQ ID NO: 3436952 - DNA, 20 bp, Homo sapiens
tcctggcacccggcccctgc

SEQ ID NO: 3436953 - DNA, 13 bp, Homo sapiens
tcctggcactgga

SEQ ID NO: 3436954 - DNA, 18 bp, Homo sapiens
tcctggcactggacccca

SEQ ID NO: 3436955 - DNA, 21 bp, Homo sapiens
tcctggcactggaccccagca

SEQ ID NO: 3436956 - DNA, 14 bp, Homo sapiens
tcctggccatccca

SEQ ID NO: 3436957 - DNA, 15 bp, Homo sapiens
tcctggccatcccac

SEQ ID NO: 3436958 - DNA, 17 bp, Homo sapiens
tcctggcctgagagtca

SEQ ID NO: 3436959 - DNA, 14 bp, Homo sapiens
tcctggcttcaggc

SEQ ID NO: 3436960 - DNA, 16 bp, Homo sapiens
tcctgggaaatattcc

SEQ ID NO: 3436961 - DNA, 21 bp, Homo sapiens
tcctgggaaatattccctaga

SEQ ID NO: 3436962 - DNA, 12 bp, Homo sapiens
tcctgggagtga

SEQ ID NO: 3436963 - DNA, 14 bp, Homo sapiens
tcctgggcagcttg

SEQ ID NO: 3436964 - DNA, 15 bp, Homo sapiens
tcctgggcctgcaga

SEQ ID NO: 3436965 - DNA, 15 bp, Homo sapiens
tcctgggtggtctgc

SEQ ID NO: 3436966 - DNA, 22 bp, Homo sapiens
tcctggtttcataacttcctgt

SEQ ID NO: 3436967 - DNA, 16 bp, Homo sapiens
tcctgtattcagacag

SEQ ID NO: 3436968 - DNA, 21 bp, Homo sapiens
tcctgtattcagacagatgag

SEQ ID NO: 3436969 - DNA, 16 bp, Homo sapiens
tcctgtccagctccaa

SEQ ID NO: 3436970 - DNA, 17 bp, Homo sapiens
tcctgtcctccctcacc

SEQ ID NO: 3436971 - DNA, 15 bp, Homo sapiens
tcctgtccttcacct

SEQ ID NO: 3436972 - DNA, 15 bp, Homo sapiens
tcctgtctctggcct

SEQ ID NO: 3436973 - DNA, 18 bp, Homo sapiens
tcctgtgaggagccccat

SEQ ID NO: 3436974 - DNA, 19 bp, Homo sapiens
tcctgtgcctccatcagct

SEQ ID NO: 3436975 - DNA, 12 bp, Homo sapiens
tcctgtgtcctg

SEQ ID NO: 3436976 - DNA, 23 bp, Homo sapiens
tcctgtgtcttgcaatggcagcc

SEQ ID NO: 3436977 - DNA, 22 bp, Homo sapiens
tcctgtgtgtccaaaactgcct

SEQ ID NO: 3436978 - DNA, 13 bp, Homo sapiens
tcctgtgtgtgcg

SEQ ID NO: 3436979 - DNA, 19 bp, Homo sapiens
tcctgtgtttctagggaaa

SEQ ID NO: 3436980 - DNA, 20 bp, Homo sapiens
tcctgttaacgtcatctcag

SEQ ID NO: 3436981 - DNA, 15 bp, Homo sapiens
tccttagaacatttt

SEQ ID NO: 3436982 - DNA, 18 bp, Homo sapiens
tccttaggttgtagcaga

SEQ ID NO: 3436983 - DNA, 23 bp, Homo sapiens
tccttcaattccatatatccttt

SEQ ID NO: 3436984 - DNA, 14 bp, Homo sapiens
tccttcacatcctg

SEQ ID NO: 3436985 - DNA, 14 bp, Homo sapiens
tccttcaccacccc

SEQ ID NO: 3436986 - DNA, 16 bp, Homo sapiens
tccttcaccaccccca

SEQ ID NO: 3436987 - DNA, 14 bp, Homo sapiens
tccttcagccctca

SEQ ID NO: 3436988 - DNA, 19 bp, Homo sapiens
tccttcagccctcacccct

SEQ ID NO: 3436989 - DNA, 21 bp, Homo sapiens
tccttccaacaggagctggga

SEQ ID NO: 3436990 - DNA, 12 bp, Homo sapiens
tccttccacctc

SEQ ID NO: 3436991 - DNA, 18 bp, Homo sapiens
tccttcccaatcttcttt

SEQ ID NO: 3436992 - DNA, 18 bp, Homo sapiens
tccttccctgtgtctttt

SEQ ID NO: 3436993 - DNA, 20 bp, Homo sapiens
tccttcctggagcccagagg

SEQ ID NO: 3436994 - DNA, 13 bp, Homo sapiens
tccttcctggcct

SEQ ID NO: 3436995 - DNA, 19 bp, Homo sapiens
tccttcctgttctgaactg

SEQ ID NO: 3436996 - DNA, 23 bp, Homo sapiens
tccttccttgttacccatgaaaa

SEQ ID NO: 3436997 - DNA, 16 bp, Homo sapiens
tccttcgaaaggcctt

SEQ ID NO: 3436998 - DNA, 18 bp, Homo sapiens
tccttcgaaaggccttca

SEQ ID NO: 3436999 - DNA, 21 bp, Homo sapiens
tccttcgaaaggccttcagac

SEQ ID NO: 3437000 - DNA, 14 bp, Homo sapiens
tccttctcccatct

SEQ ID NO: 3437001 - DNA, 17 bp, Homo sapiens
tccttgagacacggagc

SEQ ID NO: 3437002 - DNA, 16 bp, Homo sapiens
tccttgagagaccagg

SEQ ID NO: 3437003 - DNA, 16 bp, Homo sapiens
tccttgatctgtatat

SEQ ID NO: 3437004 - DNA, 18 bp, Homo sapiens
tccttggaggacagtggg

SEQ ID NO: 3437005 - DNA, 22 bp, Homo sapiens
tccttgggaggccccactgggg

SEQ ID NO: 3437006 - DNA, 16 bp, Homo sapiens
tccttggggcaggcag

SEQ ID NO: 3437007 - DNA, 20 bp, Homo sapiens
tccttgtagcgactaaacta

SEQ ID NO: 3437008 - DNA, 20 bp, Homo sapiens
tcctttagggttctgcctct

SEQ ID NO: 3437009 - DNA, 23 bp, Homo sapiens
tcctttagtaaaactccgagtga

SEQ ID NO: 3437010 - DNA, 18 bp, Homo sapiens
tcctttattattctgtat

SEQ ID NO: 3437011 - DNA, 18 bp, Homo sapiens
tcctttcaccccagggcc

SEQ ID NO: 3437012 - DNA, 19 bp, Homo sapiens
tcctttcaccccagggcct

SEQ ID NO: 3437013 - DNA, 22 bp, Homo sapiens
tcctttctcctttgctttttct

SEQ ID NO: 3437014 - DNA, 22 bp, Homo sapiens
tcctttgaagatagtaactgta

SEQ ID NO: 3437015 - DNA, 17 bp, Homo sapiens
tcctttgcgcctgtgac

SEQ ID NO: 3437016 - DNA, 15 bp, Homo sapiens
tcctttgtgaatatt

SEQ ID NO: 3437017 - DNA, 18 bp, Homo sapiens
tcctttgtgtgtgtgtca

SEQ ID NO: 3437018 - DNA, 22 bp, Homo sapiens
tcctttgtgtgtgtgtcagctg

SEQ ID NO: 3437019 - DNA, 16 bp, Homo sapiens
tccttttcttctatgt

SEQ ID NO: 3437020 - DNA, 13 bp, Homo sapiens
tccttttgtaaag

SEQ ID NO: 3437021 - DNA, 20 bp, Homo sapiens
tccttttgtaaagtgaagaa

SEQ ID NO: 3437022 - DNA, 11 bp, Homo sapiens
tccttttgtag

SEQ ID NO: 3437023 - DNA, 17 bp, Homo sapiens
tccttttgtagaatgaa

SEQ ID NO: 3437024 - DNA, 12 bp, Homo sapiens
tcctttttaagg

SEQ ID NO: 3437025 - DNA, 16 bp, Homo sapiens
tcctttttggttttta

SEQ ID NO: 3437026 - DNA, 14 bp, Homo sapiens
tcctttttgttatt

SEQ ID NO: 3437027 - DNA, 22 bp, Homo sapiens
tccttttttgttcctttttcct

SEQ ID NO: 3437028 - DNA, 13 bp, Homo sapiens
tcgaaacacagaa

SEQ ID NO: 3437029 - DNA, 12 bp, Homo sapiens
tcgaaaggcctt

SEQ ID NO: 3437030 - DNA, 13 bp, Homo sapiens
tcgaactggctgc

SEQ ID NO: 3437031 - DNA, 14 bp, Homo sapiens
tcgaactggctgca

SEQ ID NO: 3437032 - DNA, 15 bp, Homo sapiens
tcgaactggctgcaa

SEQ ID NO: 3437033 - DNA, 14 bp, Homo sapiens
tcgaatctctgtgc

SEQ ID NO: 3437034 - DNA, 22 bp, Homo sapiens
tcgaatctctgtgccttcgtct

SEQ ID NO: 3437035 - DNA, 21 bp, Homo sapiens
tcgaccccaaaggaacactga

SEQ ID NO: 3437036 - DNA, 14 bp, Homo sapiens
tcgagaactttcat

SEQ ID NO: 3437037 - DNA, 18 bp, Homo sapiens
tcgagaccagcctggcca

SEQ ID NO: 3437038 - DNA, 14 bp, Homo sapiens
tcgagagctggcca

SEQ ID NO: 3437039 - DNA, 15 bp, Homo sapiens
tcgagagctggccaa

SEQ ID NO: 3437040 - DNA, 22 bp, Homo sapiens
tcgagcagtcctgcctcagcct

SEQ ID NO: 3437041 - DNA, 10 bp, Homo sapiens
tcgaggcctg

SEQ ID NO: 3437042 - DNA, 11 bp, Homo sapiens
tcgaggcctga

SEQ ID NO: 3437043 - DNA, 12 bp, Homo sapiens
tcgaggcctgaa

SEQ ID NO: 3437044 - DNA, 15 bp, Homo sapiens
tcgaggcctgaagcc

SEQ ID NO: 3437045 - DNA, 15 bp, Homo sapiens
tcgaggtcagaggag

SEQ ID NO: 3437046 - DNA, 14 bp, Homo sapiens
tcgagtactgtggg

SEQ ID NO: 3437047 - DNA, 17 bp, Homo sapiens
tcgagtcacattctgct

SEQ ID NO: 3437048 - DNA, 18 bp, Homo sapiens
tcgagtcacattctgctt

SEQ ID NO: 3437049 - DNA, 14 bp, Homo sapiens
tcgatactgcgact

SEQ ID NO: 3437050 - DNA, 22 bp, Homo sapiens
tcgatactgcgactttctgcct

SEQ ID NO: 3437051 - DNA, 23 bp, Homo sapiens
tcgatactgcgactttctgcctg

SEQ ID NO: 3437052 - DNA, 15 bp, Homo sapiens
tcgatttctccagga

SEQ ID NO: 3437053 - DNA, 17 bp, Homo sapiens
tcgattttgtatctgca

SEQ ID NO: 3437054 - DNA, 17 bp, Homo sapiens
tcgcagagcttttcaga

SEQ ID NO: 3437055 - DNA, 13 bp, Homo sapiens
tcgcagcctgagt

SEQ ID NO: 3437056 - DNA, 20 bp, Homo sapiens
tcgcatggtcacacactgat

SEQ ID NO: 3437057 - DNA, 21 bp, Homo sapiens
tcgccaaactgtctctgcctc

SEQ ID NO: 3437058 - DNA, 14 bp, Homo sapiens
tcgccaaggcctag

SEQ ID NO: 3437059 - DNA, 20 bp, Homo sapiens
tcgccacccccccaccccag

SEQ ID NO: 3437060 - DNA, 14 bp, Homo sapiens
tcgcccagtctgga

SEQ ID NO: 3437061 - DNA, 13 bp, Homo sapiens
tcgccctcccagg

SEQ ID NO: 3437062 - DNA, 20 bp, Homo sapiens
tcgcccttacttcttgccct

SEQ ID NO: 3437063 - DNA, 22 bp, Homo sapiens
tcgccttagcactaccactcct

SEQ ID NO: 3437064 - DNA, 12 bp, Homo sapiens
tcgcctttcctc

SEQ ID NO: 3437065 - DNA, 18 bp, Homo sapiens
tcgcggcggagctggccc

SEQ ID NO: 3437066 - DNA, 19 bp, Homo sapiens
tcgcggcggagctggcccc

SEQ ID NO: 3437067 - DNA, 20 bp, Homo sapiens
tcgcggcggagctggccccg

SEQ ID NO: 3437068 - DNA, 14 bp, Homo sapiens
tcgctccctcccag

SEQ ID NO: 3437069 - DNA, 13 bp, Homo sapiens
tcgctcctgtgtc

SEQ ID NO: 3437070 - DNA, 19 bp, Homo sapiens
tcgctgatatatgtgtttt

SEQ ID NO: 3437071 - DNA, 12 bp, Homo sapiens
tcgctgttgctg

SEQ ID NO: 3437072 - DNA, 14 bp, Homo sapiens
tcgctgttgctgaa

SEQ ID NO: 3437073 - DNA, 17 bp, Homo sapiens
tcgctgttgctgaatag

SEQ ID NO: 3437074 - DNA, 19 bp, Homo sapiens
tcggaacccaagcttagaa

SEQ ID NO: 3437075 - DNA, 22 bp, Homo sapiens
tcggaactgcatgctgctggac

SEQ ID NO: 3437076 - DNA, 19 bp, Homo sapiens
tcggaactgtcctttcctt

SEQ ID NO: 3437077 - DNA, 14 bp, Homo sapiens
tcggcctttgggtg

SEQ ID NO: 3437078 - DNA, 14 bp, Homo sapiens
tcggctcagctcgg

SEQ ID NO: 3437079 - DNA, 22 bp, Homo sapiens
tcgggagaggggacgcaggccc

SEQ ID NO: 3437080 - DNA, 23 bp, Homo sapiens
tcgggagaggggacgcaggcccc

SEQ ID NO: 3437081 - DNA, 17 bp, Homo sapiens
tcgggaggtcgaggcag

SEQ ID NO: 3437082 - DNA, 21 bp, Homo sapiens
tcgggaggtcgaggcaggagg

SEQ ID NO: 3437083 - DNA, 18 bp, Homo sapiens
tctgggagtcacacagtg

SEQ ID NO: 3437084 - DNA, 16 bp, Homo sapiens
tctgggagtcaggccc

SEQ ID NO: 3437085 - DNA, 19 bp, Homo sapiens
tctgggccaccaggatcag

SEQ ID NO: 3437086 - DNA, 20 bp, Homo sapiens
tctgggtttgaagctgctgt

SEQ ID NO: 3437087 - DNA, 15 bp, Homo sapiens
tctgggttttctgaa

SEQ ID NO: 3437088 - DNA, 17 bp, Homo sapiens
tctggtcgctcctgccc

SEQ ID NO: 3437089 - DNA, 16 bp, Homo sapiens
tctggtgataaggaca

SEQ ID NO: 3437090 - DNA, 17 bp, Homo sapiens
tctggtgataaggacat

SEQ ID NO: 3437091 - DNA, 14 bp, Homo sapiens
tctggttccagggt

SEQ ID NO: 3437092 - DNA, 23 bp, Homo sapiens
tctggttccagggtccctctgtg

SEQ ID NO: 3437093 - DNA, 15 bp, Homo sapiens
tctggttgaactctg

SEQ ID NO: 3437094 - DNA, 11 bp, Homo sapiens
tctgtaaaatc

SEQ ID NO: 3437095 - DNA, 17 bp, Homo sapiens
tctgtaaaatctttctt

SEQ ID NO: 3437096 - DNA, 20 bp, Homo sapiens
tctgtaagaaacctactgcc

SEQ ID NO: 3437097 - DNA, 22 bp, Homo sapiens
tctgtaagaaacctactgccca

SEQ ID NO: 3437098 - DNA, 23 bp, Homo sapiens
tctgtacaaaggggaaagaacat

SEQ ID NO: 3437099 - DNA, 22 bp, Homo sapiens
tctgtacaaagtactagctaaa

SEQ ID NO: 3437100 - DNA, 13 bp, Homo sapiens
tctgtaccccatg

SEQ ID NO: 3437101 - DNA, 17 bp, Homo sapiens
tctgtacgtctgacagg

SEQ ID NO: 3437102 - DNA, 15 bp, Homo sapiens
tctgtatatacaata

SEQ ID NO: 3437103 - DNA, 21 bp, Homo sapiens
tctgtattttttgtttgtatt

SEQ ID NO: 3437104 - DNA, 22 bp, Homo sapiens
tctgtattttttgtttgtattg

SEQ ID NO: 3437105 - DNA, 12 bp, Homo sapiens
tctgtcactcag

SEQ ID NO: 3437106 - DNA, 19 bp, Homo sapiens
tctgtcagtcacagccacc

SEQ ID NO: 3437107 - DNA, 15 bp, Homo sapiens
tctgtcatttgagca

SEQ ID NO: 3437108 - DNA, 23 bp, Homo sapiens
tctgtcatttgagcagggctcag

SEQ ID NO: 3437109 - DNA, 17 bp, Homo sapiens
tctgtcccacttggcat

SEQ ID NO: 3437110 - DNA, 20 bp, Homo sapiens
tctgtccccttctctcatct

SEQ ID NO: 3437111 - DNA, 14 bp, Homo sapiens
tctgtccctcacag

SEQ ID NO: 3437112 - DNA, 15 bp, Homo sapiens
tctgtccctgttaga

SEQ ID NO: 3437113 - DNA, 20 bp, Homo sapiens
tctgtcccttctgtccctca

SEQ ID NO: 3437114 - DNA, 14 bp, Homo sapiens
tctgtcccttgctg

SEQ ID NO: 3437115 - DNA, 15 bp, Homo sapiens
tctgtcccttgctgt

SEQ ID NO: 3437116 - DNA, 19 bp, Homo sapiens
tctgtccgagctttgaaaa

SEQ ID NO: 3437117 - DNA, 14 bp, Homo sapiens
tctgtcctcagcct

SEQ ID NO: 3437118 - DNA, 23 bp, Homo sapiens
tctgtcctcagccttgccagaga

SEQ ID NO: 3437119 - DNA, 13 bp, Homo sapiens
tctgtcctgtgac

SEQ ID NO: 3437120 - DNA, 16 bp, Homo sapiens
tctgtcgcccagtctg

SEQ ID NO: 3437121 - DNA, 21 bp, Homo sapiens
tctgtctactaagtgatgctg

SEQ ID NO: 3437122 - DNA, 15 bp, Homo sapiens
tctgtctccagcttc

SEQ ID NO: 3437123 - DNA, 17 bp, Homo sapiens
tctgtctccagcttccc

SEQ ID NO: 3437124 - DNA, 12 bp, Homo sapiens
tctgtctctctc

SEQ ID NO: 3437125 - DNA, 16 bp, Homo sapiens
tctgtctggtggcccc

SEQ ID NO: 3437126 - DNA, 15 bp, Homo sapiens
tctgtcttcacctga

SEQ ID NO: 3437127 - DNA, 15 bp, Homo sapiens
tctgtcttgccagcc

SEQ ID NO: 3437128 - DNA, 16 bp, Homo sapiens
tctgtgacacatcgtt

SEQ ID NO: 3437129 - DNA, 16 bp, Homo sapiens
tctgtgacctgcatct

SEQ ID NO: 3437130 - DNA, 21 bp, Homo sapiens
tctgtgcacgcagtggccttc

SEQ ID NO: 3437131 - DNA, 13 bp, Homo sapiens
tctgtgctcagga

SEQ ID NO: 3437132 - DNA, 12 bp, Homo sapiens
tctgtgctgtgt

SEQ ID NO: 3437133 - DNA, 16 bp, Homo sapiens
tctgtggagatgccca

SEQ ID NO: 3437134 - DNA, 18 bp, Homo sapiens
tctgtggatggtcattgc

SEQ ID NO: 3437135 - DNA, 23 bp, Homo sapiens
tctgtgggatgggatggtggagg

SEQ ID NO: 3437136 - DNA, 17 bp, Homo sapiens
tctgtgggtctctggaa

SEQ ID NO: 3437137 - DNA, 22 bp, Homo sapiens
tctgtgggtgatggggaggggc

SEQ ID NO: 3437138 - DNA, 13 bp, Homo sapiens
tctgtgtctgtgt

SEQ ID NO: 3437139 - DNA, 13 bp, Homo sapiens
tctgttcaccttc

SEQ ID NO: 3437140 - DNA, 16 bp, Homo sapiens
tctgttcagtgtaaat

SEQ ID NO: 3437141 - DNA, 13 bp, Homo sapiens
tctgttccccctt

SEQ ID NO: 3437142 - DNA, 18 bp, Homo sapiens
tctgttcccccttcacaa

SEQ ID NO: 3437143 - DNA, 15 bp, Homo sapiens
tctgttccttcacat

SEQ ID NO: 3437144 - DNA, 18 bp, Homo sapiens
tctgttgcaagcccctct

SEQ ID NO: 3437145 - DNA, 15 bp, Homo sapiens
tctgttggcaggctg

SEQ ID NO: 3437146 - DNA, 20 bp, Homo sapiens
tctgttggcaggctggccag

SEQ ID NO: 3437147 - DNA, 16 bp, Homo sapiens
tctgtttcctgacatt

SEQ ID NO: 3437148 - DNA, 19 bp, Homo sapiens
tctgtttggactgcagaag

SEQ ID NO: 3437149 - DNA, 13 bp, Homo sapiens
tcttaaaaatatt

SEQ ID NO: 3437150 - DNA, 20 bp, Homo sapiens
tcttaaaaatgttttttcat

SEQ ID NO: 3437151 - DNA, 15 bp, Homo sapiens
tcttaacaaactctt

SEQ ID NO: 3437152 - DNA, 15 bp, Homo sapiens
tcttaatgaagtttg

SEQ ID NO: 3437153 - DNA, 17 bp, Homo sapiens
tcttaatgaagtttgaa

SEQ ID NO: 3437154 - DNA, 18 bp, Homo sapiens
tcttaatgaagtttgaat

SEQ ID NO: 3437155 - DNA, 19 bp, Homo sapiens
tcttaatgaagtttgaatg

SEQ ID NO: 3437156 - DNA, 21 bp, Homo sapiens
tcttaatgaagtttgaatgtt

SEQ ID NO: 3437157 - DNA, 15 bp, Homo sapiens
tcttacatgtataaa

SEQ ID NO: 3437158 - DNA, 13 bp, Homo sapiens
tcttactctttcc

SEQ ID NO: 3437159 - DNA, 16 bp, Homo sapiens
tcttactctttcctat

SEQ ID NO: 3437160 - DNA, 23 bp, Homo sapiens
tcttactgaaggtaaaattgaaa

SEQ ID NO: 3437161 - DNA, 15 bp, Homo sapiens
tcttagaaatttatt

SEQ ID NO: 3437162 - DNA, 22 bp, Homo sapiens
tcttagatggattctccactca

SEQ ID NO: 3437163 - DNA, 13 bp, Homo sapiens
tcttagctcccct

SEQ ID NO: 3437164 - DNA, 16 bp, Homo sapiens
tcttagctcccctcca

SEQ ID NO: 3437165 - DNA, 17 bp, Homo sapiens
tcttagctcccctccaa

SEQ ID NO: 3437166 - DNA, 20 bp, Homo sapiens
tcttatacgcttttctttgt

SEQ ID NO: 3437167 - DNA, 20 bp, Homo sapiens
tcttatagaatatttattac

SEQ ID NO: 3437168 - DNA, 20 bp, Homo sapiens
tcttatcatggtctcagtca

SEQ ID NO: 3437169 - DNA, 18 bp, Homo sapiens
tcttatggaattgatttg

SEQ ID NO: 3437170 - DNA, 21 bp, Homo sapiens
tcttatggaattgatttgcat

SEQ ID NO: 3437171 - DNA, 22 bp, Homo sapiens
tcttattcccccctaagcttct

SEQ ID NO: 3437172 - DNA, 22 bp, Homo sapiens
tcttattgcccacgctggagtg

SEQ ID NO: 3437173 - DNA, 17 bp, Homo sapiens
tcttattgcgctgctac

SEQ ID NO: 3437174 - DNA, 17 bp, Homo sapiens
tcttcaaggcttcagtc

SEQ ID NO: 3437175 - DNA, 13 bp, Homo sapiens
tcttcacaaaatc

SEQ ID NO: 3437176 - DNA, 23 bp, Homo sapiens
tcttcacccaggcctatgttgat

SEQ ID NO: 3437177 - DNA, 18 bp, Homo sapiens
tcttcacctcttccactc

SEQ ID NO: 3437178 - DNA, 23 bp, Homo sapiens
tcttcagaaagtgtgctttatgc

SEQ ID NO: 3437179 - DNA, 15 bp, Homo sapiens
tcttcagaggccctc

SEQ ID NO: 3437180 - DNA, 15 bp, Homo sapiens
tcttcagggcctggt

SEQ ID NO: 3437181 - DNA, 22 bp, Homo sapiens
tcttcagggcctggttgaagaa

SEQ ID NO: 3437182 - DNA, 15 bp, Homo sapiens
tcttcagtaagccgt

SEQ ID NO: 3437183 - DNA, 16 bp, Homo sapiens
tcttcagtaagccgtg

SEQ ID NO: 3437184 - DNA, 19 bp, Homo sapiens
tcttcagttaattcttaga

SEQ ID NO: 3437185 - DNA, 14 bp, Homo sapiens
tcttcagtttaatg

SEQ ID NO: 3437186 - DNA, 21 bp, Homo sapiens
tcttcatattctaaaaccatt

SEQ ID NO: 3437187 - DNA, 15 bp, Homo sapiens
tcttccaggtgccca

SEQ ID NO: 3437188 - DNA, 23 bp, Homo sapiens
tcttcccagcactatgctttcct

SEQ ID NO: 3437189 - DNA, 22 bp, Homo sapiens
tcttccctacagttgaaaaaca

SEQ ID NO: 3437190 - DNA, 17 bp, Homo sapiens
tcttcctccgaggccag

SEQ ID NO: 3437191 - DNA, 18 bp, Homo sapiens
tcttcctccgaggccagt

SEQ ID NO: 3437192 - DNA, 15 bp, Homo sapiens
tcttcctctgcaagt

SEQ ID NO: 3437193 - DNA, 22 bp, Homo sapiens
tcttcctctgcaagtgctcagg

SEQ ID NO: 3437194 - DNA, 15 bp, Homo sapiens
tcttcctgtgtcctg

SEQ ID NO: 3437195 - DNA, 23 bp, Homo sapiens
tcttccttgaagaactgcaggcc

SEQ ID NO: 3437196 - DNA, 14 bp, Homo sapiens
tcttcgggaccagg

SEQ ID NO: 3437197 - DNA, 13 bp, Homo sapiens
tcttctaaacttc

SEQ ID NO: 3437198 - DNA, 12 bp, Homo sapiens
tcttctaaatgg

SEQ ID NO: 3437199 - DNA, 15 bp, Homo sapiens
tcttctcaaaagaac

SEQ ID NO: 3437200 - DNA, 17 bp, Homo sapiens
tcttctcaaacctccaa

SEQ ID NO: 3437201 - DNA, 17 bp, Homo sapiens
tcttctcaaagctggga

SEQ ID NO: 3437202 - DNA, 15 bp, Homo sapiens
tcttctcatttcacc

SEQ ID NO: 3437203 - DNA, 14 bp, Homo sapiens
tcttctccaggctg

SEQ ID NO: 3437204 - DNA, 15 bp, Homo sapiens
tcttctccaggctgt

SEQ ID NO: 3437205 - DNA, 16 bp, Homo sapiens
tcttctcctatgtgta

SEQ ID NO: 3437206 - DNA, 15 bp, Homo sapiens
tcttctccttggagg

SEQ ID NO: 3437207 - DNA, 12 bp, Homo sapiens
tcttctgagcta

SEQ ID NO: 3437208 - DNA, 18 bp, Homo sapiens
tcttctgccggccctggg

SEQ ID NO: 3437209 - DNA, 12 bp, Homo sapiens
tcttctgcttca

SEQ ID NO: 3437210 - DNA, 19 bp, Homo sapiens
tcttctgcttcagcctccc

SEQ ID NO: 3437211 - DNA, 18 bp, Homo sapiens
tcttctggactggttttc

SEQ ID NO: 3437212 - DNA, 10 bp, Homo sapiens
tcttctggag

SEQ ID NO: 3437213 - DNA, 17 bp, Homo sapiens
tcttctggagatggaag

SEQ ID NO: 3437214 - DNA, 22 bp, Homo sapiens
tcttctggagatggaagcttgt

SEQ ID NO: 3437215 - DNA, 23 bp, Homo sapiens
tcttctgtacgtctgacaggcaa

SEQ ID NO: 3437216 - DNA, 20 bp, Homo sapiens
tgcaaagtcatgcaaaggct

SEQ ID NO: 3437217 - DNA, 22 bp, Homo sapiens
tgcaaagtcatgcaaaggctgg

SEQ ID NO: 3437218 - DNA, 21 bp, Homo sapiens
tgcaaagtgttttgtaccagt

SEQ ID NO: 3437219 - DNA, 12 bp, Homo sapiens
tgcaaatcctat

SEQ ID NO: 3437220 - DNA, 15 bp, Homo sapiens
tgcaaatcctatgtg

SEQ ID NO: 3437221 - DNA, 17 bp, Homo sapiens
tgcaaatcctatgtgat

SEQ ID NO: 3437222 - DNA, 19 bp, Homo sapiens
tgcaaatcctatgtgattt

SEQ ID NO: 3437223 - DNA, 15 bp, Homo sapiens
tgcaaatgctgtatt

SEQ ID NO: 3437224 - DNA, 14 bp, Homo sapiens
tgcaacaaaatgta

SEQ ID NO: 3437225 - DNA, 14 bp, Homo sapiens
tgcaacaggctggg

SEQ ID NO: 3437226 - DNA, 15 bp, Homo sapiens
tgcaacaggctgggc

SEQ ID NO: 3437227 - DNA, 16 bp, Homo sapiens
tgcaacaggctgggct

SEQ ID NO: 3437228 - DNA, 20 bp, Homo sapiens
tgcaacctccgcctcttggg

SEQ ID NO: 3437229 - DNA, 22 bp, Homo sapiens
tgcaacctcgctggactctcag

SEQ ID NO: 3437230 - DNA, 21 bp, Homo sapiens
tgcaacctctgtctcccgggt

SEQ ID NO: 3437231 - DNA, 21 bp, Homo sapiens
tgcaactgctcagctctggtc

SEQ ID NO: 3437232 - DNA, 21 bp, Homo sapiens
tgcaacttctttttattttct

SEQ ID NO: 3437233 - DNA, 14 bp, Homo sapiens
tgcaacttggactt

SEQ ID NO: 3437234 - DNA, 22 bp, Homo sapiens
tgcaagaccccaagaggaagtt

SEQ ID NO: 3437235 - DNA, 20 bp, Homo sapiens
tgcaagagaacattttactg

SEQ ID NO: 3437236 - DNA, 17 bp, Homo sapiens
tgcaagatacaggaaaa

SEQ ID NO: 3437237 - DNA, 23 bp, Homo sapiens
tgcaagcccctgctccagaagat

SEQ ID NO: 3437238 - DNA, 20 bp, Homo sapiens
tgcaagggagttagggaaat

SEQ ID NO: 3437239 - DNA, 23 bp, Homo sapiens
tgcaaggtttaggctggtggccc

SEQ ID NO: 3437240 - DNA, 17 bp, Homo sapiens
tgcaagtatactaggga

SEQ ID NO: 3437241 - DNA, 16 bp, Homo sapiens
tgcaagtccttttgta

SEQ ID NO: 3437242 - DNA, 17 bp, Homo sapiens
tgcaagtccttttgtaa

SEQ ID NO: 3437243 - DNA, 19 bp, Homo sapiens
tgcaagtccttttgtaaag

SEQ ID NO: 3437244 - DNA, 14 bp, Homo sapiens
tgcaagtgctcagg

SEQ ID NO: 3437245 - DNA, 23 bp, Homo sapiens
tgcaataaatctgacccagtgcc

SEQ ID NO: 3437246 - DNA, 12 bp, Homo sapiens
tgcaataatgca

SEQ ID NO: 3437247 - DNA, 20 bp, Homo sapiens
tgcacaagatgccccaggga

SEQ ID NO: 3437248 - DNA, 21 bp, Homo sapiens
tgcacaagctgcaccctcagg

SEQ ID NO: 3437249 - DNA, 14 bp, Homo sapiens
tgcacagaagcaca

SEQ ID NO: 3437250 - DNA, 16 bp, Homo sapiens
tgcacagaagtcctgt

SEQ ID NO: 3437251 - DNA, 21 bp, Homo sapiens
tgcacagaagtcctgtatgtc

SEQ ID NO: 3437252 - DNA, 17 bp, Homo sapiens
tgcacagcttttccaaa

SEQ ID NO: 3437253 - DNA, 19 bp, Homo sapiens
tgcacagcttttccaaaat

SEQ ID NO: 3437254 - DNA, 16 bp, Homo sapiens
tgcacatctgtgtctt

SEQ ID NO: 3437255 - DNA, 12 bp, Homo sapiens
tgcacatgtctt

SEQ ID NO: 3437256 - DNA, 22 bp, Homo sapiens
tgcacatgttggaggagagagc

SEQ ID NO: 3437257 - DNA, 14 bp, Homo sapiens
tgcacatgtttcct

SEQ ID NO: 3437258 - DNA, 12 bp, Homo sapiens
tgcacattgttc

SEQ ID NO: 3437259 - DNA, 18 bp, Homo sapiens
tgcaccaccaagccaagg

SEQ ID NO: 3437260 - DNA, 21 bp, Homo sapiens
tgcaccactgcactccagcct

SEQ ID NO: 3437261 - DNA, 22 bp, Homo sapiens
tgcaccagttttatccataatg

SEQ ID NO: 3437262 - DNA, 18 bp, Homo sapiens
tgcacccacccaggagtg

SEQ ID NO: 3437263 - DNA, 14 bp, Homo sapiens
tgcacccctcccca

SEQ ID NO: 3437264 - DNA, 18 bp, Homo sapiens
tgcacccctccccattca

SEQ ID NO: 3437265 - DNA, 15 bp, Homo sapiens
tgcaccgggccacag

SEQ ID NO: 3437266 - DNA, 22 bp, Homo sapiens
tgcaccgggccacagagaaagt

SEQ ID NO: 3437267 - DNA, 15 bp, Homo sapiens
tgcacggctgctgag

SEQ ID NO: 3437268 - DNA, 14 bp, Homo sapiens
tgcacgtgtgtgca

SEQ ID NO: 3437269 - DNA, 15 bp, Homo sapiens
tgcactaaggggccc

SEQ ID NO: 3437270 - DNA, 15 bp, Homo sapiens
tgcactatctttcag

SEQ ID NO: 3437271 - DNA, 16 bp, Homo sapiens
tgcactatctttcagc

SEQ ID NO: 3437272 - DNA, 14 bp, Homo sapiens
tgcactccagcctg

SEQ ID NO: 3437273 - DNA, 19 bp, Homo sapiens
tgcactccagcctgggtga

SEQ ID NO: 3437274 - DNA, 14 bp, Homo sapiens
tgcactgatgctgc

SEQ ID NO: 3437275 - DNA, 17 bp, Homo sapiens
tgcactgatgctgcccc

SEQ ID NO: 3437276 - DNA, 21 bp, Homo sapiens
tgcactgatgctgcccctcat

SEQ ID NO: 3437277 - DNA, 19 bp, Homo sapiens
tgcactgcccatggacagg

SEQ ID NO: 3437278 - DNA, 21 bp, Homo sapiens
tgcactgcccatggacaggct

SEQ ID NO: 3437279 - DNA, 21 bp, Homo sapiens
tgcactgtaagacgtatgtaa

SEQ ID NO: 3437280 - DNA, 22 bp, Homo sapiens
tgcactgtgtgctgactgaaca

SEQ ID NO: 3437281 - DNA, 14 bp, Homo sapiens
tgcactgttccccc

SEQ ID NO: 3437282 - DNA, 18 bp, Homo sapiens
tgcacttatgatttcatg

SEQ ID NO: 3437283 - DNA, 16 bp, Homo sapiens
tgcacttgcagactct

SEQ ID NO: 3437284 - DNA, 17 bp, Homo sapiens
tgcacttgtgattattt

SEQ ID NO: 3437285 - DNA, 12 bp, Homo sapiens
tgcactttgtaa

SEQ ID NO: 3437286 - DNA, 14 bp, Homo sapiens
tgcagaactaaact

SEQ ID NO: 3437287 - DNA, 15 bp, Homo sapiens
tgcagaaggaaaaat

SEQ ID NO: 3437288 - DNA, 13 bp, Homo sapiens
tgcagaagtaagc

SEQ ID NO: 3437289 - DNA, 16 bp, Homo sapiens
tgcagacaggaatctt

SEQ ID NO: 3437290 - DNA, 18 bp, Homo sapiens
tgcagacaggaatcttaa

SEQ ID NO: 3437291 - DNA, 20 bp, Homo sapiens
tgcagacaggaatcttaagg

SEQ ID NO: 3437292 - DNA, 13 bp, Homo sapiens
tgcagacaggcaa

SEQ ID NO: 3437293 - DNA, 22 bp, Homo sapiens
tgcagacaggcaagcacctcct

SEQ ID NO: 3437294 - DNA, 18 bp, Homo sapiens
tgcagactctacagaggc

SEQ ID NO: 3437295 - DNA, 13 bp, Homo sapiens
tgcagagcagatg

SEQ ID NO: 3437296 - DNA, 16 bp, Homo sapiens
tgcagaggtctccaaa

SEQ ID NO: 3437297 - DNA, 17 bp, Homo sapiens
tgcagatttgggctgga

SEQ ID NO: 3437298 - DNA, 23 bp, Homo sapiens
tgcagcaggaatatatgtgtgcc

SEQ ID NO: 3437299 - DNA, 14 bp, Homo sapiens
tgcagcagggatgc

SEQ ID NO: 3437300 - DNA, 21 bp, Homo sapiens
tgcagccaagtagcctctcct

SEQ ID NO: 3437301 - DNA, 21 bp, Homo sapiens
tgcagcctcaacctcctgggc

SEQ ID NO: 3437302 - DNA, 22 bp, Homo sapiens
tgcagcctcaacctcctgggct

SEQ ID NO: 3437303 - DNA, 21 bp, Homo sapiens
tgcagctcaaggaaaggcctg

SEQ ID NO: 3437304 - DNA, 14 bp, Homo sapiens
tgcagctccctggc

SEQ ID NO: 3437305 - DNA, 18 bp, Homo sapiens
tgcagctccctggcttct

SEQ ID NO: 3437306 - DNA, 19 bp, Homo sapiens
tgcagctccctggcttctg

SEQ ID NO: 3437307 - DNA, 19 bp, Homo sapiens
tgcaggaatctttaaaaga

SEQ ID NO: 3437308 - DNA, 16 bp, Homo sapiens
tgcaggacctcaggtg

SEQ ID NO: 3437309 - DNA, 13 bp, Homo sapiens
tgcaggacttgag

SEQ ID NO: 3437310 - DNA, 19 bp, Homo sapiens
tgcaggatttgttctctgt

SEQ ID NO: 3437311 - DNA, 16 bp, Homo sapiens
tgcaggccctggcctc

SEQ ID NO: 3437312 - DNA, 17 bp, Homo sapiens
tgcaggccctggcctcc

SEQ ID NO: 3437313 - DNA, 19 bp, Homo sapiens
tgcaggccctggcctcccc

SEQ ID NO: 3437314 - DNA, 20 bp, Homo sapiens
tgcaggccctggcctcccct

SEQ ID NO: 3437315 - DNA, 22 bp, Homo sapiens
tgcagggaaaattatttgcata

SEQ ID NO: 3437316 - DNA, 20 bp, Homo sapiens
tgcagggagggcagttttct

SEQ ID NO: 3437317 - DNA, 13 bp, Homo sapiens
tgcaggggtctgg

SEQ ID NO: 3437318 - DNA, 15 bp, Homo sapiens
tgcaggggtctggga

SEQ ID NO: 3437319 - DNA, 15 bp, Homo sapiens
tgcagggtcctcttc

SEQ ID NO: 3437320 - DNA, 15 bp, Homo sapiens
tgcaggttcatggat

SEQ ID NO: 3437321 - DNA, 21 bp, Homo sapiens
tgcagtaaatcttttacaact

SEQ ID NO: 3437322 - DNA, 16 bp, Homo sapiens
tgcagtatcatgccct

SEQ ID NO: 3437323 - DNA, 21 bp, Homo sapiens
tgcagtatcatgccctgtgca

SEQ ID NO: 3437324 - DNA, 16 bp, Homo sapiens
tgcagtatggtacatt

SEQ ID NO: 3437325 - DNA, 17 bp, Homo sapiens
tgcagtatggtacattt

SEQ ID NO: 3437326 - DNA, 21 bp, Homo sapiens
tgcagtcaacagttcaaagaa

SEQ ID NO: 3437327 - DNA, 22 bp, Homo sapiens
tgcagtcaacagttcaaagaag

SEQ ID NO: 3437328 - DNA, 21 bp, Homo sapiens
tgcagtcacgtggaggagcag

SEQ ID NO: 3437329 - DNA, 13 bp, Homo sapiens
tgcagtcatcttg

SEQ ID NO: 3437330 - DNA, 21 bp, Homo sapiens
tgcagtctctttattttacta

SEQ ID NO: 3437331 - DNA, 23 bp, Homo sapiens
tgcagtgctcgctgttgctgaat

SEQ ID NO: 3437332 - DNA, 13 bp, Homo sapiens
tgcagtggggttt

SEQ ID NO: 3437333 - DNA, 19 bp, Homo sapiens
tgcagtggtattaattttg

SEQ ID NO: 3437334 - DNA, 21 bp, Homo sapiens
tgcagtggtgcgatctgggtt

SEQ ID NO: 3437335 - DNA, 19 bp, Homo sapiens
tgcagtgtctttcggaatt

SEQ ID NO: 3437336 - DNA, 12 bp, Homo sapiens
tgcagtttgaaa

SEQ ID NO: 3437337 - DNA, 13 bp, Homo sapiens
tgcagtttgaaat

SEQ ID NO: 3437338 - DNA, 19 bp, Homo sapiens
tgcagtttgaaattctgaa

SEQ ID NO: 3437339 - DNA, 17 bp, Homo sapiens
tgcataacaattcctct

SEQ ID NO: 3437340 - DNA, 15 bp, Homo sapiens
tgcataatgtcttta

SEQ ID NO: 3437341 - DNA, 16 bp, Homo sapiens
tgcataatgtctttaa

SEQ ID NO: 3437342 - DNA, 18 bp, Homo sapiens
tgcataccaacctgggca

SEQ ID NO: 3437343 - DNA, 14 bp, Homo sapiens
tgcatatgtgtgtg

SEQ ID NO: 3437344 - DNA, 13 bp, Homo sapiens
tgcatatgttgaa

SEQ ID NO: 3437345 - DNA, 16 bp, Homo sapiens
tgcatcatccttgcag

SEQ ID NO: 3437346 - DNA, 17 bp, Homo sapiens
tgcatcgtttcatcttc

SEQ ID NO: 3437347 - DNA, 15 bp, Homo sapiens
tgcatctaagcccat

SEQ ID NO: 3437348 - DNA, 16 bp, Homo sapiens
tgccctgtaggaaggc

SEQ ID NO: 3437349 - DNA, 15 bp, Homo sapiens
tgccctgtgtacttc

SEQ ID NO: 3437350 - DNA, 20 bp, Homo sapiens
tgccctgtgtacttcccggg

SEQ ID NO: 3437351 - DNA, 17 bp, Homo sapiens
tgcccttggaggccagc

SEQ ID NO: 3437352 - DNA, 16 bp, Homo sapiens
tgcccttgtcccactc

SEQ ID NO: 3437353 - DNA, 17 bp, Homo sapiens
tgcccttgtcccactca

SEQ ID NO: 3437354 - DNA, 17 bp, Homo sapiens
tgcccttttttctgcct

SEQ ID NO: 3437355 - DNA, 18 bp, Homo sapiens
tgcccttttttctgcctc

SEQ ID NO: 3437356 - DNA, 21 bp, Homo sapiens
tgcccttttttctgcctcctt

SEQ ID NO: 3437357 - DNA, 15 bp, Homo sapiens
tgccgcaaattgtac

SEQ ID NO: 3437358 - DNA, 14 bp, Homo sapiens
tgccgcagagctgg

SEQ ID NO: 3437359 - DNA, 17 bp, Homo sapiens
tgccgcagagctggccg

SEQ ID NO: 3437360 - DNA, 15 bp, Homo sapiens
tgccgccccacccag

SEQ ID NO: 3437361 - DNA, 16 bp, Homo sapiens
tgccgccccacccaga

SEQ ID NO: 3437362 - DNA, 16 bp, Homo sapiens
tgccgcgatgggtcag

SEQ ID NO: 3437363 - DNA, 16 bp, Homo sapiens
tgccgcgtcgccctcc

SEQ ID NO: 3437364 - DNA, 20 bp, Homo sapiens
tgccgcgtcgccctcccagg

SEQ ID NO: 3437365 - DNA, 16 bp, Homo sapiens
tgccggatacaaactg

SEQ ID NO: 3437366 - DNA, 13 bp, Homo sapiens
tgccggcacagct

SEQ ID NO: 3437367 - DNA, 14 bp, Homo sapiens
tgccggcacagctg

SEQ ID NO: 3437368 - DNA, 23 bp, Homo sapiens
tgccgtggggccgccgcctcttt

SEQ ID NO: 3437369 - DNA, 18 bp, Homo sapiens
tgcctaaatccaaagaaa

SEQ ID NO: 3437370 - DNA, 15 bp, Homo sapiens
tgcctacatcccggg

SEQ ID NO: 3437371 - DNA, 21 bp, Homo sapiens
tgcctacatcccgggcctcag

SEQ ID NO: 3437372 - DNA, 23 bp, Homo sapiens
tgcctacatcccgggcctcagtg

SEQ ID NO: 3437373 - DNA, 15 bp, Homo sapiens
tgcctacttttggcc

SEQ ID NO: 3437374 - DNA, 17 bp, Homo sapiens
tgcctacttttggcctc

SEQ ID NO: 3437375 - DNA, 14 bp, Homo sapiens
tgcctatttgtgtg

SEQ ID NO: 3437376 - DNA, 17 bp, Homo sapiens
tgcctatttgtgtggac

SEQ ID NO: 3437377 - DNA, 15 bp, Homo sapiens
tgcctcaccttgggg

SEQ ID NO: 3437378 - DNA, 18 bp, Homo sapiens
tgcctcactaatttttgt

SEQ ID NO: 3437379 - DNA, 18 bp, Homo sapiens
tgcctcaggaggcaggac

SEQ ID NO: 3437380 - DNA, 21 bp, Homo sapiens
tgcctcaggaggcaggacctt

SEQ ID NO: 3437381 - DNA, 17 bp, Homo sapiens
tgcctccagaagcactg

SEQ ID NO: 3437382 - DNA, 21 bp, Homo sapiens
tgcctccagccaaacgggagc

SEQ ID NO: 3437383 - DNA, 20 bp, Homo sapiens
tgcctccaggaaccacacca

SEQ ID NO: 3437384 - DNA, 12 bp, Homo sapiens
tgcctccagggc

SEQ ID NO: 3437385 - DNA, 17 bp, Homo sapiens
tgcctccagggctggac

SEQ ID NO: 3437386 - DNA, 18 bp, Homo sapiens
tgcctcccctctccttcc

SEQ ID NO: 3437387 - DNA, 14 bp, Homo sapiens
tgcctccctagctt

SEQ ID NO: 3437388 - DNA, 15 bp, Homo sapiens
tgcctcctactccag

SEQ ID NO: 3437389 - DNA, 13 bp, Homo sapiens
tgcctcctcagta

SEQ ID NO: 3437390 - DNA, 23 bp, Homo sapiens
tgcctcgaaacacagaaaccttt

SEQ ID NO: 3437391 - DNA, 19 bp, Homo sapiens
tgcctcgaactggctgcaa

SEQ ID NO: 3437392 - DNA, 20 bp, Homo sapiens
tgcctcggcttttctcagct

SEQ ID NO: 3437393 - DNA, 20 bp, Homo sapiens
tgcctctactttgattctga

SEQ ID NO: 3437394 - DNA, 13 bp, Homo sapiens
tgcctctccaggc

SEQ ID NO: 3437395 - DNA, 12 bp, Homo sapiens
tgcctctgcctc

SEQ ID NO: 3437396 - DNA, 15 bp, Homo sapiens
tgcctctgcctctga

SEQ ID NO: 3437397 - DNA, 17 bp, Homo sapiens
tgcctctgcctctgaca

SEQ ID NO: 3437398 - DNA, 20 bp, Homo sapiens
tgcctctgcctctgacacac

SEQ ID NO: 3437399 - DNA, 16 bp, Homo sapiens
tgcctctgtccccttc

SEQ ID NO: 3437400 - DNA, 13 bp, Homo sapiens
tgcctctgtgctg

SEQ ID NO: 3437401 - DNA, 13 bp, Homo sapiens
tgcctcttctggg

SEQ ID NO: 3437402 - DNA, 17 bp, Homo sapiens
tgcctctttcatccact

SEQ ID NO: 3437403 - DNA, 16 bp, Homo sapiens
tgcctgacaaggccag

SEQ ID NO: 3437404 - DNA, 18 bp, Homo sapiens
tgcctgacaaggccagca

SEQ ID NO: 3437405 - DNA, 20 bp, Homo sapiens
tgcctgacaaggccagcacc

SEQ ID NO: 3437406 - DNA, 16 bp, Homo sapiens
tgcctgacaggctgtg

SEQ ID NO: 3437407 - DNA, 19 bp, Homo sapiens
tgcctgacaggctgtgact

SEQ ID NO: 3437408 - DNA, 21 bp, Homo sapiens
tgcctgactgcccagcatttg

SEQ ID NO: 3437409 - DNA, 22 bp, Homo sapiens
tgcctgatatttccctcccctg

SEQ ID NO: 3437410 - DNA, 15 bp, Homo sapiens
tgcctgatcagaaac

SEQ ID NO: 3437411 - DNA, 19 bp, Homo sapiens
tgcctgccagctgcactga

SEQ ID NO: 3437412 - DNA, 19 bp, Homo sapiens
tgcctgcccaggcccctgc

SEQ ID NO: 3437413 - DNA, 23 bp, Homo sapiens
tgcctggagtgtatgactgcaca

SEQ ID NO: 3437414 - DNA, 15 bp, Homo sapiens
tgcctggcaggctgt

SEQ ID NO: 3437415 - DNA, 21 bp, Homo sapiens
tgcctgggtggacatggcccc

SEQ ID NO: 3437416 - DNA, 22 bp, Homo sapiens
tgcctgggtttaaggggagagg

SEQ ID NO: 3437417 - DNA, 13 bp, Homo sapiens
tgcctggtatttt

SEQ ID NO: 3437418 - DNA, 19 bp, Homo sapiens
tgcctggtattttcaacca

SEQ ID NO: 3437419 - DNA, 15 bp, Homo sapiens
tgcctggtggcagct

SEQ ID NO: 3437420 - DNA, 16 bp, Homo sapiens
tgcctggtggcagctg

SEQ ID NO: 3437421 - DNA, 17 bp, Homo sapiens
tgcctggtggcagctgc

SEQ ID NO: 3437422 - DNA, 13 bp, Homo sapiens
tgcctgtaaacat

SEQ ID NO: 3437423 - DNA, 14 bp, Homo sapiens
tgcctgtcctgaaa

SEQ ID NO: 3437424 - DNA, 19 bp, Homo sapiens
tgcctgtcctgaaagcggc

SEQ ID NO: 3437425 - DNA, 15 bp, Homo sapiens
tgcctgtctgcccca

SEQ ID NO: 3437426 - DNA, 14 bp, Homo sapiens
tgcctgtggaactg

SEQ ID NO: 3437427 - DNA, 22 bp, Homo sapiens
tgcctgtggcgccgtctccagg

SEQ ID NO: 3437428 - DNA, 22 bp, Homo sapiens
tgcctgtgtccatgcgctcagg

SEQ ID NO: 3437429 - DNA, 17 bp, Homo sapiens
tgccttaaacctacctc

SEQ ID NO: 3437430 - DNA, 22 bp, Homo sapiens
tgccttccagatcctctctggg

SEQ ID NO: 3437431 - DNA, 16 bp, Homo sapiens
tgccttcctaagcctg

SEQ ID NO: 3437432 - DNA, 19 bp, Homo sapiens
tgccttcctcctgggccct

SEQ ID NO: 3437433 - DNA, 13 bp, Homo sapiens
tgccttcgcttct

SEQ ID NO: 3437434 - DNA, 17 bp, Homo sapiens
tgccttcgcttcttgcc

SEQ ID NO: 3437435 - DNA, 22 bp, Homo sapiens
tgccttctcaccagctgcaaag

SEQ ID NO: 3437436 - DNA, 14 bp, Homo sapiens
tgccttcttcaggg

SEQ ID NO: 3437437 - DNA, 16 bp, Homo sapiens
tgccttcttttgatta

SEQ ID NO: 3437438 - DNA, 15 bp, Homo sapiens
tgccttgaataataa

SEQ ID NO: 3437439 - DNA, 15 bp, Homo sapiens
tgccttgcctcctca

SEQ ID NO: 3437440 - DNA, 16 bp, Homo sapiens
tgccttgcctcctcag

SEQ ID NO: 3437441 - DNA, 14 bp, Homo sapiens
tgcctttattgtgt

SEQ ID NO: 3437442 - DNA, 13 bp, Homo sapiens
tgcctttcaaatt

SEQ ID NO: 3437443 - DNA, 17 bp, Homo sapiens
tgcctttcgaggcctga

SEQ ID NO: 3437444 - DNA, 12 bp, Homo sapiens
tgcctttgaatg

SEQ ID NO: 3437445 - DNA, 16 bp, Homo sapiens
tgccttttaattttta

SEQ ID NO: 3437446 - DNA, 22 bp, Homo sapiens
tgccttttgcagaagagggtgt

SEQ ID NO: 3437447 - DNA, 21 bp, Homo sapiens
tgccttttttcacggaagttt

SEQ ID NO: 3437448 - DNA, 19 bp, Homo sapiens
tgccttttttgtagttttt

SEQ ID NO: 3437449 - DNA, 13 bp, Homo sapiens
tgcgaaaggatga

SEQ ID NO: 3437450 - DNA, 19 bp, Homo sapiens
tgcgaaaggatgaaagtga

SEQ ID NO: 3437451 - DNA, 22 bp, Homo sapiens
tgcgaacctatgtctaaattca

SEQ ID NO: 3437452 - DNA, 14 bp, Homo sapiens
tgcgatctgggttc

SEQ ID NO: 3437453 - DNA, 15 bp, Homo sapiens
tgcgatctgggttca

SEQ ID NO: 3437454 - DNA, 21 bp, Homo sapiens
tgcgatctgggttcactgcaa

SEQ ID NO: 3437455 - DNA, 16 bp, Homo sapiens
tgcgcagccccatctg

SEQ ID NO: 3437456 - DNA, 17 bp, Homo sapiens
tgcgccaccgcccagag

SEQ ID NO: 3437457 - DNA, 16 bp, Homo sapiens
tgcgccagtcctgcta

SEQ ID NO: 3437458 - DNA, 14 bp, Homo sapiens
tgcgcctacaggag

SEQ ID NO: 3437459 - DNA, 22 bp, Homo sapiens
tgcgcctacaggagtgagcact

SEQ ID NO: 3437460 - DNA, 11 bp, Homo sapiens
tgcgcctgctg

SEQ ID NO: 3437461 - DNA, 20 bp, Homo sapiens
tgcgcgcatgtaatcccagc

SEQ ID NO: 3437462 - DNA, 22 bp, Homo sapiens
tgcgcgcatgtaatcccagcta

SEQ ID NO: 3437463 - DNA, 19 bp, Homo sapiens
tgcgctcagggccatgctg

SEQ ID NO: 3437464 - DNA, 23 bp, Homo sapiens
tgcgctcagggccatgctgaggc

SEQ ID NO: 3437465 - DNA, 16 bp, Homo sapiens
tgcgctgggcacttcc

SEQ ID NO: 3437466 - DNA, 18 bp, Homo sapiens
tgcgctgggcacttccct

SEQ ID NO: 3437467 - DNA, 14 bp, Homo sapiens
tgcggaatcagctt

SEQ ID NO: 3437468 - DNA, 13 bp, Homo sapiens
tgcggagaacaaa

SEQ ID NO: 3437469 - DNA, 21 bp, Homo sapiens
tgcggcaggactgcagagcag

SEQ ID NO: 3437470 - DNA, 17 bp, Homo sapiens
tgcggcattaaagccat

SEQ ID NO: 3437471 - DNA, 18 bp, Homo sapiens
tgcggcgtacaggctggc

SEQ ID NO: 3437472 - DNA, 13 bp, Homo sapiens
tgcgggaagctga

SEQ ID NO: 3437473 - DNA, 18 bp, Homo sapiens
tgcgggtgaacaaagcag

SEQ ID NO: 3437474 - DNA, 13 bp, Homo sapiens
tgcgtacacagag

SEQ ID NO: 3437475 - DNA, 14 bp, Homo sapiens
tgcgtacacagaga

SEQ ID NO: 3437476 - DNA, 17 bp, Homo sapiens
tgcgtacacagagaagg

SEQ ID NO: 3437477 - DNA, 13 bp, Homo sapiens
tgctaaaatagaa

SEQ ID NO: 3437478 - DNA, 20 bp, Homo sapiens
tgctaaaatagaatatagca

SEQ ID NO: 3437479 - DNA, 13 bp, Homo sapiens
tgctaagtgtgaa

SEQ ID NO: 3437480 - DNA, 14 bp, Homo sapiens
tgctaagtgtgaac

SEQ ID NO: 3437481 - DNA, 21 bp, Homo sapiens
tggccctgtagttaggcctgg

SEQ ID NO: 3437482 - DNA, 19 bp, Homo sapiens
tggccctgttctcctcccc

SEQ ID NO: 3437483 - DNA, 17 bp, Homo sapiens
tggccgagtccaagctg

SEQ ID NO: 3437484 - DNA, 17 bp, Homo sapiens
tggccgcacgcctctcc

SEQ ID NO: 3437485 - DNA, 21 bp, Homo sapiens
tggccgcgccaaataatgtct

SEQ ID NO: 3437486 - DNA, 23 bp, Homo sapiens
tggccgcgccaaataatgtctct

SEQ ID NO: 3437487 - DNA, 17 bp, Homo sapiens
tggccgctgagtggcag

SEQ ID NO: 3437488 - DNA, 22 bp, Homo sapiens
tggccgttgatgttggctggga

SEQ ID NO: 3437489 - DNA, 16 bp, Homo sapiens
tggcctaaaaatgcaa

SEQ ID NO: 3437490 - DNA, 20 bp, Homo sapiens
tggcctagcaggcacaggac

SEQ ID NO: 3437491 - DNA, 13 bp, Homo sapiens
tggcctatctcct

SEQ ID NO: 3437492 - DNA, 17 bp, Homo sapiens
tggcctatctcctaggg

SEQ ID NO: 3437493 - DNA, 18 bp, Homo sapiens
tggcctcaagtgattctc

SEQ ID NO: 3437494 - DNA, 22 bp, Homo sapiens
tggcctcacccacccctgcaca

SEQ ID NO: 3437495 - DNA, 15 bp, Homo sapiens
tggcctcatgtggct

SEQ ID NO: 3437496 - DNA, 17 bp, Homo sapiens
tggcctccatcctcatc

SEQ ID NO: 3437497 - DNA, 17 bp, Homo sapiens
tggcctcccctgccacc

SEQ ID NO: 3437498 - DNA, 14 bp, Homo sapiens
tggcctgggcctcc

SEQ ID NO: 3437499 - DNA, 17 bp, Homo sapiens
tggcctgggcctcctca

SEQ ID NO: 3437500 - DNA, 23 bp, Homo sapiens
tggcctgttttagaaggttctct

SEQ ID NO: 3437501 - DNA, 18 bp, Homo sapiens
tggccttcccgccggagg

SEQ ID NO: 3437502 - DNA, 23 bp, Homo sapiens
tggccttcccgccggaggccagc

SEQ ID NO: 3437503 - DNA, 12 bp, Homo sapiens
tggccttctccc

SEQ ID NO: 3437504 - DNA, 20 bp, Homo sapiens
tggccttctcccctcttctg

SEQ ID NO: 3437505 - DNA, 18 bp, Homo sapiens
tggccttgaaaccacctt

SEQ ID NO: 3437506 - DNA, 22 bp, Homo sapiens
tggcctttaagcctgcattctt

SEQ ID NO: 3437507 - DNA, 23 bp, Homo sapiens
tggcctttaagcctgcattctta

SEQ ID NO: 3437508 - DNA, 23 bp, Homo sapiens
tggctagtcaagctcctcctccc

SEQ ID NO: 3437509 - DNA, 18 bp, Homo sapiens
tggctcaagtcctctttt

SEQ ID NO: 3437510 - DNA, 16 bp, Homo sapiens
tggctcacacctgtaa

SEQ ID NO: 3437511 - DNA, 13 bp, Homo sapiens
tggctcacactga

SEQ ID NO: 3437512 - DNA, 15 bp, Homo sapiens
tggctcacactgaga

SEQ ID NO: 3437513 - DNA, 12 bp, Homo sapiens
tggctcctctca

SEQ ID NO: 3437514 - DNA, 22 bp, Homo sapiens
tggctctatttcttcttcacat

SEQ ID NO: 3437515 - DNA, 19 bp, Homo sapiens
tggctctttggagatcaag

SEQ ID NO: 3437516 - DNA, 22 bp, Homo sapiens
tggctgaaattctcctggaggt

SEQ ID NO: 3437517 - DNA, 20 bp, Homo sapiens
tggctgaagacttttgttat

SEQ ID NO: 3437518 - DNA, 12 bp, Homo sapiens
tggctgcaaagg

SEQ ID NO: 3437519 - DNA, 16 bp, Homo sapiens
tggctgcaggaatctt

SEQ ID NO: 3437520 - DNA, 13 bp, Homo sapiens
tggctgctaacaa

SEQ ID NO: 3437521 - DNA, 20 bp, Homo sapiens
tggctggaagatcctgcggg

SEQ ID NO: 3437522 - DNA, 19 bp, Homo sapiens
tggctggcctcacccaccc

SEQ ID NO: 3437523 - DNA, 23 bp, Homo sapiens
tggctgggaactcacctggggct

SEQ ID NO: 3437524 - DNA, 15 bp, Homo sapiens
tggctgggacgtggc

SEQ ID NO: 3437525 - DNA, 20 bp, Homo sapiens
tggctgggcagagctgcatc

SEQ ID NO: 3437526 - DNA, 12 bp, Homo sapiens
tggctgggggcc

SEQ ID NO: 3437527 - DNA, 16 bp, Homo sapiens
tggctggggtggcctg

SEQ ID NO: 3437528 - DNA, 20 bp, Homo sapiens
tggctggggtggcctgtgtg

SEQ ID NO: 3437529 - DNA, 13 bp, Homo sapiens
tggctgtaatcat

SEQ ID NO: 3437530 - DNA, 20 bp, Homo sapiens
tggctgtgacagcctctgca

SEQ ID NO: 3437531 - DNA, 21 bp, Homo sapiens
tggctgtggagacaatgtctg

SEQ ID NO: 3437532 - DNA, 22 bp, Homo sapiens
tggctgtggagacaatgtctgc

SEQ ID NO: 3437533 - DNA, 13 bp, Homo sapiens
tggctgttggctg

SEQ ID NO: 3437534 - DNA, 15 bp, Homo sapiens
tggcttaatcatttt

SEQ ID NO: 3437535 - DNA, 14 bp, Homo sapiens
tggcttctccaggg

SEQ ID NO: 3437536 - DNA, 18 bp, Homo sapiens
tggcttctggccaggaag

SEQ ID NO: 3437537 - DNA, 14 bp, Homo sapiens
tggcttctgtgggg

SEQ ID NO: 3437538 - DNA, 21 bp, Homo sapiens
tggcttgagtttaaattgtaa

SEQ ID NO: 3437539 - DNA, 11 bp, Homo sapiens
tggcttgctta

SEQ ID NO: 3437540 - DNA, 20 bp, Homo sapiens
tggctttatcctctttagag

SEQ ID NO: 3437541 - DNA, 11 bp, Homo sapiens
tggctttcagg

SEQ ID NO: 3437542 - DNA, 19 bp, Homo sapiens
tggcttttctgtttcctgt

SEQ ID NO: 3437543 - DNA, 17 bp, Homo sapiens
tggctttttactattaa

SEQ ID NO: 3437544 - DNA, 19 bp, Homo sapiens
tggctttttactattaaca

SEQ ID NO: 3437545 - DNA, 15 bp, Homo sapiens
tgggaaacagaggct

SEQ ID NO: 3437546 - DNA, 21 bp, Homo sapiens
tgggaaacctcattgttctgt

SEQ ID NO: 3437547 - DNA, 16 bp, Homo sapiens
tgggaaagtattctgt

SEQ ID NO: 3437548 - DNA, 14 bp, Homo sapiens
tgggaactggaggg

SEQ ID NO: 3437549 - DNA, 12 bp, Homo sapiens
tgggaagaggac

SEQ ID NO: 3437550 - DNA, 19 bp, Homo sapiens
tgggaaggggacccccgcc

SEQ ID NO: 3437551 - DNA, 15 bp, Homo sapiens
tgggaatatttgaat

SEQ ID NO: 3437552 - DNA, 18 bp, Homo sapiens
tgggaatatttgaatctt

SEQ ID NO: 3437553 - DNA, 20 bp, Homo sapiens
tgggaatcatggcctcttga

SEQ ID NO: 3437554 - DNA, 22 bp, Homo sapiens
tgggaatgtttgtctcatccca

SEQ ID NO: 3437555 - DNA, 23 bp, Homo sapiens
tgggacatcaggagactgggctc

SEQ ID NO: 3437556 - DNA, 19 bp, Homo sapiens
tgggaccacgtgagatcat

SEQ ID NO: 3437557 - DNA, 22 bp, Homo sapiens
tgggacccacgaaactgccctg

SEQ ID NO: 3437558 - DNA, 14 bp, Homo sapiens
tgggactacaggca

SEQ ID NO: 3437559 - DNA, 15 bp, Homo sapiens
tgggactccaggtct

SEQ ID NO: 3437560 - DNA, 18 bp, Homo sapiens
tgggacttccatgcctta

SEQ ID NO: 3437561 - DNA, 15 bp, Homo sapiens
tgggagaaaatcatc

SEQ ID NO: 3437562 - DNA, 19 bp, Homo sapiens
tgggagaaatacttgaact

SEQ ID NO: 3437563 - DNA, 20 bp, Homo sapiens
tgggagagcaggaatgaaaa

SEQ ID NO: 3437564 - DNA, 16 bp, Homo sapiens
tgggagctgaggccac

SEQ ID NO: 3437565 - DNA, 13 bp, Homo sapiens
tgggagctgcctg

SEQ ID NO: 3437566 - DNA, 14 bp, Homo sapiens
tgggagctgcctgt

SEQ ID NO: 3437567 - DNA, 17 bp, Homo sapiens
tgggagctgcctgttca

SEQ ID NO: 3437568 - DNA, 22 bp, Homo sapiens
tgggagctgcctgttcagctcc

SEQ ID NO: 3437569 - DNA, 24 bp, Homo sapiens
tgggagctgcctgttcagctccag

SEQ ID NO: 3437570 - DNA, 20 bp, Homo sapiens
tgggaggatctcttgagcct

SEQ ID NO: 3437571 - DNA, 20 bp, Homo sapiens
tgggaggctcacccccttct

SEQ ID NO: 3437572 - DNA, 16 bp, Homo sapiens
tgggagggaggctcag

SEQ ID NO: 3437573 - DNA, 14 bp, Homo sapiens
tgggagggcagcag

SEQ ID NO: 3437574 - DNA, 17 bp, Homo sapiens
tgggaggtcaaggctgc

SEQ ID NO: 3437575 - DNA, 23 bp, Homo sapiens
tgggaggtcaaggctgcagtgag

SEQ ID NO: 3437576 - DNA, 15 bp, Homo sapiens
tgggagtcaggcccg

SEQ ID NO: 3437577 - DNA, 18 bp, Homo sapiens
tgggatacacacggctcc

SEQ ID NO: 3437578 - DNA, 14 bp, Homo sapiens
tgggatcatgaaag

SEQ ID NO: 3437579 - DNA, 18 bp, Homo sapiens
tgggatcatgaaagtaga

SEQ ID NO: 3437580 - DNA, 16 bp, Homo sapiens
tgggatggtggagggc

SEQ ID NO: 3437581 - DNA, 18 bp, Homo sapiens
tgggatggtggagggcca

SEQ ID NO: 3437582 - DNA, 16 bp, Homo sapiens
tgggattacaggtgtg

SEQ ID NO: 3437583 - DNA, 21 bp, Homo sapiens
tgggattctggacaggatgtg

SEQ ID NO: 3437584 - DNA, 15 bp, Homo sapiens
tgggcaaacaggcag

SEQ ID NO: 3437585 - DNA, 16 bp, Homo sapiens
tgggcaaacaggcagt

SEQ ID NO: 3437586 - DNA, 16 bp, Homo sapiens
tgggcacacgcctccc

SEQ ID NO: 3437587 - DNA, 21 bp, Homo sapiens
tgggcacacgcctcccactgg

SEQ ID NO: 3437588 - DNA, 15 bp, Homo sapiens
tgggcacatgctcag

SEQ ID NO: 3437589 - DNA, 14 bp, Homo sapiens
tgggcacccaccct

SEQ ID NO: 3437590 - DNA, 20 bp, Homo sapiens
tgggcacttccctgctgcct

SEQ ID NO: 3437591 - DNA, 13 bp, Homo sapiens
tgggcagagccca

SEQ ID NO: 3437592 - DNA, 14 bp, Homo sapiens
tgggcagagcccaa

SEQ ID NO: 3437593 - DNA, 20 bp, Homo sapiens
tgggcagagctggctctgag

SEQ ID NO: 3437594 - DNA, 17 bp, Homo sapiens
tgggcaggactcagctc

SEQ ID NO: 3437595 - DNA, 16 bp, Homo sapiens
tgggcatagatgcagg

SEQ ID NO: 3437596 - DNA, 16 bp, Homo sapiens
tgggcatgtgggcttc

SEQ ID NO: 3437597 - DNA, 17 bp, Homo sapiens
tgggcatgtgggcttca

SEQ ID NO: 3437598 - DNA, 17 bp, Homo sapiens
tgggcattgatggggaa

SEQ ID NO: 3437599 - DNA, 12 bp, Homo sapiens
tgggccaagcca

SEQ ID NO: 3437600 - DNA, 15 bp, Homo sapiens
tgggccaagccagct

SEQ ID NO: 3437601 - DNA, 21 bp, Homo sapiens
tgggccaagccagctgcctag

SEQ ID NO: 3437602 - DNA, 20 bp, Homo sapiens
tgggccaccaggatcagcca

SEQ ID NO: 3437603 - DNA, 22 bp, Homo sapiens
tgggccacttctgggtggggca

SEQ ID NO: 3437604 - DNA, 19 bp, Homo sapiens
tgggccagacatgccacaa

SEQ ID NO: 3437605 - DNA, 18 bp, Homo sapiens
tgggcccacaaaggcaaa

SEQ ID NO: 3437606 - DNA, 13 bp, Homo sapiens
tgggccctgagcc

SEQ ID NO: 3437607 - DNA, 17 bp, Homo sapiens
tgggccctgggctggaa

SEQ ID NO: 3437608 - DNA, 20 bp, Homo sapiens
tgggcctcctcacaacatgg

SEQ ID NO: 3437609 - DNA, 16 bp, Homo sapiens
tgggcctcctgtgtgt

SEQ ID NO: 3437610 - DNA, 20 bp, Homo sapiens
tgggcctgccgggctgaggg

SEQ ID NO: 3437611 - DNA, 14 bp, Homo sapiens
tgggcctgctccag

SEQ ID NO: 3437612 - DNA, 16 bp, Homo sapiens
tgggcgggcccagcac

SEQ ID NO: 3437613 - DNA, 18 bp, Homo sapiens
tgtcttgcaatggcagcc

SEQ ID NO: 3437614 - DNA, 12 bp, Homo sapiens
tgtcttgggcag

SEQ ID NO: 3437615 - DNA, 13 bp, Homo sapiens
tgtcttgggcaga

SEQ ID NO: 3437616 - DNA, 21 bp, Homo sapiens
tgtcttgggcagagctggctc

SEQ ID NO: 3437617 - DNA, 12 bp, Homo sapiens
tgtcttgttcat

SEQ ID NO: 3437618 - DNA, 22 bp, Homo sapiens
tgtcttgttcattttgagtatt

SEQ ID NO: 3437619 - DNA, 19 bp, Homo sapiens
tgtcttgttctgtcactca

SEQ ID NO: 3437620 - DNA, 12 bp, Homo sapiens
tgtctttactcc

SEQ ID NO: 3437621 - DNA, 15 bp, Homo sapiens
tgtcttttaaaatgc

SEQ ID NO: 3437622 - DNA, 14 bp, Homo sapiens
tgtcttttgacatt

SEQ ID NO: 3437623 - DNA, 17 bp, Homo sapiens
tgtgaaaagaaaaatga

SEQ ID NO: 3437624 - DNA, 22 bp, Homo sapiens
tgtgaaaatggtccaggagaag

SEQ ID NO: 3437625 - DNA, 14 bp, Homo sapiens
tgtgaaatgctggc

SEQ ID NO: 3437626 - DNA, 13 bp, Homo sapiens
tgtgaacagcttg

SEQ ID NO: 3437627 - DNA, 17 bp, Homo sapiens
tgtgaaccaccacaccc

SEQ ID NO: 3437628 - DNA, 21 bp, Homo sapiens
tgtgaaccaccacacccagcc

SEQ ID NO: 3437629 - DNA, 18 bp, Homo sapiens
tgtgaaccctggggcctg

SEQ ID NO: 3437630 - DNA, 14 bp, Homo sapiens
tgtgaactgaaatt

SEQ ID NO: 3437631 - DNA, 22 bp, Homo sapiens
tgtgaactggaccctgttgcta

SEQ ID NO: 3437632 - DNA, 18 bp, Homo sapiens
tgtgaactttattaaata

SEQ ID NO: 3437633 - DNA, 12 bp, Homo sapiens
tgtgaagcattc

SEQ ID NO: 3437634 - DNA, 20 bp, Homo sapiens
tgtgaagccaattcagacag

SEQ ID NO: 3437635 - DNA, 18 bp, Homo sapiens
tgtgaatattttcaacta

SEQ ID NO: 3437636 - DNA, 15 bp, Homo sapiens
tgtgaatctatgctg

SEQ ID NO: 3437637 - DNA, 14 bp, Homo sapiens
tgtgaatgaacact

SEQ ID NO: 3437638 - DNA, 15 bp, Homo sapiens
tgtgacaattctgtt

SEQ ID NO: 3437639 - DNA, 21 bp, Homo sapiens
tgtgacaattctgtttttaat

SEQ ID NO: 3437640 - DNA, 11 bp, Homo sapiens
tgtgacattcc

SEQ ID NO: 3437641 - DNA, 15 bp, Homo sapiens
tgtgaccaatgtctt

SEQ ID NO: 3437642 - DNA, 16 bp, Homo sapiens
tgtgaccaatgtcttg

SEQ ID NO: 3437643 - DNA, 16 bp, Homo sapiens
tgtgacccccagctcc

SEQ ID NO: 3437644 - DNA, 17 bp, Homo sapiens
tgtgacctttaattcag

SEQ ID NO: 3437645 - DNA, 16 bp, Homo sapiens
tgtgagaggtttgact

SEQ ID NO: 3437646 - DNA, 18 bp, Homo sapiens
tgtgagcccagctgggtc

SEQ ID NO: 3437647 - DNA, 20 bp, Homo sapiens
tgtgagctaggagaagggct

SEQ ID NO: 3437648 - DNA, 21 bp, Homo sapiens
tgtgagctaggagaagggctg

SEQ ID NO: 3437649 - DNA, 22 bp, Homo sapiens
tgtgagctaggagaagggctga

SEQ ID NO: 3437650 - DNA, 19 bp, Homo sapiens
tgtgagctcccaggtgcag

SEQ ID NO: 3437651 - DNA, 23 bp, Homo sapiens
tgtgagctcccaggtgcagccag

SEQ ID NO: 3437652 - DNA, 16 bp, Homo sapiens
tgtgaggaaagtcatt

SEQ ID NO: 3437653 - DNA, 22 bp, Homo sapiens
tgtgaggaaagtcattggcttt

SEQ ID NO: 3437654 - DNA, 14 bp, Homo sapiens
tgtgaggccagggc

SEQ ID NO: 3437655 - DNA, 21 bp, Homo sapiens
tgtgagtcaccaagcccagtt

SEQ ID NO: 3437656 - DNA, 20 bp, Homo sapiens
tgtgagtgaaagttgccatt

SEQ ID NO: 3437657 - DNA, 16 bp, Homo sapiens
tgtgataaatcagtca

SEQ ID NO: 3437658 - DNA, 15 bp, Homo sapiens
tgtgatagcactttc

SEQ ID NO: 3437659 - DNA, 17 bp, Homo sapiens
tgtgatagcactttcta

SEQ ID NO: 3437660 - DNA, 14 bp, Homo sapiens
tgtgatgaatactg

SEQ ID NO: 3437661 - DNA, 22 bp, Homo sapiens
tgtgatgatgaaatgaggtcag

SEQ ID NO: 3437662 - DNA, 22 bp, Homo sapiens
tgtgattgacagctttgctgct

SEQ ID NO: 3437663 - DNA, 23 bp, Homo sapiens
tgtgattgacagctttgctgctg

SEQ ID NO: 3437664 - DNA, 14 bp, Homo sapiens
tgtgattgtggaat

SEQ ID NO: 3437665 - DNA, 17 bp, Homo sapiens
tgtgattttaactctgt

SEQ ID NO: 3437666 - DNA, 19 bp, Homo sapiens
tgtgattttaactctgtct

SEQ ID NO: 3437667 - DNA, 20 bp, Homo sapiens
tgtgcaaaaaaattaaaatg

SEQ ID NO: 3437668 - DNA, 12 bp, Homo sapiens
tgtgcaaatcct

SEQ ID NO: 3437669 - DNA, 14 bp, Homo sapiens
tgtgcacatctctg

SEQ ID NO: 3437670 - DNA, 15 bp, Homo sapiens
tgtgcacatctctgc

SEQ ID NO: 3437671 - DNA, 19 bp, Homo sapiens
tgtgcacatctctgcttga

SEQ ID NO: 3437672 - DNA, 16 bp, Homo sapiens
tgtgcacatgcacgtg

SEQ ID NO: 3437673 - DNA, 22 bp, Homo sapiens
tgtgcacatgcacgtgtgtgca

SEQ ID NO: 3437674 - DNA, 13 bp, Homo sapiens
tgtgcaccagggt

SEQ ID NO: 3437675 - DNA, 22 bp, Homo sapiens
tgtgcacctagagcttttttat

SEQ ID NO: 3437676 - DNA, 16 bp, Homo sapiens
tgtgcactaaggggcc

SEQ ID NO: 3437677 - DNA, 17 bp, Homo sapiens
tgtgcactaaggggccc

SEQ ID NO: 3437678 - DNA, 17 bp, Homo sapiens
tgtgcagggagggcagt

SEQ ID NO: 3437679 - DNA, 16 bp, Homo sapiens
tgtgcaggtggggaga

SEQ ID NO: 3437680 - DNA, 23 bp, Homo sapiens
tgtgcattcttttaaaagacaag

SEQ ID NO: 3437681 - DNA, 21 bp, Homo sapiens
tgtgccagggcaatgatgaat

SEQ ID NO: 3437682 - DNA, 12 bp, Homo sapiens
tgtgccatgtgc

SEQ ID NO: 3437683 - DNA, 16 bp, Homo sapiens
tgtgccatgtgccagg

SEQ ID NO: 3437684 - DNA, 16 bp, Homo sapiens
tgtgccccttgacaac

SEQ ID NO: 3437685 - DNA, 23 bp, Homo sapiens
tgtgccccttgacaactggcagg

SEQ ID NO: 3437686 - DNA, 17 bp, Homo sapiens
tgtgccctcctgaccca

SEQ ID NO: 3437687 - DNA, 23 bp, Homo sapiens
tgtgccctcctgacccattgctg

SEQ ID NO: 3437688 - DNA, 14 bp, Homo sapiens
tgtgcctctgtcct

SEQ ID NO: 3437689 - DNA, 16 bp, Homo sapiens
tgtgcctctgtcctta

SEQ ID NO: 3437690 - DNA, 18 bp, Homo sapiens
tgtgcctgactgcccagc

SEQ ID NO: 3437691 - DNA, 14 bp, Homo sapiens
tgtgccttcgtctt

SEQ ID NO: 3437692 - DNA, 16 bp, Homo sapiens
tgtgccttcttttgat

SEQ ID NO: 3437693 - DNA, 20 bp, Homo sapiens
tgtgctagaaattttcaaga

SEQ ID NO: 3437694 - DNA, 14 bp, Homo sapiens
tgtgctctgcttca

SEQ ID NO: 3437695 - DNA, 12 bp, Homo sapiens
tgtgctgtaatt

SEQ ID NO: 3437696 - DNA, 19 bp, Homo sapiens
tgtgcttatggtaccagat

SEQ ID NO: 3437697 - DNA, 19 bp, Homo sapiens
tgtgcttcgggcccttccc

SEQ ID NO: 3437698 - DNA, 18 bp, Homo sapiens
tgtgcttggtctgtttga

SEQ ID NO: 3437699 - DNA, 17 bp, Homo sapiens
tgtgctttatgctgaaa

SEQ ID NO: 3437700 - DNA, 14 bp, Homo sapiens
tgtgcttttcctga

SEQ ID NO: 3437701 - DNA, 21 bp, Homo sapiens
tgtgcttttcctgataaagca

SEQ ID NO: 3437702 - DNA, 15 bp, Homo sapiens
tgtggaaaagaaaca

SEQ ID NO: 3437703 - DNA, 18 bp, Homo sapiens
tgtggacacagctcttct

SEQ ID NO: 3437704 - DNA, 21 bp, Homo sapiens
tgtggactaaaagatataagt

SEQ ID NO: 3437705 - DNA, 12 bp, Homo sapiens
tgtggacttttt

SEQ ID NO: 3437706 - DNA, 12 bp, Homo sapiens
tgtggagaagcg

SEQ ID NO: 3437707 - DNA, 21 bp, Homo sapiens
tgtggagaagcggctggcagc

SEQ ID NO: 3437708 - DNA, 18 bp, Homo sapiens
tgtggagacaatgtctgc

SEQ ID NO: 3437709 - DNA, 16 bp, Homo sapiens
tgtggagccgaggcct

SEQ ID NO: 3437710 - DNA, 20 bp, Homo sapiens
tgtggagccgaggcctaccc

SEQ ID NO: 3437711 - DNA, 23 bp, Homo sapiens
tgtggatgagccctcagaaccct

SEQ ID NO: 3437712 - DNA, 16 bp, Homo sapiens
tgtggatgtggacttt

SEQ ID NO: 3437713 - DNA, 19 bp, Homo sapiens
tgtggcagtcccttataat

SEQ ID NO: 3437714 - DNA, 14 bp, Homo sapiens
tgtggcatttggaa

SEQ ID NO: 3437715 - DNA, 14 bp, Homo sapiens
tgtggccaaggagc

SEQ ID NO: 3437716 - DNA, 17 bp, Homo sapiens
tgtggccaaggagctgc

SEQ ID NO: 3437717 - DNA, 16 bp, Homo sapiens
tgtggccacttctgtc

SEQ ID NO: 3437718 - DNA, 12 bp, Homo sapiens
tgtggccccacc

SEQ ID NO: 3437719 - DNA, 13 bp, Homo sapiens
tgtggccccaccc

SEQ ID NO: 3437720 - DNA, 17 bp, Homo sapiens
tgtggccccaccctggg

SEQ ID NO: 3437721 - DNA, 19 bp, Homo sapiens
tgtggccccaccctgggcc

SEQ ID NO: 3437722 - DNA, 22 bp, Homo sapiens
tgtggctcacgtgagagtgtct

SEQ ID NO: 3437723 - DNA, 19 bp, Homo sapiens
tgtgggaaacctcattgtt

SEQ ID NO: 3437724 - DNA, 22 bp, Homo sapiens
tgtgggctagttgggcttcctc

SEQ ID NO: 3437725 - DNA, 17 bp, Homo sapiens
tgtggggctgagctggg

SEQ ID NO: 3437726 - DNA, 15 bp, Homo sapiens
tgtgggggcttcatc

SEQ ID NO: 3437727 - DNA, 22 bp, Homo sapiens
tgtggggtgtgcacatctctgc

SEQ ID NO: 3437728 - DNA, 14 bp, Homo sapiens
tgtgggtgtcctgc

SEQ ID NO: 3437729 - DNA, 14 bp, Homo sapiens
tgtgggttctacag

SEQ ID NO: 3437730 - DNA, 16 bp, Homo sapiens
tgtggtctctttgggg

SEQ ID NO: 3437731 - DNA, 15 bp, Homo sapiens
tgtggtgatgatgtg

SEQ ID NO: 3437732 - DNA, 12 bp, Homo sapiens
tgtggtttcatt

SEQ ID NO: 3437733 - DNA, 15 bp, Homo sapiens
tgtgtaaaaagagag

SEQ ID NO: 3437734 - DNA, 14 bp, Homo sapiens
tgtgtaatatgaaa

SEQ ID NO: 3437735 - DNA, 17 bp, Homo sapiens
tgtgtaattgttccttt

SEQ ID NO: 3437736 - DNA, 15 bp, Homo sapiens
tgtgtacccaaacgt

SEQ ID NO: 3437737 - DNA, 12 bp, Homo sapiens
tgtgtagggcgg

SEQ ID NO: 3437738 - DNA, 16 bp, Homo sapiens
tgtgtagggcgggagg

SEQ ID NO: 3437739 - DNA, 18 bp, Homo sapiens
tgtgtaggtgaacagtca

SEQ ID NO: 3437740 - DNA, 21 bp, Homo sapiens
tgtgtattaaaaaaaacaaaa

SEQ ID NO: 3437741 - DNA, 13 bp, Homo sapiens
tgtgtatttaaca

SEQ ID NO: 3437742 - DNA, 20 bp, Homo sapiens
tgtgtatttaacagggaggg

SEQ ID NO: 3437743 - DNA, 22 bp, Homo sapiens
tgtgtatttaacagggagggga

SEQ ID NO: 3437744 - DNA, 14 bp, Homo sapiens
tgtgtcagctgagg

SEQ ID NO: 3437745 - DNA, 20 bp, Homo sapiens
tgtgtcaggtggggcagctt

SEQ ID NO: 3437746 - DNA, 23 bp, Homo sapiens
ttaatttttttaaccaaaggtga

SEQ ID NO: 3437747 - DNA, 19 bp, Homo sapiens
ttaatttttttgagacaga

SEQ ID NO: 3437748 - DNA, 19 bp, Homo sapiens
ttacaaaaacacttcgttc

SEQ ID NO: 3437749 - DNA, 17 bp, Homo sapiens
ttacaaaactacatgag

SEQ ID NO: 3437750 - DNA, 18 bp, Homo sapiens
ttacaaagtgtgtattaa

SEQ ID NO: 3437751 - DNA, 23 bp, Homo sapiens
ttacaactgcctcgaaacacaga

SEQ ID NO: 3437752 - DNA, 19 bp, Homo sapiens
ttacaagcccccccttcca

SEQ ID NO: 3437753 - DNA, 20 bp, Homo sapiens
ttacaagcccccccttccac

SEQ ID NO: 3437754 - DNA, 18 bp, Homo sapiens
ttacaatttacaaagtgt

SEQ ID NO: 3437755 - DNA, 20 bp, Homo sapiens
ttacacaatggtttttaaat

SEQ ID NO: 3437756 - DNA, 19 bp, Homo sapiens
ttacacagaaatgctgctg

SEQ ID NO: 3437757 - DNA, 20 bp, Homo sapiens
ttacagatgaatgtatttat

SEQ ID NO: 3437758 - DNA, 19 bp, Homo sapiens
ttacagtaggagcccagct

SEQ ID NO: 3437759 - DNA, 20 bp, Homo sapiens
ttacagtttaagattttaag

SEQ ID NO: 3437760 - DNA, 14 bp, Homo sapiens
ttacatctggaatc

SEQ ID NO: 3437761 - DNA, 12 bp, Homo sapiens
ttacatcttgta

SEQ ID NO: 3437762 - DNA, 18 bp, Homo sapiens
ttacatgttttctttgct

SEQ ID NO: 3437763 - DNA, 22 bp, Homo sapiens
ttacatgttttctttgctttaa

SEQ ID NO: 3437764 - DNA, 16 bp, Homo sapiens
ttacattgttcaatta

SEQ ID NO: 3437765 - DNA, 17 bp, Homo sapiens
ttacattgtttgtctgt

SEQ ID NO: 3437766 - DNA, 23 bp, Homo sapiens
ttaccaaagtgtcttttgacatt

SEQ ID NO: 3437767 - DNA, 16 bp, Homo sapiens
ttaccatgtaaataat

SEQ ID NO: 3437768 - DNA, 21 bp, Homo sapiens
ttaccatgtaaataatctgtg

SEQ ID NO: 3437769 - DNA, 16 bp, Homo sapiens
ttacccaggtgggtcc

SEQ ID NO: 3437770 - DNA, 13 bp, Homo sapiens
ttacccatgaaaa

SEQ ID NO: 3437771 - DNA, 16 bp, Homo sapiens
ttaccgcgttgtaaaa

SEQ ID NO: 3437772 - DNA, 20 bp, Homo sapiens
ttacctgaaaacactgtgca

SEQ ID NO: 3437773 - DNA, 22 bp, Homo sapiens
ttacctgaaaacactgtgcaca

SEQ ID NO: 3437774 - DNA, 19 bp, Homo sapiens
ttacctgtcattttgcact

SEQ ID NO: 3437775 - DNA, 21 bp, Homo sapiens
ttacctgtcattttgcactgt

SEQ ID NO: 3437776 - DNA, 15 bp, Homo sapiens
ttactaactaaactc

SEQ ID NO: 3437777 - DNA, 23 bp, Homo sapiens
ttactaagttttcaaatttgtaa

SEQ ID NO: 3437778 - DNA, 13 bp, Homo sapiens
ttactagaaatgg

SEQ ID NO: 3437779 - DNA, 19 bp, Homo sapiens
ttactagaaatgggaatca

SEQ ID NO: 3437780 - DNA, 22 bp, Homo sapiens
ttactagaaatgggaatcatgg

SEQ ID NO: 3437781 - DNA, 16 bp, Homo sapiens
ttactagggatccctc

SEQ ID NO: 3437782 - DNA, 20 bp, Homo sapiens
ttactagggatccctcatct

SEQ ID NO: 3437783 - DNA, 23 bp, Homo sapiens
ttactagggatccctcatctgtc

SEQ ID NO: 3437784 - DNA, 20 bp, Homo sapiens
ttactataagaactttgagc

SEQ ID NO: 3437785 - DNA, 17 bp, Homo sapiens
ttactatgtatgttttt

SEQ ID NO: 3437786 - DNA, 18 bp, Homo sapiens
ttactctagatacctaaa

SEQ ID NO: 3437787 - DNA, 22 bp, Homo sapiens
ttactctgaagggcatcatgca

SEQ ID NO: 3437788 - DNA, 18 bp, Homo sapiens
ttactgaaggtaaaattg

SEQ ID NO: 3437789 - DNA, 20 bp, Homo sapiens
ttactgaaggtaaaattgaa

SEQ ID NO: 3437790 - DNA, 19 bp, Homo sapiens
ttactgaccctggggctgg

SEQ ID NO: 3437791 - DNA, 16 bp, Homo sapiens
ttactgagcttctctg

SEQ ID NO: 3437792 - DNA, 14 bp, Homo sapiens
ttactgataatttt

SEQ ID NO: 3437793 - DNA, 22 bp, Homo sapiens
ttactgcagcctttgcctcccc

SEQ ID NO: 3437794 - DNA, 15 bp, Homo sapiens
ttactgcagctttgt

SEQ ID NO: 3437795 - DNA, 21 bp, Homo sapiens
ttactgccaaagggaaatatc

SEQ ID NO: 3437796 - DNA, 14 bp, Homo sapiens
ttactgcttcattt

SEQ ID NO: 3437797 - DNA, 23 bp, Homo sapiens
ttactgcttcatttttgtaataa

SEQ ID NO: 3437798 - DNA, 15 bp, Homo sapiens
ttactgctttgcaaa

SEQ ID NO: 3437799 - DNA, 14 bp, Homo sapiens
ttactgggttctta

SEQ ID NO: 3437800 - DNA, 15 bp, Homo sapiens
ttactgtaactgatt

SEQ ID NO: 3437801 - DNA, 17 bp, Homo sapiens
ttactgtaagacattag

SEQ ID NO: 3437802 - DNA, 15 bp, Homo sapiens
ttactgtttgttatg

SEQ ID NO: 3437803 - DNA, 23 bp, Homo sapiens
ttacttgttttcggggagaaata

SEQ ID NO: 3437804 - DNA, 17 bp, Homo sapiens
ttactttaaaaggagcc

SEQ ID NO: 3437805 - DNA, 14 bp, Homo sapiens
ttagaaaaagaaca

SEQ ID NO: 3437806 - DNA, 12 bp, Homo sapiens
ttagaaagcatt

SEQ ID NO: 3437807 - DNA, 13 bp, Homo sapiens
ttagaaagcattt

SEQ ID NO: 3437808 - DNA, 14 bp, Homo sapiens
ttagaaagcatttg

SEQ ID NO: 3437809 - DNA, 21 bp, Homo sapiens
ttagaaagtaagagctctaag

SEQ ID NO: 3437810 - DNA, 13 bp, Homo sapiens
ttagaattaaaaa

SEQ ID NO: 3437811 - DNA, 16 bp, Homo sapiens
ttagagaatgagaaat

SEQ ID NO: 3437812 - DNA, 18 bp, Homo sapiens
ttagagaatgtgtttcaa

SEQ ID NO: 3437813 - DNA, 16 bp, Homo sapiens
ttagaggaaaaatatt

SEQ ID NO: 3437814 - DNA, 16 bp, Homo sapiens
ttagagtgtctttcca

SEQ ID NO: 3437815 - DNA, 17 bp, Homo sapiens
ttagagtgtctttccac

SEQ ID NO: 3437816 - DNA, 17 bp, Homo sapiens
ttagagttagactgttg

SEQ ID NO: 3437817 - DNA, 16 bp, Homo sapiens
ttagatagtcatgctg

SEQ ID NO: 3437818 - DNA, 17 bp, Homo sapiens
ttagatattttccatat

SEQ ID NO: 3437819 - DNA, 18 bp, Homo sapiens
ttagatattttccatata

SEQ ID NO: 3437820 - DNA, 20 bp, Homo sapiens
ttagatattttccatatatt

SEQ ID NO: 3437821 - DNA, 22 bp, Homo sapiens
ttagatattttccatatattgg

SEQ ID NO: 3437822 - DNA, 24 bp, Homo sapiens
ttagatattttccatatattggca

SEQ ID NO: 3437823 - DNA, 15 bp, Homo sapiens
ttagatctggcatgt

SEQ ID NO: 3437824 - DNA, 20 bp, Homo sapiens
ttagatggtggcacattcct

SEQ ID NO: 3437825 - DNA, 21 bp, Homo sapiens
ttagatgttccagtaatctaa

SEQ ID NO: 3437826 - DNA, 13 bp, Homo sapiens
ttagatgttctaa

SEQ ID NO: 3437827 - DNA, 20 bp, Homo sapiens
ttagatgttctaagtctttc

SEQ ID NO: 3437828 - DNA, 18 bp, Homo sapiens
ttagcaaattctgttttt

SEQ ID NO: 3437829 - DNA, 23 bp, Homo sapiens
ttagccatgtgaaactcatctca

SEQ ID NO: 3437830 - DNA, 21 bp, Homo sapiens
ttagccctcacattagatcta

SEQ ID NO: 3437831 - DNA, 17 bp, Homo sapiens
ttagcctgagtagaaag

SEQ ID NO: 3437832 - DNA, 14 bp, Homo sapiens
ttagcctttgaatg

SEQ ID NO: 3437833 - DNA, 21 bp, Homo sapiens
ttagctaaacggattccaaag

SEQ ID NO: 3437834 - DNA, 13 bp, Homo sapiens
ttagctcctgtgg

SEQ ID NO: 3437835 - DNA, 18 bp, Homo sapiens
ttagctgtattcatatat

SEQ ID NO: 3437836 - DNA, 21 bp, Homo sapiens
ttagctgtattcatatattgc

SEQ ID NO: 3437837 - DNA, 12 bp, Homo sapiens
ttagcttcagga

SEQ ID NO: 3437838 - DNA, 15 bp, Homo sapiens
ttagctttactgttt

SEQ ID NO: 3437839 - DNA, 15 bp, Homo sapiens
ttagctttgctctgc

SEQ ID NO: 3437840 - DNA, 19 bp, Homo sapiens
ttagctttgctctgccaac

SEQ ID NO: 3437841 - DNA, 16 bp, Homo sapiens
ttaggattttcacatt

SEQ ID NO: 3437842 - DNA, 14 bp, Homo sapiens
ttaggcagggaagt

SEQ ID NO: 3437843 - DNA, 16 bp, Homo sapiens
ttaggcatttcctgct

SEQ ID NO: 3437844 - DNA, 19 bp, Homo sapiens
ttaggcatttcctgctgaa

SEQ ID NO: 3437845 - DNA, 16 bp, Homo sapiens
ttaggccttcctctct

SEQ ID NO: 3437846 - DNA, 15 bp, Homo sapiens
ttaggctattcacaa

SEQ ID NO: 3437847 - DNA, 16 bp, Homo sapiens
ttaggctattcacaac

SEQ ID NO: 3437848 - DNA, 21 bp, Homo sapiens
ttaggggtggagtccgccaaa

SEQ ID NO: 3437849 - DNA, 20 bp, Homo sapiens
ttagggttggttcctttcca

SEQ ID NO: 3437850 - DNA, 15 bp, Homo sapiens
ttaggtagaaaaaca

SEQ ID NO: 3437851 - DNA, 22 bp, Homo sapiens
ttagtaacataataaattaaaa

SEQ ID NO: 3437852 - DNA, 23 bp, Homo sapiens
ttagtaacatgtgttaagtattt

SEQ ID NO: 3437853 - DNA, 17 bp, Homo sapiens
ttagtagagacagggtt

SEQ ID NO: 3437854 - DNA, 24 bp, Homo sapiens
ttagtcgtgagctcttgtgaggaa

SEQ ID NO: 3437855 - DNA, 15 bp, Homo sapiens
ttagtctaacacagt

SEQ ID NO: 3437856 - DNA, 15 bp, Homo sapiens
ttagtctgcaaaatg

SEQ ID NO: 3437857 - DNA, 19 bp, Homo sapiens
ttagtgccctctttagcca

SEQ ID NO: 3437858 - DNA, 17 bp, Homo sapiens
ttagtgctaagtgtgaa

SEQ ID NO: 3437859 - DNA, 19 bp, Homo sapiens
ttagtggtttatcagcaaa

SEQ ID NO: 3437860 - DNA, 15 bp, Homo sapiens
ttagttactttagat

SEQ ID NO: 3437861 - DNA, 20 bp, Homo sapiens
ttagtttcaagagtctaaac

SEQ ID NO: 3437862 - DNA, 14 bp, Homo sapiens
ttagttttcttgtt

SEQ ID NO: 3437863 - DNA, 12 bp, Homo sapiens
ttataaaacttc

SEQ ID NO: 3437864 - DNA, 16 bp, Homo sapiens
ttataaaattaagcaa

SEQ ID NO: 3437865 - DNA, 18 bp, Homo sapiens
ttataaaatttaacttct

SEQ ID NO: 3437866 - DNA, 19 bp, Homo sapiens
ttataaataaactgttgct

SEQ ID NO: 3437867 - DNA, 14 bp, Homo sapiens
ttataagaaaaact

SEQ ID NO: 3437868 - DNA, 16 bp, Homo sapiens
ttataagaaaaacttt

SEQ ID NO: 3437869 - DNA, 17 bp, Homo sapiens
ttataagaaaaactttt

SEQ ID NO: 3437870 - DNA, 18 bp, Homo sapiens
ttataagtcattgtatgt

SEQ ID NO: 3437871 - DNA, 20 bp, Homo sapiens
ttataatgttgtatttaatt

SEQ ID NO: 3437872 - DNA, 19 bp, Homo sapiens
ttatacaaattagaaaatg

SEQ ID NO: 3437873 - DNA, 15 bp, Homo sapiens
ttatacaatatcatc

SEQ ID NO: 3437874 - DNA, 18 bp, Homo sapiens
ttataccccaataatcaa

SEQ ID NO: 3437875 - DNA, 23 bp, Homo sapiens
ttatactactttgttaggatttt

SEQ ID NO: 3437876 - DNA, 22 bp, Homo sapiens
ttatagatcatttctaggcaaa

SEQ ID NO: 3437877 - DNA, 23 bp, Homo sapiens
ttctcaccagctgcaaagtgttt

SEQ ID NO: 3437878 - DNA, 21 bp, Homo sapiens
ttctcactgccatgccagctt

SEQ ID NO: 3437879 - DNA, 18 bp, Homo sapiens
ttctcagaatccaaagat

SEQ ID NO: 3437880 - DNA, 15 bp, Homo sapiens
ttctcagaatctacc

SEQ ID NO: 3437881 - DNA, 18 bp, Homo sapiens
ttctcagggtctctgctg

SEQ ID NO: 3437882 - DNA, 20 bp, Homo sapiens
ttctcagggtctctgctgcc

SEQ ID NO: 3437883 - DNA, 15 bp, Homo sapiens
ttctcatctttcttg

SEQ ID NO: 3437884 - DNA, 16 bp, Homo sapiens
ttctcatttcacccct

SEQ ID NO: 3437885 - DNA, 18 bp, Homo sapiens
ttctccaaaaatctgcct

SEQ ID NO: 3437886 - DNA, 20 bp, Homo sapiens
ttctccaaactgaagcagcc

SEQ ID NO: 3437887 - DNA, 15 bp, Homo sapiens
ttctccacagcaacc

SEQ ID NO: 3437888 - DNA, 13 bp, Homo sapiens
ttctccaccctgc

SEQ ID NO: 3437889 - DNA, 20 bp, Homo sapiens
ttctccatccacatgggagc

SEQ ID NO: 3437890 - DNA, 15 bp, Homo sapiens
ttctcccctcttctg

SEQ ID NO: 3437891 - DNA, 17 bp, Homo sapiens
ttctcccctgcccccag

SEQ ID NO: 3437892 - DNA, 20 bp, Homo sapiens
ttctccctcatttcaggagc

SEQ ID NO: 3437893 - DNA, 18 bp, Homo sapiens
ttctccgttagctcctgt

SEQ ID NO: 3437894 - DNA, 20 bp, Homo sapiens
ttctccgttagctcctgtgg

SEQ ID NO: 3437895 - DNA, 22 bp, Homo sapiens
ttctccgttagctcctgtggcc

SEQ ID NO: 3437896 - DNA, 13 bp, Homo sapiens
ttctcctcttgta

SEQ ID NO: 3437897 - DNA, 18 bp, Homo sapiens
ttctccttggaggacagt

SEQ ID NO: 3437898 - DNA, 14 bp, Homo sapiens
ttctcctttgtact

SEQ ID NO: 3437899 - DNA, 19 bp, Homo sapiens
ttctctaagagaacaatgt

SEQ ID NO: 3437900 - DNA, 21 bp, Homo sapiens
ttctctacccatctcccccat

SEQ ID NO: 3437901 - DNA, 16 bp, Homo sapiens
ttctctatgataatta

SEQ ID NO: 3437902 - DNA, 20 bp, Homo sapiens
ttctctcaaccttggccttc

SEQ ID NO: 3437903 - DNA, 17 bp, Homo sapiens
ttctctcatctcttagc

SEQ ID NO: 3437904 - DNA, 20 bp, Homo sapiens
ttctctcatctcttagctcc

SEQ ID NO: 3437905 - DNA, 23 bp, Homo sapiens
ttctctgaagagtgggtttcaca

SEQ ID NO: 3437906 - DNA, 17 bp, Homo sapiens
ttctctgacttctgcct

SEQ ID NO: 3437907 - DNA, 23 bp, Homo sapiens
ttctctgccgctacctccctccc

SEQ ID NO: 3437908 - DNA, 12 bp, Homo sapiens
ttctctgggaga

SEQ ID NO: 3437909 - DNA, 23 bp, Homo sapiens
ttctctgggagaaaatcatcaag

SEQ ID NO: 3437910 - DNA, 13 bp, Homo sapiens
ttctctgtacttt

SEQ ID NO: 3437911 - DNA, 13 bp, Homo sapiens
ttctcttgcattg

SEQ ID NO: 3437912 - DNA, 14 bp, Homo sapiens
ttctcttgcattgt

SEQ ID NO: 3437913 - DNA, 22 bp, Homo sapiens
ttctcttgggaactgaactcac

SEQ ID NO: 3437914 - DNA, 22 bp, Homo sapiens
ttctgaatattttatctttcct

SEQ ID NO: 3437915 - DNA, 17 bp, Homo sapiens
ttctgaatttgcaaagt

SEQ ID NO: 3437916 - DNA, 21 bp, Homo sapiens
ttctgaatttgcaaagtactg

SEQ ID NO: 3437917 - DNA, 12 bp, Homo sapiens
ttctgacttgac

SEQ ID NO: 3437918 - DNA, 14 bp, Homo sapiens
ttctgagcatttaa

SEQ ID NO: 3437919 - DNA, 16 bp, Homo sapiens
ttctgagtgccttctg

SEQ ID NO: 3437920 - DNA, 23 bp, Homo sapiens
ttctgataactagatggtgctga

SEQ ID NO: 3437921 - DNA, 15 bp, Homo sapiens
ttctgatcaaggcct

SEQ ID NO: 3437922 - DNA, 13 bp, Homo sapiens
ttctgcacagctt

SEQ ID NO: 3437923 - DNA, 15 bp, Homo sapiens
ttctgcacagctttt

SEQ ID NO: 3437924 - DNA, 18 bp, Homo sapiens
ttctgcaccttgccaggg

SEQ ID NO: 3437925 - DNA, 15 bp, Homo sapiens
ttctgcagtaaatct

SEQ ID NO: 3437926 - DNA, 17 bp, Homo sapiens
ttctgcatatgttgaat

SEQ ID NO: 3437927 - DNA, 14 bp, Homo sapiens
ttctgcatgtacta

SEQ ID NO: 3437928 - DNA, 14 bp, Homo sapiens
ttctgcctccttta

SEQ ID NO: 3437929 - DNA, 18 bp, Homo sapiens
ttctgcctgccagctgca

SEQ ID NO: 3437930 - DNA, 22 bp, Homo sapiens
ttctgcctgccagctgcactga

SEQ ID NO: 3437931 - DNA, 16 bp, Homo sapiens
ttctgcctttgatgtt

SEQ ID NO: 3437932 - DNA, 19 bp, Homo sapiens
ttctgctactggcaaaagg

SEQ ID NO: 3437933 - DNA, 12 bp, Homo sapiens
ttctgctcagct

SEQ ID NO: 3437934 - DNA, 14 bp, Homo sapiens
ttctgctcagctct

SEQ ID NO: 3437935 - DNA, 15 bp, Homo sapiens
ttctgctcagctctg

SEQ ID NO: 3437936 - DNA, 20 bp, Homo sapiens
ttctgctcagctctgggcca

SEQ ID NO: 3437937 - DNA, 19 bp, Homo sapiens
ttctgctcatcattctctg

SEQ ID NO: 3437938 - DNA, 20 bp, Homo sapiens
ttctgctcatcattctctgt

SEQ ID NO: 3437939 - DNA, 21 bp, Homo sapiens
ttctgctcatcattctctgtc

SEQ ID NO: 3437940 - DNA, 18 bp, Homo sapiens
ttctgctggaaacagact

SEQ ID NO: 3437941 - DNA, 16 bp, Homo sapiens
ttctggaaatgttctt

SEQ ID NO: 3437942 - DNA, 18 bp, Homo sapiens
ttctggaatttgttcaag

SEQ ID NO: 3437943 - DNA, 22 bp, Homo sapiens
ttctggacagtcagctcttcat

SEQ ID NO: 3437944 - DNA, 19 bp, Homo sapiens
ttctggcaggtcctcccct

SEQ ID NO: 3437945 - DNA, 14 bp, Homo sapiens
ttctggccaggaag

SEQ ID NO: 3437946 - DNA, 15 bp, Homo sapiens
ttctggcctcccaca

SEQ ID NO: 3437947 - DNA, 10 bp, Homo sapiens
ttctgggaca

SEQ ID NO: 3437948 - DNA, 19 bp, Homo sapiens
ttctgggtggggcagtggg

SEQ ID NO: 3437949 - DNA, 18 bp, Homo sapiens
ttctgggtttgaagctgc

SEQ ID NO: 3437950 - DNA, 15 bp, Homo sapiens
ttctgtaagaaacct

SEQ ID NO: 3437951 - DNA, 23 bp, Homo sapiens
ttctgtacaaagtactagctaaa

SEQ ID NO: 3437952 - DNA, 15 bp, Homo sapiens
ttctgtaccaaaaat

SEQ ID NO: 3437953 - DNA, 19 bp, Homo sapiens
ttctgtaccaaaaatagac

SEQ ID NO: 3437954 - DNA, 20 bp, Homo sapiens
ttctgtagaaatggttgtat

SEQ ID NO: 3437955 - DNA, 21 bp, Homo sapiens
ttctgtagaaatggttgtatt

SEQ ID NO: 3437956 - DNA, 16 bp, Homo sapiens
ttctgtaggttaaaaa

SEQ ID NO: 3437957 - DNA, 18 bp, Homo sapiens
ttctgtattttgtttttg

SEQ ID NO: 3437958 - DNA, 13 bp, Homo sapiens
ttctgtcactcag

SEQ ID NO: 3437959 - DNA, 16 bp, Homo sapiens
ttctgtcactcaggct

SEQ ID NO: 3437960 - DNA, 14 bp, Homo sapiens
ttctgtcccttctg

SEQ ID NO: 3437961 - DNA, 17 bp, Homo sapiens
ttctgtccgagctttga

SEQ ID NO: 3437962 - DNA, 15 bp, Homo sapiens
ttctgtctactaagt

SEQ ID NO: 3437963 - DNA, 22 bp, Homo sapiens
ttctgtcttgttcattttgagt

SEQ ID NO: 3437964 - DNA, 14 bp, Homo sapiens
ttctgtgtatctct

SEQ ID NO: 3437965 - DNA, 13 bp, Homo sapiens
ttctgtttttaat

SEQ ID NO: 3437966 - DNA, 21 bp, Homo sapiens
ttcttaaaaatattttttctg

SEQ ID NO: 3437967 - DNA, 16 bp, Homo sapiens
ttcttaaacacttgca

SEQ ID NO: 3437968 - DNA, 17 bp, Homo sapiens
ttcttaacaaactcttc

SEQ ID NO: 3437969 - DNA, 23 bp, Homo sapiens
ttcttaaggtgaggcctgtctgt

SEQ ID NO: 3437970 - DNA, 22 bp, Homo sapiens
ttcttagttactttggaacact

SEQ ID NO: 3437971 - DNA, 18 bp, Homo sapiens
ttcttatggaattgattt

SEQ ID NO: 3437972 - DNA, 14 bp, Homo sapiens
ttcttattacccaa

SEQ ID NO: 3437973 - DNA, 16 bp, Homo sapiens
ttcttcacctcttcca

SEQ ID NO: 3437974 - DNA, 22 bp, Homo sapiens
ttcttcccttttacatactgct

SEQ ID NO: 3437975 - DNA, 13 bp, Homo sapiens
ttcttctgcttca

SEQ ID NO: 3437976 - DNA, 13 bp, Homo sapiens
ttcttgaattttt

SEQ ID NO: 3437977 - DNA, 16 bp, Homo sapiens
ttcttgcaaatacctc

SEQ ID NO: 3437978 - DNA, 16 bp, Homo sapiens
ttcttgcctctgtgct

SEQ ID NO: 3437979 - DNA, 16 bp, Homo sapiens
ttcttggttgaggaaa

SEQ ID NO: 3437980 - DNA, 22 bp, Homo sapiens
ttcttggttgaggaaacaaaca

SEQ ID NO: 3437981 - DNA, 16 bp, Homo sapiens
ttcttggttggctggc

SEQ ID NO: 3437982 - DNA, 14 bp, Homo sapiens
ttcttgtgcttttc

SEQ ID NO: 3437983 - DNA, 12 bp, Homo sapiens
ttcttgttgctt

SEQ ID NO: 3437984 - DNA, 15 bp, Homo sapiens
ttcttgtttccttgt

SEQ ID NO: 3437985 - DNA, 20 bp, Homo sapiens
ttctttaaaatgtaaagcca

SEQ ID NO: 3437986 - DNA, 22 bp, Homo sapiens
ttctttaaagaagttgaagttt

SEQ ID NO: 3437987 - DNA, 15 bp, Homo sapiens
ttctttactattaaa

SEQ ID NO: 3437988 - DNA, 17 bp, Homo sapiens
ttctttactattaaaat

SEQ ID NO: 3437989 - DNA, 23 bp, Homo sapiens
ttctttagatggtggcacattcc

SEQ ID NO: 3437990 - DNA, 13 bp, Homo sapiens
ttctttattcttt

SEQ ID NO: 3437991 - DNA, 14 bp, Homo sapiens
ttctttgctgtaag

SEQ ID NO: 3437992 - DNA, 15 bp, Homo sapiens
ttctttgctgtaaga

SEQ ID NO: 3437993 - DNA, 16 bp, Homo sapiens
ttctttgctgtaagat

SEQ ID NO: 3437994 - DNA, 22 bp, Homo sapiens
ttctttggccccttgctggagt

SEQ ID NO: 3437995 - DNA, 22 bp, Homo sapiens
ttctttggtggagataaagatt

SEQ ID NO: 3437996 - DNA, 12 bp, Homo sapiens
ttcttttgtaaa

SEQ ID NO: 3437997 - DNA, 19 bp, Homo sapiens
ttctttttctgagacagct

SEQ ID NO: 3437998 - DNA, 14 bp, Homo sapiens
ttctttttttaact

SEQ ID NO: 3437999 - DNA, 18 bp, Homo sapiens
ttgaaaaagttaatgctt

SEQ ID NO: 3438000 - DNA, 19 bp, Homo sapiens
ttgaaaccaccttttatta

SEQ ID NO: 3438001 - DNA, 16 bp, Homo sapiens
ttgaaagaattatcct

SEQ ID NO: 3438002 - DNA, 22 bp, Homo sapiens
ttgaaagctgtggccagcttgt

SEQ ID NO: 3438003 - DNA, 20 bp, Homo sapiens
ttgaaaggcattctctgaag

SEQ ID NO: 3438004 - DNA, 21 bp, Homo sapiens
ttgaaaggcattctctgaaga

SEQ ID NO: 3438005 - DNA, 21 bp, Homo sapiens
ttgaaataactggaacaaatt

SEQ ID NO: 3438006 - DNA, 18 bp, Homo sapiens
ttgaaatatcctgcttga

SEQ ID NO: 3438007 - DNA, 20 bp, Homo sapiens
ttgaaatgcattgctctgga

SEQ ID NO: 3438008 - DNA, 19 bp, Homo sapiens
ttgaaatgtggttttcctg

SEQ ID NO: 3438009 - DNA, 12 bp, Homo sapiens
tttcataatctt

SEQ ID NO: 3438010 - DNA, 14 bp, Homo sapiens
tttcataatctttg

SEQ ID NO: 3438011 - DNA, 13 bp, Homo sapiens
tttcatattcttt

SEQ ID NO: 3438012 - DNA, 20 bp, Homo sapiens
tttcatccactagtgcaaat

SEQ ID NO: 3438013 - DNA, 19 bp, Homo sapiens
tttcatccccttaccctta

SEQ ID NO: 3438014 - DNA, 16 bp, Homo sapiens
tttcatctgctctcct

SEQ ID NO: 3438015 - DNA, 19 bp, Homo sapiens
tttcatctgctctccttcc

SEQ ID NO: 3438016 - DNA, 19 bp, Homo sapiens
tttcatgtaaactgtgcac

SEQ ID NO: 3438017 - DNA, 18 bp, Homo sapiens
tttcatgtacaagatgaa

SEQ ID NO: 3438018 - DNA, 23 bp, Homo sapiens
tttcatgtgcggggatcatctgc

SEQ ID NO: 3438019 - DNA, 14 bp, Homo sapiens
tttcatgttggttt

SEQ ID NO: 3438020 - DNA, 13 bp, Homo sapiens
tttcattccctgt

SEQ ID NO: 3438021 - DNA, 22 bp, Homo sapiens
tttcattgctgggcttgtctgt

SEQ ID NO: 3438022 - DNA, 11 bp, Homo sapiens
tttccaaagag

SEQ ID NO: 3438023 - DNA, 19 bp, Homo sapiens
tttccaatgcttcttataa

SEQ ID NO: 3438024 - DNA, 23 bp, Homo sapiens
tttccaccacagccagcacctgg

SEQ ID NO: 3438025 - DNA, 14 bp, Homo sapiens
tttccactactgct

SEQ ID NO: 3438026 - DNA, 15 bp, Homo sapiens
tttccactactgcta

SEQ ID NO: 3438027 - DNA, 14 bp, Homo sapiens
tttccactattttc

SEQ ID NO: 3438028 - DNA, 20 bp, Homo sapiens
tttccactattttcaaagaa

SEQ ID NO: 3438029 - DNA, 19 bp, Homo sapiens
tttccagacttccttgaga

SEQ ID NO: 3438030 - DNA, 23 bp, Homo sapiens
tttccagcagaagacaaaaagac

SEQ ID NO: 3438031 - DNA, 20 bp, Homo sapiens
tttccagtctccaccaggaa

SEQ ID NO: 3438032 - DNA, 17 bp, Homo sapiens
tttccatatattggcac

SEQ ID NO: 3438033 - DNA, 21 bp, Homo sapiens
tttccatggcaggaaggcttg

SEQ ID NO: 3438034 - DNA, 22 bp, Homo sapiens
tttccatgggaccacaactatt

SEQ ID NO: 3438035 - DNA, 21 bp, Homo sapiens
tttccattggtttacctgtga

SEQ ID NO: 3438036 - DNA, 12 bp, Homo sapiens
tttcccaattca

SEQ ID NO: 3438037 - DNA, 11 bp, Homo sapiens
tttcccaggac

SEQ ID NO: 3438038 - DNA, 16 bp, Homo sapiens
tttcccaggaccctga

SEQ ID NO: 3438039 - DNA, 18 bp, Homo sapiens
tttcccaggaccctgaag

SEQ ID NO: 3438040 - DNA, 12 bp, Homo sapiens
tttccccttcct

SEQ ID NO: 3438041 - DNA, 16 bp, Homo sapiens
tttccctattagagaa

SEQ ID NO: 3438042 - DNA, 16 bp, Homo sapiens
tttccgtttgcttttg

SEQ ID NO: 3438043 - DNA, 15 bp, Homo sapiens
tttcctaaggctgca

SEQ ID NO: 3438044 - DNA, 23 bp, Homo sapiens
tttcctaataaagttctgtactc

SEQ ID NO: 3438045 - DNA, 15 bp, Homo sapiens
tttcctatgctattg

SEQ ID NO: 3438046 - DNA, 15 bp, Homo sapiens
tttcctatgctttga

SEQ ID NO: 3438047 - DNA, 16 bp, Homo sapiens
tttcctatttcagtgt

SEQ ID NO: 3438048 - DNA, 11 bp, Homo sapiens
tttcctcagtg

SEQ ID NO: 3438049 - DNA, 11 bp, Homo sapiens
tttcctccctt

SEQ ID NO: 3438050 - DNA, 20 bp, Homo sapiens
tttcctcccttctgctactg

SEQ ID NO: 3438051 - DNA, 18 bp, Homo sapiens
tttcctcctcaggcacac

SEQ ID NO: 3438052 - DNA, 12 bp, Homo sapiens
tttcctcctctg

SEQ ID NO: 3438053 - DNA, 14 bp, Homo sapiens
tttcctccttccat

SEQ ID NO: 3438054 - DNA, 21 bp, Homo sapiens
tttcctgaaacaacttggaaa

SEQ ID NO: 3438055 - DNA, 23 bp, Homo sapiens
tttcctggcactggaccccagca

SEQ ID NO: 3438056 - DNA, 22 bp, Homo sapiens
tttccttatcacccccttgttg

SEQ ID NO: 3438057 - DNA, 15 bp, Homo sapiens
tttccttctcatctg

SEQ ID NO: 3438058 - DNA, 18 bp, Homo sapiens
tttccttctcatctgtga

SEQ ID NO: 3438059 - DNA, 21 bp, Homo sapiens
tttcctttttaaggtctttca

SEQ ID NO: 3438060 - DNA, 20 bp, Homo sapiens
tttccttttttcccataaga

SEQ ID NO: 3438061 - DNA, 22 bp, Homo sapiens
tttccttttttcccataagaca

SEQ ID NO: 3438062 - DNA, 13 bp, Homo sapiens
tttcgaggcctga

SEQ ID NO: 3438063 - DNA, 13 bp, Homo sapiens
tttcgcctttcct

SEQ ID NO: 3438064 - DNA, 16 bp, Homo sapiens
tttcgtctactgcaag

SEQ ID NO: 3438065 - DNA, 13 bp, Homo sapiens
tttcgtggggagg

SEQ ID NO: 3438066 - DNA, 18 bp, Homo sapiens
tttctaaagttgtagtga

SEQ ID NO: 3438067 - DNA, 19 bp, Homo sapiens
tttctaacaattttcagac

SEQ ID NO: 3438068 - DNA, 21 bp, Homo sapiens
tttctaataaacttggattct

SEQ ID NO: 3438069 - DNA, 15 bp, Homo sapiens
tttctaattaacctt

SEQ ID NO: 3438070 - DNA, 21 bp, Homo sapiens
tttctacccaacggccctgca

SEQ ID NO: 3438071 - DNA, 18 bp, Homo sapiens
tttctactttgaagtcat

SEQ ID NO: 3438072 - DNA, 15 bp, Homo sapiens
tttctagatacaata

SEQ ID NO: 3438073 - DNA, 20 bp, Homo sapiens
tttctagatacaataaattg

SEQ ID NO: 3438074 - DNA, 23 bp, Homo sapiens
tttctagatacaataaattgcta

SEQ ID NO: 3438075 - DNA, 21 bp, Homo sapiens
tttctagctgttgagctgttt

SEQ ID NO: 3438076 - DNA, 18 bp, Homo sapiens
tttctaggcaaaattgtg

SEQ ID NO: 3438077 - DNA, 19 bp, Homo sapiens
tttctaggcaaaattgtga

SEQ ID NO: 3438078 - DNA, 14 bp, Homo sapiens
tttctagggaaatg

SEQ ID NO: 3438079 - DNA, 18 bp, Homo sapiens
tttctagggaaatgaaag

SEQ ID NO: 3438080 - DNA, 21 bp, Homo sapiens
tttctatgagtggaaaaagcc

SEQ ID NO: 3438081 - DNA, 14 bp, Homo sapiens
tttctatttcataa

SEQ ID NO: 3438082 - DNA, 20 bp, Homo sapiens
tttctcagaatccaaagatc

SEQ ID NO: 3438083 - DNA, 14 bp, Homo sapiens
tttctcattaacaa

SEQ ID NO: 3438084 - DNA, 15 bp, Homo sapiens
tttctccagggtcag

SEQ ID NO: 3438085 - DNA, 24 bp, Homo sapiens
tttctcccctgcccccaggactgg

SEQ ID NO: 3438086 - DNA, 14 bp, Homo sapiens
tttctcctccatgg

SEQ ID NO: 3438087 - DNA, 22 bp, Homo sapiens
tttctcgctgtcctttctagag

SEQ ID NO: 3438088 - DNA, 23 bp, Homo sapiens
tttctctgccgctacctccctcc

SEQ ID NO: 3438089 - DNA, 16 bp, Homo sapiens
tttctctgtacttttc

SEQ ID NO: 3438090 - DNA, 21 bp, Homo sapiens
tttctcttagaacattgtatt

SEQ ID NO: 3438091 - DNA, 14 bp, Homo sapiens
tttctcttttcaca

SEQ ID NO: 3438092 - DNA, 21 bp, Homo sapiens
tttctcttttcccctttcctg

SEQ ID NO: 3438093 - DNA, 23 bp, Homo sapiens
tttctgataactagatggtgctg

SEQ ID NO: 3438094 - DNA, 15 bp, Homo sapiens
tttctgatcaaggcc

SEQ ID NO: 3438095 - DNA, 14 bp, Homo sapiens
tttctgcacagctt

SEQ ID NO: 3438096 - DNA, 20 bp, Homo sapiens
tttctgcacagcttttccaa

SEQ ID NO: 3438097 - DNA, 15 bp, Homo sapiens
tttctgctcagcttc

SEQ ID NO: 3438098 - DNA, 16 bp, Homo sapiens
tttctggaaatgttct

SEQ ID NO: 3438099 - DNA, 17 bp, Homo sapiens
tttctgtgccctcctga

SEQ ID NO: 3438100 - DNA, 23 bp, Homo sapiens
tttcttaaggtgaggcctgtctg

SEQ ID NO: 3438101 - DNA, 14 bp, Homo sapiens
tttcttagaaattt

SEQ ID NO: 3438102 - DNA, 12 bp, Homo sapiens
tttcttctgggc

SEQ ID NO: 3438103 - DNA, 14 bp, Homo sapiens
tttcttgaattttt

SEQ ID NO: 3438104 - DNA, 18 bp, Homo sapiens
tttcttgcctctgtcccc

SEQ ID NO: 3438105 - DNA, 18 bp, Homo sapiens
tttctttaatgcttttat

SEQ ID NO: 3438106 - DNA, 23 bp, Homo sapiens
tttctttgggaatatttgaatct

SEQ ID NO: 3438107 - DNA, 13 bp, Homo sapiens
tttctttttgaat

SEQ ID NO: 3438108 - DNA, 18 bp, Homo sapiens
tttgaaattaacctctca

SEQ ID NO: 3438109 - DNA, 16 bp, Homo sapiens
tttgaaattctgaatt

SEQ ID NO: 3438110 - DNA, 17 bp, Homo sapiens
tttgaaattctgaattt

SEQ ID NO: 3438111 - DNA, 18 bp, Homo sapiens
tttgaaattctgaatttg

SEQ ID NO: 3438112 - DNA, 21 bp, Homo sapiens
tttgaaattctgaatttgcaa

SEQ ID NO: 3438113 - DNA, 18 bp, Homo sapiens
tttgaagctactgtgtgt

SEQ ID NO: 3438114 - DNA, 11 bp, Homo sapiens
tttgaagtgta

SEQ ID NO: 3438115 - DNA, 18 bp, Homo sapiens
tttgaagtgtaggcagac

SEQ ID NO: 3438116 - DNA, 16 bp, Homo sapiens
tttgaataaagaatac

SEQ ID NO: 3438117 - DNA, 21 bp, Homo sapiens
tttgaatcttgtctcaatgct

SEQ ID NO: 3438118 - DNA, 16 bp, Homo sapiens
tttgaatgtaaccaat

SEQ ID NO: 3438119 - DNA, 13 bp, Homo sapiens
tttgaatgttaaa

SEQ ID NO: 3438120 - DNA, 22 bp, Homo sapiens
tttgaatgttaaataaattgta

SEQ ID NO: 3438121 - DNA, 22 bp, Homo sapiens
tttgacacttccattgtttaaa

SEQ ID NO: 3438122 - DNA, 15 bp, Homo sapiens
tttgaccaatttgca

SEQ ID NO: 3438123 - DNA, 18 bp, Homo sapiens
tttgaccttcatttcatg

SEQ ID NO: 3438124 - DNA, 19 bp, Homo sapiens
tttgaccttttatgtagta

SEQ ID NO: 3438125 - DNA, 21 bp, Homo sapiens
tttgactaattttacatgttt

SEQ ID NO: 3438126 - DNA, 20 bp, Homo sapiens
tttgactctggcaaagcttt

SEQ ID NO: 3438127 - DNA, 21 bp, Homo sapiens
tttgactctggcaaagctttt

SEQ ID NO: 3438128 - DNA, 14 bp, Homo sapiens
tttgacttaatgtg

SEQ ID NO: 3438129 - DNA, 15 bp, Homo sapiens
tttgactttaattta

SEQ ID NO: 3438130 - DNA, 18 bp, Homo sapiens
tttgactttcttctgaat

SEQ ID NO: 3438131 - DNA, 11 bp, Homo sapiens
tttgaggataa

SEQ ID NO: 3438132 - DNA, 13 bp, Homo sapiens
tttgagtgctctg

SEQ ID NO: 3438133 - DNA, 16 bp, Homo sapiens
tttgagtggatgatgt

SEQ ID NO: 3438134 - DNA, 21 bp, Homo sapiens
tttgagtggatgatgtttcgt

SEQ ID NO: 3438135 - DNA, 21 bp, Homo sapiens
tttgatacataaacttttgca

SEQ ID NO: 3438136 - DNA, 21 bp, Homo sapiens
tttgatgaggtattttttcct

SEQ ID NO: 3438137 - DNA, 15 bp, Homo sapiens
tttgattaggtatgt

SEQ ID NO: 3438138 - DNA, 22 bp, Homo sapiens
tttgattagttttcttgttgct

SEQ ID NO: 3438139 - DNA, 15 bp, Homo sapiens
tttgattcaaaatat

SEQ ID NO: 3438140 - DNA, 22 bp, Homo sapiens
tttgattcaaaatatttaaaaa

SEQ ID NO: 3438141 - DNA, 23 bp, Homo sapiens
caactttgaataaagaatacttg

SEQ ID NO: 3438142 - DNA, 16 bp, Homo sapiens
caactttttattgcct

SEQ ID NO: 3438143 - DNA, 18 bp, Homo sapiens
caactttttattgccttc

SEQ ID NO: 3438144 - DNA, 21 bp, Homo sapiens
caactttttattgccttctca

SEQ ID NO: 3438145 - DNA, 23 bp, Homo sapiens
caactttttattgccttctcacc

SEQ ID NO: 3438146 - DNA, 22 bp, Homo sapiens
caagaaagaaacccgacagagg

SEQ ID NO: 3438147 - DNA, 21 bp, Homo sapiens
ttctctaacttcaaggcccat

SEQ ID NO: 3438148 - DNA, 16 bp, Homo sapiens
ttctctaataagaaaa

SEQ ID NO: 3438149 - DNA, 20 bp, Homo sapiens
ttctctacccatctccccca

SEQ ID NO: 3438150 - DNA, 21 bp, Homo sapiens
ttctctataaaaaatatgtat

SEQ ID NO: 3438151 - DNA, 13 bp, Homo sapiens
ttctctatcattt

SEQ ID NO: 3438152 - DNA, 23 bp, Homo sapiens
ttctctcaaccttggccttctcc

SEQ ID NO: 3438153 - DNA, 23 bp, Homo sapiens
ttctctcatctcttagctcccct

SEQ ID NO: 3438154 - DNA, 16 bp, Homo sapiens
ttctctccaatttaac

SEQ ID NO: 3438155 - DNA, 17 bp, Homo sapiens
ttctctcctgtcctccc

SEQ ID NO: 3438156 - DNA, 21 bp, Homo sapiens
ttctctcctgtcctccctcac

SEQ ID NO: 3438157 - DNA, 16 bp, Homo sapiens
ttctctgacttctgcc

SEQ ID NO: 3438158 - DNA, 20 bp, Homo sapiens
ttctctgaggacactaacca

SEQ ID NO: 3438159 - DNA, 22 bp, Homo sapiens
ttctctgagtatctcctcgcaa

SEQ ID NO: 3438160 - DNA, 22 bp, Homo sapiens
ttctctgccgctacctccctcc

SEQ ID NO: 3438161 - DNA, 19 bp, Homo sapiens
ttctctgggagaaaatcat

SEQ ID NO: 3438162 - DNA, 20 bp, Homo sapiens
ttctctgggagaaaatcatc

SEQ ID NO: 3438163 - DNA, 14 bp, Homo sapiens
ttctctgtactttt

SEQ ID NO: 3438164 - DNA, 14 bp, Homo sapiens
ttctctgtatagta

SEQ ID NO: 3438165 - DNA, 20 bp, Homo sapiens
ttctctgtgaacgatttaga

SEQ ID NO: 3438166 - DNA, 17 bp, Homo sapiens
ttctcttttcacagcaa

SEQ ID NO: 3438167 - DNA, 20 bp, Homo sapiens
ttctcttttcccctttcctg

SEQ ID NO: 3438168 - DNA, 13 bp, Homo sapiens
ttctgaaacctta

SEQ ID NO: 3438169 - DNA, 21 bp, Homo sapiens
ttctgaatgggcaattccaga

SEQ ID NO: 3438170 - DNA, 16 bp, Homo sapiens
ttctgaatttgcaaag

SEQ ID NO: 3438171 - DNA, 22 bp, Homo sapiens
ttctgagtgccttctgtgggga

SEQ ID NO: 3438172 - DNA, 14 bp, Homo sapiens
ttctgatcaaggcc

SEQ ID NO: 3438173 - DNA, 18 bp, Homo sapiens
ttctgatgatgtgcctgg

SEQ ID NO: 3438174 - DNA, 19 bp, Homo sapiens
ttctgcaaaaatatttata

SEQ ID NO: 3438175 - DNA, 21 bp, Homo sapiens
ttctgcaagcacatctgcatt

SEQ ID NO: 3438176 - DNA, 11 bp, Homo sapiens
ttctgcacagc

SEQ ID NO: 3438177 - DNA, 20 bp, Homo sapiens
ttctgcacagcttttccaaa

SEQ ID NO: 3438178 - DNA, 22 bp, Homo sapiens
ttctgcacagcttttccaaaat

SEQ ID NO: 3438179 - DNA, 18 bp, Homo sapiens
ttctgcagtaaatctttt

SEQ ID NO: 3438180 - DNA, 16 bp, Homo sapiens
ttctgcatgtactagt

SEQ ID NO: 3438181 - DNA, 12 bp, Homo sapiens
ttctgcatttag

SEQ ID NO: 3438182 - DNA, 15 bp, Homo sapiens
ttctgcatttagctg

SEQ ID NO: 3438183 - DNA, 21 bp, Homo sapiens
ttctgcatttagctgtattca

SEQ ID NO: 3438184 - DNA, 15 bp, Homo sapiens
ttctgccatattctg

SEQ ID NO: 3438185 - DNA, 17 bp, Homo sapiens
ttctgccggccctgggg

SEQ ID NO: 3438186 - DNA, 18 bp, Homo sapiens
ttctgccggccctggggc

SEQ ID NO: 3438187 - DNA, 16 bp, Homo sapiens
ttctgcctctccaggc

SEQ ID NO: 3438188 - DNA, 12 bp, Homo sapiens
ttctgcctgcca

SEQ ID NO: 3438189 - DNA, 16 bp, Homo sapiens
ttctgcctgccagctg

SEQ ID NO: 3438190 - DNA, 15 bp, Homo sapiens
ttctgcctgcccagg

SEQ ID NO: 3438191 - DNA, 16 bp, Homo sapiens
ttctgcctgcccaggc

SEQ ID NO: 3438192 - DNA, 21 bp, Homo sapiens
ttctgcctgcccaggcccctg

SEQ ID NO: 3438193 - DNA, 19 bp, Homo sapiens
ttctgctcacatatctgtc

SEQ ID NO: 3438194 - DNA, 14 bp, Homo sapiens
ttctgcttcagcct

SEQ ID NO: 3438195 - DNA, 17 bp, Homo sapiens
ttctggaatttgttcaa

SEQ ID NO: 3438196 - DNA, 19 bp, Homo sapiens
ttctggaatttgttcaagt

SEQ ID NO: 3438197 - DNA, 21 bp, Homo sapiens
ttctggattccccatctcagg

SEQ ID NO: 3438198 - DNA, 20 bp, Homo sapiens
ttctggattttgtcaagcag

SEQ ID NO: 3438199 - DNA, 15 bp, Homo sapiens
ttctggccaggaagc

SEQ ID NO: 3438200 - DNA, 10 bp, Homo sapiens
ttctggctca

SEQ ID NO: 3438201 - DNA, 11 bp, Homo sapiens
ttctgggacac

SEQ ID NO: 3438202 - DNA, 21 bp, Homo sapiens
ttctgggagggcagcagggct

SEQ ID NO: 3438203 - DNA, 20 bp, Homo sapiens
ttctggggaaaggggacaag

SEQ ID NO: 3438204 - DNA, 21 bp, Homo sapiens
ttctgggtttgaagctgctgt

SEQ ID NO: 3438205 - DNA, 21 bp, Homo sapiens
ttctggtctctaggctgggga

SEQ ID NO: 3438206 - DNA, 20 bp, Homo sapiens
ttctggtggtttgattgttt

SEQ ID NO: 3438207 - DNA, 21 bp, Homo sapiens
ttctggtgttttatttcctat

SEQ ID NO: 3438208 - DNA, 15 bp, Homo sapiens
ttctggttccagggt

SEQ ID NO: 3438209 - DNA, 18 bp, Homo sapiens
ttctgtactcaaatgtag

SEQ ID NO: 3438210 - DNA, 14 bp, Homo sapiens
ttctgtagaaatgg

SEQ ID NO: 3438211 - DNA, 15 bp, Homo sapiens
ttctgtatatacttt

SEQ ID NO: 3438212 - DNA, 21 bp, Homo sapiens
ttctgtattttttgtttgtat

SEQ ID NO: 3438213 - DNA, 22 bp, Homo sapiens
ttctgtattttttgtttgtatt

SEQ ID NO: 3438214 - DNA, 15 bp, Homo sapiens
ttctgtccctcacag

SEQ ID NO: 3438215 - DNA, 21 bp, Homo sapiens
ttctgtccgagctttgaaaat

SEQ ID NO: 3438216 - DNA, 19 bp, Homo sapiens
ttctgtcctactctgtgtc

SEQ ID NO: 3438217 - DNA, 13 bp, Homo sapiens
ttctgtcctgctg

SEQ ID NO: 3438218 - DNA, 16 bp, Homo sapiens
ttctgtctactaagtg

SEQ ID NO: 3438219 - DNA, 11 bp, Homo sapiens
ttctgtctcca

SEQ ID NO: 3438220 - DNA, 13 bp, Homo sapiens
ttctgtctccagc

SEQ ID NO: 3438221 - DNA, 13 bp, Homo sapiens
ttctgtcttccca

SEQ ID NO: 3438222 - DNA, 13 bp, Homo sapiens
ttctgtgccctcc

SEQ ID NO: 3438223 - DNA, 23 bp, Homo sapiens
ttctgtggggcccctcacctact

SEQ ID NO: 3438224 - DNA, 21 bp, Homo sapiens
ttctgtgtatctctttcacat

SEQ ID NO: 3438225 - DNA, 15 bp, Homo sapiens
ttctgttctggagga

SEQ ID NO: 3438226 - DNA, 21 bp, Homo sapiens
ttctgttggccagtgtgacaa

SEQ ID NO: 3438227 - DNA, 11 bp, Homo sapiens
ttctgtttctt

SEQ ID NO: 3438228 - DNA, 12 bp, Homo sapiens
ttctgtttgtta

SEQ ID NO: 3438229 - DNA, 20 bp, Homo sapiens
ttctgtttttctaggcctgg

SEQ ID NO: 3438230 - DNA, 21 bp, Homo sapiens
ttcttaaatgggctactttgt

SEQ ID NO: 3438231 - DNA, 16 bp, Homo sapiens
ttcttaacaaactctt

SEQ ID NO: 3438232 - DNA, 14 bp, Homo sapiens
ttcttacatgtttt

SEQ ID NO: 3438233 - DNA, 22 bp, Homo sapiens
ttcttagaaatttatttcctag

SEQ ID NO: 3438234 - DNA, 17 bp, Homo sapiens
ttcttatggaattgatt

SEQ ID NO: 3438235 - DNA, 18 bp, Homo sapiens
ttcttcagcttgatcctg

SEQ ID NO: 3438236 - DNA, 22 bp, Homo sapiens
ttcttcccttttaaacacattt

SEQ ID NO: 3438237 - DNA, 14 bp, Homo sapiens
ttcttcgaaaatct

SEQ ID NO: 3438238 - DNA, 23 bp, Homo sapiens
ttcttctatgtaggaaaaaaata

SEQ ID NO: 3438239 - DNA, 20 bp, Homo sapiens
ttcttctgtcctgagaagca

SEQ ID NO: 3438240 - DNA, 15 bp, Homo sapiens
ttcttgaaagctgtg

SEQ ID NO: 3438241 - DNA, 21 bp, Homo sapiens
ttcttgaatttttttctgcac

SEQ ID NO: 3438242 - DNA, 20 bp, Homo sapiens
ttcttgcctctgtccccttc

SEQ ID NO: 3438243 - DNA, 20 bp, Homo sapiens
ttcttggttggctggccttc

SEQ ID NO: 3438244 - DNA, 19 bp, Homo sapiens
ttcttgtaaggctttgatt

SEQ ID NO: 3438245 - DNA, 14 bp, Homo sapiens
ttctttaaagaagt

SEQ ID NO: 3438246 - DNA, 12 bp, Homo sapiens
ttctttaatgct

SEQ ID NO: 3438247 - DNA, 18 bp, Homo sapiens
ttctttaatgcttttata

SEQ ID NO: 3438248 - DNA, 13 bp, Homo sapiens
ttctttagaattt

SEQ ID NO: 3438249 - DNA, 16 bp, Homo sapiens
ttctttagaattttta

SEQ ID NO: 3438250 - DNA, 14 bp, Homo sapiens
ttctttatttttgt

SEQ ID NO: 3438251 - DNA, 14 bp, Homo sapiens
ttctttcttagaaa

SEQ ID NO: 3438252 - DNA, 16 bp, Homo sapiens
ttctttctttgggaat

SEQ ID NO: 3438253 - DNA, 12 bp, Homo sapiens
ttctttgcaaag

SEQ ID NO: 3438254 - DNA, 18 bp, Homo sapiens
ttctttgggaatatttga

SEQ ID NO: 3438255 - DNA, 17 bp, Homo sapiens
ttctttgtaccatctgt

SEQ ID NO: 3438256 - DNA, 12 bp, Homo sapiens
ttcttttgaatt

SEQ ID NO: 3438257 - DNA, 18 bp, Homo sapiens
ttcttttgtatgtaaatg

SEQ ID NO: 3438258 - DNA, 15 bp, Homo sapiens
ttctttttattttct

SEQ ID NO: 3438259 - DNA, 12 bp, Homo sapiens
ttctttttgggg

SEQ ID NO: 3438260 - DNA, 15 bp, Homo sapiens
ttctttttttaactg

SEQ ID NO: 3438261 - DNA, 22 bp, Homo sapiens
ttcttttttttttttttgagac

SEQ ID NO: 3438262 - DNA, 20 bp, Homo sapiens
ttgaaaaaatagagcctgag

SEQ ID NO: 3438263 - DNA, 21 bp, Homo sapiens
ttgaaaataagaatagaaata

SEQ ID NO: 3438264 - DNA, 21 bp, Homo sapiens
ttgaaaatcttataatttaaa

SEQ ID NO: 3438265 - DNA, 15 bp, Homo sapiens
ttgaaacagaaaaat

SEQ ID NO: 3438266 - DNA, 19 bp, Homo sapiens
ttgaaaggcattctctgaa

SEQ ID NO: 3438267 - DNA, 16 bp, Homo sapiens
ttgaaataactggaac

SEQ ID NO: 3438268 - DNA, 18 bp, Homo sapiens
ttgaaatgcattgctctg

SEQ ID NO: 3438269 - DNA, 20 bp, Homo sapiens
ttgaaattaagaaggcaaaa

SEQ ID NO: 3438270 - DNA, 14 bp, Homo sapiens
ttgaacacaaactg

SEQ ID NO: 3438271 - DNA, 16 bp, Homo sapiens
ttgaaccccaaatgct

SEQ ID NO: 3438272 - DNA, 23 bp, Homo sapiens
ttgaaccccaaatgctctctctt

SEQ ID NO: 3438273 - DNA, 16 bp, Homo sapiens
ttgaactcctggcctc

SEQ ID NO: 3438274 - DNA, 18 bp, Homo sapiens
ttgaactgggtacttgtg

SEQ ID NO: 3438275 - DNA, 20 bp, Homo sapiens
ttgaacttttcattccctgt

SEQ ID NO: 3438276 - DNA, 18 bp, Homo sapiens
ttgaagatagtaactgta

SEQ ID NO: 3438277 - DNA, 17 bp, Homo sapiens
ttgaagggaaatttcag

SEQ ID NO: 3438278 - DNA, 20 bp, Homo sapiens
ttgaagggaggggctgtgtt

SEQ ID NO: 3438279 - DNA, 19 bp, Homo sapiens
ttgaagggccagagccagg

SEQ ID NO: 3438280 - DNA, 23 bp, Homo sapiens
ttgaaggtgctgacggccaggga

SEQ ID NO: 3438281 - DNA, 18 bp, Homo sapiens
ttgaagtgtaggcagaca

SEQ ID NO: 3438282 - DNA, 21 bp, Homo sapiens
ttgaataaaaactttgctaaa

SEQ ID NO: 3438283 - DNA, 18 bp, Homo sapiens
ttgaataaagaatacttg

SEQ ID NO: 3438284 - DNA, 22 bp, Homo sapiens
ttgaataaagaatacttgaact

SEQ ID NO: 3438285 - DNA, 12 bp, Homo sapiens
ttgaataataag

SEQ ID NO: 3438286 - DNA, 16 bp, Homo sapiens
ttgaatactctgccct

SEQ ID NO: 3438287 - DNA, 12 bp, Homo sapiens
ttgaatactttt

SEQ ID NO: 3438288 - DNA, 20 bp, Homo sapiens
ttgaatataatatatttgtg

SEQ ID NO: 3438289 - DNA, 15 bp, Homo sapiens
ttgaatctatttaag

SEQ ID NO: 3438290 - DNA, 17 bp, Homo sapiens
ttgaatctatttaagta

SEQ ID NO: 3438291 - DNA, 16 bp, Homo sapiens
ttgaatcttgtctcaa

SEQ ID NO: 3438292 - DNA, 20 bp, Homo sapiens
ttgaatcttgtctcaatgct

SEQ ID NO: 3438293 - DNA, 22 bp, Homo sapiens
ttgaatcttgtctcaatgctca

SEQ ID NO: 3438294 - DNA, 13 bp, Homo sapiens
ttgaatgcatttt

SEQ ID NO: 3438295 - DNA, 16 bp, Homo sapiens
ttgaatgcattttgtt

SEQ ID NO: 3438296 - DNA, 11 bp, Homo sapiens
ttgaatgtaac

SEQ ID NO: 3438297 - DNA, 19 bp, Homo sapiens
ttgaatgtggcttgagaaa

SEQ ID NO: 3438298 - DNA, 18 bp, Homo sapiens
ttgaattgtaactgttct

SEQ ID NO: 3438299 - DNA, 13 bp, Homo sapiens
ttgaattgtctag

SEQ ID NO: 3438300 - DNA, 22 bp, Homo sapiens
ttgaattttgttctctgggaga

SEQ ID NO: 3438301 - DNA, 16 bp, Homo sapiens
ttgaatttttcctatg

SEQ ID NO: 3438302 - DNA, 23 bp, Homo sapiens
ttgaatttttttctgcacagctt

SEQ ID NO: 3438303 - DNA, 12 bp, Homo sapiens
ttgacaataaaa

SEQ ID NO: 3438304 - DNA, 16 bp, Homo sapiens
ttgacaataaaatatt

SEQ ID NO: 3438305 - DNA, 17 bp, Homo sapiens
ttgacaattctgcatgt

SEQ ID NO: 3438306 - DNA, 16 bp, Homo sapiens
ttgacagaaagcagtt

SEQ ID NO: 3438307 - DNA, 22 bp, Homo sapiens
ttgacagaaagcagttctgatg

SEQ ID NO: 3438308 - DNA, 10 bp, Homo sapiens
ttgacagggc

SEQ ID NO: 3438309 - DNA, 17 bp, Homo sapiens
ttgacatatttaatgtt

SEQ ID NO: 3438310 - DNA, 14 bp, Homo sapiens
ttgacattgcgttt

SEQ ID NO: 3438311 - DNA, 18 bp, Homo sapiens
ttgaccaagcaggaagct

SEQ ID NO: 3438312 - DNA, 22 bp, Homo sapiens
ttgaccaagcaggaagctcaga

SEQ ID NO: 3438313 - DNA, 19 bp, Homo sapiens
ttgaccctattttttgaca

SEQ ID NO: 3438314 - DNA, 20 bp, Homo sapiens
ttgaccgcgactaatttcaa

SEQ ID NO: 3438315 - DNA, 19 bp, Homo sapiens
ttgacctgcattgtaaata

SEQ ID NO: 3438316 - DNA, 20 bp, Homo sapiens
ttgaccttcatttcatgtat

SEQ ID NO: 3438317 - DNA, 23 bp, Homo sapiens
ttgacgagtgtgaagcttccttg

SEQ ID NO: 3438318 - DNA, 14 bp, Homo sapiens
ttgactaattttac

SEQ ID NO: 3438319 - DNA, 14 bp, Homo sapiens
ttgactcagtgata

SEQ ID NO: 3438320 - DNA, 21 bp, Homo sapiens
ttgactctgggtccttcctga

SEQ ID NO: 3438321 - DNA, 17 bp, Homo sapiens
ttgactgggtttctctg

SEQ ID NO: 3438322 - DNA, 22 bp, Homo sapiens
ttgactttacgcccatctcagg

SEQ ID NO: 3438323 - DNA, 23 bp, Homo sapiens
ttgactttacgcccatctcagga

SEQ ID NO: 3438324 - DNA, 13 bp, Homo sapiens
ttgactttcaggt

SEQ ID NO: 3438325 - DNA, 10 bp, Homo sapiens
ttgagaaacc

SEQ ID NO: 3438326 - DNA, 19 bp, Homo sapiens
ttgagaaagagcacttaag

SEQ ID NO: 3438327 - DNA, 12 bp, Homo sapiens
ttgagacagagt

SEQ ID NO: 3438328 - DNA, 21 bp, Homo sapiens
ttgagaccagcctggccaaca

SEQ ID NO: 3438329 - DNA, 16 bp, Homo sapiens
ttgagagaccaggcaa

SEQ ID NO: 3438330 - DNA, 15 bp, Homo sapiens
ttgagatcagcctgg

SEQ ID NO: 3438331 - DNA, 16 bp, Homo sapiens
ttgagatcagcctggg

SEQ ID NO: 3438332 - DNA, 23 bp, Homo sapiens
ttgagcagcaggtagcctgctgg

SEQ ID NO: 3438333 - DNA, 12 bp, Homo sapiens
ttgagcagggct

SEQ ID NO: 3438334 - DNA, 15 bp, Homo sapiens
ttgagcatcacagaa

SEQ ID NO: 3438335 - DNA, 21 bp, Homo sapiens
ttgaggataaattgccataat

SEQ ID NO: 3438336 - DNA, 22 bp, Homo sapiens
ttgaggataaattgccataata

SEQ ID NO: 3438337 - DNA, 18 bp, Homo sapiens
ttgaggcaagtgtgggcc

SEQ ID NO: 3438338 - DNA, 16 bp, Homo sapiens
ttgagggaaagagctt

SEQ ID NO: 3438339 - DNA, 16 bp, Homo sapiens
ttgaggggattaatat

SEQ ID NO: 3438340 - DNA, 13 bp, Homo sapiens
ttgagtagaggct

SEQ ID NO: 3438341 - DNA, 15 bp, Homo sapiens
ttgagtgctctgatc

SEQ ID NO: 3438342 - DNA, 19 bp, Homo sapiens
ttgagtggatgatgtttcg

SEQ ID NO: 3438343 - DNA, 18 bp, Homo sapiens
ttgagttaacctttaaga

SEQ ID NO: 3438344 - DNA, 23 bp, Homo sapiens
ttgagtttgtcgctcatgtgtgc

SEQ ID NO: 3438345 - DNA, 18 bp, Homo sapiens
ttgagttttcttctgtga

SEQ ID NO: 3438346 - DNA, 12 bp, Homo sapiens
ttgagttttgtt

SEQ ID NO: 3438347 - DNA, 12 bp, Homo sapiens
ttgataatgaca

SEQ ID NO: 3438348 - DNA, 22 bp, Homo sapiens
ttgataatgacactgtttcctg

SEQ ID NO: 3438349 - DNA, 22 bp, Homo sapiens
ttgatatagaacagtgcttgcc

SEQ ID NO: 3438350 - DNA, 18 bp, Homo sapiens
ttgatcagatctgacatg

SEQ ID NO: 3438351 - DNA, 17 bp, Homo sapiens
ttgatcatgtacttttt

SEQ ID NO: 3438352 - DNA, 15 bp, Homo sapiens
ttgatctggaaccca

SEQ ID NO: 3438353 - DNA, 16 bp, Homo sapiens
ttgatctggaacccag

SEQ ID NO: 3438354 - DNA, 20 bp, Homo sapiens
ttgatgaccaaagtcctttt

SEQ ID NO: 3438355 - DNA, 21 bp, Homo sapiens
ttgatggagtgtgagccacct

SEQ ID NO: 3438356 - DNA, 15 bp, Homo sapiens
ttgatgtttagaaaa

SEQ ID NO: 3438357 - DNA, 19 bp, Homo sapiens
ttgattaggtatgtttgta

SEQ ID NO: 3438358 - DNA, 22 bp, Homo sapiens
ttgattaggtatgtttgtaact

SEQ ID NO: 3438359 - DNA, 15 bp, Homo sapiens
ttgattcaaaatatt

SEQ ID NO: 3438360 - DNA, 16 bp, Homo sapiens
ttgattcagctctgca

SEQ ID NO: 3438361 - DNA, 12 bp, Homo sapiens
ttgattctgcag

SEQ ID NO: 3438362 - DNA, 14 bp, Homo sapiens
ttgattgatttgaa

SEQ ID NO: 3438363 - DNA, 23 bp, Homo sapiens
ttgattgtttacaggatattcca

SEQ ID NO: 3438364 - DNA, 18 bp, Homo sapiens
ttgatttaaacacacaga

SEQ ID NO: 3438365 - DNA, 14 bp, Homo sapiens
ttgatttgaagaac

SEQ ID NO: 3438366 - DNA, 14 bp, Homo sapiens
ttgattttctggat

SEQ ID NO: 3438367 - DNA, 15 bp, Homo sapiens
ttgcaaaaactacaa

SEQ ID NO: 3438368 - DNA, 18 bp, Homo sapiens
ttgcaaagtattgtaaat

SEQ ID NO: 3438369 - DNA, 13 bp, Homo sapiens
ttgcaagggaaaa

SEQ ID NO: 3438370 - DNA, 15 bp, Homo sapiens
ttgcaagtgaaggtt

SEQ ID NO: 3438371 - DNA, 18 bp, Homo sapiens
ttgcaagtgaaggtttac

SEQ ID NO: 3438372 - DNA, 14 bp, Homo sapiens
ttgcaatggcagcc

SEQ ID NO: 3438373 - DNA, 17 bp, Homo sapiens
ttgcacaactctactgt

SEQ ID NO: 3438374 - DNA, 22 bp, Homo sapiens
ttgcacaactctactgttgcaa

SEQ ID NO: 3438375 - DNA, 15 bp, Homo sapiens
ttgcacagaagtcct

SEQ ID NO: 3438376 - DNA, 18 bp, Homo sapiens
ttgcacagaagtcctgta

SEQ ID NO: 3438377 - DNA, 15 bp, Homo sapiens
ttgcacatcttggct

SEQ ID NO: 3438378 - DNA, 16 bp, Homo sapiens
ttgcacatgtttcctc

SEQ ID NO: 3438379 - DNA, 12 bp, Homo sapiens
ttgcacattgtt

SEQ ID NO: 3438380 - DNA, 14 bp, Homo sapiens
ttgcacattgttca

SEQ ID NO: 3438381 - DNA, 13 bp, Homo sapiens
ttgcaccagtttt

SEQ ID NO: 3438382 - DNA, 18 bp, Homo sapiens
ttgcaccagttttatcca

SEQ ID NO: 3438383 - DNA, 17 bp, Homo sapiens
ttgcacctacctcacag

SEQ ID NO: 3438384 - DNA, 19 bp, Homo sapiens
ttgcagaactaaactcatt

SEQ ID NO: 3438385 - DNA, 11 bp, Homo sapiens
ttgcagacagg

SEQ ID NO: 3438386 - DNA, 18 bp, Homo sapiens
ttgcagacaggaatctta

SEQ ID NO: 3438387 - DNA, 17 bp, Homo sapiens
ttgcagggtcctcttct

SEQ ID NO: 3438388 - DNA, 14 bp, Homo sapiens
ttgcatctgtataa

SEQ ID NO: 3438389 - DNA, 19 bp, Homo sapiens
ttgcatctgtataagtaag

SEQ ID NO: 3438390 - DNA, 23 bp, Homo sapiens
ttgcatctgtataagtaagaaaa

SEQ ID NO: 3438391 - DNA, 16 bp, Homo sapiens
ttgcatgtgactctga

SEQ ID NO: 3438392 - DNA, 17 bp, Homo sapiens
ttgcatgtgactctgaa

SEQ ID NO: 3438393 - DNA, 14 bp, Homo sapiens
ttgcattgaacaca

SEQ ID NO: 3438394 - DNA, 15 bp, Homo sapiens
ttgcatttctgtatt

SEQ ID NO: 3438395 - DNA, 18 bp, Homo sapiens
ttgcatttctgtattttt

SEQ ID NO: 3438396 - DNA, 19 bp, Homo sapiens
ttgccaaaattcatttcta

SEQ ID NO: 3438397 - DNA, 22 bp, Homo sapiens
ttgccaagctccaagccccatc

SEQ ID NO: 3438398 - DNA, 19 bp, Homo sapiens
ttgccaatatgccagcttg

SEQ ID NO: 3438399 - DNA, 19 bp, Homo sapiens
ttgccacccccagttccta

SEQ ID NO: 3438400 - DNA, 12 bp, Homo sapiens
ttgccagccaga

SEQ ID NO: 3438401 - DNA, 13 bp, Homo sapiens
ttgccagccagaa

SEQ ID NO: 3438402 - DNA, 22 bp, Homo sapiens
ttgccatattgcacatgtctta

SEQ ID NO: 3438403 - DNA, 17 bp, Homo sapiens
ttgccatgttggccagg

SEQ ID NO: 3438404 - DNA, 19 bp, Homo sapiens
ttgccatgttggccaggct

SEQ ID NO: 3438405 - DNA, 21 bp, Homo sapiens
ttgccatgttggccaggctgg

SEQ ID NO: 3438406 - DNA, 14 bp, Homo sapiens
ttgccattattcta

SEQ ID NO: 3438407 - DNA, 20 bp, Homo sapiens
ttgccattattctatgtagt

SEQ ID NO: 3438408 - DNA, 21 bp, Homo sapiens
ttgccattctcttgcattgtg

SEQ ID NO: 3438409 - DNA, 23 bp, Homo sapiens
ttgcccacgctggagtgcagtga

SEQ ID NO: 3438410 - DNA, 16 bp, Homo sapiens
ttgcccaggcaggtct

SEQ ID NO: 3438411 - DNA, 12 bp, Homo sapiens
ttgcccaggctg

SEQ ID NO: 3438412 - DNA, 18 bp, Homo sapiens
ttgcccaggctggtctca

SEQ ID NO: 3438413 - DNA, 22 bp, Homo sapiens
ttgccccctgcccgtgtacata

SEQ ID NO: 3438414 - DNA, 18 bp, Homo sapiens
ttgccgcgtcgccctccc

SEQ ID NO: 3438415 - DNA, 20 bp, Homo sapiens
ttgcctatcctgctgttcta

SEQ ID NO: 3438416 - DNA, 18 bp, Homo sapiens
ttgcctctgcctctgaca

SEQ ID NO: 3438417 - DNA, 17 bp, Homo sapiens
ttgcctctgtccccttc

SEQ ID NO: 3438418 - DNA, 18 bp, Homo sapiens
ttgcctctgtccccttct

SEQ ID NO: 3438419 - DNA, 19 bp, Homo sapiens
ttgcctctgtccccttctc

SEQ ID NO: 3438420 - DNA, 20 bp, Homo sapiens
ttcccaggatgagcatccca

SEQ ID NO: 3438421 - DNA, 15 bp, Homo sapiens
ttcccagtggctgct

SEQ ID NO: 3438422 - DNA, 17 bp, Homo sapiens
ttcccagtggctgctgc

SEQ ID NO: 3438423 - DNA, 18 bp, Homo sapiens
ttcccagtggctgctgcc

SEQ ID NO: 3438424 - DNA, 14 bp, Homo sapiens
ttcccatggggagg

SEQ ID NO: 3438425 - DNA, 23 bp, Homo sapiens
ttccccactgacagcctcccacc

SEQ ID NO: 3438426 - DNA, 12 bp, Homo sapiens
ttccccagagaa

SEQ ID NO: 3438427 - DNA, 17 bp, Homo sapiens
ttccccatcttctaaac

SEQ ID NO: 3438428 - DNA, 17 bp, Homo sapiens
ttccccatggggctgcg

SEQ ID NO: 3438429 - DNA, 17 bp, Homo sapiens
ttcccctccttctccct

SEQ ID NO: 3438430 - DNA, 12 bp, Homo sapiens
ttcccctgtgtc

SEQ ID NO: 3438431 - DNA, 17 bp, Homo sapiens
ttccccttccttttaag

SEQ ID NO: 3438432 - DNA, 21 bp, Homo sapiens
ttccctcaccttggcaccaga

SEQ ID NO: 3438433 - DNA, 21 bp, Homo sapiens
ttccctgagaaacccaccagc

SEQ ID NO: 3438434 - DNA, 15 bp, Homo sapiens
ttcccttcggccaaa

SEQ ID NO: 3438435 - DNA, 18 bp, Homo sapiens
ttcccttttacatactgc

SEQ ID NO: 3438436 - DNA, 19 bp, Homo sapiens
ttcccttttacatactgct

SEQ ID NO: 3438437 - DNA, 21 bp, Homo sapiens
ttcccttttacatactgctgt

SEQ ID NO: 3438438 - DNA, 16 bp, Homo sapiens
ttccgtagactgttta

SEQ ID NO: 3438439 - DNA, 18 bp, Homo sapiens
ttccgtagccagctgctc

SEQ ID NO: 3438440 - DNA, 20 bp, Homo sapiens
ttccgtaggtagatgtgtaa

SEQ ID NO: 3438441 - DNA, 21 bp, Homo sapiens
ttccgtcaccacgactggcca

SEQ ID NO: 3438442 - DNA, 17 bp, Homo sapiens
ttccgtttgcttttgtt

SEQ ID NO: 3438443 - DNA, 18 bp, Homo sapiens
ttcctaagacctggggtt

SEQ ID NO: 3438444 - DNA, 14 bp, Homo sapiens
ttcctacattttct

SEQ ID NO: 3438445 - DNA, 15 bp, Homo sapiens
ttcctaccctgcctc

SEQ ID NO: 3438446 - DNA, 17 bp, Homo sapiens
ttcctagttctgtagaa

SEQ ID NO: 3438447 - DNA, 11 bp, Homo sapiens
ttcctataagg

SEQ ID NO: 3438448 - DNA, 17 bp, Homo sapiens
ttcctatcataaaaata

SEQ ID NO: 3438449 - DNA, 22 bp, Homo sapiens
ttcctatttcagtgttacctgt

SEQ ID NO: 3438450 - DNA, 12 bp, Homo sapiens
ttcctcagctta

SEQ ID NO: 3438451 - DNA, 16 bp, Homo sapiens
ttcctcagcttatctc

SEQ ID NO: 3438452 - DNA, 19 bp, Homo sapiens
ttcctcagcttatctcttt

SEQ ID NO: 3438453 - DNA, 23 bp, Homo sapiens
ttcctcatagtatggtggctggg

SEQ ID NO: 3438454 - DNA, 11 bp, Homo sapiens
ttcctcccttc

SEQ ID NO: 3438455 - DNA, 18 bp, Homo sapiens
ttcctcccttctgctact

SEQ ID NO: 3438456 - DNA, 13 bp, Homo sapiens
ttcctcctcaggc

SEQ ID NO: 3438457 - DNA, 13 bp, Homo sapiens
ttcctcctggaaa

SEQ ID NO: 3438458 - DNA, 23 bp, Homo sapiens
ttcctctgataatatattttcaa

SEQ ID NO: 3438459 - DNA, 14 bp, Homo sapiens
ttcctctttgcttt

SEQ ID NO: 3438460 - DNA, 15 bp, Homo sapiens
ttcctgaactataac

SEQ ID NO: 3438461 - DNA, 15 bp, Homo sapiens
ttcctgtccagctcc

SEQ ID NO: 3438462 - DNA, 11 bp, Homo sapiens
ttcctgtccca

SEQ ID NO: 3438463 - DNA, 22 bp, Homo sapiens
ttcctgtccctgcgcctttcct

SEQ ID NO: 3438464 - DNA, 19 bp, Homo sapiens
ttcctgtgatacatttctg

SEQ ID NO: 3438465 - DNA, 11 bp, Homo sapiens
ttcctgtgtcc

SEQ ID NO: 3438466 - DNA, 14 bp, Homo sapiens
ttcctgtgtcctga

SEQ ID NO: 3438467 - DNA, 22 bp, Homo sapiens
ttcctgtgtgtccaaaactgcc

SEQ ID NO: 3438468 - DNA, 15 bp, Homo sapiens
ttcctgttctgaact

SEQ ID NO: 3438469 - DNA, 15 bp, Homo sapiens
ttccttcctgttctg

SEQ ID NO: 3438470 - DNA, 20 bp, Homo sapiens
ttccttcgaaaggccttcag

SEQ ID NO: 3438471 - DNA, 17 bp, Homo sapiens
ttccttgagaaaaacaa

SEQ ID NO: 3438472 - DNA, 21 bp, Homo sapiens
ttccttgagttgattcagctc

SEQ ID NO: 3438473 - DNA, 23 bp, Homo sapiens
ttccttggaagggggctctttta

SEQ ID NO: 3438474 - DNA, 13 bp, Homo sapiens
ttccttggctggt

SEQ ID NO: 3438475 - DNA, 15 bp, Homo sapiens
ttccttggggcaggc

SEQ ID NO: 3438476 - DNA, 20 bp, Homo sapiens
ttccttgtagcgactaaact

SEQ ID NO: 3438477 - DNA, 20 bp, Homo sapiens
ttccttgttacccatgaaaa

SEQ ID NO: 3438478 - DNA, 14 bp, Homo sapiens
ttcctttgaagata

SEQ ID NO: 3438479 - DNA, 21 bp, Homo sapiens
ttccttttaagtaaggtccaa

SEQ ID NO: 3438480 - DNA, 13 bp, Homo sapiens
ttccttttcttta

SEQ ID NO: 3438481 - DNA, 21 bp, Homo sapiens
ttccttttttaaaaatgcaaa

SEQ ID NO: 3438482 - DNA, 12 bp, Homo sapiens
ttcgaaaggcct

SEQ ID NO: 3438483 - DNA, 13 bp, Homo sapiens
ttcgaggcctgaa

SEQ ID NO: 3438484 - DNA, 20 bp, Homo sapiens
ttcgaggcctgaagccagct

SEQ ID NO: 3438485 - DNA, 19 bp, Homo sapiens
ttcgcatggtcacacactg

SEQ ID NO: 3438486 - DNA, 23 bp, Homo sapiens
ttcgcatggtcacacactgatgc

SEQ ID NO: 3438487 - DNA, 17 bp, Homo sapiens
ttcgccaaactgtctct

SEQ ID NO: 3438488 - DNA, 18 bp, Homo sapiens
ttcgccaaactgtctctg

SEQ ID NO: 3438489 - DNA, 14 bp, Homo sapiens
ttcgcctggagccc

SEQ ID NO: 3438490 - DNA, 15 bp, Homo sapiens
ttcgcgctctgctca

SEQ ID NO: 3438491 - DNA, 19 bp, Homo sapiens
ttcgctcctgtgtcttgca

SEQ ID NO: 3438492 - DNA, 23 bp, Homo sapiens
ttcgctgtcccccaacactgagc

SEQ ID NO: 3438493 - DNA, 17 bp, Homo sapiens
ttcggccaaacagacag

SEQ ID NO: 3438494 - DNA, 12 bp, Homo sapiens
ttcgggctgtgc

SEQ ID NO: 3438495 - DNA, 22 bp, Homo sapiens
ttcggtggctagtcaagctcct

SEQ ID NO: 3438496 - DNA, 16 bp, Homo sapiens
ttcgtccacagcttcc

SEQ ID NO: 3438497 - DNA, 18 bp, Homo sapiens
ttcgtgaagtatactgta

SEQ ID NO: 3438498 - DNA, 20 bp, Homo sapiens
ttcgtgagccccatcttcac

SEQ ID NO: 3438499 - DNA, 20 bp, Homo sapiens
ttcgtgcggaatcagcttct

SEQ ID NO: 3438500 - DNA, 22 bp, Homo sapiens
ttctaaaggtgttgtcccttct

SEQ ID NO: 3438501 - DNA, 12 bp, Homo sapiens
ttctaaagttgt

SEQ ID NO: 3438502 - DNA, 18 bp, Homo sapiens
ttctaaagttgtagtgaa

SEQ ID NO: 3438503 - DNA, 14 bp, Homo sapiens
ttctaacctggagg

SEQ ID NO: 3438504 - DNA, 22 bp, Homo sapiens
ttctaaggaaatggagaagctc

SEQ ID NO: 3438505 - DNA, 13 bp, Homo sapiens
ttctaaggaagac

SEQ ID NO: 3438506 - DNA, 17 bp, Homo sapiens
ttctaagtctttccatt

SEQ ID NO: 3438507 - DNA, 14 bp, Homo sapiens
ttctaatagaactc

SEQ ID NO: 3438508 - DNA, 21 bp, Homo sapiens
ttctaatgaggagagaaaata

SEQ ID NO: 3438509 - DNA, 16 bp, Homo sapiens
ttctaatggaatggtt

SEQ ID NO: 3438510 - DNA, 17 bp, Homo sapiens
ttctaatggaatggttt

SEQ ID NO: 3438511 - DNA, 15 bp, Homo sapiens
ttctacaatgtgaac

SEQ ID NO: 3438512 - DNA, 20 bp, Homo sapiens
ttctacccagcgagccctgg

SEQ ID NO: 3438513 - DNA, 13 bp, Homo sapiens
ttctacgccaggg

SEQ ID NO: 3438514 - DNA, 21 bp, Homo sapiens
ttctagaacatccctgccagc

SEQ ID NO: 3438515 - DNA, 22 bp, Homo sapiens
ttctagaacatccctgccagct

SEQ ID NO: 3438516 - DNA, 16 bp, Homo sapiens
ttctagagcactgcca

SEQ ID NO: 3438517 - DNA, 18 bp, Homo sapiens
ttctaggtggcaaggctg

SEQ ID NO: 3438518 - DNA, 18 bp, Homo sapiens
ttctagtgtaacactgca

SEQ ID NO: 3438519 - DNA, 13 bp, Homo sapiens
ttctagttttatg

SEQ ID NO: 3438520 - DNA, 19 bp, Homo sapiens
ttctagttttcagtttgta

SEQ ID NO: 3438521 - DNA, 23 bp, Homo sapiens
ttctataaggccataaaacaggt

SEQ ID NO: 3438522 - DNA, 13 bp, Homo sapiens
ttctataatttaa

SEQ ID NO: 3438523 - DNA, 20 bp, Homo sapiens
ttctatcttgttccaaggcc

SEQ ID NO: 3438524 - DNA, 19 bp, Homo sapiens
ttctatgagtggaaaaagc

SEQ ID NO: 3438525 - DNA, 20 bp, Homo sapiens
ttctattgactttcttaaaa

SEQ ID NO: 3438526 - DNA, 18 bp, Homo sapiens
ttctatttatatgtacat

SEQ ID NO: 3438527 - DNA, 19 bp, Homo sapiens
ttctatttatatgtacatg

SEQ ID NO: 3438528 - DNA, 15 bp, Homo sapiens
ttctatttatttact

SEQ ID NO: 3438529 - DNA, 13 bp, Homo sapiens
ttctatttcataa

SEQ ID NO: 3438530 - DNA, 14 bp, Homo sapiens
ttctatttcataat

SEQ ID NO: 3438531 - DNA, 22 bp, Homo sapiens
ttctattttaagactgatttta

SEQ ID NO: 3438532 - DNA, 15 bp, Homo sapiens
ttctcaaagctggga

SEQ ID NO: 3438533 - DNA, 23 bp, Homo sapiens
ttctcacaatagccgatatcaga

SEQ ID NO: 3438534 - DNA, 17 bp, Homo sapiens
ttctcaccagctgcaaa

SEQ ID NO: 3438535 - DNA, 21 bp, Homo sapiens
ttctcaccagctgcaaagtgt

SEQ ID NO: 3438536 - DNA, 22 bp, Homo sapiens
ttctcaccagctgcaaagtgtt

SEQ ID NO: 3438537 - DNA, 17 bp, Homo sapiens
ttctcagaatccaaaga

SEQ ID NO: 3438538 - DNA, 19 bp, Homo sapiens
ttctcagaatctacccaaa

SEQ ID NO: 3438539 - DNA, 23 bp, Homo sapiens
ttctcagactttggaaaatgcat

SEQ ID NO: 3438540 - DNA, 12 bp, Homo sapiens
ttctcattcctg

SEQ ID NO: 3438541 - DNA, 13 bp, Homo sapiens
ttctcatttagtg

SEQ ID NO: 3438542 - DNA, 19 bp, Homo sapiens
ttctcatttcacccctccc

SEQ ID NO: 3438543 - DNA, 14 bp, Homo sapiens
ttctccactcagtt

SEQ ID NO: 3438544 - DNA, 20 bp, Homo sapiens
ttctccccaatgagacttgc

SEQ ID NO: 3438545 - DNA, 16 bp, Homo sapiens
ttctcccctcttctga

SEQ ID NO: 3438546 - DNA, 17 bp, Homo sapiens
ttctcccctcttctgag

SEQ ID NO: 3438547 - DNA, 15 bp, Homo sapiens
ttctcccctgccccc

SEQ ID NO: 3438548 - DNA, 19 bp, Homo sapiens
ttctcccctgcccccagga

SEQ ID NO: 3438549 - DNA, 22 bp, Homo sapiens
ttctcccctgcccccaggactg

SEQ ID NO: 3438550 - DNA, 23 bp, Homo sapiens
ttctcccctgcccccaggactgg

SEQ ID NO: 3438551 - DNA, 16 bp, Homo sapiens
ttctccgttagctcct

SEQ ID NO: 3438552 - DNA, 23 bp, Homo sapiens
ttctcctccatgggagaaaatag

SEQ ID NO: 3438553 - DNA, 22 bp, Homo sapiens
ttctcctgcctttgcctccaga

SEQ ID NO: 3438554 - DNA, 15 bp, Homo sapiens
ttctccttcagccct

SEQ ID NO: 3438555 - DNA, 17 bp, Homo sapiens
ttctcctttgtactttg

SEQ ID NO: 3438556 - DNA, 17 bp, Homo sapiens
ttatcaaaaagtattat

SEQ ID NO: 3438557 - DNA, 16 bp, Homo sapiens
ttatcaactcaagaat

SEQ ID NO: 3438558 - DNA, 18 bp, Homo sapiens
ttatcacctcattctgaa

SEQ ID NO: 3438559 - DNA, 19 bp, Homo sapiens
ttatcacctcattctgaac

SEQ ID NO: 3438560 - DNA, 11 bp, Homo sapiens
ttatcatgcaa

SEQ ID NO: 3438561 - DNA, 12 bp, Homo sapiens
ttatcattgctc

SEQ ID NO: 3438562 - DNA, 16 bp, Homo sapiens
ttatccaaaatgtgta

SEQ ID NO: 3438563 - DNA, 18 bp, Homo sapiens
ttatccaaaatgtgtatt

SEQ ID NO: 3438564 - DNA, 17 bp, Homo sapiens
ttatccataatgatgga

SEQ ID NO: 3438565 - DNA, 17 bp, Homo sapiens
ttatccatattgagtca

SEQ ID NO: 3438566 - DNA, 19 bp, Homo sapiens
ttatcctaaaacaaatagt

SEQ ID NO: 3438567 - DNA, 21 bp, Homo sapiens
ttatcctagcacatgcttcaa

SEQ ID NO: 3438568 - DNA, 21 bp, Homo sapiens
ttatctaaaagaaatgtctat

SEQ ID NO: 3438569 - DNA, 17 bp, Homo sapiens
ttatctaagaatacagc

SEQ ID NO: 3438570 - DNA, 19 bp, Homo sapiens
ttatctaagaatacagctt

SEQ ID NO: 3438571 - DNA, 17 bp, Homo sapiens
ttatctatacatatctt

SEQ ID NO: 3438572 - DNA, 16 bp, Homo sapiens
ttatctcacttgtgcc

SEQ ID NO: 3438573 - DNA, 12 bp, Homo sapiens
ttatctgtccca

SEQ ID NO: 3438574 - DNA, 12 bp, Homo sapiens
ttatctgtttcc

SEQ ID NO: 3438575 - DNA, 22 bp, Homo sapiens
ttatctgtttcctgacattgtc

SEQ ID NO: 3438576 - DNA, 21 bp, Homo sapiens
ttatcttatactgtacaataa

SEQ ID NO: 3438577 - DNA, 13 bp, Homo sapiens
ttatgaagagcta

SEQ ID NO: 3438578 - DNA, 14 bp, Homo sapiens
ttatgaatctttcc

SEQ ID NO: 3438579 - DNA, 14 bp, Homo sapiens
ttatgaatgaaaaa

SEQ ID NO: 3438580 - DNA, 19 bp, Homo sapiens
ttatgagatggatcacata

SEQ ID NO: 3438581 - DNA, 19 bp, Homo sapiens
ttatgagggtcctctactt

SEQ ID NO: 3438582 - DNA, 13 bp, Homo sapiens
ttatgatatcatt

SEQ ID NO: 3438583 - DNA, 19 bp, Homo sapiens
ttatgatcaccatgtattt

SEQ ID NO: 3438584 - DNA, 17 bp, Homo sapiens
ttatgcatgtttgttgt

SEQ ID NO: 3438585 - DNA, 17 bp, Homo sapiens
ttatgccagttgttaaa

SEQ ID NO: 3438586 - DNA, 14 bp, Homo sapiens
ttatgctcagggtc

SEQ ID NO: 3438587 - DNA, 19 bp, Homo sapiens
ttatggaattgatttgcat

SEQ ID NO: 3438588 - DNA, 20 bp, Homo sapiens
ttatgtaaatgtttgttaaa

SEQ ID NO: 3438589 - DNA, 19 bp, Homo sapiens
ttatgtataaaatgtaaca

SEQ ID NO: 3438590 - DNA, 24 bp, Homo sapiens
ttatgtataaaatgtaacactgat

SEQ ID NO: 3438591 - DNA, 13 bp, Homo sapiens
ttatgttaaacta

SEQ ID NO: 3438592 - DNA, 14 bp, Homo sapiens
ttatgttaaactag

SEQ ID NO: 3438593 - DNA, 16 bp, Homo sapiens
ttattaaaattctgaa

SEQ ID NO: 3438594 - DNA, 20 bp, Homo sapiens
ttattaaatacaaaacttcc

SEQ ID NO: 3438595 - DNA, 19 bp, Homo sapiens
ttattaacaattaggcaga

SEQ ID NO: 3438596 - DNA, 18 bp, Homo sapiens
ttattaatttttaaggat

SEQ ID NO: 3438597 - DNA, 13 bp, Homo sapiens
ttattacctctga

SEQ ID NO: 3438598 - DNA, 15 bp, Homo sapiens
ttattacctctgata

SEQ ID NO: 3438599 - DNA, 17 bp, Homo sapiens
ttattagagtgtctttc

SEQ ID NO: 3438600 - DNA, 16 bp, Homo sapiens
ttattagggagaaaat

SEQ ID NO: 3438601 - DNA, 19 bp, Homo sapiens
ttattagggagaaaattca

SEQ ID NO: 3438602 - DNA, 20 bp, Homo sapiens
ttattagggagaaaattcaa

SEQ ID NO: 3438603 - DNA, 24 bp, Homo sapiens
ttattagtaccatagtaccattta

SEQ ID NO: 3438604 - DNA, 14 bp, Homo sapiens
ttattatatttaca

SEQ ID NO: 3438605 - DNA, 17 bp, Homo sapiens
ttattatatttgacatg

SEQ ID NO: 3438606 - DNA, 22 bp, Homo sapiens
ttattatatttgacatgggtat

SEQ ID NO: 3438607 - DNA, 19 bp, Homo sapiens
ttattatcctcctgttctg

SEQ ID NO: 3438608 - DNA, 17 bp, Homo sapiens
ttattatggaaaacatt

SEQ ID NO: 3438609 - DNA, 21 bp, Homo sapiens
ttattcaataaagtatttaat

SEQ ID NO: 3438610 - DNA, 13 bp, Homo sapiens
ttattcagtgtca

SEQ ID NO: 3438611 - DNA, 18 bp, Homo sapiens
ttattcattatttgtcaa

SEQ ID NO: 3438612 - DNA, 22 bp, Homo sapiens
ttattccagaatgctgtacatc

SEQ ID NO: 3438613 - DNA, 20 bp, Homo sapiens
ttattcccccctaagcttct

SEQ ID NO: 3438614 - DNA, 15 bp, Homo sapiens
ttattctcatttagt

SEQ ID NO: 3438615 - DNA, 11 bp, Homo sapiens
ttattctgctc

SEQ ID NO: 3438616 - DNA, 20 bp, Homo sapiens
ttattgaatctatttaagta

SEQ ID NO: 3438617 - DNA, 14 bp, Homo sapiens
ttattgacaataat

SEQ ID NO: 3438618 - DNA, 19 bp, Homo sapiens
ttattgacacagaaaatgt

SEQ ID NO: 3438619 - DNA, 22 bp, Homo sapiens
ttattgagggtcattctttatt

SEQ ID NO: 3438620 - DNA, 14 bp, Homo sapiens
ttattgccttctca

SEQ ID NO: 3438621 - DNA, 17 bp, Homo sapiens
ttattgccttctcacca

SEQ ID NO: 3438622 - DNA, 12 bp, Homo sapiens
ttattgtacctc

SEQ ID NO: 3438623 - DNA, 12 bp, Homo sapiens
ttattgtacttg

SEQ ID NO: 3438624 - DNA, 15 bp, Homo sapiens
ttattgtgtttgtca

SEQ ID NO: 3438625 - DNA, 18 bp, Homo sapiens
ttattgtgtttgtcatta

SEQ ID NO: 3438626 - DNA, 19 bp, Homo sapiens
ttattgtgtttgtcattag

SEQ ID NO: 3438627 - DNA, 12 bp, Homo sapiens
ttatttaaaaga

SEQ ID NO: 3438628 - DNA, 20 bp, Homo sapiens
ttatttaaactctgttgcaa

SEQ ID NO: 3438629 - DNA, 20 bp, Homo sapiens
ttatttacagatgaatgtat

SEQ ID NO: 3438630 - DNA, 21 bp, Homo sapiens
ttatttactgagcttctctgt

SEQ ID NO: 3438631 - DNA, 17 bp, Homo sapiens
ttatttagggaactgct

SEQ ID NO: 3438632 - DNA, 18 bp, Homo sapiens
ttatttagggaactgctt

SEQ ID NO: 3438633 - DNA, 21 bp, Homo sapiens
ttatttagggaactgcttgac

SEQ ID NO: 3438634 - DNA, 19 bp, Homo sapiens
ttatttccactattttcaa

SEQ ID NO: 3438635 - DNA, 18 bp, Homo sapiens
ttatttcctagttctgta

SEQ ID NO: 3438636 - DNA, 19 bp, Homo sapiens
ttatttcctagttctgtag

SEQ ID NO: 3438637 - DNA, 13 bp, Homo sapiens
ttatttctgcata

SEQ ID NO: 3438638 - DNA, 11 bp, Homo sapiens
ttatttgcata

SEQ ID NO: 3438639 - DNA, 12 bp, Homo sapiens
ttatttgtcaaa

SEQ ID NO: 3438640 - DNA, 22 bp, Homo sapiens
ttattttataagaaaaactttt

SEQ ID NO: 3438641 - DNA, 13 bp, Homo sapiens
ttattttccaaaa

SEQ ID NO: 3438642 - DNA, 17 bp, Homo sapiens
ttattttggaactatga

SEQ ID NO: 3438643 - DNA, 17 bp, Homo sapiens
ttatttttagacagagt

SEQ ID NO: 3438644 - DNA, 16 bp, Homo sapiens
ttatttttgtacatgt

SEQ ID NO: 3438645 - DNA, 21 bp, Homo sapiens
ttcaaaaaaaaaaaaaagaga

SEQ ID NO: 3438646 - DNA, 15 bp, Homo sapiens
ttcaaaagataatat

SEQ ID NO: 3438647 - DNA, 16 bp, Homo sapiens
ttcaaaagttgaaatt

SEQ ID NO: 3438648 - DNA, 17 bp, Homo sapiens
ttcaaaagttgaaatta

SEQ ID NO: 3438649 - DNA, 14 bp, Homo sapiens
ttcaaaataaaaac

SEQ ID NO: 3438650 - DNA, 20 bp, Homo sapiens
ttcaaaatgctttttattat

SEQ ID NO: 3438651 - DNA, 16 bp, Homo sapiens
ttcaaactggggcctc

SEQ ID NO: 3438652 - DNA, 15 bp, Homo sapiens
ttcaaagactgtgaa

SEQ ID NO: 3438653 - DNA, 22 bp, Homo sapiens
ttcaaagcaattgaaatgcatt

SEQ ID NO: 3438654 - DNA, 21 bp, Homo sapiens
ttcaaattgtgtgtgctctgc

SEQ ID NO: 3438655 - DNA, 19 bp, Homo sapiens
ttcaacagtgaagacagaa

SEQ ID NO: 3438656 - DNA, 13 bp, Homo sapiens
ttcaactttgaat

SEQ ID NO: 3438657 - DNA, 17 bp, Homo sapiens
ttcaagcagtcgtgcct

SEQ ID NO: 3438658 - DNA, 23 bp, Homo sapiens
ttcaagcagtcgtgcctgtgtcc

SEQ ID NO: 3438659 - DNA, 14 bp, Homo sapiens
ttcaagccattcca

SEQ ID NO: 3438660 - DNA, 10 bp, Homo sapiens
ttcaaggcct

SEQ ID NO: 3438661 - DNA, 11 bp, Homo sapiens
ttcaaggcctt

SEQ ID NO: 3438662 - DNA, 14 bp, Homo sapiens
ttcaaggccttcag

SEQ ID NO: 3438663 - DNA, 19 bp, Homo sapiens
ttcaaggccttcagtttat

SEQ ID NO: 3438664 - DNA, 14 bp, Homo sapiens
ttcaagttcaatcc

SEQ ID NO: 3438665 - DNA, 18 bp, Homo sapiens
ttcaataaagcatttata

SEQ ID NO: 3438666 - DNA, 14 bp, Homo sapiens
ttcaataaagtatt

SEQ ID NO: 3438667 - DNA, 18 bp, Homo sapiens
ttcaataaagtatttaat

SEQ ID NO: 3438668 - DNA, 19 bp, Homo sapiens
ttcaataaagtatttaatt

SEQ ID NO: 3438669 - DNA, 17 bp, Homo sapiens
ttcaattgcatctccca

SEQ ID NO: 3438670 - DNA, 14 bp, Homo sapiens
ttcaattgtaaatt

SEQ ID NO: 3438671 - DNA, 17 bp, Homo sapiens
ttcacaaacttttatac

SEQ ID NO: 3438672 - DNA, 13 bp, Homo sapiens
ttcacacacccct

SEQ ID NO: 3438673 - DNA, 14 bp, Homo sapiens
ttcacacacccctc

SEQ ID NO: 3438674 - DNA, 13 bp, Homo sapiens
ttcacactgtctg

SEQ ID NO: 3438675 - DNA, 11 bp, Homo sapiens
ttcacagatgc

SEQ ID NO: 3438676 - DNA, 22 bp, Homo sapiens
ttcacagcaacattttcttgaa

SEQ ID NO: 3438677 - DNA, 23 bp, Homo sapiens
ttcacagcaacattttcttgaat

SEQ ID NO: 3438678 - DNA, 21 bp, Homo sapiens
ttcacagttctttgggccaga

SEQ ID NO: 3438679 - DNA, 18 bp, Homo sapiens
ttcacatctaacctcatc

SEQ ID NO: 3438680 - DNA, 19 bp, Homo sapiens
ttcacatctaacctcatct

SEQ ID NO: 3438681 - DNA, 20 bp, Homo sapiens
ttcacatctaacctcatctt

SEQ ID NO: 3438682 - DNA, 23 bp, Homo sapiens
ttcacattcccctggggacccac

SEQ ID NO: 3438683 - DNA, 20 bp, Homo sapiens
ttcacattgtttgctgctat

SEQ ID NO: 3438684 - DNA, 12 bp, Homo sapiens
ttcaccatggcc

SEQ ID NO: 3438685 - DNA, 16 bp, Homo sapiens
ttcaccatggccccct

SEQ ID NO: 3438686 - DNA, 17 bp, Homo sapiens
ttcaccatggccccctc

SEQ ID NO: 3438687 - DNA, 18 bp, Homo sapiens
ttcacccaggcctatgtt

SEQ ID NO: 3438688 - DNA, 13 bp, Homo sapiens
ttcaccccaccct

SEQ ID NO: 3438689 - DNA, 14 bp, Homo sapiens
ttcaccccaccctt

SEQ ID NO: 3438690 - DNA, 12 bp, Homo sapiens
ttcacccctccc

SEQ ID NO: 3438691 - DNA, 16 bp, Homo sapiens
ttcacccctccctttc

SEQ ID NO: 3438692 - DNA, 17 bp, Homo sapiens
ttcacccctccctttct

SEQ ID NO: 3438693 - DNA, 13 bp, Homo sapiens
ttcaccctctgta

SEQ ID NO: 3438694 - DNA, 21 bp, Homo sapiens
ttcacctgtttttaagctgtt

SEQ ID NO: 3438695 - DNA, 23 bp, Homo sapiens
ttcaccttcgtttactatgcctg

SEQ ID NO: 3438696 - DNA, 14 bp, Homo sapiens
ttcacctttgtagc

SEQ ID NO: 3438697 - DNA, 17 bp, Homo sapiens
ttcacggaagagccttg

SEQ ID NO: 3438698 - DNA, 13 bp, Homo sapiens
ttcactaaagcag

SEQ ID NO: 3438699 - DNA, 14 bp, Homo sapiens
ttcactaaagcagt

SEQ ID NO: 3438700 - DNA, 19 bp, Homo sapiens
ttcactctcctatgccttt

SEQ ID NO: 3438701 - DNA, 20 bp, Homo sapiens
ttcactcttcaaatgcctga

SEQ ID NO: 3438702 - DNA, 22 bp, Homo sapiens
ttcactgtcctccaagccagcg

SEQ ID NO: 3438703 - DNA, 19 bp, Homo sapiens
ttcagaatcacttctgaga

SEQ ID NO: 3438704 - DNA, 19 bp, Homo sapiens
ttcagacaaaatggataca

SEQ ID NO: 3438705 - DNA, 21 bp, Homo sapiens
ttcagactcccattcctgaag

SEQ ID NO: 3438706 - DNA, 12 bp, Homo sapiens
ttcagagatgga

SEQ ID NO: 3438707 - DNA, 23 bp, Homo sapiens
ttcagagctgacacaggatgaag

SEQ ID NO: 3438708 - DNA, 22 bp, Homo sapiens
ttcagaggccctcgctgccagc

SEQ ID NO: 3438709 - DNA, 14 bp, Homo sapiens
ttcagaggctgcag

SEQ ID NO: 3438710 - DNA, 15 bp, Homo sapiens
ttcagatgtaatgtt

SEQ ID NO: 3438711 - DNA, 17 bp, Homo sapiens
ttcagatgtaatgtttt

SEQ ID NO: 3438712 - DNA, 15 bp, Homo sapiens
ttcagatgtgaacca

SEQ ID NO: 3438713 - DNA, 20 bp, Homo sapiens
ttcagattgtggaatgttgg

SEQ ID NO: 3438714 - DNA, 22 bp, Homo sapiens
ttcagattgtggaatgttggat

SEQ ID NO: 3438715 - DNA, 22 bp, Homo sapiens
ttcagcattaagctgttcctgt

SEQ ID NO: 3438716 - DNA, 20 bp, Homo sapiens
ttcagctcacgcttcacagt

SEQ ID NO: 3438717 - DNA, 12 bp, Homo sapiens
ttcagctccagc

SEQ ID NO: 3438718 - DNA, 23 bp, Homo sapiens
ttcagctccagctcaccagcccc

SEQ ID NO: 3438719 - DNA, 22 bp, Homo sapiens
ttcagcttgtaaatagctcagg

SEQ ID NO: 3438720 - DNA, 20 bp, Homo sapiens
ttcaggaacctcgagtactg

SEQ ID NO: 3438721 - DNA, 21 bp, Homo sapiens
ttcaggaacctcgagtactgt

SEQ ID NO: 3438722 - DNA, 22 bp, Homo sapiens
ttcaggagcagcctcagaacaa

SEQ ID NO: 3438723 - DNA, 22 bp, Homo sapiens
ttcaggctccccagatcatgtt

SEQ ID NO: 3438724 - DNA, 23 bp, Homo sapiens
ttcaggctcgccaaggcctagga

SEQ ID NO: 3438725 - DNA, 17 bp, Homo sapiens
ttcagggttggcccctg

SEQ ID NO: 3438726 - DNA, 19 bp, Homo sapiens
ttcagggttggcccctgcc

SEQ ID NO: 3438727 - DNA, 14 bp, Homo sapiens
ttcaggtactaaat

SEQ ID NO: 3438728 - DNA, 19 bp, Homo sapiens
ttcaggtagctgcccctgg

SEQ ID NO: 3438729 - DNA, 21 bp, Homo sapiens
ttcagtaacccccactggact

SEQ ID NO: 3438730 - DNA, 14 bp, Homo sapiens
ttcagtactttttt

SEQ ID NO: 3438731 - DNA, 14 bp, Homo sapiens
ttcagtggcagctg

SEQ ID NO: 3438732 - DNA, 15 bp, Homo sapiens
ttcagtggcagctgc

SEQ ID NO: 3438733 - DNA, 14 bp, Homo sapiens
ttcagtggggcagt

SEQ ID NO: 3438734 - DNA, 18 bp, Homo sapiens
ttcagtgttaaatgtgat

SEQ ID NO: 3438735 - DNA, 18 bp, Homo sapiens
ttcagtgttacctgtgtg

SEQ ID NO: 3438736 - DNA, 15 bp, Homo sapiens
ttcagtttaatgcaa

SEQ ID NO: 3438737 - DNA, 13 bp, Homo sapiens
ttcataatgaaaa

SEQ ID NO: 3438738 - DNA, 17 bp, Homo sapiens
ttcatagtaacttctta

SEQ ID NO: 3438739 - DNA, 13 bp, Homo sapiens
ttcatatattgca

SEQ ID NO: 3438740 - DNA, 17 bp, Homo sapiens
ttcatatattgcatttc

SEQ ID NO: 3438741 - DNA, 19 bp, Homo sapiens
ttcatatattgcatttctg

SEQ ID NO: 3438742 - DNA, 21 bp, Homo sapiens
ttcatatgaaaggtgccatgg

SEQ ID NO: 3438743 - DNA, 18 bp, Homo sapiens
ttcatatggtaggaacca

SEQ ID NO: 3438744 - DNA, 19 bp, Homo sapiens
ttcatcattccctctcatc

SEQ ID NO: 3438745 - DNA, 15 bp, Homo sapiens
ttcatccactagtgc

SEQ ID NO: 3438746 - DNA, 21 bp, Homo sapiens
ttcatcccatgatgtagtgcc

SEQ ID NO: 3438747 - DNA, 23 bp, Homo sapiens
ttcatcgaatctactaattccac

SEQ ID NO: 3438748 - DNA, 15 bp, Homo sapiens
ttcatctgctctcct

SEQ ID NO: 3438749 - DNA, 13 bp, Homo sapiens
ttcatcttcctgt

SEQ ID NO: 3438750 - DNA, 17 bp, Homo sapiens
ttcatcttcctgtgtcc

SEQ ID NO: 3438751 - DNA, 17 bp, Homo sapiens
ttcatcttttattttgg

SEQ ID NO: 3438752 - DNA, 22 bp, Homo sapiens
ttcatgccaccatggccagcca

SEQ ID NO: 3438753 - DNA, 16 bp, Homo sapiens
ttcatggatcagatct

SEQ ID NO: 3438754 - DNA, 17 bp, Homo sapiens
ttcatgtacaagatgaa

SEQ ID NO: 3438755 - DNA, 21 bp, Homo sapiens
ttcatgtacaagatgaaggag

SEQ ID NO: 3438756 - DNA, 17 bp, Homo sapiens
ttcatgtctattccatt

SEQ ID NO: 3438757 - DNA, 21 bp, Homo sapiens
ttcatgtgtgccaaggctgat

SEQ ID NO: 3438758 - DNA, 22 bp, Homo sapiens
ttcatgttgcacacccactcag

SEQ ID NO: 3438759 - DNA, 20 bp, Homo sapiens
ttcatgttggtttattttca

SEQ ID NO: 3438760 - DNA, 17 bp, Homo sapiens
ttcatgttttaacaaaa

SEQ ID NO: 3438761 - DNA, 18 bp, Homo sapiens
ttcatgttttaacaaaaa

SEQ ID NO: 3438762 - DNA, 16 bp, Homo sapiens
ttcattaattctataa

SEQ ID NO: 3438763 - DNA, 15 bp, Homo sapiens
ttcattccccagctc

SEQ ID NO: 3438764 - DNA, 15 bp, Homo sapiens
ttcattctccttgtt

SEQ ID NO: 3438765 - DNA, 17 bp, Homo sapiens
ttcattctccttgttgt

SEQ ID NO: 3438766 - DNA, 14 bp, Homo sapiens
ttcattctctttta

SEQ ID NO: 3438767 - DNA, 13 bp, Homo sapiens
ttcattctgcaag

SEQ ID NO: 3438768 - DNA, 18 bp, Homo sapiens
ttcattctgcaagtatac

SEQ ID NO: 3438769 - DNA, 18 bp, Homo sapiens
ttcattgaggataaattg

SEQ ID NO: 3438770 - DNA, 20 bp, Homo sapiens
ttcattgaggataaattgcc

SEQ ID NO: 3438771 - DNA, 22 bp, Homo sapiens
ttcattgaggataaattgccat

SEQ ID NO: 3438772 - DNA, 21 bp, Homo sapiens
ttcatttagctaaacggattc

SEQ ID NO: 3438773 - DNA, 14 bp, Homo sapiens
ttcatttcatgtat

SEQ ID NO: 3438774 - DNA, 14 bp, Homo sapiens
ttcattttcagagt

SEQ ID NO: 3438775 - DNA, 23 bp, Homo sapiens
ttcatttttgatagctgtcccat

SEQ ID NO: 3438776 - DNA, 23 bp, Homo sapiens
ttcatttttgtaataacatttaa

SEQ ID NO: 3438777 - DNA, 18 bp, Homo sapiens
ttcatttttttccaggct

SEQ ID NO: 3438778 - DNA, 18 bp, Homo sapiens
ttccaaaagtggcctctt

SEQ ID NO: 3438779 - DNA, 22 bp, Homo sapiens
ttccaaaataaaaaccttccaa

SEQ ID NO: 3438780 - DNA, 15 bp, Homo sapiens
ttccaaaccttatct

SEQ ID NO: 3438781 - DNA, 21 bp, Homo sapiens
ttccaaagagtagaattgcat

SEQ ID NO: 3438782 - DNA, 12 bp, Homo sapiens
ttccaaagcaaa

SEQ ID NO: 3438783 - DNA, 17 bp, Homo sapiens
ttccaaataaaatgttc

SEQ ID NO: 3438784 - DNA, 23 bp, Homo sapiens
ttccaaattcacaagttgtgttt

SEQ ID NO: 3438785 - DNA, 19 bp, Homo sapiens
ttccaactcgtatagcatg

SEQ ID NO: 3438786 - DNA, 23 bp, Homo sapiens
ttccaagcttccatagctgctgc

SEQ ID NO: 3438787 - DNA, 14 bp, Homo sapiens
ttccacaaagaaaa

SEQ ID NO: 3438788 - DNA, 22 bp, Homo sapiens
ttccacaagtgccgcaaattgt

SEQ ID NO: 3438789 - DNA, 15 bp, Homo sapiens
ttccacggagccact

SEQ ID NO: 3438790 - DNA, 18 bp, Homo sapiens
ttccactattttcaaaga

SEQ ID NO: 3438791 - DNA, 16 bp, Homo sapiens
ttccactccattgtcg

SEQ ID NO: 3438792 - DNA, 15 bp, Homo sapiens
ttccactgagggcag

SEQ ID NO: 3438793 - DNA, 20 bp, Homo sapiens
ttccactgtcaagaaagagc

SEQ ID NO: 3438794 - DNA, 17 bp, Homo sapiens
ttccacttgtttgcact

SEQ ID NO: 3438795 - DNA, 19 bp, Homo sapiens
ttccagaatgctgtacatc

SEQ ID NO: 3438796 - DNA, 22 bp, Homo sapiens
ttccagacattctcgcttccct

SEQ ID NO: 3438797 - DNA, 22 bp, Homo sapiens
ttccagatcccaggcccctgga

SEQ ID NO: 3438798 - DNA, 15 bp, Homo sapiens
ttccagatcctctct

SEQ ID NO: 3438799 - DNA, 18 bp, Homo sapiens
ttccagatcctctctggg

SEQ ID NO: 3438800 - DNA, 16 bp, Homo sapiens
ttccagcagaagacaa

SEQ ID NO: 3438801 - DNA, 15 bp, Homo sapiens
ttccagccagggctg

SEQ ID NO: 3438802 - DNA, 20 bp, Homo sapiens
ttccagcccctctggtcgct

SEQ ID NO: 3438803 - DNA, 20 bp, Homo sapiens
ttccaggaggagttagccaa

SEQ ID NO: 3438804 - DNA, 23 bp, Homo sapiens
ttccaggaggagttagccaaaca

SEQ ID NO: 3438805 - DNA, 16 bp, Homo sapiens
ttccatagctgctgcc

SEQ ID NO: 3438806 - DNA, 18 bp, Homo sapiens
ttccatatatccttttct

SEQ ID NO: 3438807 - DNA, 14 bp, Homo sapiens
ttccatatattggc

SEQ ID NO: 3438808 - DNA, 15 bp, Homo sapiens
ttccatatcctggtg

SEQ ID NO: 3438809 - DNA, 18 bp, Homo sapiens
ttccatcctttacgtgtt

SEQ ID NO: 3438810 - DNA, 14 bp, Homo sapiens
ttccatctctgact

SEQ ID NO: 3438811 - DNA, 18 bp, Homo sapiens
ttccatgattctatttat

SEQ ID NO: 3438812 - DNA, 21 bp, Homo sapiens
ttccatggtgtgatcgtctga

SEQ ID NO: 3438813 - DNA, 12 bp, Homo sapiens
ttccatttccaa

SEQ ID NO: 3438814 - DNA, 16 bp, Homo sapiens
ttccatttccagttca

SEQ ID NO: 3438815 - DNA, 13 bp, Homo sapiens
ttccatttgcaag

SEQ ID NO: 3438816 - DNA, 21 bp, Homo sapiens
ttcccaaacccagtctcctct

SEQ ID NO: 3438817 - DNA, 16 bp, Homo sapiens
ttcccaaacgcctccc

SEQ ID NO: 3438818 - DNA, 17 bp, Homo sapiens
ttcccaactctagctgg

SEQ ID NO: 3438819 - DNA, 17 bp, Homo sapiens
ttcccaagatgcctgat

SEQ ID NO: 3438820 - DNA, 14 bp, Homo sapiens
ttcccaagctctgc

SEQ ID NO: 3438821 - DNA, 16 bp, Homo sapiens
ttcccaagctctgctc

SEQ ID NO: 3438822 - DNA, 20 bp, Homo sapiens
ttcccaagtaagaggctgga

SEQ ID NO: 3438823 - DNA, 14 bp, Homo sapiens
ttcccaattcacat

SEQ ID NO: 3438824 - DNA, 14 bp, Homo sapiens
ttcccacgaggaat

SEQ ID NO: 3438825 - DNA, 23 bp, Homo sapiens
ttcccagcactatgctttccttc

SEQ ID NO: 3438826 - DNA, 21 bp, Homo sapiens
ttcccagctacacctttctcc

SEQ ID NO: 3438827 - DNA, 13 bp, Homo sapiens
ttcccaggaccct

SEQ ID NO: 3438828 - DNA, 20 bp, Homo sapiens
ttcccaggaccctgaagggg

SEQ ID NO: 3438829 - DNA, 20 bp, Homo sapiens
tgttttaagaggcagggtct

SEQ ID NO: 3438830 - DNA, 22 bp, Homo sapiens
tgttttaagaggcagggtctca

SEQ ID NO: 3438831 - DNA, 20 bp, Homo sapiens
tgttttatggcctaaattta

SEQ ID NO: 3438832 - DNA, 14 bp, Homo sapiens
tgttttatttccta

SEQ ID NO: 3438833 - DNA, 17 bp, Homo sapiens
tgttttccagctcctca

SEQ ID NO: 3438834 - DNA, 16 bp, Homo sapiens
tgttttccgtgaaaac

SEQ ID NO: 3438835 - DNA, 22 bp, Homo sapiens
tgttttcctcccttctgctact

SEQ ID NO: 3438836 - DNA, 12 bp, Homo sapiens
tgttttctgggg

SEQ ID NO: 3438837 - DNA, 20 bp, Homo sapiens
tgttttctggggaaagggga

SEQ ID NO: 3438838 - DNA, 23 bp, Homo sapiens
tgttttggattctttaaatatat

SEQ ID NO: 3438839 - DNA, 13 bp, Homo sapiens
tgttttggggttt

SEQ ID NO: 3438840 - DNA, 12 bp, Homo sapiens
tgttttgtacca

SEQ ID NO: 3438841 - DNA, 13 bp, Homo sapiens
tgttttgtaccag

SEQ ID NO: 3438842 - DNA, 12 bp, Homo sapiens
tgttttgttaat

SEQ ID NO: 3438843 - DNA, 14 bp, Homo sapiens
tgttttgtttatta

SEQ ID NO: 3438844 - DNA, 19 bp, Homo sapiens
tgttttgtttggttttaca

SEQ ID NO: 3438845 - DNA, 17 bp, Homo sapiens
tgtttttaagctgtttc

SEQ ID NO: 3438846 - DNA, 20 bp, Homo sapiens
tgtttttaagctgtttccat

SEQ ID NO: 3438847 - DNA, 13 bp, Homo sapiens
tgtttttcacatt

SEQ ID NO: 3438848 - DNA, 16 bp, Homo sapiens
tgtttttgcacatgtt

SEQ ID NO: 3438849 - DNA, 13 bp, Homo sapiens
tgttttttccttt

SEQ ID NO: 3438850 - DNA, 22 bp, Homo sapiens
tgtttttttctttttttataaa

SEQ ID NO: 3438851 - DNA, 15 bp, Homo sapiens
ttaaaaaaaacaaaa

SEQ ID NO: 3438852 - DNA, 18 bp, Homo sapiens
ttaaaaaaaacaaaaaga

SEQ ID NO: 3438853 - DNA, 19 bp, Homo sapiens
ttaaaaaaaacaaaaagaa

SEQ ID NO: 3438854 - DNA, 12 bp, Homo sapiens
ttaaaaaaaaga

SEQ ID NO: 3438855 - DNA, 21 bp, Homo sapiens
ttaaaaaaataaaacagtatc

SEQ ID NO: 3438856 - DNA, 22 bp, Homo sapiens
ttaaaaaaataaaacagtatct

SEQ ID NO: 3438857 - DNA, 13 bp, Homo sapiens
ttaaaaaatactt

SEQ ID NO: 3438858 - DNA, 11 bp, Homo sapiens
ttaaaaataaa

SEQ ID NO: 3438859 - DNA, 15 bp, Homo sapiens
ttaaaaatataaaac

SEQ ID NO: 3438860 - DNA, 15 bp, Homo sapiens
ttaaaaatcaacttt

SEQ ID NO: 3438861 - DNA, 24 bp, Homo sapiens
ttaaaaatgttttttcatgtgttt

SEQ ID NO: 3438862 - DNA, 12 bp, Homo sapiens
ttaaaacacttt

SEQ ID NO: 3438863 - DNA, 12 bp, Homo sapiens
ttaaaagacaag

SEQ ID NO: 3438864 - DNA, 15 bp, Homo sapiens
ttaaaagacaagact

SEQ ID NO: 3438865 - DNA, 17 bp, Homo sapiens
ttaaaagagctcagaca

SEQ ID NO: 3438866 - DNA, 23 bp, Homo sapiens
ttaaaagtcagtatcatattatt

SEQ ID NO: 3438867 - DNA, 15 bp, Homo sapiens
ttaaaataaactgta

SEQ ID NO: 3438868 - DNA, 18 bp, Homo sapiens
ttaaaataaactgtaaac

SEQ ID NO: 3438869 - DNA, 22 bp, Homo sapiens
ttaaaatagcaacactctatat

SEQ ID NO: 3438870 - DNA, 14 bp, Homo sapiens
ttaaaatattttgg

SEQ ID NO: 3438871 - DNA, 21 bp, Homo sapiens
ttaaaatggatgccttgaata

SEQ ID NO: 3438872 - DNA, 12 bp, Homo sapiens
ttaaacacacag

SEQ ID NO: 3438873 - DNA, 22 bp, Homo sapiens
ttaaacacacagatacacacac

SEQ ID NO: 3438874 - DNA, 19 bp, Homo sapiens
ttaaacagatatcttcagt

SEQ ID NO: 3438875 - DNA, 19 bp, Homo sapiens
ttaaaccagattggagcaa

SEQ ID NO: 3438876 - DNA, 21 bp, Homo sapiens
ttaaactagcatatctgcctt

SEQ ID NO: 3438877 - DNA, 22 bp, Homo sapiens
ttaaactagcatatctgccttt

SEQ ID NO: 3438878 - DNA, 23 bp, Homo sapiens
ttaaactagcatatctgccttta

SEQ ID NO: 3438879 - DNA, 19 bp, Homo sapiens
ttaaactggtattttatct

SEQ ID NO: 3438880 - DNA, 19 bp, Homo sapiens
ttaaagctaaagtatctgt

SEQ ID NO: 3438881 - DNA, 20 bp, Homo sapiens
ttaaagtgactaatggcatg

SEQ ID NO: 3438882 - DNA, 15 bp, Homo sapiens
ttaaataaattgtat

SEQ ID NO: 3438883 - DNA, 17 bp, Homo sapiens
ttaaataaattgtatat

SEQ ID NO: 3438884 - DNA, 16 bp, Homo sapiens
ttaaatacaaaacttc

SEQ ID NO: 3438885 - DNA, 13 bp, Homo sapiens
ttaaatatatatt

SEQ ID NO: 3438886 - DNA, 20 bp, Homo sapiens
ttaaatatatattattctca

SEQ ID NO: 3438887 - DNA, 16 bp, Homo sapiens
ttaaatgtacagacat

SEQ ID NO: 3438888 - DNA, 12 bp, Homo sapiens
ttaaattacaat

SEQ ID NO: 3438889 - DNA, 23 bp, Homo sapiens
ttaaattctccagttttttgtta

SEQ ID NO: 3438890 - DNA, 15 bp, Homo sapiens
ttaaattttgtaatg

SEQ ID NO: 3438891 - DNA, 14 bp, Homo sapiens
ttaaattttgtgtc

SEQ ID NO: 3438892 - DNA, 12 bp, Homo sapiens
ttaacaaataca

SEQ ID NO: 3438893 - DNA, 13 bp, Homo sapiens
ttaacagagtctg

SEQ ID NO: 3438894 - DNA, 14 bp, Homo sapiens
ttaacagagtctga

SEQ ID NO: 3438895 - DNA, 19 bp, Homo sapiens
ttaacagagtctgaaccta

SEQ ID NO: 3438896 - DNA, 16 bp, Homo sapiens
ttaacatgatgtacta

SEQ ID NO: 3438897 - DNA, 18 bp, Homo sapiens
ttaaccaaaggtgaagga

SEQ ID NO: 3438898 - DNA, 17 bp, Homo sapiens
ttaaccacttcagctga

SEQ ID NO: 3438899 - DNA, 15 bp, Homo sapiens
ttaaccctttttcca

SEQ ID NO: 3438900 - DNA, 13 bp, Homo sapiens
ttaacctgatgca

SEQ ID NO: 3438901 - DNA, 20 bp, Homo sapiens
ttaacgtattagttgccaat

SEQ ID NO: 3438902 - DNA, 19 bp, Homo sapiens
ttaactactatattgattg

SEQ ID NO: 3438903 - DNA, 20 bp, Homo sapiens
ttaactactatattgattgt

SEQ ID NO: 3438904 - DNA, 16 bp, Homo sapiens
ttaactagaatttatt

SEQ ID NO: 3438905 - DNA, 17 bp, Homo sapiens
ttaactccctttttaca

SEQ ID NO: 3438906 - DNA, 16 bp, Homo sapiens
ttaactcttttggaca

SEQ ID NO: 3438907 - DNA, 16 bp, Homo sapiens
ttaactggtgaagaga

SEQ ID NO: 3438908 - DNA, 20 bp, Homo sapiens
ttaactggtgcactttgtaa

SEQ ID NO: 3438909 - DNA, 22 bp, Homo sapiens
ttaactggtgcactttgtaaat

SEQ ID NO: 3438910 - DNA, 23 bp, Homo sapiens
ttaactttgtggtctaaagtgtt

SEQ ID NO: 3438911 - DNA, 11 bp, Homo sapiens
ttaagaaaatc

SEQ ID NO: 3438912 - DNA, 18 bp, Homo sapiens
ttaagacatgatttcctt

SEQ ID NO: 3438913 - DNA, 11 bp, Homo sapiens
ttaagacctgg

SEQ ID NO: 3438914 - DNA, 14 bp, Homo sapiens
ttaagacctggcag

SEQ ID NO: 3438915 - DNA, 13 bp, Homo sapiens
ttaagacgtgttt

SEQ ID NO: 3438916 - DNA, 17 bp, Homo sapiens
ttaagacgtgtttgtgt

SEQ ID NO: 3438917 - DNA, 18 bp, Homo sapiens
ttaagactgattttaata

SEQ ID NO: 3438918 - DNA, 15 bp, Homo sapiens
ttaagaggcagggtc

SEQ ID NO: 3438919 - DNA, 15 bp, Homo sapiens
ttaagcctgaagagc

SEQ ID NO: 3438920 - DNA, 17 bp, Homo sapiens
ttaagctgttactgtct

SEQ ID NO: 3438921 - DNA, 18 bp, Homo sapiens
ttaaggacactggggtct

SEQ ID NO: 3438922 - DNA, 14 bp, Homo sapiens
ttaaggagcctaat

SEQ ID NO: 3438923 - DNA, 19 bp, Homo sapiens
ttaagtattgcatctgtat

SEQ ID NO: 3438924 - DNA, 19 bp, Homo sapiens
ttaagtccctgtcacctct

SEQ ID NO: 3438925 - DNA, 18 bp, Homo sapiens
ttaataagatatttagta

SEQ ID NO: 3438926 - DNA, 14 bp, Homo sapiens
ttaataatatactt

SEQ ID NO: 3438927 - DNA, 21 bp, Homo sapiens
ttaataatatacttgtggact

SEQ ID NO: 3438928 - DNA, 15 bp, Homo sapiens
ttaatactaccttga

SEQ ID NO: 3438929 - DNA, 18 bp, Homo sapiens
ttaatagtaatttgtaaa

SEQ ID NO: 3438930 - DNA, 19 bp, Homo sapiens
ttaatagtaatttgtaaag

SEQ ID NO: 3438931 - DNA, 12 bp, Homo sapiens
ttaatatgaaaa

SEQ ID NO: 3438932 - DNA, 16 bp, Homo sapiens
ttaatatgaaaactta

SEQ ID NO: 3438933 - DNA, 19 bp, Homo sapiens
ttaatatgctgcaacaaaa

SEQ ID NO: 3438934 - DNA, 20 bp, Homo sapiens
ttaatatgctgcaacaaaat

SEQ ID NO: 3438935 - DNA, 19 bp, Homo sapiens
ttaatatttgctgacagct

SEQ ID NO: 3438936 - DNA, 14 bp, Homo sapiens
ttaatcaagttgaa

SEQ ID NO: 3438937 - DNA, 17 bp, Homo sapiens
ttaatcaagttgaattg

SEQ ID NO: 3438938 - DNA, 15 bp, Homo sapiens
ttaatcattttcatt

SEQ ID NO: 3438939 - DNA, 14 bp, Homo sapiens
ttaatcttgctttc

SEQ ID NO: 3438940 - DNA, 16 bp, Homo sapiens
ttaatgaaaaggaatc

SEQ ID NO: 3438941 - DNA, 14 bp, Homo sapiens
ttaatgaagtttga

SEQ ID NO: 3438942 - DNA, 15 bp, Homo sapiens
ttaatgaagtttgaa

SEQ ID NO: 3438943 - DNA, 22 bp, Homo sapiens
ttaatgaagtttgaatgttaaa

SEQ ID NO: 3438944 - DNA, 22 bp, Homo sapiens
ttaatgaatcgtaatgaagttg

SEQ ID NO: 3438945 - DNA, 21 bp, Homo sapiens
ttaatgcaagagaacatttta

SEQ ID NO: 3438946 - DNA, 18 bp, Homo sapiens
ttaatgcttttatatttt

SEQ ID NO: 3438947 - DNA, 15 bp, Homo sapiens
ttaatgtttaaaaca

SEQ ID NO: 3438948 - DNA, 16 bp, Homo sapiens
ttaatgttttaaatgt

SEQ ID NO: 3438949 - DNA, 11 bp, Homo sapiens
ttaatgttttt

SEQ ID NO: 3438950 - DNA, 14 bp, Homo sapiens
ttaattaggaaaaa

SEQ ID NO: 3438951 - DNA, 13 bp, Homo sapiens
ttaattagtgcta

SEQ ID NO: 3438952 - DNA, 16 bp, Homo sapiens
ttaattagtgctaagt

SEQ ID NO: 3438953 - DNA, 18 bp, Homo sapiens
ttaattagtgctaagtgt

SEQ ID NO: 3438954 - DNA, 20 bp, Homo sapiens
ttaattagtgctaagtgtga

SEQ ID NO: 3438955 - DNA, 21 bp, Homo sapiens
ttaattagtgctaagtgtgaa

SEQ ID NO: 3438956 - DNA, 14 bp, Homo sapiens
ttaattcaggtatg

SEQ ID NO: 3438957 - DNA, 19 bp, Homo sapiens
ttaattgctttcctgcctc

SEQ ID NO: 3438958 - DNA, 18 bp, Homo sapiens
ttaatttagtaaatgtta

SEQ ID NO: 3438959 - DNA, 17 bp, Homo sapiens
ttaattttttggtacaa

SEQ ID NO: 3438960 - DNA, 13 bp, Homo sapiens
ttacaaagtgtgt

SEQ ID NO: 3438961 - DNA, 17 bp, Homo sapiens
ttacaaagtgtgtatta

SEQ ID NO: 3438962 - DNA, 22 bp, Homo sapiens
ttacaaagtgtgtattaaaaaa

SEQ ID NO: 3438963 - DNA, 15 bp, Homo sapiens
ttacaaggttatgta

SEQ ID NO: 3438964 - DNA, 18 bp, Homo sapiens
ttacaaggttatgtagag

SEQ ID NO: 3438965 - DNA, 14 bp, Homo sapiens
ttacaatgttttat

SEQ ID NO: 3438966 - DNA, 13 bp, Homo sapiens
ttacaattgaaat

SEQ ID NO: 3438967 - DNA, 16 bp, Homo sapiens
tgtattcagataatta

SEQ ID NO: 3438968 - DNA, 14 bp, Homo sapiens
tgtattcatatatt

SEQ ID NO: 3438969 - DNA, 22 bp, Homo sapiens
tgtattcatatattgcatttct

SEQ ID NO: 3438970 - DNA, 13 bp, Homo sapiens
tgtattctctgag

SEQ ID NO: 3438971 - DNA, 20 bp, Homo sapiens
tgtattctctgagctgtgca

SEQ ID NO: 3438972 - DNA, 18 bp, Homo sapiens
tgtattgtaaaaaattca

SEQ ID NO: 3438973 - DNA, 19 bp, Homo sapiens
tgtattgttttctgacagt

SEQ ID NO: 3438974 - DNA, 21 bp, Homo sapiens
tgtatttaacaaaaagtgctt

SEQ ID NO: 3438975 - DNA, 14 bp, Homo sapiens
tgtatttattcaat

SEQ ID NO: 3438976 - DNA, 17 bp, Homo sapiens
tgtatttattcaataaa

SEQ ID NO: 3438977 - DNA, 22 bp, Homo sapiens
tgtattttgtaaataataaaat

SEQ ID NO: 3438978 - DNA, 16 bp, Homo sapiens
tgtatttttatataat

SEQ ID NO: 3438979 - DNA, 23 bp, Homo sapiens
tgtatttttatataatatctaaa

SEQ ID NO: 3438980 - DNA, 19 bp, Homo sapiens
tgtatttttcaataaagca

SEQ ID NO: 3438981 - DNA, 17 bp, Homo sapiens
tgtattttttgtttgta

SEQ ID NO: 3438982 - DNA, 20 bp, Homo sapiens
tgtattttttgtttgtattg

SEQ ID NO: 3438983 - DNA, 21 bp, Homo sapiens
tgtattttttgtttgtattgt

SEQ ID NO: 3438984 - DNA, 20 bp, Homo sapiens
tgtatttttttgcaagtgaa

SEQ ID NO: 3438985 - DNA, 17 bp, Homo sapiens
tgtcaaacaaagccaga

SEQ ID NO: 3438986 - DNA, 12 bp, Homo sapiens
tgtcaaagcagg

SEQ ID NO: 3438987 - DNA, 15 bp, Homo sapiens
tgtcaacattgtgat

SEQ ID NO: 3438988 - DNA, 13 bp, Homo sapiens
tgtcaacttttga

SEQ ID NO: 3438989 - DNA, 14 bp, Homo sapiens
tgtcaagaaagagc

SEQ ID NO: 3438990 - DNA, 19 bp, Homo sapiens
tgtcaagagggtctgagga

SEQ ID NO: 3438991 - DNA, 22 bp, Homo sapiens
tgtcaagagtagttatataatt

SEQ ID NO: 3438992 - DNA, 20 bp, Homo sapiens
tgtcaagcctgtgcaaaaaa

SEQ ID NO: 3438993 - DNA, 18 bp, Homo sapiens
tgtcaagctgctctgagc

SEQ ID NO: 3438994 - DNA, 19 bp, Homo sapiens
tgtcaaggctgcttagaat

SEQ ID NO: 3438995 - DNA, 21 bp, Homo sapiens
tgtcaagtcccccagcagaac

SEQ ID NO: 3438996 - DNA, 17 bp, Homo sapiens
tgtcaagtctctgctgg

SEQ ID NO: 3438997 - DNA, 19 bp, Homo sapiens
tgtcaagtctctgctggcc

SEQ ID NO: 3438998 - DNA, 21 bp, Homo sapiens
tgtcaatattggtgtactgta

SEQ ID NO: 3438999 - DNA, 16 bp, Homo sapiens
tgtcaatgatttgtca

SEQ ID NO: 3439000 - DNA, 23 bp, Homo sapiens
tgtcaatgccaggatttctcatt

SEQ ID NO: 3439001 - DNA, 17 bp, Homo sapiens
tgtcaatttatgaatat

SEQ ID NO: 3439002 - DNA, 19 bp, Homo sapiens
tgtcaatttatgaatataa

SEQ ID NO: 3439003 - DNA, 13 bp, Homo sapiens
tgtcacaggcagg

SEQ ID NO: 3439004 - DNA, 16 bp, Homo sapiens
tgtcacaggcaggtcc

SEQ ID NO: 3439005 - DNA, 14 bp, Homo sapiens
tgtcaccaaggaaa

SEQ ID NO: 3439006 - DNA, 23 bp, Homo sapiens
tgtcaccaaggaaacgctacctc

SEQ ID NO: 3439007 - DNA, 20 bp, Homo sapiens
tgtcactcaaggcggtgctt

SEQ ID NO: 3439008 - DNA, 22 bp, Homo sapiens
tgtcactcattgctgagcctct

SEQ ID NO: 3439009 - DNA, 16 bp, Homo sapiens
tgtcactgcttttggc

SEQ ID NO: 3439010 - DNA, 21 bp, Homo sapiens
tgtcactgcttttggcctgga

SEQ ID NO: 3439011 - DNA, 18 bp, Homo sapiens
tgtcagcaaaaagcaaaa

SEQ ID NO: 3439012 - DNA, 22 bp, Homo sapiens
tgtcagcaaaaagcaaaatcat

SEQ ID NO: 3439013 - DNA, 19 bp, Homo sapiens
tgtcagtggggctctctga

SEQ ID NO: 3439014 - DNA, 20 bp, Homo sapiens
tgtcatatgtagccttcaca

SEQ ID NO: 3439015 - DNA, 13 bp, Homo sapiens
tgtcatctgtgca

SEQ ID NO: 3439016 - DNA, 14 bp, Homo sapiens
tgtcattagcctga

SEQ ID NO: 3439017 - DNA, 17 bp, Homo sapiens
tgtcattagcctgagta

SEQ ID NO: 3439018 - DNA, 19 bp, Homo sapiens
tgtcatttgagcagggctc

SEQ ID NO: 3439019 - DNA, 14 bp, Homo sapiens
tgtccaatcctatg

SEQ ID NO: 3439020 - DNA, 18 bp, Homo sapiens
tgtccacacccagctcag

SEQ ID NO: 3439021 - DNA, 18 bp, Homo sapiens
tgtccacgactgtctcca

SEQ ID NO: 3439022 - DNA, 19 bp, Homo sapiens
tgtccacgtgtgtgtgtga

SEQ ID NO: 3439023 - DNA, 19 bp, Homo sapiens
tgtccagcattgctggact

SEQ ID NO: 3439024 - DNA, 17 bp, Homo sapiens
tgtccagctcccgctgt

SEQ ID NO: 3439025 - DNA, 17 bp, Homo sapiens
tgtccagctgagcgcca

SEQ ID NO: 3439026 - DNA, 21 bp, Homo sapiens
tgtccagctgagcgccaggat

SEQ ID NO: 3439027 - DNA, 12 bp, Homo sapiens
tgtccagtgcct

SEQ ID NO: 3439028 - DNA, 16 bp, Homo sapiens
tgtccagtgcctacat

SEQ ID NO: 3439029 - DNA, 20 bp, Homo sapiens
tgtccatgcgctcagggcca

SEQ ID NO: 3439030 - DNA, 18 bp, Homo sapiens
tgtcccaccatacgagca

SEQ ID NO: 3439031 - DNA, 23 bp, Homo sapiens
tgtcccaccatacgagcacctcc

SEQ ID NO: 3439032 - DNA, 20 bp, Homo sapiens
tgtcccagaggctgccccac

SEQ ID NO: 3439033 - DNA, 17 bp, Homo sapiens
tgtcccatctctacccc

SEQ ID NO: 3439034 - DNA, 14 bp, Homo sapiens
tgtccccaaatccg

SEQ ID NO: 3439035 - DNA, 19 bp, Homo sapiens
tgtccccaaatccgaacct

SEQ ID NO: 3439036 - DNA, 21 bp, Homo sapiens
tgtccccaaatccgaacctcc

SEQ ID NO: 3439037 - DNA, 22 bp, Homo sapiens
tgtccccaaatccgaacctcct

SEQ ID NO: 3439038 - DNA, 12 bp, Homo sapiens
tgtcccctccca

SEQ ID NO: 3439039 - DNA, 13 bp, Homo sapiens
tgtcccctcccag

SEQ ID NO: 3439040 - DNA, 16 bp, Homo sapiens
tgtcccctcccagagc

SEQ ID NO: 3439041 - DNA, 22 bp, Homo sapiens
tgtccccttctctcatctctta

SEQ ID NO: 3439042 - DNA, 21 bp, Homo sapiens
tgtccctcactgttgaatttt

SEQ ID NO: 3439043 - DNA, 12 bp, Homo sapiens
tgtccctccggg

SEQ ID NO: 3439044 - DNA, 22 bp, Homo sapiens
tgtccctgcacttgcagactct

SEQ ID NO: 3439045 - DNA, 18 bp, Homo sapiens
tgtccctgcgcctttcct

SEQ ID NO: 3439046 - DNA, 16 bp, Homo sapiens
tgtcccttaaacaaaa

SEQ ID NO: 3439047 - DNA, 14 bp, Homo sapiens
tgtccgagctttga

SEQ ID NO: 3439048 - DNA, 16 bp, Homo sapiens
tgtcctaattcttctg

SEQ ID NO: 3439049 - DNA, 20 bp, Homo sapiens
tgtcctcacggtgccttttt

SEQ ID NO: 3439050 - DNA, 22 bp, Homo sapiens
tgtcctcacggtgccttttttc

SEQ ID NO: 3439051 - DNA, 12 bp, Homo sapiens
tgtcctcagcct

SEQ ID NO: 3439052 - DNA, 13 bp, Homo sapiens
tgtcctcagcctt

SEQ ID NO: 3439053 - DNA, 17 bp, Homo sapiens
tgtcctcagccttgcca

SEQ ID NO: 3439054 - DNA, 18 bp, Homo sapiens
tgtcctcaggtggccatg

SEQ ID NO: 3439055 - DNA, 19 bp, Homo sapiens
tgtcctcaggtggccatgc

SEQ ID NO: 3439056 - DNA, 18 bp, Homo sapiens
tgtcctcatttctccaga

SEQ ID NO: 3439057 - DNA, 17 bp, Homo sapiens
tgtcctccaagccagcg

SEQ ID NO: 3439058 - DNA, 15 bp, Homo sapiens
tgtcctccaggagct

SEQ ID NO: 3439059 - DNA, 21 bp, Homo sapiens
tgtcctccaggagcttcttgt

SEQ ID NO: 3439060 - DNA, 22 bp, Homo sapiens
tgtcctgaaacgctcctttgtg

SEQ ID NO: 3439061 - DNA, 18 bp, Homo sapiens
tgtcctgaaagcggctgc

SEQ ID NO: 3439062 - DNA, 15 bp, Homo sapiens
tgtcctgatgctttt

SEQ ID NO: 3439063 - DNA, 19 bp, Homo sapiens
tgtcctgcctgtctgcccc

SEQ ID NO: 3439064 - DNA, 21 bp, Homo sapiens
tgtcctgcctgtctgccccag

SEQ ID NO: 3439065 - DNA, 12 bp, Homo sapiens
tgtcctgggagt

SEQ ID NO: 3439066 - DNA, 19 bp, Homo sapiens
tgtcctgggagtgagctgg

SEQ ID NO: 3439067 - DNA, 14 bp, Homo sapiens
tgtcctgggcctgc

SEQ ID NO: 3439068 - DNA, 18 bp, Homo sapiens
tgtccttagaacatttta

SEQ ID NO: 3439069 - DNA, 19 bp, Homo sapiens
tgtcctttaaaaaagaaaa

SEQ ID NO: 3439070 - DNA, 16 bp, Homo sapiens
tgtcctttttgttatt

SEQ ID NO: 3439071 - DNA, 15 bp, Homo sapiens
tgtcgggcaccagcc

SEQ ID NO: 3439072 - DNA, 23 bp, Homo sapiens
tgtcgtgagtgtctcttgtctaa

SEQ ID NO: 3439073 - DNA, 22 bp, Homo sapiens
tgtctaaaatgcctcagtgtat

SEQ ID NO: 3439074 - DNA, 17 bp, Homo sapiens
tgtctaaacaatgctga

SEQ ID NO: 3439075 - DNA, 21 bp, Homo sapiens
tgtctaaacaatgctgatttg

SEQ ID NO: 3439076 - DNA, 18 bp, Homo sapiens
tgtctaattaaaacactt

SEQ ID NO: 3439077 - DNA, 18 bp, Homo sapiens
tgtctactcagcatttga

SEQ ID NO: 3439078 - DNA, 20 bp, Homo sapiens
tgtctagagcctcttgggga

SEQ ID NO: 3439079 - DNA, 19 bp, Homo sapiens
tgtctagggtgttctgtac

SEQ ID NO: 3439080 - DNA, 21 bp, Homo sapiens
tgtctcaaaaaaagaaaaaga

SEQ ID NO: 3439081 - DNA, 14 bp, Homo sapiens
tgtctcagcctccc

SEQ ID NO: 3439082 - DNA, 15 bp, Homo sapiens
tgtctcagcctccca

SEQ ID NO: 3439083 - DNA, 21 bp, Homo sapiens
tgtctccaaccccccagcact

SEQ ID NO: 3439084 - DNA, 20 bp, Homo sapiens
tgtctctagaagtgccatct

SEQ ID NO: 3439085 - DNA, 23 bp, Homo sapiens
tgtctctagaagtgccatctcaa

SEQ ID NO: 3439086 - DNA, 12 bp, Homo sapiens
tgtctctctggg

SEQ ID NO: 3439087 - DNA, 14 bp, Homo sapiens
tgtctcttgagttt

SEQ ID NO: 3439088 - DNA, 17 bp, Homo sapiens
tgtctcttgagtttgtc

SEQ ID NO: 3439089 - DNA, 13 bp, Homo sapiens
tgtctctttcatg

SEQ ID NO: 3439090 - DNA, 23 bp, Homo sapiens
tgtctctttggcgacctcctttc

SEQ ID NO: 3439091 - DNA, 17 bp, Homo sapiens
tgtctgagtgaacctgt

SEQ ID NO: 3439092 - DNA, 17 bp, Homo sapiens
tgtctgcagccctgaga

SEQ ID NO: 3439093 - DNA, 15 bp, Homo sapiens
tgtctgcagccttga

SEQ ID NO: 3439094 - DNA, 23 bp, Homo sapiens
tgtctggaaacctgtcattgtat

SEQ ID NO: 3439095 - DNA, 21 bp, Homo sapiens
tgtctggatgatgctgtgcta

SEQ ID NO: 3439096 - DNA, 19 bp, Homo sapiens
tgtctggattcccaggatg

SEQ ID NO: 3439097 - DNA, 13 bp, Homo sapiens
tgtctgtgtgtgt

SEQ ID NO: 3439098 - DNA, 19 bp, Homo sapiens
tgtcttaatgaagtttgaa

SEQ ID NO: 3439099 - DNA, 20 bp, Homo sapiens
tgtcttaatttctatcttgt

SEQ ID NO: 3439100 - DNA, 13 bp, Homo sapiens
tgtcttatttgtt

SEQ ID NO: 3439101 - DNA, 13 bp, Homo sapiens
tgtcttcacctga

SEQ ID NO: 3439102 - DNA, 15 bp, Homo sapiens
ttacaattgaaatga

SEQ ID NO: 3439103 - DNA, 17 bp, Homo sapiens
ttacaattgaaatgact

SEQ ID NO: 3439104 - DNA, 12 bp, Homo sapiens
ttacaatttaca

SEQ ID NO: 3439105 - DNA, 16 bp, Homo sapiens
ttacaatttacaaagt

SEQ ID NO: 3439106 - DNA, 19 bp, Homo sapiens
ttacaatttacaaagtgtg

SEQ ID NO: 3439107 - DNA, 13 bp, Homo sapiens
ttacaattttatc

SEQ ID NO: 3439108 - DNA, 18 bp, Homo sapiens
ttacaattttatctgttt

SEQ ID NO: 3439109 - DNA, 16 bp, Homo sapiens
ttacacaagagctgga

SEQ ID NO: 3439110 - DNA, 18 bp, Homo sapiens
ttacacaatggtttttaa

SEQ ID NO: 3439111 - DNA, 23 bp, Homo sapiens
ttacacagaaatgctgctggcca

SEQ ID NO: 3439112 - DNA, 17 bp, Homo sapiens
ttacactttatggtaag

SEQ ID NO: 3439113 - DNA, 21 bp, Homo sapiens
ttacaggatattccaaaataa

SEQ ID NO: 3439114 - DNA, 15 bp, Homo sapiens
ttacaggttcttagg

SEQ ID NO: 3439115 - DNA, 22 bp, Homo sapiens
ttacagtaaagtatagaaatat

SEQ ID NO: 3439116 - DNA, 17 bp, Homo sapiens
ttacagtgtctgtgtgt

SEQ ID NO: 3439117 - DNA, 13 bp, Homo sapiens
ttacatcttgtag

SEQ ID NO: 3439118 - DNA, 20 bp, Homo sapiens
ttacatgtaatttgatgagg

SEQ ID NO: 3439119 - DNA, 21 bp, Homo sapiens
ttacatgtataaagtgattga

SEQ ID NO: 3439120 - DNA, 16 bp, Homo sapiens
ttacatgtttataaat

SEQ ID NO: 3439121 - DNA, 16 bp, Homo sapiens
ttacattacagaatat

SEQ ID NO: 3439122 - DNA, 16 bp, Homo sapiens
ttacattctctaataa

SEQ ID NO: 3439123 - DNA, 13 bp, Homo sapiens
ttacattgttcaa

SEQ ID NO: 3439124 - DNA, 16 bp, Homo sapiens
ttaccaaaaattttgt

SEQ ID NO: 3439125 - DNA, 19 bp, Homo sapiens
ttaccatggagttaacatc

SEQ ID NO: 3439126 - DNA, 14 bp, Homo sapiens
ttaccatgtaaata

SEQ ID NO: 3439127 - DNA, 21 bp, Homo sapiens
ttacccaaacccatggctcta

SEQ ID NO: 3439128 - DNA, 16 bp, Homo sapiens
ttacccacacacagat

SEQ ID NO: 3439129 - DNA, 18 bp, Homo sapiens
ttacccactgccatgcac

SEQ ID NO: 3439130 - DNA, 17 bp, Homo sapiens
ttacccccattcgcgct

SEQ ID NO: 3439131 - DNA, 13 bp, Homo sapiens
ttaccccgggaga

SEQ ID NO: 3439132 - DNA, 21 bp, Homo sapiens
ttacccggagaaggccgctgc

SEQ ID NO: 3439133 - DNA, 13 bp, Homo sapiens
ttaccctctttgc

SEQ ID NO: 3439134 - DNA, 15 bp, Homo sapiens
ttaccctctttgctg

SEQ ID NO: 3439135 - DNA, 12 bp, Homo sapiens
ttacccttagaa

SEQ ID NO: 3439136 - DNA, 15 bp, Homo sapiens
ttaccgcgttgtaaa

SEQ ID NO: 3439137 - DNA, 11 bp, Homo sapiens
ttacctctgat

SEQ ID NO: 3439138 - DNA, 21 bp, Homo sapiens
ttacctctgatacctcaaccc

SEQ ID NO: 3439139 - DNA, 18 bp, Homo sapiens
ttacctgaaaacactgtg

SEQ ID NO: 3439140 - DNA, 15 bp, Homo sapiens
ttacctgctgcttct

SEQ ID NO: 3439141 - DNA, 20 bp, Homo sapiens
ttacctgtcattttgcactg

SEQ ID NO: 3439142 - DNA, 13 bp, Homo sapiens
ttacctgtgtgct

SEQ ID NO: 3439143 - DNA, 15 bp, Homo sapiens
ttaccttgttattta

SEQ ID NO: 3439144 - DNA, 13 bp, Homo sapiens
ttacgctttgatt

SEQ ID NO: 3439145 - DNA, 15 bp, Homo sapiens
ttacgctttgattca

SEQ ID NO: 3439146 - DNA, 17 bp, Homo sapiens
ttacgtgtttaaaaaaa

SEQ ID NO: 3439147 - DNA, 18 bp, Homo sapiens
ttactaagttttcaaatt

SEQ ID NO: 3439148 - DNA, 17 bp, Homo sapiens
ttactaattatactact

SEQ ID NO: 3439149 - DNA, 16 bp, Homo sapiens
ttactagaaatgggaa

SEQ ID NO: 3439150 - DNA, 14 bp, Homo sapiens
ttactaggtaactt

SEQ ID NO: 3439151 - DNA, 16 bp, Homo sapiens
ttactaggtaacttca

SEQ ID NO: 3439152 - DNA, 17 bp, Homo sapiens
ttactaggtaacttcat

SEQ ID NO: 3439153 - DNA, 13 bp, Homo sapiens
ttactatgcctgt

SEQ ID NO: 3439154 - DNA, 14 bp, Homo sapiens
ttactgagcttctc

SEQ ID NO: 3439155 - DNA, 16 bp, Homo sapiens
ttactgcttcattttt

SEQ ID NO: 3439156 - DNA, 17 bp, Homo sapiens
ttactggacaaagaatt

SEQ ID NO: 3439157 - DNA, 23 bp, Homo sapiens
ttactgtcaaggctgcttagaat

SEQ ID NO: 3439158 - DNA, 19 bp, Homo sapiens
ttactgttgtacaatcatg

SEQ ID NO: 3439159 - DNA, 20 bp, Homo sapiens
ttactgttgtacaatcatgt

SEQ ID NO: 3439160 - DNA, 16 bp, Homo sapiens
ttacttaactgtttca

SEQ ID NO: 3439161 - DNA, 15 bp, Homo sapiens
ttacttctctataaa

SEQ ID NO: 3439162 - DNA, 11 bp, Homo sapiens
ttacttctgct

SEQ ID NO: 3439163 - DNA, 12 bp, Homo sapiens
ttacttctgcta

SEQ ID NO: 3439164 - DNA, 14 bp, Homo sapiens
ttacttcttgccct

SEQ ID NO: 3439165 - DNA, 18 bp, Homo sapiens
ttactttaaaaggagcca

SEQ ID NO: 3439166 - DNA, 23 bp, Homo sapiens
ttacttttttttttttttggtag

SEQ ID NO: 3439167 - DNA, 21 bp, Homo sapiens
ttagaaaaagaacatgcagtt

SEQ ID NO: 3439168 - DNA, 19 bp, Homo sapiens
ttagaaaatgttatttaac

SEQ ID NO: 3439169 - DNA, 17 bp, Homo sapiens
ttagaaagcatttgaat

SEQ ID NO: 3439170 - DNA, 18 bp, Homo sapiens
ttagaaagcatttgaatg

SEQ ID NO: 3439171 - DNA, 12 bp, Homo sapiens
ttagaacatttt

SEQ ID NO: 3439172 - DNA, 18 bp, Homo sapiens
ttagaacattttaattca

SEQ ID NO: 3439173 - DNA, 21 bp, Homo sapiens
ttagaatcagccttgaaacat

SEQ ID NO: 3439174 - DNA, 22 bp, Homo sapiens
ttagaatccaaacttggatttt

SEQ ID NO: 3439175 - DNA, 11 bp, Homo sapiens
ttagacagagt

SEQ ID NO: 3439176 - DNA, 17 bp, Homo sapiens
ttagacatcttcagatt

SEQ ID NO: 3439177 - DNA, 21 bp, Homo sapiens
ttagactcatggtgtgttaca

SEQ ID NO: 3439178 - DNA, 22 bp, Homo sapiens
ttagactcatggtgtgttacac

SEQ ID NO: 3439179 - DNA, 20 bp, Homo sapiens
ttagagcagtttctgtcctg

SEQ ID NO: 3439180 - DNA, 14 bp, Homo sapiens
ttagagttagactg

SEQ ID NO: 3439181 - DNA, 18 bp, Homo sapiens
ttagagttagactgttgg

SEQ ID NO: 3439182 - DNA, 20 bp, Homo sapiens
ttagatacactaaaaatctg

SEQ ID NO: 3439183 - DNA, 15 bp, Homo sapiens
ttagatgattatata

SEQ ID NO: 3439184 - DNA, 17 bp, Homo sapiens
ttagatggattctccac

SEQ ID NO: 3439185 - DNA, 16 bp, Homo sapiens
ttagatggtggcacat

SEQ ID NO: 3439186 - DNA, 22 bp, Homo sapiens
ttagatgttccagtaatctaat

SEQ ID NO: 3439187 - DNA, 22 bp, Homo sapiens
ttagatgttctaagtctttcca

SEQ ID NO: 3439188 - DNA, 19 bp, Homo sapiens
ttagatgttctctatcatt

SEQ ID NO: 3439189 - DNA, 23 bp, Homo sapiens
ttagatgttctctatcatttaat

SEQ ID NO: 3439190 - DNA, 14 bp, Homo sapiens
ttagattattgaaa

SEQ ID NO: 3439191 - DNA, 12 bp, Homo sapiens
ttagcagacagg

SEQ ID NO: 3439192 - DNA, 13 bp, Homo sapiens
ttagccacaaaat

SEQ ID NO: 3439193 - DNA, 21 bp, Homo sapiens
ttagccagaatctcattactg

SEQ ID NO: 3439194 - DNA, 18 bp, Homo sapiens
ttagctcccctccaacct

SEQ ID NO: 3439195 - DNA, 20 bp, Homo sapiens
ttagctgcttctatgtttca

SEQ ID NO: 3439196 - DNA, 13 bp, Homo sapiens
ttagcttcaggaa

SEQ ID NO: 3439197 - DNA, 15 bp, Homo sapiens
ttaggaagagaaacc

SEQ ID NO: 3439198 - DNA, 13 bp, Homo sapiens
ttaggagaagcca

SEQ ID NO: 3439199 - DNA, 17 bp, Homo sapiens
ttaggagaagccaggaa

SEQ ID NO: 3439200 - DNA, 20 bp, Homo sapiens
ttaggatacttaacaaatac

SEQ ID NO: 3439201 - DNA, 16 bp, Homo sapiens
ttaggcagactcttta

SEQ ID NO: 3439202 - DNA, 16 bp, Homo sapiens
ttaggctggtggccca

SEQ ID NO: 3439203 - DNA, 17 bp, Homo sapiens
ttagggcaccaggggtt

SEQ ID NO: 3439204 - DNA, 16 bp, Homo sapiens
ttagggttctgcctct

SEQ ID NO: 3439205 - DNA, 14 bp, Homo sapiens
ttaggtagaaaaac

SEQ ID NO: 3439206 - DNA, 19 bp, Homo sapiens
ttaggtatgtttgtaactt

SEQ ID NO: 3439207 - DNA, 19 bp, Homo sapiens
ttaggtgtgggggaagcac

SEQ ID NO: 3439208 - DNA, 17 bp, Homo sapiens
ttagtaaaaaatcaatt

SEQ ID NO: 3439209 - DNA, 12 bp, Homo sapiens
ttagtaacatgt

SEQ ID NO: 3439210 - DNA, 14 bp, Homo sapiens
ttagtagagacagg

SEQ ID NO: 3439211 - DNA, 13 bp, Homo sapiens
ttagtcgtgagct

SEQ ID NO: 3439212 - DNA, 22 bp, Homo sapiens
ttagtctcttgtattaaactct

SEQ ID NO: 3439213 - DNA, 15 bp, Homo sapiens
ttagtgctaagtgtg

SEQ ID NO: 3439214 - DNA, 19 bp, Homo sapiens
ttagtgctaagtgtgaact

SEQ ID NO: 3439215 - DNA, 21 bp, Homo sapiens
ttagtgctaagtgtgaactgg

SEQ ID NO: 3439216 - DNA, 12 bp, Homo sapiens
ttagttgcacta

SEQ ID NO: 3439217 - DNA, 13 bp, Homo sapiens
ttagttgcactaa

SEQ ID NO: 3439218 - DNA, 14 bp, Homo sapiens
ttagttgccaatat

SEQ ID NO: 3439219 - DNA, 16 bp, Homo sapiens
ttagttgccaatatgc

SEQ ID NO: 3439220 - DNA, 21 bp, Homo sapiens
ttagtttcaagagtctaaacc

SEQ ID NO: 3439221 - DNA, 13 bp, Homo sapiens
ttagttttcttgt

SEQ ID NO: 3439222 - DNA, 20 bp, Homo sapiens
ttataaaatggctgtaatca

SEQ ID NO: 3439223 - DNA, 18 bp, Homo sapiens
ttataaatcttatgctct

SEQ ID NO: 3439224 - DNA, 22 bp, Homo sapiens
ttataactactccggagacagg

SEQ ID NO: 3439225 - DNA, 16 bp, Homo sapiens
ttataattttcctaat

SEQ ID NO: 3439226 - DNA, 16 bp, Homo sapiens
ttataatttttttcaa

SEQ ID NO: 3439227 - DNA, 15 bp, Homo sapiens
ttatactgtacaata

SEQ ID NO: 3439228 - DNA, 23 bp, Homo sapiens
ttatagaatatttattacctctg

SEQ ID NO: 3439229 - DNA, 15 bp, Homo sapiens
ttatagacaaataat

SEQ ID NO: 3439230 - DNA, 21 bp, Homo sapiens
ttatagatcatttctaggcaa

SEQ ID NO: 3439231 - DNA, 16 bp, Homo sapiens
ttatagtttgggcttc

SEQ ID NO: 3439232 - DNA, 18 bp, Homo sapiens
ttatataatatctaaagt

SEQ ID NO: 3439233 - DNA, 16 bp, Homo sapiens
ttatataattgttgaa

SEQ ID NO: 3439234 - DNA, 15 bp, Homo sapiens
ttatatattgttgtt

SEQ ID NO: 3439235 - DNA, 15 bp, Homo sapiens
ttatatcatatgtat

SEQ ID NO: 3439236 - DNA, 19 bp, Homo sapiens
ttatatgtacatgagaagg

SEQ ID NO: 3439237 - DNA, 16 bp, Homo sapiens
ttatatgtcaaagcag

SEQ ID NO: 3439238 - DNA, 21 bp, Homo sapiens
ttatatttcagatgtaatgtt

SEQ ID NO: 3439239 - DNA, 14 bp, Homo sapiens
ttatatttgacatg

SEQ ID NO: 3439240 - DNA, 13 bp, Homo sapiens
ttgcctctgtgct

SEQ ID NO: 3439241 - DNA, 21 bp, Homo sapiens
ttgcctcttttacctgctgct

SEQ ID NO: 3439242 - DNA, 22 bp, Homo sapiens
ttgccttcctaagcctgtggct

SEQ ID NO: 3439243 - DNA, 14 bp, Homo sapiens
ttgccttctcacca

SEQ ID NO: 3439244 - DNA, 17 bp, Homo sapiens
ttgccttctcaccagct

SEQ ID NO: 3439245 - DNA, 20 bp, Homo sapiens
ttgccttctcaccagctgca

SEQ ID NO: 3439246 - DNA, 18 bp, Homo sapiens
ttgcctttcgaggcctga

SEQ ID NO: 3439247 - DNA, 15 bp, Homo sapiens
ttgccttttaatttt

SEQ ID NO: 3439248 - DNA, 20 bp, Homo sapiens
ttgcgttggtctctgcattt

SEQ ID NO: 3439249 - DNA, 18 bp, Homo sapiens
ttgctctatgctttccaa

SEQ ID NO: 3439250 - DNA, 20 bp, Homo sapiens
ttgctctgtttgtggggtga

SEQ ID NO: 3439251 - DNA, 15 bp, Homo sapiens
ttgctgagcctctgc

SEQ ID NO: 3439252 - DNA, 22 bp, Homo sapiens
ttgctgagcctctgctccccag

SEQ ID NO: 3439253 - DNA, 12 bp, Homo sapiens
ttgctgcagaga

SEQ ID NO: 3439254 - DNA, 14 bp, Homo sapiens
ttgctgccagagaa

SEQ ID NO: 3439255 - DNA, 17 bp, Homo sapiens
ttgctgctgtccagtgc

SEQ ID NO: 3439256 - DNA, 19 bp, Homo sapiens
ttgctgctgtccagtgcct

SEQ ID NO: 3439257 - DNA, 18 bp, Homo sapiens
ttgctgtaagatgtctgt

SEQ ID NO: 3439258 - DNA, 16 bp, Homo sapiens
ttgctgtataagttat

SEQ ID NO: 3439259 - DNA, 11 bp, Homo sapiens
ttgctgtatat

SEQ ID NO: 3439260 - DNA, 18 bp, Homo sapiens
ttgctgtatgctgatcat

SEQ ID NO: 3439261 - DNA, 18 bp, Homo sapiens
ttgctgtctgcagccttg

SEQ ID NO: 3439262 - DNA, 20 bp, Homo sapiens
ttgctgtgagcaagaagtca

SEQ ID NO: 3439263 - DNA, 23 bp, Homo sapiens
ttgctgttattatatttgacatg

SEQ ID NO: 3439264 - DNA, 12 bp, Homo sapiens
ttgctgttgaca

SEQ ID NO: 3439265 - DNA, 19 bp, Homo sapiens
ttgctgttgtccaactatt

SEQ ID NO: 3439266 - DNA, 19 bp, Homo sapiens
ttgctgttttcctcccttc

SEQ ID NO: 3439267 - DNA, 17 bp, Homo sapiens
ttgcttccccttttgcc

SEQ ID NO: 3439268 - DNA, 20 bp, Homo sapiens
ttgcttccccttttgccaat

SEQ ID NO: 3439269 - DNA, 22 bp, Homo sapiens
ttgcttcttctcctatgtgtaa

SEQ ID NO: 3439270 - DNA, 16 bp, Homo sapiens
ttgcttgggtctctct

SEQ ID NO: 3439271 - DNA, 15 bp, Homo sapiens
ttgctttattccaga

SEQ ID NO: 3439272 - DNA, 13 bp, Homo sapiens
ttgctttcactct

SEQ ID NO: 3439273 - DNA, 18 bp, Homo sapiens
ttgctttctttagaattt

SEQ ID NO: 3439274 - DNA, 11 bp, Homo sapiens
ttgctttgagc

SEQ ID NO: 3439275 - DNA, 14 bp, Homo sapiens
ttgctttgcccagc

SEQ ID NO: 3439276 - DNA, 20 bp, Homo sapiens
ttgcttttggcaaaactcta

SEQ ID NO: 3439277 - DNA, 17 bp, Homo sapiens
ttggaaccatgccttcc

SEQ ID NO: 3439278 - DNA, 19 bp, Homo sapiens
ttggaagatcctgtgagga

SEQ ID NO: 3439279 - DNA, 23 bp, Homo sapiens
ttggaatattgtccattgtccaa

SEQ ID NO: 3439280 - DNA, 13 bp, Homo sapiens
ttggacatcagtg

SEQ ID NO: 3439281 - DNA, 16 bp, Homo sapiens
ttggacatcagtgttt

SEQ ID NO: 3439282 - DNA, 14 bp, Homo sapiens
ttggaccagatcta

SEQ ID NO: 3439283 - DNA, 19 bp, Homo sapiens
ttggacctaaatggcctca

SEQ ID NO: 3439284 - DNA, 18 bp, Homo sapiens
ttggagagtttcctgaaa

SEQ ID NO: 3439285 - DNA, 21 bp, Homo sapiens
ttggagagtttcctgaaacaa

SEQ ID NO: 3439286 - DNA, 22 bp, Homo sapiens
ttggagcactgttctgggactc

SEQ ID NO: 3439287 - DNA, 14 bp, Homo sapiens
ttggagcttcatgg

SEQ ID NO: 3439288 - DNA, 14 bp, Homo sapiens
ttggaggagagagc

SEQ ID NO: 3439289 - DNA, 16 bp, Homo sapiens
ttggaggagagagcct

SEQ ID NO: 3439290 - DNA, 18 bp, Homo sapiens
ttggaggagagagccttg

SEQ ID NO: 3439291 - DNA, 19 bp, Homo sapiens
ttggaggagcaaagttaaa

SEQ ID NO: 3439292 - DNA, 21 bp, Homo sapiens
ttggaggcaatcctaccttgc

SEQ ID NO: 3439293 - DNA, 16 bp, Homo sapiens
ttggagggtgtcccaa

SEQ ID NO: 3439294 - DNA, 22 bp, Homo sapiens
ttggagtgttccccttccactg

SEQ ID NO: 3439295 - DNA, 13 bp, Homo sapiens
ttggatccaagga

SEQ ID NO: 3439296 - DNA, 19 bp, Homo sapiens
ttggatccgtttgaccaat

SEQ ID NO: 3439297 - DNA, 18 bp, Homo sapiens
ttggattctttaaatata

SEQ ID NO: 3439298 - DNA, 13 bp, Homo sapiens
ttggcaggctggc

SEQ ID NO: 3439299 - DNA, 13 bp, Homo sapiens
ttggcattccgca

SEQ ID NO: 3439300 - DNA, 14 bp, Homo sapiens
ttggccactccgag

SEQ ID NO: 3439301 - DNA, 16 bp, Homo sapiens
ttggccatctctggat

SEQ ID NO: 3439302 - DNA, 20 bp, Homo sapiens
ttggcctatctcctagggct

SEQ ID NO: 3439303 - DNA, 11 bp, Homo sapiens
ttggccttctc

SEQ ID NO: 3439304 - DNA, 17 bp, Homo sapiens
ttggctcgaatctctgt

SEQ ID NO: 3439305 - DNA, 20 bp, Homo sapiens
ttggctcgaatctctgtgcc

SEQ ID NO: 3439306 - DNA, 21 bp, Homo sapiens
ttggctgaaattctcctggag

SEQ ID NO: 3439307 - DNA, 22 bp, Homo sapiens
ttggctgaaattctcctggagg

SEQ ID NO: 3439308 - DNA, 17 bp, Homo sapiens
ttggctgtgtctaaact

SEQ ID NO: 3439309 - DNA, 18 bp, Homo sapiens
ttggctgtgtctaaactg

SEQ ID NO: 3439310 - DNA, 23 bp, Homo sapiens
ttggctgtgtctaaactgcatta

SEQ ID NO: 3439311 - DNA, 16 bp, Homo sapiens
ttggcttaatcatttt

SEQ ID NO: 3439312 - DNA, 14 bp, Homo sapiens
ttggcttgcttatg

SEQ ID NO: 3439313 - DNA, 20 bp, Homo sapiens
ttggcttgcttatgtgtagg

SEQ ID NO: 3439314 - DNA, 11 bp, Homo sapiens
ttgggaatgtt

SEQ ID NO: 3439315 - DNA, 21 bp, Homo sapiens
ttgggcagagctggctctgag

SEQ ID NO: 3439316 - DNA, 17 bp, Homo sapiens
ttgggcatgtgggcttc

SEQ ID NO: 3439317 - DNA, 13 bp, Homo sapiens
ttgggccagacat

SEQ ID NO: 3439318 - DNA, 14 bp, Homo sapiens
ttgggccagacatg

SEQ ID NO: 3439319 - DNA, 16 bp, Homo sapiens
ttgggcctgctccaga

SEQ ID NO: 3439320 - DNA, 23 bp, Homo sapiens
ttggggggaatgctcctctcttt

SEQ ID NO: 3439321 - DNA, 22 bp, Homo sapiens
ttggggggctgaggtgggagga

SEQ ID NO: 3439322 - DNA, 20 bp, Homo sapiens
ttgggggggtggccgctgag

SEQ ID NO: 3439323 - DNA, 17 bp, Homo sapiens
ttggggtacccactgct

SEQ ID NO: 3439324 - DNA, 18 bp, Homo sapiens
ttggggtgggtataaaag

SEQ ID NO: 3439325 - DNA, 17 bp, Homo sapiens
ttggggtttgatttgct

SEQ ID NO: 3439326 - DNA, 21 bp, Homo sapiens
ttgggtatgttaacctaggca

SEQ ID NO: 3439327 - DNA, 14 bp, Homo sapiens
ttggtcctctctct

SEQ ID NO: 3439328 - DNA, 23 bp, Homo sapiens
ttggtctcctggatgggcctttg

SEQ ID NO: 3439329 - DNA, 15 bp, Homo sapiens
ttggtgaattttcaa

SEQ ID NO: 3439330 - DNA, 20 bp, Homo sapiens
ttggttcattaattctataa

SEQ ID NO: 3439331 - DNA, 19 bp, Homo sapiens
ttggttctaatagaactca

SEQ ID NO: 3439332 - DNA, 15 bp, Homo sapiens
ttggttggctggcct

SEQ ID NO: 3439333 - DNA, 14 bp, Homo sapiens
ttggtttgccttcc

SEQ ID NO: 3439334 - DNA, 13 bp, Homo sapiens
ttggtttggcctc

SEQ ID NO: 3439335 - DNA, 17 bp, Homo sapiens
ttggttttgttcccctc

SEQ ID NO: 3439336 - DNA, 18 bp, Homo sapiens
ttggttttgttcccctcc

SEQ ID NO: 3439337 - DNA, 22 bp, Homo sapiens
ttgtaaaaaattcacataataa

SEQ ID NO: 3439338 - DNA, 14 bp, Homo sapiens
ttgtaaaatatagc

SEQ ID NO: 3439339 - DNA, 20 bp, Homo sapiens
ttgtaaaatatagctgtaca

SEQ ID NO: 3439340 - DNA, 16 bp, Homo sapiens
ttgtaaaggaatttaa

SEQ ID NO: 3439341 - DNA, 23 bp, Homo sapiens
ttgtaaataagttttttttctgg

SEQ ID NO: 3439342 - DNA, 17 bp, Homo sapiens
ttgtaaatagctcaggt

SEQ ID NO: 3439343 - DNA, 14 bp, Homo sapiens
ttgtaaatcacatc

SEQ ID NO: 3439344 - DNA, 23 bp, Homo sapiens
ttgtaaattattaatttatgcag

SEQ ID NO: 3439345 - DNA, 17 bp, Homo sapiens
ttgtaactttttacatt

SEQ ID NO: 3439346 - DNA, 14 bp, Homo sapiens
ttgtaaggctttga

SEQ ID NO: 3439347 - DNA, 18 bp, Homo sapiens
ttgtaataacatttaatt

SEQ ID NO: 3439348 - DNA, 22 bp, Homo sapiens
ttgtaatgaattcctagaatta

SEQ ID NO: 3439349 - DNA, 23 bp, Homo sapiens
ttgtacataagtacctcagcatt

SEQ ID NO: 3439350 - DNA, 16 bp, Homo sapiens
ttgtactaaagccaaa

SEQ ID NO: 3439351 - DNA, 23 bp, Homo sapiens
ttgtactaaagccaaacatatat

SEQ ID NO: 3439352 - DNA, 14 bp, Homo sapiens
ttgtagagccaggg

SEQ ID NO: 3439353 - DNA, 16 bp, Homo sapiens
ttgtagtaagaaacat

SEQ ID NO: 3439354 - DNA, 15 bp, Homo sapiens
ttgtagtaagagctt

SEQ ID NO: 3439355 - DNA, 15 bp, Homo sapiens
ttgtatagtaaagtg

SEQ ID NO: 3439356 - DNA, 13 bp, Homo sapiens
ttgtatattcact

SEQ ID NO: 3439357 - DNA, 15 bp, Homo sapiens
ttgtattaaactctt

SEQ ID NO: 3439358 - DNA, 13 bp, Homo sapiens
ttgtattagatgt

SEQ ID NO: 3439359 - DNA, 16 bp, Homo sapiens
ttgtattagatgttct

SEQ ID NO: 3439360 - DNA, 12 bp, Homo sapiens
ttgtattcagat

SEQ ID NO: 3439361 - DNA, 20 bp, Homo sapiens
ttgtattctctgagctgtgc

SEQ ID NO: 3439362 - DNA, 16 bp, Homo sapiens
ttgtattgtttcaatt

SEQ ID NO: 3439363 - DNA, 22 bp, Homo sapiens
ttgtatttttttgcaagtgaag

SEQ ID NO: 3439364 - DNA, 14 bp, Homo sapiens
ttgtcaacattgtg

SEQ ID NO: 3439365 - DNA, 22 bp, Homo sapiens
ttgtcacatgaaacatttgcaa

SEQ ID NO: 3439366 - DNA, 13 bp, Homo sapiens
ttgtcatatgtag

SEQ ID NO: 3439367 - DNA, 19 bp, Homo sapiens
ttgtcatctttcttctatt

SEQ ID NO: 3439368 - DNA, 17 bp, Homo sapiens
ttgtcattagcctgagt

SEQ ID NO: 3439369 - DNA, 18 bp, Homo sapiens
ttgtcattagcctgagta

SEQ ID NO: 3439370 - DNA, 13 bp, Homo sapiens
ttgtcccatctct

SEQ ID NO: 3439371 - DNA, 15 bp, Homo sapiens
ttgtccctctgcccc

SEQ ID NO: 3439372 - DNA, 15 bp, Homo sapiens
ttgtcctgtgaaata

SEQ ID NO: 3439373 - DNA, 20 bp, Homo sapiens
ttgtcgggcaccagccagcg

SEQ ID NO: 3439374 - DNA, 22 bp, Homo sapiens
ttgtctaaaatgcctcagtgta

SEQ ID NO: 3439375 - DNA, 19 bp, Homo sapiens
ttgtctagggtgttctgta

SEQ ID NO: 3439376 - DNA, 16 bp, Homo sapiens
ttgtctcaatgctcat

SEQ ID NO: 3439377 - DNA, 18 bp, Homo sapiens
ttgtctcaatgctcataa

SEQ ID NO: 3439378 - DNA, 12 bp, Homo sapiens
ttgtctctgggc

SEQ ID NO: 3439379 - DNA, 15 bp, Homo sapiens
ttgtcttaaaaagtg

SEQ ID NO: 3439380 - DNA, 21 bp, Homo sapiens
ttgtgaaataaaactggcttt

SEQ ID NO: 3439381 - DNA, 20 bp, Homo sapiens
ttgtgaagctaatgaccaac

SEQ ID NO: 3439382 - DNA, 16 bp, Homo sapiens
ttgtgaggaaagtcat

SEQ ID NO: 3439383 - DNA, 22 bp, Homo sapiens
ttgtgaggaaagtcattggctt

SEQ ID NO: 3439384 - DNA, 20 bp, Homo sapiens
ttgtgatgtatattcctttg

SEQ ID NO: 3439385 - DNA, 13 bp, Homo sapiens
ttgtgcagctttt

SEQ ID NO: 3439386 - DNA, 22 bp, Homo sapiens
ttgtgccaacctattttgaagt

SEQ ID NO: 3439387 - DNA, 14 bp, Homo sapiens
ttgtgctatagtat

SEQ ID NO: 3439388 - DNA, 23 bp, Homo sapiens
ttgtgctctatagcagacactaa

SEQ ID NO: 3439389 - DNA, 15 bp, Homo sapiens
ttgtgctttgtatca

SEQ ID NO: 3439390 - DNA, 22 bp, Homo sapiens
ttgtggaatggagattcagttt

SEQ ID NO: 3439391 - DNA, 18 bp, Homo sapiens
ttgtggaatgttggataa

SEQ ID NO: 3439392 - DNA, 16 bp, Homo sapiens
ttgtggacacagctct

SEQ ID NO: 3439393 - DNA, 13 bp, Homo sapiens
ttgtggactaaaa

SEQ ID NO: 3439394 - DNA, 20 bp, Homo sapiens
ttgtggccaaggagctgcta

SEQ ID NO: 3439395 - DNA, 21 bp, Homo sapiens
ttgtggcctgggcctcctcac

SEQ ID NO: 3439396 - DNA, 21 bp, Homo sapiens
ttgtgtatttaacagggaggg

SEQ ID NO: 3439397 - DNA, 20 bp, Homo sapiens
ttgtgtgtgtgtcagctgag

SEQ ID NO: 3439398 - DNA, 15 bp, Homo sapiens
ttgtgtttgtcatta

SEQ ID NO: 3439399 - DNA, 16 bp, Homo sapiens
ttgttaaaataactag

SEQ ID NO: 3439400 - DNA, 18 bp, Homo sapiens
ttgttacccatgaaaaac

SEQ ID NO: 3439401 - DNA, 20 bp, Homo sapiens
ttgttacctgtcattttgca

SEQ ID NO: 3439402 - DNA, 21 bp, Homo sapiens
ttgttacctgtcattttgcac

SEQ ID NO: 3439403 - DNA, 23 bp, Homo sapiens
ttgttacctgtcattttgcactg

SEQ ID NO: 3439404 - DNA, 18 bp, Homo sapiens
ttgttactaactaaactc

SEQ ID NO: 3439405 - DNA, 19 bp, Homo sapiens
ttgttatggcttaatgaca

SEQ ID NO: 3439406 - DNA, 15 bp, Homo sapiens
ttgttattgaagtgt

SEQ ID NO: 3439407 - DNA, 19 bp, Homo sapiens
ttgttattgatgttgctgt

SEQ ID NO: 3439408 - DNA, 23 bp, Homo sapiens
ttgttattgatgttgctgttatt

SEQ ID NO: 3439409 - DNA, 13 bp, Homo sapiens
ttgttcaattaga

SEQ ID NO: 3439410 - DNA, 15 bp, Homo sapiens
ttgttcatagcccag

SEQ ID NO: 3439411 - DNA, 18 bp, Homo sapiens
ttgttccacttgtttgca

SEQ ID NO: 3439412 - DNA, 19 bp, Homo sapiens
ttgttccacttgtttgcac

SEQ ID NO: 3439413 - DNA, 23 bp, Homo sapiens
ttgttccacttgtttgcactgtg

SEQ ID NO: 3439414 - DNA, 13 bp, Homo sapiens
ttgttcccctcct

SEQ ID NO: 3439415 - DNA, 15 bp, Homo sapiens
ttgttcccctcctcc

SEQ ID NO: 3439416 - DNA, 19 bp, Homo sapiens
ttgttcccctcctccactc

SEQ ID NO: 3439417 - DNA, 20 bp, Homo sapiens
ttgttcccctcctccactct

SEQ ID NO: 3439418 - DNA, 15 bp, Homo sapiens
ttgttctagttttca

SEQ ID NO: 3439419 - DNA, 12 bp, Homo sapiens
ttgttctctggg

SEQ ID NO: 3439420 - DNA, 15 bp, Homo sapiens
ttgttctctgggaga

SEQ ID NO: 3439421 - DNA, 14 bp, Homo sapiens
ttgttggatccgtt

SEQ ID NO: 3439422 - DNA, 22 bp, Homo sapiens
ttgttggatccgtttgaccaat

SEQ ID NO: 3439423 - DNA, 20 bp, Homo sapiens
ttgttggtgaattttcaagg

SEQ ID NO: 3439424 - DNA, 13 bp, Homo sapiens
ttgttgtgctttt

SEQ ID NO: 3439425 - DNA, 12 bp, Homo sapiens
ttgtttatgtaa

SEQ ID NO: 3439426 - DNA, 20 bp, Homo sapiens
ttgtttatgtaaatgtttgt

SEQ ID NO: 3439427 - DNA, 17 bp, Homo sapiens
ttgtttccttttttccc

SEQ ID NO: 3439428 - DNA, 17 bp, Homo sapiens
ttgtttctctgttgtaa

SEQ ID NO: 3439429 - DNA, 14 bp, Homo sapiens
ttgtttgctgctat

SEQ ID NO: 3439430 - DNA, 22 bp, Homo sapiens
ttgtttggaggagcaaagttaa

SEQ ID NO: 3439431 - DNA, 18 bp, Homo sapiens
ttgtttggcaaggaaagg

SEQ ID NO: 3439432 - DNA, 20 bp, Homo sapiens
ttgtttggggatgagaaagg

SEQ ID NO: 3439433 - DNA, 16 bp, Homo sapiens
ttgtttgtattgtaaa

SEQ ID NO: 3439434 - DNA, 17 bp, Homo sapiens
ttgtttgttttggattc

SEQ ID NO: 3439435 - DNA, 20 bp, Homo sapiens
ttgttttaaaattaaagcta

SEQ ID NO: 3439436 - DNA, 12 bp, Homo sapiens
ttgttttacaat

SEQ ID NO: 3439437 - DNA, 20 bp, Homo sapiens
ttgttttcggggagaaataa

SEQ ID NO: 3439438 - DNA, 12 bp, Homo sapiens
ttgttttggatt

SEQ ID NO: 3439439 - DNA, 13 bp, Homo sapiens
ttgttttgtattg

SEQ ID NO: 3439440 - DNA, 21 bp, Homo sapiens
tttaaaaaaataaaacagtat

SEQ ID NO: 3439441 - DNA, 18 bp, Homo sapiens
tttaaaaaaattccaagt

SEQ ID NO: 3439442 - DNA, 16 bp, Homo sapiens
tttaaaaaatattttc

SEQ ID NO: 3439443 - DNA, 18 bp, Homo sapiens
tttaaaaaatgttttctg

SEQ ID NO: 3439444 - DNA, 14 bp, Homo sapiens
tttaaaaagcatgt

SEQ ID NO: 3439445 - DNA, 16 bp, Homo sapiens
tttaaaaatacacatg

SEQ ID NO: 3439446 - DNA, 13 bp, Homo sapiens
tttaaaaatcaac

SEQ ID NO: 3439447 - DNA, 14 bp, Homo sapiens
tttaaaaatgtctt

SEQ ID NO: 3439448 - DNA, 19 bp, Homo sapiens
tttaaaagacaagacttca

SEQ ID NO: 3439449 - DNA, 23 bp, Homo sapiens
tttaaaagagagagagagaaaaa

SEQ ID NO: 3439450 - DNA, 15 bp, Homo sapiens
tttaaaagcagagca

SEQ ID NO: 3439451 - DNA, 20 bp, Homo sapiens
tttaaaagcagagcattttt

SEQ ID NO: 3439452 - DNA, 21 bp, Homo sapiens
tttaaaagtaggaaatacaat

SEQ ID NO: 3439453 - DNA, 19 bp, Homo sapiens
tttaaaataaactgtaaac

SEQ ID NO: 3439454 - DNA, 18 bp, Homo sapiens
tttaaaatgtaaagccat

SEQ ID NO: 3439455 - DNA, 19 bp, Homo sapiens
tttaaaatttttttagaaa

SEQ ID NO: 3439456 - DNA, 23 bp, Homo sapiens
tttaaatatatattattctcatt

SEQ ID NO: 3439457 - DNA, 13 bp, Homo sapiens
tttaaatattttc

SEQ ID NO: 3439458 - DNA, 16 bp, Homo sapiens
tttaaatgtaaaacat

SEQ ID NO: 3439459 - DNA, 20 bp, Homo sapiens
tttaaatgtacagacatatt

SEQ ID NO: 3439460 - DNA, 12 bp, Homo sapiens
tttaaccaaagg

SEQ ID NO: 3439461 - DNA, 13 bp, Homo sapiens
tttaaccaaaggt

SEQ ID NO: 3439462 - DNA, 21 bp, Homo sapiens
tttaacctgccaacatacttt

SEQ ID NO: 3439463 - DNA, 17 bp, Homo sapiens
tttaactagaatttatt

SEQ ID NO: 3439464 - DNA, 15 bp, Homo sapiens
tttaactcccttttt

SEQ ID NO: 3439465 - DNA, 18 bp, Homo sapiens
tttaactccctttttaca

SEQ ID NO: 3439466 - DNA, 19 bp, Homo sapiens
tttaactctataatgtgtt

SEQ ID NO: 3439467 - DNA, 17 bp, Homo sapiens
tttaactctgtcttcac

SEQ ID NO: 3439468 - DNA, 19 bp, Homo sapiens
tttaactgagggctgatct

SEQ ID NO: 3439469 - DNA, 13 bp, Homo sapiens
tttaactggtgca

SEQ ID NO: 3439470 - DNA, 22 bp, Homo sapiens
tttaagaaaaaataacacacat

SEQ ID NO: 3439471 - DNA, 22 bp, Homo sapiens
tttaagacagtcccatcaaaac

SEQ ID NO: 3439472 - DNA, 19 bp, Homo sapiens
tttaagacgtgtttgtgtt

SEQ ID NO: 3439473 - DNA, 17 bp, Homo sapiens
tttaagcaacatctttt

SEQ ID NO: 3439474 - DNA, 16 bp, Homo sapiens
tttaagcctgaagagc

SEQ ID NO: 3439475 - DNA, 21 bp, Homo sapiens
tttaagctgttactgtcttca

SEQ ID NO: 3439476 - DNA, 15 bp, Homo sapiens
tttaagtccctgtca

SEQ ID NO: 3439477 - DNA, 22 bp, Homo sapiens
tttaagtgtaactggcagtttt

SEQ ID NO: 3439478 - DNA, 20 bp, Homo sapiens
tttaataaaaaggcacctat

SEQ ID NO: 3439479 - DNA, 15 bp, Homo sapiens
tttaataatatactt

SEQ ID NO: 3439480 - DNA, 17 bp, Homo sapiens
tttaataatatacttgt

SEQ ID NO: 3439481 - DNA, 17 bp, Homo sapiens
tttaatacagtttattt

SEQ ID NO: 3439482 - DNA, 15 bp, Homo sapiens
tttaatccccagtaa

SEQ ID NO: 3439483 - DNA, 20 bp, Homo sapiens
tttaatgcaagagaacattt

SEQ ID NO: 3439484 - DNA, 21 bp, Homo sapiens
tttaatgcaagagaacatttt

SEQ ID NO: 3439485 - DNA, 23 bp, Homo sapiens
tttaatgccgatatactctagat

SEQ ID NO: 3439486 - DNA, 15 bp, Homo sapiens
tttaatgctatttga

SEQ ID NO: 3439487 - DNA, 16 bp, Homo sapiens
tttaatgtttaaaaca

SEQ ID NO: 3439488 - DNA, 15 bp, Homo sapiens
tttaatgttttaaat

SEQ ID NO: 3439489 - DNA, 14 bp, Homo sapiens
tttaattagtgcta

SEQ ID NO: 3439490 - DNA, 15 bp, Homo sapiens
tttaattagtgctaa

SEQ ID NO: 3439491 - DNA, 17 bp, Homo sapiens
tttaattagtgctaagt

SEQ ID NO: 3439492 - DNA, 21 bp, Homo sapiens
tttaattagtgctaagtgtga

SEQ ID NO: 3439493 - DNA, 23 bp, Homo sapiens
tttaattcatcccaactgtcttt

SEQ ID NO: 3439494 - DNA, 20 bp, Homo sapiens
tttaattctgtcttgttcat

SEQ ID NO: 3439495 - DNA, 22 bp, Homo sapiens
tttaatttattaattgctttga

SEQ ID NO: 3439496 - DNA, 19 bp, Homo sapiens
tttaatttttttgagacag

SEQ ID NO: 3439497 - DNA, 11 bp, Homo sapiens
tttacaactca

SEQ ID NO: 3439498 - DNA, 23 bp, Homo sapiens
tttacaggatattccaaaataaa

SEQ ID NO: 3439499 - DNA, 15 bp, Homo sapiens
tttacatactgctgt

SEQ ID NO: 3439500 - DNA, 14 bp, Homo sapiens
tttaccaaaaattt

SEQ ID NO: 3439501 - DNA, 23 bp, Homo sapiens
tttaccagagagagcaaggaagc

SEQ ID NO: 3439502 - DNA, 16 bp, Homo sapiens
tttaccccatccctgt

SEQ ID NO: 3439503 - DNA, 21 bp, Homo sapiens
tttaccctgaggtcactgcta

SEQ ID NO: 3439504 - DNA, 14 bp, Homo sapiens
tttacctagagaac

SEQ ID NO: 3439505 - DNA, 14 bp, Homo sapiens
tttacctgctgctt

SEQ ID NO: 3439506 - DNA, 15 bp, Homo sapiens
tttacctgtgaaata

SEQ ID NO: 3439507 - DNA, 13 bp, Homo sapiens
tttacgctttgat

SEQ ID NO: 3439508 - DNA, 18 bp, Homo sapiens
tttacgctttgattcata

SEQ ID NO: 3439509 - DNA, 21 bp, Homo sapiens
tttactagaaatgggaatcat

SEQ ID NO: 3439510 - DNA, 23 bp, Homo sapiens
tttactagaaatgggaatcatgg

SEQ ID NO: 3439511 - DNA, 23 bp, Homo sapiens
tttactagggatccctcatctgt

SEQ ID NO: 3439512 - DNA, 17 bp, Homo sapiens
tttactattaacatgat

SEQ ID NO: 3439513 - DNA, 17 bp, Homo sapiens
tttactcctcacactta

SEQ ID NO: 3439514 - DNA, 14 bp, Homo sapiens
tttactgaagcctt

SEQ ID NO: 3439515 - DNA, 17 bp, Homo sapiens
tttactgagcttctctg

SEQ ID NO: 3439516 - DNA, 18 bp, Homo sapiens
tttactgagcttctctgt

SEQ ID NO: 3439517 - DNA, 21 bp, Homo sapiens
tttactgagcttctctgtgaa

SEQ ID NO: 3439518 - DNA, 22 bp, Homo sapiens
tttactgccaaagggaaatatc

SEQ ID NO: 3439519 - DNA, 14 bp, Homo sapiens
tttactgttgtaca

SEQ ID NO: 3439520 - DNA, 14 bp, Homo sapiens
tttactgtttgtta

SEQ ID NO: 3439521 - DNA, 15 bp, Homo sapiens
tttacttaactgttt

SEQ ID NO: 3439522 - DNA, 15 bp, Homo sapiens
tttactttgtgttca

SEQ ID NO: 3439523 - DNA, 13 bp, Homo sapiens
tttagaaaatata

SEQ ID NO: 3439524 - DNA, 16 bp, Homo sapiens
tttagaaagcatttga

SEQ ID NO: 3439525 - DNA, 18 bp, Homo sapiens
tttagaaagcatttgaat

SEQ ID NO: 3439526 - DNA, 22 bp, Homo sapiens
tttagaaagcatttgaatgcat

SEQ ID NO: 3439527 - DNA, 22 bp, Homo sapiens
tttagaaatactgcaagaaaat

SEQ ID NO: 3439528 - DNA, 11 bp, Homo sapiens
tttagaacttg

SEQ ID NO: 3439529 - DNA, 16 bp, Homo sapiens
tttagacagtctcact

SEQ ID NO: 3439530 - DNA, 20 bp, Homo sapiens
tttagacagtctcactttgt

SEQ ID NO: 3439531 - DNA, 21 bp, Homo sapiens
tttagagaatgtgtttcaaaa

SEQ ID NO: 3439532 - DNA, 18 bp, Homo sapiens
tttagagttagactgttg

SEQ ID NO: 3439533 - DNA, 14 bp, Homo sapiens
tttagatggtggca

SEQ ID NO: 3439534 - DNA, 23 bp, Homo sapiens
tttagctgtattcatatattgca

SEQ ID NO: 3439535 - DNA, 21 bp, Homo sapiens
tttaggacacatttagatgca

SEQ ID NO: 3439536 - DNA, 16 bp, Homo sapiens
tttaggatacttaaca

SEQ ID NO: 3439537 - DNA, 18 bp, Homo sapiens
tttaggatacttaacaaa

SEQ ID NO: 3439538 - DNA, 17 bp, Homo sapiens
tttagtaaatgttatct

SEQ ID NO: 3439539 - DNA, 18 bp, Homo sapiens
tttagtaatattttactt

SEQ ID NO: 3439540 - DNA, 15 bp, Homo sapiens
tttagtaatttccta

SEQ ID NO: 3439541 - DNA, 13 bp, Homo sapiens
tttagtaatttct

SEQ ID NO: 3439542 - DNA, 19 bp, Homo sapiens
tttagtgatcacagcagct

SEQ ID NO: 3439543 - DNA, 13 bp, Homo sapiens
tttagttactgaa

SEQ ID NO: 3439544 - DNA, 16 bp, Homo sapiens
tttataaaatggctgt

SEQ ID NO: 3439545 - DNA, 18 bp, Homo sapiens
tttataaacagacaatat

SEQ ID NO: 3439546 - DNA, 22 bp, Homo sapiens
tttataaacagacaatatgtga

SEQ ID NO: 3439547 - DNA, 23 bp, Homo sapiens
tttataaacagacaatatgtgag

SEQ ID NO: 3439548 - DNA, 20 bp, Homo sapiens
tttataaataaaatcatgta

SEQ ID NO: 3439549 - DNA, 19 bp, Homo sapiens
tttataacaacgtcttttt

SEQ ID NO: 3439550 - DNA, 19 bp, Homo sapiens
tttataagtcattgtatgt

SEQ ID NO: 3439551 - DNA, 18 bp, Homo sapiens
tttatactctttctgtat

SEQ ID NO: 3439552 - DNA, 12 bp, Homo sapiens
tttatagatcat

SEQ ID NO: 3439553 - DNA, 17 bp, Homo sapiens
tttatagatcatttcta

SEQ ID NO: 3439554 - DNA, 13 bp, Homo sapiens
tttatagtaatga

SEQ ID NO: 3439555 - DNA, 17 bp, Homo sapiens
tttatatgaagataagt

SEQ ID NO: 3439556 - DNA, 19 bp, Homo sapiens
tttatcacctcattctgaa

SEQ ID NO: 3439557 - DNA, 15 bp, Homo sapiens
tttatcagcaaaaaa

SEQ ID NO: 3439558 - DNA, 18 bp, Homo sapiens
tttatccaaaatgtgtat

SEQ ID NO: 3439559 - DNA, 20 bp, Homo sapiens
tttatccaaaatgtgtattt

SEQ ID NO: 3439560 - DNA, 14 bp, Homo sapiens
tttatgagatggat

SEQ ID NO: 3439561 - DNA, 21 bp, Homo sapiens
tttatgatcagtgttgttgct

SEQ ID NO: 3439562 - DNA, 19 bp, Homo sapiens
tttatgtagtaattgacat

SEQ ID NO: 3439563 - DNA, 11 bp, Homo sapiens
tttattaaata

SEQ ID NO: 3439564 - DNA, 12 bp, Homo sapiens
tttattaaataa

SEQ ID NO: 3439565 - DNA, 19 bp, Homo sapiens
tttattaaatagttaatat

SEQ ID NO: 3439566 - DNA, 17 bp, Homo sapiens
tttattaccccctcctt

SEQ ID NO: 3439567 - DNA, 23 bp, Homo sapiens
tttattaccccctccttcagaca

SEQ ID NO: 3439568 - DNA, 17 bp, Homo sapiens
tttattcaattcctctg

SEQ ID NO: 3439569 - DNA, 18 bp, Homo sapiens
tttattccagaatgctgt

SEQ ID NO: 3439570 - DNA, 19 bp, Homo sapiens
tttattccagaatgctgta

SEQ ID NO: 3439571 - DNA, 23 bp, Homo sapiens
tttattccagaatgctgtacatc

SEQ ID NO: 3439572 - DNA, 22 bp, Homo sapiens
tttattcctatatagtttattg

SEQ ID NO: 3439573 - DNA, 17 bp, Homo sapiens
tttattctttactatta

SEQ ID NO: 3439574 - DNA, 13 bp, Homo sapiens
tttattgacacag

SEQ ID NO: 3439575 - DNA, 14 bp, Homo sapiens
tttattgacacaga

SEQ ID NO: 3439576 - DNA, 15 bp, Homo sapiens
tttattgacacagaa

SEQ ID NO: 3439577 - DNA, 14 bp, Homo sapiens
tttattgagaaaga

SEQ ID NO: 3439578 - DNA, 21 bp, Homo sapiens
tttattgtgtttgtcattagc

SEQ ID NO: 3439579 - DNA, 17 bp, Homo sapiens
tttatttttcatttagt

SEQ ID NO: 3439580 - DNA, 19 bp, Homo sapiens
tttcaaaatagaaaagtta

SEQ ID NO: 3439581 - DNA, 15 bp, Homo sapiens
tttcaaaatgctttt

SEQ ID NO: 3439582 - DNA, 22 bp, Homo sapiens
tttcaaactttattgacaagtg

SEQ ID NO: 3439583 - DNA, 14 bp, Homo sapiens
tttcaaagcaattg

SEQ ID NO: 3439584 - DNA, 20 bp, Homo sapiens
tttcaaatttagaaactaat

SEQ ID NO: 3439585 - DNA, 21 bp, Homo sapiens
tttcaaatttagaaactaatt

SEQ ID NO: 3439586 - DNA, 20 bp, Homo sapiens
tttcaacagtgaagacagaa

SEQ ID NO: 3439587 - DNA, 16 bp, Homo sapiens
tttcaactgccaaaat

SEQ ID NO: 3439588 - DNA, 13 bp, Homo sapiens
tttcaactttgaa

SEQ ID NO: 3439589 - DNA, 23 bp, Homo sapiens
tttcaagcagtcgtgcctgtgtc

SEQ ID NO: 3439590 - DNA, 17 bp, Homo sapiens
tttcaaggccttcagtt

SEQ ID NO: 3439591 - DNA, 21 bp, Homo sapiens
tttcaaggccttcagtttatt

SEQ ID NO: 3439592 - DNA, 20 bp, Homo sapiens
tttcaaggtaatttcttgtg

SEQ ID NO: 3439593 - DNA, 20 bp, Homo sapiens
tttcaagtcaaattaataat

SEQ ID NO: 3439594 - DNA, 20 bp, Homo sapiens
tttcaattgcatctcccaga

SEQ ID NO: 3439595 - DNA, 14 bp, Homo sapiens
tttcacaaggtctt

SEQ ID NO: 3439596 - DNA, 23 bp, Homo sapiens
tttcacaattccatttccagttc

SEQ ID NO: 3439597 - DNA, 16 bp, Homo sapiens
tttcacagcaacattt

SEQ ID NO: 3439598 - DNA, 22 bp, Homo sapiens
tttcaccatttgattatgtagc

SEQ ID NO: 3439599 - DNA, 13 bp, Homo sapiens
tttcacccctccc

SEQ ID NO: 3439600 - DNA, 15 bp, Homo sapiens
tttcacccctccctt

SEQ ID NO: 3439601 - DNA, 18 bp, Homo sapiens
tttcacccctccctttct

SEQ ID NO: 3439602 - DNA, 22 bp, Homo sapiens
tttcacctgtttttaagctgtt

SEQ ID NO: 3439603 - DNA, 21 bp, Homo sapiens
tttcagactcccattcctgaa

SEQ ID NO: 3439604 - DNA, 16 bp, Homo sapiens
tttcagagatggacag

SEQ ID NO: 3439605 - DNA, 17 bp, Homo sapiens
tttcagatgatttgaaa

SEQ ID NO: 3439606 - DNA, 15 bp, Homo sapiens
tttcagatgtaatgt

SEQ ID NO: 3439607 - DNA, 17 bp, Homo sapiens
tttcagatgtaatgttt

SEQ ID NO: 3439608 - DNA, 18 bp, Homo sapiens
tttcagatgtaatgtttt

SEQ ID NO: 3439609 - DNA, 16 bp, Homo sapiens
tttcagattgtggaat

SEQ ID NO: 3439610 - DNA, 17 bp, Homo sapiens
tttcaggagcagcctca

SEQ ID NO: 3439611 - DNA, 19 bp, Homo sapiens
tttcagtacttttttaaat

SEQ ID NO: 3439612 - DNA, 19 bp, Homo sapiens
tttcataagtatttcaaat

SEQ ID NO: 3439613 - DNA, 18 bp, Homo sapiens
tttcatctgctctccttc

SEQ ID NO: 3439614 - DNA, 12 bp, Homo sapiens
tttcatgtacaa

SEQ ID NO: 3439615 - DNA, 23 bp, Homo sapiens
tttcatgttggtttattttcaca

SEQ ID NO: 3439616 - DNA, 17 bp, Homo sapiens
tttcatgttttaacaaa

SEQ ID NO: 3439617 - DNA, 19 bp, Homo sapiens
tttcatgttttaacaaaaa

SEQ ID NO: 3439618 - DNA, 18 bp, Homo sapiens
tttcattcagcctttaga

SEQ ID NO: 3439619 - DNA, 16 bp, Homo sapiens
tttcattgaggataaa

SEQ ID NO: 3439620 - DNA, 18 bp, Homo sapiens
tttcattgaggataaatt

SEQ ID NO: 3439621 - DNA, 21 bp, Homo sapiens
tttcattgaggataaattgcc

SEQ ID NO: 3439622 - DNA, 17 bp, Homo sapiens
tttcattggttaatttt

SEQ ID NO: 3439623 - DNA, 17 bp, Homo sapiens
tttcatttttaaatgtg

SEQ ID NO: 3439624 - DNA, 20 bp, Homo sapiens
tttcatttttttccaggctg

SEQ ID NO: 3439625 - DNA, 22 bp, Homo sapiens
tttccaaaataaaaaccttcca

SEQ ID NO: 3439626 - DNA, 16 bp, Homo sapiens
tttccaattatttgac

SEQ ID NO: 3439627 - DNA, 19 bp, Homo sapiens
tttccaccacagccagcac

SEQ ID NO: 3439628 - DNA, 19 bp, Homo sapiens
tttccactattttcaaaga

SEQ ID NO: 3439629 - DNA, 16 bp, Homo sapiens
tttccagcagaagaca

SEQ ID NO: 3439630 - DNA, 19 bp, Homo sapiens
tttccaggtttaagctgtt

SEQ ID NO: 3439631 - DNA, 21 bp, Homo sapiens
tttccagtctccaccaggaac

SEQ ID NO: 3439632 - DNA, 12 bp, Homo sapiens
tttccatatatt

SEQ ID NO: 3439633 - DNA, 19 bp, Homo sapiens
tttccatgggaccacaact

SEQ ID NO: 3439634 - DNA, 15 bp, Homo sapiens
tttcccaattcacat

SEQ ID NO: 3439635 - DNA, 16 bp, Homo sapiens
tttcccatggggaggg

SEQ ID NO: 3439636 - DNA, 20 bp, Homo sapiens
tttccccgaagagtcagccc

SEQ ID NO: 3439637 - DNA, 13 bp, Homo sapiens
tttcccctttcct

SEQ ID NO: 3439638 - DNA, 15 bp, Homo sapiens
tttcccctttcctgt

SEQ ID NO: 3439639 - DNA, 16 bp, Homo sapiens
tttcccctttcctgtc

SEQ ID NO: 3439640 - DNA, 13 bp, Homo sapiens
tttccctgacctc

SEQ ID NO: 3439641 - DNA, 15 bp, Homo sapiens
tttcccttgaggaaa

SEQ ID NO: 3439642 - DNA, 17 bp, Homo sapiens
tttcccttgcttcccct

SEQ ID NO: 3439643 - DNA, 15 bp, Homo sapiens
tttccctttgccttc

SEQ ID NO: 3439644 - DNA, 23 bp, Homo sapiens
tttcctagatggcagtcactgaa

SEQ ID NO: 3439645 - DNA, 17 bp, Homo sapiens
tttcctcccttctgcta

SEQ ID NO: 3439646 - DNA, 22 bp, Homo sapiens
tttcctcctgaggctttggatt

SEQ ID NO: 3439647 - DNA, 17 bp, Homo sapiens
tttcctcttcctgccta

SEQ ID NO: 3439648 - DNA, 21 bp, Homo sapiens
tttcctgataaagcacagctg

SEQ ID NO: 3439649 - DNA, 13 bp, Homo sapiens
tttccttaccttt

SEQ ID NO: 3439650 - DNA, 16 bp, Homo sapiens
tttccttccctaccca

SEQ ID NO: 3439651 - DNA, 19 bp, Homo sapiens
tttccttggggcaggcagt

SEQ ID NO: 3439652 - DNA, 15 bp, Homo sapiens
tttccttttttaaaa

SEQ ID NO: 3439653 - DNA, 16 bp, Homo sapiens
tttcgcctttcctctc

SEQ ID NO: 3439654 - DNA, 12 bp, Homo sapiens
tttctaaagttg

SEQ ID NO: 3439655 - DNA, 13 bp, Homo sapiens
tttctaaatgttt

SEQ ID NO: 3439656 - DNA, 21 bp, Homo sapiens
tttctaacaattttcagacct

SEQ ID NO: 3439657 - DNA, 19 bp, Homo sapiens
tttctaatgaggagagaaa

SEQ ID NO: 3439658 - DNA, 18 bp, Homo sapiens
tttctacccagcgagccc

SEQ ID NO: 3439659 - DNA, 19 bp, Homo sapiens
tttctacttgttataaact

SEQ ID NO: 3439660 - DNA, 22 bp, Homo sapiens
tttctactttgaagtcatacca

SEQ ID NO: 3439661 - DNA, 20 bp, Homo sapiens
tttctagaacatccctgcca

SEQ ID NO: 3439662 - DNA, 22 bp, Homo sapiens
tttctagaacatccctgccagc

SEQ ID NO: 3439663 - DNA, 16 bp, Homo sapiens
tttctagagcactgcc

SEQ ID NO: 3439664 - DNA, 18 bp, Homo sapiens
tttctagatacaataaat

SEQ ID NO: 3439665 - DNA, 19 bp, Homo sapiens
tttctagctgttgagctgt

SEQ ID NO: 3439666 - DNA, 17 bp, Homo sapiens
tttctatttctcctcca

SEQ ID NO: 3439667 - DNA, 22 bp, Homo sapiens
tttctctaacttcaaggcccat

SEQ ID NO: 3439668 - DNA, 15 bp, Homo sapiens
tttctctcctgtcct

SEQ ID NO: 3439669 - DNA, 16 bp, Homo sapiens
tttctctcctgtcctc

SEQ ID NO: 3439670 - DNA, 18 bp, Homo sapiens
tttctctgtacttttcat

SEQ ID NO: 3439671 - DNA, 14 bp, Homo sapiens
tttctctgttgtaa

SEQ ID NO: 3439672 - DNA, 20 bp, Homo sapiens
tttctgagacagcttgtctg

SEQ ID NO: 3439673 - DNA, 15 bp, Homo sapiens
tttctgcctccttta

SEQ ID NO: 3439674 - DNA, 19 bp, Homo sapiens
tttctgctcagcttctcct

SEQ ID NO: 3439675 - DNA, 23 bp, Homo sapiens
tttctggattccccatctcaggc

SEQ ID NO: 3439676 - DNA, 17 bp, Homo sapiens
tttctggtggtctgttg

SEQ ID NO: 3439677 - DNA, 21 bp, Homo sapiens
tttctggtgttttatttccta

SEQ ID NO: 3439678 - DNA, 17 bp, Homo sapiens
tttctgtatatactttt

SEQ ID NO: 3439679 - DNA, 13 bp, Homo sapiens
tttctgtgccctc

SEQ ID NO: 3439680 - DNA, 15 bp, Homo sapiens
tttcttaaatgggct

SEQ ID NO: 3439681 - DNA, 17 bp, Homo sapiens
tttcttattgcgctgct

SEQ ID NO: 3439682 - DNA, 12 bp, Homo sapiens
tttcttctatgt

SEQ ID NO: 3439683 - DNA, 13 bp, Homo sapiens
tttcttgaatttt

SEQ ID NO: 3439684 - DNA, 21 bp, Homo sapiens
tttcttgatcaacatcttttc

SEQ ID NO: 3439685 - DNA, 16 bp, Homo sapiens
tttcttgttgctttgt

SEQ ID NO: 3439686 - DNA, 21 bp, Homo sapiens
tttcttgttgctttgttgcac

SEQ ID NO: 3439687 - DNA, 15 bp, Homo sapiens
tttctttaaaaaaca

SEQ ID NO: 3439688 - DNA, 13 bp, Homo sapiens
tttctttaatgct

SEQ ID NO: 3439689 - DNA, 11 bp, Homo sapiens
tttctttatat

SEQ ID NO: 3439690 - DNA, 17 bp, Homo sapiens
tttctttgggaatattt

SEQ ID NO: 3439691 - DNA, 13 bp, Homo sapiens
tttctttgtggct

SEQ ID NO: 3439692 - DNA, 14 bp, Homo sapiens
tttcttttgtaata

SEQ ID NO: 3439693 - DNA, 19 bp, Homo sapiens
tttcttttgtaataaacta

SEQ ID NO: 3439694 - DNA, 19 bp, Homo sapiens
tttctttttttaactggtg

SEQ ID NO: 3439695 - DNA, 23 bp, Homo sapiens
tttgaaataaagaaccagtccct

SEQ ID NO: 3439696 - DNA, 11 bp, Homo sapiens
tttgaaattct

SEQ ID NO: 3439697 - DNA, 18 bp, Homo sapiens
tttgaagaacatgtgaga

SEQ ID NO: 3439698 - DNA, 14 bp, Homo sapiens
tttgaagctgctgt

SEQ ID NO: 3439699 - DNA, 22 bp, Homo sapiens
tttgaagtgtaggcagacacag

SEQ ID NO: 3439700 - DNA, 18 bp, Homo sapiens
tttgaataaagaatactt

SEQ ID NO: 3439701 - DNA, 18 bp, Homo sapiens
tttgaatcttgtctcaat

SEQ ID NO: 3439702 - DNA, 11 bp, Homo sapiens
tttgaatgtta

SEQ ID NO: 3439703 - DNA, 16 bp, Homo sapiens
tttgaatgttaaataa

SEQ ID NO: 3439704 - DNA, 16 bp, Homo sapiens
tttgaatgttaatttt

SEQ ID NO: 3439705 - DNA, 14 bp, Homo sapiens
tttgaattgttaca

SEQ ID NO: 3439706 - DNA, 20 bp, Homo sapiens
tttgacaacgtttcagcgac

SEQ ID NO: 3439707 - DNA, 14 bp, Homo sapiens
tttgacacttccat

SEQ ID NO: 3439708 - DNA, 17 bp, Homo sapiens
tttgacatgggtatttt

SEQ ID NO: 3439709 - DNA, 12 bp, Homo sapiens
tttgaccaattt

SEQ ID NO: 3439710 - DNA, 14 bp, Homo sapiens
tttgaccaatttgc

SEQ ID NO: 3439711 - DNA, 14 bp, Homo sapiens
tttgactaatttta

SEQ ID NO: 3439712 - DNA, 19 bp, Homo sapiens
tttgactctggcaaagctt

SEQ ID NO: 3439713 - DNA, 23 bp, Homo sapiens
tttgacttaatgtgattactgct

SEQ ID NO: 3439714 - DNA, 21 bp, Homo sapiens
tttgagaaacaacaatttcta

SEQ ID NO: 3439715 - DNA, 18 bp, Homo sapiens
tttgagaacaaagatgac

SEQ ID NO: 3439716 - DNA, 18 bp, Homo sapiens
tttgagaagaaaacatct

SEQ ID NO: 3439717 - DNA, 16 bp, Homo sapiens
tttgagaccagcctgg

SEQ ID NO: 3439718 - DNA, 17 bp, Homo sapiens
tttgagatcagcctggg

SEQ ID NO: 3439719 - DNA, 14 bp, Homo sapiens
tttgagtgctctga

SEQ ID NO: 3439720 - DNA, 14 bp, Homo sapiens
tttgagtgttttaa

SEQ ID NO: 3439721 - DNA, 18 bp, Homo sapiens
tttgatcaggtggggagt

SEQ ID NO: 3439722 - DNA, 14 bp, Homo sapiens
tttgatccaagctg

SEQ ID NO: 3439723 - DNA, 16 bp, Homo sapiens
tttgatgcatgtcttt

SEQ ID NO: 3439724 - DNA, 12 bp, Homo sapiens
tttgattctcct

SEQ ID NO: 3439725 - DNA, 16 bp, Homo sapiens
tttgattctccttcag

SEQ ID NO: 3439726 - DNA, 14 bp, Homo sapiens
tttgattgtttaca

SEQ ID NO: 3439727 - DNA, 13 bp, Homo sapiens
tttgcaaagtact

SEQ ID NO: 3439728 - DNA, 23 bp, Homo sapiens
tttgcaaagtactgtaagaataa

SEQ ID NO: 3439729 - DNA, 19 bp, Homo sapiens
tttgcaaagtattgtaaat

SEQ ID NO: 3439730 - DNA, 22 bp, Homo sapiens
tttgcaaagtattgtaaattat

SEQ ID NO: 3439731 - DNA, 21 bp, Homo sapiens
tttgcaagggaaaagtctctt

SEQ ID NO: 3439732 - DNA, 15 bp, Homo sapiens
tttgcaagtgaaggt

SEQ ID NO: 3439733 - DNA, 16 bp, Homo sapiens
tttgcaagtgaaggtt

SEQ ID NO: 3439734 - DNA, 22 bp, Homo sapiens
tttgcaagtgaaggtttacaat

SEQ ID NO: 3439735 - DNA, 14 bp, Homo sapiens
tttgcactgtgtgc

SEQ ID NO: 3439736 - DNA, 19 bp, Homo sapiens
tttgcactgtgtgctgact

SEQ ID NO: 3439737 - DNA, 22 bp, Homo sapiens
tttgcagggtcctcttctgggc

SEQ ID NO: 3439738 - DNA, 18 bp, Homo sapiens
tttgcataacaattcctc

SEQ ID NO: 3439739 - DNA, 17 bp, Homo sapiens
tttgcattaaattcaca

SEQ ID NO: 3439740 - DNA, 14 bp, Homo sapiens
tttgcatttggaat

SEQ ID NO: 3439741 - DNA, 18 bp, Homo sapiens
tttgccatgttggccagg

SEQ ID NO: 3439742 - DNA, 18 bp, Homo sapiens
tttgccggatacaaactg

SEQ ID NO: 3439743 - DNA, 17 bp, Homo sapiens
tttgcctcaccttgggg

SEQ ID NO: 3439744 - DNA, 15 bp, Homo sapiens
tttgcgtacacagag

SEQ ID NO: 3439745 - DNA, 12 bp, Homo sapiens
tttgctctgcca

SEQ ID NO: 3439746 - DNA, 18 bp, Homo sapiens
tttgctgtatatttgtga

SEQ ID NO: 3439747 - DNA, 21 bp, Homo sapiens
tttgcttgctcatatgcatgt

SEQ ID NO: 3439748 - DNA, 13 bp, Homo sapiens
tttggaaacaaca

SEQ ID NO: 3439749 - DNA, 12 bp, Homo sapiens
tttggatgaagg

SEQ ID NO: 3439750 - DNA, 11 bp, Homo sapiens
tttggattctt

SEQ ID NO: 3439751 - DNA, 23 bp, Homo sapiens
tttggattctttaaatatatatt

SEQ ID NO: 3439752 - DNA, 16 bp, Homo sapiens
tttggatttgacattg

SEQ ID NO: 3439753 - DNA, 17 bp, Homo sapiens
tttggcaatgccatcat

SEQ ID NO: 3439754 - DNA, 23 bp, Homo sapiens
tttggccatctctggatgcctga

SEQ ID NO: 3439755 - DNA, 21 bp, Homo sapiens
tttggcctcatctctgcctga

SEQ ID NO: 3439756 - DNA, 21 bp, Homo sapiens
tttggctgaaattctcctgga

SEQ ID NO: 3439757 - DNA, 22 bp, Homo sapiens
tttgggaggccaaggtgggagg

SEQ ID NO: 3439758 - DNA, 19 bp, Homo sapiens
tttgggatagagaatgttc

SEQ ID NO: 3439759 - DNA, 17 bp, Homo sapiens
tttgggatccctgtctt

SEQ ID NO: 3439760 - DNA, 20 bp, Homo sapiens
tttggggattttcaaaagat

SEQ ID NO: 3439761 - DNA, 22 bp, Homo sapiens
tttgggtatgttaacctaggca

SEQ ID NO: 3439762 - DNA, 15 bp, Homo sapiens
tttgggttctgcctg

SEQ ID NO: 3439763 - DNA, 13 bp, Homo sapiens
tttggtacaaaaa

SEQ ID NO: 3439764 - DNA, 23 bp, Homo sapiens
tttggtagtggaaaaaaaaaaga

SEQ ID NO: 3439765 - DNA, 14 bp, Homo sapiens
tttggtattgtatt

SEQ ID NO: 3439766 - DNA, 15 bp, Homo sapiens
tttggtggagataaa

SEQ ID NO: 3439767 - DNA, 18 bp, Homo sapiens
tttggttaaaaaaaagaa

SEQ ID NO: 3439768 - DNA, 14 bp, Homo sapiens
tttggtttggcctc

SEQ ID NO: 3439769 - DNA, 20 bp, Homo sapiens
tttggtttggcctccatcct

SEQ ID NO: 3439770 - DNA, 16 bp, Homo sapiens
tttgtaaagtgaagaa

SEQ ID NO: 3439771 - DNA, 20 bp, Homo sapiens
tttgtaaataggatttttag

SEQ ID NO: 3439772 - DNA, 16 bp, Homo sapiens
tttgtaactttttaca

SEQ ID NO: 3439773 - DNA, 12 bp, Homo sapiens
tttgtaataaca

SEQ ID NO: 3439774 - DNA, 20 bp, Homo sapiens
tttgtaataacatttaattt

SEQ ID NO: 3439775 - DNA, 13 bp, Homo sapiens
tttgtacataaat

SEQ ID NO: 3439776 - DNA, 19 bp, Homo sapiens
tttgtacatatgtaaaata

SEQ ID NO: 3439777 - DNA, 19 bp, Homo sapiens
tttgtaccagtgaattttt

SEQ ID NO: 3439778 - DNA, 12 bp, Homo sapiens
tttgtagttttt

SEQ ID NO: 3439779 - DNA, 20 bp, Homo sapiens
tttgtatcagtcagtgctgg

SEQ ID NO: 3439780 - DNA, 22 bp, Homo sapiens
tttgtatctgcaggcagacacg

SEQ ID NO: 3439781 - DNA, 12 bp, Homo sapiens
tttgtatgaaat

SEQ ID NO: 3439782 - DNA, 22 bp, Homo sapiens
tttgtatgaaattataatctgt

SEQ ID NO: 3439783 - DNA, 12 bp, Homo sapiens
tttgtatgtaaa

SEQ ID NO: 3439784 - DNA, 17 bp, Homo sapiens
tttgtatgtaaatgtgc

SEQ ID NO: 3439785 - DNA, 23 bp, Homo sapiens
tttgtattgtaaaaaattcacat

SEQ ID NO: 3439786 - DNA, 21 bp, Homo sapiens
tttgtattgtttcaattgcat

SEQ ID NO: 3439787 - DNA, 16 bp, Homo sapiens
tttgtcaacattgtga

SEQ ID NO: 3439788 - DNA, 19 bp, Homo sapiens
tttgtcaatttatgaatat

SEQ ID NO: 3439789 - DNA, 17 bp, Homo sapiens
tttgtcctaaaacacct

SEQ ID NO: 3439790 - DNA, 11 bp, Homo sapiens
tttgtctaaaa

SEQ ID NO: 3439791 - DNA, 13 bp, Homo sapiens
tttgtctgtcgtg

SEQ ID NO: 3439792 - DNA, 14 bp, Homo sapiens
tttgtcttaaaaag

SEQ ID NO: 3439793 - DNA, 23 bp, Homo sapiens
tttgtcttaaaaagtggaaaaat

SEQ ID NO: 3439794 - DNA, 11 bp, Homo sapiens
tttgtggccaa

SEQ ID NO: 3439795 - DNA, 20 bp, Homo sapiens
tttgtggccaaggagctgct

SEQ ID NO: 3439796 - DNA, 22 bp, Homo sapiens
tttgtggccaaggagctgctat

SEQ ID NO: 3439797 - DNA, 22 bp, Homo sapiens
tttgtggtacgacctttagatt

SEQ ID NO: 3439798 - DNA, 14 bp, Homo sapiens
tttgtgtaacatat

SEQ ID NO: 3439799 - DNA, 13 bp, Homo sapiens
tttgtgtatttaa

SEQ ID NO: 3439800 - DNA, 22 bp, Homo sapiens
tttgttaggattttcacattct

SEQ ID NO: 3439801 - DNA, 17 bp, Homo sapiens
tttgttataccatttcc

SEQ ID NO: 3439802 - DNA, 17 bp, Homo sapiens
tttgttcaagttttggg

SEQ ID NO: 3439803 - DNA, 12 bp, Homo sapiens
tttgttcccctc

SEQ ID NO: 3439804 - DNA, 13 bp, Homo sapiens
tttgttcccctcc

SEQ ID NO: 3439805 - DNA, 18 bp, Homo sapiens
tttgttcccctcctccac

SEQ ID NO: 3439806 - DNA, 20 bp, Homo sapiens
tttgttcgcatggtcacaca

SEQ ID NO: 3439807 - DNA, 13 bp, Homo sapiens
tttgttctctggg

SEQ ID NO: 3439808 - DNA, 21 bp, Homo sapiens
tttgttctctgggagaaaatc

SEQ ID NO: 3439809 - DNA, 13 bp, Homo sapiens
tttgttctctgtc

SEQ ID NO: 3439810 - DNA, 15 bp, Homo sapiens
tttgttgtaaaacaa

SEQ ID NO: 3439811 - DNA, 15 bp, Homo sapiens
tttgttgtcagctga

SEQ ID NO: 3439812 - DNA, 16 bp, Homo sapiens
tttgttgtcagctgaa

SEQ ID NO: 3439813 - DNA, 15 bp, Homo sapiens
tttgttgtgtgtgca

SEQ ID NO: 3439814 - DNA, 16 bp, Homo sapiens
tttgtttggtattgta

SEQ ID NO: 3439815 - DNA, 18 bp, Homo sapiens
tttgtttggtattgtatt

SEQ ID NO: 3439816 - DNA, 13 bp, Homo sapiens
tttgtttttaatt

SEQ ID NO: 3439817 - DNA, 18 bp, Homo sapiens
ttttaaaaaatattttct

SEQ ID NO: 3439818 - DNA, 20 bp, Homo sapiens
ttttaaaaaatgttttctgg

SEQ ID NO: 3439819 - DNA, 21 bp, Homo sapiens
ttttaaagtaaccctacaaaa

SEQ ID NO: 3439820 - DNA, 15 bp, Homo sapiens
ttttaaatattttct

SEQ ID NO: 3439821 - DNA, 17 bp, Homo sapiens
ttttaaatattttctat

SEQ ID NO: 3439822 - DNA, 22 bp, Homo sapiens
ttttaaatgtacagacatattt

SEQ ID NO: 3439823 - DNA, 21 bp, Homo sapiens
ttttaaccaaaggtgaaggaa

SEQ ID NO: 3439824 - DNA, 14 bp, Homo sapiens
ttttaactctgtct

SEQ ID NO: 3439825 - DNA, 16 bp, Homo sapiens
ttttaagaggcagggt

SEQ ID NO: 3439826 - DNA, 15 bp, Homo sapiens
ttttaagcaaaatat

SEQ ID NO: 3439827 - DNA, 13 bp, Homo sapiens
ttttaaggtcttt

SEQ ID NO: 3439828 - DNA, 18 bp, Homo sapiens
ttttaagttaatagattt

SEQ ID NO: 3439829 - DNA, 19 bp, Homo sapiens
ttttaatgaaaaggaatca

SEQ ID NO: 3439830 - DNA, 22 bp, Homo sapiens
ttttaatgaaaaggaatcacgt

SEQ ID NO: 3439831 - DNA, 17 bp, Homo sapiens
ttttaatgatgacaaaa

SEQ ID NO: 3439832 - DNA, 20 bp, Homo sapiens
ttttaatgtcatttgttaaa

SEQ ID NO: 3439833 - DNA, 18 bp, Homo sapiens
ttttaatttagtaaatgt

SEQ ID NO: 3439834 - DNA, 20 bp, Homo sapiens
ttttaatttagtaaatgtta

SEQ ID NO: 3439835 - DNA, 12 bp, Homo sapiens
ttttacacttta

SEQ ID NO: 3439836 - DNA, 12 bp, Homo sapiens
ttttacattaca

SEQ ID NO: 3439837 - DNA, 13 bp, Homo sapiens
ttttacatttcta

SEQ ID NO: 3439838 - DNA, 14 bp, Homo sapiens
ttttacctgctgct

SEQ ID NO: 3439839 - DNA, 20 bp, Homo sapiens
ttttactaagttttcaaatt

SEQ ID NO: 3439840 - DNA, 22 bp, Homo sapiens
ttttactgttgtacaatcatgt

SEQ ID NO: 3439841 - DNA, 19 bp, Homo sapiens
ttttagaaagcatttgaat

SEQ ID NO: 3439842 - DNA, 21 bp, Homo sapiens
ttttagaaagcatttgaatgc

SEQ ID NO: 3439843 - DNA, 22 bp, Homo sapiens
ttttagaaagcatttgaatgca

SEQ ID NO: 3439844 - DNA, 20 bp, Homo sapiens
ttttagagaatgtgtttcaa

SEQ ID NO: 3439845 - DNA, 23 bp, Homo sapiens
ttttagaggcagggctgcattgg

SEQ ID NO: 3439846 - DNA, 17 bp, Homo sapiens
ttttaggatacttaaca

SEQ ID NO: 3439847 - DNA, 18 bp, Homo sapiens
ttttaggatacttaacaa

SEQ ID NO: 3439848 - DNA, 18 bp, Homo sapiens
ttttataaataaactgtt

SEQ ID NO: 3439849 - DNA, 13 bp, Homo sapiens
ttttataagaaaa

SEQ ID NO: 3439850 - DNA, 17 bp, Homo sapiens
ttttataagaaaaactt

SEQ ID NO: 3439851 - DNA, 18 bp, Homo sapiens
ttttatactctttctgta

SEQ ID NO: 3439852 - DNA, 22 bp, Homo sapiens
ttttatataatatctaaagtta

SEQ ID NO: 3439853 - DNA, 16 bp, Homo sapiens
ttttatatgttgctat

SEQ ID NO: 3439854 - DNA, 13 bp, Homo sapiens
ttttatccataat

SEQ ID NO: 3439855 - DNA, 14 bp, Homo sapiens
ttttatccataatg

SEQ ID NO: 3439856 - DNA, 15 bp, Homo sapiens
ttttatccataatga

SEQ ID NO: 3439857 - DNA, 15 bp, Homo sapiens
ttttatctgtttcct

SEQ ID NO: 3439858 - DNA, 19 bp, Homo sapiens
ttttatgagaaagccttct

SEQ ID NO: 3439859 - DNA, 21 bp, Homo sapiens
ttttatgagatggatcacata

SEQ ID NO: 3439860 - DNA, 13 bp, Homo sapiens
ttttatgcatgtt

SEQ ID NO: 3439861 - DNA, 19 bp, Homo sapiens
ttttatgtagtaattgaca

SEQ ID NO: 3439862 - DNA, 16 bp, Homo sapiens
ttttattaaacagata

SEQ ID NO: 3439863 - DNA, 16 bp, Homo sapiens
ttttattgccttctca

SEQ ID NO: 3439864 - DNA, 24 bp, Homo sapiens
ttttattgccttctcaccagctgc

SEQ ID NO: 3439865 - DNA, 20 bp, Homo sapiens
ttttattttcaccctctgta

SEQ ID NO: 3439866 - DNA, 18 bp, Homo sapiens
ttttcaacagtgaagaca

SEQ ID NO: 3439867 - DNA, 13 bp, Homo sapiens
ttttcaactgcca

SEQ ID NO: 3439868 - DNA, 23 bp, Homo sapiens
ttttcaactgccaaaatgctcta

SEQ ID NO: 3439869 - DNA, 15 bp, Homo sapiens
ttttcaaggccttca

SEQ ID NO: 3439870 - DNA, 14 bp, Homo sapiens
ttttcaatatttat

SEQ ID NO: 3439871 - DNA, 15 bp, Homo sapiens
ttttcacggaagttt

SEQ ID NO: 3439872 - DNA, 17 bp, Homo sapiens
ttttcacggaagttttc

SEQ ID NO: 3439873 - DNA, 17 bp, Homo sapiens
ttttcattcctaaagaa

SEQ ID NO: 3439874 - DNA, 21 bp, Homo sapiens
ttttccaaagaaaagtattgt

SEQ ID NO: 3439875 - DNA, 12 bp, Homo sapiens
ttttccaggctg

SEQ ID NO: 3439876 - DNA, 19 bp, Homo sapiens
ttttccaggtttaagctgt

SEQ ID NO: 3439877 - DNA, 13 bp, Homo sapiens
ttttccatatatt

SEQ ID NO: 3439878 - DNA, 16 bp, Homo sapiens
ttttccatatcctggt

SEQ ID NO: 3439879 - DNA, 16 bp, Homo sapiens
ttttccattggtttac

SEQ ID NO: 3439880 - DNA, 12 bp, Homo sapiens
ttttcccacgag

SEQ ID NO: 3439881 - DNA, 17 bp, Homo sapiens
ttttcccctttcctgtc

SEQ ID NO: 3439882 - DNA, 15 bp, Homo sapiens
ttttccctgtacagt

SEQ ID NO: 3439883 - DNA, 17 bp, Homo sapiens
ttttcctcccttctgct

SEQ ID NO: 3439884 - DNA, 21 bp, Homo sapiens
ttttcctcccttctgctactg

SEQ ID NO: 3439885 - DNA, 14 bp, Homo sapiens
ttttcgcctttcct

SEQ ID NO: 3439886 - DNA, 15 bp, Homo sapiens
ttttctagatacaat

SEQ ID NO: 3439887 - DNA, 17 bp, Homo sapiens
ttttctctaactcagaa

SEQ ID NO: 3439888 - DNA, 14 bp, Homo sapiens
ttttctctgtactt

SEQ ID NO: 3439889 - DNA, 18 bp, Homo sapiens
ttttctctgtacttttca

SEQ ID NO: 3439890 - DNA, 12 bp, Homo sapiens
ttttctgcacag

SEQ ID NO: 3439891 - DNA, 16 bp, Homo sapiens
ttttctgcacagcttt

SEQ ID NO: 3439892 - DNA, 22 bp, Homo sapiens
ttttctgcacagcttttccaaa

SEQ ID NO: 3439893 - DNA, 10 bp, Homo sapiens
ttttctgggt

SEQ ID NO: 3439894 - DNA, 15 bp, Homo sapiens
ttttcttcactgtcc

SEQ ID NO: 3439895 - DNA, 20 bp, Homo sapiens
ttttctttatttttgttaat

SEQ ID NO: 3439896 - DNA, 14 bp, Homo sapiens
ttttctttcctcct

SEQ ID NO: 3439897 - DNA, 17 bp, Homo sapiens
ttttctttcctcctttc

SEQ ID NO: 3439898 - DNA, 22 bp, Homo sapiens
ttttgaaatgtggttttcctga

SEQ ID NO: 3439899 - DNA, 17 bp, Homo sapiens
ttttgaaattaacctct

SEQ ID NO: 3439900 - DNA, 10 bp, Homo sapiens
ttttgaagtg

SEQ ID NO: 3439901 - DNA, 11 bp, Homo sapiens
ttttgaagtgt

SEQ ID NO: 3439902 - DNA, 15 bp, Homo sapiens
ttttgaataaaaact

SEQ ID NO: 3439903 - DNA, 20 bp, Homo sapiens
ttttgaccttcatttcatgt

SEQ ID NO: 3439904 - DNA, 21 bp, Homo sapiens
ttttgactctggcaaagcttt

SEQ ID NO: 3439905 - DNA, 17 bp, Homo sapiens
ttttgacttaatgtgat

SEQ ID NO: 3439906 - DNA, 18 bp, Homo sapiens
ttttgagaacgtaaagaa

SEQ ID NO: 3439907 - DNA, 17 bp, Homo sapiens
ttttgcaacctcgctgg

SEQ ID NO: 3439908 - DNA, 12 bp, Homo sapiens
ttttgcactgta

SEQ ID NO: 3439909 - DNA, 12 bp, Homo sapiens
ttttgctgtata

SEQ ID NO: 3439910 - DNA, 17 bp, Homo sapiens
ttttggagtgttatgta

SEQ ID NO: 3439911 - DNA, 20 bp, Homo sapiens
ttttggagtgttatgtattt

SEQ ID NO: 3439912 - DNA, 22 bp, Homo sapiens
ttttggggattttcaaaagata

SEQ ID NO: 3439913 - DNA, 18 bp, Homo sapiens
ttttgggggtgggtctgg

SEQ ID NO: 3439914 - DNA, 14 bp, Homo sapiens
ttttggtacaaaaa

SEQ ID NO: 3439915 - DNA, 14 bp, Homo sapiens
ttttggtagagatg

SEQ ID NO: 3439916 - DNA, 14 bp, Homo sapiens
ttttggttttgttc

SEQ ID NO: 3439917 - DNA, 15 bp, Homo sapiens
ttttgtaaagatgcc

SEQ ID NO: 3439918 - DNA, 13 bp, Homo sapiens
ttttgtaccagtg

SEQ ID NO: 3439919 - DNA, 14 bp, Homo sapiens
ttttgtaccagtga

SEQ ID NO: 3439920 - DNA, 16 bp, Homo sapiens
ttttgtatagtaaagt

SEQ ID NO: 3439921 - DNA, 17 bp, Homo sapiens
ttttgtatagtaaagtg

SEQ ID NO: 3439922 - DNA, 18 bp, Homo sapiens
ttttgtatagtaaagtga

SEQ ID NO: 3439923 - DNA, 20 bp, Homo sapiens
ttttgtatgtaaatgtgcat

SEQ ID NO: 3439924 - DNA, 16 bp, Homo sapiens
ttttgtcaacattgtg

SEQ ID NO: 3439925 - DNA, 11 bp, Homo sapiens
ttttgtgtcct

SEQ ID NO: 3439926 - DNA, 16 bp, Homo sapiens
ttttgttcaaagccag

SEQ ID NO: 3439927 - DNA, 14 bp, Homo sapiens
ttttgttcccctcc

SEQ ID NO: 3439928 - DNA, 13 bp, Homo sapiens
ttttgttccctat

SEQ ID NO: 3439929 - DNA, 13 bp, Homo sapiens
ttttgttgtgtgt

SEQ ID NO: 3439930 - DNA, 13 bp, Homo sapiens
ttttgtttccttt

SEQ ID NO: 3439931 - DNA, 22 bp, Homo sapiens
ttttgtttccttttttcccata

SEQ ID NO: 3439932 - DNA, 18 bp, Homo sapiens
ttttgtttggcaaggaaa

SEQ ID NO: 3439933 - DNA, 19 bp, Homo sapiens
ttttgtttggcaaggaaag

SEQ ID NO: 3439934 - DNA, 22 bp, Homo sapiens
ttttgtttggtattgtatttat

SEQ ID NO: 3439935 - DNA, 16 bp, Homo sapiens
ttttgtttttgtctta

SEQ ID NO: 3439936 - DNA, 18 bp, Homo sapiens
ttttgttttttcaaaata

SEQ ID NO: 3439937 - DNA, 18 bp, Homo sapiens
tttttaaaataaactgta

SEQ ID NO: 3439938 - DNA, 21 bp, Homo sapiens
tttttaaaataaactgtaaac

SEQ ID NO: 3439939 - DNA, 14 bp, Homo sapiens
tttttaactggtga

SEQ ID NO: 3439940 - DNA, 15 bp, Homo sapiens
tttttaactggtgaa

SEQ ID NO: 3439941 - DNA, 16 bp, Homo sapiens
tttttaactggtgaag

SEQ ID NO: 3439942 - DNA, 18 bp, Homo sapiens
tttttaagctgtttccat

SEQ ID NO: 3439943 - DNA, 23 bp, Homo sapiens
tttttaagggttatcttagatgt

SEQ ID NO: 3439944 - DNA, 13 bp, Homo sapiens
tttttacagctgt

SEQ ID NO: 3439945 - DNA, 16 bp, Homo sapiens
tttttacattacagaa

SEQ ID NO: 3439946 - DNA, 19 bp, Homo sapiens
tttttactaagttttcaaa

SEQ ID NO: 3439947 - DNA, 20 bp, Homo sapiens
tttttactaagttttcaaat

SEQ ID NO: 3439948 - DNA, 15 bp, Homo sapiens
tttttatattaatgt

SEQ ID NO: 3439949 - DNA, 22 bp, Homo sapiens
tttttattaaacagatatcttc

SEQ ID NO: 3439950 - DNA, 23 bp, Homo sapiens
tttttattgaatctatttaagta

SEQ ID NO: 3439951 - DNA, 15 bp, Homo sapiens
tttttcaaagcaatt

SEQ ID NO: 3439952 - DNA, 24 bp, Homo sapiens
tttttcaggctcgccaaggcctag

SEQ ID NO: 3439953 - DNA, 18 bp, Homo sapiens
tttttcatgttttaacaa

SEQ ID NO: 3439954 - DNA, 13 bp, Homo sapiens
tttttccatcttt

SEQ ID NO: 3439955 - DNA, 18 bp, Homo sapiens
tttttcccataagacaat

SEQ ID NO: 3439956 - DNA, 19 bp, Homo sapiens
tttttcctccctgcttaaa

SEQ ID NO: 3439957 - DNA, 11 bp, Homo sapiens
tttttctctaa

SEQ ID NO: 3439958 - DNA, 12 bp, Homo sapiens
tttttctctcct

SEQ ID NO: 3439959 - DNA, 12 bp, Homo sapiens
tttttctgcaca

SEQ ID NO: 3439960 - DNA, 13 bp, Homo sapiens
tttttctgcacag

SEQ ID NO: 3439961 - DNA, 13 bp, Homo sapiens
tttttctgcagaa

SEQ ID NO: 3439962 - DNA, 12 bp, Homo sapiens
tttttctgcctc

SEQ ID NO: 3439963 - DNA, 24 bp, Homo sapiens
tttttgaagtgtaggcagacacag

SEQ ID NO: 3439964 - DNA, 18 bp, Homo sapiens
tttttgcaagtgaaggtt

SEQ ID NO: 3439965 - DNA, 9 bp, Homo sapiens
tttttggat

SEQ ID NO: 3439966 - DNA, 14 bp, Homo sapiens
tttttggtacaaaa

SEQ ID NO: 3439967 - DNA, 21 bp, Homo sapiens
tttttggttaaaaaaaagaat

SEQ ID NO: 3439968 - DNA, 11 bp, Homo sapiens
tttttgtacat

SEQ ID NO: 3439969 - DNA, 20 bp, Homo sapiens
tttttgtagagccagggtct

SEQ ID NO: 3439970 - DNA, 13 bp, Homo sapiens
tttttgtgaagac

SEQ ID NO: 3439971 - DNA, 19 bp, Homo sapiens
tttttgttggagtgtttct

SEQ ID NO: 3439972 - DNA, 19 bp, Homo sapiens
tttttgttgttttgtagca

SEQ ID NO: 3439973 - DNA, 16 bp, Homo sapiens
tttttgtttgtattgt

SEQ ID NO: 3439974 - DNA, 12 bp, Homo sapiens
ttttttaaaaaa

SEQ ID NO: 3439975 - DNA, 13 bp, Homo sapiens
ttttttataacaa

SEQ ID NO: 3439976 - DNA, 11 bp, Homo sapiens
ttttttattca

SEQ ID NO: 3439977 - DNA, 18 bp, Homo sapiens
ttttttcaatatttatta

SEQ ID NO: 3439978 - DNA, 18 bp, Homo sapiens
ttttttctgcacagcttt

SEQ ID NO: 3439979 - DNA, 12 bp, Homo sapiens
ttttttcttgta

SEQ ID NO: 3439980 - DNA, 13 bp, Homo sapiens
ttttttggtacaa

SEQ ID NO: 3439981 - DNA, 12 bp, Homo sapiens
ttttttgtagtt

SEQ ID NO: 3439982 - DNA, 12 bp, Homo sapiens
ttttttgtttgt

SEQ ID NO: 3439983 - DNA, 14 bp, Homo sapiens
tttttttaactggt

SEQ ID NO: 3439984 - DNA, 13 bp, Homo sapiens
tttttttcctttt

SEQ ID NO: 3439985 - DNA, 15 bp, Homo sapiens
tgctctaggaagaca

SEQ ID NO: 3439986 - DNA, 21 bp, Homo sapiens
tgctctaggctgccccgggtc

SEQ ID NO: 3439987 - DNA, 14 bp, Homo sapiens
tgctctagtgcctt

SEQ ID NO: 3439988 - DNA, 16 bp, Homo sapiens
tgctctagtgccttct

SEQ ID NO: 3439989 - DNA, 14 bp, Homo sapiens
tgctctcactgttt

SEQ ID NO: 3439990 - DNA, 22 bp, Homo sapiens
tgctctcactgtttgtttttat

SEQ ID NO: 3439991 - DNA, 14 bp, Homo sapiens
tgctctcagcctcc

SEQ ID NO: 3439992 - DNA, 23 bp, Homo sapiens
tgctctccgaccagacaccttga

SEQ ID NO: 3439993 - DNA, 14 bp, Homo sapiens
tgctctctcttctt

SEQ ID NO: 3439994 - DNA, 19 bp, Homo sapiens
tgctctgatcatccactgt

SEQ ID NO: 3439995 - DNA, 16 bp, Homo sapiens
tgctctgatccctcta

SEQ ID NO: 3439996 - DNA, 22 bp, Homo sapiens
tgctctgcgtgtcacctgtgct

SEQ ID NO: 3439997 - DNA, 14 bp, Homo sapiens
tgctctgctgacag

SEQ ID NO: 3439998 - DNA, 15 bp, Homo sapiens
tgctctgctgacaga

SEQ ID NO: 3439999 - DNA, 16 bp, Homo sapiens
tgctctgctgacagac

SEQ ID NO: 3440000 - DNA, 21 bp, Homo sapiens
tgctctgctgacagacacagg

SEQ ID NO: 3440001 - DNA, 16 bp, Homo sapiens
tgctctgcttgacaac

SEQ ID NO: 3440002 - DNA, 14 bp, Homo sapiens
tgctctggacaggc

SEQ ID NO: 3440003 - DNA, 16 bp, Homo sapiens
tgctctggacaggcat

SEQ ID NO: 3440004 - DNA, 20 bp, Homo sapiens
tgctcttgaccttgtagaga

SEQ ID NO: 3440005 - DNA, 18 bp, Homo sapiens
tgctgaataggcgatcac

SEQ ID NO: 3440006 - DNA, 19 bp, Homo sapiens
tgctgacagacacaggccc

SEQ ID NO: 3440007 - DNA, 23 bp, Homo sapiens
tgctgacagacacaggcccggct

SEQ ID NO: 3440008 - DNA, 14 bp, Homo sapiens
tgctgacagctctt

SEQ ID NO: 3440009 - DNA, 15 bp, Homo sapiens
tgctgacagctgacc

SEQ ID NO: 3440010 - DNA, 16 bp, Homo sapiens
tgctgacagctgctcc

SEQ ID NO: 3440011 - DNA, 16 bp, Homo sapiens
tgctgacctccacagc

SEQ ID NO: 3440012 - DNA, 17 bp, Homo sapiens
tgctgactgttttctct

SEQ ID NO: 3440013 - DNA, 24 bp, Homo sapiens
tgctgactgttttctcttgagagg

SEQ ID NO: 3440014 - DNA, 12 bp, Homo sapiens
tgctgagcctct

SEQ ID NO: 3440015 - DNA, 17 bp, Homo sapiens
tgctgagcctctgctcc

SEQ ID NO: 3440016 - DNA, 16 bp, Homo sapiens
tgctgaggcctgggcc

SEQ ID NO: 3440017 - DNA, 23 bp, Homo sapiens
tgctgagggtgtttcttcctgca

SEQ ID NO: 3440018 - DNA, 17 bp, Homo sapiens
tgctgagtcatctgtta

SEQ ID NO: 3440019 - DNA, 21 bp, Homo sapiens
tgctgatcatcgccagaggtg

SEQ ID NO: 3440020 - DNA, 18 bp, Homo sapiens
tgctgatttggtgaccaa

SEQ ID NO: 3440021 - DNA, 17 bp, Homo sapiens
tgctgcaacaaaatgta

SEQ ID NO: 3440022 - DNA, 16 bp, Homo sapiens
tgctgcagctccctgg

SEQ ID NO: 3440023 - DNA, 14 bp, Homo sapiens
tgctgccagggctt

SEQ ID NO: 3440024 - DNA, 15 bp, Homo sapiens
tgctgccagggcttc

SEQ ID NO: 3440025 - DNA, 11 bp, Homo sapiens
tgctgccatcc

SEQ ID NO: 3440026 - DNA, 21 bp, Homo sapiens
tgctgccccatcagtgctccc

SEQ ID NO: 3440027 - DNA, 19 bp, Homo sapiens
tgctgccgccccacccaga

SEQ ID NO: 3440028 - DNA, 23 bp, Homo sapiens
tgctgccgccccacccagatggg

SEQ ID NO: 3440029 - DNA, 20 bp, Homo sapiens
tgctgccggcacagctggga

SEQ ID NO: 3440030 - DNA, 16 bp, Homo sapiens
tgctgctagatcttta

SEQ ID NO: 3440031 - DNA, 19 bp, Homo sapiens
tgctgctatcctgccaaaa

SEQ ID NO: 3440032 - DNA, 13 bp, Homo sapiens
tgctgctgcctgc

SEQ ID NO: 3440033 - DNA, 11 bp, Homo sapiens
tgctgctggcc

SEQ ID NO: 3440034 - DNA, 12 bp, Homo sapiens
tgctgctggcca

SEQ ID NO: 3440035 - DNA, 14 bp, Homo sapiens
tgctgctggccaaa

SEQ ID NO: 3440036 - DNA, 19 bp, Homo sapiens
tgctgctgtccagtgccta

SEQ ID NO: 3440037 - DNA, 19 bp, Homo sapiens
tgctgcttgaggcaactca

SEQ ID NO: 3440038 - DNA, 15 bp, Homo sapiens
tgctggaagcccagc

SEQ ID NO: 3440039 - DNA, 16 bp, Homo sapiens
tgctggacagtatcac

SEQ ID NO: 3440040 - DNA, 18 bp, Homo sapiens
tgctggagcactgggctc

SEQ ID NO: 3440041 - DNA, 20 bp, Homo sapiens
tgctggagcactgggctccc

SEQ ID NO: 3440042 - DNA, 13 bp, Homo sapiens
tgctggaggcctc

SEQ ID NO: 3440043 - DNA, 16 bp, Homo sapiens
tgctggaggcctcagg

SEQ ID NO: 3440044 - DNA, 20 bp, Homo sapiens
tgctggaggcctcaggtgct

SEQ ID NO: 3440045 - DNA, 20 bp, Homo sapiens
tgctggagtttcatgtacaa

SEQ ID NO: 3440046 - DNA, 13 bp, Homo sapiens
tgctggccaaata

SEQ ID NO: 3440047 - DNA, 13 bp, Homo sapiens
tgctggcccaggg

SEQ ID NO: 3440048 - DNA, 20 bp, Homo sapiens
tgctggcccagggcccagag

SEQ ID NO: 3440049 - DNA, 18 bp, Homo sapiens
tgctggctgttggctggg

SEQ ID NO: 3440050 - DNA, 19 bp, Homo sapiens
tgctggctgttggctgggg

SEQ ID NO: 3440051 - DNA, 17 bp, Homo sapiens
tgctgggagctccactc

SEQ ID NO: 3440052 - DNA, 18 bp, Homo sapiens
tgctgggagctccactct

SEQ ID NO: 3440053 - DNA, 17 bp, Homo sapiens
tgctgggattacaggtg

SEQ ID NO: 3440054 - DNA, 20 bp, Homo sapiens
tgctggttttatctgagtga

SEQ ID NO: 3440055 - DNA, 13 bp, Homo sapiens
tgctggttttcta

SEQ ID NO: 3440056 - DNA, 17 bp, Homo sapiens
tgctgtaagatgtctgt

SEQ ID NO: 3440057 - DNA, 22 bp, Homo sapiens
tgctgtaagatgtctgtttgct

SEQ ID NO: 3440058 - DNA, 17 bp, Homo sapiens
tgctgtacatctatttt

SEQ ID NO: 3440059 - DNA, 21 bp, Homo sapiens
tgctgtatatttgtgatagca

SEQ ID NO: 3440060 - DNA, 20 bp, Homo sapiens
tgctgtatgctgatcatcgc

SEQ ID NO: 3440061 - DNA, 23 bp, Homo sapiens
tgctgtcaatattggtgtactgt

SEQ ID NO: 3440062 - DNA, 21 bp, Homo sapiens
tgctgtcacctctcccacggg

SEQ ID NO: 3440063 - DNA, 18 bp, Homo sapiens
tgctgtcacttcttcacc

SEQ ID NO: 3440064 - DNA, 13 bp, Homo sapiens
tgctgtccagtgc

SEQ ID NO: 3440065 - DNA, 14 bp, Homo sapiens
tgctgtcctcaggt

SEQ ID NO: 3440066 - DNA, 18 bp, Homo sapiens
tgctgtcctcaggtggcc

SEQ ID NO: 3440067 - DNA, 19 bp, Homo sapiens
tgctgtcctcaggtggcca

SEQ ID NO: 3440068 - DNA, 15 bp, Homo sapiens
tgctgtctgcagcct

SEQ ID NO: 3440069 - DNA, 18 bp, Homo sapiens
tgctgtgaaccctggggc

SEQ ID NO: 3440070 - DNA, 17 bp, Homo sapiens
tgctgtggtgtgtcccc

SEQ ID NO: 3440071 - DNA, 18 bp, Homo sapiens
tgctgttgacatatttaa

SEQ ID NO: 3440072 - DNA, 21 bp, Homo sapiens
tgctgttggtcctctctctgt

SEQ ID NO: 3440073 - DNA, 14 bp, Homo sapiens
tgctgttttcctcc

SEQ ID NO: 3440074 - DNA, 15 bp, Homo sapiens
tgctgttttcctccc

SEQ ID NO: 3440075 - DNA, 17 bp, Homo sapiens
tgctgttttcctccctt

SEQ ID NO: 3440076 - DNA, 22 bp, Homo sapiens
tgctgttttcctcccttctgct

SEQ ID NO: 3440077 - DNA, 15 bp, Homo sapiens
tgcttaaaaatgtag

SEQ ID NO: 3440078 - DNA, 18 bp, Homo sapiens
tgcttaaaaatgtagcag

SEQ ID NO: 3440079 - DNA, 15 bp, Homo sapiens
tgcttactgtgcacc

SEQ ID NO: 3440080 - DNA, 22 bp, Homo sapiens
tgcttagagggatttctttgct

SEQ ID NO: 3440081 - DNA, 21 bp, Homo sapiens
tgcttcaatagttcaaggaac

SEQ ID NO: 3440082 - DNA, 13 bp, Homo sapiens
tgcttcagcctcc

SEQ ID NO: 3440083 - DNA, 15 bp, Homo sapiens
tgcttcatttttgta

SEQ ID NO: 3440084 - DNA, 18 bp, Homo sapiens
tgcttcatttttgtaata

SEQ ID NO: 3440085 - DNA, 23 bp, Homo sapiens
tgcttcatttttgtaataacatt

SEQ ID NO: 3440086 - DNA, 14 bp, Homo sapiens
tgcttcccaggttc

SEQ ID NO: 3440087 - DNA, 18 bp, Homo sapiens
tgcttccccttttgccaa

SEQ ID NO: 3440088 - DNA, 15 bp, Homo sapiens
tgcttccctaatcta

SEQ ID NO: 3440089 - DNA, 15 bp, Homo sapiens
tgcttcctcctggaa

SEQ ID NO: 3440090 - DNA, 21 bp, Homo sapiens
tgcttctccaaaaatctgcct

SEQ ID NO: 3440091 - DNA, 22 bp, Homo sapiens
tgcttctccaaaaatctgcctg

SEQ ID NO: 3440092 - DNA, 24 bp, Homo sapiens
tgcttctccaaaaatctgcctggg

SEQ ID NO: 3440093 - DNA, 21 bp, Homo sapiens
tgcttctctgacttctgcctg

SEQ ID NO: 3440094 - DNA, 16 bp, Homo sapiens
tgcttctgaatacaaa

SEQ ID NO: 3440095 - DNA, 21 bp, Homo sapiens
tgcttcttctcctatgtgtaa

SEQ ID NO: 3440096 - DNA, 19 bp, Homo sapiens
tgcttctttctttgggaat

SEQ ID NO: 3440097 - DNA, 16 bp, Homo sapiens
tgcttgacaacatctg

SEQ ID NO: 3440098 - DNA, 15 bp, Homo sapiens
tgcttgagctcagga

SEQ ID NO: 3440099 - DNA, 12 bp, Homo sapiens
tgcttgaggaaa

SEQ ID NO: 3440100 - DNA, 18 bp, Homo sapiens
tgcttgatagaaatgcca

SEQ ID NO: 3440101 - DNA, 20 bp, Homo sapiens
tgcttgatgggattctggac

SEQ ID NO: 3440102 - DNA, 14 bp, Homo sapiens
tgcttgatgtttgg

SEQ ID NO: 3440103 - DNA, 15 bp, Homo sapiens
tgcttggagctgagc

SEQ ID NO: 3440104 - DNA, 13 bp, Homo sapiens
tgcttgggtctct

SEQ ID NO: 3440105 - DNA, 13 bp, Homo sapiens
tgcttgtcatctg

SEQ ID NO: 3440106 - DNA, 12 bp, Homo sapiens
tgcttgtgttat

SEQ ID NO: 3440107 - DNA, 19 bp, Homo sapiens
tgcttgttccctctccctg

SEQ ID NO: 3440108 - DNA, 23 bp, Homo sapiens
tgcttgtttgctcacctggggtg

SEQ ID NO: 3440109 - DNA, 14 bp, Homo sapiens
tgctttattccaga

SEQ ID NO: 3440110 - DNA, 20 bp, Homo sapiens
tgctttccaaaccttatctc

SEQ ID NO: 3440111 - DNA, 17 bp, Homo sapiens
tgctttccgtggcactg

SEQ ID NO: 3440112 - DNA, 21 bp, Homo sapiens
tgctttccgtggcactgcata

SEQ ID NO: 3440113 - DNA, 20 bp, Homo sapiens
tgctttcgtctccagcccct

SEQ ID NO: 3440114 - DNA, 12 bp, Homo sapiens
tgctttctcccc

SEQ ID NO: 3440115 - DNA, 14 bp, Homo sapiens
tgctttctgatcaa

SEQ ID NO: 3440116 - DNA, 12 bp, Homo sapiens
tgctttctgctc

SEQ ID NO: 3440117 - DNA, 13 bp, Homo sapiens
tgctttctgctca

SEQ ID NO: 3440118 - DNA, 14 bp, Homo sapiens
tgctttgcaaagac

SEQ ID NO: 3440119 - DNA, 13 bp, Homo sapiens
tgctttgcccagc

SEQ ID NO: 3440120 - DNA, 14 bp, Homo sapiens
tgctttgctttctg

SEQ ID NO: 3440121 - DNA, 22 bp, Homo sapiens
tgctttgtatcagtcagtgctg

SEQ ID NO: 3440122 - DNA, 15 bp, Homo sapiens
tgcagaggccagagg

SEQ ID NO: 3440123 - DNA, 17 bp, Homo sapiens
tgcagaggcctggggga

SEQ ID NO: 3440124 - DNA, 14 bp, Homo sapiens
tgcagaggtctcca

SEQ ID NO: 3440125 - DNA, 16 bp, Homo sapiens
tgcagcagggatgccc

SEQ ID NO: 3440126 - DNA, 17 bp, Homo sapiens
tgcagcatatacaataa

SEQ ID NO: 3440127 - DNA, 11 bp, Homo sapiens
tgcagccagag

SEQ ID NO: 3440128 - DNA, 16 bp, Homo sapiens
tgcagccctgagaaag

SEQ ID NO: 3440129 - DNA, 19 bp, Homo sapiens
tgcagccctgagaaagccc

SEQ ID NO: 3440130 - DNA, 21 bp, Homo sapiens
tgcagccttgaactctgggct

SEQ ID NO: 3440131 - DNA, 22 bp, Homo sapiens
tgcagctcaaggaaaggcctga

SEQ ID NO: 3440132 - DNA, 15 bp, Homo sapiens
tgcagctcctcagcg

SEQ ID NO: 3440133 - DNA, 20 bp, Homo sapiens
tgcagctcctcagcggctcc

SEQ ID NO: 3440134 - DNA, 18 bp, Homo sapiens
tgcaggacctcaggtgag

SEQ ID NO: 3440135 - DNA, 16 bp, Homo sapiens
tgcaggacctgcctgt

SEQ ID NO: 3440136 - DNA, 17 bp, Homo sapiens
tgcaggacctgcctgta

SEQ ID NO: 3440137 - DNA, 16 bp, Homo sapiens
tgcaggacttctgcct

SEQ ID NO: 3440138 - DNA, 18 bp, Homo sapiens
tgcaggatggtgtctctt

SEQ ID NO: 3440139 - DNA, 12 bp, Homo sapiens
tgcaggcagaca

SEQ ID NO: 3440140 - DNA, 15 bp, Homo sapiens
tgcaggccaggccag

SEQ ID NO: 3440141 - DNA, 12 bp, Homo sapiens
tgcaggccctgg

SEQ ID NO: 3440142 - DNA, 15 bp, Homo sapiens
tgcaggccctggcct

SEQ ID NO: 3440143 - DNA, 17 bp, Homo sapiens
tgcaggcctaggtgcag

SEQ ID NO: 3440144 - DNA, 22 bp, Homo sapiens
tgcaggcctaggtgcagctcct

SEQ ID NO: 3440145 - DNA, 13 bp, Homo sapiens
tgcagggagtccg

SEQ ID NO: 3440146 - DNA, 22 bp, Homo sapiens
tgcagggtcctcttctgggcct

SEQ ID NO: 3440147 - DNA, 23 bp, Homo sapiens
tgcagggttcaagccttccaggg

SEQ ID NO: 3440148 - DNA, 16 bp, Homo sapiens
tgcaggtgaaacccag

SEQ ID NO: 3440149 - DNA, 23 bp, Homo sapiens
tgcaggtgtggagagagaggctt

SEQ ID NO: 3440150 - DNA, 22 bp, Homo sapiens
tgcaggttggaactatgcagtg

SEQ ID NO: 3440151 - DNA, 15 bp, Homo sapiens
tgcagtaaatctttt

SEQ ID NO: 3440152 - DNA, 18 bp, Homo sapiens
tgcagtaaatcttttaca

SEQ ID NO: 3440153 - DNA, 17 bp, Homo sapiens
tgcagtcaacagttcaa

SEQ ID NO: 3440154 - DNA, 22 bp, Homo sapiens
tgcagtcctgatcagagccgtg

SEQ ID NO: 3440155 - DNA, 17 bp, Homo sapiens
tgcagtctctttatttt

SEQ ID NO: 3440156 - DNA, 22 bp, Homo sapiens
tgcagtggtatgatcacggctc

SEQ ID NO: 3440157 - DNA, 14 bp, Homo sapiens
tgcagtgtgaaaag

SEQ ID NO: 3440158 - DNA, 18 bp, Homo sapiens
tgcagtttaagagcagaa

SEQ ID NO: 3440159 - DNA, 11 bp, Homo sapiens
tgcagtttgaa

SEQ ID NO: 3440160 - DNA, 14 bp, Homo sapiens
tgcagtttgaaatt

SEQ ID NO: 3440161 - DNA, 15 bp, Homo sapiens
tgcagtttgaaattc

SEQ ID NO: 3440162 - DNA, 16 bp, Homo sapiens
tgcagtttgaaattct

SEQ ID NO: 3440163 - DNA, 17 bp, Homo sapiens
tgcagtttgaaattctg

SEQ ID NO: 3440164 - DNA, 18 bp, Homo sapiens
tgcagtttgaaattctga

SEQ ID NO: 3440165 - DNA, 21 bp, Homo sapiens
tgcagtttgaaattctgaatt

SEQ ID NO: 3440166 - DNA, 22 bp, Homo sapiens
tgcagtttgaaattctgaattt

SEQ ID NO: 3440167 - DNA, 23 bp, Homo sapiens
tgcagtttgaaattctgaatttg

SEQ ID NO: 3440168 - DNA, 19 bp, Homo sapiens
tgcagtttgagacaggaga

SEQ ID NO: 3440169 - DNA, 18 bp, Homo sapiens
tgcataaggtttttatgc

SEQ ID NO: 3440170 - DNA, 14 bp, Homo sapiens
tgcataagtgaaaa

SEQ ID NO: 3440171 - DNA, 14 bp, Homo sapiens
tgcatagcagctgc

SEQ ID NO: 3440172 - DNA, 17 bp, Homo sapiens
tgcatatgttgaatact

SEQ ID NO: 3440173 - DNA, 15 bp, Homo sapiens
tgcatattcccctct

SEQ ID NO: 3440174 - DNA, 15 bp, Homo sapiens
tgcatatttatccaa

SEQ ID NO: 3440175 - DNA, 22 bp, Homo sapiens
tgcatatttatccaaaatgtgt

SEQ ID NO: 3440176 - DNA, 15 bp, Homo sapiens
tgcatcccccccacc

SEQ ID NO: 3440177 - DNA, 17 bp, Homo sapiens
tgcatcccccccacctc

SEQ ID NO: 3440178 - DNA, 12 bp, Homo sapiens
tgcatctaagcc

SEQ ID NO: 3440179 - DNA, 17 bp, Homo sapiens
tgcatctaagcccatgg

SEQ ID NO: 3440180 - DNA, 21 bp, Homo sapiens
tgcatctcactggatgcaaag

SEQ ID NO: 3440181 - DNA, 18 bp, Homo sapiens
tgcatctcccagataatg

SEQ ID NO: 3440182 - DNA, 21 bp, Homo sapiens
tgcatctgaccagcagcgcct

SEQ ID NO: 3440183 - DNA, 13 bp, Homo sapiens
tgcatctggggcc

SEQ ID NO: 3440184 - DNA, 21 bp, Homo sapiens
tgcatctgtataagtaagaaa

SEQ ID NO: 3440185 - DNA, 14 bp, Homo sapiens
tgcatcttactgaa

SEQ ID NO: 3440186 - DNA, 14 bp, Homo sapiens
tgcatgattttgta

SEQ ID NO: 3440187 - DNA, 18 bp, Homo sapiens
tgcatgattttgtaaccc

SEQ ID NO: 3440188 - DNA, 22 bp, Homo sapiens
tgcatgcactgttccccctgtg

SEQ ID NO: 3440189 - DNA, 21 bp, Homo sapiens
tgcatggtgccccaggaccag

SEQ ID NO: 3440190 - DNA, 20 bp, Homo sapiens
tgcatgtaaacacgcctgca

SEQ ID NO: 3440191 - DNA, 22 bp, Homo sapiens
tgcatgtactagtcctctagaa

SEQ ID NO: 3440192 - DNA, 23 bp, Homo sapiens
tgcatgtcctttgcgcctgtgac

SEQ ID NO: 3440193 - DNA, 14 bp, Homo sapiens
tgcatgtgactctg

SEQ ID NO: 3440194 - DNA, 14 bp, Homo sapiens
tgcatgtgtgtgtg

SEQ ID NO: 3440195 - DNA, 18 bp, Homo sapiens
tgcatgttgaccatgtct

SEQ ID NO: 3440196 - DNA, 21 bp, Homo sapiens
tgcatgttttccagctcctca

SEQ ID NO: 3440197 - DNA, 15 bp, Homo sapiens
tgcattaaattcaca

SEQ ID NO: 3440198 - DNA, 16 bp, Homo sapiens
tgcattaaattcacaa

SEQ ID NO: 3440199 - DNA, 22 bp, Homo sapiens
tgcattcggtacttacccggag

SEQ ID NO: 3440200 - DNA, 19 bp, Homo sapiens
tgcattcttaacaaactct

SEQ ID NO: 3440201 - DNA, 14 bp, Homo sapiens
tgcattgaacacaa

SEQ ID NO: 3440202 - DNA, 18 bp, Homo sapiens
tgcattgaacacaaactg

SEQ ID NO: 3440203 - DNA, 23 bp, Homo sapiens
tgcattgaacacaaactgtaaat

SEQ ID NO: 3440204 - DNA, 20 bp, Homo sapiens
tgcattgaccgcgactaatt

SEQ ID NO: 3440205 - DNA, 12 bp, Homo sapiens
tgcattgtaaat

SEQ ID NO: 3440206 - DNA, 12 bp, Homo sapiens
tgcattgtgctt

SEQ ID NO: 3440207 - DNA, 18 bp, Homo sapiens
tgcatttatagatcattt

SEQ ID NO: 3440208 - DNA, 13 bp, Homo sapiens
tgcatttctgtat

SEQ ID NO: 3440209 - DNA, 15 bp, Homo sapiens
tgcatttctgtattt

SEQ ID NO: 3440210 - DNA, 18 bp, Homo sapiens
tgcatttgtgctagaaat

SEQ ID NO: 3440211 - DNA, 23 bp, Homo sapiens
tgcattttggagagtttcctgaa

SEQ ID NO: 3440212 - DNA, 22 bp, Homo sapiens
tgcattttgtttggtattgtat

SEQ ID NO: 3440213 - DNA, 13 bp, Homo sapiens
tgcatttttctgc

SEQ ID NO: 3440214 - DNA, 14 bp, Homo sapiens
tgcatttttctgca

SEQ ID NO: 3440215 - DNA, 20 bp, Homo sapiens
tgccaaaaaaagacagggct

SEQ ID NO: 3440216 - DNA, 14 bp, Homo sapiens
tgccaaagggaaat

SEQ ID NO: 3440217 - DNA, 19 bp, Homo sapiens
tgccaaatataaataaaaa

SEQ ID NO: 3440218 - DNA, 13 bp, Homo sapiens
tgccaacccctct

SEQ ID NO: 3440219 - DNA, 17 bp, Homo sapiens
tgccaagcactgtgctc

SEQ ID NO: 3440220 - DNA, 14 bp, Homo sapiens
tgccaagctcagga

SEQ ID NO: 3440221 - DNA, 18 bp, Homo sapiens
tgccaagctcaggaccag

SEQ ID NO: 3440222 - DNA, 22 bp, Homo sapiens
tgccaagctcaggaccaggcaa

SEQ ID NO: 3440223 - DNA, 20 bp, Homo sapiens
tgccaatatgccagcttgga

SEQ ID NO: 3440224 - DNA, 14 bp, Homo sapiens
tgccaatcaatagc

SEQ ID NO: 3440225 - DNA, 16 bp, Homo sapiens
tgccaatctcaacacc

SEQ ID NO: 3440226 - DNA, 13 bp, Homo sapiens
tgccacaccctcc

SEQ ID NO: 3440227 - DNA, 20 bp, Homo sapiens
tgccacaccctccccattca

SEQ ID NO: 3440228 - DNA, 14 bp, Homo sapiens
tgccacagagcggg

SEQ ID NO: 3440229 - DNA, 21 bp, Homo sapiens
tgccacagcctcccctgccag

SEQ ID NO: 3440230 - DNA, 18 bp, Homo sapiens
tgccacaggacacagtca

SEQ ID NO: 3440231 - DNA, 17 bp, Homo sapiens
tgccacagtatattttt

SEQ ID NO: 3440232 - DNA, 18 bp, Homo sapiens
tgccaccaccctgtcttc

SEQ ID NO: 3440233 - DNA, 19 bp, Homo sapiens
tgccaccaccctgtcttcc

SEQ ID NO: 3440234 - DNA, 23 bp, Homo sapiens
tgccaccaccctgtcttcctctg

SEQ ID NO: 3440235 - DNA, 14 bp, Homo sapiens
tgccaccaggccac

SEQ ID NO: 3440236 - DNA, 19 bp, Homo sapiens
tgccacccacctccctgcc

SEQ ID NO: 3440237 - DNA, 21 bp, Homo sapiens
tgccacccacctccctgcctc

SEQ ID NO: 3440238 - DNA, 21 bp, Homo sapiens
tgccacccctaaactccaggg

SEQ ID NO: 3440239 - DNA, 20 bp, Homo sapiens
tgccaccctggggagaaagt

SEQ ID NO: 3440240 - DNA, 23 bp, Homo sapiens
tgccacgaatttctgtgccctcc

SEQ ID NO: 3440241 - DNA, 22 bp, Homo sapiens
tgccacgttggagaagcccgtg

SEQ ID NO: 3440242 - DNA, 15 bp, Homo sapiens
tgccactcactaggc

SEQ ID NO: 3440243 - DNA, 17 bp, Homo sapiens
tgccactcactaggccc

SEQ ID NO: 3440244 - DNA, 18 bp, Homo sapiens
tgccactcactaggcccc

SEQ ID NO: 3440245 - DNA, 15 bp, Homo sapiens
tgccactccagtcct

SEQ ID NO: 3440246 - DNA, 22 bp, Homo sapiens
tgccactccagtcctgccacca

SEQ ID NO: 3440247 - DNA, 22 bp, Homo sapiens
tgccactgccttcgcttcttgc

SEQ ID NO: 3440248 - DNA, 20 bp, Homo sapiens
tgccactggcaaatgtaact

SEQ ID NO: 3440249 - DNA, 20 bp, Homo sapiens
tgccagagaagtctggtcag

SEQ ID NO: 3440250 - DNA, 17 bp, Homo sapiens
tgccagagataaactaa

SEQ ID NO: 3440251 - DNA, 13 bp, Homo sapiens
tgccagagcaggg

SEQ ID NO: 3440252 - DNA, 12 bp, Homo sapiens
tgccagccagaa

SEQ ID NO: 3440253 - DNA, 21 bp, Homo sapiens
tgccagcttggacatcagtgt

SEQ ID NO: 3440254 - DNA, 18 bp, Homo sapiens
tgccagggcttcctcttc

SEQ ID NO: 3440255 - DNA, 18 bp, Homo sapiens
tgccaggtttttggtctg

SEQ ID NO: 3440256 - DNA, 24 bp, Homo sapiens
tgccaggtttttggtctgacccac

SEQ ID NO: 3440257 - DNA, 23 bp, Homo sapiens
tgccagtctcactgtgggaaggc

SEQ ID NO: 3440258 - DNA, 13 bp, Homo sapiens
tgccagtgtgctg

SEQ ID NO: 3440259 - DNA, 23 bp, Homo sapiens
tgccataaaacattaagaaaatc

SEQ ID NO: 3440260 - DNA, 23 bp, Homo sapiens
tgccatagccaggagcgcatctc

SEQ ID NO: 3440261 - DNA, 16 bp, Homo sapiens
tgccatattctgttgg

SEQ ID NO: 3440262 - DNA, 15 bp, Homo sapiens
tgccatattgcacat

SEQ ID NO: 3440263 - DNA, 14 bp, Homo sapiens
tgccatattttcac

SEQ ID NO: 3440264 - DNA, 13 bp, Homo sapiens
tgccatcatctcc

SEQ ID NO: 3440265 - DNA, 15 bp, Homo sapiens
tgccatcatctcctg

SEQ ID NO: 3440266 - DNA, 23 bp, Homo sapiens
tgccatcatctcctgccttcctc

SEQ ID NO: 3440267 - DNA, 16 bp, Homo sapiens
tgccatcattgctgtc

SEQ ID NO: 3440268 - DNA, 20 bp, Homo sapiens
tgccatccaggttcagcttg

SEQ ID NO: 3440269 - DNA, 16 bp, Homo sapiens
tgccatccattctgga

SEQ ID NO: 3440270 - DNA, 19 bp, Homo sapiens
tgccatgatgcctctgtct

SEQ ID NO: 3440271 - DNA, 16 bp, Homo sapiens
tgccatggaagaggct

SEQ ID NO: 3440272 - DNA, 18 bp, Homo sapiens
tgccatgtaaatccccac

SEQ ID NO: 3440273 - DNA, 19 bp, Homo sapiens
tgccatgtgactctggctt

SEQ ID NO: 3440274 - DNA, 14 bp, Homo sapiens
tgccatgtgccagg

SEQ ID NO: 3440275 - DNA, 15 bp, Homo sapiens
tgccatgtgccaggt

SEQ ID NO: 3440276 - DNA, 15 bp, Homo sapiens
tgccatgttgcccct

SEQ ID NO: 3440277 - DNA, 21 bp, Homo sapiens
tgccatgttgcccctttctct

SEQ ID NO: 3440278 - DNA, 12 bp, Homo sapiens
tgccatgttggc

SEQ ID NO: 3440279 - DNA, 15 bp, Homo sapiens
tgccatgttggccag

SEQ ID NO: 3440280 - DNA, 16 bp, Homo sapiens
tgccatgttggccagg

SEQ ID NO: 3440281 - DNA, 19 bp, Homo sapiens
tgccatgttggccaggctg

SEQ ID NO: 3440282 - DNA, 16 bp, Homo sapiens
tgccattattctatgt

SEQ ID NO: 3440283 - DNA, 18 bp, Homo sapiens
tgccattattctatgtag

SEQ ID NO: 3440284 - DNA, 21 bp, Homo sapiens
tgccattattctatgtagtgg

SEQ ID NO: 3440285 - DNA, 19 bp, Homo sapiens
tgcccaacccttccctcac

SEQ ID NO: 3440286 - DNA, 22 bp, Homo sapiens
tgcccaacccttccctcacctt

SEQ ID NO: 3440287 - DNA, 14 bp, Homo sapiens
tgcccaactgttat

SEQ ID NO: 3440288 - DNA, 16 bp, Homo sapiens
tgcccaagccagaggc

SEQ ID NO: 3440289 - DNA, 13 bp, Homo sapiens
tgcccaaggccac

SEQ ID NO: 3440290 - DNA, 14 bp, Homo sapiens
tgcccaagggaaag

SEQ ID NO: 3440291 - DNA, 14 bp, Homo sapiens
tgcccacaggccgc

SEQ ID NO: 3440292 - DNA, 21 bp, Homo sapiens
tgcccacaggccgccctgcgg

SEQ ID NO: 3440293 - DNA, 20 bp, Homo sapiens
tgcccagctatacctgtgcc

SEQ ID NO: 3440294 - DNA, 21 bp, Homo sapiens
tgcccagctatacctgtgcct

SEQ ID NO: 3440295 - DNA, 15 bp, Homo sapiens
tgcccaggcaggtct

SEQ ID NO: 3440296 - DNA, 16 bp, Homo sapiens
tgcccaggcaggtctt

SEQ ID NO: 3440297 - DNA, 14 bp, Homo sapiens
tgcccaggcccaga

SEQ ID NO: 3440298 - DNA, 15 bp, Homo sapiens
tgcccaggcccctgc

SEQ ID NO: 3440299 - DNA, 18 bp, Homo sapiens
tgcccaggcccctgccac

SEQ ID NO: 3440300 - DNA, 18 bp, Homo sapiens
tgcccaggctggcgtgca

SEQ ID NO: 3440301 - DNA, 20 bp, Homo sapiens
tgcccaggctggcgtgcagt

SEQ ID NO: 3440302 - DNA, 15 bp, Homo sapiens
tgcccaggctggtct

SEQ ID NO: 3440303 - DNA, 22 bp, Homo sapiens
tgcccatttcatattctttcaa

SEQ ID NO: 3440304 - DNA, 20 bp, Homo sapiens
tgccccaaacaaatatgcaa

SEQ ID NO: 3440305 - DNA, 15 bp, Homo sapiens
tgccccactctgcct

SEQ ID NO: 3440306 - DNA, 12 bp, Homo sapiens
tgccccagccag

SEQ ID NO: 3440307 - DNA, 18 bp, Homo sapiens
tgccccaggaccagctca

SEQ ID NO: 3440308 - DNA, 20 bp, Homo sapiens
tgccccatcagtgctccctc

SEQ ID NO: 3440309 - DNA, 20 bp, Homo sapiens
tgccccatcctccagcaggg

SEQ ID NO: 3440310 - DNA, 16 bp, Homo sapiens
tgccccatctcccctc

SEQ ID NO: 3440311 - DNA, 19 bp, Homo sapiens
tgccccatctcccctcagc

SEQ ID NO: 3440312 - DNA, 12 bp, Homo sapiens
tgccccattctt

SEQ ID NO: 3440313 - DNA, 12 bp, Homo sapiens
tgcccccaggac

SEQ ID NO: 3440314 - DNA, 17 bp, Homo sapiens
tgcccccatttcaccca

SEQ ID NO: 3440315 - DNA, 17 bp, Homo sapiens
tgccccggcccctcccc

SEQ ID NO: 3440316 - DNA, 19 bp, Homo sapiens
tgccccgggtccccagctc

SEQ ID NO: 3440317 - DNA, 21 bp, Homo sapiens
tgcccctcccagaacacactc

SEQ ID NO: 3440318 - DNA, 14 bp, Homo sapiens
tgcccctctctggg

SEQ ID NO: 3440319 - DNA, 16 bp, Homo sapiens
tgcccctctctgggcc

SEQ ID NO: 3440320 - DNA, 11 bp, Homo sapiens
tgcccctgctg

SEQ ID NO: 3440321 - DNA, 19 bp, Homo sapiens
tgcccctgctgctgtcacc

SEQ ID NO: 3440322 - DNA, 14 bp, Homo sapiens
tgcccctggctctg

SEQ ID NO: 3440323 - DNA, 21 bp, Homo sapiens
tgccccttgacaactggcagg

SEQ ID NO: 3440324 - DNA, 20 bp, Homo sapiens
tgcccggctaatttttgtaa

SEQ ID NO: 3440325 - DNA, 21 bp, Homo sapiens
tgcccggggaaaggcaaggtc

SEQ ID NO: 3440326 - DNA, 20 bp, Homo sapiens
tgcccgtaaacacgcctgca

SEQ ID NO: 3440327 - DNA, 23 bp, Homo sapiens
tgcccgtaaacacgcctgcaaac

SEQ ID NO: 3440328 - DNA, 14 bp, Homo sapiens
tgcccgtgtacata

SEQ ID NO: 3440329 - DNA, 13 bp, Homo sapiens
tgccctaaaccct

SEQ ID NO: 3440330 - DNA, 23 bp, Homo sapiens
tgccctagttttctttcctcctt

SEQ ID NO: 3440331 - DNA, 18 bp, Homo sapiens
tgccctccagctctttcc

SEQ ID NO: 3440332 - DNA, 17 bp, Homo sapiens
tgccctcccctctctgc

SEQ ID NO: 3440333 - DNA, 21 bp, Homo sapiens
tgccctcccctctctgcaccg

SEQ ID NO: 3440334 - DNA, 14 bp, Homo sapiens
tgccctcctctccc

SEQ ID NO: 3440335 - DNA, 15 bp, Homo sapiens
tgccctcctctccca

SEQ ID NO: 3440336 - DNA, 16 bp, Homo sapiens
tgccctcctctcccat

SEQ ID NO: 3440337 - DNA, 14 bp, Homo sapiens
tgccctccttccca

SEQ ID NO: 3440338 - DNA, 15 bp, Homo sapiens
tgccctccttcccaa

SEQ ID NO: 3440339 - DNA, 14 bp, Homo sapiens
tgccctctcaggcc

SEQ ID NO: 3440340 - DNA, 15 bp, Homo sapiens
tgccctctttagcca

SEQ ID NO: 3440341 - DNA, 15 bp, Homo sapiens
tgcccttaaatcata

SEQ ID NO: 3440342 - DNA, 15 bp, Homo sapiens
tgccgacagaaggaa

SEQ ID NO: 3440343 - DNA, 13 bp, Homo sapiens
tgccgatttctgt

SEQ ID NO: 3440344 - DNA, 17 bp, Homo sapiens
tgccgctacctccctcc

SEQ ID NO: 3440345 - DNA, 14 bp, Homo sapiens
tgccggagaggaag

SEQ ID NO: 3440346 - DNA, 12 bp, Homo sapiens
tgccggcacagc

SEQ ID NO: 3440347 - DNA, 18 bp, Homo sapiens
tgccggcacagctgggat

SEQ ID NO: 3440348 - DNA, 16 bp, Homo sapiens
tgccggcaggatgcag

SEQ ID NO: 3440349 - DNA, 18 bp, Homo sapiens
tgccgggttttatatttt

SEQ ID NO: 3440350 - DNA, 19 bp, Homo sapiens
tgccgtcagtgctgtgctg

SEQ ID NO: 3440351 - DNA, 16 bp, Homo sapiens
tgcctaaatccaaaga

SEQ ID NO: 3440352 - DNA, 18 bp, Homo sapiens
tgcctcaccttggggcct

SEQ ID NO: 3440353 - DNA, 15 bp, Homo sapiens
tgcctcagccctgac

SEQ ID NO: 3440354 - DNA, 13 bp, Homo sapiens
tgcctcagcctcc

SEQ ID NO: 3440355 - DNA, 14 bp, Homo sapiens
tgcctcagcctccg

SEQ ID NO: 3440356 - DNA, 15 bp, Homo sapiens
tgcctcagtgtattt

SEQ ID NO: 3440357 - DNA, 21 bp, Homo sapiens
tgcctcattttagaaccacca

SEQ ID NO: 3440358 - DNA, 17 bp, Homo sapiens
tgcctccaggaaccaca

SEQ ID NO: 3440359 - DNA, 15 bp, Homo sapiens
tgcctccagggctgg

SEQ ID NO: 3440360 - DNA, 16 bp, Homo sapiens
tgcctccagggctgga

SEQ ID NO: 3440361 - DNA, 19 bp, Homo sapiens
tgcctccagggctggactg

SEQ ID NO: 3440362 - DNA, 20 bp, Homo sapiens
tgcctccagggctggactga

SEQ ID NO: 3440363 - DNA, 23 bp, Homo sapiens
tgcctccagggctggactgaggc

SEQ ID NO: 3440364 - DNA, 20 bp, Homo sapiens
tgcctccattatccattccc

SEQ ID NO: 3440365 - DNA, 12 bp, Homo sapiens
tgcctcccttga

SEQ ID NO: 3440366 - DNA, 19 bp, Homo sapiens
tgcctccgcctcagtaaga

SEQ ID NO: 3440367 - DNA, 16 bp, Homo sapiens
tgcctcctactccagt

SEQ ID NO: 3440368 - DNA, 18 bp, Homo sapiens
tgcctcctactccagtat

SEQ ID NO: 3440369 - DNA, 12 bp, Homo sapiens
tgcctccttgaa

SEQ ID NO: 3440370 - DNA, 18 bp, Homo sapiens
tgcctccttgaaagaaag

SEQ ID NO: 3440371 - DNA, 21 bp, Homo sapiens
tgcctcgaaacacagaaacct

SEQ ID NO: 3440372 - DNA, 18 bp, Homo sapiens
tgcctcgaactggctgca

SEQ ID NO: 3440373 - DNA, 20 bp, Homo sapiens
tgcctcgaactggctgcaaa

SEQ ID NO: 3440374 - DNA, 20 bp, Homo sapiens
tgcctcggcctcccaaagtg

SEQ ID NO: 3440375 - DNA, 21 bp, Homo sapiens
tgcctcggcttttctcagctg

SEQ ID NO: 3440376 - DNA, 14 bp, Homo sapiens
tgcctctccaggca

SEQ ID NO: 3440377 - DNA, 20 bp, Homo sapiens
tgcctctgacacacagctct

SEQ ID NO: 3440378 - DNA, 21 bp, Homo sapiens
tgcctctgacacacagctctg

SEQ ID NO: 3440379 - DNA, 14 bp, Homo sapiens
tgcctctgtcccct

SEQ ID NO: 3440380 - DNA, 13 bp, Homo sapiens
tgcctctgtcctt

SEQ ID NO: 3440381 - DNA, 11 bp, Homo sapiens
tgcctctgtgc

SEQ ID NO: 3440382 - DNA, 12 bp, Homo sapiens
tgcctctgtgct

SEQ ID NO: 3440383 - DNA, 14 bp, Homo sapiens
tgcctctgtgctgt

SEQ ID NO: 3440384 - DNA, 16 bp, Homo sapiens
tgcctctgtgctgtgt

SEQ ID NO: 3440385 - DNA, 17 bp, Homo sapiens
tgcctctgtgctgtgtg

SEQ ID NO: 3440386 - DNA, 17 bp, Homo sapiens
tgcctcttccttgaaga

SEQ ID NO: 3440387 - DNA, 21 bp, Homo sapiens
tgcctcttctctactctaggg

SEQ ID NO: 3440388 - DNA, 20 bp, Homo sapiens
tgcctcttctgggagggcag

SEQ ID NO: 3440389 - DNA, 21 bp, Homo sapiens
tgcctcttctgggagggcagc

SEQ ID NO: 3440390 - DNA, 15 bp, Homo sapiens
tgcctctttcatcca

SEQ ID NO: 3440391 - DNA, 20 bp, Homo sapiens
tgcctcttttacctgctgct

SEQ ID NO: 3440392 - DNA, 17 bp, Homo sapiens
tgcctgaagtcacacag

SEQ ID NO: 3440393 - DNA, 15 bp, Homo sapiens
tgcctgacaaggcca

SEQ ID NO: 3440394 - DNA, 17 bp, Homo sapiens
tgcctgatcagaaacca

SEQ ID NO: 3440395 - DNA, 15 bp, Homo sapiens
tgcctgatggacctg

SEQ ID NO: 3440396 - DNA, 16 bp, Homo sapiens
tgaagggccagagcca

SEQ ID NO: 3440397 - DNA, 18 bp, Homo sapiens
tgaagggccagagccagg

SEQ ID NO: 3440398 - DNA, 19 bp, Homo sapiens
tgaaggtgctgacggccag

SEQ ID NO: 3440399 - DNA, 14 bp, Homo sapiens
tgaaggtttacaat

SEQ ID NO: 3440400 - DNA, 14 bp, Homo sapiens
tgaagtaaaactta

SEQ ID NO: 3440401 - DNA, 15 bp, Homo sapiens
tgaagtatactgtat

SEQ ID NO: 3440402 - DNA, 14 bp, Homo sapiens
tgaagtcacacagt

SEQ ID NO: 3440403 - DNA, 16 bp, Homo sapiens
tgaagtctcttccctt

SEQ ID NO: 3440404 - DNA, 19 bp, Homo sapiens
tgaagttgcttttttgact

SEQ ID NO: 3440405 - DNA, 22 bp, Homo sapiens
tgaagttgttactaactaaact

SEQ ID NO: 3440406 - DNA, 21 bp, Homo sapiens
tgaagtttccttggctggtgc

SEQ ID NO: 3440407 - DNA, 12 bp, Homo sapiens
tgaagtttgaat

SEQ ID NO: 3440408 - DNA, 13 bp, Homo sapiens
tgaagtttgaatg

SEQ ID NO: 3440409 - DNA, 14 bp, Homo sapiens
tgaagtttgaatgt

SEQ ID NO: 3440410 - DNA, 16 bp, Homo sapiens
tgaagtttgaatgtta

SEQ ID NO: 3440411 - DNA, 21 bp, Homo sapiens
tgaataaaaactttgctaaat

SEQ ID NO: 3440412 - DNA, 15 bp, Homo sapiens
tgaataaagaatact

SEQ ID NO: 3440413 - DNA, 16 bp, Homo sapiens
tgaataaagaatactt

SEQ ID NO: 3440414 - DNA, 17 bp, Homo sapiens
tgaataaagaatacttg

SEQ ID NO: 3440415 - DNA, 20 bp, Homo sapiens
tgaataaagaatacttgaac

SEQ ID NO: 3440416 - DNA, 15 bp, Homo sapiens
tgaatactttataaa

SEQ ID NO: 3440417 - DNA, 16 bp, Homo sapiens
tgaatactttttacaa

SEQ ID NO: 3440418 - DNA, 19 bp, Homo sapiens
tgaatagcttatgtacaaa

SEQ ID NO: 3440419 - DNA, 19 bp, Homo sapiens
tgaataggcgatcacaacg

SEQ ID NO: 3440420 - DNA, 12 bp, Homo sapiens
tgaatataatga

SEQ ID NO: 3440421 - DNA, 21 bp, Homo sapiens
tgaatattttcaactatgtag

SEQ ID NO: 3440422 - DNA, 19 bp, Homo sapiens
tgaatcagtataaacaaag

SEQ ID NO: 3440423 - DNA, 20 bp, Homo sapiens
tgaatcagtttccaattatt

SEQ ID NO: 3440424 - DNA, 23 bp, Homo sapiens
tgaatcagtttccaattatttga

SEQ ID NO: 3440425 - DNA, 13 bp, Homo sapiens
tgaatcatgagcc

SEQ ID NO: 3440426 - DNA, 14 bp, Homo sapiens
tgaatcatgagcct

SEQ ID NO: 3440427 - DNA, 15 bp, Homo sapiens
tgaatcatgagcctg

SEQ ID NO: 3440428 - DNA, 18 bp, Homo sapiens
tgaatcatgagcctgctg

SEQ ID NO: 3440429 - DNA, 16 bp, Homo sapiens
tgaatcttgtctcaat

SEQ ID NO: 3440430 - DNA, 20 bp, Homo sapiens
tgaatgagaatgtgccatgt

SEQ ID NO: 3440431 - DNA, 23 bp, Homo sapiens
tgaatgatgatcctaggcatttg

SEQ ID NO: 3440432 - DNA, 14 bp, Homo sapiens
tgaatgatttgcat

SEQ ID NO: 3440433 - DNA, 23 bp, Homo sapiens
tgaatgcagtctgtccaggctcg

SEQ ID NO: 3440434 - DNA, 12 bp, Homo sapiens
tgaatgcatttt

SEQ ID NO: 3440435 - DNA, 14 bp, Homo sapiens
tgaatgcattttgt

SEQ ID NO: 3440436 - DNA, 15 bp, Homo sapiens
tgaatgccactgcct

SEQ ID NO: 3440437 - DNA, 22 bp, Homo sapiens
tgaatgccactgccttcgcttc

SEQ ID NO: 3440438 - DNA, 18 bp, Homo sapiens
tgaatgccagtgtgctga

SEQ ID NO: 3440439 - DNA, 23 bp, Homo sapiens
tgaatgtatttatttgggagacc

SEQ ID NO: 3440440 - DNA, 11 bp, Homo sapiens
tgaatgttaaa

SEQ ID NO: 3440441 - DNA, 13 bp, Homo sapiens
tgaatgttaaata

SEQ ID NO: 3440442 - DNA, 15 bp, Homo sapiens
tgaatgttaaataaa

SEQ ID NO: 3440443 - DNA, 16 bp, Homo sapiens
tgaatgttaaataaat

SEQ ID NO: 3440444 - DNA, 18 bp, Homo sapiens
tgaatgttaaataaattg

SEQ ID NO: 3440445 - DNA, 16 bp, Homo sapiens
tgaattgcgttggtct

SEQ ID NO: 3440446 - DNA, 18 bp, Homo sapiens
tgaattgtaactgttctt

SEQ ID NO: 3440447 - DNA, 22 bp, Homo sapiens
tgaattgtctagggtgttctgt

SEQ ID NO: 3440448 - DNA, 19 bp, Homo sapiens
tgaatttaataatctgtag

SEQ ID NO: 3440449 - DNA, 11 bp, Homo sapiens
tgaatttgcaa

SEQ ID NO: 3440450 - DNA, 17 bp, Homo sapiens
tgaatttgcaaagtact

SEQ ID NO: 3440451 - DNA, 14 bp, Homo sapiens
tgaattttaagggt

SEQ ID NO: 3440452 - DNA, 19 bp, Homo sapiens
tgaattttataaataaaat

SEQ ID NO: 3440453 - DNA, 18 bp, Homo sapiens
tgaattttcaaggccttc

SEQ ID NO: 3440454 - DNA, 20 bp, Homo sapiens
tgaattttcaaggccttcag

SEQ ID NO: 3440455 - DNA, 23 bp, Homo sapiens
tgaattttctttttaataaaaag

SEQ ID NO: 3440456 - DNA, 19 bp, Homo sapiens
tgaattttgttctctggga

SEQ ID NO: 3440457 - DNA, 22 bp, Homo sapiens
tgaatttttctctaactcagaa

SEQ ID NO: 3440458 - DNA, 13 bp, Homo sapiens
tgaatttttgcaa

SEQ ID NO: 3440459 - DNA, 14 bp, Homo sapiens
tgaatttttgcaat

SEQ ID NO: 3440460 - DNA, 16 bp, Homo sapiens
tgaatttttgcaataa

SEQ ID NO: 3440461 - DNA, 17 bp, Homo sapiens
tgaatttttgcaataat

SEQ ID NO: 3440462 - DNA, 21 bp, Homo sapiens
tgaatttttttcatcttctct

SEQ ID NO: 3440463 - DNA, 18 bp, Homo sapiens
tgaatttttttctgcaca

SEQ ID NO: 3440464 - DNA, 16 bp, Homo sapiens
tgaattttttttaatg

SEQ ID NO: 3440465 - DNA, 15 bp, Homo sapiens
tgacaaaaattattt

SEQ ID NO: 3440466 - DNA, 17 bp, Homo sapiens
tgacaaaaattattttt

SEQ ID NO: 3440467 - DNA, 17 bp, Homo sapiens
tgacaaaggcaagcact

SEQ ID NO: 3440468 - DNA, 17 bp, Homo sapiens
tgacaaatgtaaacatt

SEQ ID NO: 3440469 - DNA, 14 bp, Homo sapiens
tgacaactggcagg

SEQ ID NO: 3440470 - DNA, 12 bp, Homo sapiens
tgacaaggccag

SEQ ID NO: 3440471 - DNA, 15 bp, Homo sapiens
tgacaattctgcatg

SEQ ID NO: 3440472 - DNA, 20 bp, Homo sapiens
tgacacacagctctgtcctg

SEQ ID NO: 3440473 - DNA, 21 bp, Homo sapiens
tgacacacagctctgtcctgg

SEQ ID NO: 3440474 - DNA, 18 bp, Homo sapiens
tgacacagaaaatgttga

SEQ ID NO: 3440475 - DNA, 16 bp, Homo sapiens
tgacacaggtctttcc

SEQ ID NO: 3440476 - DNA, 17 bp, Homo sapiens
tgacacaggtctttcct

SEQ ID NO: 3440477 - DNA, 17 bp, Homo sapiens
tgacacatcgttttggg

SEQ ID NO: 3440478 - DNA, 20 bp, Homo sapiens
tgacacctttcataatcttt

SEQ ID NO: 3440479 - DNA, 20 bp, Homo sapiens
tgacactaccttatcaggca

SEQ ID NO: 3440480 - DNA, 22 bp, Homo sapiens
tgacactcccttgggctccctg

SEQ ID NO: 3440481 - DNA, 17 bp, Homo sapiens
tgacactgtttcctgat

SEQ ID NO: 3440482 - DNA, 18 bp, Homo sapiens
tgacacttccattgttta

SEQ ID NO: 3440483 - DNA, 15 bp, Homo sapiens
tgacacttgtcccca

SEQ ID NO: 3440484 - DNA, 14 bp, Homo sapiens
tgacagaaagcagt

SEQ ID NO: 3440485 - DNA, 22 bp, Homo sapiens
tgacagaaagcagttctgatgc

SEQ ID NO: 3440486 - DNA, 20 bp, Homo sapiens
tgacagacacaggcccggct

SEQ ID NO: 3440487 - DNA, 14 bp, Homo sapiens
tgacagagacccag

SEQ ID NO: 3440488 - DNA, 15 bp, Homo sapiens
tgacagagacccaga

SEQ ID NO: 3440489 - DNA, 14 bp, Homo sapiens
tgacagaggcagcc

SEQ ID NO: 3440490 - DNA, 17 bp, Homo sapiens
tgacagaggcagcccca

SEQ ID NO: 3440491 - DNA, 19 bp, Homo sapiens
tgacagagtgagactctgt

SEQ ID NO: 3440492 - DNA, 15 bp, Homo sapiens
tgacagccagagcct

SEQ ID NO: 3440493 - DNA, 15 bp, Homo sapiens
tgacagcctgcagca

SEQ ID NO: 3440494 - DNA, 13 bp, Homo sapiens
tgacagctgctcc

SEQ ID NO: 3440495 - DNA, 18 bp, Homo sapiens
tgacagctgctcctagag

SEQ ID NO: 3440496 - DNA, 15 bp, Homo sapiens
tgacagctttgctgc

SEQ ID NO: 3440497 - DNA, 19 bp, Homo sapiens
tgacaggctgtgactcttc

SEQ ID NO: 3440498 - DNA, 16 bp, Homo sapiens
tgacagggcacaccgg

SEQ ID NO: 3440499 - DNA, 20 bp, Homo sapiens
tgacagtgtgggacaggctc

SEQ ID NO: 3440500 - DNA, 16 bp, Homo sapiens
tgacagtttttctgtt

SEQ ID NO: 3440501 - DNA, 16 bp, Homo sapiens
tgacataatatattct

SEQ ID NO: 3440502 - DNA, 11 bp, Homo sapiens
tgacatattta

SEQ ID NO: 3440503 - DNA, 12 bp, Homo sapiens
tgacatatttaa

SEQ ID NO: 3440504 - DNA, 14 bp, Homo sapiens
tgacatatttaatg

SEQ ID NO: 3440505 - DNA, 18 bp, Homo sapiens
tgacatatttaatgtttt

SEQ ID NO: 3440506 - DNA, 19 bp, Homo sapiens
tgacatatttaatgtttta

SEQ ID NO: 3440507 - DNA, 20 bp, Homo sapiens
tgacatatttaatgttttaa

SEQ ID NO: 3440508 - DNA, 21 bp, Homo sapiens
tgacatatttaatgttttaaa

SEQ ID NO: 3440509 - DNA, 16 bp, Homo sapiens
tgacatgattccttcc

SEQ ID NO: 3440510 - DNA, 18 bp, Homo sapiens
tgacatgattccttcctg

SEQ ID NO: 3440511 - DNA, 22 bp, Homo sapiens
tgacatgattccttcctgttct

SEQ ID NO: 3440512 - DNA, 23 bp, Homo sapiens
tgacatggaggcactgaagcccg

SEQ ID NO: 3440513 - DNA, 12 bp, Homo sapiens
tgacattcacct

SEQ ID NO: 3440514 - DNA, 17 bp, Homo sapiens
tgacattcatgcctggc

SEQ ID NO: 3440515 - DNA, 14 bp, Homo sapiens
tgacattgccaaaa

SEQ ID NO: 3440516 - DNA, 18 bp, Homo sapiens
tgacattgccaaaaagga

SEQ ID NO: 3440517 - DNA, 15 bp, Homo sapiens
tgacattgcgtttga

SEQ ID NO: 3440518 - DNA, 12 bp, Homo sapiens
tgacattgtctc

SEQ ID NO: 3440519 - DNA, 18 bp, Homo sapiens
tgacatttatttttcatt

SEQ ID NO: 3440520 - DNA, 14 bp, Homo sapiens
tgacatttctttgt

SEQ ID NO: 3440521 - DNA, 16 bp, Homo sapiens
tgacattttatttttt

SEQ ID NO: 3440522 - DNA, 12 bp, Homo sapiens
tgaccaaaaaaa

SEQ ID NO: 3440523 - DNA, 16 bp, Homo sapiens
tgaccaaagtcctttt

SEQ ID NO: 3440524 - DNA, 20 bp, Homo sapiens
tgaccaacctgtttctacct

SEQ ID NO: 3440525 - DNA, 14 bp, Homo sapiens
tgaccaagcaggaa

SEQ ID NO: 3440526 - DNA, 17 bp, Homo sapiens
tgaccaagcaggaagct

SEQ ID NO: 3440527 - DNA, 21 bp, Homo sapiens
tgaccaagcaggaagctcaga

SEQ ID NO: 3440528 - DNA, 14 bp, Homo sapiens
tgaccaatgtcttg

SEQ ID NO: 3440529 - DNA, 13 bp, Homo sapiens
tgaccaatttgca

SEQ ID NO: 3440530 - DNA, 14 bp, Homo sapiens
tgaccacagcacag

SEQ ID NO: 3440531 - DNA, 15 bp, Homo sapiens
tgaccacagcacagc

SEQ ID NO: 3440532 - DNA, 12 bp, Homo sapiens
tgaccaccagtt

SEQ ID NO: 3440533 - DNA, 18 bp, Homo sapiens
tgaccactttggagcact

SEQ ID NO: 3440534 - DNA, 14 bp, Homo sapiens
tgaccagcagcgcc

SEQ ID NO: 3440535 - DNA, 17 bp, Homo sapiens
tgaccagccgtgagcat

SEQ ID NO: 3440536 - DNA, 13 bp, Homo sapiens
tgaccaggcctgg

SEQ ID NO: 3440537 - DNA, 12 bp, Homo sapiens
tgacccactgct

SEQ ID NO: 3440538 - DNA, 13 bp, Homo sapiens
tgacccactgctt

SEQ ID NO: 3440539 - DNA, 16 bp, Homo sapiens
tgacccagtgccccca

SEQ ID NO: 3440540 - DNA, 17 bp, Homo sapiens
tgacccagtgcccccac

SEQ ID NO: 3440541 - DNA, 13 bp, Homo sapiens
tgacccattgctg

SEQ ID NO: 3440542 - DNA, 14 bp, Homo sapiens
tgacccattgctgt

SEQ ID NO: 3440543 - DNA, 13 bp, Homo sapiens
tgaccccagagga

SEQ ID NO: 3440544 - DNA, 17 bp, Homo sapiens
tgaccctgagctgacca

SEQ ID NO: 3440545 - DNA, 17 bp, Homo sapiens
tgaccctggggctggct

SEQ ID NO: 3440546 - DNA, 18 bp, Homo sapiens
tgaccctgtatatagccc

SEQ ID NO: 3440547 - DNA, 19 bp, Homo sapiens
tgaccctgtatatagccca

SEQ ID NO: 3440548 - DNA, 19 bp, Homo sapiens
tgaccggacttttctgcaa

SEQ ID NO: 3440549 - DNA, 20 bp, Homo sapiens
tgacctcaggtgatccaccc

SEQ ID NO: 3440550 - DNA, 13 bp, Homo sapiens
tgacctctgcctg

SEQ ID NO: 3440551 - DNA, 14 bp, Homo sapiens
tgacctctgcctga

SEQ ID NO: 3440552 - DNA, 16 bp, Homo sapiens
tgacctgtttctctgc

SEQ ID NO: 3440553 - DNA, 19 bp, Homo sapiens
tgaccttatccttcctctc

SEQ ID NO: 3440554 - DNA, 20 bp, Homo sapiens
tgaccttcatttcatgtata

SEQ ID NO: 3440555 - DNA, 18 bp, Homo sapiens
tgacctttaactgagggc

SEQ ID NO: 3440556 - DNA, 21 bp, Homo sapiens
tgacctttaactgagggctga

SEQ ID NO: 3440557 - DNA, 18 bp, Homo sapiens
tgacctttaattcaggta

SEQ ID NO: 3440558 - DNA, 15 bp, Homo sapiens
tgacctttgtacagc

SEQ ID NO: 3440559 - DNA, 20 bp, Homo sapiens
tgacctttgtacagcccaga

SEQ ID NO: 3440560 - DNA, 17 bp, Homo sapiens
tgaccttttatgtagta

SEQ ID NO: 3440561 - DNA, 19 bp, Homo sapiens
tgacgaacttccatggccc

SEQ ID NO: 3440562 - DNA, 19 bp, Homo sapiens
tgacggccagggagaagct

SEQ ID NO: 3440563 - DNA, 15 bp, Homo sapiens
tgactaattttacat

SEQ ID NO: 3440564 - DNA, 21 bp, Homo sapiens
tgactaattttacatgtttat

SEQ ID NO: 3440565 - DNA, 22 bp, Homo sapiens
tgactaattttacatgtttata

SEQ ID NO: 3440566 - DNA, 18 bp, Homo sapiens
tgactagggagccatgtt

SEQ ID NO: 3440567 - DNA, 20 bp, Homo sapiens
tgactagggagccatgtttc

SEQ ID NO: 3440568 - DNA, 21 bp, Homo sapiens
tgactagggagccatgtttca

SEQ ID NO: 3440569 - DNA, 13 bp, Homo sapiens
tgactcagggctc

SEQ ID NO: 3440570 - DNA, 20 bp, Homo sapiens
tgactcattctgaaggagcc

SEQ ID NO: 3440571 - DNA, 14 bp, Homo sapiens
tgactcggtttctc

SEQ ID NO: 3440572 - DNA, 15 bp, Homo sapiens
tgactcggtttctcc

SEQ ID NO: 3440573 - DNA, 19 bp, Homo sapiens
tgactctcacctgtactat

SEQ ID NO: 3440574 - DNA, 13 bp, Homo sapiens
tgactctccaggg

SEQ ID NO: 3440575 - DNA, 21 bp, Homo sapiens
tgactctcgtgcatttcaact

SEQ ID NO: 3440576 - DNA, 16 bp, Homo sapiens
tgactctggcttggcc

SEQ ID NO: 3440577 - DNA, 22 bp, Homo sapiens
tgactgaacattagttgcacta

SEQ ID NO: 3440578 - DNA, 14 bp, Homo sapiens
tgactgcccagcat

SEQ ID NO: 3440579 - DNA, 21 bp, Homo sapiens
tgactgcccagcatttgggta

SEQ ID NO: 3440580 - DNA, 22 bp, Homo sapiens
tgactgcccggcacagatgctc

SEQ ID NO: 3440581 - DNA, 14 bp, Homo sapiens
tgactgccttgcct

SEQ ID NO: 3440582 - DNA, 22 bp, Homo sapiens
tgactgccttgcctcctcagta

SEQ ID NO: 3440583 - DNA, 23 bp, Homo sapiens
tgactgggtttctctgtatagta

SEQ ID NO: 3440584 - DNA, 18 bp, Homo sapiens
tgactgttcaagagcaca

SEQ ID NO: 3440585 - DNA, 24 bp, Homo sapiens
tgactgttcaagagcacacttggc

SEQ ID NO: 3440586 - DNA, 16 bp, Homo sapiens
tgacttctgcctggag

SEQ ID NO: 3440587 - DNA, 22 bp, Homo sapiens
tgactttacgcccatctcagga

SEQ ID NO: 3440588 - DNA, 12 bp, Homo sapiens
tgactttcaggt

SEQ ID NO: 3440589 - DNA, 13 bp, Homo sapiens
tgactttttataa

SEQ ID NO: 3440590 - DNA, 15 bp, Homo sapiens
tgagaaacccaccag

SEQ ID NO: 3440591 - DNA, 18 bp, Homo sapiens
tgagaaacccaccagcct

SEQ ID NO: 3440592 - DNA, 12 bp, Homo sapiens
tgagaaactcta

SEQ ID NO: 3440593 - DNA, 21 bp, Homo sapiens
tgagaaatatggacacttaat

SEQ ID NO: 3440594 - DNA, 19 bp, Homo sapiens
tgagaacaaccaaaatctt

SEQ ID NO: 3440595 - DNA, 12 bp, Homo sapiens
tgagaacactgt

SEQ ID NO: 3440596 - DNA, 16 bp, Homo sapiens
tgagaacactgtgaaa

SEQ ID NO: 3440597 - DNA, 21 bp, Homo sapiens
tgagaacctgggttgcagaca

SEQ ID NO: 3440598 - DNA, 17 bp, Homo sapiens
tgagaactgcatatgtt

SEQ ID NO: 3440599 - DNA, 14 bp, Homo sapiens
tgagaagaaaacat

SEQ ID NO: 3440600 - DNA, 19 bp, Homo sapiens
tgagaagtgaatgctggga

SEQ ID NO: 3440601 - DNA, 16 bp, Homo sapiens
tgagaatacaagatat

SEQ ID NO: 3440602 - DNA, 21 bp, Homo sapiens
tgagaatcccaaatttgattg

SEQ ID NO: 3440603 - DNA, 14 bp, Homo sapiens
tgagaatgtgccat

SEQ ID NO: 3440604 - DNA, 16 bp, Homo sapiens
tgagacagtccagcct

SEQ ID NO: 3440605 - DNA, 19 bp, Homo sapiens
tgagacagtccagcctgga

SEQ ID NO: 3440606 - DNA, 15 bp, Homo sapiens
tgagaccagcctggc

SEQ ID NO: 3440607 - DNA, 17 bp, Homo sapiens
tgagaccagcctggcca

SEQ ID NO: 3440608 - DNA, 15 bp, Homo sapiens
tgagactcgagaact

SEQ ID NO: 3440609 - DNA, 17 bp, Homo sapiens
tgagactcgagaacttt

SEQ ID NO: 3440610 - DNA, 13 bp, Homo sapiens
tgagactctgtct

SEQ ID NO: 3440611 - DNA, 20 bp, Homo sapiens
tgagactctgtctcaaaaaa

SEQ ID NO: 3440612 - DNA, 15 bp, Homo sapiens
tgagactgagagggc

SEQ ID NO: 3440613 - DNA, 17 bp, Homo sapiens
tgagacttgccttccta

SEQ ID NO: 3440614 - DNA, 22 bp, Homo sapiens
tgagagaaaatactatttcaag

SEQ ID NO: 3440615 - DNA, 14 bp, Homo sapiens
tgagagaccaggca

SEQ ID NO: 3440616 - DNA, 14 bp, Homo sapiens
tgagaggggaacag

SEQ ID NO: 3440617 - DNA, 19 bp, Homo sapiens
tgagaggggaacagactgg

SEQ ID NO: 3440618 - DNA, 14 bp, Homo sapiens
tgagaggtttgact

SEQ ID NO: 3440619 - DNA, 16 bp, Homo sapiens
tgagagtcagctctct

SEQ ID NO: 3440620 - DNA, 17 bp, Homo sapiens
tgagagtcagctctctg

SEQ ID NO: 3440621 - DNA, 19 bp, Homo sapiens
tgagagtcagctctctgcc

SEQ ID NO: 3440622 - DNA, 17 bp, Homo sapiens
tgagagttttggatgca

SEQ ID NO: 3440623 - DNA, 15 bp, Homo sapiens
tgagatacatacaga

SEQ ID NO: 3440624 - DNA, 13 bp, Homo sapiens
tgagatgctggtt

SEQ ID NO: 3440625 - DNA, 17 bp, Homo sapiens
tgagattcaatattgaa

SEQ ID NO: 3440626 - DNA, 22 bp, Homo sapiens
tgagattgtcctcatttctcca

SEQ ID NO: 3440627 - DNA, 19 bp, Homo sapiens
tgagatttcatctgctctc

SEQ ID NO: 3440628 - DNA, 17 bp, Homo sapiens
tgagcaagtatgctgtg

SEQ ID NO: 3440629 - DNA, 17 bp, Homo sapiens
tgagcaatgtataaccc

SEQ ID NO: 3440630 - DNA, 18 bp, Homo sapiens
tgagcaatgtataacccc

SEQ ID NO: 3440631 - DNA, 21 bp, Homo sapiens
tgagcacaactttaagaggac

SEQ ID NO: 3440632 - DNA, 14 bp, Homo sapiens
tgagcaccagggga

SEQ ID NO: 3440633 - DNA, 21 bp, Homo sapiens
tgagcacctttggaaacaaca

SEQ ID NO: 3440634 - DNA, 14 bp, Homo sapiens
tgagcagagcccgg

SEQ ID NO: 3440635 - DNA, 19 bp, Homo sapiens
tgagcagagcccggagctc

SEQ ID NO: 3440636 - DNA, 12 bp, Homo sapiens
tgagcagggctc

SEQ ID NO: 3440637 - DNA, 13 bp, Homo sapiens
tgagcagggctca

SEQ ID NO: 3440638 - DNA, 14 bp, Homo sapiens
tgagcagggctcag

SEQ ID NO: 3440639 - DNA, 19 bp, Homo sapiens
tgagcagggctcagcgggg

SEQ ID NO: 3440640 - DNA, 23 bp, Homo sapiens
tgagcagggctcagcggggacag

SEQ ID NO: 3440641 - DNA, 14 bp, Homo sapiens
tgagcataactcca

SEQ ID NO: 3440642 - DNA, 21 bp, Homo sapiens
tgagcatgacagcctgcagca

SEQ ID NO: 3440643 - DNA, 15 bp, Homo sapiens
tgagcatggagctgg

SEQ ID NO: 3440644 - DNA, 18 bp, Homo sapiens
tgagcatggagctggccg

SEQ ID NO: 3440645 - DNA, 12 bp, Homo sapiens
tgagccaccacg

SEQ ID NO: 3440646 - DNA, 12 bp, Homo sapiens
tgagccactgca

SEQ ID NO: 3440647 - DNA, 18 bp, Homo sapiens
tgagccactgcaccgggc

SEQ ID NO: 3440648 - DNA, 22 bp, Homo sapiens
tgagccagccaggccctgccag

SEQ ID NO: 3440649 - DNA, 17 bp, Homo sapiens
tgagcccatggccctcc

SEQ ID NO: 3440650 - DNA, 22 bp, Homo sapiens
tgagcccctgtctagagaggga

SEQ ID NO: 3440651 - DNA, 16 bp, Homo sapiens
tgagcctagccctggg

SEQ ID NO: 3440652 - DNA, 15 bp, Homo sapiens
tgagcctagctacct

SEQ ID NO: 3440653 - DNA, 21 bp, Homo sapiens
tgagcctgatgtttacagtgt

SEQ ID NO: 3440654 - DNA, 16 bp, Homo sapiens
tgagcctggccagcct

SEQ ID NO: 3440655 - DNA, 22 bp, Homo sapiens
tgagcctgggaggtcaaggctg

SEQ ID NO: 3440656 - DNA, 23 bp, Homo sapiens
tgagcgaggagatgctccttggg

SEQ ID NO: 3440657 - DNA, 23 bp, Homo sapiens
tgagcgcctccatccaaggccag

SEQ ID NO: 3440658 - DNA, 24 bp, Homo sapiens
tgagctactgccgtcagtgctgtg

SEQ ID NO: 3440659 - DNA, 20 bp, Homo sapiens
tgagctaggagaagggctga

SEQ ID NO: 3440660 - DNA, 21 bp, Homo sapiens
tgagctagttggttgaatttt

SEQ ID NO: 3440661 - DNA, 21 bp, Homo sapiens
tgagctcccaggtgcagccag

SEQ ID NO: 3440662 - DNA, 18 bp, Homo sapiens
tgagctctacccagggcc

SEQ ID NO: 3440663 - DNA, 13 bp, Homo sapiens
tgagctcttgtga

SEQ ID NO: 3440664 - DNA, 15 bp, Homo sapiens
tgagctgaccagccg

SEQ ID NO: 3440665 - DNA, 24 bp, Homo sapiens
tgagctgaccagccgtgagcatgt

SEQ ID NO: 3440666 - DNA, 22 bp, Homo sapiens
tgagctgcttcactagggaatc

SEQ ID NO: 3440667 - DNA, 18 bp, Homo sapiens
tgagctgtatcttgatgt

SEQ ID NO: 3440668 - DNA, 23 bp, Homo sapiens
tgagcttttaaataaaattgaaa

SEQ ID NO: 3440669 - DNA, 16 bp, Homo sapiens
tgaggaatatttcaag

SEQ ID NO: 3440670 - DNA, 22 bp, Homo sapiens
tgaggaatccagacccggctgc

SEQ ID NO: 3440671 - DNA, 19 bp, Homo sapiens
tgaggaatgtatatgtttt

SEQ ID NO: 3440672 - DNA, 21 bp, Homo sapiens
tgaggacactaaccacgctgg

SEQ ID NO: 3440673 - DNA, 13 bp, Homo sapiens
tgaggaggaggct

SEQ ID NO: 3440674 - DNA, 15 bp, Homo sapiens
tgaggataaattgcc

SEQ ID NO: 3440675 - DNA, 14 bp, Homo sapiens
tgaggataactttt

SEQ ID NO: 3440676 - DNA, 18 bp, Homo sapiens
tgaggatgggtcagagct

SEQ ID NO: 3440677 - DNA, 16 bp, Homo sapiens
tgaggcatcctctgac

SEQ ID NO: 3440678 - DNA, 13 bp, Homo sapiens
tgaggccacactc

SEQ ID NO: 3440679 - DNA, 17 bp, Homo sapiens
tgaggcctactctaaag

SEQ ID NO: 3440680 - DNA, 13 bp, Homo sapiens
tgaggcctgggcc

SEQ ID NO: 3440681 - DNA, 16 bp, Homo sapiens
tgaggcctgtctgtga

SEQ ID NO: 3440682 - DNA, 19 bp, Homo sapiens
tgaggcctgtctgtgacct

SEQ ID NO: 3440683 - DNA, 11 bp, Homo sapiens
tgaggctggca

SEQ ID NO: 3440684 - DNA, 15 bp, Homo sapiens
tgaggctggcacagg

SEQ ID NO: 3440685 - DNA, 19 bp, Homo sapiens
tgaggctgggggagagccg

SEQ ID NO: 3440686 - DNA, 11 bp, Homo sapiens
tgaggctgtgg

SEQ ID NO: 3440687 - DNA, 21 bp, Homo sapiens
tgaggctgtggtcacagcgga

SEQ ID NO: 3440688 - DNA, 14 bp, Homo sapiens
tgaggctttccatg

SEQ ID NO: 3440689 - DNA, 21 bp, Homo sapiens
tgagggaaagagcttataaaa

SEQ ID NO: 3440690 - DNA, 23 bp, Homo sapiens
tgagggaggacaggcgggaggag

SEQ ID NO: 3440691 - DNA, 15 bp, Homo sapiens
tgagggatgacttac

SEQ ID NO: 3440692 - DNA, 11 bp, Homo sapiens
tgagggcagtc

SEQ ID NO: 3440693 - DNA, 13 bp, Homo sapiens
tgagggcctgctg

SEQ ID NO: 3440694 - DNA, 19 bp, Homo sapiens
tgagggcctgctggaggcc

SEQ ID NO: 3440695 - DNA, 22 bp, Homo sapiens
tgagggcctgctggaggcctca

SEQ ID NO: 3440696 - DNA, 22 bp, Homo sapiens
tgagggggaatagtctagatgg

SEQ ID NO: 3440697 - DNA, 23 bp, Homo sapiens
tgaggggtcgacttcgggctggc

SEQ ID NO: 3440698 - DNA, 21 bp, Homo sapiens
tgagggtgcttgttccctctc

SEQ ID NO: 3440699 - DNA, 16 bp, Homo sapiens
tgaggtattttttcct

SEQ ID NO: 3440700 - DNA, 14 bp, Homo sapiens
tgaggtcactgcta

SEQ ID NO: 3440701 - DNA, 13 bp, Homo sapiens
tgaggtcagagcc

SEQ ID NO: 3440702 - DNA, 18 bp, Homo sapiens
tgaggtcagagcctgcag

SEQ ID NO: 3440703 - DNA, 16 bp, Homo sapiens
tgaggtcaggagttcc

SEQ ID NO: 3440704 - DNA, 13 bp, Homo sapiens
tgaggtgggagga

SEQ ID NO: 3440705 - DNA, 22 bp, Homo sapiens
tgagtaactgatttgtaacaag

SEQ ID NO: 3440706 - DNA, 18 bp, Homo sapiens
tgagtagaaaggccttta

SEQ ID NO: 3440707 - DNA, 23 bp, Homo sapiens
tgagtagaaaggcctttaaaatt

SEQ ID NO: 3440708 - DNA, 14 bp, Homo sapiens
tgagtagaggctta

SEQ ID NO: 3440709 - DNA, 21 bp, Homo sapiens
tgagtagatgcgcagccccat

SEQ ID NO: 3440710 - DNA, 16 bp, Homo sapiens
tgagtatttttaaaaa

SEQ ID NO: 3440711 - DNA, 22 bp, Homo sapiens
tgagtatttttaaaaaatatgt

SEQ ID NO: 3440712 - DNA, 15 bp, Homo sapiens
tgagtcatctgttag

SEQ ID NO: 3440713 - DNA, 18 bp, Homo sapiens
tgagtgaaagttgccatt

SEQ ID NO: 3440714 - DNA, 20 bp, Homo sapiens
tgagtgatgcggcagattga

SEQ ID NO: 3440715 - DNA, 19 bp, Homo sapiens
tgagtgcagccgtttgaga

SEQ ID NO: 3440716 - DNA, 14 bp, Homo sapiens
tgagtgcctggcca

SEQ ID NO: 3440717 - DNA, 15 bp, Homo sapiens
tgagtgccttttgca

SEQ ID NO: 3440718 - DNA, 12 bp, Homo sapiens
tgagtgctctga

SEQ ID NO: 3440719 - DNA, 19 bp, Homo sapiens
tgagtgctctgatccctct

SEQ ID NO: 3440720 - DNA, 13 bp, Homo sapiens
tgagtggcagggg

SEQ ID NO: 3440721 - DNA, 23 bp, Homo sapiens
tgagtgggggatcacagcctctg

SEQ ID NO: 3440722 - DNA, 21 bp, Homo sapiens
tgagtgttttatgagaaagcc

SEQ ID NO: 3440723 - DNA, 16 bp, Homo sapiens
tgagttacagcctgtt

SEQ ID NO: 3440724 - DNA, 18 bp, Homo sapiens
tgagttcataccctgtta

SEQ ID NO: 3440725 - DNA, 14 bp, Homo sapiens
tgagttctgctgaa

SEQ ID NO: 3440726 - DNA, 17 bp, Homo sapiens
tgagttggggtctggca

SEQ ID NO: 3440727 - DNA, 13 bp, Homo sapiens
tgagtttcatgtt

SEQ ID NO: 3440728 - DNA, 19 bp, Homo sapiens
tgagtttgtcgctcatgtg

SEQ ID NO: 3440729 - DNA, 17 bp, Homo sapiens
tgagttttcttctgtga

SEQ ID NO: 3440730 - DNA, 15 bp, Homo sapiens
tgagttttttattcc

SEQ ID NO: 3440731 - DNA, 23 bp, Homo sapiens
tgataactagatggtgctgagaa

SEQ ID NO: 3440732 - DNA, 21 bp, Homo sapiens
tgataagagggcacacactgt

SEQ ID NO: 3440733 - DNA, 19 bp, Homo sapiens
tgataatattgtggtgcca

SEQ ID NO: 3440734 - DNA, 12 bp, Homo sapiens
tgataatgacac

SEQ ID NO: 3440735 - DNA, 13 bp, Homo sapiens
tgataatgacact

SEQ ID NO: 3440736 - DNA, 22 bp, Homo sapiens
tgataatgacactgtttcctga

SEQ ID NO: 3440737 - DNA, 16 bp, Homo sapiens
tgataattacaataca

SEQ ID NO: 3440738 - DNA, 13 bp, Homo sapiens
tgataattttgct

SEQ ID NO: 3440739 - DNA, 14 bp, Homo sapiens
tgatacagaactct

SEQ ID NO: 3440740 - DNA, 20 bp, Homo sapiens
tgatacagtcaacaagcctg

SEQ ID NO: 3440741 - DNA, 18 bp, Homo sapiens
tgatactggaggaacact

SEQ ID NO: 3440742 - DNA, 16 bp, Homo sapiens
tgatagtcttttgctt

SEQ ID NO: 3440743 - DNA, 16 bp, Homo sapiens
tgatataatctttcaa

SEQ ID NO: 3440744 - DNA, 18 bp, Homo sapiens
tgatatagaattagcttt

SEQ ID NO: 3440745 - DNA, 22 bp, Homo sapiens
tgatatagaattagctttttca

SEQ ID NO: 3440746 - DNA, 16 bp, Homo sapiens
tgatatggagcaagag

SEQ ID NO: 3440747 - DNA, 16 bp, Homo sapiens
tgatatgttttatttc

SEQ ID NO: 3440748 - DNA, 17 bp, Homo sapiens
tgatcaacatcttttct

SEQ ID NO: 3440749 - DNA, 11 bp, Homo sapiens
tgatcaaggcc

SEQ ID NO: 3440750 - DNA, 18 bp, Homo sapiens
tgatcaagtcctttgtga

SEQ ID NO: 3440751 - DNA, 19 bp, Homo sapiens
tgatcaagtcctttgtgaa

SEQ ID NO: 3440752 - DNA, 16 bp, Homo sapiens
tgatcaattttgactt

SEQ ID NO: 3440753 - DNA, 14 bp, Homo sapiens
tgatcacagcagct

SEQ ID NO: 3440754 - DNA, 13 bp, Homo sapiens
tgatcacggctca

SEQ ID NO: 3440755 - DNA, 14 bp, Homo sapiens
tgatcacggctcac

SEQ ID NO: 3440756 - DNA, 22 bp, Homo sapiens
tgatcagagccgtggtcctttg

SEQ ID NO: 3440757 - DNA, 17 bp, Homo sapiens
tgatcagatctgacatg

SEQ ID NO: 3440758 - DNA, 15 bp, Homo sapiens
tgatcagtggacagt

SEQ ID NO: 3440759 - DNA, 19 bp, Homo sapiens
tgatcagtggacagtctgc

SEQ ID NO: 3440760 - DNA, 19 bp, Homo sapiens
tgatcatgtactttttagt

SEQ ID NO: 3440761 - DNA, 17 bp, Homo sapiens
tgatccacccacctcag

SEQ ID NO: 3440762 - DNA, 20 bp, Homo sapiens
tgatccacccacctcagcct

SEQ ID NO: 3440763 - DNA, 21 bp, Homo sapiens
tgatccacccacctcagcctc

SEQ ID NO: 3440764 - DNA, 19 bp, Homo sapiens
tgatccctctgggggctct

SEQ ID NO: 3440765 - DNA, 19 bp, Homo sapiens
tgatcctcccacctcagcc

SEQ ID NO: 3440766 - DNA, 21 bp, Homo sapiens
tgatcctcccacctcagcctc

SEQ ID NO: 3440767 - DNA, 22 bp, Homo sapiens
tgatcctcccacctcagcctcc

SEQ ID NO: 3440768 - DNA, 20 bp, Homo sapiens
tgatcctggaggcccagttc

SEQ ID NO: 3440769 - DNA, 23 bp, Homo sapiens
tgatcctggaggtcttttctagt

SEQ ID NO: 3440770 - DNA, 13 bp, Homo sapiens
tgatcctgtgaag

SEQ ID NO: 3440771 - DNA, 15 bp, Homo sapiens
tgatcgcctttccca

SEQ ID NO: 3440772 - DNA, 21 bp, Homo sapiens
tgatctccaggcaaaaggagt

SEQ ID NO: 3440773 - DNA, 18 bp, Homo sapiens
tgatctcgaactcctaac

SEQ ID NO: 3440774 - DNA, 23 bp, Homo sapiens
tgatctgcaggggtctgggagtc

SEQ ID NO: 3440775 - DNA, 13 bp, Homo sapiens
tgatctggaaccc

SEQ ID NO: 3440776 - DNA, 17 bp, Homo sapiens
tgatctggaacccagac

SEQ ID NO: 3440777 - DNA, 18 bp, Homo sapiens
tgatctggaacccagact

SEQ ID NO: 3440778 - DNA, 19 bp, Homo sapiens
tgatctggaacccagactc

SEQ ID NO: 3440779 - DNA, 13 bp, Homo sapiens
tgatctgtatata

SEQ ID NO: 3440780 - DNA, 19 bp, Homo sapiens
tgatctgtatatacaataa

SEQ ID NO: 3440781 - DNA, 13 bp, Homo sapiens
tgatctgttgcaa

SEQ ID NO: 3440782 - DNA, 16 bp, Homo sapiens
tgatctttgcagacag

SEQ ID NO: 3440783 - DNA, 21 bp, Homo sapiens
tgatctttgcagacaggcaag

SEQ ID NO: 3440784 - DNA, 21 bp, Homo sapiens
tgatgaagccgaccttagatt

SEQ ID NO: 3440785 - DNA, 20 bp, Homo sapiens
tgatgacaaaaaatgtttta

SEQ ID NO: 3440786 - DNA, 14 bp, Homo sapiens
tgatgaccaaagtc

SEQ ID NO: 3440787 - DNA, 13 bp, Homo sapiens
tgatgactgcctt

SEQ ID NO: 3440788 - DNA, 20 bp, Homo sapiens
tgatgactgccttgcctcct

SEQ ID NO: 3440789 - DNA, 14 bp, Homo sapiens
tgatgagattttta

SEQ ID NO: 3440790 - DNA, 21 bp, Homo sapiens
tgatgatctttgcagacaggc

SEQ ID NO: 3440791 - DNA, 20 bp, Homo sapiens
tgatgatgaaatgaggtcag

SEQ ID NO: 3440792 - DNA, 16 bp, Homo sapiens
tgatgatgtgcctggg

SEQ ID NO: 3440793 - DNA, 22 bp, Homo sapiens
tgatgcaggatttgttctctgt

SEQ ID NO: 3440794 - DNA, 16 bp, Homo sapiens
tgatgcatgtctttta

SEQ ID NO: 3440795 - DNA, 19 bp, Homo sapiens
tgatggaaggatctctcca

SEQ ID NO: 3440796 - DNA, 14 bp, Homo sapiens
tgatggatttaaca

SEQ ID NO: 3440797 - DNA, 15 bp, Homo sapiens
tgatggatttaacag

SEQ ID NO: 3440798 - DNA, 23 bp, Homo sapiens
tgatggcaacagatctggaacct

SEQ ID NO: 3440799 - DNA, 20 bp, Homo sapiens
tgatggcaggatggcctggc

SEQ ID NO: 3440800 - DNA, 22 bp, Homo sapiens
tgatgggcaacccccagcctgc

SEQ ID NO: 3440801 - DNA, 17 bp, Homo sapiens
tgatggggaaggaggct

SEQ ID NO: 3440802 - DNA, 22 bp, Homo sapiens
tgatggggccctaattcagcca

SEQ ID NO: 3440803 - DNA, 17 bp, Homo sapiens
tgatgtagtgcctcttt

SEQ ID NO: 3440804 - DNA, 19 bp, Homo sapiens
tgatgtcaatttctgtgtt

SEQ ID NO: 3440805 - DNA, 13 bp, Homo sapiens
tgatgtgcctggg

SEQ ID NO: 3440806 - DNA, 14 bp, Homo sapiens
tgatgttggctggg

SEQ ID NO: 3440807 - DNA, 15 bp, Homo sapiens
tgatgttggctggga

SEQ ID NO: 3440808 - DNA, 13 bp, Homo sapiens
tgatgtttcattt

SEQ ID NO: 3440809 - DNA, 20 bp, Homo sapiens
tgattaaagtgctcacgtta

SEQ ID NO: 3440810 - DNA, 19 bp, Homo sapiens
tgattaaccacttcagctg

SEQ ID NO: 3440811 - DNA, 14 bp, Homo sapiens
tgattacagtgcag

SEQ ID NO: 3440812 - DNA, 16 bp, Homo sapiens
tgattacagtgcagtg

SEQ ID NO: 3440813 - DNA, 13 bp, Homo sapiens
tgattaggtatgt

SEQ ID NO: 3440814 - DNA, 21 bp, Homo sapiens
tgattaggtatgtttgtaact

SEQ ID NO: 3440815 - DNA, 14 bp, Homo sapiens
tgattatatattgt

SEQ ID NO: 3440816 - DNA, 14 bp, Homo sapiens
tgattcaggtgcag

SEQ ID NO: 3440817 - DNA, 18 bp, Homo sapiens
tgattcaggtgcagagga

SEQ ID NO: 3440818 - DNA, 24 bp, Homo sapiens
tgattcagtgttaaatgtgatgaa

SEQ ID NO: 3440819 - DNA, 17 bp, Homo sapiens
tgattccctcctgctac

SEQ ID NO: 3440820 - DNA, 20 bp, Homo sapiens
tgattccttcctgttctgaa

SEQ ID NO: 3440821 - DNA, 15 bp, Homo sapiens
tgattctcagggtct

SEQ ID NO: 3440822 - DNA, 23 bp, Homo sapiens
tgattctcagggtctctgctgcc

SEQ ID NO: 3440823 - DNA, 20 bp, Homo sapiens
tgattctcctgcctcagcct

SEQ ID NO: 3440824 - DNA, 14 bp, Homo sapiens
tgattctccttcag

SEQ ID NO: 3440825 - DNA, 16 bp, Homo sapiens
tgattctccttcagcc

SEQ ID NO: 3440826 - DNA, 21 bp, Homo sapiens
tgattctccttcagccctcac

SEQ ID NO: 3440827 - DNA, 16 bp, Homo sapiens
tgattctgcagtaaat

SEQ ID NO: 3440828 - DNA, 13 bp, Homo sapiens
tgattgacagctt

SEQ ID NO: 3440829 - DNA, 17 bp, Homo sapiens
tgattgacagctttgct

SEQ ID NO: 3440830 - DNA, 19 bp, Homo sapiens
tgattgcacgtgcctgtgg

SEQ ID NO: 3440831 - DNA, 21 bp, Homo sapiens
tgattgtggaatggagattca

SEQ ID NO: 3440832 - DNA, 12 bp, Homo sapiens
tgattgtttaca

SEQ ID NO: 3440833 - DNA, 15 bp, Homo sapiens
tgatttaaacacaca

SEQ ID NO: 3440834 - DNA, 16 bp, Homo sapiens
tgatttaaacacacag

SEQ ID NO: 3440835 - DNA, 17 bp, Homo sapiens
tgatttataaacagaca

SEQ ID NO: 3440836 - DNA, 16 bp, Homo sapiens
tgatttcccccctccg

SEQ ID NO: 3440837 - DNA, 20 bp, Homo sapiens
tgatttcccccctccgcctc

SEQ ID NO: 3440838 - DNA, 17 bp, Homo sapiens
tgatttccttgaatgtg

SEQ ID NO: 3440839 - DNA, 19 bp, Homo sapiens
tgatttgaagaacatgtga

SEQ ID NO: 3440840 - DNA, 19 bp, Homo sapiens
tgatttggtgaccaactgt

SEQ ID NO: 3440841 - DNA, 14 bp, Homo sapiens
tgattttaactctg

SEQ ID NO: 3440842 - DNA, 13 bp, Homo sapiens
tgattttcattgc

SEQ ID NO: 3440843 - DNA, 13 bp, Homo sapiens
tgattttttgcat

SEQ ID NO: 3440844 - DNA, 19 bp, Homo sapiens
tgcaaaaggactctcagga

SEQ ID NO: 3440845 - DNA, 22 bp, Homo sapiens
tgcaaaaggttcactaaagcag

SEQ ID NO: 3440846 - DNA, 23 bp, Homo sapiens
tgcaaaaggttcactaaagcagt

SEQ ID NO: 3440847 - DNA, 21 bp, Homo sapiens
tgcaaaatgaggaatgtatat

SEQ ID NO: 3440848 - DNA, 16 bp, Homo sapiens
tgcaaagaaaatcaga

SEQ ID NO: 3440849 - DNA, 23 bp, Homo sapiens
tgcaaagatctgtcctcagcctt

SEQ ID NO: 3440850 - DNA, 21 bp, Homo sapiens
tgcaaagtactgtaagaataa

SEQ ID NO: 3440851 - DNA, 20 bp, Homo sapiens
tgcaaagtattgtaaattat

SEQ ID NO: 3440852 - DNA, 19 bp, Homo sapiens
tgcaaagtgttttgtacca

SEQ ID NO: 3440853 - DNA, 21 bp, Homo sapiens
tgcaaatcctatgtgatttta

SEQ ID NO: 3440854 - DNA, 14 bp, Homo sapiens
tgcaaatcttgaaa

SEQ ID NO: 3440855 - DNA, 16 bp, Homo sapiens
tgcaacaaaatgtaga

SEQ ID NO: 3440856 - DNA, 19 bp, Homo sapiens
tgcaacaggctgggcttca

SEQ ID NO: 3440857 - DNA, 14 bp, Homo sapiens
tgcaacctccgcct

SEQ ID NO: 3440858 - DNA, 18 bp, Homo sapiens
tgcaacctccgcctcttg

SEQ ID NO: 3440859 - DNA, 21 bp, Homo sapiens
tgcaacctccgcctcttgggt

SEQ ID NO: 3440860 - DNA, 19 bp, Homo sapiens
tgcaacctcgctggactct

SEQ ID NO: 3440861 - DNA, 12 bp, Homo sapiens
tgcaacctctgc

SEQ ID NO: 3440862 - DNA, 18 bp, Homo sapiens
tgcaacctcttggcctga

SEQ ID NO: 3440863 - DNA, 20 bp, Homo sapiens
tgcaagaagtcttgagaaaa

SEQ ID NO: 3440864 - DNA, 17 bp, Homo sapiens
tgcaagagaacatttta

SEQ ID NO: 3440865 - DNA, 18 bp, Homo sapiens
tgcaaggacattcttgta

SEQ ID NO: 3440866 - DNA, 13 bp, Homo sapiens
tgcaaggcaaaga

SEQ ID NO: 3440867 - DNA, 18 bp, Homo sapiens
tgcaagtccttttgtaaa

SEQ ID NO: 3440868 - DNA, 20 bp, Homo sapiens
tgcaagtccttttgtaaagt

SEQ ID NO: 3440869 - DNA, 12 bp, Homo sapiens
tgcaagtctctt

SEQ ID NO: 3440870 - DNA, 16 bp, Homo sapiens
tgcaagtgctcaggga

SEQ ID NO: 3440871 - DNA, 19 bp, Homo sapiens
tgcaataaatctgacccag

SEQ ID NO: 3440872 - DNA, 15 bp, Homo sapiens
tgcaataatgcagta

SEQ ID NO: 3440873 - DNA, 20 bp, Homo sapiens
tgcaataatgcagtatggta

SEQ ID NO: 3440874 - DNA, 16 bp, Homo sapiens
tgcaatgactcaggac

SEQ ID NO: 3440875 - DNA, 13 bp, Homo sapiens
tgcaatggcagcc

SEQ ID NO: 3440876 - DNA, 15 bp, Homo sapiens
tgcaatggcagcctt

SEQ ID NO: 3440877 - DNA, 22 bp, Homo sapiens
tgcaatgtctgagtgaacctgt

SEQ ID NO: 3440878 - DNA, 14 bp, Homo sapiens
tgcaatttctacta

SEQ ID NO: 3440879 - DNA, 19 bp, Homo sapiens
tgcacaaaacccagacctg

SEQ ID NO: 3440880 - DNA, 14 bp, Homo sapiens
tgcacaacattaca

SEQ ID NO: 3440881 - DNA, 16 bp, Homo sapiens
tgcacaactctactgt

SEQ ID NO: 3440882 - DNA, 22 bp, Homo sapiens
tgcacaagatgccccagggatg

SEQ ID NO: 3440883 - DNA, 14 bp, Homo sapiens
tgcacaagctgcac

SEQ ID NO: 3440884 - DNA, 15 bp, Homo sapiens
tgcacaagctgcacc

SEQ ID NO: 3440885 - DNA, 18 bp, Homo sapiens
tgcacaagctgcaccctc

SEQ ID NO: 3440886 - DNA, 17 bp, Homo sapiens
tgcacacaccagagccc

SEQ ID NO: 3440887 - DNA, 22 bp, Homo sapiens
tgcacacaccagagcccacctt

SEQ ID NO: 3440888 - DNA, 18 bp, Homo sapiens
tgcacacccactcagctc

SEQ ID NO: 3440889 - DNA, 17 bp, Homo sapiens
tgcacagcgtcctgtcc

SEQ ID NO: 3440890 - DNA, 18 bp, Homo sapiens
tgcacagggattctcaca

SEQ ID NO: 3440891 - DNA, 15 bp, Homo sapiens
tgcacatctctgctt

SEQ ID NO: 3440892 - DNA, 18 bp, Homo sapiens
tgcacatctgtgtcttgt

SEQ ID NO: 3440893 - DNA, 21 bp, Homo sapiens
tgcacatgactcgggggtggg

SEQ ID NO: 3440894 - DNA, 14 bp, Homo sapiens
tgcacatgtcttaa

SEQ ID NO: 3440895 - DNA, 16 bp, Homo sapiens
tgcacatgtcttaatg

SEQ ID NO: 3440896 - DNA, 20 bp, Homo sapiens
tgcacatgttggaggagaga

SEQ ID NO: 3440897 - DNA, 24 bp, Homo sapiens
tgcacatgttggaggagagagcct

SEQ ID NO: 3440898 - DNA, 16 bp, Homo sapiens
tgcacatgtttcctct

SEQ ID NO: 3440899 - DNA, 18 bp, Homo sapiens
tgcacatgtttcctctag

SEQ ID NO: 3440900 - DNA, 14 bp, Homo sapiens
tgcaccaagcagga

SEQ ID NO: 3440901 - DNA, 14 bp, Homo sapiens
tgcaccactgcact

SEQ ID NO: 3440902 - DNA, 23 bp, Homo sapiens
tgcaccagggttgaccccagagg

SEQ ID NO: 3440903 - DNA, 13 bp, Homo sapiens
tgcaccagtttta

SEQ ID NO: 3440904 - DNA, 21 bp, Homo sapiens
tgcaccagttttatccataat

SEQ ID NO: 3440905 - DNA, 21 bp, Homo sapiens
tgcaccatccctttttgaagt

SEQ ID NO: 3440906 - DNA, 22 bp, Homo sapiens
tgcaccatccctttttgaagtg

SEQ ID NO: 3440907 - DNA, 14 bp, Homo sapiens
tgcacccccctggg

SEQ ID NO: 3440908 - DNA, 15 bp, Homo sapiens
tgcacccctccccat

SEQ ID NO: 3440909 - DNA, 22 bp, Homo sapiens
tgcacccctccccattcacaga

SEQ ID NO: 3440910 - DNA, 16 bp, Homo sapiens
tgcaccctcaggcagg

SEQ ID NO: 3440911 - DNA, 17 bp, Homo sapiens
tgcaccgggccacagag

SEQ ID NO: 3440912 - DNA, 13 bp, Homo sapiens
tgcacggctgctg

SEQ ID NO: 3440913 - DNA, 14 bp, Homo sapiens
tgcactaactgctg

SEQ ID NO: 3440914 - DNA, 15 bp, Homo sapiens
tgcactaactgctgg

SEQ ID NO: 3440915 - DNA, 22 bp, Homo sapiens
tgcactatagcctaggtgacag

SEQ ID NO: 3440916 - DNA, 18 bp, Homo sapiens
tgcactgacattgttggc

SEQ ID NO: 3440917 - DNA, 23 bp, Homo sapiens
tgcactgagtgaaggaagagaga

SEQ ID NO: 3440918 - DNA, 16 bp, Homo sapiens
tgcactgatgctgccc

SEQ ID NO: 3440919 - DNA, 18 bp, Homo sapiens
tgcactgtgaaggaccct

SEQ ID NO: 3440920 - DNA, 17 bp, Homo sapiens
tgcactgtgtgctgact

SEQ ID NO: 3440921 - DNA, 19 bp, Homo sapiens
tgcactgttccccctgtgc

SEQ ID NO: 3440922 - DNA, 23 bp, Homo sapiens
tgcactgttccccctgtgcagcc

SEQ ID NO: 3440923 - DNA, 16 bp, Homo sapiens
tgcacttacttgctta

SEQ ID NO: 3440924 - DNA, 18 bp, Homo sapiens
tgcacttacttgcttatt

SEQ ID NO: 3440925 - DNA, 20 bp, Homo sapiens
tgcacttgtgattatttatt

SEQ ID NO: 3440926 - DNA, 13 bp, Homo sapiens
tgcactttgtaaa

SEQ ID NO: 3440927 - DNA, 14 bp, Homo sapiens
tgcactttgtaaat

SEQ ID NO: 3440928 - DNA, 15 bp, Homo sapiens
tgcactttgtaaatt

SEQ ID NO: 3440929 - DNA, 17 bp, Homo sapiens
tgcactttgtaaattcc

SEQ ID NO: 3440930 - DNA, 20 bp, Homo sapiens
tgcagaagagggtgtgtttg

SEQ ID NO: 3440931 - DNA, 20 bp, Homo sapiens
tgcagaaggaaaaatgtgta

SEQ ID NO: 3440932 - DNA, 21 bp, Homo sapiens
tgcagaaggaaaaatgtgtaa

SEQ ID NO: 3440933 - DNA, 22 bp, Homo sapiens
tgcagaaggaaaaatgtgtaat

SEQ ID NO: 3440934 - DNA, 15 bp, Homo sapiens
tgcagacaggaatct

SEQ ID NO: 3440935 - DNA, 15 bp, Homo sapiens
tgcagacatgagtgc

SEQ ID NO: 3440936 - DNA, 23 bp, Homo sapiens
tgcagacctgtcaccctgcagga

SEQ ID NO: 3440937 - DNA, 16 bp, Homo sapiens
tgcagactctacagag

SEQ ID NO: 3440938 - DNA, 17 bp, Homo sapiens
tgcagactctacagagg

SEQ ID NO: 3440939 - DNA, 22 bp, Homo sapiens
tgcagactctacagaggccatg

SEQ ID NO: 3440940 - DNA, 21 bp, Homo sapiens
tgcagagaaacttaagcaaag

SEQ ID NO: 3440941 - DNA, 21 bp, Homo sapiens
tgcagaggaagtacaaactaa

SEQ ID NO: 3440942 - DNA, 19 bp, Homo sapiens
tgcctgcacaaactcacca

SEQ ID NO: 3440943 - DNA, 11 bp, Homo sapiens
tgcctgccata

SEQ ID NO: 3440944 - DNA, 19 bp, Homo sapiens
tgcctgccatagccaggag

SEQ ID NO: 3440945 - DNA, 14 bp, Homo sapiens
tgcctgcccaggcc

SEQ ID NO: 3440946 - DNA, 17 bp, Homo sapiens
tgcctgcccaggcccct

SEQ ID NO: 3440947 - DNA, 24 bp, Homo sapiens
tgcctgcccaggcccctgccaccc

SEQ ID NO: 3440948 - DNA, 18 bp, Homo sapiens
tgcctgccccaaacaaat

SEQ ID NO: 3440949 - DNA, 20 bp, Homo sapiens
tgcctgctgttggtcctctc

SEQ ID NO: 3440950 - DNA, 22 bp, Homo sapiens
tgcctggcttcgcaaaatgttt

SEQ ID NO: 3440951 - DNA, 19 bp, Homo sapiens
tgcctggtggcagctgcgg

SEQ ID NO: 3440952 - DNA, 15 bp, Homo sapiens
tgcctgtaaacatag

SEQ ID NO: 3440953 - DNA, 18 bp, Homo sapiens
tgcctgtagcccactctg

SEQ ID NO: 3440954 - DNA, 20 bp, Homo sapiens
tgcctgtagcccactctgct

SEQ ID NO: 3440955 - DNA, 17 bp, Homo sapiens
tgcctgtagtcccaggc

SEQ ID NO: 3440956 - DNA, 21 bp, Homo sapiens
tgcctgtcctgaaagcggctg

SEQ ID NO: 3440957 - DNA, 14 bp, Homo sapiens
tgcctgtctgcccc

SEQ ID NO: 3440958 - DNA, 16 bp, Homo sapiens
tgcctgtctgccccag

SEQ ID NO: 3440959 - DNA, 11 bp, Homo sapiens
tgcctgtggcg

SEQ ID NO: 3440960 - DNA, 21 bp, Homo sapiens
tgcctgtggcgccgtctccag

SEQ ID NO: 3440961 - DNA, 16 bp, Homo sapiens
tgcctgtgggcctggg

SEQ ID NO: 3440962 - DNA, 15 bp, Homo sapiens
tgcctgtgtccatgc

SEQ ID NO: 3440963 - DNA, 21 bp, Homo sapiens
tgcctgtgtccatgcgctcag

SEQ ID NO: 3440964 - DNA, 16 bp, Homo sapiens
tgcctgttcagctcca

SEQ ID NO: 3440965 - DNA, 20 bp, Homo sapiens
tgcctgttcagctccagctc

SEQ ID NO: 3440966 - DNA, 18 bp, Homo sapiens
tgccttaaacctacctcc

SEQ ID NO: 3440967 - DNA, 20 bp, Homo sapiens
tgccttaataaaaaatgaaa

SEQ ID NO: 3440968 - DNA, 21 bp, Homo sapiens
tgccttaccgagagccaaaca

SEQ ID NO: 3440969 - DNA, 23 bp, Homo sapiens
tgccttattagagtgtctttcca

SEQ ID NO: 3440970 - DNA, 15 bp, Homo sapiens
tgccttccagaaaac

SEQ ID NO: 3440971 - DNA, 18 bp, Homo sapiens
tgccttccagaaaacaaa

SEQ ID NO: 3440972 - DNA, 19 bp, Homo sapiens
tgccttcctaagcctgtgg

SEQ ID NO: 3440973 - DNA, 20 bp, Homo sapiens
tgccttcctaagcctgtggc

SEQ ID NO: 3440974 - DNA, 21 bp, Homo sapiens
tgccttcctaagcctgtggct

SEQ ID NO: 3440975 - DNA, 15 bp, Homo sapiens
tgccttcctcctggg

SEQ ID NO: 3440976 - DNA, 21 bp, Homo sapiens
tgccttcgcttcttgcctctg

SEQ ID NO: 3440977 - DNA, 20 bp, Homo sapiens
tgccttcgtctttcccatgg

SEQ ID NO: 3440978 - DNA, 15 bp, Homo sapiens
tgccttctaaaggtg

SEQ ID NO: 3440979 - DNA, 13 bp, Homo sapiens
tgccttctcacca

SEQ ID NO: 3440980 - DNA, 19 bp, Homo sapiens
tgccttctcaccagctgca

SEQ ID NO: 3440981 - DNA, 20 bp, Homo sapiens
tgccttctcaccagctgcaa

SEQ ID NO: 3440982 - DNA, 17 bp, Homo sapiens
tgccttcttcagggcct

SEQ ID NO: 3440983 - DNA, 19 bp, Homo sapiens
tgccttcttcagggcctgg

SEQ ID NO: 3440984 - DNA, 12 bp, Homo sapiens
tgccttgaataa

SEQ ID NO: 3440985 - DNA, 13 bp, Homo sapiens
tgccttgaattgt

SEQ ID NO: 3440986 - DNA, 17 bp, Homo sapiens
tgccttgaattgtctag

SEQ ID NO: 3440987 - DNA, 13 bp, Homo sapiens
tgccttgcctcct

SEQ ID NO: 3440988 - DNA, 12 bp, Homo sapiens
tgccttgccttt

SEQ ID NO: 3440989 - DNA, 13 bp, Homo sapiens
tgccttggctcag

SEQ ID NO: 3440990 - DNA, 16 bp, Homo sapiens
tgccttggctcagaca

SEQ ID NO: 3440991 - DNA, 15 bp, Homo sapiens
tgcctttagaaaata

SEQ ID NO: 3440992 - DNA, 23 bp, Homo sapiens
tgcctttagaaaatataagtaaa

SEQ ID NO: 3440993 - DNA, 21 bp, Homo sapiens
tgcctttattgtgtttgtcat

SEQ ID NO: 3440994 - DNA, 12 bp, Homo sapiens
tgcctttcaaat

SEQ ID NO: 3440995 - DNA, 20 bp, Homo sapiens
tgccttttttcacggaagtt

SEQ ID NO: 3440996 - DNA, 22 bp, Homo sapiens
tgcgaatggttccattctctct

SEQ ID NO: 3440997 - DNA, 15 bp, Homo sapiens
tgcgacgcttgctct

SEQ ID NO: 3440998 - DNA, 21 bp, Homo sapiens
tgcgactttctgcctggagtg

SEQ ID NO: 3440999 - DNA, 19 bp, Homo sapiens
tgcgatctgggttcactgc

SEQ ID NO: 3441000 - DNA, 17 bp, Homo sapiens
tgcgcagccccatctgt

SEQ ID NO: 3441001 - DNA, 20 bp, Homo sapiens
tgcgcagccccatctgtgca

SEQ ID NO: 3441002 - DNA, 21 bp, Homo sapiens
tgcgcagccccatctgtgcat

SEQ ID NO: 3441003 - DNA, 20 bp, Homo sapiens
tgcgcattctaacctggagg

SEQ ID NO: 3441004 - DNA, 13 bp, Homo sapiens
tgcgcctacagga

SEQ ID NO: 3441005 - DNA, 16 bp, Homo sapiens
tgcgcctacaggagtg

SEQ ID NO: 3441006 - DNA, 18 bp, Homo sapiens
tgcgcctgtgatgctggg

SEQ ID NO: 3441007 - DNA, 19 bp, Homo sapiens
tgcgcctgtgatgctgggc

SEQ ID NO: 3441008 - DNA, 17 bp, Homo sapiens
tgcgcgcacaatagtaa

SEQ ID NO: 3441009 - DNA, 21 bp, Homo sapiens
tgcgctcagggccatgctgag

SEQ ID NO: 3441010 - DNA, 18 bp, Homo sapiens
tgcggacagccacggcca

SEQ ID NO: 3441011 - DNA, 22 bp, Homo sapiens
tgcggacagccacggccaggcc

SEQ ID NO: 3441012 - DNA, 13 bp, Homo sapiens
tgcggaggctgct

SEQ ID NO: 3441013 - DNA, 13 bp, Homo sapiens
tgcggatggccgg

SEQ ID NO: 3441014 - DNA, 16 bp, Homo sapiens
tgcggcaggactgcag

SEQ ID NO: 3441015 - DNA, 14 bp, Homo sapiens
tgcggccagagccg

SEQ ID NO: 3441016 - DNA, 17 bp, Homo sapiens
tgcggcctttggcttca

SEQ ID NO: 3441017 - DNA, 22 bp, Homo sapiens
tgcgggtgaacaaagcagccac

SEQ ID NO: 3441018 - DNA, 15 bp, Homo sapiens
tgcggtccacccagg

SEQ ID NO: 3441019 - DNA, 17 bp, Homo sapiens
tgcggtccacccaggag

SEQ ID NO: 3441020 - DNA, 16 bp, Homo sapiens
tgcgtacacagagaag

SEQ ID NO: 3441021 - DNA, 19 bp, Homo sapiens
tgcgtccacgagctgttta

SEQ ID NO: 3441022 - DNA, 17 bp, Homo sapiens
tgcgtgcccctgctgct

SEQ ID NO: 3441023 - DNA, 13 bp, Homo sapiens
tgcgttggtctct

SEQ ID NO: 3441024 - DNA, 17 bp, Homo sapiens
tgcgttggtctctgcat

SEQ ID NO: 3441025 - DNA, 21 bp, Homo sapiens
tgctaaaatagaatatagcat

SEQ ID NO: 3441026 - DNA, 15 bp, Homo sapiens
tgctaaatgtgaatg

SEQ ID NO: 3441027 - DNA, 20 bp, Homo sapiens
tgctaagccccagcaagcaa

SEQ ID NO: 3441028 - DNA, 19 bp, Homo sapiens
tgctaagtgtgaactggac

SEQ ID NO: 3441029 - DNA, 18 bp, Homo sapiens
tgctacctcccttgcctt

SEQ ID NO: 3441030 - DNA, 18 bp, Homo sapiens
tgctactagctctttgag

SEQ ID NO: 3441031 - DNA, 15 bp, Homo sapiens
tgctactctgttcct

SEQ ID NO: 3441032 - DNA, 15 bp, Homo sapiens
tgctagaaattttca

SEQ ID NO: 3441033 - DNA, 20 bp, Homo sapiens
tgctataaagctagatgctt

SEQ ID NO: 3441034 - DNA, 13 bp, Homo sapiens
tgctatagtattt

SEQ ID NO: 3441035 - DNA, 14 bp, Homo sapiens
tgctatagtatttg

SEQ ID NO: 3441036 - DNA, 22 bp, Homo sapiens
tgctatagtatttgattcaaaa

SEQ ID NO: 3441037 - DNA, 20 bp, Homo sapiens
tgctatcctgccaaaatcat

SEQ ID NO: 3441038 - DNA, 19 bp, Homo sapiens
tgctatgttctgtcttccc

SEQ ID NO: 3441039 - DNA, 17 bp, Homo sapiens
tgctattgacaataaaa

SEQ ID NO: 3441040 - DNA, 18 bp, Homo sapiens
tgctattgacaataaaat

SEQ ID NO: 3441041 - DNA, 17 bp, Homo sapiens
tgctatttgaacaagtg

SEQ ID NO: 3441042 - DNA, 14 bp, Homo sapiens
tgctcaagaaacaa

SEQ ID NO: 3441043 - DNA, 16 bp, Homo sapiens
tgctcacgttaccttg

SEQ ID NO: 3441044 - DNA, 21 bp, Homo sapiens
tgctcacgttaccttgacaca

SEQ ID NO: 3441045 - DNA, 16 bp, Homo sapiens
tgctcagaacttgctg

SEQ ID NO: 3441046 - DNA, 20 bp, Homo sapiens
tgctcagaacttgctgctgt

SEQ ID NO: 3441047 - DNA, 18 bp, Homo sapiens
tgctcagctctgggccat

SEQ ID NO: 3441048 - DNA, 20 bp, Homo sapiens
tgctcagctctgggccattc

SEQ ID NO: 3441049 - DNA, 15 bp, Homo sapiens
tgctcagcttctcct

SEQ ID NO: 3441050 - DNA, 20 bp, Homo sapiens
tgctcagcttctcctgtgtg

SEQ ID NO: 3441051 - DNA, 14 bp, Homo sapiens
tgctcaggactcag

SEQ ID NO: 3441052 - DNA, 17 bp, Homo sapiens
tgctcagggaaatggcc

SEQ ID NO: 3441053 - DNA, 16 bp, Homo sapiens
tgctcagggtcaattt

SEQ ID NO: 3441054 - DNA, 17 bp, Homo sapiens
tgctcagttcagaatca

SEQ ID NO: 3441055 - DNA, 20 bp, Homo sapiens
tgctcatcattctctgtctc

SEQ ID NO: 3441056 - DNA, 16 bp, Homo sapiens
tgctcatctgctggtc

SEQ ID NO: 3441057 - DNA, 18 bp, Homo sapiens
tgctcatctgctggtccg

SEQ ID NO: 3441058 - DNA, 19 bp, Homo sapiens
tgctcatgggctgtgtgat

SEQ ID NO: 3441059 - DNA, 19 bp, Homo sapiens
tgctccagctgttcagctg

SEQ ID NO: 3441060 - DNA, 12 bp, Homo sapiens
tgctccaggcag

SEQ ID NO: 3441061 - DNA, 14 bp, Homo sapiens
tgctccaggcaggc

SEQ ID NO: 3441062 - DNA, 22 bp, Homo sapiens
tgctccaggcaggctaaggcgt

SEQ ID NO: 3441063 - DNA, 19 bp, Homo sapiens
tgctccagggatgattcaa

SEQ ID NO: 3441064 - DNA, 15 bp, Homo sapiens
tgctcccctctgaaa

SEQ ID NO: 3441065 - DNA, 12 bp, Homo sapiens
tgctccctctgt

SEQ ID NO: 3441066 - DNA, 18 bp, Homo sapiens
tgctccctggttctgatg

SEQ ID NO: 3441067 - DNA, 16 bp, Homo sapiens
tgctcctccctctgac

SEQ ID NO: 3441068 - DNA, 17 bp, Homo sapiens
tgctcctctccccagca

SEQ ID NO: 3441069 - DNA, 14 bp, Homo sapiens
tgctccttgggccc

SEQ ID NO: 3441070 - DNA, 18 bp, Homo sapiens
tgctccttgggccctttg

SEQ ID NO: 3441071 - DNA, 21 bp, Homo sapiens
tgctccttgggccctttgagt

SEQ ID NO: 3441072 - DNA, 23 bp, Homo sapiens
tgctccttgttcctagagtagag

SEQ ID NO: 3441073 - DNA, 14 bp, Homo sapiens
tgctcctttcccct

SEQ ID NO: 3441074 - DNA, 13 bp, Homo sapiens
tgctcgccctgcg

SEQ ID NO: 3441075 - DNA, 13 bp, Homo sapiens
tgctcgctgttgc

SEQ ID NO: 3441076 - DNA, 18 bp, Homo sapiens
tgctctagatgagctggg

SEQ ID NO: 3441077 - DNA, 19 bp, Homo sapiens
tgctctagatgagctgggc

SEQ ID NO: 3441078 - DNA, 22 bp, Homo sapiens
tgcttttccttggggcaggcag

SEQ ID NO: 3441079 - DNA, 21 bp, Homo sapiens
tgcttttggcaaaactctact

SEQ ID NO: 3441080 - DNA, 13 bp, Homo sapiens
tgcttttggcctg

SEQ ID NO: 3441081 - DNA, 14 bp, Homo sapiens
tgcttttggtctgt

SEQ ID NO: 3441082 - DNA, 17 bp, Homo sapiens
tgcttttggtctgtgtg

SEQ ID NO: 3441083 - DNA, 18 bp, Homo sapiens
tgctttttatttctgcat

SEQ ID NO: 3441084 - DNA, 21 bp, Homo sapiens
tgctttttgcgtacacagaga

SEQ ID NO: 3441085 - DNA, 13 bp, Homo sapiens
tggaaaaactgag

SEQ ID NO: 3441086 - DNA, 20 bp, Homo sapiens
tggaaaaactgagacaggca

SEQ ID NO: 3441087 - DNA, 22 bp, Homo sapiens
tggaaaaactgagacaggcagt

SEQ ID NO: 3441088 - DNA, 20 bp, Homo sapiens
tggaaaaatagcctgcctct

SEQ ID NO: 3441089 - DNA, 15 bp, Homo sapiens
tggaaaacgaagctc

SEQ ID NO: 3441090 - DNA, 17 bp, Homo sapiens
tggaaacatcactgggg

SEQ ID NO: 3441091 - DNA, 18 bp, Homo sapiens
tggaaacattcaggagct

SEQ ID NO: 3441092 - DNA, 18 bp, Homo sapiens
tggaaacattttttaaaa

SEQ ID NO: 3441093 - DNA, 13 bp, Homo sapiens
tggaaactggcca

SEQ ID NO: 3441094 - DNA, 23 bp, Homo sapiens
tggaaagataactaggaaatcca

SEQ ID NO: 3441095 - DNA, 16 bp, Homo sapiens
tggaacactactctta

SEQ ID NO: 3441096 - DNA, 19 bp, Homo sapiens
tggaacactactcttacat

SEQ ID NO: 3441097 - DNA, 20 bp, Homo sapiens
tggaacactagacaagccag

SEQ ID NO: 3441098 - DNA, 21 bp, Homo sapiens
tggaacactagacaagccaga

SEQ ID NO: 3441099 - DNA, 22 bp, Homo sapiens
tggaacccagactcagacattg

SEQ ID NO: 3441100 - DNA, 15 bp, Homo sapiens
tggaacctcagcctg

SEQ ID NO: 3441101 - DNA, 16 bp, Homo sapiens
tggaacctcagcctgg

SEQ ID NO: 3441102 - DNA, 19 bp, Homo sapiens
tggaacctcagcctggcca

SEQ ID NO: 3441103 - DNA, 21 bp, Homo sapiens
tggaactgcgttatgaagagc

SEQ ID NO: 3441104 - DNA, 14 bp, Homo sapiens
tggaacttagccat

SEQ ID NO: 3441105 - DNA, 16 bp, Homo sapiens
tggaacttagccattt

SEQ ID NO: 3441106 - DNA, 21 bp, Homo sapiens
tggaagaaaaaaaccacacaa

SEQ ID NO: 3441107 - DNA, 20 bp, Homo sapiens
tggaagacagagacctcctg

SEQ ID NO: 3441108 - DNA, 23 bp, Homo sapiens
tggaagacagagacctcctgcct

SEQ ID NO: 3441109 - DNA, 13 bp, Homo sapiens
tggaagatcctgc

SEQ ID NO: 3441110 - DNA, 16 bp, Homo sapiens
tggaagattttcattg

SEQ ID NO: 3441111 - DNA, 18 bp, Homo sapiens
tggaagattttcattgag

SEQ ID NO: 3441112 - DNA, 17 bp, Homo sapiens
tggaagctaatttgcat

SEQ ID NO: 3441113 - DNA, 14 bp, Homo sapiens
tggaagctcttctt

SEQ ID NO: 3441114 - DNA, 15 bp, Homo sapiens
tggaaggaccctgtg

SEQ ID NO: 3441115 - DNA, 21 bp, Homo sapiens
tggaatcagattttaacagct

SEQ ID NO: 3441116 - DNA, 22 bp, Homo sapiens
tggaatcaggaatattttccaa

SEQ ID NO: 3441117 - DNA, 18 bp, Homo sapiens
tggaatcccactgtatga

SEQ ID NO: 3441118 - DNA, 17 bp, Homo sapiens
tggaatctgaggcatcc

SEQ ID NO: 3441119 - DNA, 20 bp, Homo sapiens
tggaatctgaggcatcctct

SEQ ID NO: 3441120 - DNA, 17 bp, Homo sapiens
tggaatctggagaccag

SEQ ID NO: 3441121 - DNA, 14 bp, Homo sapiens
tggaatgcagtggt

SEQ ID NO: 3441122 - DNA, 16 bp, Homo sapiens
tggaatggtttgggaa

SEQ ID NO: 3441123 - DNA, 15 bp, Homo sapiens
tggaatgttggataa

SEQ ID NO: 3441124 - DNA, 21 bp, Homo sapiens
tggaattatgctggcttctga

SEQ ID NO: 3441125 - DNA, 19 bp, Homo sapiens
tggaattgatttgcattga

SEQ ID NO: 3441126 - DNA, 19 bp, Homo sapiens
tggaatttttgcttgactt

SEQ ID NO: 3441127 - DNA, 21 bp, Homo sapiens
tggaatttttgcttgacttca

SEQ ID NO: 3441128 - DNA, 15 bp, Homo sapiens
tggacaaagaacctt

SEQ ID NO: 3441129 - DNA, 13 bp, Homo sapiens
tggacacagctct

SEQ ID NO: 3441130 - DNA, 14 bp, Homo sapiens
tggacacagctctt

SEQ ID NO: 3441131 - DNA, 18 bp, Homo sapiens
tggacacagctcttctcc

SEQ ID NO: 3441132 - DNA, 22 bp, Homo sapiens
tggacacagctcttctccaggc

SEQ ID NO: 3441133 - DNA, 23 bp, Homo sapiens
tggacacttaatactaccttgaa

SEQ ID NO: 3441134 - DNA, 23 bp, Homo sapiens
tggacacttttcacctccttcaa

SEQ ID NO: 3441135 - DNA, 14 bp, Homo sapiens
tggacagccccacc

SEQ ID NO: 3441136 - DNA, 13 bp, Homo sapiens
tggacaggatgtg

SEQ ID NO: 3441137 - DNA, 12 bp, Homo sapiens
tggacaggcatg

SEQ ID NO: 3441138 - DNA, 16 bp, Homo sapiens
tggacaggcatgttct

SEQ ID NO: 3441139 - DNA, 15 bp, Homo sapiens
tggacaggggattgg

SEQ ID NO: 3441140 - DNA, 23 bp, Homo sapiens
tggacagtatcactgtctttcct

SEQ ID NO: 3441141 - DNA, 13 bp, Homo sapiens
tggacatcagtgt

SEQ ID NO: 3441142 - DNA, 18 bp, Homo sapiens
tggacatcagtgtttgtt

SEQ ID NO: 3441143 - DNA, 23 bp, Homo sapiens
tggacatcctcctcccacccggc

SEQ ID NO: 3441144 - DNA, 18 bp, Homo sapiens
tggacatgaagattcttt

SEQ ID NO: 3441145 - DNA, 21 bp, Homo sapiens
tggacatgaagattctttccc

SEQ ID NO: 3441146 - DNA, 22 bp, Homo sapiens
tggacatgaagattctttccca

SEQ ID NO: 3441147 - DNA, 16 bp, Homo sapiens
tggacatgcctgtcct

SEQ ID NO: 3441148 - DNA, 12 bp, Homo sapiens
tggaccagagga

SEQ ID NO: 3441149 - DNA, 14 bp, Homo sapiens
tggaccagaggaag

SEQ ID NO: 3441150 - DNA, 18 bp, Homo sapiens
tggaccagtggtctcaca

SEQ ID NO: 3441151 - DNA, 13 bp, Homo sapiens
tggaccctgttgc

SEQ ID NO: 3441152 - DNA, 15 bp, Homo sapiens
tggaccctgttgcta

SEQ ID NO: 3441153 - DNA, 18 bp, Homo sapiens
tggacctaaatggcctca

SEQ ID NO: 3441154 - DNA, 21 bp, Homo sapiens
tggacctaaatggcctcatgt

SEQ ID NO: 3441155 - DNA, 18 bp, Homo sapiens
tggacggtgctccaggca

SEQ ID NO: 3441156 - DNA, 19 bp, Homo sapiens
tggacggtgctccaggcag

SEQ ID NO: 3441157 - DNA, 22 bp, Homo sapiens
tggacggtgctccaggcaggct

SEQ ID NO: 3441158 - DNA, 14 bp, Homo sapiens
tggactaaaagata

SEQ ID NO: 3441159 - DNA, 22 bp, Homo sapiens
tggactaaaagatataagtgct

SEQ ID NO: 3441160 - DNA, 18 bp, Homo sapiens
tggactcagggcagcgcc

SEQ ID NO: 3441161 - DNA, 21 bp, Homo sapiens
tggactccagcctgcctggca

SEQ ID NO: 3441162 - DNA, 19 bp, Homo sapiens
tggactcctgccaccagca

SEQ ID NO: 3441163 - DNA, 20 bp, Homo sapiens
tggactctcagtctctgagc

SEQ ID NO: 3441164 - DNA, 18 bp, Homo sapiens
tggactggaccagacaat

SEQ ID NO: 3441165 - DNA, 15 bp, Homo sapiens
tggagaactcctagg

SEQ ID NO: 3441166 - DNA, 17 bp, Homo sapiens
tggagaactcctagggt

SEQ ID NO: 3441167 - DNA, 20 bp, Homo sapiens
tggagaagccacaggcctga

SEQ ID NO: 3441168 - DNA, 22 bp, Homo sapiens
tggagaagccacaggcctgaga

SEQ ID NO: 3441169 - DNA, 13 bp, Homo sapiens
tggagaagcggct

SEQ ID NO: 3441170 - DNA, 14 bp, Homo sapiens
tggagaagctctgt

SEQ ID NO: 3441171 - DNA, 23 bp, Homo sapiens
tggagacaaaatattttcctgcc

SEQ ID NO: 3441172 - DNA, 16 bp, Homo sapiens
tggagacaatgtctgc

SEQ ID NO: 3441173 - DNA, 19 bp, Homo sapiens
tggagactcctaggcagga

SEQ ID NO: 3441174 - DNA, 18 bp, Homo sapiens
tggagagctggagcctgg

SEQ ID NO: 3441175 - DNA, 16 bp, Homo sapiens
tggagaggccctctgg

SEQ ID NO: 3441176 - DNA, 18 bp, Homo sapiens
tggagaggccctctggag

SEQ ID NO: 3441177 - DNA, 20 bp, Homo sapiens
tggagataaagatttcttga

SEQ ID NO: 3441178 - DNA, 16 bp, Homo sapiens
tggagatcctcctgca

SEQ ID NO: 3441179 - DNA, 20 bp, Homo sapiens
tggagatcctcctgcagacc

SEQ ID NO: 3441180 - DNA, 15 bp, Homo sapiens
tggagatggaagctt

SEQ ID NO: 3441181 - DNA, 18 bp, Homo sapiens
tggagcaaagtggtaggt

SEQ ID NO: 3441182 - DNA, 12 bp, Homo sapiens
tggagcactggg

SEQ ID NO: 3441183 - DNA, 17 bp, Homo sapiens
tggagcactgggctccc

SEQ ID NO: 3441184 - DNA, 20 bp, Homo sapiens
tggagcactgttctgggact

SEQ ID NO: 3441185 - DNA, 16 bp, Homo sapiens
tggagcagaggggctg

SEQ ID NO: 3441186 - DNA, 15 bp, Homo sapiens
tggagcatcaagcca

SEQ ID NO: 3441187 - DNA, 23 bp, Homo sapiens
tggagcccagaggagggcagcag

SEQ ID NO: 3441188 - DNA, 15 bp, Homo sapiens
tggagcccagggagc

SEQ ID NO: 3441189 - DNA, 22 bp, Homo sapiens
tggagcccagggcatcttgctg

SEQ ID NO: 3441190 - DNA, 17 bp, Homo sapiens
tggagccgaggcctacc

SEQ ID NO: 3441191 - DNA, 18 bp, Homo sapiens
tggagctcagagagggca

SEQ ID NO: 3441192 - DNA, 21 bp, Homo sapiens
tggagcttcatggcagaaggc

SEQ ID NO: 3441193 - DNA, 19 bp, Homo sapiens
tggaggaacacttgatgga

SEQ ID NO: 3441194 - DNA, 11 bp, Homo sapiens
tggaggacagt

SEQ ID NO: 3441195 - DNA, 13 bp, Homo sapiens
tggaggagagagc

SEQ ID NO: 3441196 - DNA, 17 bp, Homo sapiens
tggaggagagagccttg

SEQ ID NO: 3441197 - DNA, 22 bp, Homo sapiens
tggaggagagagccttgggagc

SEQ ID NO: 3441198 - DNA, 23 bp, Homo sapiens
tggaggagagagccttgggagcc

SEQ ID NO: 3441199 - DNA, 11 bp, Homo sapiens
tggaggagcaa

SEQ ID NO: 3441200 - DNA, 14 bp, Homo sapiens
tggaggagcaaagg

SEQ ID NO: 3441201 - DNA, 17 bp, Homo sapiens
tggaggatcagtttttt

SEQ ID NO: 3441202 - DNA, 18 bp, Homo sapiens
tggaggattgctgccaga

SEQ ID NO: 3441203 - DNA, 23 bp, Homo sapiens
tggaggattgctgccagagaagt

SEQ ID NO: 3441204 - DNA, 14 bp, Homo sapiens
tggaggcactttag

SEQ ID NO: 3441205 - DNA, 20 bp, Homo sapiens
tggaggcagatgtggggctg

SEQ ID NO: 3441206 - DNA, 14 bp, Homo sapiens
tggaggcccaggct

SEQ ID NO: 3441207 - DNA, 12 bp, Homo sapiens
tggaggcccagt

SEQ ID NO: 3441208 - DNA, 17 bp, Homo sapiens
tggaggcctcaggtgct

SEQ ID NO: 3441209 - DNA, 16 bp, Homo sapiens
tggaggctgcctccca

SEQ ID NO: 3441210 - DNA, 20 bp, Homo sapiens
tggaggttaaggctgaggaa

SEQ ID NO: 3441211 - DNA, 24 bp, Homo sapiens
tggaggttaaggctgaggaaaggc

SEQ ID NO: 3441212 - DNA, 22 bp, Homo sapiens
tggagtcatgtgcctctgtcct

SEQ ID NO: 3441213 - DNA, 17 bp, Homo sapiens
tggagtgtatgactgca

SEQ ID NO: 3441214 - DNA, 14 bp, Homo sapiens
tggagttgaaaatc

SEQ ID NO: 3441215 - DNA, 15 bp, Homo sapiens
tggagttgatctgga

SEQ ID NO: 3441216 - DNA, 22 bp, Homo sapiens
tggagttgatctggaacccaga

SEQ ID NO: 3441217 - DNA, 21 bp, Homo sapiens
tggagtttcatgtacaagatg

SEQ ID NO: 3441218 - DNA, 17 bp, Homo sapiens
tggagttttttgtacca

SEQ ID NO: 3441219 - DNA, 18 bp, Homo sapiens
tggagttttttgtaccaa

SEQ ID NO: 3441220 - DNA, 23 bp, Homo sapiens
tggataagctatccgtgttgcag

SEQ ID NO: 3441221 - DNA, 13 bp, Homo sapiens
tggatacataaag

SEQ ID NO: 3441222 - DNA, 14 bp, Homo sapiens
tggatacataaaga

SEQ ID NO: 3441223 - DNA, 18 bp, Homo sapiens
tggatacatacaccagca

SEQ ID NO: 3441224 - DNA, 23 bp, Homo sapiens
tggatagaacatgggatacttta

SEQ ID NO: 3441225 - DNA, 21 bp, Homo sapiens
tggatatttgtactgtttaat

SEQ ID NO: 3441226 - DNA, 18 bp, Homo sapiens
tggatcctgggctgggtg

SEQ ID NO: 3441227 - DNA, 19 bp, Homo sapiens
tggatcctgggctgggtgg

SEQ ID NO: 3441228 - DNA, 18 bp, Homo sapiens
tggatctcattggaccct

SEQ ID NO: 3441229 - DNA, 21 bp, Homo sapiens
tggatgatggtcttcagcctc

SEQ ID NO: 3441230 - DNA, 14 bp, Homo sapiens
tggatgatgtttcg

SEQ ID NO: 3441231 - DNA, 22 bp, Homo sapiens
tggatgcatgttttccagctcc

SEQ ID NO: 3441232 - DNA, 14 bp, Homo sapiens
tggatgcctggtgg

SEQ ID NO: 3441233 - DNA, 18 bp, Homo sapiens
tggatgcctggtggcagc

SEQ ID NO: 3441234 - DNA, 18 bp, Homo sapiens
tggatggccccagcacag

SEQ ID NO: 3441235 - DNA, 18 bp, Homo sapiens
tggatggccgtggatgcg

SEQ ID NO: 3441236 - DNA, 23 bp, Homo sapiens
tggatgggggaactcagatccag

SEQ ID NO: 3441237 - DNA, 14 bp, Homo sapiens
tggatggtgtgcct

SEQ ID NO: 3441238 - DNA, 16 bp, Homo sapiens
tggatgtctgaacttt

SEQ ID NO: 3441239 - DNA, 19 bp, Homo sapiens
tggattccccatctcaggc

SEQ ID NO: 3441240 - DNA, 17 bp, Homo sapiens
tggattctttaaatata

SEQ ID NO: 3441241 - DNA, 20 bp, Homo sapiens
tggattggagatagggaaag

SEQ ID NO: 3441242 - DNA, 21 bp, Homo sapiens
tggattgtggatgtggacttt

SEQ ID NO: 3441243 - DNA, 13 bp, Homo sapiens
tggatttaacagc

SEQ ID NO: 3441244 - DNA, 20 bp, Homo sapiens
tggatttaacagcatgacaa

SEQ ID NO: 3441245 - DNA, 13 bp, Homo sapiens
tggatttgacatt

SEQ ID NO: 3441246 - DNA, 19 bp, Homo sapiens
tggatttttgactctggca

SEQ ID NO: 3441247 - DNA, 16 bp, Homo sapiens
tggcaaaaaggcagga

SEQ ID NO: 3441248 - DNA, 18 bp, Homo sapiens
tggcaaagcttttagaaa

SEQ ID NO: 3441249 - DNA, 17 bp, Homo sapiens
tggcaaaggaaggtgga

SEQ ID NO: 3441250 - DNA, 23 bp, Homo sapiens
tggcaaatgtaactgtgccagtt

SEQ ID NO: 3441251 - DNA, 20 bp, Homo sapiens
tggcaacagatctggaacct

SEQ ID NO: 3441252 - DNA, 19 bp, Homo sapiens
tggcaagagtgtggaggct

SEQ ID NO: 3441253 - DNA, 16 bp, Homo sapiens
tggcaaggctgtgctc

SEQ ID NO: 3441254 - DNA, 14 bp, Homo sapiens
tggcacaggacatg

SEQ ID NO: 3441255 - DNA, 12 bp, Homo sapiens
tggcacattcct

SEQ ID NO: 3441256 - DNA, 15 bp, Homo sapiens
tggcacattcctttg

SEQ ID NO: 3441257 - DNA, 16 bp, Homo sapiens
tggcacattcctttgg

SEQ ID NO: 3441258 - DNA, 19 bp, Homo sapiens
tggcacattcctttgggta

SEQ ID NO: 3441259 - DNA, 14 bp, Homo sapiens
tggcaccagacacc

SEQ ID NO: 3441260 - DNA, 16 bp, Homo sapiens
tggcaccagacaccca

SEQ ID NO: 3441261 - DNA, 17 bp, Homo sapiens
tggcaccagcagcctgg

SEQ ID NO: 3441262 - DNA, 16 bp, Homo sapiens
tggcacccggcccctg

SEQ ID NO: 3441263 - DNA, 20 bp, Homo sapiens
tggcacccggcccctgctgg

SEQ ID NO: 3441264 - DNA, 16 bp, Homo sapiens
tggcactggaccccag

SEQ ID NO: 3441265 - DNA, 18 bp, Homo sapiens
tggcactggaccccagca

SEQ ID NO: 3441266 - DNA, 15 bp, Homo sapiens
tggcagactgtgtaa

SEQ ID NO: 3441267 - DNA, 17 bp, Homo sapiens
tggcagactgtgtaaaa

SEQ ID NO: 3441268 - DNA, 20 bp, Homo sapiens
tggcagagttgtaaatatat

SEQ ID NO: 3441269 - DNA, 16 bp, Homo sapiens
tggcagatgcacatgt

SEQ ID NO: 3441270 - DNA, 20 bp, Homo sapiens
tggcagcctcccatccaggg

SEQ ID NO: 3441271 - DNA, 13 bp, Homo sapiens
tggcagccttggc

SEQ ID NO: 3441272 - DNA, 17 bp, Homo sapiens
tggcagccttggcaaac

SEQ ID NO: 3441273 - DNA, 21 bp, Homo sapiens
tggcagctctggacagcccca

SEQ ID NO: 3441274 - DNA, 19 bp, Homo sapiens
tggcagctgcggtccaccc

SEQ ID NO: 3441275 - DNA, 21 bp, Homo sapiens
tggcagctgcggtccacccag

SEQ ID NO: 3441276 - DNA, 12 bp, Homo sapiens
tggcaggaaggc

SEQ ID NO: 3441277 - DNA, 15 bp, Homo sapiens
tggcaggaaggcttg

SEQ ID NO: 3441278 - DNA, 20 bp, Homo sapiens
tggcaggcaggctcccaggg

SEQ ID NO: 3441279 - DNA, 13 bp, Homo sapiens
tggcaggctggcc

SEQ ID NO: 3441280 - DNA, 18 bp, Homo sapiens
tggcaggggacaggagtc

SEQ ID NO: 3441281 - DNA, 20 bp, Homo sapiens
tggcagtccagccagctcct

SEQ ID NO: 3441282 - DNA, 14 bp, Homo sapiens
tggcagtgatgaat

SEQ ID NO: 3441283 - DNA, 13 bp, Homo sapiens
tggcagtgggagc

SEQ ID NO: 3441284 - DNA, 15 bp, Homo sapiens
tggcagtgggagctg

SEQ ID NO: 3441285 - DNA, 20 bp, Homo sapiens
tggcagtgggagctgcctgt

SEQ ID NO: 3441286 - DNA, 19 bp, Homo sapiens
tggcagtttgttgatcttt

SEQ ID NO: 3441287 - DNA, 14 bp, Homo sapiens
tggcatcagctggc

SEQ ID NO: 3441288 - DNA, 18 bp, Homo sapiens
tggcatcagctggcgtca

SEQ ID NO: 3441289 - DNA, 23 bp, Homo sapiens
tggcatcgcaccattctgactcg

SEQ ID NO: 3441290 - DNA, 15 bp, Homo sapiens
tggcatctcccacac

SEQ ID NO: 3441291 - DNA, 19 bp, Homo sapiens
tggcatgtccacgtgtgtg

SEQ ID NO: 3441292 - DNA, 21 bp, Homo sapiens
tggcatttcaattcctggccc

SEQ ID NO: 3441293 - DNA, 17 bp, Homo sapiens
tggccaaggagctgcta

SEQ ID NO: 3441294 - DNA, 12 bp, Homo sapiens
tggccaagggcc

SEQ ID NO: 3441295 - DNA, 13 bp, Homo sapiens
tggccaagggcca

SEQ ID NO: 3441296 - DNA, 14 bp, Homo sapiens
tggccaagggccag

SEQ ID NO: 3441297 - DNA, 11 bp, Homo sapiens
tggccaccagt

SEQ ID NO: 3441298 - DNA, 13 bp, Homo sapiens
tggccaggaagct

SEQ ID NO: 3441299 - DNA, 20 bp, Homo sapiens
tggccaggctgatctcgaac

SEQ ID NO: 3441300 - DNA, 17 bp, Homo sapiens
tggccaggctggtctca

SEQ ID NO: 3441301 - DNA, 20 bp, Homo sapiens
tggccagggccacgctccag

SEQ ID NO: 3441302 - DNA, 23 bp, Homo sapiens
tggccagtgtgacaaggattgct

SEQ ID NO: 3441303 - DNA, 17 bp, Homo sapiens
tggccatctctggatgc

SEQ ID NO: 3441304 - DNA, 14 bp, Homo sapiens
tggccatgcctcag

SEQ ID NO: 3441305 - DNA, 17 bp, Homo sapiens
tggccatgcctcagccc

SEQ ID NO: 3441306 - DNA, 14 bp, Homo sapiens
tggcccaaatccag

SEQ ID NO: 3441307 - DNA, 14 bp, Homo sapiens
tggcccactgcatc

SEQ ID NO: 3441308 - DNA, 17 bp, Homo sapiens
tggcccagggcccagag

SEQ ID NO: 3441309 - DNA, 22 bp, Homo sapiens
tggcccagggcccagagcccag

SEQ ID NO: 3441310 - DNA, 22 bp, Homo sapiens
tggccccaccctgggccctggg

SEQ ID NO: 3441311 - DNA, 12 bp, Homo sapiens
tggccccagcac

SEQ ID NO: 3441312 - DNA, 18 bp, Homo sapiens
tggccccagcacagcttg

SEQ ID NO: 3441313 - DNA, 15 bp, Homo sapiens
tggccccgtttctgg

SEQ ID NO: 3441314 - DNA, 15 bp, Homo sapiens
tggcccctgcccggc

SEQ ID NO: 3441315 - DNA, 20 bp, Homo sapiens
tggcccctgctgtctctctg

SEQ ID NO: 3441316 - DNA, 15 bp, Homo sapiens
tggccgagtccaagc

SEQ ID NO: 3441317 - DNA, 19 bp, Homo sapiens
tggccgagtccaagctggg

SEQ ID NO: 3441318 - DNA, 22 bp, Homo sapiens
tggccgcgccaaataatgtctc

SEQ ID NO: 3441319 - DNA, 19 bp, Homo sapiens
tggccgctgagtggcaggg

SEQ ID NO: 3441320 - DNA, 17 bp, Homo sapiens
tggccgtggatgcgcag

SEQ ID NO: 3441321 - DNA, 14 bp, Homo sapiens
tggccgtggatggc

SEQ ID NO: 3441322 - DNA, 15 bp, Homo sapiens
tggcctatctcctag

SEQ ID NO: 3441323 - DNA, 15 bp, Homo sapiens
tggcctcacccaccc

SEQ ID NO: 3441324 - DNA, 19 bp, Homo sapiens
tggcctcatgtggctggaa

SEQ ID NO: 3441325 - DNA, 20 bp, Homo sapiens
tggcctcatgtggctggaag

SEQ ID NO: 3441326 - DNA, 23 bp, Homo sapiens
tggcctccatcctcatctctctt

SEQ ID NO: 3441327 - DNA, 18 bp, Homo sapiens
tggcctcccacagactca

SEQ ID NO: 3441328 - DNA, 19 bp, Homo sapiens
tggcctcccctgccaccag

SEQ ID NO: 3441329 - DNA, 21 bp, Homo sapiens
tggcctctccttgtggcctgg

SEQ ID NO: 3441330 - DNA, 14 bp, Homo sapiens
tggcctcttgaaga

SEQ ID NO: 3441331 - DNA, 14 bp, Homo sapiens
tggcctctttgtct

SEQ ID NO: 3441332 - DNA, 21 bp, Homo sapiens
tggcctgaagagtcctctgaa

SEQ ID NO: 3441333 - DNA, 24 bp, Homo sapiens
tggcctgggccgtatctccggctc

SEQ ID NO: 3441334 - DNA, 18 bp, Homo sapiens
tggccttccatttatatg

SEQ ID NO: 3441335 - DNA, 22 bp, Homo sapiens
tggccttcccgccggaggccag

SEQ ID NO: 3441336 - DNA, 11 bp, Homo sapiens
tggccttctcc

SEQ ID NO: 3441337 - DNA, 18 bp, Homo sapiens
tggccttctcccctcttc

SEQ ID NO: 3441338 - DNA, 21 bp, Homo sapiens
tggccttctcccctcttctga

SEQ ID NO: 3441339 - DNA, 22 bp, Homo sapiens
tggccttctcccctcttctgag

SEQ ID NO: 3441340 - DNA, 15 bp, Homo sapiens
tggcgccgtctccag

SEQ ID NO: 3441341 - DNA, 18 bp, Homo sapiens
tggcgccgtctccagggg

SEQ ID NO: 3441342 - DNA, 18 bp, Homo sapiens
tggctacgcctcttctgt

SEQ ID NO: 3441343 - DNA, 15 bp, Homo sapiens
tggctagtcaagctc

SEQ ID NO: 3441344 - DNA, 18 bp, Homo sapiens
tggctagtcaagctcctc

SEQ ID NO: 3441345 - DNA, 20 bp, Homo sapiens
tggctagtcaagctcctcct

SEQ ID NO: 3441346 - DNA, 22 bp, Homo sapiens
tggctattagagatcaacccct

SEQ ID NO: 3441347 - DNA, 16 bp, Homo sapiens
tggctcacactgagaa

SEQ ID NO: 3441348 - DNA, 13 bp, Homo sapiens
tggctcacgcctg

SEQ ID NO: 3441349 - DNA, 16 bp, Homo sapiens
tggctcagccagcact

SEQ ID NO: 3441350 - DNA, 17 bp, Homo sapiens
tggctcattctgcacct

SEQ ID NO: 3441351 - DNA, 20 bp, Homo sapiens
tggctccagatgcagggcag

SEQ ID NO: 3441352 - DNA, 21 bp, Homo sapiens
tggctccagatgcagggcagt

SEQ ID NO: 3441353 - DNA, 14 bp, Homo sapiens
tggctcctcccagc

SEQ ID NO: 3441354 - DNA, 13 bp, Homo sapiens
tggctcctctcag

SEQ ID NO: 3441355 - DNA, 14 bp, Homo sapiens
tggctcctctcagt

SEQ ID NO: 3441356 - DNA, 13 bp, Homo sapiens
tggctccttcacc

SEQ ID NO: 3441357 - DNA, 19 bp, Homo sapiens
tggctctgaccgaaacagc

SEQ ID NO: 3441358 - DNA, 19 bp, Homo sapiens
tggctctgagcgcctccat

SEQ ID NO: 3441359 - DNA, 16 bp, Homo sapiens
tggctgaaattctcct

SEQ ID NO: 3441360 - DNA, 18 bp, Homo sapiens
tggctgaaattctcctgg

SEQ ID NO: 3441361 - DNA, 19 bp, Homo sapiens
tggctgaaattctcctgga

SEQ ID NO: 3441362 - DNA, 20 bp, Homo sapiens
tggctgaaattctcctggag

SEQ ID NO: 3441363 - DNA, 13 bp, Homo sapiens
tggctgaactcat

SEQ ID NO: 3441364 - DNA, 23 bp, Homo sapiens
tggctgagggatgacttacctgt

SEQ ID NO: 3441365 - DNA, 17 bp, Homo sapiens
tggctgcctcatttaga

SEQ ID NO: 3441366 - DNA, 11 bp, Homo sapiens
tggctgctgcc

SEQ ID NO: 3441367 - DNA, 12 bp, Homo sapiens
tggctgctgccc

SEQ ID NO: 3441368 - DNA, 14 bp, Homo sapiens
tggctgctgcccag

SEQ ID NO: 3441369 - DNA, 21 bp, Homo sapiens
tggctggaagatcctgcgggt

SEQ ID NO: 3441370 - DNA, 21 bp, Homo sapiens
tggctggccttccacttggct

SEQ ID NO: 3441371 - DNA, 19 bp, Homo sapiens
tggctgggacgtggctcag

SEQ ID NO: 3441372 - DNA, 15 bp, Homo sapiens
tggctgggggcctca

SEQ ID NO: 3441373 - DNA, 19 bp, Homo sapiens
tggctggggtggcctgtgt

SEQ ID NO: 3441374 - DNA, 16 bp, Homo sapiens
tggctgtaatcatttg

SEQ ID NO: 3441375 - DNA, 22 bp, Homo sapiens
tggctgtaatcatttgtttaca

SEQ ID NO: 3441376 - DNA, 20 bp, Homo sapiens
tggctgtgtaaccttgggtg

SEQ ID NO: 3441377 - DNA, 15 bp, Homo sapiens
tggctgtgtctaaac

SEQ ID NO: 3441378 - DNA, 17 bp, Homo sapiens
tggctgtgtctaaactg

SEQ ID NO: 3441379 - DNA, 15 bp, Homo sapiens
tggctgttggctggg

SEQ ID NO: 3441380 - DNA, 16 bp, Homo sapiens
tggctgttggctgggg

SEQ ID NO: 3441381 - DNA, 18 bp, Homo sapiens
tggctgttggctgggggc

SEQ ID NO: 3441382 - DNA, 23 bp, Homo sapiens
tggctgttggctgggggcctcag

SEQ ID NO: 3441383 - DNA, 17 bp, Homo sapiens
tggcttaaaacaacact

SEQ ID NO: 3441384 - DNA, 13 bp, Homo sapiens
tggcttaaaatgt

SEQ ID NO: 3441385 - DNA, 15 bp, Homo sapiens
tggcttatccagctg

SEQ ID NO: 3441386 - DNA, 23 bp, Homo sapiens
tggcttcacggaagagccttgcg

SEQ ID NO: 3441387 - DNA, 20 bp, Homo sapiens
tggcttcattagagcaggcg

SEQ ID NO: 3441388 - DNA, 15 bp, Homo sapiens
tggcttctggccagg

SEQ ID NO: 3441389 - DNA, 17 bp, Homo sapiens
tggcttctggccaggaa

SEQ ID NO: 3441390 - DNA, 16 bp, Homo sapiens
tggcttgggcagcatc

SEQ ID NO: 3441391 - DNA, 16 bp, Homo sapiens
tggctttatgcacatt

SEQ ID NO: 3441392 - DNA, 21 bp, Homo sapiens
tggctttttactattaacatg

SEQ ID NO: 3441393 - DNA, 23 bp, Homo sapiens
tggctttttactattaacatgat

SEQ ID NO: 3441394 - DNA, 18 bp, Homo sapiens
tgggaaacttggctcgaa

SEQ ID NO: 3441395 - DNA, 16 bp, Homo sapiens
tgggaaaggagtagaa

SEQ ID NO: 3441396 - DNA, 17 bp, Homo sapiens
tgggaacactggcagac

SEQ ID NO: 3441397 - DNA, 17 bp, Homo sapiens
tgggaactggagggtga

SEQ ID NO: 3441398 - DNA, 13 bp, Homo sapiens
tgggaagaggact

SEQ ID NO: 3441399 - DNA, 18 bp, Homo sapiens
tgggaagaggacttcggg

SEQ ID NO: 3441400 - DNA, 21 bp, Homo sapiens
tgggaagcctttactgaccct

SEQ ID NO: 3441401 - DNA, 22 bp, Homo sapiens
tgggaaggggacccccgccccc

SEQ ID NO: 3441402 - DNA, 13 bp, Homo sapiens
tgggaatatttga

SEQ ID NO: 3441403 - DNA, 22 bp, Homo sapiens
tgggaatatttgaatcttgtct

SEQ ID NO: 3441404 - DNA, 20 bp, Homo sapiens
tgggaatgttacattgtttg

SEQ ID NO: 3441405 - DNA, 16 bp, Homo sapiens
tgggaatgtttgtctc

SEQ ID NO: 3441406 - DNA, 22 bp, Homo sapiens
tgggacaggctcttctttccca

SEQ ID NO: 3441407 - DNA, 15 bp, Homo sapiens
tgggacgtggctcag

SEQ ID NO: 3441408 - DNA, 21 bp, Homo sapiens
tgggacgtggctcagccagca

SEQ ID NO: 3441409 - DNA, 18 bp, Homo sapiens
tgggactcaatgcactga

SEQ ID NO: 3441410 - DNA, 20 bp, Homo sapiens
tgggactcaatgcactgaca

SEQ ID NO: 3441411 - DNA, 23 bp, Homo sapiens
tgggactcagccttcagacagag

SEQ ID NO: 3441412 - DNA, 14 bp, Homo sapiens
tgggactccaggtc

SEQ ID NO: 3441413 - DNA, 16 bp, Homo sapiens
tgggactccaggtctt

SEQ ID NO: 3441414 - DNA, 21 bp, Homo sapiens
tgggagaattcttacatgttt

SEQ ID NO: 3441415 - DNA, 23 bp, Homo sapiens
tgggagattcaagggacccatga

SEQ ID NO: 3441416 - DNA, 13 bp, Homo sapiens
tgggagccactgc

SEQ ID NO: 3441417 - DNA, 15 bp, Homo sapiens
tgggagccactgcca

SEQ ID NO: 3441418 - DNA, 16 bp, Homo sapiens
tgggagccactgccac

SEQ ID NO: 3441419 - DNA, 17 bp, Homo sapiens
tgggagccactgccact

SEQ ID NO: 3441420 - DNA, 14 bp, Homo sapiens
tgggagccgggtct

SEQ ID NO: 3441421 - DNA, 16 bp, Homo sapiens
tgggagctccactctg

SEQ ID NO: 3441422 - DNA, 22 bp, Homo sapiens
tgggagctgaggccacactcag

SEQ ID NO: 3441423 - DNA, 23 bp, Homo sapiens
tgggagctgcctgttcagctcca

SEQ ID NO: 3441424 - DNA, 18 bp, Homo sapiens
tgggaggatctcttgagc

SEQ ID NO: 3441425 - DNA, 22 bp, Homo sapiens
tgggaggatctcttgagcctgg

SEQ ID NO: 3441426 - DNA, 18 bp, Homo sapiens
tgggaggattgcttgagc

SEQ ID NO: 3441427 - DNA, 21 bp, Homo sapiens
tgggaggattgcttgagctca

SEQ ID NO: 3441428 - DNA, 22 bp, Homo sapiens
tgggaggattgcttgagctcag

SEQ ID NO: 3441429 - DNA, 20 bp, Homo sapiens
tgggaggccaaggtgggagg

SEQ ID NO: 3441430 - DNA, 18 bp, Homo sapiens
tgggaggccccactgggg

SEQ ID NO: 3441431 - DNA, 19 bp, Homo sapiens
tgggaggtatgggctgggg

SEQ ID NO: 3441432 - DNA, 19 bp, Homo sapiens
tgggaggttgatcagatct

SEQ ID NO: 3441433 - DNA, 15 bp, Homo sapiens
tgggagtcacacagt

SEQ ID NO: 3441434 - DNA, 17 bp, Homo sapiens
tgggatagagaatgttc

SEQ ID NO: 3441435 - DNA, 20 bp, Homo sapiens
tgggatgtggttttcttaag

SEQ ID NO: 3441436 - DNA, 22 bp, Homo sapiens
tgggattacaagcgtgagccac

SEQ ID NO: 3441437 - DNA, 17 bp, Homo sapiens
tgggattcaggaatgtg

SEQ ID NO: 3441438 - DNA, 19 bp, Homo sapiens
tgggattgagtctgtgcca

SEQ ID NO: 3441439 - DNA, 21 bp, Homo sapiens
tgggcaaagcctagtgaaggc

SEQ ID NO: 3441440 - DNA, 20 bp, Homo sapiens
tgggcaacccccagcctgct

SEQ ID NO: 3441441 - DNA, 14 bp, Homo sapiens
tgggcaaggaggcc

SEQ ID NO: 3441442 - DNA, 15 bp, Homo sapiens
tgggcaatatagcaa

SEQ ID NO: 3441443 - DNA, 13 bp, Homo sapiens
tgggcaatttaga

SEQ ID NO: 3441444 - DNA, 22 bp, Homo sapiens
tgggcacacgcctcccactggg

SEQ ID NO: 3441445 - DNA, 16 bp, Homo sapiens
tgggcacccaccctgg

SEQ ID NO: 3441446 - DNA, 20 bp, Homo sapiens
tgggcacccaccctgggacc

SEQ ID NO: 3441447 - DNA, 16 bp, Homo sapiens
tgggcagagctggctc

SEQ ID NO: 3441448 - DNA, 17 bp, Homo sapiens
tgggcagcacaaggcct

SEQ ID NO: 3441449 - DNA, 13 bp, Homo sapiens
tgggcaggaaaag

SEQ ID NO: 3441450 - DNA, 18 bp, Homo sapiens
tgggcaggactcagctcc

SEQ ID NO: 3441451 - DNA, 22 bp, Homo sapiens
tgggcaggactcagctccccag

SEQ ID NO: 3441452 - DNA, 22 bp, Homo sapiens
tgggcatagatgcaggtgagcc

SEQ ID NO: 3441453 - DNA, 23 bp, Homo sapiens
tgggcattgatggggaaggaggc

SEQ ID NO: 3441454 - DNA, 14 bp, Homo sapiens
tgggccaagccagc

SEQ ID NO: 3441455 - DNA, 15 bp, Homo sapiens
tgggccactgtggtg

SEQ ID NO: 3441456 - DNA, 19 bp, Homo sapiens
tgggccattctccacagca

SEQ ID NO: 3441457 - DNA, 20 bp, Homo sapiens
tgggccattctccacagcaa

SEQ ID NO: 3441458 - DNA, 23 bp, Homo sapiens
tgggcccctggccccgcctgcct

SEQ ID NO: 3441459 - DNA, 16 bp, Homo sapiens
tgggccctctctgctc

SEQ ID NO: 3441460 - DNA, 18 bp, Homo sapiens
tgggccctctctgctctg

SEQ ID NO: 3441461 - DNA, 15 bp, Homo sapiens
tgggccgggcctggg

SEQ ID NO: 3441462 - DNA, 22 bp, Homo sapiens
tgggcctcagtgtgcccatctg

SEQ ID NO: 3441463 - DNA, 18 bp, Homo sapiens
tgggcctgctccagacct

SEQ ID NO: 3441464 - DNA, 16 bp, Homo sapiens
tgggcctttgagcctg

SEQ ID NO: 3441465 - DNA, 17 bp, Homo sapiens
tgggcgtacgctggtgc

SEQ ID NO: 3441466 - DNA, 22 bp, Homo sapiens
tgggctaagtgatcctcccacc

SEQ ID NO: 3441467 - DNA, 14 bp, Homo sapiens
tgggctctggctct

SEQ ID NO: 3441468 - DNA, 20 bp, Homo sapiens
tgggctgaactgagcctagc

SEQ ID NO: 3441469 - DNA, 21 bp, Homo sapiens
tgggctgaactgagcctagct

SEQ ID NO: 3441470 - DNA, 11 bp, Homo sapiens
tgggctgaggg

SEQ ID NO: 3441471 - DNA, 16 bp, Homo sapiens
tgggctgagggagcct

SEQ ID NO: 3441472 - DNA, 14 bp, Homo sapiens
tgggctgggccctc

SEQ ID NO: 3441473 - DNA, 20 bp, Homo sapiens
tgggctgggccctctcttct

SEQ ID NO: 3441474 - DNA, 17 bp, Homo sapiens
tgggctggtgtcacctg

SEQ ID NO: 3441475 - DNA, 22 bp, Homo sapiens
tgggcttcagcctagtggcttg

SEQ ID NO: 3441476 - DNA, 18 bp, Homo sapiens
tgggcttcagggcaggtg

SEQ ID NO: 3441477 - DNA, 19 bp, Homo sapiens
tgggcttcagtggcagctg

SEQ ID NO: 3441478 - DNA, 21 bp, Homo sapiens
tgggcttcagtggcagctgct

SEQ ID NO: 3441479 - DNA, 19 bp, Homo sapiens
tgggcttcccagtggctgc

SEQ ID NO: 3441480 - DNA, 22 bp, Homo sapiens
tgggcttcccagtggctgctgc

SEQ ID NO: 3441481 - DNA, 23 bp, Homo sapiens
tgggcttcccagtggctgctgcc

SEQ ID NO: 3441482 - DNA, 21 bp, Homo sapiens
tgggcttgtctgtagatttta

SEQ ID NO: 3441483 - DNA, 21 bp, Homo sapiens
tggggaaaggggacaaggaag

SEQ ID NO: 3441484 - DNA, 21 bp, Homo sapiens
tggggaaaggggtcggctgac

SEQ ID NO: 3441485 - DNA, 23 bp, Homo sapiens
tggggaaaggggtcggctgacca

SEQ ID NO: 3441486 - DNA, 11 bp, Homo sapiens
tggggaagagt

SEQ ID NO: 3441487 - DNA, 13 bp, Homo sapiens
tggggaaggaggc

SEQ ID NO: 3441488 - DNA, 19 bp, Homo sapiens
tggggactccggctgtgct

SEQ ID NO: 3441489 - DNA, 17 bp, Homo sapiens
tggggagactgggctga

SEQ ID NO: 3441490 - DNA, 22 bp, Homo sapiens
tggggagggattctggttccag

SEQ ID NO: 3441491 - DNA, 17 bp, Homo sapiens
tggggagttaagacctg

SEQ ID NO: 3441492 - DNA, 19 bp, Homo sapiens
tggggagttaagacctggc

SEQ ID NO: 3441493 - DNA, 20 bp, Homo sapiens
tggggagttaagacctggca

SEQ ID NO: 3441494 - DNA, 18 bp, Homo sapiens
tggggatcaaagttctgc

SEQ ID NO: 3441495 - DNA, 23 bp, Homo sapiens
tggggatgagaaaggttgaagca

SEQ ID NO: 3441496 - DNA, 23 bp, Homo sapiens
tggggattgggtgggcaggaaaa

SEQ ID NO: 3441497 - DNA, 18 bp, Homo sapiens
tggggcagctgagcagct

SEQ ID NO: 3441498 - DNA, 13 bp, Homo sapiens
tggggcagcttga

SEQ ID NO: 3441499 - DNA, 14 bp, Homo sapiens
tggggcaggcagtg

SEQ ID NO: 3441500 - DNA, 14 bp, Homo sapiens
tggggccagatcca

SEQ ID NO: 3441501 - DNA, 19 bp, Homo sapiens
tggggccagatccagcctg

SEQ ID NO: 3441502 - DNA, 12 bp, Homo sapiens
tggggccctaat

SEQ ID NO: 3441503 - DNA, 21 bp, Homo sapiens
tggggccctaattcagccatg

SEQ ID NO: 3441504 - DNA, 19 bp, Homo sapiens
tggggccgccgcctctttc

SEQ ID NO: 3441505 - DNA, 14 bp, Homo sapiens
tggggcctccagaa

SEQ ID NO: 3441506 - DNA, 20 bp, Homo sapiens
tggggccttgatgactgcct

SEQ ID NO: 3441507 - DNA, 20 bp, Homo sapiens
tggggctagggggagcccct

SEQ ID NO: 3441508 - DNA, 13 bp, Homo sapiens
tggggctgctggc

SEQ ID NO: 3441509 - DNA, 14 bp, Homo sapiens
tggggctggcctcc

SEQ ID NO: 3441510 - DNA, 13 bp, Homo sapiens
tggggctggcttt

SEQ ID NO: 3441511 - DNA, 12 bp, Homo sapiens
tggggctgtgtt

SEQ ID NO: 3441512 - DNA, 18 bp, Homo sapiens
tgggggaactcagatcca

SEQ ID NO: 3441513 - DNA, 21 bp, Homo sapiens
tgggggatcacagcctctgaa

SEQ ID NO: 3441514 - DNA, 13 bp, Homo sapiens
tgggggcagggct

SEQ ID NO: 3441515 - DNA, 18 bp, Homo sapiens
tgggggctctggccaagg

SEQ ID NO: 3441516 - DNA, 19 bp, Homo sapiens
tggggggctgaggtgggag

SEQ ID NO: 3441517 - DNA, 10 bp, Homo sapiens
tgggggtggg

SEQ ID NO: 3441518 - DNA, 21 bp, Homo sapiens
tggggtaccaagagactcctt

SEQ ID NO: 3441519 - DNA, 14 bp, Homo sapiens
tggggtacccactg

SEQ ID NO: 3441520 - DNA, 15 bp, Homo sapiens
tggggtacccactgc

SEQ ID NO: 3441521 - DNA, 18 bp, Homo sapiens
tggggtacccactgctct

SEQ ID NO: 3441522 - DNA, 20 bp, Homo sapiens
tggggtacccactgctctgg

SEQ ID NO: 3441523 - DNA, 18 bp, Homo sapiens
tggggtagctagaggaac

SEQ ID NO: 3441524 - DNA, 20 bp, Homo sapiens
tggggtagctagaggaacca

SEQ ID NO: 3441525 - DNA, 14 bp, Homo sapiens
tggggtccagggag

SEQ ID NO: 3441526 - DNA, 19 bp, Homo sapiens
tggggtcctggccatccca

SEQ ID NO: 3441527 - DNA, 16 bp, Homo sapiens
tggggtctgtaaaatc

SEQ ID NO: 3441528 - DNA, 15 bp, Homo sapiens
tgggtaaaattagat

SEQ ID NO: 3441529 - DNA, 24 bp, Homo sapiens
tgggtaaaattagatgcatgttga

SEQ ID NO: 3441530 - DNA, 16 bp, Homo sapiens
tgggtaactagggaag

SEQ ID NO: 3441531 - DNA, 18 bp, Homo sapiens
tgggtacttgtggacaca

SEQ ID NO: 3441532 - DNA, 23 bp, Homo sapiens
tgggtatgttaacctaggcagtg

SEQ ID NO: 3441533 - DNA, 14 bp, Homo sapiens
tgggtattaccatg

SEQ ID NO: 3441534 - DNA, 15 bp, Homo sapiens
tgggtattaccatgt

SEQ ID NO: 3441535 - DNA, 19 bp, Homo sapiens
tgggtattaccatgtaaat

SEQ ID NO: 3441536 - DNA, 16 bp, Homo sapiens
tgggtcatagaaattc

SEQ ID NO: 3441537 - DNA, 15 bp, Homo sapiens
tgggtccaggggatg

SEQ ID NO: 3441538 - DNA, 17 bp, Homo sapiens
tgggtccatgggcagag

SEQ ID NO: 3441539 - DNA, 18 bp, Homo sapiens
tgggtccatgggcagagc

SEQ ID NO: 3441540 - DNA, 14 bp, Homo sapiens
tgggtcgggagagg

SEQ ID NO: 3441541 - DNA, 19 bp, Homo sapiens
tgggtcgggagaggggacg

SEQ ID NO: 3441542 - DNA, 22 bp, Homo sapiens
tgggtctcgctttgttgcccag

SEQ ID NO: 3441543 - DNA, 15 bp, Homo sapiens
tgggtgaaggctggc

SEQ ID NO: 3441544 - DNA, 23 bp, Homo sapiens
tgggtgtcaagagggtctgagga

SEQ ID NO: 3441545 - DNA, 14 bp, Homo sapiens
tgggtgtgtgactc

SEQ ID NO: 3441546 - DNA, 15 bp, Homo sapiens
tgggtgttcctggca

SEQ ID NO: 3441547 - DNA, 20 bp, Homo sapiens
tgggtgttcctggcagttta

SEQ ID NO: 3441548 - DNA, 14 bp, Homo sapiens
tgggttctgcctgc

SEQ ID NO: 3441549 - DNA, 19 bp, Homo sapiens
tgggttctgcctgccagct

SEQ ID NO: 3441550 - DNA, 17 bp, Homo sapiens
tgggtttgaagctgctg

SEQ ID NO: 3441551 - DNA, 16 bp, Homo sapiens
tgggtttttcatcttt

SEQ ID NO: 3441552 - DNA, 19 bp, Homo sapiens
tggtaaacgctgtccctag

SEQ ID NO: 3441553 - DNA, 14 bp, Homo sapiens
tggtaattgtacta

SEQ ID NO: 3441554 - DNA, 14 bp, Homo sapiens
tggtacaaaaataa

SEQ ID NO: 3441555 - DNA, 13 bp, Homo sapiens
tggtaccagatgc

SEQ ID NO: 3441556 - DNA, 15 bp, Homo sapiens
tggtacgtgaccctc

SEQ ID NO: 3441557 - DNA, 16 bp, Homo sapiens
tggtaggcatttccta

SEQ ID NO: 3441558 - DNA, 18 bp, Homo sapiens
tggtatgatgctgccggc

SEQ ID NO: 3441559 - DNA, 22 bp, Homo sapiens
tggtattgtatttattcaataa

SEQ ID NO: 3441560 - DNA, 22 bp, Homo sapiens
tggtcaaacaaactctctgaac

SEQ ID NO: 3441561 - DNA, 15 bp, Homo sapiens
tggtcaatcaacact

SEQ ID NO: 3441562 - DNA, 14 bp, Homo sapiens
tggtcacacactga

SEQ ID NO: 3441563 - DNA, 15 bp, Homo sapiens
tggtcacacactgat

SEQ ID NO: 3441564 - DNA, 14 bp, Homo sapiens
tggtcagagccaca

SEQ ID NO: 3441565 - DNA, 15 bp, Homo sapiens
tggtcagagccacag

SEQ ID NO: 3441566 - DNA, 17 bp, Homo sapiens
tggtcagagccacaggg

SEQ ID NO: 3441567 - DNA, 21 bp, Homo sapiens
tggtcagagccacagggtctg

SEQ ID NO: 3441568 - DNA, 22 bp, Homo sapiens
tggtcagccctagggtggagag

SEQ ID NO: 3441569 - DNA, 13 bp, Homo sapiens
tggtccacagggc

SEQ ID NO: 3441570 - DNA, 14 bp, Homo sapiens
tggtccacagggca

SEQ ID NO: 3441571 - DNA, 13 bp, Homo sapiens
tggtcccactcag

SEQ ID NO: 3441572 - DNA, 12 bp, Homo sapiens
tggtcctaccca

SEQ ID NO: 3441573 - DNA, 21 bp, Homo sapiens
tggtcctagaggccctttgct

SEQ ID NO: 3441574 - DNA, 13 bp, Homo sapiens
tggtcgctcctgc

SEQ ID NO: 3441575 - DNA, 16 bp, Homo sapiens
tggtctaaagtgttta

SEQ ID NO: 3441576 - DNA, 17 bp, Homo sapiens
tggtctaaagtgtttag

SEQ ID NO: 3441577 - DNA, 18 bp, Homo sapiens
tggtctaaagtgtttagc

SEQ ID NO: 3441578 - DNA, 17 bp, Homo sapiens
tggtctcaaactcttga

SEQ ID NO: 3441579 - DNA, 17 bp, Homo sapiens
tggtctctaggctgggg

SEQ ID NO: 3441580 - DNA, 19 bp, Homo sapiens
tggtctctaggctggggaa

SEQ ID NO: 3441581 - DNA, 19 bp, Homo sapiens
tggtctctgcatttttctg

SEQ ID NO: 3441582 - DNA, 15 bp, Homo sapiens
tggtctgcaggcagg

SEQ ID NO: 3441583 - DNA, 22 bp, Homo sapiens
tggtctgggtgtagctcttaga

SEQ ID NO: 3441584 - DNA, 14 bp, Homo sapiens
tggtcttccttttt

SEQ ID NO: 3441585 - DNA, 17 bp, Homo sapiens
tggtcttggcagcacct

SEQ ID NO: 3441586 - DNA, 20 bp, Homo sapiens
tggtctttcttacaaggaag

SEQ ID NO: 3441587 - DNA, 22 bp, Homo sapiens
tggtgacctctgcctgaagtca

SEQ ID NO: 3441588 - DNA, 19 bp, Homo sapiens
tggtgatccaaacaaaatg

SEQ ID NO: 3441589 - DNA, 17 bp, Homo sapiens
tggtgccacaaataaaa

SEQ ID NO: 3441590 - DNA, 20 bp, Homo sapiens
tggtgccagatcctcttctc

SEQ ID NO: 3441591 - DNA, 18 bp, Homo sapiens
tggtgccccaggaccagc

SEQ ID NO: 3441592 - DNA, 23 bp, Homo sapiens
tggtgctgagtagatgcgcagcc

SEQ ID NO: 3441593 - DNA, 19 bp, Homo sapiens
tggtgctgctgctgctgtg

SEQ ID NO: 3441594 - DNA, 18 bp, Homo sapiens
tggtggaaaacgaagctc

SEQ ID NO: 3441595 - DNA, 14 bp, Homo sapiens
tggtggaggattgc

SEQ ID NO: 3441596 - DNA, 20 bp, Homo sapiens
tggtggaggattgctgccag

SEQ ID NO: 3441597 - DNA, 13 bp, Homo sapiens
tggtggagggcca

SEQ ID NO: 3441598 - DNA, 12 bp, Homo sapiens
tggtggcagctg

SEQ ID NO: 3441599 - DNA, 19 bp, Homo sapiens
tggtggcagtggaggtggg

SEQ ID NO: 3441600 - DNA, 20 bp, Homo sapiens
tggtggcagtgggagctgcc

SEQ ID NO: 3441601 - DNA, 16 bp, Homo sapiens
tggtggcctggtccct

SEQ ID NO: 3441602 - DNA, 23 bp, Homo sapiens
tggtgggccaacaaagaacacta

SEQ ID NO: 3441603 - DNA, 18 bp, Homo sapiens
tggtgggcttcagggcag

SEQ ID NO: 3441604 - DNA, 15 bp, Homo sapiens
tggtggtttgattgt

SEQ ID NO: 3441605 - DNA, 17 bp, Homo sapiens
tggtggtttgattgttt

SEQ ID NO: 3441606 - DNA, 16 bp, Homo sapiens
tggtgtcacctgaaga

SEQ ID NO: 3441607 - DNA, 11 bp, Homo sapiens
tggtgtctcca

SEQ ID NO: 3441608 - DNA, 20 bp, Homo sapiens
tggtgtctccaaccccccag

SEQ ID NO: 3441609 - DNA, 18 bp, Homo sapiens
tggtgtgatcgtctgact

SEQ ID NO: 3441610 - DNA, 15 bp, Homo sapiens
tggtgtgggtgtcct

SEQ ID NO: 3441611 - DNA, 16 bp, Homo sapiens
tggtgtgggtgtcctg

SEQ ID NO: 3441612 - DNA, 23 bp, Homo sapiens
tggtgtgggtgtcctgcctgtct

SEQ ID NO: 3441613 - DNA, 20 bp, Homo sapiens
tggttaaaaaaaagaataaa

SEQ ID NO: 3441614 - DNA, 12 bp, Homo sapiens
tggttccagggt

SEQ ID NO: 3441615 - DNA, 11 bp, Homo sapiens
tggttctcatc

SEQ ID NO: 3441616 - DNA, 14 bp, Homo sapiens
tggttctcatcttt

SEQ ID NO: 3441617 - DNA, 20 bp, Homo sapiens
tggttctgatgatgtgcctg

SEQ ID NO: 3441618 - DNA, 12 bp, Homo sapiens
tggttctggcca

SEQ ID NO: 3441619 - DNA, 13 bp, Homo sapiens
tggttctgtgcca

SEQ ID NO: 3441620 - DNA, 15 bp, Homo sapiens
tggttgactgggttt

SEQ ID NO: 3441621 - DNA, 12 bp, Homo sapiens
tggttgaggaaa

SEQ ID NO: 3441622 - DNA, 23 bp, Homo sapiens
tggttgattggggtttgatttgc

SEQ ID NO: 3441623 - DNA, 20 bp, Homo sapiens
tggttgcacttatgatttca

SEQ ID NO: 3441624 - DNA, 14 bp, Homo sapiens
tggttgtattagat

SEQ ID NO: 3441625 - DNA, 16 bp, Homo sapiens
tggttgtattagatgt

SEQ ID NO: 3441626 - DNA, 18 bp, Homo sapiens
tggtttctcagaatccaa

SEQ ID NO: 3441627 - DNA, 19 bp, Homo sapiens
tggtttggccatctctgga

SEQ ID NO: 3441628 - DNA, 20 bp, Homo sapiens
tggtttgggaatatccatgt

SEQ ID NO: 3441629 - DNA, 14 bp, Homo sapiens
tggttttcctgaaa

SEQ ID NO: 3441630 - DNA, 20 bp, Homo sapiens
tggttttgttcccctcctcc

SEQ ID NO: 3441631 - DNA, 19 bp, Homo sapiens
tgtaaaaaattcacataat

SEQ ID NO: 3441632 - DNA, 22 bp, Homo sapiens
tgtaaaaaattcacataataaa

SEQ ID NO: 3441633 - DNA, 21 bp, Homo sapiens
tgtaaaaggccaaacctctgt

SEQ ID NO: 3441634 - DNA, 14 bp, Homo sapiens
tgtaaaatctttct

SEQ ID NO: 3441635 - DNA, 22 bp, Homo sapiens
tgtaaaatctttctttcttaga

SEQ ID NO: 3441636 - DNA, 14 bp, Homo sapiens
tgtaaaatgtaatg

SEQ ID NO: 3441637 - DNA, 16 bp, Homo sapiens
tgtaaaggaatttaaa

SEQ ID NO: 3441638 - DNA, 19 bp, Homo sapiens
tgtaaaggagtcaaaacta

SEQ ID NO: 3441639 - DNA, 15 bp, Homo sapiens
tgtaaaggggcagct

SEQ ID NO: 3441640 - DNA, 15 bp, Homo sapiens
tgtaaagtgaagaat

SEQ ID NO: 3441641 - DNA, 21 bp, Homo sapiens
tgtaaagtgaagaatcctttt

SEQ ID NO: 3441642 - DNA, 19 bp, Homo sapiens
tgtaaagttggttggataa

SEQ ID NO: 3441643 - DNA, 13 bp, Homo sapiens
tgtaaataaagcc

SEQ ID NO: 3441644 - DNA, 18 bp, Homo sapiens
tgtaaataaagccctggg

SEQ ID NO: 3441645 - DNA, 20 bp, Homo sapiens
tgtaaataagttttttttct

SEQ ID NO: 3441646 - DNA, 16 bp, Homo sapiens
tgtaaataatctgtga

SEQ ID NO: 3441647 - DNA, 16 bp, Homo sapiens
tgtaaatagctcaggt

SEQ ID NO: 3441648 - DNA, 18 bp, Homo sapiens
tgtaaataggatttttag

SEQ ID NO: 3441649 - DNA, 18 bp, Homo sapiens
tgtaaataggttcttctt

SEQ ID NO: 3441650 - DNA, 16 bp, Homo sapiens
tgtaaatcacatcctt

SEQ ID NO: 3441651 - DNA, 17 bp, Homo sapiens
tgtaacaagccacccca

SEQ ID NO: 3441652 - DNA, 16 bp, Homo sapiens
tgtaacactgatgata

SEQ ID NO: 3441653 - DNA, 18 bp, Homo sapiens
tgtaacatgatgttaact

SEQ ID NO: 3441654 - DNA, 21 bp, Homo sapiens
tgtaaccttgggtggcccctg

SEQ ID NO: 3441655 - DNA, 21 bp, Homo sapiens
tgtaactgaggactgtttgca

SEQ ID NO: 3441656 - DNA, 18 bp, Homo sapiens
tgtaactttttacattac

SEQ ID NO: 3441657 - DNA, 19 bp, Homo sapiens
tgtaactttttacattaca

SEQ ID NO: 3441658 - DNA, 22 bp, Homo sapiens
tgtaagaaacacactgaggcag

SEQ ID NO: 3441659 - DNA, 18 bp, Homo sapiens
tgtaagaactacaaacaa

SEQ ID NO: 3441660 - DNA, 22 bp, Homo sapiens
tgtaagaataggcattaacaca

SEQ ID NO: 3441661 - DNA, 18 bp, Homo sapiens
tgtaagacgtatgtaaca

SEQ ID NO: 3441662 - DNA, 19 bp, Homo sapiens
tgtaagacgtatgtaacat

SEQ ID NO: 3441663 - DNA, 12 bp, Homo sapiens
tgtaaggcctta

SEQ ID NO: 3441664 - DNA, 22 bp, Homo sapiens
tgtaaggtgttcagtagagcta

SEQ ID NO: 3441665 - DNA, 19 bp, Homo sapiens
tgtaagtgaagtaaaactt

SEQ ID NO: 3441666 - DNA, 17 bp, Homo sapiens
tgtaataacatttaatt

SEQ ID NO: 3441667 - DNA, 13 bp, Homo sapiens
tgtaatatgaaat

SEQ ID NO: 3441668 - DNA, 21 bp, Homo sapiens
tgtaatcccagctactcgaga

SEQ ID NO: 3441669 - DNA, 22 bp, Homo sapiens
tgtaatcccagctacttgggag

SEQ ID NO: 3441670 - DNA, 16 bp, Homo sapiens
tgtaatccgaatctct

SEQ ID NO: 3441671 - DNA, 21 bp, Homo sapiens
tgtaatcttgaattgtaactg

SEQ ID NO: 3441672 - DNA, 20 bp, Homo sapiens
tgtaatggagcatcaagcca

SEQ ID NO: 3441673 - DNA, 16 bp, Homo sapiens
tgtaattgttcctttt

SEQ ID NO: 3441674 - DNA, 19 bp, Homo sapiens
tgtaattgtttgtctttaa

SEQ ID NO: 3441675 - DNA, 18 bp, Homo sapiens
tgtaattttactttttat

SEQ ID NO: 3441676 - DNA, 14 bp, Homo sapiens
tgtacaaaggggaa

SEQ ID NO: 3441677 - DNA, 16 bp, Homo sapiens
tgtacaagatgaagga

SEQ ID NO: 3441678 - DNA, 13 bp, Homo sapiens
tgtacaatcatgt

SEQ ID NO: 3441679 - DNA, 14 bp, Homo sapiens
tgtacaatcatgtt

SEQ ID NO: 3441680 - DNA, 15 bp, Homo sapiens
tgtacaatcatgttc

SEQ ID NO: 3441681 - DNA, 14 bp, Homo sapiens
tgtacacattttgt

SEQ ID NO: 3441682 - DNA, 23 bp, Homo sapiens
tgtacagaatatttctattgaat

SEQ ID NO: 3441683 - DNA, 17 bp, Homo sapiens
tgtacagacatatttaa

SEQ ID NO: 3441684 - DNA, 14 bp, Homo sapiens
tgtacatctatttt

SEQ ID NO: 3441685 - DNA, 19 bp, Homo sapiens
tgtacatctattttggatt

SEQ ID NO: 3441686 - DNA, 21 bp, Homo sapiens
tgtacatctattttggattgt

SEQ ID NO: 3441687 - DNA, 23 bp, Homo sapiens
tgtacccacgctgggtattacca

SEQ ID NO: 3441688 - DNA, 19 bp, Homo sapiens
tgtacctcctctcagtgtt

SEQ ID NO: 3441689 - DNA, 16 bp, Homo sapiens
tgtacgtctgacaggc

SEQ ID NO: 3441690 - DNA, 16 bp, Homo sapiens
tgtactaaagccaaac

SEQ ID NO: 3441691 - DNA, 13 bp, Homo sapiens
tgtactagtttta

SEQ ID NO: 3441692 - DNA, 15 bp, Homo sapiens
tgtactattgcagac

SEQ ID NO: 3441693 - DNA, 14 bp, Homo sapiens
tgtactctcctttt

SEQ ID NO: 3441694 - DNA, 17 bp, Homo sapiens
tgtactgtatgtgatga

SEQ ID NO: 3441695 - DNA, 21 bp, Homo sapiens
tgtacttcccgggccagggct

SEQ ID NO: 3441696 - DNA, 22 bp, Homo sapiens
tgtacttcccgggccagggctg

SEQ ID NO: 3441697 - DNA, 15 bp, Homo sapiens
tgtactttgcttgct

SEQ ID NO: 3441698 - DNA, 11 bp, Homo sapiens
tgtactttgtg

SEQ ID NO: 3441699 - DNA, 17 bp, Homo sapiens
tgtacttttcattctct

SEQ ID NO: 3441700 - DNA, 15 bp, Homo sapiens
tgtactttttccaga

SEQ ID NO: 3441701 - DNA, 23 bp, Homo sapiens
tgtagaaaatttgttattttgca

SEQ ID NO: 3441702 - DNA, 13 bp, Homo sapiens
tgtagaaatggtt

SEQ ID NO: 3441703 - DNA, 21 bp, Homo sapiens
tgtagaaatggttgtattaga

SEQ ID NO: 3441704 - DNA, 17 bp, Homo sapiens
tgtagaagtctttcaga

SEQ ID NO: 3441705 - DNA, 14 bp, Homo sapiens
tgtagagtgggagc

SEQ ID NO: 3441706 - DNA, 19 bp, Homo sapiens
tgtagatggaaaaacttgt

SEQ ID NO: 3441707 - DNA, 23 bp, Homo sapiens
tgtagatggaaaaacttgtgcta

SEQ ID NO: 3441708 - DNA, 15 bp, Homo sapiens
tgtagccttcacaca

SEQ ID NO: 3441709 - DNA, 22 bp, Homo sapiens
tgtaggaaccgtggtatgtctg

SEQ ID NO: 3441710 - DNA, 11 bp, Homo sapiens
tgtaggcagac

SEQ ID NO: 3441711 - DNA, 12 bp, Homo sapiens
tgtaggcagaca

SEQ ID NO: 3441712 - DNA, 14 bp, Homo sapiens
tgtaggcagacaca

SEQ ID NO: 3441713 - DNA, 16 bp, Homo sapiens
tgtaggcagaggctgc

SEQ ID NO: 3441714 - DNA, 14 bp, Homo sapiens
tgtaggcctgcctt

SEQ ID NO: 3441715 - DNA, 17 bp, Homo sapiens
tgtaggcttagtttgtg

SEQ ID NO: 3441716 - DNA, 19 bp, Homo sapiens
tgtaggtgaacagtcacgc

SEQ ID NO: 3441717 - DNA, 14 bp, Homo sapiens
tgtagtaattgaca

SEQ ID NO: 3441718 - DNA, 19 bp, Homo sapiens
tgtagtaattgacatgtgc

SEQ ID NO: 3441719 - DNA, 22 bp, Homo sapiens
tgtagtcagaattagctgcttc

SEQ ID NO: 3441720 - DNA, 20 bp, Homo sapiens
tgtagtccgtgctgacagct

SEQ ID NO: 3441721 - DNA, 22 bp, Homo sapiens
tgtagtccgtgctgacagctgc

SEQ ID NO: 3441722 - DNA, 16 bp, Homo sapiens
tgtagtgaagctctca

SEQ ID NO: 3441723 - DNA, 20 bp, Homo sapiens
tgtagtgctcgagtcacatt

SEQ ID NO: 3441724 - DNA, 15 bp, Homo sapiens
tgtagttaggcctgg

SEQ ID NO: 3441725 - DNA, 22 bp, Homo sapiens
tgtagttgcaatagaacagaga

SEQ ID NO: 3441726 - DNA, 16 bp, Homo sapiens
tgtagtttggagacaa

SEQ ID NO: 3441727 - DNA, 10 bp, Homo sapiens
tgtataaaat

SEQ ID NO: 3441728 - DNA, 14 bp, Homo sapiens
tgtataaaatcagc

SEQ ID NO: 3441729 - DNA, 14 bp, Homo sapiens
tgtataaaatgtaa

SEQ ID NO: 3441730 - DNA, 17 bp, Homo sapiens
tgtataagtaagaaaat

SEQ ID NO: 3441731 - DNA, 20 bp, Homo sapiens
tgtataagtggaggcacttt

SEQ ID NO: 3441732 - DNA, 15 bp, Homo sapiens
tgtatagtactggca

SEQ ID NO: 3441733 - DNA, 16 bp, Homo sapiens
tgtatatacaataaca

SEQ ID NO: 3441734 - DNA, 17 bp, Homo sapiens
tgtatatacaataacat

SEQ ID NO: 3441735 - DNA, 18 bp, Homo sapiens
tgtatatacaataacata

SEQ ID NO: 3441736 - DNA, 13 bp, Homo sapiens
tgtatatatatgt

SEQ ID NO: 3441737 - DNA, 21 bp, Homo sapiens
tgtatatatatgtgaggatgt

SEQ ID NO: 3441738 - DNA, 22 bp, Homo sapiens
tgtatatttgtgatagcacttt

SEQ ID NO: 3441739 - DNA, 19 bp, Homo sapiens
tgtatcataattaccaagt

SEQ ID NO: 3441740 - DNA, 19 bp, Homo sapiens
tgtatcccatgagcctcag

SEQ ID NO: 3441741 - DNA, 23 bp, Homo sapiens
tgtatcccatgagcctcagcatc

SEQ ID NO: 3441742 - DNA, 18 bp, Homo sapiens
tgtatctgcaggcagaca

SEQ ID NO: 3441743 - DNA, 15 bp, Homo sapiens
tgtatgctgatcatc

SEQ ID NO: 3441744 - DNA, 23 bp, Homo sapiens
tgtatgctgatcatcgccagagg

SEQ ID NO: 3441745 - DNA, 19 bp, Homo sapiens
tgtatggaatcccactgta

SEQ ID NO: 3441746 - DNA, 16 bp, Homo sapiens
tgtatggcatgacaac

SEQ ID NO: 3441747 - DNA, 15 bp, Homo sapiens
tgtatggttctgtgc

SEQ ID NO: 3441748 - DNA, 14 bp, Homo sapiens
tgtatgtaaatgtg

SEQ ID NO: 3441749 - DNA, 22 bp, Homo sapiens
tgtatgtaaatgtgcattcttt

SEQ ID NO: 3441750 - DNA, 11 bp, Homo sapiens
tgtatgtctgt

SEQ ID NO: 3441751 - DNA, 17 bp, Homo sapiens
tgtatgtttttttccaa

SEQ ID NO: 3441752 - DNA, 20 bp, Homo sapiens
tgtattaaaaaaaacaaaaa

SEQ ID NO: 3441753 - DNA, 21 bp, Homo sapiens
tgtattaaaaaaaacaaaaag

SEQ ID NO: 3441754 - DNA, 22 bp, Homo sapiens
tgtattacaaatccaatgaaat

SEQ ID NO: 3441755 - DNA, 18 bp, Homo sapiens
tgtattagatgttctcta

SEQ ID NO: 3441756 - DNA, 17 bp, Homo sapiens
tgtattcacacacccct

SEQ ID NO: 3441757 - DNA, 11 bp, Homo sapiens
tgtcttcctct

SEQ ID NO: 3441758 - DNA, 14 bp, Homo sapiens
tgtcttcctctgca

SEQ ID NO: 3441759 - DNA, 16 bp, Homo sapiens
tgtcttcctctgcaag

SEQ ID NO: 3441760 - DNA, 21 bp, Homo sapiens
tgtcttcctctgcaagtgctc

SEQ ID NO: 3441761 - DNA, 18 bp, Homo sapiens
tgtcttgccagccagaag

SEQ ID NO: 3441762 - DNA, 15 bp, Homo sapiens
tgtcttgttcatttt

SEQ ID NO: 3441763 - DNA, 13 bp, Homo sapiens
tgtcttgttctgt

SEQ ID NO: 3441764 - DNA, 15 bp, Homo sapiens
tgtcttgttctgtca

SEQ ID NO: 3441765 - DNA, 23 bp, Homo sapiens
tgtctttcagcattcagtccgcc

SEQ ID NO: 3441766 - DNA, 22 bp, Homo sapiens
tgtctttcctaagacctggggt

SEQ ID NO: 3441767 - DNA, 12 bp, Homo sapiens
tgtcttttgaca

SEQ ID NO: 3441768 - DNA, 23 bp, Homo sapiens
tgtgaaaagaaaaatgagcctgg

SEQ ID NO: 3441769 - DNA, 20 bp, Homo sapiens
tgtgaaataaaactggcttt

SEQ ID NO: 3441770 - DNA, 23 bp, Homo sapiens
tgtgaaccaccacacccagccca

SEQ ID NO: 3441771 - DNA, 21 bp, Homo sapiens
tgtgaacgatttagaaagaag

SEQ ID NO: 3441772 - DNA, 18 bp, Homo sapiens
tgtgaactgaaattaaaa

SEQ ID NO: 3441773 - DNA, 16 bp, Homo sapiens
tgtgaagacacctgca

SEQ ID NO: 3441774 - DNA, 19 bp, Homo sapiens
tgtgaagctaatgaccaac

SEQ ID NO: 3441775 - DNA, 19 bp, Homo sapiens
tgtgaaggcagagaaaggg

SEQ ID NO: 3441776 - DNA, 14 bp, Homo sapiens
tgtgaatattttca

SEQ ID NO: 3441777 - DNA, 21 bp, Homo sapiens
tgtgaatctatgctggtgaaa

SEQ ID NO: 3441778 - DNA, 21 bp, Homo sapiens
tgtgacaaggattgctactgt

SEQ ID NO: 3441779 - DNA, 17 bp, Homo sapiens
tgtgacagcctctgcag

SEQ ID NO: 3441780 - DNA, 12 bp, Homo sapiens
tgtgacatgccc

SEQ ID NO: 3441781 - DNA, 14 bp, Homo sapiens
tgtgacattccttc

SEQ ID NO: 3441782 - DNA, 17 bp, Homo sapiens
tgtgacccccagctccg

SEQ ID NO: 3441783 - DNA, 15 bp, Homo sapiens
tgtgactctggcttg

SEQ ID NO: 3441784 - DNA, 16 bp, Homo sapiens
tgtgactctggcttgg

SEQ ID NO: 3441785 - DNA, 20 bp, Homo sapiens
tgtgactctggcttggccta

SEQ ID NO: 3441786 - DNA, 16 bp, Homo sapiens
tgtgactcttctctca

SEQ ID NO: 3441787 - DNA, 21 bp, Homo sapiens
tgtgagaagtgaatgctggga

SEQ ID NO: 3441788 - DNA, 22 bp, Homo sapiens
tgtgagaagtgaatgctgggac

SEQ ID NO: 3441789 - DNA, 15 bp, Homo sapiens
tgtgagactactaag

SEQ ID NO: 3441790 - DNA, 15 bp, Homo sapiens
tgtgagaggtttgac

SEQ ID NO: 3441791 - DNA, 14 bp, Homo sapiens
tgtgagcaagaagt

SEQ ID NO: 3441792 - DNA, 14 bp, Homo sapiens
tgtgagcccagctg

SEQ ID NO: 3441793 - DNA, 15 bp, Homo sapiens
tgtgaggccagggca

SEQ ID NO: 3441794 - DNA, 16 bp, Homo sapiens
tgtgaggccagggcag

SEQ ID NO: 3441795 - DNA, 22 bp, Homo sapiens
tgtgaggccagggcagagtgag

SEQ ID NO: 3441796 - DNA, 17 bp, Homo sapiens
tgtgagtcaccaagccc

SEQ ID NO: 3441797 - DNA, 15 bp, Homo sapiens
tgtgagtgaaagttg

SEQ ID NO: 3441798 - DNA, 21 bp, Homo sapiens
tgtgagtgaaagttgccatta

SEQ ID NO: 3441799 - DNA, 21 bp, Homo sapiens
tgtgagtgccttttgcagaag

SEQ ID NO: 3441800 - DNA, 16 bp, Homo sapiens
tgtgatacatttctga

SEQ ID NO: 3441801 - DNA, 16 bp, Homo sapiens
tgtgatgccctgccct

SEQ ID NO: 3441802 - DNA, 17 bp, Homo sapiens
tgtgattgtggaatgga

SEQ ID NO: 3441803 - DNA, 23 bp, Homo sapiens
tgtgcaaaaaaattaaaatggat

SEQ ID NO: 3441804 - DNA, 19 bp, Homo sapiens
tgtgcacaagtgtgcacag

SEQ ID NO: 3441805 - DNA, 21 bp, Homo sapiens
tgtgcaccaccacacccggct

SEQ ID NO: 3441806 - DNA, 17 bp, Homo sapiens
tgtgcacccctccccat

SEQ ID NO: 3441807 - DNA, 14 bp, Homo sapiens
tgtgcacgtacaca

SEQ ID NO: 3441808 - DNA, 12 bp, Homo sapiens
tgtgcagctttt

SEQ ID NO: 3441809 - DNA, 17 bp, Homo sapiens
tgtgcagcttttggtca

SEQ ID NO: 3441810 - DNA, 15 bp, Homo sapiens
tgtgcagggagggca

SEQ ID NO: 3441811 - DNA, 19 bp, Homo sapiens
tgtgccaacctattttgaa

SEQ ID NO: 3441812 - DNA, 23 bp, Homo sapiens
tgtgccaatcaatagcaccccta

SEQ ID NO: 3441813 - DNA, 18 bp, Homo sapiens
tgtgccagggcaatgatg

SEQ ID NO: 3441814 - DNA, 16 bp, Homo sapiens
tgtgccctccttccca

SEQ ID NO: 3441815 - DNA, 21 bp, Homo sapiens
tgtgcctcggcttttctcagc

SEQ ID NO: 3441816 - DNA, 15 bp, Homo sapiens
tgtgcctctgtcctt

SEQ ID NO: 3441817 - DNA, 14 bp, Homo sapiens
tgtgcgcctacagg

SEQ ID NO: 3441818 - DNA, 17 bp, Homo sapiens
tgtgctagaaattttca

SEQ ID NO: 3441819 - DNA, 13 bp, Homo sapiens
tgtgctatagtat

SEQ ID NO: 3441820 - DNA, 18 bp, Homo sapiens
tgtgctatagtatttgat

SEQ ID NO: 3441821 - DNA, 18 bp, Homo sapiens
tgtgctatggtgctctgt

SEQ ID NO: 3441822 - DNA, 18 bp, Homo sapiens
tgtgctctatagcagaca

SEQ ID NO: 3441823 - DNA, 15 bp, Homo sapiens
tgtgctctggacagg

SEQ ID NO: 3441824 - DNA, 18 bp, Homo sapiens
tgtgctgggagaaatact

SEQ ID NO: 3441825 - DNA, 12 bp, Homo sapiens
tgtgctgggagc

SEQ ID NO: 3441826 - DNA, 21 bp, Homo sapiens
tgtgctgggagctccactctg

SEQ ID NO: 3441827 - DNA, 12 bp, Homo sapiens
tgtgctgtgtgt

SEQ ID NO: 3441828 - DNA, 15 bp, Homo sapiens
tgtgctgtgtgtgac

SEQ ID NO: 3441829 - DNA, 21 bp, Homo sapiens
tgtgcttctctatgataatta

SEQ ID NO: 3441830 - DNA, 21 bp, Homo sapiens
tgtgcttctttctttgggaat

SEQ ID NO: 3441831 - DNA, 21 bp, Homo sapiens
tgtgcttgaaggccctgctga

SEQ ID NO: 3441832 - DNA, 22 bp, Homo sapiens
tgtgcttgaaggccctgctgag

SEQ ID NO: 3441833 - DNA, 13 bp, Homo sapiens
tgtgctttatgct

SEQ ID NO: 3441834 - DNA, 22 bp, Homo sapiens
tgtgctttgtatcagtcagtgc

SEQ ID NO: 3441835 - DNA, 17 bp, Homo sapiens
tgtggaatgttggataa

SEQ ID NO: 3441836 - DNA, 16 bp, Homo sapiens
tgtggactaaaagata

SEQ ID NO: 3441837 - DNA, 24 bp, Homo sapiens
tgtggagacaatgtctgcagccct

SEQ ID NO: 3441838 - DNA, 22 bp, Homo sapiens
tgtggagatgcccaggatttga

SEQ ID NO: 3441839 - DNA, 19 bp, Homo sapiens
tgtggagccgaggcctacc

SEQ ID NO: 3441840 - DNA, 19 bp, Homo sapiens
tgtggagggcacattcctt

SEQ ID NO: 3441841 - DNA, 19 bp, Homo sapiens
tgtggatgagccctcagaa

SEQ ID NO: 3441842 - DNA, 15 bp, Homo sapiens
tgtggatggaaatgt

SEQ ID NO: 3441843 - DNA, 18 bp, Homo sapiens
tgtggccaaggagctgct

SEQ ID NO: 3441844 - DNA, 17 bp, Homo sapiens
tgtggccatggcctctg

SEQ ID NO: 3441845 - DNA, 16 bp, Homo sapiens
tgtggccctgtcctgc

SEQ ID NO: 3441846 - DNA, 11 bp, Homo sapiens
tgtggcctgca

SEQ ID NO: 3441847 - DNA, 16 bp, Homo sapiens
tgtggcctgggcctcc

SEQ ID NO: 3441848 - DNA, 12 bp, Homo sapiens
tgtgggaacaga

SEQ ID NO: 3441849 - DNA, 15 bp, Homo sapiens
tgtgggaaggccagc

SEQ ID NO: 3441850 - DNA, 13 bp, Homo sapiens
tgtggggactccg

SEQ ID NO: 3441851 - DNA, 14 bp, Homo sapiens
tgtgggtctctgga

SEQ ID NO: 3441852 - DNA, 23 bp, Homo sapiens
tgtggtcacagcggaggtgtgga

SEQ ID NO: 3441853 - DNA, 16 bp, Homo sapiens
tgtggtgcagtgtgaa

SEQ ID NO: 3441854 - DNA, 18 bp, Homo sapiens
tgtggtggattctccctg

SEQ ID NO: 3441855 - DNA, 17 bp, Homo sapiens
tgtgtaaaatgtaatgc

SEQ ID NO: 3441856 - DNA, 16 bp, Homo sapiens
tgtgtaattttgttct

SEQ ID NO: 3441857 - DNA, 12 bp, Homo sapiens
tgtgtaggtgaa

SEQ ID NO: 3441858 - DNA, 19 bp, Homo sapiens
tgtgtaggtgaacagtcac

SEQ ID NO: 3441859 - DNA, 20 bp, Homo sapiens
tgtgtatatatatgtgagga

SEQ ID NO: 3441860 - DNA, 12 bp, Homo sapiens
tgtgtatgggta

SEQ ID NO: 3441861 - DNA, 15 bp, Homo sapiens
tgtgtatttacgctt

SEQ ID NO: 3441862 - DNA, 16 bp, Homo sapiens
tgtgtatttcttatac

SEQ ID NO: 3441863 - DNA, 14 bp, Homo sapiens
tgtgtcaatccaga

SEQ ID NO: 3441864 - DNA, 17 bp, Homo sapiens
tgtgtcaggtggggcag

SEQ ID NO: 3441865 - DNA, 19 bp, Homo sapiens
tgtgtccacgactgtctcc

SEQ ID NO: 3441866 - DNA, 16 bp, Homo sapiens
tgtgtccccctctgtc

SEQ ID NO: 3441867 - DNA, 17 bp, Homo sapiens
tgtgtccctcttctctt

SEQ ID NO: 3441868 - DNA, 20 bp, Homo sapiens
tgtgtcctgaaacgctcctt

SEQ ID NO: 3441869 - DNA, 12 bp, Homo sapiens
tgtgtctaaact

SEQ ID NO: 3441870 - DNA, 18 bp, Homo sapiens
tgtgtgaatgaacactct

SEQ ID NO: 3441871 - DNA, 14 bp, Homo sapiens
tgtgtgacaattct

SEQ ID NO: 3441872 - DNA, 15 bp, Homo sapiens
tgtgtgacaattctg

SEQ ID NO: 3441873 - DNA, 20 bp, Homo sapiens
tgtgtgacaattctgttttt

SEQ ID NO: 3441874 - DNA, 15 bp, Homo sapiens
tgtgtgattgacagc

SEQ ID NO: 3441875 - DNA, 21 bp, Homo sapiens
tgtgtgattgacagctttgct

SEQ ID NO: 3441876 - DNA, 16 bp, Homo sapiens
tgtgtggccacttctg

SEQ ID NO: 3441877 - DNA, 18 bp, Homo sapiens
tgtgtggccacttctgtc

SEQ ID NO: 3441878 - DNA, 21 bp, Homo sapiens
tgtgtggtggattctccctgg

SEQ ID NO: 3441879 - DNA, 22 bp, Homo sapiens
tgtgtgtccacgactgtctcca

SEQ ID NO: 3441880 - DNA, 13 bp, Homo sapiens
tgtgtgtgtgaat

SEQ ID NO: 3441881 - DNA, 18 bp, Homo sapiens
tgtgttactgctttgcaa

SEQ ID NO: 3441882 - DNA, 14 bp, Homo sapiens
tgtgttatgaagca

SEQ ID NO: 3441883 - DNA, 13 bp, Homo sapiens
tgtgttgccaagc

SEQ ID NO: 3441884 - DNA, 14 bp, Homo sapiens
tgtgtttgctttct

SEQ ID NO: 3441885 - DNA, 15 bp, Homo sapiens
tgtgtttggctttca

SEQ ID NO: 3441886 - DNA, 17 bp, Homo sapiens
tgtgtttggctttcagg

SEQ ID NO: 3441887 - DNA, 10 bp, Homo sapiens
tgtgtttgtt

SEQ ID NO: 3441888 - DNA, 13 bp, Homo sapiens
tgttaaaaataaa

SEQ ID NO: 3441889 - DNA, 23 bp, Homo sapiens
tgttaaactagcatatctgcctt

SEQ ID NO: 3441890 - DNA, 18 bp, Homo sapiens
tgttaaataaattgtata

SEQ ID NO: 3441891 - DNA, 16 bp, Homo sapiens
tgttaacctaggcagt

SEQ ID NO: 3441892 - DNA, 18 bp, Homo sapiens
tgttaagcagctaaattt

SEQ ID NO: 3441893 - DNA, 19 bp, Homo sapiens
tgttaatgatagctactgt

SEQ ID NO: 3441894 - DNA, 13 bp, Homo sapiens
tgttaattgaaag

SEQ ID NO: 3441895 - DNA, 22 bp, Homo sapiens
tgttacctgaaaacactgtgca

SEQ ID NO: 3441896 - DNA, 18 bp, Homo sapiens
tgttacctgtcattttgc

SEQ ID NO: 3441897 - DNA, 19 bp, Homo sapiens
tgttacctgtcattttgca

SEQ ID NO: 3441898 - DNA, 15 bp, Homo sapiens
tgttacctgtgtgct

SEQ ID NO: 3441899 - DNA, 12 bp, Homo sapiens
tgttactgcctt

SEQ ID NO: 3441900 - DNA, 19 bp, Homo sapiens
tgttactgccttaataaaa

SEQ ID NO: 3441901 - DNA, 16 bp, Homo sapiens
tgttactgctttgcaa

SEQ ID NO: 3441902 - DNA, 14 bp, Homo sapiens
tgttactgtaattc

SEQ ID NO: 3441903 - DNA, 16 bp, Homo sapiens
tgttaggaaaatttca

SEQ ID NO: 3441904 - DNA, 14 bp, Homo sapiens
tgttataactactc

SEQ ID NO: 3441905 - DNA, 20 bp, Homo sapiens
tgttatagaacttcatggat

SEQ ID NO: 3441906 - DNA, 19 bp, Homo sapiens
tgttatcaccgtgggctcc

SEQ ID NO: 3441907 - DNA, 20 bp, Homo sapiens
tgttatgtactagtgttctg

SEQ ID NO: 3441908 - DNA, 13 bp, Homo sapiens
tgttatgtatttc

SEQ ID NO: 3441909 - DNA, 15 bp, Homo sapiens
tgttattatatttga

SEQ ID NO: 3441910 - DNA, 13 bp, Homo sapiens
tgttatttctcag

SEQ ID NO: 3441911 - DNA, 17 bp, Homo sapiens
tgttatttctcagactt

SEQ ID NO: 3441912 - DNA, 15 bp, Homo sapiens
tgttcaaagactgtg

SEQ ID NO: 3441913 - DNA, 21 bp, Homo sapiens
tgttcaaagccagcgtcctcc

SEQ ID NO: 3441914 - DNA, 14 bp, Homo sapiens
tgttcacaacctgg

SEQ ID NO: 3441915 - DNA, 17 bp, Homo sapiens
tgttcacttttgacaaa

SEQ ID NO: 3441916 - DNA, 18 bp, Homo sapiens
tgttcagctccagctcac

SEQ ID NO: 3441917 - DNA, 22 bp, Homo sapiens
tgttcagctccagctcaccagc

SEQ ID NO: 3441918 - DNA, 13 bp, Homo sapiens
tgttcagtaataa

SEQ ID NO: 3441919 - DNA, 20 bp, Homo sapiens
tgttccacttgtttgcactg

SEQ ID NO: 3441920 - DNA, 17 bp, Homo sapiens
tgttcccacctgctgga

SEQ ID NO: 3441921 - DNA, 20 bp, Homo sapiens
tgttcccatgtagccccctg

SEQ ID NO: 3441922 - DNA, 22 bp, Homo sapiens
tgttccccactgacagcctccc

SEQ ID NO: 3441923 - DNA, 15 bp, Homo sapiens
tgttccccctgtgca

SEQ ID NO: 3441924 - DNA, 12 bp, Homo sapiens
tgttcccctcct

SEQ ID NO: 3441925 - DNA, 23 bp, Homo sapiens
tgttcccctcctccactctcccc

SEQ ID NO: 3441926 - DNA, 23 bp, Homo sapiens
tgttccctatttttctctcctgt

SEQ ID NO: 3441927 - DNA, 14 bp, Homo sapiens
tgttcctagagtag

SEQ ID NO: 3441928 - DNA, 22 bp, Homo sapiens
tgttcgcatggtcacacactga

SEQ ID NO: 3441929 - DNA, 23 bp, Homo sapiens
tgttcgcatggtcacacactgat

SEQ ID NO: 3441930 - DNA, 14 bp, Homo sapiens
tgttctcctcccca

SEQ ID NO: 3441931 - DNA, 13 bp, Homo sapiens
tgttctctgagga

SEQ ID NO: 3441932 - DNA, 13 bp, Homo sapiens
tgttctctgggag

SEQ ID NO: 3441933 - DNA, 14 bp, Homo sapiens
tgttctctgggaga

SEQ ID NO: 3441934 - DNA, 16 bp, Homo sapiens
tgttctctgggagaaa

SEQ ID NO: 3441935 - DNA, 15 bp, Homo sapiens
tgttctgaaacctta

SEQ ID NO: 3441936 - DNA, 13 bp, Homo sapiens
tgttctgaactgt

SEQ ID NO: 3441937 - DNA, 23 bp, Homo sapiens
tgttctgcaaaaatatttataaa

SEQ ID NO: 3441938 - DNA, 13 bp, Homo sapiens
tgttctgggacac

SEQ ID NO: 3441939 - DNA, 15 bp, Homo sapiens
tgttctgtcttccca

SEQ ID NO: 3441940 - DNA, 18 bp, Homo sapiens
tgttctgtcttcccaaac

SEQ ID NO: 3441941 - DNA, 19 bp, Homo sapiens
tgttctgtttgttattgtt

SEQ ID NO: 3441942 - DNA, 19 bp, Homo sapiens
tgttgaaaacccagactgt

SEQ ID NO: 3441943 - DNA, 20 bp, Homo sapiens
tgttgaacaggtgtttttcc

SEQ ID NO: 3441944 - DNA, 14 bp, Homo sapiens
tgttgaaggaactt

SEQ ID NO: 3441945 - DNA, 18 bp, Homo sapiens
tgttgaaggaacttgtct

SEQ ID NO: 3441946 - DNA, 17 bp, Homo sapiens
tgttgaagtctcaggag

SEQ ID NO: 3441947 - DNA, 16 bp, Homo sapiens
tgttgacacaggtctt

SEQ ID NO: 3441948 - DNA, 15 bp, Homo sapiens
tgttgacatatttaa

SEQ ID NO: 3441949 - DNA, 16 bp, Homo sapiens
tgttgacatatttaat

SEQ ID NO: 3441950 - DNA, 18 bp, Homo sapiens
tgttgaccatgtctatga

SEQ ID NO: 3441951 - DNA, 22 bp, Homo sapiens
tgttgagaatcccaaatttgat

SEQ ID NO: 3441952 - DNA, 16 bp, Homo sapiens
tgttgagcatcacaga

SEQ ID NO: 3441953 - DNA, 17 bp, Homo sapiens
tgttgagcatcacagaa

SEQ ID NO: 3441954 - DNA, 17 bp, Homo sapiens
tgttgatcatgtacttt

SEQ ID NO: 3441955 - DNA, 20 bp, Homo sapiens
tgttgatcatgtacttttta

SEQ ID NO: 3441956 - DNA, 19 bp, Homo sapiens
tgttgatccatccagcttg

SEQ ID NO: 3441957 - DNA, 16 bp, Homo sapiens
tgttgatgctttcgtc

SEQ ID NO: 3441958 - DNA, 17 bp, Homo sapiens
tgttgcaagtgcaataa

SEQ ID NO: 3441959 - DNA, 20 bp, Homo sapiens
tgttgcacacccactcagct

SEQ ID NO: 3441960 - DNA, 21 bp, Homo sapiens
tgttgcacacccactcagctc

SEQ ID NO: 3441961 - DNA, 12 bp, Homo sapiens
tgttgcccaggc

SEQ ID NO: 3441962 - DNA, 19 bp, Homo sapiens
tgttgcccaggcaggtctt

SEQ ID NO: 3441963 - DNA, 15 bp, Homo sapiens
tgttgcccaggctgg

SEQ ID NO: 3441964 - DNA, 23 bp, Homo sapiens
tgttgcccaggctggcgtgcagt

SEQ ID NO: 3441965 - DNA, 14 bp, Homo sapiens
tgttgctgaatagg

SEQ ID NO: 3441966 - DNA, 23 bp, Homo sapiens
tgttgctgaataggcgatcacaa

SEQ ID NO: 3441967 - DNA, 14 bp, Homo sapiens
tgttgcttggacta

SEQ ID NO: 3441968 - DNA, 12 bp, Homo sapiens
tgttgctttgtt

SEQ ID NO: 3441969 - DNA, 18 bp, Homo sapiens
tgttggaggagagagcct

SEQ ID NO: 3441970 - DNA, 21 bp, Homo sapiens
tgttggatccgtttgaccaat

SEQ ID NO: 3441971 - DNA, 12 bp, Homo sapiens
tgttggcaggct

SEQ ID NO: 3441972 - DNA, 18 bp, Homo sapiens
tgttggcaggctggccag

SEQ ID NO: 3441973 - DNA, 21 bp, Homo sapiens
tgttggcaggctggccagtcc

SEQ ID NO: 3441974 - DNA, 11 bp, Homo sapiens
tgttggccagg

SEQ ID NO: 3441975 - DNA, 17 bp, Homo sapiens
tgttggctgggggcctc

SEQ ID NO: 3441976 - DNA, 19 bp, Homo sapiens
tgttgggaaacttggctcg

SEQ ID NO: 3441977 - DNA, 17 bp, Homo sapiens
tgttggggtgggtataa

SEQ ID NO: 3441978 - DNA, 18 bp, Homo sapiens
tgttggggtgggtataaa

SEQ ID NO: 3441979 - DNA, 20 bp, Homo sapiens
tgttggggtgggtataaaag

SEQ ID NO: 3441980 - DNA, 23 bp, Homo sapiens
tgttggggtgggtataaaagatg

SEQ ID NO: 3441981 - DNA, 22 bp, Homo sapiens
tgttgtaaaacaaaatttgact

SEQ ID NO: 3441982 - DNA, 22 bp, Homo sapiens
tgttgtacatttcaccatggcc

SEQ ID NO: 3441983 - DNA, 12 bp, Homo sapiens
tgttgtcccttc

SEQ ID NO: 3441984 - DNA, 13 bp, Homo sapiens
tgttgtcccttct

SEQ ID NO: 3441985 - DNA, 19 bp, Homo sapiens
tgttgttttgtagcaacca

SEQ ID NO: 3441986 - DNA, 18 bp, Homo sapiens
tgtttaaaaatacacatg

SEQ ID NO: 3441987 - DNA, 20 bp, Homo sapiens
tgtttaaaaatacacatgga

SEQ ID NO: 3441988 - DNA, 14 bp, Homo sapiens
tgtttaatctgtta

SEQ ID NO: 3441989 - DNA, 20 bp, Homo sapiens
tgtttaatctgttatgtact

SEQ ID NO: 3441990 - DNA, 16 bp, Homo sapiens
tgtttaatgttctgtg

SEQ ID NO: 3441991 - DNA, 17 bp, Homo sapiens
tgtttacatttgatgca

SEQ ID NO: 3441992 - DNA, 17 bp, Homo sapiens
tgtttagcagcagcctt

SEQ ID NO: 3441993 - DNA, 19 bp, Homo sapiens
tgtttattaaaattctgaa

SEQ ID NO: 3441994 - DNA, 13 bp, Homo sapiens
tgtttattaaata

SEQ ID NO: 3441995 - DNA, 14 bp, Homo sapiens
tgtttcaaaaccat

SEQ ID NO: 3441996 - DNA, 13 bp, Homo sapiens
tgtttcacaaggt

SEQ ID NO: 3441997 - DNA, 16 bp, Homo sapiens
tgtttcacaaggtctt

SEQ ID NO: 3441998 - DNA, 20 bp, Homo sapiens
tgtttccagcagaagacaaa

SEQ ID NO: 3441999 - DNA, 21 bp, Homo sapiens
tgtttccagcagaagacaaaa

SEQ ID NO: 3442000 - DNA, 15 bp, Homo sapiens
tgtttctacctatat

SEQ ID NO: 3442001 - DNA, 22 bp, Homo sapiens
tgtttctctgttgtaagaatag

SEQ ID NO: 3442002 - DNA, 11 bp, Homo sapiens
tgtttctgtaa

SEQ ID NO: 3442003 - DNA, 16 bp, Homo sapiens
tgtttctgtaagaaac

SEQ ID NO: 3442004 - DNA, 17 bp, Homo sapiens
tgtttctgttcaccttc

SEQ ID NO: 3442005 - DNA, 21 bp, Homo sapiens
tgtttcttttgtatgtaaatg

SEQ ID NO: 3442006 - DNA, 16 bp, Homo sapiens
tgtttgcactgtgtgc

SEQ ID NO: 3442007 - DNA, 12 bp, Homo sapiens
tgtttgcccaaa

SEQ ID NO: 3442008 - DNA, 16 bp, Homo sapiens
tgtttgcctctgcctc

SEQ ID NO: 3442009 - DNA, 22 bp, Homo sapiens
tgtttgctttctgatcaaggcc

SEQ ID NO: 3442010 - DNA, 15 bp, Homo sapiens
tgtttggaggagcaa

SEQ ID NO: 3442011 - DNA, 22 bp, Homo sapiens
tgtttggaggagcaaagttaaa

SEQ ID NO: 3442012 - DNA, 17 bp, Homo sapiens
tgtttggcaaggaaagg

SEQ ID NO: 3442013 - DNA, 13 bp, Homo sapiens
tgtttggctttca

SEQ ID NO: 3442014 - DNA, 19 bp, Homo sapiens
tgtttggggatgagaaagg

SEQ ID NO: 3442015 - DNA, 22 bp, Homo sapiens
tgtttggtattgtatttattca

SEQ ID NO: 3442016 - DNA, 13 bp, Homo sapiens
tgtttggttttac

SEQ ID NO: 3442017 - DNA, 14 bp, Homo sapiens
tgtttggttttaca

SEQ ID NO: 3442018 - DNA, 23 bp, Homo sapiens
tgtttgtaactttttacattaca

SEQ ID NO: 3442019 - DNA, 13 bp, Homo sapiens
tgtttgtatgaaa

SEQ ID NO: 3442020 - DNA, 15 bp, Homo sapiens
tgtttgtcattagcc

SEQ ID NO: 3442021 - DNA, 16 bp, Homo sapiens
tgtttgtctcatccca

SEQ ID NO: 3442022 - DNA, 15 bp, Homo sapiens
tgtttgtgctgtggt

SEQ ID NO: 3442023 - DNA, 14 bp, Homo sapiens
tgtttgtgtattta

SEQ ID NO: 3442024 - DNA, 12 bp, Homo sapiens
tgtttgttatgg

SEQ ID NO: 3442025 - DNA, 23 bp, Homo sapiens
tgtttgttggatccgtttgacca

SEQ ID NO: 3442026 - DNA, 22 bp, Homo sapiens
tgttttaaactacatcttgaaa

SEQ ID NO: 3442027 - DNA, 19 bp, Homo sapiens
tgttttaaagaatatgact

SEQ ID NO: 3442028 - DNA, 14 bp, Homo sapiens
tgttttaaatgtac

SEQ ID NO: 3442029 - DNA, 11 bp, Homo sapiens
tgttttaacaa

SEQ ID NO: 3442030 - DNA, 16 bp, Homo sapiens
tgttttaagaggcagg

SEQ ID NO: 3442031 - DNA, 14 bp, Homo sapiens
tataaattcctctt

SEQ ID NO: 3442032 - DNA, 20 bp, Homo sapiens
tataaattcctctttgcttt

SEQ ID NO: 3442033 - DNA, 15 bp, Homo sapiens
tataagaaagacatc

SEQ ID NO: 3442034 - DNA, 22 bp, Homo sapiens
tataagaaagacatctttctct

SEQ ID NO: 3442035 - DNA, 16 bp, Homo sapiens
tataagaataaaatgt

SEQ ID NO: 3442036 - DNA, 20 bp, Homo sapiens
tataagtgctgtataaaatc

SEQ ID NO: 3442037 - DNA, 21 bp, Homo sapiens
tataagtgctgtataaaatca

SEQ ID NO: 3442038 - DNA, 21 bp, Homo sapiens
tataagtggtgcttagaaaat

SEQ ID NO: 3442039 - DNA, 20 bp, Homo sapiens
tataagttatttttgtacat

SEQ ID NO: 3442040 - DNA, 20 bp, Homo sapiens
tataagttgagaaggtgcct

SEQ ID NO: 3442041 - DNA, 22 bp, Homo sapiens
tataagttgagaaggtgcctgc

SEQ ID NO: 3442042 - DNA, 22 bp, Homo sapiens
tataatatatttgtgtatttaa

SEQ ID NO: 3442043 - DNA, 20 bp, Homo sapiens
tataatatctaaagttatat

SEQ ID NO: 3442044 - DNA, 19 bp, Homo sapiens
tataatggacagattaata

SEQ ID NO: 3442045 - DNA, 17 bp, Homo sapiens
tataatgtttttaatat

SEQ ID NO: 3442046 - DNA, 20 bp, Homo sapiens
tataattgggtcatagaaat

SEQ ID NO: 3442047 - DNA, 16 bp, Homo sapiens
tataatttaatgcatg

SEQ ID NO: 3442048 - DNA, 17 bp, Homo sapiens
tataatttgctggaaca

SEQ ID NO: 3442049 - DNA, 13 bp, Homo sapiens
tatacaataatgt

SEQ ID NO: 3442050 - DNA, 15 bp, Homo sapiens
tatacaataatgtaa

SEQ ID NO: 3442051 - DNA, 18 bp, Homo sapiens
tatacatatctttattaa

SEQ ID NO: 3442052 - DNA, 19 bp, Homo sapiens
tataccagtataattgagt

SEQ ID NO: 3442053 - DNA, 18 bp, Homo sapiens
tataccatttcctcagct

SEQ ID NO: 3442054 - DNA, 14 bp, Homo sapiens
tatacctgtgcctc

SEQ ID NO: 3442055 - DNA, 15 bp, Homo sapiens
tatacctgtgcctcg

SEQ ID NO: 3442056 - DNA, 21 bp, Homo sapiens
tatactactttgttaggattt

SEQ ID NO: 3442057 - DNA, 21 bp, Homo sapiens
tatactattaaaaaggtttac

SEQ ID NO: 3442058 - DNA, 17 bp, Homo sapiens
tatacttgtggactaaa

SEQ ID NO: 3442059 - DNA, 22 bp, Homo sapiens
tatacttgtggactaaaagata

SEQ ID NO: 3442060 - DNA, 17 bp, Homo sapiens
tatagaacttcatggat

SEQ ID NO: 3442061 - DNA, 22 bp, Homo sapiens
tatagaacttcatggatcagat

SEQ ID NO: 3442062 - DNA, 16 bp, Homo sapiens
tatagacccgaggaaa

SEQ ID NO: 3442063 - DNA, 18 bp, Homo sapiens
tatagcacatcacctggg

SEQ ID NO: 3442064 - DNA, 19 bp, Homo sapiens
tatagcatctttcatatgg

SEQ ID NO: 3442065 - DNA, 22 bp, Homo sapiens
tatagcccagccaggccccagg

SEQ ID NO: 3442066 - DNA, 18 bp, Homo sapiens
tataggttttaaagacct

SEQ ID NO: 3442067 - DNA, 19 bp, Homo sapiens
tatagtatttgattcaaaa

SEQ ID NO: 3442068 - DNA, 14 bp, Homo sapiens
tatagtgtatagaa

SEQ ID NO: 3442069 - DNA, 20 bp, Homo sapiens
tatagttaatattttgttct

SEQ ID NO: 3442070 - DNA, 21 bp, Homo sapiens
tatagttcatgtctgctatca

SEQ ID NO: 3442071 - DNA, 17 bp, Homo sapiens
tatataaaataaatata

SEQ ID NO: 3442072 - DNA, 19 bp, Homo sapiens
tatataaaataaatatata

SEQ ID NO: 3442073 - DNA, 23 bp, Homo sapiens
tatataaaataaatatatataaa

SEQ ID NO: 3442074 - DNA, 12 bp, Homo sapiens
tatataaatata

SEQ ID NO: 3442075 - DNA, 15 bp, Homo sapiens
tatataagaaagaca

SEQ ID NO: 3442076 - DNA, 13 bp, Homo sapiens
tatataatatcta

SEQ ID NO: 3442077 - DNA, 13 bp, Homo sapiens
tatatatataaaa

SEQ ID NO: 3442078 - DNA, 18 bp, Homo sapiens
tatatatgtatgtatgtg

SEQ ID NO: 3442079 - DNA, 15 bp, Homo sapiens
tatatattattctca

SEQ ID NO: 3442080 - DNA, 13 bp, Homo sapiens
tatatatttctat

SEQ ID NO: 3442081 - DNA, 19 bp, Homo sapiens
tatatatttttttttggat

SEQ ID NO: 3442082 - DNA, 15 bp, Homo sapiens
tatatcatatgtata

SEQ ID NO: 3442083 - DNA, 14 bp, Homo sapiens
tatatgaaaacctg

SEQ ID NO: 3442084 - DNA, 18 bp, Homo sapiens
tatatggcagagttgtaa

SEQ ID NO: 3442085 - DNA, 17 bp, Homo sapiens
tatatgtatttttatat

SEQ ID NO: 3442086 - DNA, 15 bp, Homo sapiens
tatattaaaaatata

SEQ ID NO: 3442087 - DNA, 20 bp, Homo sapiens
tatattaaaaatataaaact

SEQ ID NO: 3442088 - DNA, 21 bp, Homo sapiens
tatattaaaaatataaaactg

SEQ ID NO: 3442089 - DNA, 23 bp, Homo sapiens
tatattaaaaatataaaactgcg

SEQ ID NO: 3442090 - DNA, 17 bp, Homo sapiens
tatattaatgtacttgt

SEQ ID NO: 3442091 - DNA, 14 bp, Homo sapiens
tatattatcatgca

SEQ ID NO: 3442092 - DNA, 16 bp, Homo sapiens
tatattattctcattt

SEQ ID NO: 3442093 - DNA, 18 bp, Homo sapiens
tatattattctcatttag

SEQ ID NO: 3442094 - DNA, 22 bp, Homo sapiens
tatattattctcatttagtgcc

SEQ ID NO: 3442095 - DNA, 15 bp, Homo sapiens
tatatttacaaatgg

SEQ ID NO: 3442096 - DNA, 16 bp, Homo sapiens
tatatttcagatgtaa

SEQ ID NO: 3442097 - DNA, 13 bp, Homo sapiens
tatatttctatta

SEQ ID NO: 3442098 - DNA, 22 bp, Homo sapiens
tatatttgggcctgctccagac

SEQ ID NO: 3442099 - DNA, 23 bp, Homo sapiens
tatatttgtgatagcactttcta

SEQ ID NO: 3442100 - DNA, 20 bp, Homo sapiens
tatatttgtgctatagtatt

SEQ ID NO: 3442101 - DNA, 20 bp, Homo sapiens
tatatttgtgtatttaacag

SEQ ID NO: 3442102 - DNA, 18 bp, Homo sapiens
tatcaacctaagcaacag

SEQ ID NO: 3442103 - DNA, 19 bp, Homo sapiens
tatcaacctaagcaacaga

SEQ ID NO: 3442104 - DNA, 19 bp, Homo sapiens
tatcaatataatgttttta

SEQ ID NO: 3442105 - DNA, 17 bp, Homo sapiens
tatcacctcattctgaa

SEQ ID NO: 3442106 - DNA, 18 bp, Homo sapiens
tatcactgacacaaaaag

SEQ ID NO: 3442107 - DNA, 13 bp, Homo sapiens
tatcagaatttgt

SEQ ID NO: 3442108 - DNA, 14 bp, Homo sapiens
tatcagcaaaaaag

SEQ ID NO: 3442109 - DNA, 19 bp, Homo sapiens
tatcaggtgctgccatcca

SEQ ID NO: 3442110 - DNA, 20 bp, Homo sapiens
tatcaggtgctgccatccag

SEQ ID NO: 3442111 - DNA, 15 bp, Homo sapiens
tatcatgcaaatgct

SEQ ID NO: 3442112 - DNA, 16 bp, Homo sapiens
tatcatgcaaatgctg

SEQ ID NO: 3442113 - DNA, 18 bp, Homo sapiens
tatcatgcccctgtactc

SEQ ID NO: 3442114 - DNA, 22 bp, Homo sapiens
tatcattgctcccctgatagaa

SEQ ID NO: 3442115 - DNA, 21 bp, Homo sapiens
tatcattgttggtgttaattg

SEQ ID NO: 3442116 - DNA, 23 bp, Homo sapiens
tatcattgttggtgttaattgaa

SEQ ID NO: 3442117 - DNA, 14 bp, Homo sapiens
tatcatttaataat

SEQ ID NO: 3442118 - DNA, 18 bp, Homo sapiens
tatcatttaataatatac

SEQ ID NO: 3442119 - DNA, 22 bp, Homo sapiens
tatcatttaataatatacttgt

SEQ ID NO: 3442120 - DNA, 11 bp, Homo sapiens
tatccataatg

SEQ ID NO: 3442121 - DNA, 14 bp, Homo sapiens
tatccataatgatg

SEQ ID NO: 3442122 - DNA, 14 bp, Homo sapiens
tatccattctttct

SEQ ID NO: 3442123 - DNA, 15 bp, Homo sapiens
tatccccccatcttg

SEQ ID NO: 3442124 - DNA, 17 bp, Homo sapiens
tatccccccatcttgct

SEQ ID NO: 3442125 - DNA, 20 bp, Homo sapiens
tatcctagcacatgcttcaa

SEQ ID NO: 3442126 - DNA, 18 bp, Homo sapiens
tatcctgccaaaatcatt

SEQ ID NO: 3442127 - DNA, 13 bp, Homo sapiens
tatccttcatctt

SEQ ID NO: 3442128 - DNA, 16 bp, Homo sapiens
tatccttcatctttta

SEQ ID NO: 3442129 - DNA, 20 bp, Homo sapiens
tatccttcatcttttaaaga

SEQ ID NO: 3442130 - DNA, 22 bp, Homo sapiens
tatccttcatcttttaaagaaa

SEQ ID NO: 3442131 - DNA, 24 bp, Homo sapiens
tatcctttcctcattaaattacct

SEQ ID NO: 3442132 - DNA, 23 bp, Homo sapiens
tatctaaaccatatgaacatata

SEQ ID NO: 3442133 - DNA, 20 bp, Homo sapiens
tatctaaagttatatttcag

SEQ ID NO: 3442134 - DNA, 23 bp, Homo sapiens
tatctaagaatacagctttctga

SEQ ID NO: 3442135 - DNA, 21 bp, Homo sapiens
tatctaatatgtaacaagcca

SEQ ID NO: 3442136 - DNA, 13 bp, Homo sapiens
tatctactctcct

SEQ ID NO: 3442137 - DNA, 13 bp, Homo sapiens
tatctcagggcct

SEQ ID NO: 3442138 - DNA, 16 bp, Homo sapiens
tatctccggctcccag

SEQ ID NO: 3442139 - DNA, 18 bp, Homo sapiens
tatctgcaggcagacacg

SEQ ID NO: 3442140 - DNA, 14 bp, Homo sapiens
tatctgcctgacag

SEQ ID NO: 3442141 - DNA, 20 bp, Homo sapiens
tatctggaagttgagactta

SEQ ID NO: 3442142 - DNA, 15 bp, Homo sapiens
tatcttcagtttaat

SEQ ID NO: 3442143 - DNA, 23 bp, Homo sapiens
tatcttgatgtttagaaaagtat

SEQ ID NO: 3442144 - DNA, 15 bp, Homo sapiens
tatcttgttccaagg

SEQ ID NO: 3442145 - DNA, 14 bp, Homo sapiens
tatctttattaatc

SEQ ID NO: 3442146 - DNA, 15 bp, Homo sapiens
tatctttattaatca

SEQ ID NO: 3442147 - DNA, 17 bp, Homo sapiens
tatctttgattctcctt

SEQ ID NO: 3442148 - DNA, 18 bp, Homo sapiens
tatctttgattctccttc

SEQ ID NO: 3442149 - DNA, 17 bp, Homo sapiens
tatgaacacttaaatta

SEQ ID NO: 3442150 - DNA, 20 bp, Homo sapiens
tatgaactttatagttgttt

SEQ ID NO: 3442151 - DNA, 15 bp, Homo sapiens
tatgaagacttaaaa

SEQ ID NO: 3442152 - DNA, 15 bp, Homo sapiens
tatgaatgagaatgt

SEQ ID NO: 3442153 - DNA, 16 bp, Homo sapiens
tatgaatgatttgcat

SEQ ID NO: 3442154 - DNA, 15 bp, Homo sapiens
tatgaattgtacaga

SEQ ID NO: 3442155 - DNA, 13 bp, Homo sapiens
tatgataattaca

SEQ ID NO: 3442156 - DNA, 21 bp, Homo sapiens
tatgatcacggctcactgcag

SEQ ID NO: 3442157 - DNA, 23 bp, Homo sapiens
tatgatcacggctcactgcagcc

SEQ ID NO: 3442158 - DNA, 14 bp, Homo sapiens
tatgatcagtgttg

SEQ ID NO: 3442159 - DNA, 17 bp, Homo sapiens
tatgatcagtgttgttg

SEQ ID NO: 3442160 - DNA, 13 bp, Homo sapiens
tatgatgctgccg

SEQ ID NO: 3442161 - DNA, 21 bp, Homo sapiens
tatgatgctgccggcacagct

SEQ ID NO: 3442162 - DNA, 22 bp, Homo sapiens
tatgcatggtgccccaggacca

SEQ ID NO: 3442163 - DNA, 18 bp, Homo sapiens
tatgctattgacaataaa

SEQ ID NO: 3442164 - DNA, 19 bp, Homo sapiens
tatgctgaaacagaatact

SEQ ID NO: 3442165 - DNA, 20 bp, Homo sapiens
tatgctgatcatcgccagag

SEQ ID NO: 3442166 - DNA, 14 bp, Homo sapiens
tatgctttccttct

SEQ ID NO: 3442167 - DNA, 19 bp, Homo sapiens
tatggaattgatttgcatt

SEQ ID NO: 3442168 - DNA, 16 bp, Homo sapiens
tatggacggtgctcca

SEQ ID NO: 3442169 - DNA, 18 bp, Homo sapiens
tatggcagagttgtaaat

SEQ ID NO: 3442170 - DNA, 18 bp, Homo sapiens
tatgggaacactggcaga

SEQ ID NO: 3442171 - DNA, 23 bp, Homo sapiens
tatgggactcaatgcactgacat

SEQ ID NO: 3442172 - DNA, 17 bp, Homo sapiens
tatggtaccagatgcag

SEQ ID NO: 3442173 - DNA, 20 bp, Homo sapiens
tatggtataatggttgactg

SEQ ID NO: 3442174 - DNA, 23 bp, Homo sapiens
tatggtgctctgtctacttgctc

SEQ ID NO: 3442175 - DNA, 10 bp, Homo sapiens
tatgtaccaa

SEQ ID NO: 3442176 - DNA, 14 bp, Homo sapiens
tatgtaccaagaat

SEQ ID NO: 3442177 - DNA, 14 bp, Homo sapiens
tatgtactagtgtt

SEQ ID NO: 3442178 - DNA, 20 bp, Homo sapiens
tatgtactcctctttacact

SEQ ID NO: 3442179 - DNA, 21 bp, Homo sapiens
tatgtactcctctttacactg

SEQ ID NO: 3442180 - DNA, 14 bp, Homo sapiens
tatgtagtaattga

SEQ ID NO: 3442181 - DNA, 20 bp, Homo sapiens
tatgtagtaattgacatgtg

SEQ ID NO: 3442182 - DNA, 13 bp, Homo sapiens
tatgtagtggttt

SEQ ID NO: 3442183 - DNA, 19 bp, Homo sapiens
tatgtagtggttttaggat

SEQ ID NO: 3442184 - DNA, 22 bp, Homo sapiens
tatgtagtggttttaggatact

SEQ ID NO: 3442185 - DNA, 15 bp, Homo sapiens
tatgtatcaagccct

SEQ ID NO: 3442186 - DNA, 11 bp, Homo sapiens
tatgtatttcc

SEQ ID NO: 3442187 - DNA, 22 bp, Homo sapiens
tatgtcgagagctggccaaaga

SEQ ID NO: 3442188 - DNA, 23 bp, Homo sapiens
tatgtcgtagaattccttcgaaa

SEQ ID NO: 3442189 - DNA, 18 bp, Homo sapiens
tatgtctagagcctcttg

SEQ ID NO: 3442190 - DNA, 14 bp, Homo sapiens
tatgtctgccatgt

SEQ ID NO: 3442191 - DNA, 18 bp, Homo sapiens
tatgtctgctcctttccc

SEQ ID NO: 3442192 - DNA, 23 bp, Homo sapiens
tatgtcttttgatgaatagaagt

SEQ ID NO: 3442193 - DNA, 19 bp, Homo sapiens
tatgtgaaaggaacatttt

SEQ ID NO: 3442194 - DNA, 19 bp, Homo sapiens
tatgtgaagcccagcatct

SEQ ID NO: 3442195 - DNA, 20 bp, Homo sapiens
tatgtgagctaggagaaggg

SEQ ID NO: 3442196 - DNA, 16 bp, Homo sapiens
tatgtgagtgcctttt

SEQ ID NO: 3442197 - DNA, 18 bp, Homo sapiens
tatgtgattttaactctg

SEQ ID NO: 3442198 - DNA, 15 bp, Homo sapiens
tatgtgctgtaattt

SEQ ID NO: 3442199 - DNA, 21 bp, Homo sapiens
tatgtgggggcttcatctctt

SEQ ID NO: 3442200 - DNA, 20 bp, Homo sapiens
tatgttaaactagcatatct

SEQ ID NO: 3442201 - DNA, 22 bp, Homo sapiens
tatgttatagaacttcatggat

SEQ ID NO: 3442202 - DNA, 12 bp, Homo sapiens
tatgtttacaaa

SEQ ID NO: 3442203 - DNA, 15 bp, Homo sapiens
tatgtttttgttcaa

SEQ ID NO: 3442204 - DNA, 22 bp, Homo sapiens
tatgttttttttctgctggaaa

SEQ ID NO: 3442205 - DNA, 19 bp, Homo sapiens
tattaaaattctgaatttt

SEQ ID NO: 3442206 - DNA, 13 bp, Homo sapiens
tattaaacagata

SEQ ID NO: 3442207 - DNA, 17 bp, Homo sapiens
tattaaacagatatctt

SEQ ID NO: 3442208 - DNA, 12 bp, Homo sapiens
tattaaagacag

SEQ ID NO: 3442209 - DNA, 14 bp, Homo sapiens
tattaaataaaatg

SEQ ID NO: 3442210 - DNA, 16 bp, Homo sapiens
tattaaatacaaaact

SEQ ID NO: 3442211 - DNA, 21 bp, Homo sapiens
tattaaattaaattttgtgtc

SEQ ID NO: 3442212 - DNA, 14 bp, Homo sapiens
tattaaggaagaca

SEQ ID NO: 3442213 - DNA, 16 bp, Homo sapiens
tattaaggatgtagct

SEQ ID NO: 3442214 - DNA, 15 bp, Homo sapiens
tattaatactggtat

SEQ ID NO: 3442215 - DNA, 21 bp, Homo sapiens
tattacatagtttgaaaaata

SEQ ID NO: 3442216 - DNA, 18 bp, Homo sapiens
tattacatgtaatttgat

SEQ ID NO: 3442217 - DNA, 11 bp, Homo sapiens
tattacctctg

SEQ ID NO: 3442218 - DNA, 14 bp, Homo sapiens
tattacctctgata

SEQ ID NO: 3442219 - DNA, 14 bp, Homo sapiens
tattagatgttctc

SEQ ID NO: 3442220 - DNA, 17 bp, Homo sapiens
tattagatgttctctat

SEQ ID NO: 3442221 - DNA, 15 bp, Homo sapiens
tattagccacaaaat

SEQ ID NO: 3442222 - DNA, 23 bp, Homo sapiens
tattagccacaaaattgggaaag

SEQ ID NO: 3442223 - DNA, 14 bp, Homo sapiens
tattagctttactg

SEQ ID NO: 3442224 - DNA, 16 bp, Homo sapiens
tattagctttactgtt

SEQ ID NO: 3442225 - DNA, 14 bp, Homo sapiens
tattagtaccatag

SEQ ID NO: 3442226 - DNA, 20 bp, Homo sapiens
tattatagagagttatgaac

SEQ ID NO: 3442227 - DNA, 18 bp, Homo sapiens
tattatcatgcaaatgct

SEQ ID NO: 3442228 - DNA, 17 bp, Homo sapiens
tattatgagatgctggc

SEQ ID NO: 3442229 - DNA, 15 bp, Homo sapiens
tattatggaaaacat

SEQ ID NO: 3442230 - DNA, 12 bp, Homo sapiens
tattatgtataa

SEQ ID NO: 3442231 - DNA, 20 bp, Homo sapiens
tattatgtataaaatgtaac

SEQ ID NO: 3442232 - DNA, 14 bp, Homo sapiens
tattattatttatt

SEQ ID NO: 3442233 - DNA, 17 bp, Homo sapiens
tattattctcatttagt

SEQ ID NO: 3442234 - DNA, 18 bp, Homo sapiens
tattattctcatttagtg

SEQ ID NO: 3442235 - DNA, 22 bp, Homo sapiens
tattcacatcgcttctgtgtat

SEQ ID NO: 3442236 - DNA, 16 bp, Homo sapiens
tattcagaatctttgt

SEQ ID NO: 3442237 - DNA, 16 bp, Homo sapiens
tattcagacaaaatgg

SEQ ID NO: 3442238 - DNA, 17 bp, Homo sapiens
tattcagacaaaatgga

SEQ ID NO: 3442239 - DNA, 13 bp, Homo sapiens
tattcagacagat

SEQ ID NO: 3442240 - DNA, 15 bp, Homo sapiens
tattcagtgtcactg

SEQ ID NO: 3442241 - DNA, 14 bp, Homo sapiens
tattcatatattgc

SEQ ID NO: 3442242 - DNA, 21 bp, Homo sapiens
tattcatatattgcatttctg

SEQ ID NO: 3442243 - DNA, 17 bp, Homo sapiens
tattcattatttgtcaa

SEQ ID NO: 3442244 - DNA, 19 bp, Homo sapiens
tattcattatttgtcaaat

SEQ ID NO: 3442245 - DNA, 17 bp, Homo sapiens
tattccaagcttccata

SEQ ID NO: 3442246 - DNA, 17 bp, Homo sapiens
tattccagaatgctgta

SEQ ID NO: 3442247 - DNA, 20 bp, Homo sapiens
tattccagaatgctgtacat

SEQ ID NO: 3442248 - DNA, 21 bp, Homo sapiens
tattccagaatgctgtacatc

SEQ ID NO: 3442249 - DNA, 18 bp, Homo sapiens
tattcccccctaagcttc

SEQ ID NO: 3442250 - DNA, 20 bp, Homo sapiens
tattcctatatagtttattg

SEQ ID NO: 3442251 - DNA, 21 bp, Homo sapiens
tattcctatatagtttattga

SEQ ID NO: 3442252 - DNA, 22 bp, Homo sapiens
tattcgatactgcgactttctg

SEQ ID NO: 3442253 - DNA, 13 bp, Homo sapiens
tattctatgtagt

SEQ ID NO: 3442254 - DNA, 15 bp, Homo sapiens
tattctatgtagtgg

SEQ ID NO: 3442255 - DNA, 16 bp, Homo sapiens
tattctcatttagtgc

SEQ ID NO: 3442256 - DNA, 18 bp, Homo sapiens
tattctctgagctgtgca

SEQ ID NO: 3442257 - DNA, 19 bp, Homo sapiens
tattctctgagctgtgcag

SEQ ID NO: 3442258 - DNA, 14 bp, Homo sapiens
tattgaaagaatta

SEQ ID NO: 3442259 - DNA, 19 bp, Homo sapiens
tattgacaataaaatatta

SEQ ID NO: 3442260 - DNA, 20 bp, Homo sapiens
tattgacacagaaaatgttg

SEQ ID NO: 3442261 - DNA, 15 bp, Homo sapiens
tattgaccaccagtt

SEQ ID NO: 3442262 - DNA, 15 bp, Homo sapiens
tattgactctgggtc

SEQ ID NO: 3442263 - DNA, 18 bp, Homo sapiens
tattgactttcttaaaaa

SEQ ID NO: 3442264 - DNA, 17 bp, Homo sapiens
tattgagattgtcctca

SEQ ID NO: 3442265 - DNA, 14 bp, Homo sapiens
tattgcacatgtct

SEQ ID NO: 3442266 - DNA, 14 bp, Homo sapiens
tattgcacattgtt

SEQ ID NO: 3442267 - DNA, 15 bp, Homo sapiens
tattgcatctgtata

SEQ ID NO: 3442268 - DNA, 16 bp, Homo sapiens
tattgccttctcacca

SEQ ID NO: 3442269 - DNA, 20 bp, Homo sapiens
tattgccttctcaccagctg

SEQ ID NO: 3442270 - DNA, 15 bp, Homo sapiens
tattgctgagagaaa

SEQ ID NO: 3442271 - DNA, 17 bp, Homo sapiens
tattggacaaagaacct

SEQ ID NO: 3442272 - DNA, 17 bp, Homo sapiens
tattggcactgctaaaa

SEQ ID NO: 3442273 - DNA, 17 bp, Homo sapiens
tattggtgtactgtaat

SEQ ID NO: 3442274 - DNA, 15 bp, Homo sapiens
tattgtatttattca

SEQ ID NO: 3442275 - DNA, 17 bp, Homo sapiens
tattgtatttattcaat

SEQ ID NO: 3442276 - DNA, 17 bp, Homo sapiens
tattgtccattgtccaa

SEQ ID NO: 3442277 - DNA, 18 bp, Homo sapiens
tattgtgtttgtcattag

SEQ ID NO: 3442278 - DNA, 23 bp, Homo sapiens
tattgttccagcagttttcaagt

SEQ ID NO: 3442279 - DNA, 13 bp, Homo sapiens
tattgttgttact

SEQ ID NO: 3442280 - DNA, 18 bp, Homo sapiens
tattgtttcaattgcatc

SEQ ID NO: 3442281 - DNA, 13 bp, Homo sapiens
tatttaaaaatgt

SEQ ID NO: 3442282 - DNA, 23 bp, Homo sapiens
tatttaacagctgaattatctat

SEQ ID NO: 3442283 - DNA, 17 bp, Homo sapiens
tatttaagcaacatctt

SEQ ID NO: 3442284 - DNA, 18 bp, Homo sapiens
tatttaagcaacatcttt

SEQ ID NO: 3442285 - DNA, 21 bp, Homo sapiens
tatttaatgccgatatactct

SEQ ID NO: 3442286 - DNA, 18 bp, Homo sapiens
tatttaatgttttaaatg

SEQ ID NO: 3442287 - DNA, 18 bp, Homo sapiens
tatttaccaaaaattttg

SEQ ID NO: 3442288 - DNA, 14 bp, Homo sapiens
tatttacgctttga

SEQ ID NO: 3442289 - DNA, 19 bp, Homo sapiens
tatttagcttgggaaaggt

SEQ ID NO: 3442290 - DNA, 17 bp, Homo sapiens
tatttagggaactgctt

SEQ ID NO: 3442291 - DNA, 19 bp, Homo sapiens
tatttataacaacctaaat

SEQ ID NO: 3442292 - DNA, 20 bp, Homo sapiens
tatttatctgtgcaaatcct

SEQ ID NO: 3442293 - DNA, 13 bp, Homo sapiens
tatttattcaata

SEQ ID NO: 3442294 - DNA, 14 bp, Homo sapiens
tatttattcaataa

SEQ ID NO: 3442295 - DNA, 18 bp, Homo sapiens
tatttattcaataaagta

SEQ ID NO: 3442296 - DNA, 19 bp, Homo sapiens
tatttattcaataaagtat

SEQ ID NO: 3442297 - DNA, 19 bp, Homo sapiens
tatttcagatgtaatgttt

SEQ ID NO: 3442298 - DNA, 17 bp, Homo sapiens
tatttcagtgttacctg

SEQ ID NO: 3442299 - DNA, 18 bp, Homo sapiens
tatttcagtgttacctgt

SEQ ID NO: 3442300 - DNA, 20 bp, Homo sapiens
tatttcagtgttacctgtgt

SEQ ID NO: 3442301 - DNA, 20 bp, Homo sapiens
tatttccactattttcaaag

SEQ ID NO: 3442302 - DNA, 20 bp, Homo sapiens
tatttccctcccctggggac

SEQ ID NO: 3442303 - DNA, 13 bp, Homo sapiens
tatttctattatt

SEQ ID NO: 3442304 - DNA, 11 bp, Homo sapiens
tatttctattg

SEQ ID NO: 3442305 - DNA, 22 bp, Homo sapiens
tatttctcagactttggaaaat

SEQ ID NO: 3442306 - DNA, 13 bp, Homo sapiens
tatttcttaaaca

SEQ ID NO: 3442307 - DNA, 19 bp, Homo sapiens
tatttcttcttcacatcca

SEQ ID NO: 3442308 - DNA, 12 bp, Homo sapiens
tatttgaatctt

SEQ ID NO: 3442309 - DNA, 16 bp, Homo sapiens
tatttgaatcttgtct

SEQ ID NO: 3442310 - DNA, 18 bp, Homo sapiens
tatttgaatcttgtctca

SEQ ID NO: 3442311 - DNA, 19 bp, Homo sapiens
tatttgaatcttgtctcaa

SEQ ID NO: 3442312 - DNA, 14 bp, Homo sapiens
tatttgagaatata

SEQ ID NO: 3442313 - DNA, 16 bp, Homo sapiens
tatttgattcaaaata

SEQ ID NO: 3442314 - DNA, 22 bp, Homo sapiens
tatttgcataacaattcctcta

SEQ ID NO: 3442315 - DNA, 15 bp, Homo sapiens
tatttgtaggagaaa

SEQ ID NO: 3442316 - DNA, 12 bp, Homo sapiens
tatttgtcaaat

SEQ ID NO: 3442317 - DNA, 17 bp, Homo sapiens
tatttgtgtatttaaca

SEQ ID NO: 3442318 - DNA, 14 bp, Homo sapiens
tattttaagtattg

SEQ ID NO: 3442319 - DNA, 22 bp, Homo sapiens
tattttataatgttgtatttaa

SEQ ID NO: 3442320 - DNA, 23 bp, Homo sapiens
tattttatctttgattctccttc

SEQ ID NO: 3442321 - DNA, 21 bp, Homo sapiens
tattttattacatctttcaca

SEQ ID NO: 3442322 - DNA, 12 bp, Homo sapiens
tattttcaaaga

SEQ ID NO: 3442323 - DNA, 20 bp, Homo sapiens
tattttcaaccataaaagaa

SEQ ID NO: 3442324 - DNA, 22 bp, Homo sapiens
tattttcaaccataaaagaagt

SEQ ID NO: 3442325 - DNA, 14 bp, Homo sapiens
tattttcagatgtg

SEQ ID NO: 3442326 - DNA, 14 bp, Homo sapiens
tattttccatatat

SEQ ID NO: 3442327 - DNA, 22 bp, Homo sapiens
tattttccctattagagaagag

SEQ ID NO: 3442328 - DNA, 12 bp, Homo sapiens
tattttcctgcc

SEQ ID NO: 3442329 - DNA, 14 bp, Homo sapiens
tattttctatttta

SEQ ID NO: 3442330 - DNA, 16 bp, Homo sapiens
tattttggattgtgga

SEQ ID NO: 3442331 - DNA, 16 bp, Homo sapiens
tattttgtcatatcaa

SEQ ID NO: 3442332 - DNA, 18 bp, Homo sapiens
tattttgtcatatcaaat

SEQ ID NO: 3442333 - DNA, 13 bp, Homo sapiens
tattttgtctaaa

SEQ ID NO: 3442334 - DNA, 19 bp, Homo sapiens
tatttttatataatatcta

SEQ ID NO: 3442335 - DNA, 23 bp, Homo sapiens
tatttttatataatatctaaagt

SEQ ID NO: 3442336 - DNA, 18 bp, Homo sapiens
tatttttcaataaagcat

SEQ ID NO: 3442337 - DNA, 20 bp, Homo sapiens
tatttttcaataaagcattt

SEQ ID NO: 3442338 - DNA, 16 bp, Homo sapiens
tatttttgctgcttct

SEQ ID NO: 3442339 - DNA, 14 bp, Homo sapiens
tatttttgtacatg

SEQ ID NO: 3442340 - DNA, 13 bp, Homo sapiens
tatttttgttaat

SEQ ID NO: 3442341 - DNA, 11 bp, Homo sapiens
tattttttcct

SEQ ID NO: 3442342 - DNA, 12 bp, Homo sapiens
tattttttctgt

SEQ ID NO: 3442343 - DNA, 14 bp, Homo sapiens
tattttttgacact

SEQ ID NO: 3442344 - DNA, 17 bp, Homo sapiens
tatttttttgcaagtga

SEQ ID NO: 3442345 - DNA, 16 bp, Homo sapiens
tcaaaaaaagccttta

SEQ ID NO: 3442346 - DNA, 22 bp, Homo sapiens
tcaaaacggttttactgcagct

SEQ ID NO: 3442347 - DNA, 16 bp, Homo sapiens
tcaaaactacaaatca

SEQ ID NO: 3442348 - DNA, 11 bp, Homo sapiens
tcaaaaggaac

SEQ ID NO: 3442349 - DNA, 14 bp, Homo sapiens
tcaaaagttgaaat

SEQ ID NO: 3442350 - DNA, 20 bp, Homo sapiens
tcaaaataaaaaccaagaag

SEQ ID NO: 3442351 - DNA, 15 bp, Homo sapiens
tcaaaatagaaaagt

SEQ ID NO: 3442352 - DNA, 20 bp, Homo sapiens
tcaaaatatttaaaaatgtc

SEQ ID NO: 3442353 - DNA, 22 bp, Homo sapiens
tcaaaatatttaaaaatgtctt

SEQ ID NO: 3442354 - DNA, 16 bp, Homo sapiens
tcaaacaaagccagaa

SEQ ID NO: 3442355 - DNA, 16 bp, Homo sapiens
tcaaacactgcaggca

SEQ ID NO: 3442356 - DNA, 14 bp, Homo sapiens
tcaaagaaggcatt

SEQ ID NO: 3442357 - DNA, 19 bp, Homo sapiens
tcaaagcaattgaaatgca

SEQ ID NO: 3442358 - DNA, 12 bp, Homo sapiens
tcaaagccagcg

SEQ ID NO: 3442359 - DNA, 23 bp, Homo sapiens
tcaaagccagcgtcctcctctgt

SEQ ID NO: 3442360 - DNA, 20 bp, Homo sapiens
tcaaagtgtaaacaccatag

SEQ ID NO: 3442361 - DNA, 12 bp, Homo sapiens
tcaaataagaaa

SEQ ID NO: 3442362 - DNA, 16 bp, Homo sapiens
tcaaatccctctccaa

SEQ ID NO: 3442363 - DNA, 19 bp, Homo sapiens
tcaaatctcttccttccct

SEQ ID NO: 3442364 - DNA, 17 bp, Homo sapiens
tcaaatggaagacacat

SEQ ID NO: 3442365 - DNA, 17 bp, Homo sapiens
tcaaattaataatctta

SEQ ID NO: 3442366 - DNA, 22 bp, Homo sapiens
tcaaattaataatcttattagg

SEQ ID NO: 3442367 - DNA, 19 bp, Homo sapiens
tcaaattctttttttatta

SEQ ID NO: 3442368 - DNA, 22 bp, Homo sapiens
tcaaattctttttttattatta

SEQ ID NO: 3442369 - DNA, 18 bp, Homo sapiens
tcaaatttatttttttct

SEQ ID NO: 3442370 - DNA, 15 bp, Homo sapiens
tcaacaaaaattgtc

SEQ ID NO: 3442371 - DNA, 18 bp, Homo sapiens
tcaacaataaaatttttt

SEQ ID NO: 3442372 - DNA, 18 bp, Homo sapiens
tcaacaccttaatatgct

SEQ ID NO: 3442373 - DNA, 23 bp, Homo sapiens
tcaacactaccagcgtatatata

SEQ ID NO: 3442374 - DNA, 15 bp, Homo sapiens
tcaacagtgaagaca

SEQ ID NO: 3442375 - DNA, 22 bp, Homo sapiens
tcaacagtgaagacagaagttt

SEQ ID NO: 3442376 - DNA, 16 bp, Homo sapiens
tcaacagttcaaagaa

SEQ ID NO: 3442377 - DNA, 18 bp, Homo sapiens
tcaacatttattttgaga

SEQ ID NO: 3442378 - DNA, 17 bp, Homo sapiens
tcaaccaatgccaaaaa

SEQ ID NO: 3442379 - DNA, 13 bp, Homo sapiens
tcaaccatcctgg

SEQ ID NO: 3442380 - DNA, 20 bp, Homo sapiens
tcaaccccaccatatgaatt

SEQ ID NO: 3442381 - DNA, 18 bp, Homo sapiens
tcaaccccttcgctcctg

SEQ ID NO: 3442382 - DNA, 19 bp, Homo sapiens
tcaaccccttcgctcctgt

SEQ ID NO: 3442383 - DNA, 12 bp, Homo sapiens
tcaaccctcagc

SEQ ID NO: 3442384 - DNA, 17 bp, Homo sapiens
tcaacctcttctggctc

SEQ ID NO: 3442385 - DNA, 18 bp, Homo sapiens
tcaacctcttctggctca

SEQ ID NO: 3442386 - DNA, 19 bp, Homo sapiens
tcaacctcttctggctcaa

SEQ ID NO: 3442387 - DNA, 13 bp, Homo sapiens
tcaacctgcctga

SEQ ID NO: 3442388 - DNA, 18 bp, Homo sapiens
tcaacctgggcaaagcct

SEQ ID NO: 3442389 - DNA, 14 bp, Homo sapiens
tcaaccttggcctt

SEQ ID NO: 3442390 - DNA, 18 bp, Homo sapiens
tcaaccttggccttctcc

SEQ ID NO: 3442391 - DNA, 14 bp, Homo sapiens
tcaactatgtaggt

SEQ ID NO: 3442392 - DNA, 18 bp, Homo sapiens
tcaactttgaataaagaa

SEQ ID NO: 3442393 - DNA, 20 bp, Homo sapiens
tcaagaaataaaaggaagcc

SEQ ID NO: 3442394 - DNA, 15 bp, Homo sapiens
tcaagagcacacttg

SEQ ID NO: 3442395 - DNA, 17 bp, Homo sapiens
tcaagagggtctgagga

SEQ ID NO: 3442396 - DNA, 19 bp, Homo sapiens
tcaagatactgctactgta

SEQ ID NO: 3442397 - DNA, 19 bp, Homo sapiens
tcaagatgggggcagggct

SEQ ID NO: 3442398 - DNA, 16 bp, Homo sapiens
tcaagcagtcgtgcct

SEQ ID NO: 3442399 - DNA, 19 bp, Homo sapiens
tcaagccaagcagccaagc

SEQ ID NO: 3442400 - DNA, 18 bp, Homo sapiens
tcaagcctgtgcaaaaaa

SEQ ID NO: 3442401 - DNA, 16 bp, Homo sapiens
tcaagctctgcaacag

SEQ ID NO: 3442402 - DNA, 21 bp, Homo sapiens
tcaagctggtggcctctgcag

SEQ ID NO: 3442403 - DNA, 17 bp, Homo sapiens
tcaaggaacttgaaaaa

SEQ ID NO: 3442404 - DNA, 18 bp, Homo sapiens
tcaaggaacttgaaaaat

SEQ ID NO: 3442405 - DNA, 22 bp, Homo sapiens
tcaaggaacttgaaaaatactt

SEQ ID NO: 3442406 - DNA, 18 bp, Homo sapiens
tcaaggaataatgggctt

SEQ ID NO: 3442407 - DNA, 13 bp, Homo sapiens
tcaaggcactgcc

SEQ ID NO: 3442408 - DNA, 14 bp, Homo sapiens
tcaaggcactgcct

SEQ ID NO: 3442409 - DNA, 16 bp, Homo sapiens
tcaaggcactgcctga

SEQ ID NO: 3442410 - DNA, 17 bp, Homo sapiens
tcaaggctgcttagaat

SEQ ID NO: 3442411 - DNA, 17 bp, Homo sapiens
tcaaggcttcagtctca

SEQ ID NO: 3442412 - DNA, 17 bp, Homo sapiens
tcaagtctctgctggcc

SEQ ID NO: 3442413 - DNA, 15 bp, Homo sapiens
tcaagtgaaaaagga

SEQ ID NO: 3442414 - DNA, 23 bp, Homo sapiens
tcaagtgaaaaaggaggaagaga

SEQ ID NO: 3442415 - DNA, 16 bp, Homo sapiens
tcaagtgattctcctg

SEQ ID NO: 3442416 - DNA, 18 bp, Homo sapiens
tcaagtgattctcctgcc

SEQ ID NO: 3442417 - DNA, 21 bp, Homo sapiens
tcaagttttaagtgaaagtga

SEQ ID NO: 3442418 - DNA, 18 bp, Homo sapiens
tcaataaaaaacaaatat

SEQ ID NO: 3442419 - DNA, 20 bp, Homo sapiens
tcaataaaaaacaaatatat

SEQ ID NO: 3442420 - DNA, 15 bp, Homo sapiens
tcaataaagcattta

SEQ ID NO: 3442421 - DNA, 19 bp, Homo sapiens
tcaataaagcatttataaa

SEQ ID NO: 3442422 - DNA, 11 bp, Homo sapiens
tcaataaagta

SEQ ID NO: 3442423 - DNA, 16 bp, Homo sapiens
tcaataaagtatttaa

SEQ ID NO: 3442424 - DNA, 22 bp, Homo sapiens
tcaataaagtatttaattagtg

SEQ ID NO: 3442425 - DNA, 21 bp, Homo sapiens
tcaatagtgcaactgttttga

SEQ ID NO: 3442426 - DNA, 18 bp, Homo sapiens
tcaatagttcaaggaact

SEQ ID NO: 3442427 - DNA, 22 bp, Homo sapiens
tcaatataatgtttttaatatt

SEQ ID NO: 3442428 - DNA, 12 bp, Homo sapiens
tcaatattgaat

SEQ ID NO: 3442429 - DNA, 10 bp, Homo sapiens
tcaatattta

SEQ ID NO: 3442430 - DNA, 13 bp, Homo sapiens
tcaatcaacacta

SEQ ID NO: 3442431 - DNA, 15 bp, Homo sapiens
tcaatcaacactacc

SEQ ID NO: 3442432 - DNA, 15 bp, Homo sapiens
tcaatcctacctgtt

SEQ ID NO: 3442433 - DNA, 13 bp, Homo sapiens
tcaatgctcataa

SEQ ID NO: 3442434 - DNA, 14 bp, Homo sapiens
tcaatgctcataac

SEQ ID NO: 3442435 - DNA, 19 bp, Homo sapiens
tcaattagaatagtgttct

SEQ ID NO: 3442436 - DNA, 14 bp, Homo sapiens
tcaattcctctggg

SEQ ID NO: 3442437 - DNA, 15 bp, Homo sapiens
tcaattcctctggga

SEQ ID NO: 3442438 - DNA, 16 bp, Homo sapiens
tcaattcttgccaaat

SEQ ID NO: 3442439 - DNA, 16 bp, Homo sapiens
tcaattgcatctccca

SEQ ID NO: 3442440 - DNA, 13 bp, Homo sapiens
tcaattgtaaatt

SEQ ID NO: 3442441 - DNA, 14 bp, Homo sapiens
tcaattgtaaattg

SEQ ID NO: 3442442 - DNA, 13 bp, Homo sapiens
tcaatttatgaat

SEQ ID NO: 3442443 - DNA, 14 bp, Homo sapiens
tcacaaaattttat

SEQ ID NO: 3442444 - DNA, 22 bp, Homo sapiens
tcacaaaattttattcctatat

SEQ ID NO: 3442445 - DNA, 21 bp, Homo sapiens
tcacaaacttttatactcttt

SEQ ID NO: 3442446 - DNA, 15 bp, Homo sapiens
tcacaaagcccaagg

SEQ ID NO: 3442447 - DNA, 14 bp, Homo sapiens
tcacaagcacaaag

SEQ ID NO: 3442448 - DNA, 18 bp, Homo sapiens
tcacaagcacaaagctca

SEQ ID NO: 3442449 - DNA, 22 bp, Homo sapiens
tcacaattccatttccagttca

SEQ ID NO: 3442450 - DNA, 16 bp, Homo sapiens
tcacacctgccctaaa

SEQ ID NO: 3442451 - DNA, 12 bp, Homo sapiens
tcacactgagaa

SEQ ID NO: 3442452 - DNA, 19 bp, Homo sapiens
tcacactgagaatgtaaga

SEQ ID NO: 3442453 - DNA, 16 bp, Homo sapiens
tcacactgggtggtgg

SEQ ID NO: 3442454 - DNA, 23 bp, Homo sapiens
tcacactgggtggtggcctggtc

SEQ ID NO: 3442455 - DNA, 20 bp, Homo sapiens
tcacagatcgcatttcctaa

SEQ ID NO: 3442456 - DNA, 15 bp, Homo sapiens
tcacaggcaggtcca

SEQ ID NO: 3442457 - DNA, 13 bp, Homo sapiens
tcacagtgtttct

SEQ ID NO: 3442458 - DNA, 14 bp, Homo sapiens
tcacagtgtttctt

SEQ ID NO: 3442459 - DNA, 19 bp, Homo sapiens
tcacagttctttgggccag

SEQ ID NO: 3442460 - DNA, 20 bp, Homo sapiens
tcacagttctttgggccaga

SEQ ID NO: 3442461 - DNA, 11 bp, Homo sapiens
tcacataataa

SEQ ID NO: 3442462 - DNA, 18 bp, Homo sapiens
tcacatacaattattttt

SEQ ID NO: 3442463 - DNA, 23 bp, Homo sapiens
tcacatattttattaagaactca

SEQ ID NO: 3442464 - DNA, 19 bp, Homo sapiens
tcacatccattgtctcttc

SEQ ID NO: 3442465 - DNA, 21 bp, Homo sapiens
tcacatcgcttctgtgtatct

SEQ ID NO: 3442466 - DNA, 19 bp, Homo sapiens
tcacattaatatttgctga

SEQ ID NO: 3442467 - DNA, 20 bp, Homo sapiens
tcacattaatatttgctgac

SEQ ID NO: 3442468 - DNA, 18 bp, Homo sapiens
tcacattcccctggggac

SEQ ID NO: 3442469 - DNA, 12 bp, Homo sapiens
tcacattctgct

SEQ ID NO: 3442470 - DNA, 16 bp, Homo sapiens
tcacattctgcttaaa

SEQ ID NO: 3442471 - DNA, 14 bp, Homo sapiens
tcacattcttggct

SEQ ID NO: 3442472 - DNA, 19 bp, Homo sapiens
tcacattgtttgctgctat

SEQ ID NO: 3442473 - DNA, 12 bp, Homo sapiens
tcacatttaaat

SEQ ID NO: 3442474 - DNA, 14 bp, Homo sapiens
tcacatttattctg

SEQ ID NO: 3442475 - DNA, 17 bp, Homo sapiens
tcacatttattctgctc

SEQ ID NO: 3442476 - DNA, 15 bp, Homo sapiens
tcaccaaaagacact

SEQ ID NO: 3442477 - DNA, 16 bp, Homo sapiens
tcaccaaaagacactg

SEQ ID NO: 3442478 - DNA, 20 bp, Homo sapiens
tcaccacatgcggagaacaa

SEQ ID NO: 3442479 - DNA, 11 bp, Homo sapiens
tcaccaccccc

SEQ ID NO: 3442480 - DNA, 17 bp, Homo sapiens
tcaccagccccagtgcc

SEQ ID NO: 3442481 - DNA, 12 bp, Homo sapiens
tcaccagctgca

SEQ ID NO: 3442482 - DNA, 14 bp, Homo sapiens
tcaccagctgcaaa

SEQ ID NO: 3442483 - DNA, 21 bp, Homo sapiens
tcaccagctgcaaagtgtttt

SEQ ID NO: 3442484 - DNA, 14 bp, Homo sapiens
tcaccatctgtgca

SEQ ID NO: 3442485 - DNA, 15 bp, Homo sapiens
tcaccattctgcatt

SEQ ID NO: 3442486 - DNA, 21 bp, Homo sapiens
tcaccattctgcatttagctg

SEQ ID NO: 3442487 - DNA, 13 bp, Homo sapiens
tcacccacccctg

SEQ ID NO: 3442488 - DNA, 13 bp, Homo sapiens
tcaccccaccctt

SEQ ID NO: 3442489 - DNA, 12 bp, Homo sapiens
tcaccccagggc

SEQ ID NO: 3442490 - DNA, 16 bp, Homo sapiens
tcaccccagggcctga

SEQ ID NO: 3442491 - DNA, 20 bp, Homo sapiens
tcaccccagggcctgagcct

SEQ ID NO: 3442492 - DNA, 13 bp, Homo sapiens
tcacccccttctc

SEQ ID NO: 3442493 - DNA, 22 bp, Homo sapiens
tcacccccttctccatccacat

SEQ ID NO: 3442494 - DNA, 18 bp, Homo sapiens
tcacccctggttctcatc

SEQ ID NO: 3442495 - DNA, 19 bp, Homo sapiens
tcacccctggttctcatct

SEQ ID NO: 3442496 - DNA, 15 bp, Homo sapiens
tcaccctagccctct

SEQ ID NO: 3442497 - DNA, 23 bp, Homo sapiens
tcaccctgatttaggagaagcca

SEQ ID NO: 3442498 - DNA, 17 bp, Homo sapiens
tcaccgtgggctccctg

SEQ ID NO: 3442499 - DNA, 20 bp, Homo sapiens
tcacctatttccattcaaca

SEQ ID NO: 3442500 - DNA, 12 bp, Homo sapiens
tcacctcagcct

SEQ ID NO: 3442501 - DNA, 13 bp, Homo sapiens
tcacctcagcctc

SEQ ID NO: 3442502 - DNA, 20 bp, Homo sapiens
tcacctcttccactccttct

SEQ ID NO: 3442503 - DNA, 19 bp, Homo sapiens
tcacctgattcaactaaaa

SEQ ID NO: 3442504 - DNA, 21 bp, Homo sapiens
tcacctgattcaactaaaaaa

SEQ ID NO: 3442505 - DNA, 15 bp, Homo sapiens
tcacctgccctgtgc

SEQ ID NO: 3442506 - DNA, 17 bp, Homo sapiens
tcacctggggctgctgg

SEQ ID NO: 3442507 - DNA, 20 bp, Homo sapiens
tcacctggggctgctggcct

SEQ ID NO: 3442508 - DNA, 23 bp, Homo sapiens
tcacctgtactattgcagacctg

SEQ ID NO: 3442509 - DNA, 21 bp, Homo sapiens
tcacctgtgcttcgggccctt

SEQ ID NO: 3442510 - DNA, 18 bp, Homo sapiens
tcacctgtttttaagctg

SEQ ID NO: 3442511 - DNA, 20 bp, Homo sapiens
tcacctgtttttaagctgtt

SEQ ID NO: 3442512 - DNA, 21 bp, Homo sapiens
tcacctgtttttaagctgttt

SEQ ID NO: 3442513 - DNA, 20 bp, Homo sapiens
tcaccttaggcagggaagtg

SEQ ID NO: 3442514 - DNA, 21 bp, Homo sapiens
tcaccttcgtttactatgcct

SEQ ID NO: 3442515 - DNA, 22 bp, Homo sapiens
tcaccttcgtttactatgcctg

SEQ ID NO: 3442516 - DNA, 15 bp, Homo sapiens
tcacctttactttag

SEQ ID NO: 3442517 - DNA, 17 bp, Homo sapiens
tcacctttactttagaa

SEQ ID NO: 3442518 - DNA, 19 bp, Homo sapiens
tcacctttgtagcactcag

SEQ ID NO: 3442519 - DNA, 18 bp, Homo sapiens
tcacgattgtcatcagga

SEQ ID NO: 3442520 - DNA, 15 bp, Homo sapiens
tcacgcacctcccat

SEQ ID NO: 3442521 - DNA, 16 bp, Homo sapiens
tcacgcacctcccatc

SEQ ID NO: 3442522 - DNA, 17 bp, Homo sapiens
tcacgcacctcccatcc

SEQ ID NO: 3442523 - DNA, 14 bp, Homo sapiens
tcacgcacctgggt

SEQ ID NO: 3442524 - DNA, 16 bp, Homo sapiens
tcacgccactgcacta

SEQ ID NO: 3442525 - DNA, 13 bp, Homo sapiens
tcacgcctgaaac

SEQ ID NO: 3442526 - DNA, 16 bp, Homo sapiens
tcacgcctgtaatccc

SEQ ID NO: 3442527 - DNA, 20 bp, Homo sapiens
tcacgcctgtaatcctagca

SEQ ID NO: 3442528 - DNA, 22 bp, Homo sapiens
tcacggcaggacaacgaggaag

SEQ ID NO: 3442529 - DNA, 20 bp, Homo sapiens
tcacggctcactgcagcctc

SEQ ID NO: 3442530 - DNA, 16 bp, Homo sapiens
tcacgtgcgctgggca

SEQ ID NO: 3442531 - DNA, 17 bp, Homo sapiens
tcacgtgcgctgggcac

SEQ ID NO: 3442532 - DNA, 22 bp, Homo sapiens
tcacgtgcgctgggcacttccc

SEQ ID NO: 3442533 - DNA, 23 bp, Homo sapiens
tcacgtgcgctgggcacttccct

SEQ ID NO: 3442534 - DNA, 16 bp, Homo sapiens
tcactaatttttgtat

SEQ ID NO: 3442535 - DNA, 12 bp, Homo sapiens
tcactagcagct

SEQ ID NO: 3442536 - DNA, 13 bp, Homo sapiens
tcactagcagctg

SEQ ID NO: 3442537 - DNA, 14 bp, Homo sapiens
tcactagcagctgc

SEQ ID NO: 3442538 - DNA, 19 bp, Homo sapiens
tcactaggcccccacttgc

SEQ ID NO: 3442539 - DNA, 21 bp, Homo sapiens
tcactaggcccccacttgcct

SEQ ID NO: 3442540 - DNA, 17 bp, Homo sapiens
tcactatgttgcccagg

SEQ ID NO: 3442541 - DNA, 19 bp, Homo sapiens
tcactatgttgcccaggca

SEQ ID NO: 3442542 - DNA, 14 bp, Homo sapiens
tcactcagatggaa

SEQ ID NO: 3442543 - DNA, 17 bp, Homo sapiens
tcactcattgctgagcc

SEQ ID NO: 3442544 - DNA, 18 bp, Homo sapiens
tcactcattgctgagcct

SEQ ID NO: 3442545 - DNA, 21 bp, Homo sapiens
tcactcccatacctttaatgg

SEQ ID NO: 3442546 - DNA, 17 bp, Homo sapiens
tcactcctgactgcccg

SEQ ID NO: 3442547 - DNA, 17 bp, Homo sapiens
tcactctcctatgcctt

SEQ ID NO: 3442548 - DNA, 15 bp, Homo sapiens
tcactctgagtgttt

SEQ ID NO: 3442549 - DNA, 12 bp, Homo sapiens
tcactctgtcgc

SEQ ID NO: 3442550 - DNA, 18 bp, Homo sapiens
tcactgcttttggcctgg

SEQ ID NO: 3442551 - DNA, 12 bp, Homo sapiens
tcactgtctttc

SEQ ID NO: 3442552 - DNA, 15 bp, Homo sapiens
tcactgtctttccta

SEQ ID NO: 3442553 - DNA, 21 bp, Homo sapiens
tcactgtgggaaggccagctg

SEQ ID NO: 3442554 - DNA, 11 bp, Homo sapiens
tcactgtgtta

SEQ ID NO: 3442555 - DNA, 16 bp, Homo sapiens
tcactgtgttactgct

SEQ ID NO: 3442556 - DNA, 14 bp, Homo sapiens
tcactgttgcccag

SEQ ID NO: 3442557 - DNA, 18 bp, Homo sapiens
tcactgttgcccaggctg

SEQ ID NO: 3442558 - DNA, 19 bp, Homo sapiens
tcactgttgcccaggctgg

SEQ ID NO: 3442559 - DNA, 20 bp, Homo sapiens
tcacttcttcacctcttcca

SEQ ID NO: 3442560 - DNA, 20 bp, Homo sapiens
tcacttgggaagaggacttc

SEQ ID NO: 3442561 - DNA, 19 bp, Homo sapiens
tcacttgtgccaacactca

SEQ ID NO: 3442562 - DNA, 13 bp, Homo sapiens
tcactttaaacct

SEQ ID NO: 3442563 - DNA, 16 bp, Homo sapiens
tcagaaaaaaattcat

SEQ ID NO: 3442564 - DNA, 18 bp, Homo sapiens
tcagaaacatcagttact

SEQ ID NO: 3442565 - DNA, 23 bp, Homo sapiens
tcagaaagtgtgctttatgctga

SEQ ID NO: 3442566 - DNA, 16 bp, Homo sapiens
tcagaaatacagattt

SEQ ID NO: 3442567 - DNA, 16 bp, Homo sapiens
tcagaaatttaaaagc

SEQ ID NO: 3442568 - DNA, 23 bp, Homo sapiens
tcagaaatttaaaagcagagcat

SEQ ID NO: 3442569 - DNA, 21 bp, Homo sapiens
tcagaaatttaattcatgttt

SEQ ID NO: 3442570 - DNA, 17 bp, Homo sapiens
tcagaaccctgccatgg

SEQ ID NO: 3442571 - DNA, 21 bp, Homo sapiens
tcagaaccctgccatggaact

SEQ ID NO: 3442572 - DNA, 20 bp, Homo sapiens
tcagaacccttggcttgccc

SEQ ID NO: 3442573 - DNA, 21 bp, Homo sapiens
tcagaactcaaatggggccag

SEQ ID NO: 3442574 - DNA, 14 bp, Homo sapiens
tcagaactgtgcca

SEQ ID NO: 3442575 - DNA, 18 bp, Homo sapiens
tcagaacttgctgctgtc

SEQ ID NO: 3442576 - DNA, 19 bp, Homo sapiens
tcagaacttgctgctgtct

SEQ ID NO: 3442577 - DNA, 14 bp, Homo sapiens
tcagaagacactga

SEQ ID NO: 3442578 - DNA, 14 bp, Homo sapiens
tcagaatccaaaga

SEQ ID NO: 3442579 - DNA, 21 bp, Homo sapiens
tcagacaaaatggatacataa

SEQ ID NO: 3442580 - DNA, 20 bp, Homo sapiens
tcagacacatgctatgttct

SEQ ID NO: 3442581 - DNA, 19 bp, Homo sapiens
tcagacacttcatggacca

SEQ ID NO: 3442582 - DNA, 17 bp, Homo sapiens
tcagacagagaggactg

SEQ ID NO: 3442583 - DNA, 15 bp, Homo sapiens
tcagacatgttttcc

SEQ ID NO: 3442584 - DNA, 19 bp, Homo sapiens
tcagactcccattcctgaa

SEQ ID NO: 3442585 - DNA, 22 bp, Homo sapiens
tcagactcccattcctgaagaa

SEQ ID NO: 3442586 - DNA, 15 bp, Homo sapiens
tcagactttggaaaa

SEQ ID NO: 3442587 - DNA, 19 bp, Homo sapiens
tcagactttggaaaatgca

SEQ ID NO: 3442588 - DNA, 20 bp, Homo sapiens
tcagactttggaaaatgcat

SEQ ID NO: 3442589 - DNA, 18 bp, Homo sapiens
tcagagaccaggccctgg

SEQ ID NO: 3442590 - DNA, 14 bp, Homo sapiens
tcagagatggacag

SEQ ID NO: 3442591 - DNA, 21 bp, Homo sapiens
tcagagccacagggtctgcct

SEQ ID NO: 3442592 - DNA, 23 bp, Homo sapiens
tcagagccacagggtctgcctcc

SEQ ID NO: 3442593 - DNA, 20 bp, Homo sapiens
tcagagccgtggtcctttgg

SEQ ID NO: 3442594 - DNA, 12 bp, Homo sapiens
tcagagcctgca

SEQ ID NO: 3442595 - DNA, 21 bp, Homo sapiens
tcagaggccctcgctgccagc

SEQ ID NO: 3442596 - DNA, 23 bp, Homo sapiens
tcagaggtttacctagagaacag

SEQ ID NO: 3442597 - DNA, 19 bp, Homo sapiens
tcagatcttaatataaatt

SEQ ID NO: 3442598 - DNA, 21 bp, Homo sapiens
tcagatcttaatataaattca

SEQ ID NO: 3442599 - DNA, 24 bp, Homo sapiens
tcagatcttaatataaattcactt

SEQ ID NO: 3442600 - DNA, 18 bp, Homo sapiens
tcagatgatttcccccct

SEQ ID NO: 3442601 - DNA, 21 bp, Homo sapiens
tcagatggaaccgcaggaagc

SEQ ID NO: 3442602 - DNA, 13 bp, Homo sapiens
tcagatgtaatgt

SEQ ID NO: 3442603 - DNA, 17 bp, Homo sapiens
tcagatgttttggtcaa

SEQ ID NO: 3442604 - DNA, 14 bp, Homo sapiens
tcagattgcatgtg

SEQ ID NO: 3442605 - DNA, 17 bp, Homo sapiens
tcagattgcatgtgact

SEQ ID NO: 3442606 - DNA, 15 bp, Homo sapiens
tcagatttccagtct

SEQ ID NO: 3442607 - DNA, 17 bp, Homo sapiens
tcagatttccagtctcc

SEQ ID NO: 3442608 - DNA, 13 bp, Homo sapiens
tcagcaaaccatt

SEQ ID NO: 3442609 - DNA, 20 bp, Homo sapiens
tcagcaaaccatttttaaag

SEQ ID NO: 3442610 - DNA, 20 bp, Homo sapiens
tcagcagactttctctgtgt

SEQ ID NO: 3442611 - DNA, 18 bp, Homo sapiens
tcagcagcaaattttcag

SEQ ID NO: 3442612 - DNA, 16 bp, Homo sapiens
tcagcatcctggcacc

SEQ ID NO: 3442613 - DNA, 22 bp, Homo sapiens
tcagccaaggttttataaggct

SEQ ID NO: 3442614 - DNA, 23 bp, Homo sapiens
tcagccaaggttttataaggctg

SEQ ID NO: 3442615 - DNA, 21 bp, Homo sapiens
tcagcctactccgctcactga

SEQ ID NO: 3442616 - DNA, 13 bp, Homo sapiens
tcagcctcccaaa

SEQ ID NO: 3442617 - DNA, 21 bp, Homo sapiens
tcagcctcccaaagtgctggg

SEQ ID NO: 3442618 - DNA, 17 bp, Homo sapiens
tcagcctcccaacccca

SEQ ID NO: 3442619 - DNA, 20 bp, Homo sapiens
tcagcctcccgaatagctgg

SEQ ID NO: 3442620 - DNA, 21 bp, Homo sapiens
tcagcctcccgagtagctggg

SEQ ID NO: 3442621 - DNA, 19 bp, Homo sapiens
tcagcctgctccagctgtt

SEQ ID NO: 3442622 - DNA, 16 bp, Homo sapiens
tcagcctggccagaca

SEQ ID NO: 3442623 - DNA, 21 bp, Homo sapiens
tcagccttgaaaaacaagtct

SEQ ID NO: 3442624 - DNA, 23 bp, Homo sapiens
tcagcgactccgttggccactcc

SEQ ID NO: 3442625 - DNA, 14 bp, Homo sapiens
tcagcggggacagc

SEQ ID NO: 3442626 - DNA, 15 bp, Homo sapiens
tcagcggggacagct

SEQ ID NO: 3442627 - DNA, 18 bp, Homo sapiens
tcagcggggacagctcct

SEQ ID NO: 3442628 - DNA, 20 bp, Homo sapiens
tcagcggggacagctccttc

SEQ ID NO: 3442629 - DNA, 23 bp, Homo sapiens
tcagctccagctcaccagcccca

SEQ ID NO: 3442630 - DNA, 24 bp, Homo sapiens
tcagctccagctcaccagccccag

SEQ ID NO: 3442631 - DNA, 15 bp, Homo sapiens
tcagctccccagagt

SEQ ID NO: 3442632 - DNA, 17 bp, Homo sapiens
tcagctccttcctggag

SEQ ID NO: 3442633 - DNA, 19 bp, Homo sapiens
tcagctctcagttgcagcc

SEQ ID NO: 3442634 - DNA, 23 bp, Homo sapiens
tcagctctgcaagaattgaagca

SEQ ID NO: 3442635 - DNA, 19 bp, Homo sapiens
tcagctcttcatctgccca

SEQ ID NO: 3442636 - DNA, 20 bp, Homo sapiens
tcagctcttcatctgcccaa

SEQ ID NO: 3442637 - DNA, 15 bp, Homo sapiens
tcagctgaacctggg

SEQ ID NO: 3442638 - DNA, 16 bp, Homo sapiens
tcagctgtagtcctca

SEQ ID NO: 3442639 - DNA, 20 bp, Homo sapiens
tcagcttctatccttgactt

SEQ ID NO: 3442640 - DNA, 22 bp, Homo sapiens
tcagctttaagatatctttgga

SEQ ID NO: 3442641 - DNA, 22 bp, Homo sapiens
tcaggaaaggaatcatttctat

SEQ ID NO: 3442642 - DNA, 13 bp, Homo sapiens
tcaggaagaacac

SEQ ID NO: 3442643 - DNA, 17 bp, Homo sapiens
tcaggaatattttccaa

SEQ ID NO: 3442644 - DNA, 18 bp, Homo sapiens
tcaggaatattttccaaa

SEQ ID NO: 3442645 - DNA, 10 bp, Homo sapiens
tcaggagcag

SEQ ID NO: 3442646 - DNA, 21 bp, Homo sapiens
tcaggagcagcctcagaacaa

SEQ ID NO: 3442647 - DNA, 12 bp, Homo sapiens
tcaggagcttgc

SEQ ID NO: 3442648 - DNA, 16 bp, Homo sapiens
tcaggaggaaggctta

SEQ ID NO: 3442649 - DNA, 14 bp, Homo sapiens
tcaggccagagcca

SEQ ID NO: 3442650 - DNA, 21 bp, Homo sapiens
tcaggccatcatcagtggagc

SEQ ID NO: 3442651 - DNA, 22 bp, Homo sapiens
tcaggccatcatcagtggagcc

SEQ ID NO: 3442652 - DNA, 23 bp, Homo sapiens
tcaggccatcatcagtggagcca

SEQ ID NO: 3442653 - DNA, 16 bp, Homo sapiens
tcaggcccggcagggc

SEQ ID NO: 3442654 - DNA, 23 bp, Homo sapiens
tcaggccggcagccccagcctgc

SEQ ID NO: 3442655 - DNA, 18 bp, Homo sapiens
tcaggctcgccaaggcct

SEQ ID NO: 3442656 - DNA, 21 bp, Homo sapiens
tcaggctcgccaaggcctagg

SEQ ID NO: 3442657 - DNA, 12 bp, Homo sapiens
tcagggacccct

SEQ ID NO: 3442658 - DNA, 14 bp, Homo sapiens
tcagggacccctgc

SEQ ID NO: 3442659 - DNA, 22 bp, Homo sapiens
tcagggaggccctgtgcccctt

SEQ ID NO: 3442660 - DNA, 20 bp, Homo sapiens
tcagggattttttttttaaa

SEQ ID NO: 3442661 - DNA, 19 bp, Homo sapiens
tcagggcagcgccaggctg

SEQ ID NO: 3442662 - DNA, 23 bp, Homo sapiens
tcaggggtgtgcggcctttggct

SEQ ID NO: 3442663 - DNA, 15 bp, Homo sapiens
tcagggtcatagcat

SEQ ID NO: 3442664 - DNA, 15 bp, Homo sapiens
tcagggtccagaccc

SEQ ID NO: 3442665 - DNA, 12 bp, Homo sapiens
tcagggtctctg

SEQ ID NO: 3442666 - DNA, 16 bp, Homo sapiens
tcagggtctctgctgc

SEQ ID NO: 3442667 - DNA, 18 bp, Homo sapiens
tcagggtctctgctgccg

SEQ ID NO: 3442668 - DNA, 16 bp, Homo sapiens
tcagggttggcccctg

SEQ ID NO: 3442669 - DNA, 19 bp, Homo sapiens
tcagggttggcccctgccc

SEQ ID NO: 3442670 - DNA, 13 bp, Homo sapiens
tcaggtaacaggc

SEQ ID NO: 3442671 - DNA, 15 bp, Homo sapiens
tcaggtaacaggcag

SEQ ID NO: 3442672 - DNA, 16 bp, Homo sapiens
tcaggtgagaagcaga

SEQ ID NO: 3442673 - DNA, 21 bp, Homo sapiens
tcaggtgagaagcagaggaag

SEQ ID NO: 3442674 - DNA, 13 bp, Homo sapiens
tcaggtgctgcca

SEQ ID NO: 3442675 - DNA, 14 bp, Homo sapiens
tcaggtgctgccat

SEQ ID NO: 3442676 - DNA, 18 bp, Homo sapiens
tcaggtgctgccatccag

SEQ ID NO: 3442677 - DNA, 13 bp, Homo sapiens
tcaggtgctgtcc

SEQ ID NO: 3442678 - DNA, 14 bp, Homo sapiens
tcaggtggggcagc

SEQ ID NO: 3442679 - DNA, 17 bp, Homo sapiens
tcaggtgtccctgcact

SEQ ID NO: 3442680 - DNA, 14 bp, Homo sapiens
tcaggttttgtaaa

SEQ ID NO: 3442681 - DNA, 13 bp, Homo sapiens
tcagtaagccgtg

SEQ ID NO: 3442682 - DNA, 21 bp, Homo sapiens
tcagtagtttgagaccagcct

SEQ ID NO: 3442683 - DNA, 21 bp, Homo sapiens
tcagtatgtgggggcttcatc

SEQ ID NO: 3442684 - DNA, 20 bp, Homo sapiens
tcagtatgttgtcaaagaga

SEQ ID NO: 3442685 - DNA, 14 bp, Homo sapiens
tcagtatttttcct

SEQ ID NO: 3442686 - DNA, 13 bp, Homo sapiens
tcagtcacagcca

SEQ ID NO: 3442687 - DNA, 14 bp, Homo sapiens
tcagtcacagccac

SEQ ID NO: 3442688 - DNA, 13 bp, Homo sapiens
tcagtcagtgctg

SEQ ID NO: 3442689 - DNA, 16 bp, Homo sapiens
tcagtcagtgctggag

SEQ ID NO: 3442690 - DNA, 20 bp, Homo sapiens
tcagtctctgagcagtgaat

SEQ ID NO: 3442691 - DNA, 22 bp, Homo sapiens
tcagtgcagcatatacaataat

SEQ ID NO: 3442692 - DNA, 12 bp, Homo sapiens
tcagtgctccct

SEQ ID NO: 3442693 - DNA, 16 bp, Homo sapiens
tcagtgctggagaaat

SEQ ID NO: 3442694 - DNA, 11 bp, Homo sapiens
tcagtggcagc

SEQ ID NO: 3442695 - DNA, 14 bp, Homo sapiens
tcagtggggcagtc

SEQ ID NO: 3442696 - DNA, 16 bp, Homo sapiens
tcagtggggctctctg

SEQ ID NO: 3442697 - DNA, 18 bp, Homo sapiens
tcagtggggctctctgag

SEQ ID NO: 3442698 - DNA, 21 bp, Homo sapiens
tcagtggtccacatcccggga

SEQ ID NO: 3442699 - DNA, 23 bp, Homo sapiens
tcagtgtaaatagttactccagt

SEQ ID NO: 3442700 - DNA, 19 bp, Homo sapiens
tcagtgtaccatttgcctc

SEQ ID NO: 3442701 - DNA, 16 bp, Homo sapiens
tcagtgtatttgtatt

SEQ ID NO: 3442702 - DNA, 16 bp, Homo sapiens
tcagtgtccaaagcag

SEQ ID NO: 3442703 - DNA, 17 bp, Homo sapiens
tcagtgttaaatgtgat

SEQ ID NO: 3442704 - DNA, 13 bp, Homo sapiens
tcagtgtttgttg

SEQ ID NO: 3442705 - DNA, 20 bp, Homo sapiens
tcagtgttttggactccatc

SEQ ID NO: 3442706 - DNA, 18 bp, Homo sapiens
tcagttaattcttagata

SEQ ID NO: 3442707 - DNA, 16 bp, Homo sapiens
tcagttacccactcgg

SEQ ID NO: 3442708 - DNA, 16 bp, Homo sapiens
tcagttactctgaagg

SEQ ID NO: 3442709 - DNA, 17 bp, Homo sapiens
tcagttattggtggaat

SEQ ID NO: 3442710 - DNA, 21 bp, Homo sapiens
tcagttgtccttaaatttgta

SEQ ID NO: 3442711 - DNA, 13 bp, Homo sapiens
tcagtttaatgca

SEQ ID NO: 3442712 - DNA, 16 bp, Homo sapiens
tcagtttatttccact

SEQ ID NO: 3442713 - DNA, 13 bp, Homo sapiens
tcagttttaacta

SEQ ID NO: 3442714 - DNA, 13 bp, Homo sapiens
tcagttttcattt

SEQ ID NO: 3442715 - DNA, 18 bp, Homo sapiens
tcataacggatcagaaat

SEQ ID NO: 3442716 - DNA, 23 bp, Homo sapiens
tcataacggatcagaaatacaga

SEQ ID NO: 3442717 - DNA, 12 bp, Homo sapiens
tcataattacca

SEQ ID NO: 3442718 - DNA, 20 bp, Homo sapiens
tcatactatctactctcctc

SEQ ID NO: 3442719 - DNA, 22 bp, Homo sapiens
tcatagcaataacattcccact

SEQ ID NO: 3442720 - DNA, 14 bp, Homo sapiens
tcatagcccagtag

SEQ ID NO: 3442721 - DNA, 23 bp, Homo sapiens
tcataggtagaaacaaatacttg

SEQ ID NO: 3442722 - DNA, 15 bp, Homo sapiens
tcataggttgagcaa

SEQ ID NO: 3442723 - DNA, 15 bp, Homo sapiens
tcatagtaacttctt

SEQ ID NO: 3442724 - DNA, 21 bp, Homo sapiens
tcatagtaacttcttatggaa

SEQ ID NO: 3442725 - DNA, 15 bp, Homo sapiens
tcatatactgccatg

SEQ ID NO: 3442726 - DNA, 16 bp, Homo sapiens
tcatatattgcatttc

SEQ ID NO: 3442727 - DNA, 22 bp, Homo sapiens
tcatatattgcatttctgtatt

SEQ ID NO: 3442728 - DNA, 20 bp, Homo sapiens
tcatatgcaaagcatattaa

SEQ ID NO: 3442729 - DNA, 23 bp, Homo sapiens
tcatcaaatggaagacacattga

SEQ ID NO: 3442730 - DNA, 19 bp, Homo sapiens
tcatcaacttaaaagtcag

SEQ ID NO: 3442731 - DNA, 16 bp, Homo sapiens
tcatcaagaagggctg

SEQ ID NO: 3442732 - DNA, 21 bp, Homo sapiens
tcatcaaggcactgcctgatg

SEQ ID NO: 3442733 - DNA, 21 bp, Homo sapiens
tcatcaagggtgcgtctggga

SEQ ID NO: 3442734 - DNA, 17 bp, Homo sapiens
tcatcactgtggctgtc

SEQ ID NO: 3442735 - DNA, 15 bp, Homo sapiens
tcatcagagcctttc

SEQ ID NO: 3442736 - DNA, 14 bp, Homo sapiens
tcatcatcagagcc

SEQ ID NO: 3442737 - DNA, 18 bp, Homo sapiens
tcatcattctctgtctca

SEQ ID NO: 3442738 - DNA, 20 bp, Homo sapiens
tcatcattctctgtctcatc

SEQ ID NO: 3442739 - DNA, 22 bp, Homo sapiens
tcatccactagtgcaaatcata

SEQ ID NO: 3442740 - DNA, 14 bp, Homo sapiens
tcatccactgtgcc

SEQ ID NO: 3442741 - DNA, 19 bp, Homo sapiens
tcatccactgtgccatgtg

SEQ ID NO: 3442742 - DNA, 21 bp, Homo sapiens
tcatccactgtgccatgtgcc

SEQ ID NO: 3442743 - DNA, 12 bp, Homo sapiens
tcatccatcatc

SEQ ID NO: 3442744 - DNA, 11 bp, Homo sapiens
tcatcccctta

SEQ ID NO: 3442745 - DNA, 18 bp, Homo sapiens
tcatccctaatgctgcag

SEQ ID NO: 3442746 - DNA, 13 bp, Homo sapiens
tcatcctcaggaa

SEQ ID NO: 3442747 - DNA, 21 bp, Homo sapiens
tcatcctccagtaccttgctt

SEQ ID NO: 3442748 - DNA, 12 bp, Homo sapiens
tcatcctgcagg

SEQ ID NO: 3442749 - DNA, 23 bp, Homo sapiens
tcatcgattcaaactgctccaag

SEQ ID NO: 3442750 - DNA, 15 bp, Homo sapiens
tcatcgccagaggtg

SEQ ID NO: 3442751 - DNA, 21 bp, Homo sapiens
tcatcgccagaggtgcttcac

SEQ ID NO: 3442752 - DNA, 18 bp, Homo sapiens
tcatcgctcccaaaggaa

SEQ ID NO: 3442753 - DNA, 21 bp, Homo sapiens
tcatctatggcagtccagcca

SEQ ID NO: 3442754 - DNA, 16 bp, Homo sapiens
tcatctatttggaacc

SEQ ID NO: 3442755 - DNA, 11 bp, Homo sapiens
tcatctcaggg

SEQ ID NO: 3442756 - DNA, 21 bp, Homo sapiens
tcatctcctgccttcctcctg

SEQ ID NO: 3442757 - DNA, 16 bp, Homo sapiens
tcatctctctgcccaa

SEQ ID NO: 3442758 - DNA, 15 bp, Homo sapiens
tcatctctcttgggc

SEQ ID NO: 3442759 - DNA, 12 bp, Homo sapiens
tcatctctgcct

SEQ ID NO: 3442760 - DNA, 14 bp, Homo sapiens
tcatctctgtccca

SEQ ID NO: 3442761 - DNA, 19 bp, Homo sapiens
tcatctcttagctcccctc

SEQ ID NO: 3442762 - DNA, 18 bp, Homo sapiens
tcatctgaggcatccagc

SEQ ID NO: 3442763 - DNA, 16 bp, Homo sapiens
tcatctgcatgtctac

SEQ ID NO: 3442764 - DNA, 21 bp, Homo sapiens
tcatctgctctccttcctgga

SEQ ID NO: 3442765 - DNA, 13 bp, Homo sapiens
tcatctgctggtc

SEQ ID NO: 3442766 - DNA, 12 bp, Homo sapiens
tcatctggctgc

SEQ ID NO: 3442767 - DNA, 20 bp, Homo sapiens
tcatctggttgaactctggt

SEQ ID NO: 3442768 - DNA, 12 bp, Homo sapiens
tcatctgtccct

SEQ ID NO: 3442769 - DNA, 18 bp, Homo sapiens
tcatctgtccctccggga

SEQ ID NO: 3442770 - DNA, 12 bp, Homo sapiens
tcatctgtgcac

SEQ ID NO: 3442771 - DNA, 23 bp, Homo sapiens
tcatcttaggttggcaaaaaggc

SEQ ID NO: 3442772 - DNA, 14 bp, Homo sapiens
tcatcttcctgtgt

SEQ ID NO: 3442773 - DNA, 16 bp, Homo sapiens
tcatcttgaccaagca

SEQ ID NO: 3442774 - DNA, 11 bp, Homo sapiens
tcatcttttat

SEQ ID NO: 3442775 - DNA, 22 bp, Homo sapiens
tcatgaatttattgcacattgt

SEQ ID NO: 3442776 - DNA, 14 bp, Homo sapiens
tcatgacagccaga

SEQ ID NO: 3442777 - DNA, 14 bp, Homo sapiens
tcatgagcctgctg

SEQ ID NO: 3442778 - DNA, 15 bp, Homo sapiens
tcatgatgagaaatg

SEQ ID NO: 3442779 - DNA, 22 bp, Homo sapiens
tcatgattcacccccaaacagt

SEQ ID NO: 3442780 - DNA, 20 bp, Homo sapiens
tcatgcaaatgctgtattct

SEQ ID NO: 3442781 - DNA, 16 bp, Homo sapiens
tcatgcccctggctgg

SEQ ID NO: 3442782 - DNA, 16 bp, Homo sapiens
tcatgcgcaactggag

SEQ ID NO: 3442783 - DNA, 19 bp, Homo sapiens
tcatgctggaacctgcaaa

SEQ ID NO: 3442784 - DNA, 19 bp, Homo sapiens
tcatggagggggctgcagg

SEQ ID NO: 3442785 - DNA, 22 bp, Homo sapiens
tcatggcagaaggcaaacccat

SEQ ID NO: 3442786 - DNA, 13 bp, Homo sapiens
tcatggccctgta

SEQ ID NO: 3442787 - DNA, 13 bp, Homo sapiens
tcatggcctcttg

SEQ ID NO: 3442788 - DNA, 15 bp, Homo sapiens
tcatggcctcttgaa

SEQ ID NO: 3442789 - DNA, 15 bp, Homo sapiens
tcatggccttgtcta

SEQ ID NO: 3442790 - DNA, 16 bp, Homo sapiens
tcatggtctcagtcat

SEQ ID NO: 3442791 - DNA, 22 bp, Homo sapiens
tcatgtactttttagtaatttc

SEQ ID NO: 3442792 - DNA, 14 bp, Homo sapiens
tcatgtccccctta

SEQ ID NO: 3442793 - DNA, 12 bp, Homo sapiens
tcatgtctattc

SEQ ID NO: 3442794 - DNA, 16 bp, Homo sapiens
tcatgtctattccatt

SEQ ID NO: 3442795 - DNA, 18 bp, Homo sapiens
tcatgtgcctctgtcctt

SEQ ID NO: 3442796 - DNA, 21 bp, Homo sapiens
tcatgtggctggaagatcctg

SEQ ID NO: 3442797 - DNA, 21 bp, Homo sapiens
tcatgtgtgtccacgactgtc

SEQ ID NO: 3442798 - DNA, 21 bp, Homo sapiens
tcatgttgatcatgtactttt

SEQ ID NO: 3442799 - DNA, 15 bp, Homo sapiens
tcatgtttcttaaat

SEQ ID NO: 3442800 - DNA, 16 bp, Homo sapiens
tcatgttttaacaaaa

SEQ ID NO: 3442801 - DNA, 18 bp, Homo sapiens
tcatgttttaacaaaaac

SEQ ID NO: 3442802 - DNA, 15 bp, Homo sapiens
tcatgttttggtgaa

SEQ ID NO: 3442803 - DNA, 21 bp, Homo sapiens
tcattaatgacacttgtcccc

SEQ ID NO: 3442804 - DNA, 14 bp, Homo sapiens
tcattaattctata

SEQ ID NO: 3442805 - DNA, 16 bp, Homo sapiens
tcattacccttttctg

SEQ ID NO: 3442806 - DNA, 14 bp, Homo sapiens
tcattactgcttca

SEQ ID NO: 3442807 - DNA, 16 bp, Homo sapiens
tcattactgcttcatt

SEQ ID NO: 3442808 - DNA, 20 bp, Homo sapiens
tcattactgcttcatttttg

SEQ ID NO: 3442809 - DNA, 19 bp, Homo sapiens
tcattatttgtcaaattgt

SEQ ID NO: 3442810 - DNA, 14 bp, Homo sapiens
tcattcctgttctt

SEQ ID NO: 3442811 - DNA, 23 bp, Homo sapiens
tcattccttgagaaaaacaatga

SEQ ID NO: 3442812 - DNA, 16 bp, Homo sapiens
tcattctctgtctcat

SEQ ID NO: 3442813 - DNA, 18 bp, Homo sapiens
tcattctctgtctcatcc

SEQ ID NO: 3442814 - DNA, 13 bp, Homo sapiens
tcattctttattc

SEQ ID NO: 3442815 - DNA, 20 bp, Homo sapiens
tcattgaggataaattgcca

SEQ ID NO: 3442816 - DNA, 17 bp, Homo sapiens
tcattgatttcctgtgt

SEQ ID NO: 3442817 - DNA, 15 bp, Homo sapiens
tcattgctgagcctc

SEQ ID NO: 3442818 - DNA, 22 bp, Homo sapiens
tcattgctgagcctctgctccc

SEQ ID NO: 3442819 - DNA, 23 bp, Homo sapiens
tcattgctgagcctctgctcccc

SEQ ID NO: 3442820 - DNA, 14 bp, Homo sapiens
tcattggctttatc

SEQ ID NO: 3442821 - DNA, 17 bp, Homo sapiens
tcattggctttatcctc

SEQ ID NO: 3442822 - DNA, 16 bp, Homo sapiens
tcattgtattcagata

SEQ ID NO: 3442823 - DNA, 18 bp, Homo sapiens
tcatttaataatatactt

SEQ ID NO: 3442824 - DNA, 19 bp, Homo sapiens
tcatttagtttgattattc

SEQ ID NO: 3442825 - DNA, 22 bp, Homo sapiens
tcatttattgtttatgtaaatg

SEQ ID NO: 3442826 - DNA, 15 bp, Homo sapiens
tcatttcaggagcag

SEQ ID NO: 3442827 - DNA, 22 bp, Homo sapiens
tcatttcctatgtaactgcatt

SEQ ID NO: 3442828 - DNA, 13 bp, Homo sapiens
tcatttcctgtgt

SEQ ID NO: 3442829 - DNA, 21 bp, Homo sapiens
tcatttctaggcaaaattgtg

SEQ ID NO: 3442830 - DNA, 22 bp, Homo sapiens
tcatttctaggcaaaattgtga

SEQ ID NO: 3442831 - DNA, 19 bp, Homo sapiens
tcatttctccagattatct

SEQ ID NO: 3442832 - DNA, 16 bp, Homo sapiens
tcatttgagtctctta

SEQ ID NO: 3442833 - DNA, 23 bp, Homo sapiens
tcatttggggtagctagaggaac

SEQ ID NO: 3442834 - DNA, 16 bp, Homo sapiens
tcatttgtcacacact

SEQ ID NO: 3442835 - DNA, 15 bp, Homo sapiens
tcatttgtttacatt

SEQ ID NO: 3442836 - DNA, 23 bp, Homo sapiens
tcattttctagatacaataaatt

SEQ ID NO: 3442837 - DNA, 18 bp, Homo sapiens
tcattttgagtattttta

SEQ ID NO: 3442838 - DNA, 15 bp, Homo sapiens
tcatttttgtaataa

SEQ ID NO: 3442839 - DNA, 18 bp, Homo sapiens
tcatttttgtaataacat

SEQ ID NO: 3442840 - DNA, 19 bp, Homo sapiens
tcatttttgtaataacatt

SEQ ID NO: 3442841 - DNA, 13 bp, Homo sapiens
tcatttttttcca

SEQ ID NO: 3442842 - DNA, 18 bp, Homo sapiens
tccaaaagaagcccccag

SEQ ID NO: 3442843 - DNA, 12 bp, Homo sapiens
tccaaaccactt

SEQ ID NO: 3442844 - DNA, 19 bp, Homo sapiens
tccaaacctgtaacctttc

SEQ ID NO: 3442845 - DNA, 19 bp, Homo sapiens
tccaaactgattaaatatt

SEQ ID NO: 3442846 - DNA, 20 bp, Homo sapiens
tccaaagagtagaattgcat

SEQ ID NO: 3442847 - DNA, 14 bp, Homo sapiens
tccaaagcagacag

SEQ ID NO: 3442848 - DNA, 21 bp, Homo sapiens
tccaaaggccatggagagctg

SEQ ID NO: 3442849 - DNA, 15 bp, Homo sapiens
tccaaataaaatgtt

SEQ ID NO: 3442850 - DNA, 17 bp, Homo sapiens
tccaacagaagaactgt

SEQ ID NO: 3442851 - DNA, 17 bp, Homo sapiens
tccaacaggagctggga

SEQ ID NO: 3442852 - DNA, 14 bp, Homo sapiens
tccaaccccccagc

SEQ ID NO: 3442853 - DNA, 21 bp, Homo sapiens
tccaacctgcaaagatctgtc

SEQ ID NO: 3442854 - DNA, 15 bp, Homo sapiens
tccaacttggctgca

SEQ ID NO: 3442855 - DNA, 23 bp, Homo sapiens
tccaagcagcctgagcaactctt

SEQ ID NO: 3442856 - DNA, 16 bp, Homo sapiens
tccaagctggtcccac

SEQ ID NO: 3442857 - DNA, 21 bp, Homo sapiens
tccaaggaaaccacagctgct

SEQ ID NO: 3442858 - DNA, 19 bp, Homo sapiens
tccaaggaactaatttctt

SEQ ID NO: 3442859 - DNA, 16 bp, Homo sapiens
tccaatacctcttgga

SEQ ID NO: 3442860 - DNA, 21 bp, Homo sapiens
tccaatcagagaccaggccct

SEQ ID NO: 3442861 - DNA, 18 bp, Homo sapiens
tccaatgtggcaaggaaa

SEQ ID NO: 3442862 - DNA, 17 bp, Homo sapiens
tccaattttaatttagt

SEQ ID NO: 3442863 - DNA, 12 bp, Homo sapiens
tccacaaaataa

SEQ ID NO: 3442864 - DNA, 20 bp, Homo sapiens
tccacaaagaaaattcctat

SEQ ID NO: 3442865 - DNA, 22 bp, Homo sapiens
tccacaacctcttccccccaaa

SEQ ID NO: 3442866 - DNA, 17 bp, Homo sapiens
tccacagcaaccccagg

SEQ ID NO: 3442867 - DNA, 12 bp, Homo sapiens
tccacagcttcc

SEQ ID NO: 3442868 - DNA, 23 bp, Homo sapiens
tccacagcttcctgtccccatct

SEQ ID NO: 3442869 - DNA, 13 bp, Homo sapiens
tccacaggaagtg

SEQ ID NO: 3442870 - DNA, 21 bp, Homo sapiens
tccacagggcttgttttccaa

SEQ ID NO: 3442871 - DNA, 17 bp, Homo sapiens
tccacccaggagccccg

SEQ ID NO: 3442872 - DNA, 18 bp, Homo sapiens
tccacctcgacgtttaca

SEQ ID NO: 3442873 - DNA, 13 bp, Homo sapiens
tccacctgtctca

SEQ ID NO: 3442874 - DNA, 16 bp, Homo sapiens
tccacctgtctcagcc

SEQ ID NO: 3442875 - DNA, 17 bp, Homo sapiens
tccacctgtctcagcct

SEQ ID NO: 3442876 - DNA, 20 bp, Homo sapiens
tccacctgtctcagcctccc

SEQ ID NO: 3442877 - DNA, 15 bp, Homo sapiens
tccacgactgtctcc

SEQ ID NO: 3442878 - DNA, 18 bp, Homo sapiens
tccacgactgtctccatg

SEQ ID NO: 3442879 - DNA, 20 bp, Homo sapiens
tccacggagccactcctctg

SEQ ID NO: 3442880 - DNA, 23 bp, Homo sapiens
tccacggcctgcccagtcgaccc

SEQ ID NO: 3442881 - DNA, 17 bp, Homo sapiens
tccacgtattccccttc

SEQ ID NO: 3442882 - DNA, 17 bp, Homo sapiens
tccactagtgcaaatca

SEQ ID NO: 3442883 - DNA, 18 bp, Homo sapiens
tccactagtgcaaatcat

SEQ ID NO: 3442884 - DNA, 13 bp, Homo sapiens
tccactattttca

SEQ ID NO: 3442885 - DNA, 17 bp, Homo sapiens
tccactattttcaaaga

SEQ ID NO: 3442886 - DNA, 15 bp, Homo sapiens
tccactccttctctc

SEQ ID NO: 3442887 - DNA, 14 bp, Homo sapiens
tccactctccccca

SEQ ID NO: 3442888 - DNA, 18 bp, Homo sapiens
tccactctgatagaatta

SEQ ID NO: 3442889 - DNA, 19 bp, Homo sapiens
tccactctgatagaattat

SEQ ID NO: 3442890 - DNA, 12 bp, Homo sapiens
tccactctgctt

SEQ ID NO: 3442891 - DNA, 20 bp, Homo sapiens
tccactctgcttctctgact

SEQ ID NO: 3442892 - DNA, 18 bp, Homo sapiens
tccactgctctcagcctc

SEQ ID NO: 3442893 - DNA, 18 bp, Homo sapiens
tccactttgtttcgtggg

SEQ ID NO: 3442894 - DNA, 14 bp, Homo sapiens
tccagaaaacaaaa

SEQ ID NO: 3442895 - DNA, 22 bp, Homo sapiens
tccagaactcactggggcctac

SEQ ID NO: 3442896 - DNA, 19 bp, Homo sapiens
tccagaaggagacaggcag

SEQ ID NO: 3442897 - DNA, 19 bp, Homo sapiens
tccagaattcattccccag

SEQ ID NO: 3442898 - DNA, 14 bp, Homo sapiens
tccagacccggctg

SEQ ID NO: 3442899 - DNA, 19 bp, Homo sapiens
tccagacccggctgcgtgg

SEQ ID NO: 3442900 - DNA, 13 bp, Homo sapiens
tccagacctgatc

SEQ ID NO: 3442901 - DNA, 18 bp, Homo sapiens
tccagacctgatcctgga

SEQ ID NO: 3442902 - DNA, 22 bp, Homo sapiens
tccagacctgatcctggaggcc

SEQ ID NO: 3442903 - DNA, 20 bp, Homo sapiens
tccagacttccttgagacac

SEQ ID NO: 3442904 - DNA, 23 bp, Homo sapiens
tccagagattcattttctagata

SEQ ID NO: 3442905 - DNA, 12 bp, Homo sapiens
tccagagggcac

SEQ ID NO: 3442906 - DNA, 17 bp, Homo sapiens
tccagatcctctctggg

SEQ ID NO: 3442907 - DNA, 23 bp, Homo sapiens
tccagattatctatttgtgtgtg

SEQ ID NO: 3442908 - DNA, 23 bp, Homo sapiens
tccagcagaagacaaaaagacaa

SEQ ID NO: 3442909 - DNA, 12 bp, Homo sapiens
tccagcagggaa

SEQ ID NO: 3442910 - DNA, 17 bp, Homo sapiens
tccagcagtctctgcct

SEQ ID NO: 3442911 - DNA, 23 bp, Homo sapiens
tccagcagtctctgccttgcctt

SEQ ID NO: 3442912 - DNA, 16 bp, Homo sapiens
tccagcccctctggtc

SEQ ID NO: 3442913 - DNA, 18 bp, Homo sapiens
tccagcccctctggtcgc

SEQ ID NO: 3442914 - DNA, 18 bp, Homo sapiens
tccagccccttctcagaa

SEQ ID NO: 3442915 - DNA, 21 bp, Homo sapiens
tccagccccttctcagaatct

SEQ ID NO: 3442916 - DNA, 14 bp, Homo sapiens
tccagcctcagctc

SEQ ID NO: 3442917 - DNA, 16 bp, Homo sapiens
tccagcctgcctggca

SEQ ID NO: 3442918 - DNA, 12 bp, Homo sapiens
tccagcctgggt

SEQ ID NO: 3442919 - DNA, 23 bp, Homo sapiens
tccagctcaccagccccagtgcc

SEQ ID NO: 3442920 - DNA, 16 bp, Homo sapiens
tccagctccaacctgc

SEQ ID NO: 3442921 - DNA, 18 bp, Homo sapiens
tccagctccaacctgcaa

SEQ ID NO: 3442922 - DNA, 18 bp, Homo sapiens
tccagctcccgctgtggc

SEQ ID NO: 3442923 - DNA, 23 bp, Homo sapiens
tccagctcctcatccagggctct

SEQ ID NO: 3442924 - DNA, 17 bp, Homo sapiens
tccagctgttcagctgg

SEQ ID NO: 3442925 - DNA, 18 bp, Homo sapiens
tccaggaaccacaccaca

SEQ ID NO: 3442926 - DNA, 23 bp, Homo sapiens
tccaggactatatttgggcctgc

SEQ ID NO: 3442927 - DNA, 16 bp, Homo sapiens
tccaggagaaggccaa

SEQ ID NO: 3442928 - DNA, 23 bp, Homo sapiens
tccaggagaaggccaattcctat

SEQ ID NO: 3442929 - DNA, 21 bp, Homo sapiens
tccaggaggagttagccaaac

SEQ ID NO: 3442930 - DNA, 13 bp, Homo sapiens
tccaggcagatcc

SEQ ID NO: 3442931 - DNA, 19 bp, Homo sapiens
tccaggcagatccaggact

SEQ ID NO: 3442932 - DNA, 17 bp, Homo sapiens
tccaggcccaaggctcc

SEQ ID NO: 3442933 - DNA, 19 bp, Homo sapiens
tccaggcccaaggctcccg

SEQ ID NO: 3442934 - DNA, 10 bp, Homo sapiens
tccaggctcc

SEQ ID NO: 3442935 - DNA, 11 bp, Homo sapiens
tccaggctggt

SEQ ID NO: 3442936 - DNA, 13 bp, Homo sapiens
tccaggctggttc

SEQ ID NO: 3442937 - DNA, 21 bp, Homo sapiens
tccaggctgtatcccatgagc

SEQ ID NO: 3442938 - DNA, 15 bp, Homo sapiens
tccaggctgtgtttg

SEQ ID NO: 3442939 - DNA, 15 bp, Homo sapiens
tccagggacagaggc

SEQ ID NO: 3442940 - DNA, 23 bp, Homo sapiens
tccagggacagaggccccagcct

SEQ ID NO: 3442941 - DNA, 14 bp, Homo sapiens
tccagggactgaag

SEQ ID NO: 3442942 - DNA, 22 bp, Homo sapiens
tccagggatgattcaagccatt

SEQ ID NO: 3442943 - DNA, 23 bp, Homo sapiens
tccagggatgattcaagccattc

SEQ ID NO: 3442944 - DNA, 18 bp, Homo sapiens
tccagggatttgcctcac

SEQ ID NO: 3442945 - DNA, 21 bp, Homo sapiens
tccagggctggactgaggcct

SEQ ID NO: 3442946 - DNA, 17 bp, Homo sapiens
tccaggggatgggaggt

SEQ ID NO: 3442947 - DNA, 19 bp, Homo sapiens
tccaggggtcctaggcctc

SEQ ID NO: 3442948 - DNA, 16 bp, Homo sapiens
tccaggtgttactgta

SEQ ID NO: 3442949 - DNA, 18 bp, Homo sapiens
tccaggtgttactgtaat

SEQ ID NO: 3442950 - DNA, 20 bp, Homo sapiens
tccaggttcaacccacagct

SEQ ID NO: 3442951 - DNA, 20 bp, Homo sapiens
tccaggtttaagctgttact

SEQ ID NO: 3442952 - DNA, 19 bp, Homo sapiens
tccagtaatctaatatggc

SEQ ID NO: 3442953 - DNA, 22 bp, Homo sapiens
tccagtaccttgcttcttactg

SEQ ID NO: 3442954 - DNA, 18 bp, Homo sapiens
tccagtatgacagaggag

SEQ ID NO: 3442955 - DNA, 17 bp, Homo sapiens
tccagtcaaatctgggc

SEQ ID NO: 3442956 - DNA, 18 bp, Homo sapiens
tccagtcaaatctgggct

SEQ ID NO: 3442957 - DNA, 23 bp, Homo sapiens
tccagtccaaggaaaccacagct

SEQ ID NO: 3442958 - DNA, 14 bp, Homo sapiens
tccagtcctgccac

SEQ ID NO: 3442959 - DNA, 20 bp, Homo sapiens
tccagtcctgccaccaccct

SEQ ID NO: 3442960 - DNA, 15 bp, Homo sapiens
tccagtctccaccag

SEQ ID NO: 3442961 - DNA, 19 bp, Homo sapiens
tccagtctccaccaggaac

SEQ ID NO: 3442962 - DNA, 20 bp, Homo sapiens
tccagtctgggtaacaggga

SEQ ID NO: 3442963 - DNA, 22 bp, Homo sapiens
tccagtgagccgagatggcgct

SEQ ID NO: 3442964 - DNA, 10 bp, Homo sapiens
tccagtgcct

SEQ ID NO: 3442965 - DNA, 18 bp, Homo sapiens
tccagtgtccttagaaca

SEQ ID NO: 3442966 - DNA, 21 bp, Homo sapiens
tccagtgtgcacccctcccca

SEQ ID NO: 3442967 - DNA, 23 bp, Homo sapiens
tccagttggagttttttgtacca

SEQ ID NO: 3442968 - DNA, 14 bp, Homo sapiens
tccataagtaagaa

SEQ ID NO: 3442969 - DNA, 13 bp, Homo sapiens
tccataatgatgg

SEQ ID NO: 3442970 - DNA, 15 bp, Homo sapiens
tccataatgatggat

SEQ ID NO: 3442971 - DNA, 23 bp, Homo sapiens
tccataatgatggatttaacagc

SEQ ID NO: 3442972 - DNA, 17 bp, Homo sapiens
tccatagctgctgccct

SEQ ID NO: 3442973 - DNA, 13 bp, Homo sapiens
tccatatcctggt

SEQ ID NO: 3442974 - DNA, 17 bp, Homo sapiens
tccatcagcaccccagt

SEQ ID NO: 3442975 - DNA, 22 bp, Homo sapiens
tccatcagcttaggggctgctg

SEQ ID NO: 3442976 - DNA, 18 bp, Homo sapiens
tccatcagttagagctga

SEQ ID NO: 3442977 - DNA, 18 bp, Homo sapiens
tccatccagcttgccaga

SEQ ID NO: 3442978 - DNA, 14 bp, Homo sapiens
tccatcctcatctc

SEQ ID NO: 3442979 - DNA, 21 bp, Homo sapiens
tccatcctcatctctcttggg

SEQ ID NO: 3442980 - DNA, 24 bp, Homo sapiens
tccatcctcatctctcttgggcca

SEQ ID NO: 3442981 - DNA, 16 bp, Homo sapiens
tccatgcgctcagggc

SEQ ID NO: 3442982 - DNA, 14 bp, Homo sapiens
tccatggccctgcc

SEQ ID NO: 3442983 - DNA, 15 bp, Homo sapiens
tccatgggcagagcc

SEQ ID NO: 3442984 - DNA, 16 bp, Homo sapiens
tccatgggcagagccc

SEQ ID NO: 3442985 - DNA, 22 bp, Homo sapiens
tccatgggcagagcccaaggga

SEQ ID NO: 3442986 - DNA, 20 bp, Homo sapiens
tccatgggccatatgaaaag

SEQ ID NO: 3442987 - DNA, 17 bp, Homo sapiens
tccatgtacttgtttgc

SEQ ID NO: 3442988 - DNA, 21 bp, Homo sapiens
tccatgtattcacacacccct

SEQ ID NO: 3442989 - DNA, 16 bp, Homo sapiens
tccattatccattccc

SEQ ID NO: 3442990 - DNA, 18 bp, Homo sapiens
tccattcccaagatgcct

SEQ ID NO: 3442991 - DNA, 20 bp, Homo sapiens
tccattcccaagatgcctga

SEQ ID NO: 3442992 - DNA, 23 bp, Homo sapiens
tccattttttcaaggtaatttct

SEQ ID NO: 3442993 - DNA, 14 bp, Homo sapiens
tcccaaacccagtc

SEQ ID NO: 3442994 - DNA, 24 bp, Homo sapiens
tcccaaacgccctttcctcctcag

SEQ ID NO: 3442995 - DNA, 13 bp, Homo sapiens
tcccaaagtgctg

SEQ ID NO: 3442996 - DNA, 14 bp, Homo sapiens
tcccaaagtgctgg

SEQ ID NO: 3442997 - DNA, 15 bp, Homo sapiens
tcccaaagtgctggg

SEQ ID NO: 3442998 - DNA, 16 bp, Homo sapiens
tcccaaagtgctggga

SEQ ID NO: 3442999 - DNA, 14 bp, Homo sapiens
tcccaaatgagcca

SEQ ID NO: 3443000 - DNA, 17 bp, Homo sapiens
tcccaaatttgattgat

SEQ ID NO: 3443001 - DNA, 14 bp, Homo sapiens
tcccaacaagcaag

SEQ ID NO: 3443002 - DNA, 13 bp, Homo sapiens
tcccaaccccagg

SEQ ID NO: 3443003 - DNA, 15 bp, Homo sapiens
tcccaaccccagggc

SEQ ID NO: 3443004 - DNA, 20 bp, Homo sapiens
tcccaacgtgcaaagccaag

SEQ ID NO: 3443005 - DNA, 22 bp, Homo sapiens
tcccaacgtgcaaagccaaggc

SEQ ID NO: 3443006 - DNA, 15 bp, Homo sapiens
tcccaactctagctg

SEQ ID NO: 3443007 - DNA, 16 bp, Homo sapiens
tcccaactctagctgg

SEQ ID NO: 3443008 - DNA, 16 bp, Homo sapiens
tcccaagatgcctgat

SEQ ID NO: 3443009 - DNA, 18 bp, Homo sapiens
tcccaagatgcctgatca

SEQ ID NO: 3443010 - DNA, 16 bp, Homo sapiens
tcccaagctcagaggc

SEQ ID NO: 3443011 - DNA, 15 bp, Homo sapiens
tcccaagctggctgg

SEQ ID NO: 3443012 - DNA, 17 bp, Homo sapiens
tcccaagctggctgggg

SEQ ID NO: 3443013 - DNA, 23 bp, Homo sapiens
tcccaagtaagaggctggagttg

SEQ ID NO: 3443014 - DNA, 16 bp, Homo sapiens
tcccaagtagaatctc

SEQ ID NO: 3443015 - DNA, 20 bp, Homo sapiens
tcccaagtagctgggattac

SEQ ID NO: 3443016 - DNA, 18 bp, Homo sapiens
tcccaatttcagactccc

SEQ ID NO: 3443017 - DNA, 14 bp, Homo sapiens
tcccacctcagcct

SEQ ID NO: 3443018 - DNA, 20 bp, Homo sapiens
tcccacctgcatctggggcc

SEQ ID NO: 3443019 - DNA, 16 bp, Homo sapiens
tcccaccttggctgca

SEQ ID NO: 3443020 - DNA, 14 bp, Homo sapiens
tcccactcagtcca

SEQ ID NO: 3443021 - DNA, 13 bp, Homo sapiens
tcccactgtatga

SEQ ID NO: 3443022 - DNA, 20 bp, Homo sapiens
tcccagaacacactccatca

SEQ ID NO: 3443023 - DNA, 22 bp, Homo sapiens
tcccagagctggtggacccagg

SEQ ID NO: 3443024 - DNA, 16 bp, Homo sapiens
tcccagatacttgggg

SEQ ID NO: 3443025 - DNA, 19 bp, Homo sapiens
tcccagattggctcacact

SEQ ID NO: 3443026 - DNA, 22 bp, Homo sapiens
tcccagattggctcacactgag

SEQ ID NO: 3443027 - DNA, 15 bp, Homo sapiens
tcccagcctcagcgc

SEQ ID NO: 3443028 - DNA, 17 bp, Homo sapiens
tcccagctacttgggag

SEQ ID NO: 3443029 - DNA, 16 bp, Homo sapiens
tcccagctaggaagag

SEQ ID NO: 3443030 - DNA, 20 bp, Homo sapiens
tcccagctaggaagagcagg

SEQ ID NO: 3443031 - DNA, 22 bp, Homo sapiens
tcccagctgtgctctggacagg

SEQ ID NO: 3443032 - DNA, 13 bp, Homo sapiens
tcccaggaccctg

SEQ ID NO: 3443033 - DNA, 14 bp, Homo sapiens
tcccaggaccctga

SEQ ID NO: 3443034 - DNA, 16 bp, Homo sapiens
tcccaggaccctgaag

SEQ ID NO: 3443035 - DNA, 19 bp, Homo sapiens
tcccaggcccctggaggct

SEQ ID NO: 3443036 - DNA, 21 bp, Homo sapiens
tcccaggctctcaacagggga

SEQ ID NO: 3443037 - DNA, 19 bp, Homo sapiens
tcccagtgccgagaaggaa

SEQ ID NO: 3443038 - DNA, 22 bp, Homo sapiens
tcccataaccgctgattctcag

SEQ ID NO: 3443039 - DNA, 19 bp, Homo sapiens
tcccatagatactctcttc

SEQ ID NO: 3443040 - DNA, 21 bp, Homo sapiens
tcccatagatactctcttctt

SEQ ID NO: 3443041 - DNA, 16 bp, Homo sapiens
tcccatagtccctgcc

SEQ ID NO: 3443042 - DNA, 18 bp, Homo sapiens
tcccatagtccctgccac

SEQ ID NO: 3443043 - DNA, 14 bp, Homo sapiens
tcccatccagggcc

SEQ ID NO: 3443044 - DNA, 15 bp, Homo sapiens
tcccatctcttcctt

SEQ ID NO: 3443045 - DNA, 16 bp, Homo sapiens
tcccatgacccaggct

SEQ ID NO: 3443046 - DNA, 19 bp, Homo sapiens
tcccatgacccaggctggg

SEQ ID NO: 3443047 - DNA, 15 bp, Homo sapiens
tcccatgagcctcag

SEQ ID NO: 3443048 - DNA, 18 bp, Homo sapiens
tcccatgagcctcagcat

SEQ ID NO: 3443049 - DNA, 22 bp, Homo sapiens
tcccatgagcctcagcatcctg

SEQ ID NO: 3443050 - DNA, 13 bp, Homo sapiens
tcccatgtagccc

SEQ ID NO: 3443051 - DNA, 15 bp, Homo sapiens
tcccatgtagccccc

SEQ ID NO: 3443052 - DNA, 14 bp, Homo sapiens
tcccattcctgaag

SEQ ID NO: 3443053 - DNA, 17 bp, Homo sapiens
tcccattcctgaagaac

SEQ ID NO: 3443054 - DNA, 19 bp, Homo sapiens
tcccattgtccctctgccc

SEQ ID NO: 3443055 - DNA, 21 bp, Homo sapiens
tcccattgtccctctgcccca

SEQ ID NO: 3443056 - DNA, 14 bp, Homo sapiens
tccccaaatccgaa

SEQ ID NO: 3443057 - DNA, 21 bp, Homo sapiens
tccccaataattgcagaacta

SEQ ID NO: 3443058 - DNA, 21 bp, Homo sapiens
tccccaatgagacttgccttc

SEQ ID NO: 3443059 - DNA, 10 bp, Homo sapiens
tccccacaga

SEQ ID NO: 3443060 - DNA, 17 bp, Homo sapiens
tccccacagaactgctt

SEQ ID NO: 3443061 - DNA, 19 bp, Homo sapiens
tccccacagaactgcttac

SEQ ID NO: 3443062 - DNA, 23 bp, Homo sapiens
tccccaccctgaaagccctgagc

SEQ ID NO: 3443063 - DNA, 19 bp, Homo sapiens
tccccagagtcctctatga

SEQ ID NO: 3443064 - DNA, 15 bp, Homo sapiens
tccccagcccagaga

SEQ ID NO: 3443065 - DNA, 11 bp, Homo sapiens
tccccagcctg

SEQ ID NO: 3443066 - DNA, 20 bp, Homo sapiens
tccccagcctgcgcctgctg

SEQ ID NO: 3443067 - DNA, 12 bp, Homo sapiens
tccccagctccc

SEQ ID NO: 3443068 - DNA, 14 bp, Homo sapiens
tccccagctcccca

SEQ ID NO: 3443069 - DNA, 15 bp, Homo sapiens
tccccagctccccag

SEQ ID NO: 3443070 - DNA, 16 bp, Homo sapiens
tccccagctccccagg

SEQ ID NO: 3443071 - DNA, 14 bp, Homo sapiens
tccccaggactcac

SEQ ID NO: 3443072 - DNA, 19 bp, Homo sapiens
tccccaggactcaccctca

SEQ ID NO: 3443073 - DNA, 11 bp, Homo sapiens
tccccaggccc

SEQ ID NO: 3443074 - DNA, 19 bp, Homo sapiens
tccccaggccccaggaagc

SEQ ID NO: 3443075 - DNA, 15 bp, Homo sapiens
tccccaggggagttg

SEQ ID NO: 3443076 - DNA, 15 bp, Homo sapiens
tccccaggtccagct

SEQ ID NO: 3443077 - DNA, 21 bp, Homo sapiens
tccccaggtctctccactgct

SEQ ID NO: 3443078 - DNA, 13 bp, Homo sapiens
tccccatctcagg

SEQ ID NO: 3443079 - DNA, 16 bp, Homo sapiens
tccccatgcagacatg

SEQ ID NO: 3443080 - DNA, 13 bp, Homo sapiens
tccccatggagcc

SEQ ID NO: 3443081 - DNA, 15 bp, Homo sapiens
tccccatggagccag

SEQ ID NO: 3443082 - DNA, 16 bp, Homo sapiens
tccccatggagccagc

SEQ ID NO: 3443083 - DNA, 14 bp, Homo sapiens
tccccattcacaga

SEQ ID NO: 3443084 - DNA, 17 bp, Homo sapiens
tccccattcacagagcc

SEQ ID NO: 3443085 - DNA, 18 bp, Homo sapiens
tccccattcacagagcct

SEQ ID NO: 3443086 - DNA, 15 bp, Homo sapiens
tccccattttctggt

SEQ ID NO: 3443087 - DNA, 22 bp, Homo sapiens
tcccccaacatataaaataatg

SEQ ID NO: 3443088 - DNA, 20 bp, Homo sapiens
tcccccactgccacaccctc

SEQ ID NO: 3443089 - DNA, 20 bp, Homo sapiens
tcccccagcagaaccagcct

SEQ ID NO: 3443090 - DNA, 23 bp, Homo sapiens
tcccccatctcgctccctcccag

SEQ ID NO: 3443091 - DNA, 18 bp, Homo sapiens
tcccccccatgcactgtg

SEQ ID NO: 3443092 - DNA, 18 bp, Homo sapiens
tcccccctcctctgaaac

SEQ ID NO: 3443093 - DNA, 15 bp, Homo sapiens
tccccctctgtccag

SEQ ID NO: 3443094 - DNA, 13 bp, Homo sapiens
tccccgccctttt

SEQ ID NO: 3443095 - DNA, 15 bp, Homo sapiens
tccccgccctttttt

SEQ ID NO: 3443096 - DNA, 17 bp, Homo sapiens
tcccctccgccaggcga

SEQ ID NO: 3443097 - DNA, 20 bp, Homo sapiens
tcccctccgccaggcgagat

SEQ ID NO: 3443098 - DNA, 16 bp, Homo sapiens
tcccctccggactggt

SEQ ID NO: 3443099 - DNA, 19 bp, Homo sapiens
tcccctccggactggtgcc

SEQ ID NO: 3443100 - DNA, 15 bp, Homo sapiens
tcccctctccttcct

SEQ ID NO: 3443101 - DNA, 15 bp, Homo sapiens
tcccctctgaaagtt

SEQ ID NO: 3443102 - DNA, 23 bp, Homo sapiens
tcccctcttcctaccctgcctcc

SEQ ID NO: 3443103 - DNA, 13 bp, Homo sapiens
tcccctcttctga

SEQ ID NO: 3443104 - DNA, 14 bp, Homo sapiens
tcccctcttctgag

SEQ ID NO: 3443105 - DNA, 13 bp, Homo sapiens
tcccctgccacca

SEQ ID NO: 3443106 - DNA, 14 bp, Homo sapiens
tcccctgccagggc

SEQ ID NO: 3443107 - DNA, 19 bp, Homo sapiens
tcccctgcctcctactcca

SEQ ID NO: 3443108 - DNA, 13 bp, Homo sapiens
tccccttccactg

SEQ ID NO: 3443109 - DNA, 17 bp, Homo sapiens
tccccttccactgaggg

SEQ ID NO: 3443110 - DNA, 18 bp, Homo sapiens
tccccttctctcatctct

SEQ ID NO: 3443111 - DNA, 22 bp, Homo sapiens
tcccgagcacctccacatcctc

SEQ ID NO: 3443112 - DNA, 15 bp, Homo sapiens
tcccgagtagctggg

SEQ ID NO: 3443113 - DNA, 18 bp, Homo sapiens
tcccgagtagctgggact

SEQ ID NO: 3443114 - DNA, 21 bp, Homo sapiens
tcccgagtagctgggattaca

SEQ ID NO: 3443115 - DNA, 15 bp, Homo sapiens
tcccgccggaggcca

SEQ ID NO: 3443116 - DNA, 19 bp, Homo sapiens
tcccgccggaggccagcta

SEQ ID NO: 3443117 - DNA, 12 bp, Homo sapiens
tcccgcggtgcc

SEQ ID NO: 3443118 - DNA, 16 bp, Homo sapiens
tcccgggccagggctg

SEQ ID NO: 3443119 - DNA, 18 bp, Homo sapiens
tcccgggcctcagtgccc

SEQ ID NO: 3443120 - DNA, 14 bp, Homo sapiens
tcccggggctccac

SEQ ID NO: 3443121 - DNA, 18 bp, Homo sapiens
tccctaaaaacacagaca

SEQ ID NO: 3443122 - DNA, 14 bp, Homo sapiens
tccctaatgctgca

SEQ ID NO: 3443123 - DNA, 20 bp, Homo sapiens
tccctaatgctgcagatttg

SEQ ID NO: 3443124 - DNA, 13 bp, Homo sapiens
tccctaccacctc

SEQ ID NO: 3443125 - DNA, 18 bp, Homo sapiens
tccctaccacctccccag

SEQ ID NO: 3443126 - DNA, 18 bp, Homo sapiens
tccctaccgacccagggt

SEQ ID NO: 3443127 - DNA, 12 bp, Homo sapiens
tccctagacttt

SEQ ID NO: 3443128 - DNA, 14 bp, Homo sapiens
tccctatactgctt

SEQ ID NO: 3443129 - DNA, 21 bp, Homo sapiens
tccctatttttctctcctgtc

SEQ ID NO: 3443130 - DNA, 19 bp, Homo sapiens
tccctcatttcaggagcag

SEQ ID NO: 3443131 - DNA, 16 bp, Homo sapiens
tccctcccccccatgc

SEQ ID NO: 3443132 - DNA, 16 bp, Homo sapiens
tccctcccctgccatt

SEQ ID NO: 3443133 - DNA, 22 bp, Homo sapiens
tccctcccctggggacagcaag

SEQ ID NO: 3443134 - DNA, 14 bp, Homo sapiens
tccctccgggacct

SEQ ID NO: 3443135 - DNA, 22 bp, Homo sapiens
tccctctacagagcttccctga

SEQ ID NO: 3443136 - DNA, 19 bp, Homo sapiens
tccctctgggggctctggc

SEQ ID NO: 3443137 - DNA, 22 bp, Homo sapiens
tccctgactcattctgaaggag

SEQ ID NO: 3443138 - DNA, 13 bp, Homo sapiens
tccctgcacttgc

SEQ ID NO: 3443139 - DNA, 22 bp, Homo sapiens
tccctgcatctgaccagcagcg

SEQ ID NO: 3443140 - DNA, 16 bp, Homo sapiens
tccctgcgcctttcct

SEQ ID NO: 3443141 - DNA, 12 bp, Homo sapiens
tccctggcttct

SEQ ID NO: 3443142 - DNA, 14 bp, Homo sapiens
tccctggcttctgt

SEQ ID NO: 3443143 - DNA, 14 bp, Homo sapiens
tccctggggtgggg

SEQ ID NO: 3443144 - DNA, 12 bp, Homo sapiens
tccctggttctg

SEQ ID NO: 3443145 - DNA, 17 bp, Homo sapiens
tccctggttctgatgat

SEQ ID NO: 3443146 - DNA, 14 bp, Homo sapiens
tccctgtaacctct

SEQ ID NO: 3443147 - DNA, 18 bp, Homo sapiens
tccctgtaacctcttcag

SEQ ID NO: 3443148 - DNA, 23 bp, Homo sapiens
tccctgtaacctcttcagaggcc

SEQ ID NO: 3443149 - DNA, 16 bp, Homo sapiens
tccctgtaggattttt

SEQ ID NO: 3443150 - DNA, 21 bp, Homo sapiens
tccctgtagttgacaattctg

SEQ ID NO: 3443151 - DNA, 13 bp, Homo sapiens
tccctgtcacctc

SEQ ID NO: 3443152 - DNA, 14 bp, Homo sapiens
tccctgtctttcct

SEQ ID NO: 3443153 - DNA, 13 bp, Homo sapiens
tccctgtgtcttt

SEQ ID NO: 3443154 - DNA, 14 bp, Homo sapiens
tccctgtgtctttt

SEQ ID NO: 3443155 - DNA, 16 bp, Homo sapiens
tcccttcccataagct

SEQ ID NO: 3443156 - DNA, 14 bp, Homo sapiens
tcccttcctattcc

SEQ ID NO: 3443157 - DNA, 22 bp, Homo sapiens
tcccttctagggttattgcatt

SEQ ID NO: 3443158 - DNA, 20 bp, Homo sapiens
tcccttctgctactggcaaa

SEQ ID NO: 3443159 - DNA, 16 bp, Homo sapiens
tcccttctgtccctca

SEQ ID NO: 3443160 - DNA, 17 bp, Homo sapiens
tcccttgaccaggcctg

SEQ ID NO: 3443161 - DNA, 21 bp, Homo sapiens
tcccttgaccaggcctgggcc

SEQ ID NO: 3443162 - DNA, 23 bp, Homo sapiens
tcccttgaggaaacaacagcttt

SEQ ID NO: 3443163 - DNA, 21 bp, Homo sapiens
tcccttgcctttcgaggcctg

SEQ ID NO: 3443164 - DNA, 18 bp, Homo sapiens
tccctttctcccctgccc

SEQ ID NO: 3443165 - DNA, 18 bp, Homo sapiens
tcccttttaaacacattt

SEQ ID NO: 3443166 - DNA, 17 bp, Homo sapiens
tccctttttacacttta

SEQ ID NO: 3443167 - DNA, 16 bp, Homo sapiens
tccgaacctcctctgt

SEQ ID NO: 3443168 - DNA, 17 bp, Homo sapiens
tccgaacctcctctgtg

SEQ ID NO: 3443169 - DNA, 18 bp, Homo sapiens
tccgaacctcctctgtga

SEQ ID NO: 3443170 - DNA, 20 bp, Homo sapiens
tccgaccactaattgccaag

SEQ ID NO: 3443171 - DNA, 13 bp, Homo sapiens
tccgaccagacac

SEQ ID NO: 3443172 - DNA, 23 bp, Homo sapiens
tccgactctttctgagtgccttc

SEQ ID NO: 3443173 - DNA, 18 bp, Homo sapiens
tccgatgacagtgctcta

SEQ ID NO: 3443174 - DNA, 15 bp, Homo sapiens
tccgcaggtgctggt

SEQ ID NO: 3443175 - DNA, 16 bp, Homo sapiens
tccgcaggtgctggtc

SEQ ID NO: 3443176 - DNA, 21 bp, Homo sapiens
tccgcatccctaccgacccag

SEQ ID NO: 3443177 - DNA, 13 bp, Homo sapiens
tccgcctccagga

SEQ ID NO: 3443178 - DNA, 20 bp, Homo sapiens
tccgcctgaggccagcctgc

SEQ ID NO: 3443179 - DNA, 11 bp, Homo sapiens
tccgccttcac

SEQ ID NO: 3443180 - DNA, 17 bp, Homo sapiens
tccggaatgccacccac

SEQ ID NO: 3443181 - DNA, 12 bp, Homo sapiens
tccggactggtg

SEQ ID NO: 3443182 - DNA, 17 bp, Homo sapiens
tccggctcccagcctca

SEQ ID NO: 3443183 - DNA, 15 bp, Homo sapiens
tccggctgtgctggg

SEQ ID NO: 3443184 - DNA, 21 bp, Homo sapiens
tccgggacctggtgctgcctc

SEQ ID NO: 3443185 - DNA, 20 bp, Homo sapiens
tccgggggggcccatctctt

SEQ ID NO: 3443186 - DNA, 21 bp, Homo sapiens
tccgtagccagctgctcccca

SEQ ID NO: 3443187 - DNA, 12 bp, Homo sapiens
tccgtggcacat

SEQ ID NO: 3443188 - DNA, 23 bp, Homo sapiens
tccgtgggacggtgcccaagcca

SEQ ID NO: 3443189 - DNA, 16 bp, Homo sapiens
tccgttagctcctgtg

SEQ ID NO: 3443190 - DNA, 17 bp, Homo sapiens
tccgttagctcctgtgg

SEQ ID NO: 3443191 - DNA, 19 bp, Homo sapiens
tccgttagctcctgtggcc

SEQ ID NO: 3443192 - DNA, 22 bp, Homo sapiens
tccgtttgaccaatttgcacca

SEQ ID NO: 3443193 - DNA, 22 bp, Homo sapiens
tcctaaaataagggcagagtca

SEQ ID NO: 3443194 - DNA, 23 bp, Homo sapiens
tcctaaaataagggcagagtcac

SEQ ID NO: 3443195 - DNA, 23 bp, Homo sapiens
tcctaaagaaaaatatcttggcc

SEQ ID NO: 3443196 - DNA, 13 bp, Homo sapiens
tcctaagcctgtg

SEQ ID NO: 3443197 - DNA, 18 bp, Homo sapiens
tcctaataaagttctgta

SEQ ID NO: 3443198 - DNA, 15 bp, Homo sapiens
tcctaatcatccaat

SEQ ID NO: 3443199 - DNA, 18 bp, Homo sapiens
tcctaattcttctgtcct

SEQ ID NO: 3443200 - DNA, 18 bp, Homo sapiens
tcctacattttctttttt

SEQ ID NO: 3443201 - DNA, 18 bp, Homo sapiens
tcctacccaccctccttt

SEQ ID NO: 3443202 - DNA, 14 bp, Homo sapiens
tcctacccatcccc

SEQ ID NO: 3443203 - DNA, 15 bp, Homo sapiens
tcctacctattatcc

SEQ ID NO: 3443204 - DNA, 17 bp, Homo sapiens
tcctactaataaaccag

SEQ ID NO: 3443205 - DNA, 18 bp, Homo sapiens
tcctactaataaaccagt

SEQ ID NO: 3443206 - DNA, 12 bp, Homo sapiens
tcctactctgtg

SEQ ID NO: 3443207 - DNA, 21 bp, Homo sapiens
tcctagaaattccccaccctg

SEQ ID NO: 3443208 - DNA, 20 bp, Homo sapiens
tcctagaggccctttgctgt

SEQ ID NO: 3443209 - DNA, 20 bp, Homo sapiens
tcctagagggaggggcctag

SEQ ID NO: 3443210 - DNA, 23 bp, Homo sapiens
tcctagaggttctgggttttctg

SEQ ID NO: 3443211 - DNA, 14 bp, Homo sapiens
tcctagagtagagt

SEQ ID NO: 3443212 - DNA, 18 bp, Homo sapiens
tcctagatggcagtcact

SEQ ID NO: 3443213 - DNA, 14 bp, Homo sapiens
tcctaggcatttgc

SEQ ID NO: 3443214 - DNA, 17 bp, Homo sapiens
tcctaggcctcaactcc

SEQ ID NO: 3443215 - DNA, 23 bp, Homo sapiens
tcctaggcctcaactcctcccat

SEQ ID NO: 3443216 - DNA, 18 bp, Homo sapiens
tcctaggtagggtttaat

SEQ ID NO: 3443217 - DNA, 21 bp, Homo sapiens
tcctaggtcatgcctcctccc

SEQ ID NO: 3443218 - DNA, 17 bp, Homo sapiens
tcctagttttcctactt

SEQ ID NO: 3443219 - DNA, 19 bp, Homo sapiens
tcctatacgcagcgtgctt

SEQ ID NO: 3443220 - DNA, 20 bp, Homo sapiens
tcctatatatttctattatt

SEQ ID NO: 3443221 - DNA, 21 bp, Homo sapiens
tcctatgtgattttaactctg

SEQ ID NO: 3443222 - DNA, 22 bp, Homo sapiens
tcctatgtgattttaactctgt

SEQ ID NO: 3443223 - DNA, 17 bp, Homo sapiens
tcctattcaaattccta

SEQ ID NO: 3443224 - DNA, 17 bp, Homo sapiens
tcctcaaaactggagtc

SEQ ID NO: 3443225 - DNA, 13 bp, Homo sapiens
tcctcaatccagc

SEQ ID NO: 3443226 - DNA, 20 bp, Homo sapiens
tcctcacaacatggtgtctg

SEQ ID NO: 3443227 - DNA, 22 bp, Homo sapiens
tcctcacacttttggaaccatg

SEQ ID NO: 3443228 - DNA, 19 bp, Homo sapiens
tcctcactcccttcccata

SEQ ID NO: 3443229 - DNA, 11 bp, Homo sapiens
tcctcagcctt

SEQ ID NO: 3443230 - DNA, 21 bp, Homo sapiens
tcctcagccttgccagagatc

SEQ ID NO: 3443231 - DNA, 16 bp, Homo sapiens
tcctcagtatgtgggg

SEQ ID NO: 3443232 - DNA, 23 bp, Homo sapiens
tcctcataaaaagcaaaacaaaa

SEQ ID NO: 3443233 - DNA, 16 bp, Homo sapiens
tcctcatccagggctc

SEQ ID NO: 3443234 - DNA, 20 bp, Homo sapiens
tcctcatctctaacagctca

SEQ ID NO: 3443235 - DNA, 22 bp, Homo sapiens
tcctcatctctaacagctcagg

SEQ ID NO: 3443236 - DNA, 23 bp, Homo sapiens
tcctcatgtcttctcacaagcca

SEQ ID NO: 3443237 - DNA, 17 bp, Homo sapiens
tcctcatgttctgcttt

SEQ ID NO: 3443238 - DNA, 18 bp, Homo sapiens
tcctcattagcattttgc

SEQ ID NO: 3443239 - DNA, 21 bp, Homo sapiens
tcctcatttggggtagctaga

SEQ ID NO: 3443240 - DNA, 23 bp, Homo sapiens
tcctcatttggggtagctagagg

SEQ ID NO: 3443241 - DNA, 17 bp, Homo sapiens
tcctccaacaccaagca

SEQ ID NO: 3443242 - DNA, 22 bp, Homo sapiens
tcctccaacaccaagcacagca

SEQ ID NO: 3443243 - DNA, 12 bp, Homo sapiens
tcctccaagcca

SEQ ID NO: 3443244 - DNA, 21 bp, Homo sapiens
tcctccacgttctgctcatca

SEQ ID NO: 3443245 - DNA, 14 bp, Homo sapiens
tcctccagcaggga

SEQ ID NO: 3443246 - DNA, 21 bp, Homo sapiens
tcctcccaatttcagactccc

SEQ ID NO: 3443247 - DNA, 12 bp, Homo sapiens
tcctcccacctc

SEQ ID NO: 3443248 - DNA, 14 bp, Homo sapiens
tcctcccacctcag

SEQ ID NO: 3443249 - DNA, 21 bp, Homo sapiens
tcctcccacctcagcctcccg

SEQ ID NO: 3443250 - DNA, 20 bp, Homo sapiens
tcctcccatagatactctct

SEQ ID NO: 3443251 - DNA, 22 bp, Homo sapiens
tcctccctgcatctgaccagca

SEQ ID NO: 3443252 - DNA, 10 bp, Homo sapiens
tcctcccttc

SEQ ID NO: 3443253 - DNA, 14 bp, Homo sapiens
tcctcccttctgct

SEQ ID NO: 3443254 - DNA, 16 bp, Homo sapiens
tcctcccttctgctac

SEQ ID NO: 3443255 - DNA, 17 bp, Homo sapiens
tcctcccttctgctact

SEQ ID NO: 3443256 - DNA, 12 bp, Homo sapiens
tcctcctcaggc

SEQ ID NO: 3443257 - DNA, 12 bp, Homo sapiens
tcctcctccagg

SEQ ID NO: 3443258 - DNA, 14 bp, Homo sapiens
tcctcctccagggt

SEQ ID NO: 3443259 - DNA, 15 bp, Homo sapiens
tcctcctccagggtg

SEQ ID NO: 3443260 - DNA, 14 bp, Homo sapiens
tcctcctcccaccc

SEQ ID NO: 3443261 - DNA, 14 bp, Homo sapiens
tcctcctccctgca

SEQ ID NO: 3443262 - DNA, 14 bp, Homo sapiens
tcctcctctgactt

SEQ ID NO: 3443263 - DNA, 13 bp, Homo sapiens
tcctcctctgtga

SEQ ID NO: 3443264 - DNA, 12 bp, Homo sapiens
tcctcctgcaga

SEQ ID NO: 3443265 - DNA, 16 bp, Homo sapiens
tcctcctgcccacctg

SEQ ID NO: 3443266 - DNA, 16 bp, Homo sapiens
tcctcctgggccctct

SEQ ID NO: 3443267 - DNA, 20 bp, Homo sapiens
tcctcctgggccctctctgc

SEQ ID NO: 3443268 - DNA, 22 bp, Homo sapiens
tcctctacaccaattaatgtag

SEQ ID NO: 3443269 - DNA, 18 bp, Homo sapiens
tcctctactaacaatcag

SEQ ID NO: 3443270 - DNA, 13 bp, Homo sapiens
tcctctagaaata

SEQ ID NO: 3443271 - DNA, 14 bp, Homo sapiens
tcctctcagcccct

SEQ ID NO: 3443272 - DNA, 15 bp, Homo sapiens
tcctctccattttag

SEQ ID NO: 3443273 - DNA, 19 bp, Homo sapiens
tcctctccattttagccca

SEQ ID NO: 3443274 - DNA, 19 bp, Homo sapiens
tcctctcccattgtccctc

SEQ ID NO: 3443275 - DNA, 14 bp, Homo sapiens
tcctctccccagcc

SEQ ID NO: 3443276 - DNA, 16 bp, Homo sapiens
tcctctccccagccca

SEQ ID NO: 3443277 - DNA, 17 bp, Homo sapiens
tcctctccccagcccag

SEQ ID NO: 3443278 - DNA, 20 bp, Homo sapiens
tcctctccccagcccagaga

SEQ ID NO: 3443279 - DNA, 23 bp, Homo sapiens
tcctctccccagcccagagacat

SEQ ID NO: 3443280 - DNA, 14 bp, Homo sapiens
tcctctctccagat

SEQ ID NO: 3443281 - DNA, 13 bp, Homo sapiens
tcctctctctgtg

SEQ ID NO: 3443282 - DNA, 23 bp, Homo sapiens
tcctctctggggctgtgttttga

SEQ ID NO: 3443283 - DNA, 11 bp, Homo sapiens
tcctctctttg

SEQ ID NO: 3443284 - DNA, 11 bp, Homo sapiens
tcctctgaaac

SEQ ID NO: 3443285 - DNA, 14 bp, Homo sapiens
tcctctgaaacagc

SEQ ID NO: 3443286 - DNA, 15 bp, Homo sapiens
tcctctgactccact

SEQ ID NO: 3443287 - DNA, 21 bp, Homo sapiens
tcctctgataatatattttca

SEQ ID NO: 3443288 - DNA, 12 bp, Homo sapiens
tcctcttgtaaa

SEQ ID NO: 3443289 - DNA, 21 bp, Homo sapiens
tcctcttgtaaataaagccct

SEQ ID NO: 3443290 - DNA, 16 bp, Homo sapiens
tcctgaaacgctcctt

SEQ ID NO: 3443291 - DNA, 17 bp, Homo sapiens
tcctgaaacgctccttt

SEQ ID NO: 3443292 - DNA, 21 bp, Homo sapiens
tcctgaaacgctcctttgtgt

SEQ ID NO: 3443293 - DNA, 21 bp, Homo sapiens
tcctgaaactatattttgtca

SEQ ID NO: 3443294 - DNA, 22 bp, Homo sapiens
tcctgaaagcggctgcctccat

SEQ ID NO: 3443295 - DNA, 23 bp, Homo sapiens
tcctgaagaaccagtccccccac

SEQ ID NO: 3443296 - DNA, 15 bp, Homo sapiens
tcctgacattgtctc

SEQ ID NO: 3443297 - DNA, 16 bp, Homo sapiens
tcctgacctcaggtga

SEQ ID NO: 3443298 - DNA, 13 bp, Homo sapiens
tcctgacttttaa

SEQ ID NO: 3443299 - DNA, 19 bp, Homo sapiens
tcctgagaaaaaaggttcc

SEQ ID NO: 3443300 - DNA, 16 bp, Homo sapiens
tcctgaggctttggat

SEQ ID NO: 3443301 - DNA, 18 bp, Homo sapiens
tcctgaggctttggattt

SEQ ID NO: 3443302 - DNA, 15 bp, Homo sapiens
tcctgataaagcaca

SEQ ID NO: 3443303 - DNA, 15 bp, Homo sapiens
tcctgataataaagg

SEQ ID NO: 3443304 - DNA, 14 bp, Homo sapiens
tcctgatcagagcc

SEQ ID NO: 3443305 - DNA, 17 bp, Homo sapiens
tcctgcagaccacgccc

SEQ ID NO: 3443306 - DNA, 11 bp, Homo sapiens
tcctgccaaaa

SEQ ID NO: 3443307 - DNA, 17 bp, Homo sapiens
tcctgccgcagagctgg

SEQ ID NO: 3443308 - DNA, 16 bp, Homo sapiens
tcctgccggagaggaa

SEQ ID NO: 3443309 - DNA, 17 bp, Homo sapiens
tcctgccggagaggaag

SEQ ID NO: 3443310 - DNA, 15 bp, Homo sapiens
tcctgcctcagcctc

SEQ ID NO: 3443311 - DNA, 16 bp, Homo sapiens
tcctgcctcagcctcc

SEQ ID NO: 3443312 - DNA, 19 bp, Homo sapiens
tcctgcctcagcctcccaa

SEQ ID NO: 3443313 - DNA, 21 bp, Homo sapiens
tcctgcctcagcctcccgagt

SEQ ID NO: 3443314 - DNA, 14 bp, Homo sapiens
tcctgcctgtctgc

SEQ ID NO: 3443315 - DNA, 17 bp, Homo sapiens
tcctgcctgtctgcccc

SEQ ID NO: 3443316 - DNA, 20 bp, Homo sapiens
tcctgcctgtctgccccagc

SEQ ID NO: 3443317 - DNA, 14 bp, Homo sapiens
tcctgcctgtggcg

SEQ ID NO: 3443318 - DNA, 17 bp, Homo sapiens
tcctgcggcaggactgc

SEQ ID NO: 3443319 - DNA, 20 bp, Homo sapiens
tcctgcggcaggactgcaga

SEQ ID NO: 3443320 - DNA, 13 bp, Homo sapiens
tcctgcgggtggg

SEQ ID NO: 3443321 - DNA, 22 bp, Homo sapiens
tcctgcttgatgggattctgga

SEQ ID NO: 3443322 - DNA, 15 bp, Homo sapiens
tcctgctttggcagt

SEQ ID NO: 3443323 - DNA, 18 bp, Homo sapiens
tcctggagcaatcacaga

SEQ ID NO: 3443324 - DNA, 20 bp, Homo sapiens
tcctggagcaatcacagatg

SEQ ID NO: 3443325 - DNA, 16 bp, Homo sapiens
tcctggaggtcttttc

SEQ ID NO: 3443326 - DNA, 14 bp, Homo sapiens
tcctggagttgcat

SEQ ID NO: 3443327 - DNA, 18 bp, Homo sapiens
tcctggatgttgtgtgta

SEQ ID NO: 3443328 - DNA, 21 bp, Homo sapiens
tcctggcacccggcccctgct

SEQ ID NO: 3443329 - DNA, 23 bp, Homo sapiens
tcctggcacccggcccctgctgg

SEQ ID NO: 3443330 - DNA, 17 bp, Homo sapiens
tcctggcagtttaaaaa

SEQ ID NO: 3443331 - DNA, 20 bp, Homo sapiens
tcctggcagtttaaaaaaat

SEQ ID NO: 3443332 - DNA, 20 bp, Homo sapiens
tcctggccatcccacaagtg

SEQ ID NO: 3443333 - DNA, 12 bp, Homo sapiens
tcctggcctcaa

SEQ ID NO: 3443334 - DNA, 12 bp, Homo sapiens
tcctggcctcct

SEQ ID NO: 3443335 - DNA, 17 bp, Homo sapiens
tcctggcctccttcccc

SEQ ID NO: 3443336 - DNA, 13 bp, Homo sapiens
tcctggcctgaga

SEQ ID NO: 3443337 - DNA, 17 bp, Homo sapiens
tcctgggccctctctgc

SEQ ID NO: 3443338 - DNA, 12 bp, Homo sapiens
tcctgggcctgc

SEQ ID NO: 3443339 - DNA, 16 bp, Homo sapiens
tcctgggcctgcagaa

SEQ ID NO: 3443340 - DNA, 12 bp, Homo sapiens
tcctgggctcag

SEQ ID NO: 3443341 - DNA, 20 bp, Homo sapiens
tcctgggctgggtggcccct

SEQ ID NO: 3443342 - DNA, 20 bp, Homo sapiens
tcctgggttttgtattctct

SEQ ID NO: 3443343 - DNA, 14 bp, Homo sapiens
tcctgtatgtctgt

SEQ ID NO: 3443344 - DNA, 16 bp, Homo sapiens
tcctgtatgtctgtca

SEQ ID NO: 3443345 - DNA, 17 bp, Homo sapiens
tcctgtccacacccagc

SEQ ID NO: 3443346 - DNA, 13 bp, Homo sapiens
tcctgtccagctc

SEQ ID NO: 3443347 - DNA, 17 bp, Homo sapiens
tcctgtccagctccaac

SEQ ID NO: 3443348 - DNA, 10 bp, Homo sapiens
tcctgtccca

SEQ ID NO: 3443349 - DNA, 16 bp, Homo sapiens
tcctgtccccatctgt

SEQ ID NO: 3443350 - DNA, 14 bp, Homo sapiens
tcctgtccctgcgc

SEQ ID NO: 3443351 - DNA, 15 bp, Homo sapiens
tcctgtcctccctca

SEQ ID NO: 3443352 - DNA, 16 bp, Homo sapiens
tcctgtgaatgccact

SEQ ID NO: 3443353 - DNA, 20 bp, Homo sapiens
tcctgtgaatgccactgcct

SEQ ID NO: 3443354 - DNA, 11 bp, Homo sapiens
tcctgtgagga

SEQ ID NO: 3443355 - DNA, 18 bp, Homo sapiens
tcctgtgatacatttctg

SEQ ID NO: 3443356 - DNA, 22 bp, Homo sapiens
tcctgtggccccaccctgggcc

SEQ ID NO: 3443357 - DNA, 24 bp, Homo sapiens
tcctgtgtcttgcaatggcagcct

SEQ ID NO: 3443358 - DNA, 19 bp, Homo sapiens
tcctgtgtgattgacagct

SEQ ID NO: 3443359 - DNA, 22 bp, Homo sapiens
tcctgttctgaaaccttagttt

SEQ ID NO: 3443360 - DNA, 19 bp, Homo sapiens
tccttaaaaatcacactgt

SEQ ID NO: 3443361 - DNA, 20 bp, Homo sapiens
tccttaatgaagagccagcc

SEQ ID NO: 3443362 - DNA, 21 bp, Homo sapiens
tccttaatgaagagccagccc

SEQ ID NO: 3443363 - DNA, 22 bp, Homo sapiens
tccttaatgaagagccagccca

SEQ ID NO: 3443364 - DNA, 14 bp, Homo sapiens
tccttacccatctg

SEQ ID NO: 3443365 - DNA, 18 bp, Homo sapiens
tccttacccatctgcacc

SEQ ID NO: 3443366 - DNA, 20 bp, Homo sapiens
tccttagaacattttaattc

SEQ ID NO: 3443367 - DNA, 21 bp, Homo sapiens
tccttatcactgacacaaaaa

SEQ ID NO: 3443368 - DNA, 13 bp, Homo sapiens
tccttcaccaccc

SEQ ID NO: 3443369 - DNA, 23 bp, Homo sapiens
tccttcacctttcccactttctt

SEQ ID NO: 3443370 - DNA, 13 bp, Homo sapiens
tccttcagacacc

SEQ ID NO: 3443371 - DNA, 21 bp, Homo sapiens
tccttcagccctcacccctgg

SEQ ID NO: 3443372 - DNA, 22 bp, Homo sapiens
tccttcatcatgagttctgctg

SEQ ID NO: 3443373 - DNA, 14 bp, Homo sapiens
tccttccaacagga

SEQ ID NO: 3443374 - DNA, 20 bp, Homo sapiens
tccttccaacaggagctggg

SEQ ID NO: 3443375 - DNA, 15 bp, Homo sapiens
tccttccagcccaga

SEQ ID NO: 3443376 - DNA, 17 bp, Homo sapiens
tccttcccaatcttctt

SEQ ID NO: 3443377 - DNA, 16 bp, Homo sapiens
tccttcctcacaccag

SEQ ID NO: 3443378 - DNA, 14 bp, Homo sapiens
tccttcctctcctt

SEQ ID NO: 3443379 - DNA, 14 bp, Homo sapiens
tccttcctggcctg

SEQ ID NO: 3443380 - DNA, 14 bp, Homo sapiens
tccttcctgttctg

SEQ ID NO: 3443381 - DNA, 17 bp, Homo sapiens
tccttctgcggccagag

SEQ ID NO: 3443382 - DNA, 15 bp, Homo sapiens
tccttctttgggata

SEQ ID NO: 3443383 - DNA, 21 bp, Homo sapiens
tccttctttgggatagagaat

SEQ ID NO: 3443384 - DNA, 19 bp, Homo sapiens
tccttgaagaactgcaggc

SEQ ID NO: 3443385 - DNA, 21 bp, Homo sapiens
tccttgaagaactgcaggccc

SEQ ID NO: 3443386 - DNA, 23 bp, Homo sapiens
tccttgaagaactgcaggccctg

SEQ ID NO: 3443387 - DNA, 20 bp, Homo sapiens
tccttgacctgcattgtaaa

SEQ ID NO: 3443388 - DNA, 21 bp, Homo sapiens
tccttgagacacggagcccag

SEQ ID NO: 3443389 - DNA, 22 bp, Homo sapiens
tccttgatctgtatatacaata

SEQ ID NO: 3443390 - DNA, 16 bp, Homo sapiens
tccttggaggacagtg

SEQ ID NO: 3443391 - DNA, 15 bp, Homo sapiens
tccttggctggtgca

SEQ ID NO: 3443392 - DNA, 20 bp, Homo sapiens
tccttggctttatgcacatt

SEQ ID NO: 3443393 - DNA, 14 bp, Homo sapiens
tccttgggcccttt

SEQ ID NO: 3443394 - DNA, 16 bp, Homo sapiens
tccttgggccctttga

SEQ ID NO: 3443395 - DNA, 17 bp, Homo sapiens
tccttggggcaggcagt

SEQ ID NO: 3443396 - DNA, 18 bp, Homo sapiens
tccttgggggctcccagg

SEQ ID NO: 3443397 - DNA, 19 bp, Homo sapiens
tccttgtggcctgggcctc

SEQ ID NO: 3443398 - DNA, 14 bp, Homo sapiens
tccttgttcctaga

SEQ ID NO: 3443399 - DNA, 14 bp, Homo sapiens
tcctttacgtgttt

SEQ ID NO: 3443400 - DNA, 22 bp, Homo sapiens
tcctttagcgcccagttgggtg

SEQ ID NO: 3443401 - DNA, 23 bp, Homo sapiens
tcctttagcgcccagttgggtgg

SEQ ID NO: 3443402 - DNA, 23 bp, Homo sapiens
tcctttaggagggagttatctaa

SEQ ID NO: 3443403 - DNA, 19 bp, Homo sapiens
tcctttagggttctgcctc

SEQ ID NO: 3443404 - DNA, 17 bp, Homo sapiens
tcctttcaccccagggc

SEQ ID NO: 3443405 - DNA, 21 bp, Homo sapiens
tcctttcaccccagggcctga

SEQ ID NO: 3443406 - DNA, 14 bp, Homo sapiens
tcctttcctcctct

SEQ ID NO: 3443407 - DNA, 13 bp, Homo sapiens
tcctttgtacttt

SEQ ID NO: 3443408 - DNA, 17 bp, Homo sapiens
tcctttgtgaatatttt

SEQ ID NO: 3443409 - DNA, 17 bp, Homo sapiens
tcctttgtgtgtgtgtc

SEQ ID NO: 3443410 - DNA, 15 bp, Homo sapiens
tcctttgttcccggc

SEQ ID NO: 3443411 - DNA, 20 bp, Homo sapiens
tccttttaaatcttgatacc

SEQ ID NO: 3443412 - DNA, 15 bp, Homo sapiens
tccttttataggtga

SEQ ID NO: 3443413 - DNA, 13 bp, Homo sapiens
tccttttctttaa

SEQ ID NO: 3443414 - DNA, 14 bp, Homo sapiens
tccttttgaccttc

SEQ ID NO: 3443415 - DNA, 18 bp, Homo sapiens
tccttttgaccttcattt

SEQ ID NO: 3443416 - DNA, 16 bp, Homo sapiens
tcgaaaggccttcaga

SEQ ID NO: 3443417 - DNA, 20 bp, Homo sapiens
tcgaatctactaattccaca

SEQ ID NO: 3443418 - DNA, 18 bp, Homo sapiens
tcgacatcactgttcatg

SEQ ID NO: 3443419 - DNA, 22 bp, Homo sapiens
tcgagaactttcatttttttcc

SEQ ID NO: 3443420 - DNA, 14 bp, Homo sapiens
tcgagacagaacct

SEQ ID NO: 3443421 - DNA, 13 bp, Homo sapiens
tcgagaccagcct

SEQ ID NO: 3443422 - DNA, 21 bp, Homo sapiens
tcgagagctggccaaagagcc

SEQ ID NO: 3443423 - DNA, 21 bp, Homo sapiens
tcgagatggcagattcccact

SEQ ID NO: 3443424 - DNA, 21 bp, Homo sapiens
tcgagcagtcctgcctcagcc

SEQ ID NO: 3443425 - DNA, 15 bp, Homo sapiens
tcgagctacatgcat

SEQ ID NO: 3443426 - DNA, 20 bp, Homo sapiens
tcgaggcctgaagccagctg

SEQ ID NO: 3443427 - DNA, 23 bp, Homo sapiens
tcgaggtgccttcttcagggcct

SEQ ID NO: 3443428 - DNA, 17 bp, Homo sapiens
tcgagtactgtgggcaa

SEQ ID NO: 3443429 - DNA, 23 bp, Homo sapiens
tcgagtactgtgggcaatttaga

SEQ ID NO: 3443430 - DNA, 15 bp, Homo sapiens
tcgatgattcaggtg

SEQ ID NO: 3443431 - DNA, 23 bp, Homo sapiens
tcgatgggggagtctgaagcaga

SEQ ID NO: 3443432 - DNA, 16 bp, Homo sapiens
tcgatgttatgtaaaa

SEQ ID NO: 3443433 - DNA, 17 bp, Homo sapiens
tcgattcatattgaata

SEQ ID NO: 3443434 - DNA, 14 bp, Homo sapiens
tcgcatcttcccaa

SEQ ID NO: 3443435 - DNA, 19 bp, Homo sapiens
tcgcatggtcacacactga

SEQ ID NO: 3443436 - DNA, 13 bp, Homo sapiens
tcgcatttcctaa

SEQ ID NO: 3443437 - DNA, 16 bp, Homo sapiens
tcgccaaactgtctct

SEQ ID NO: 3443438 - DNA, 17 bp, Homo sapiens
tcgccaaactgtctctg

SEQ ID NO: 3443439 - DNA, 22 bp, Homo sapiens
tcgccacccccccaccccaggc

SEQ ID NO: 3443440 - DNA, 19 bp, Homo sapiens
tcgcccaggctggagtgca

SEQ ID NO: 3443441 - DNA, 19 bp, Homo sapiens
tcgcccagtctggaatgca

SEQ ID NO: 3443442 - DNA, 23 bp, Homo sapiens
tcgcccagtctggaatgcagtgg

SEQ ID NO: 3443443 - DNA, 14 bp, Homo sapiens
tcgccccagcaggt

SEQ ID NO: 3443444 - DNA, 20 bp, Homo sapiens
tcgccccagcaggtgctgac

SEQ ID NO: 3443445 - DNA, 17 bp, Homo sapiens
tcgccctcccaggctct

SEQ ID NO: 3443446 - DNA, 21 bp, Homo sapiens
tcgcctttcctctctatattt

SEQ ID NO: 3443447 - DNA, 16 bp, Homo sapiens
tcgcggcggagctggc

SEQ ID NO: 3443448 - DNA, 17 bp, Homo sapiens
tcgctcccgccagcagc

SEQ ID NO: 3443449 - DNA, 15 bp, Homo sapiens
tcgctccctcccagg

SEQ ID NO: 3443450 - DNA, 19 bp, Homo sapiens
tcgctgccagctctgtatc

SEQ ID NO: 3443451 - DNA, 20 bp, Homo sapiens
tcgctgccagctctgtatca

SEQ ID NO: 3443452 - DNA, 20 bp, Homo sapiens
tcgctggactctcagtctct

SEQ ID NO: 3443453 - DNA, 23 bp, Homo sapiens
tcgctggactctcagtctctgag

SEQ ID NO: 3443454 - DNA, 23 bp, Homo sapiens
tcgctgtgtcagcatagaagtaa

SEQ ID NO: 3443455 - DNA, 19 bp, Homo sapiens
tcgcttccctgaaagactg

SEQ ID NO: 3443456 - DNA, 22 bp, Homo sapiens
tcgcttctgtgtatctctttca

SEQ ID NO: 3443457 - DNA, 17 bp, Homo sapiens
tcgcttcttgcctctgt

SEQ ID NO: 3443458 - DNA, 19 bp, Homo sapiens
tcgcttcttgcctctgtgc

SEQ ID NO: 3443459 - DNA, 13 bp, Homo sapiens
tcggaggaagccc

SEQ ID NO: 3443460 - DNA, 16 bp, Homo sapiens
tcggcagatactgtct

SEQ ID NO: 3443461 - DNA, 12 bp, Homo sapiens
tcggctctggag

SEQ ID NO: 3443462 - DNA, 16 bp, Homo sapiens
tcggctgaccatgctc

SEQ ID NO: 3443463 - DNA, 16 bp, Homo sapiens
tcgggagacagcatca

SEQ ID NO: 3443464 - DNA, 15 bp, Homo sapiens
tcgggagaggggacg

SEQ ID NO: 3443465 - DNA, 13 bp, Homo sapiens
tcgggaggctgag

SEQ ID NO: 3443466 - DNA, 13 bp, Homo sapiens
tcgggctgtgccc

SEQ ID NO: 3443467 - DNA, 17 bp, Homo sapiens
tcggggcttgccccact

SEQ ID NO: 3443468 - DNA, 22 bp, Homo sapiens
tcggtacccggggcccagggca

SEQ ID NO: 3443469 - DNA, 16 bp, Homo sapiens
tcggtaggttcagcca

SEQ ID NO: 3443470 - DNA, 13 bp, Homo sapiens
tcggtttctccaa

SEQ ID NO: 3443471 - DNA, 15 bp, Homo sapiens
tcgtccacagcttcc

SEQ ID NO: 3443472 - DNA, 17 bp, Homo sapiens
tcgtcctggattcactg

SEQ ID NO: 3443473 - DNA, 18 bp, Homo sapiens
tcgtctttcccatgggga

SEQ ID NO: 3443474 - DNA, 20 bp, Homo sapiens
tcgtctttcccatggggagg

SEQ ID NO: 3443475 - DNA, 13 bp, Homo sapiens
tcgtgacaacact

SEQ ID NO: 3443476 - DNA, 14 bp, Homo sapiens
tcgtgcatttcaac

SEQ ID NO: 3443477 - DNA, 15 bp, Homo sapiens
tcgtgcctgtgtcca

SEQ ID NO: 3443478 - DNA, 18 bp, Homo sapiens
tcgtggggtgtgctggga

SEQ ID NO: 3443479 - DNA, 17 bp, Homo sapiens
tcgttacatcttgtagg

SEQ ID NO: 3443480 - DNA, 11 bp, Homo sapiens
tctaaaacaat

SEQ ID NO: 3443481 - DNA, 24 bp, Homo sapiens
tctaaaccccagattcttcagctt

SEQ ID NO: 3443482 - DNA, 14 bp, Homo sapiens
tctaaactgcatta

SEQ ID NO: 3443483 - DNA, 19 bp, Homo sapiens
tctaaagtgtttagctgtc

SEQ ID NO: 3443484 - DNA, 12 bp, Homo sapiens
tctaaagttata

SEQ ID NO: 3443485 - DNA, 16 bp, Homo sapiens
tctaaagttgtagtga

SEQ ID NO: 3443486 - DNA, 16 bp, Homo sapiens
tctaacaattttcaga

SEQ ID NO: 3443487 - DNA, 19 bp, Homo sapiens
tctaacagctcaggatctc

SEQ ID NO: 3443488 - DNA, 18 bp, Homo sapiens
tctaacctcatcttcttc

SEQ ID NO: 3443489 - DNA, 13 bp, Homo sapiens
tctaacctggagg

SEQ ID NO: 3443490 - DNA, 17 bp, Homo sapiens
tctaagaatacagcttt

SEQ ID NO: 3443491 - DNA, 20 bp, Homo sapiens
tctaagagaacaatgtgcta

SEQ ID NO: 3443492 - DNA, 15 bp, Homo sapiens
tctaagcctgaaggg

SEQ ID NO: 3443493 - DNA, 23 bp, Homo sapiens
tctaagtacctttcctacatttt

SEQ ID NO: 3443494 - DNA, 19 bp, Homo sapiens
tctaagtcaatccaagagt

SEQ ID NO: 3443495 - DNA, 16 bp, Homo sapiens
tctaataaacttggat

SEQ ID NO: 3443496 - DNA, 15 bp, Homo sapiens
tctaatatttctagt

SEQ ID NO: 3443497 - DNA, 19 bp, Homo sapiens
tctaatctagatatcgact

SEQ ID NO: 3443498 - DNA, 20 bp, Homo sapiens
tctaatctagatatcgactt

SEQ ID NO: 3443499 - DNA, 22 bp, Homo sapiens
tctaatgaggagagaaaatata

SEQ ID NO: 3443500 - DNA, 16 bp, Homo sapiens
tctaattaaaacactt

SEQ ID NO: 3443501 - DNA, 18 bp, Homo sapiens
tctaattaaccttactaa

SEQ ID NO: 3443502 - DNA, 17 bp, Homo sapiens
tctacaatgtgaacttt

SEQ ID NO: 3443503 - DNA, 19 bp, Homo sapiens
tctacaatgtgaactttat

SEQ ID NO: 3443504 - DNA, 17 bp, Homo sapiens
tctacagagcttccctg

SEQ ID NO: 3443505 - DNA, 15 bp, Homo sapiens
tctacagaggccatg

SEQ ID NO: 3443506 - DNA, 19 bp, Homo sapiens
tctacaggtcaagaaatag

SEQ ID NO: 3443507 - DNA, 13 bp, Homo sapiens
tctacccaaagga

SEQ ID NO: 3443508 - DNA, 20 bp, Homo sapiens
tctacccagcgagccctggt

SEQ ID NO: 3443509 - DNA, 13 bp, Homo sapiens
tctacccagggcc

SEQ ID NO: 3443510 - DNA, 19 bp, Homo sapiens
tctacggtgtatggttctg

SEQ ID NO: 3443511 - DNA, 18 bp, Homo sapiens
tctactcagcatttgatt

SEQ ID NO: 3443512 - DNA, 20 bp, Homo sapiens
tctactctcctcatctctaa

SEQ ID NO: 3443513 - DNA, 19 bp, Homo sapiens
tctacttctgcccttgcca

SEQ ID NO: 3443514 - DNA, 12 bp, Homo sapiens
tctactttgaag

SEQ ID NO: 3443515 - DNA, 20 bp, Homo sapiens
tctactttgaagtcatacca

SEQ ID NO: 3443516 - DNA, 16 bp, Homo sapiens
tctactttgattctga

SEQ ID NO: 3443517 - DNA, 23 bp, Homo sapiens
tctactttttgaacttttcattc

SEQ ID NO: 3443518 - DNA, 16 bp, Homo sapiens
tctagaaataggttaa

SEQ ID NO: 3443519 - DNA, 21 bp, Homo sapiens
tctagaacatccctgccagct

SEQ ID NO: 3443520 - DNA, 18 bp, Homo sapiens
tctagaacttgaccccct

SEQ ID NO: 3443521 - DNA, 18 bp, Homo sapiens
tctagaagtgccatctca

SEQ ID NO: 3443522 - DNA, 12 bp, Homo sapiens
tctagagcctct

SEQ ID NO: 3443523 - DNA, 18 bp, Homo sapiens
tctagagccttcagcctt

SEQ ID NO: 3443524 - DNA, 19 bp, Homo sapiens
tctagaggctcatggccct

SEQ ID NO: 3443525 - DNA, 15 bp, Homo sapiens
tctagatacaataaa

SEQ ID NO: 3443526 - DNA, 15 bp, Homo sapiens
tctagatacctaaaa

SEQ ID NO: 3443527 - DNA, 22 bp, Homo sapiens
tctagatacctaaaacataaga

SEQ ID NO: 3443528 - DNA, 15 bp, Homo sapiens
tctagatatcgactt

SEQ ID NO: 3443529 - DNA, 19 bp, Homo sapiens
tctagatgaagttttacat

SEQ ID NO: 3443530 - DNA, 20 bp, Homo sapiens
tctagatgaagttttacatt

SEQ ID NO: 3443531 - DNA, 21 bp, Homo sapiens
tctagatgaagttttacattg

SEQ ID NO: 3443532 - DNA, 19 bp, Homo sapiens
tctagatggctcctctcag

SEQ ID NO: 3443533 - DNA, 20 bp, Homo sapiens
tctaggcaaaattgtgaagc

SEQ ID NO: 3443534 - DNA, 22 bp, Homo sapiens
tctaggcaaaattgtgaagcta

SEQ ID NO: 3443535 - DNA, 20 bp, Homo sapiens
tctaggcctcctggcccagg

SEQ ID NO: 3443536 - DNA, 15 bp, Homo sapiens
tctaggctctgcctt

SEQ ID NO: 3443537 - DNA, 13 bp, Homo sapiens
tctaggctgcccc

SEQ ID NO: 3443538 - DNA, 19 bp, Homo sapiens
tctagggaaaaaccagcgt

SEQ ID NO: 3443539 - DNA, 14 bp, Homo sapiens
tctagggtgttctg

SEQ ID NO: 3443540 - DNA, 15 bp, Homo sapiens
tctagggtgttctgt

SEQ ID NO: 3443541 - DNA, 18 bp, Homo sapiens
tctagggttattgcattt

SEQ ID NO: 3443542 - DNA, 17 bp, Homo sapiens
tctaggtggcaaggctg

SEQ ID NO: 3443543 - DNA, 14 bp, Homo sapiens
tctagtactagaaa

SEQ ID NO: 3443544 - DNA, 16 bp, Homo sapiens
tctagtagctgaaatg

SEQ ID NO: 3443545 - DNA, 18 bp, Homo sapiens
tctagtgccttctaaagg

SEQ ID NO: 3443546 - DNA, 11 bp, Homo sapiens
tctagttttca

SEQ ID NO: 3443547 - DNA, 13 bp, Homo sapiens
tctataaggccat

SEQ ID NO: 3443548 - DNA, 14 bp, Homo sapiens
tctataaggccata

SEQ ID NO: 3443549 - DNA, 18 bp, Homo sapiens
tctatacatatctttatt

SEQ ID NO: 3443550 - DNA, 16 bp, Homo sapiens
tctatagactctagga

SEQ ID NO: 3443551 - DNA, 21 bp, Homo sapiens
tctatagttgatatgttttat

SEQ ID NO: 3443552 - DNA, 14 bp, Homo sapiens
tctatcttgttcca

SEQ ID NO: 3443553 - DNA, 16 bp, Homo sapiens
tctatggcagtccagc

SEQ ID NO: 3443554 - DNA, 15 bp, Homo sapiens
tctatgggtttagtt

SEQ ID NO: 3443555 - DNA, 14 bp, Homo sapiens
tctatgtaggaaaa

SEQ ID NO: 3443556 - DNA, 18 bp, Homo sapiens
tctatgttcaaagactgt

SEQ ID NO: 3443557 - DNA, 22 bp, Homo sapiens
tctatgtttacaaatggacata

SEQ ID NO: 3443558 - DNA, 13 bp, Homo sapiens
tctattctctcca

SEQ ID NO: 3443559 - DNA, 18 bp, Homo sapiens
tctattgaccaccagtta

SEQ ID NO: 3443560 - DNA, 18 bp, Homo sapiens
tctatttaattaggaaaa

SEQ ID NO: 3443561 - DNA, 20 bp, Homo sapiens
tctatttaattaggaaaaaa

SEQ ID NO: 3443562 - DNA, 18 bp, Homo sapiens
tctatttatatgtacatg

SEQ ID NO: 3443563 - DNA, 13 bp, Homo sapiens
tctatttatgttt

SEQ ID NO: 3443564 - DNA, 15 bp, Homo sapiens
tctatttatgtttgc

SEQ ID NO: 3443565 - DNA, 17 bp, Homo sapiens
tctatttctagagacaa

SEQ ID NO: 3443566 - DNA, 12 bp, Homo sapiens
tctatttggaac

SEQ ID NO: 3443567 - DNA, 12 bp, Homo sapiens
tctattttaaga

SEQ ID NO: 3443568 - DNA, 15 bp, Homo sapiens
tctattttggattgt

SEQ ID NO: 3443569 - DNA, 13 bp, Homo sapiens
tctcaaactcttg

SEQ ID NO: 3443570 - DNA, 23 bp, Homo sapiens
tctcaaatccctctccaactgcc

SEQ ID NO: 3443571 - DNA, 13 bp, Homo sapiens
tctcaaccatccc

SEQ ID NO: 3443572 - DNA, 15 bp, Homo sapiens
tctcaaccttggcct

SEQ ID NO: 3443573 - DNA, 17 bp, Homo sapiens
tctcaaccttggccttc

SEQ ID NO: 3443574 - DNA, 18 bp, Homo sapiens
tctcaaccttggccttct

SEQ ID NO: 3443575 - DNA, 19 bp, Homo sapiens
tctcaaccttggccttctc

SEQ ID NO: 3443576 - DNA, 16 bp, Homo sapiens
tctcaatgaagccagc

SEQ ID NO: 3443577 - DNA, 14 bp, Homo sapiens
tctcaccagctgca

SEQ ID NO: 3443578 - DNA, 15 bp, Homo sapiens
tctcaccagctgcaa

SEQ ID NO: 3443579 - DNA, 21 bp, Homo sapiens
tctcaccccatcccacaccct

SEQ ID NO: 3443580 - DNA, 13 bp, Homo sapiens
tctcacctcagcc

SEQ ID NO: 3443581 - DNA, 15 bp, Homo sapiens
tctcaccttccaaat

SEQ ID NO: 3443582 - DNA, 16 bp, Homo sapiens
tctcactataccagta

SEQ ID NO: 3443583 - DNA, 20 bp, Homo sapiens
tctcactatgttgcccaggc

SEQ ID NO: 3443584 - DNA, 20 bp, Homo sapiens
tctcactgccatgccagctt

SEQ ID NO: 3443585 - DNA, 14 bp, Homo sapiens
tctcactgttgccc

SEQ ID NO: 3443586 - DNA, 11 bp, Homo sapiens
tctcagagaca

SEQ ID NO: 3443587 - DNA, 11 bp, Homo sapiens
tctcagcctcc

SEQ ID NO: 3443588 - DNA, 13 bp, Homo sapiens
tctcagcctccca

SEQ ID NO: 3443589 - DNA, 14 bp, Homo sapiens
tctcaggagcttgc

SEQ ID NO: 3443590 - DNA, 18 bp, Homo sapiens
tctcaggagcttgcaaga

SEQ ID NO: 3443591 - DNA, 14 bp, Homo sapiens
tctcagggcctggt

SEQ ID NO: 3443592 - DNA, 15 bp, Homo sapiens
tctcagggcctggtc

SEQ ID NO: 3443593 - DNA, 17 bp, Homo sapiens
tctcagggtctctgctg

SEQ ID NO: 3443594 - DNA, 17 bp, Homo sapiens
tctcagtactttggagg

SEQ ID NO: 3443595 - DNA, 11 bp, Homo sapiens
tctcagtctct

SEQ ID NO: 3443596 - DNA, 14 bp, Homo sapiens
tctcagttgcagcc

SEQ ID NO: 3443597 - DNA, 20 bp, Homo sapiens
tctcataacccctctatttc

SEQ ID NO: 3443598 - DNA, 18 bp, Homo sapiens
tctcatcaacttaaaagt

SEQ ID NO: 3443599 - DNA, 20 bp, Homo sapiens
tctcatcaacttaaaagtca

SEQ ID NO: 3443600 - DNA, 13 bp, Homo sapiens
tctcatccatcat

SEQ ID NO: 3443601 - DNA, 14 bp, Homo sapiens
tctcatccatcatc

SEQ ID NO: 3443602 - DNA, 20 bp, Homo sapiens
tctcatctcttagctcccct

SEQ ID NO: 3443603 - DNA, 13 bp, Homo sapiens
tctcatctgtgat

SEQ ID NO: 3443604 - DNA, 22 bp, Homo sapiens
tctcatctttcttgatcaacat

SEQ ID NO: 3443605 - DNA, 14 bp, Homo sapiens
tctcatgaatctgc

SEQ ID NO: 3443606 - DNA, 18 bp, Homo sapiens
tctcatgaatctgcaatg

SEQ ID NO: 3443607 - DNA, 16 bp, Homo sapiens
tctcatgaggggagag

SEQ ID NO: 3443608 - DNA, 23 bp, Homo sapiens
tctcatggaaactggccaggggt

SEQ ID NO: 3443609 - DNA, 17 bp, Homo sapiens
tctcattacccttttct

SEQ ID NO: 3443610 - DNA, 19 bp, Homo sapiens
tctcattacccttttctgg

SEQ ID NO: 3443611 - DNA, 19 bp, Homo sapiens
tctcattactgcttcattt

SEQ ID NO: 3443612 - DNA, 16 bp, Homo sapiens
tctcattcctgttctt

SEQ ID NO: 3443613 - DNA, 22 bp, Homo sapiens
tctcatttcacccctccctttc

SEQ ID NO: 3443614 - DNA, 14 bp, Homo sapiens
tctcatttgtcaca

SEQ ID NO: 3443615 - DNA, 20 bp, Homo sapiens
tctccaaaaatctgcctggg

SEQ ID NO: 3443616 - DNA, 22 bp, Homo sapiens
tctccaaaaatctgcctgggtt

SEQ ID NO: 3443617 - DNA, 22 bp, Homo sapiens
tctccaaactgaagcagcctct

SEQ ID NO: 3443618 - DNA, 23 bp, Homo sapiens
tctccaaactgaagcagcctctc

SEQ ID NO: 3443619 - DNA, 17 bp, Homo sapiens
tctccaaccccccagca

SEQ ID NO: 3443620 - DNA, 21 bp, Homo sapiens
tctccaactgcctaaggccct

SEQ ID NO: 3443621 - DNA, 14 bp, Homo sapiens
tctccacagcaacc

SEQ ID NO: 3443622 - DNA, 19 bp, Homo sapiens
tctccacagcaaccccagg

SEQ ID NO: 3443623 - DNA, 16 bp, Homo sapiens
tctccaccaggaacct

SEQ ID NO: 3443624 - DNA, 17 bp, Homo sapiens
tctccaccctgctctcc

SEQ ID NO: 3443625 - DNA, 17 bp, Homo sapiens
tctccactcagttgcaa

SEQ ID NO: 3443626 - DNA, 18 bp, Homo sapiens
tctccactgctctcagcc

SEQ ID NO: 3443627 - DNA, 14 bp, Homo sapiens
tctccagatgtttc

SEQ ID NO: 3443628 - DNA, 18 bp, Homo sapiens
tctccagcctcagctctc

SEQ ID NO: 3443629 - DNA, 19 bp, Homo sapiens
tctccatacgcgttctagg

SEQ ID NO: 3443630 - DNA, 13 bp, Homo sapiens
tctccatccacat

SEQ ID NO: 3443631 - DNA, 19 bp, Homo sapiens
tctccatccacatgggagc

SEQ ID NO: 3443632 - DNA, 16 bp, Homo sapiens
tctccatggccctgcc

SEQ ID NO: 3443633 - DNA, 24 bp, Homo sapiens
tctccatggccctgccatgctctc

SEQ ID NO: 3443634 - DNA, 16 bp, Homo sapiens
tctcccagataatgtg

SEQ ID NO: 3443635 - DNA, 21 bp, Homo sapiens
tctcccagataatgtgaaaat

SEQ ID NO: 3443636 - DNA, 18 bp, Homo sapiens
tctcccatctcttccttg

SEQ ID NO: 3443637 - DNA, 17 bp, Homo sapiens
tctcccattgtccctct

SEQ ID NO: 3443638 - DNA, 16 bp, Homo sapiens
tctccccagcccagag

SEQ ID NO: 3443639 - DNA, 19 bp, Homo sapiens
tctccccaggtccagctct

SEQ ID NO: 3443640 - DNA, 22 bp, Homo sapiens
tctccccaggtccagctctgga

SEQ ID NO: 3443641 - DNA, 18 bp, Homo sapiens
tctcccctcagagtgcaa

SEQ ID NO: 3443642 - DNA, 16 bp, Homo sapiens
tctcccctcttctgag

SEQ ID NO: 3443643 - DNA, 14 bp, Homo sapiens
tctcccctgccccc

SEQ ID NO: 3443644 - DNA, 12 bp, Homo sapiens
tctccctcccct

SEQ ID NO: 3443645 - DNA, 15 bp, Homo sapiens
tctccctgaccctgt

SEQ ID NO: 3443646 - DNA, 17 bp, Homo sapiens
tctccgaccagacacct

SEQ ID NO: 3443647 - DNA, 22 bp, Homo sapiens
tctccgttagctcctgtggccc

SEQ ID NO: 3443648 - DNA, 16 bp, Homo sapiens
tctcctagggctatgg

SEQ ID NO: 3443649 - DNA, 15 bp, Homo sapiens
tctcctatatatttc

SEQ ID NO: 3443650 - DNA, 15 bp, Homo sapiens
tctcctcatctctaa

SEQ ID NO: 3443651 - DNA, 12 bp, Homo sapiens
tctcctccccaa

SEQ ID NO: 3443652 - DNA, 16 bp, Homo sapiens
tctcctctcagcccct

SEQ ID NO: 3443653 - DNA, 12 bp, Homo sapiens
tctcctctccat

SEQ ID NO: 3443654 - DNA, 13 bp, Homo sapiens
tctcctcttgtaa

SEQ ID NO: 3443655 - DNA, 14 bp, Homo sapiens
tctcctcttgtaaa

SEQ ID NO: 3443656 - DNA, 21 bp, Homo sapiens
tctcctcttgtaaataaagcc

SEQ ID NO: 3443657 - DNA, 18 bp, Homo sapiens
tctcctgcctcagcctcc

SEQ ID NO: 3443658 - DNA, 22 bp, Homo sapiens
tctcctgcctcagcctcccaaa

SEQ ID NO: 3443659 - DNA, 17 bp, Homo sapiens
tctcctgccttcctcct

SEQ ID NO: 3443660 - DNA, 18 bp, Homo sapiens
tctcctgccttcctcctg

SEQ ID NO: 3443661 - DNA, 15 bp, Homo sapiens
tctcctgcctttgcc

SEQ ID NO: 3443662 - DNA, 19 bp, Homo sapiens
tctccttcagccctcaccc

SEQ ID NO: 3443663 - DNA, 14 bp, Homo sapiens
tctccttgtggcct

SEQ ID NO: 3443664 - DNA, 20 bp, Homo sapiens
tctccttgtggcctgggcct

SEQ ID NO: 3443665 - DNA, 20 bp, Homo sapiens
tctcgaactcctaacctcaa

SEQ ID NO: 3443666 - DNA, 23 bp, Homo sapiens
tctcgcataggacctttccacca

SEQ ID NO: 3443667 - DNA, 15 bp, Homo sapiens
tctcgctccctccca

SEQ ID NO: 3443668 - DNA, 15 bp, Homo sapiens
tctcgcttccctgaa

SEQ ID NO: 3443669 - DNA, 16 bp, Homo sapiens
tctcggctcagtgcaa

SEQ ID NO: 3443670 - DNA, 18 bp, Homo sapiens
tctcgtgcatttcaactt

SEQ ID NO: 3443671 - DNA, 18 bp, Homo sapiens
tctctaacagctcaggat

SEQ ID NO: 3443672 - DNA, 21 bp, Homo sapiens
tctctaactcagaaacatcag

SEQ ID NO: 3443673 - DNA, 16 bp, Homo sapiens
tctctaataagaaaac

SEQ ID NO: 3443674 - DNA, 13 bp, Homo sapiens
tctctaccagata

SEQ ID NO: 3443675 - DNA, 20 bp, Homo sapiens
tctctagaagtgccatctca

SEQ ID NO: 3443676 - DNA, 12 bp, Homo sapiens
tctctatcattt

SEQ ID NO: 3443677 - DNA, 14 bp, Homo sapiens
tctctatgataatt

SEQ ID NO: 3443678 - DNA, 15 bp, Homo sapiens
tctctatgataatta

SEQ ID NO: 3443679 - DNA, 17 bp, Homo sapiens
tctctatgataattaca

SEQ ID NO: 3443680 - DNA, 16 bp, Homo sapiens
tctctcaaccttggcc

SEQ ID NO: 3443681 - DNA, 18 bp, Homo sapiens
tctctcaaccttggcctt

SEQ ID NO: 3443682 - DNA, 20 bp, Homo sapiens
tctctcaaccttggccttct

SEQ ID NO: 3443683 - DNA, 19 bp, Homo sapiens
tctctcatctcttagctcc

SEQ ID NO: 3443684 - DNA, 24 bp, Homo sapiens
tctctccactgctctcagcctccc

SEQ ID NO: 3443685 - DNA, 17 bp, Homo sapiens
tctctccagctaattca

SEQ ID NO: 3443686 - DNA, 14 bp, Homo sapiens
tctctccctcccct

SEQ ID NO: 3443687 - DNA, 17 bp, Homo sapiens
tctctcttgggccaagc

SEQ ID NO: 3443688 - DNA, 13 bp, Homo sapiens
tctctgacttctg

SEQ ID NO: 3443689 - DNA, 17 bp, Homo sapiens
tctctgacttctgcctg

SEQ ID NO: 3443690 - DNA, 18 bp, Homo sapiens
tctctgacttctgcctgg

SEQ ID NO: 3443691 - DNA, 14 bp, Homo sapiens
tctctgagcagtga

SEQ ID NO: 3443692 - DNA, 14 bp, Homo sapiens
tctctgaggacact

SEQ ID NO: 3443693 - DNA, 12 bp, Homo sapiens
tctctgcccaac

SEQ ID NO: 3443694 - DNA, 13 bp, Homo sapiens
tctctgcccaacc

SEQ ID NO: 3443695 - DNA, 14 bp, Homo sapiens
tctctgccctgtgt

SEQ ID NO: 3443696 - DNA, 15 bp, Homo sapiens
tctctgcctcttccc

SEQ ID NO: 3443697 - DNA, 18 bp, Homo sapiens
tctctgcctgacaaggcc

SEQ ID NO: 3443698 - DNA, 19 bp, Homo sapiens
tctctgcctgacaaggcca

SEQ ID NO: 3443699 - DNA, 11 bp, Homo sapiens
tctctgctgcc

SEQ ID NO: 3443700 - DNA, 18 bp, Homo sapiens
tctctgcttgagtcaggt

SEQ ID NO: 3443701 - DNA, 23 bp, Homo sapiens
tctctggaagaggaaccaggaga

SEQ ID NO: 3443702 - DNA, 13 bp, Homo sapiens
tctctgggagaaa

SEQ ID NO: 3443703 - DNA, 14 bp, Homo sapiens
tctctgggagaaaa

SEQ ID NO: 3443704 - DNA, 18 bp, Homo sapiens
tctctgggagaaaatcat

SEQ ID NO: 3443705 - DNA, 19 bp, Homo sapiens
tctctgggagaaaatcatc

SEQ ID NO: 3443706 - DNA, 21 bp, Homo sapiens
tctctgggcttggggcttcct

SEQ ID NO: 3443707 - DNA, 16 bp, Homo sapiens
tctctggggctgtgtt

SEQ ID NO: 3443708 - DNA, 15 bp, Homo sapiens
tctctgtcccttgct

SEQ ID NO: 3443709 - DNA, 17 bp, Homo sapiens
tctctgtcccttgctgt

SEQ ID NO: 3443710 - DNA, 19 bp, Homo sapiens
tctctgtcccttgctgtat

SEQ ID NO: 3443711 - DNA, 14 bp, Homo sapiens
tctctgtctcatcc

SEQ ID NO: 3443712 - DNA, 12 bp, Homo sapiens
tctctgtgcctt

SEQ ID NO: 3443713 - DNA, 22 bp, Homo sapiens
tctctgtgtatgagtgtgaatg

SEQ ID NO: 3443714 - DNA, 16 bp, Homo sapiens
tctcttagctcccctc

SEQ ID NO: 3443715 - DNA, 17 bp, Homo sapiens
tctcttagctcccctcc

SEQ ID NO: 3443716 - DNA, 19 bp, Homo sapiens
tctcttcctccgaggccag

SEQ ID NO: 3443717 - DNA, 21 bp, Homo sapiens
tctcttccttgacctgcattg

SEQ ID NO: 3443718 - DNA, 13 bp, Homo sapiens
tctcttgagcctg

SEQ ID NO: 3443719 - DNA, 17 bp, Homo sapiens
tctcttgagcctgggag

SEQ ID NO: 3443720 - DNA, 18 bp, Homo sapiens
tctcttgagcctgggagg

SEQ ID NO: 3443721 - DNA, 15 bp, Homo sapiens
tctcttgagtttgtc

SEQ ID NO: 3443722 - DNA, 21 bp, Homo sapiens
tctcttgcattgtgacaagaa

SEQ ID NO: 3443723 - DNA, 20 bp, Homo sapiens
tctcttgggccaagccagct

SEQ ID NO: 3443724 - DNA, 21 bp, Homo sapiens
tctcttgggccaagccagctg

SEQ ID NO: 3443725 - DNA, 16 bp, Homo sapiens
tctctttgggaatgtt

SEQ ID NO: 3443726 - DNA, 15 bp, Homo sapiens
tctcttttcaaaaca

SEQ ID NO: 3443727 - DNA, 12 bp, Homo sapiens
tctcttttccac

SEQ ID NO: 3443728 - DNA, 21 bp, Homo sapiens
tctcttttcccctttcctgtc

SEQ ID NO: 3443729 - DNA, 11 bp, Homo sapiens
tctgaaacagc

SEQ ID NO: 3443730 - DNA, 12 bp, Homo sapiens
tctgaaacagct

SEQ ID NO: 3443731 - DNA, 17 bp, Homo sapiens
tctgaaacagctgcctt

SEQ ID NO: 3443732 - DNA, 18 bp, Homo sapiens
tctgaaacagctgcctta

SEQ ID NO: 3443733 - DNA, 15 bp, Homo sapiens
tctgaaaccagtgtt

SEQ ID NO: 3443734 - DNA, 14 bp, Homo sapiens
tctgaactttggga

SEQ ID NO: 3443735 - DNA, 15 bp, Homo sapiens
tctgaactttgggaa

SEQ ID NO: 3443736 - DNA, 22 bp, Homo sapiens
tctgaagagtgggtttcacaag

SEQ ID NO: 3443737 - DNA, 20 bp, Homo sapiens
tctgaagctgacgaacttcc

SEQ ID NO: 3443738 - DNA, 20 bp, Homo sapiens
tctgaaggagccccattcct

SEQ ID NO: 3443739 - DNA, 21 bp, Homo sapiens
tctgaaggagccccattcctg

SEQ ID NO: 3443740 - DNA, 19 bp, Homo sapiens
tctgaatctcaagatgggg

SEQ ID NO: 3443741 - DNA, 13 bp, Homo sapiens
tctgaatttgcaa

SEQ ID NO: 3443742 - DNA, 14 bp, Homo sapiens
tctgaatttgcaaa

SEQ ID NO: 3443743 - DNA, 16 bp, Homo sapiens
tctgaatttgcaaagt

SEQ ID NO: 3443744 - DNA, 21 bp, Homo sapiens
tctgaatttgcaaagtactgt

SEQ ID NO: 3443745 - DNA, 19 bp, Homo sapiens
tctgacacacagctctgtc

SEQ ID NO: 3443746 - DNA, 18 bp, Homo sapiens
tctgaccagcagcgcctt

SEQ ID NO: 3443747 - DNA, 14 bp, Homo sapiens
tctgacccactgct

SEQ ID NO: 3443748 - DNA, 14 bp, Homo sapiens
tctgacccagtgcc

SEQ ID NO: 3443749 - DNA, 22 bp, Homo sapiens
tctgacccagtgcccccactga

SEQ ID NO: 3443750 - DNA, 16 bp, Homo sapiens
tctgactcggtttctc

SEQ ID NO: 3443751 - DNA, 18 bp, Homo sapiens
tctgactcggtttctcca

SEQ ID NO: 3443752 - DNA, 15 bp, Homo sapiens
tctgacttctgcctg

SEQ ID NO: 3443753 - DNA, 20 bp, Homo sapiens
tctgacttctgcctggagac

SEQ ID NO: 3443754 - DNA, 19 bp, Homo sapiens
tctgagaatctttattgag

SEQ ID NO: 3443755 - DNA, 23 bp, Homo sapiens
tctgagaatctttattgagaaag

SEQ ID NO: 3443756 - DNA, 22 bp, Homo sapiens
tctgagcaaactatttgcgact

SEQ ID NO: 3443757 - DNA, 15 bp, Homo sapiens
tctgagccacagtgg

SEQ ID NO: 3443758 - DNA, 16 bp, Homo sapiens
tctgaggaatccagac

SEQ ID NO: 3443759 - DNA, 23 bp, Homo sapiens
tctgaggaatccagacccggctg

SEQ ID NO: 3443760 - DNA, 20 bp, Homo sapiens
tctgaggacactaaccacgc

SEQ ID NO: 3443761 - DNA, 17 bp, Homo sapiens
tctgaggcatcctctga

SEQ ID NO: 3443762 - DNA, 23 bp, Homo sapiens
tctgagtatctcctcgcaagctg

SEQ ID NO: 3443763 - DNA, 20 bp, Homo sapiens
tctgagtctatgttcaaaga

SEQ ID NO: 3443764 - DNA, 19 bp, Homo sapiens
tctgagtgccttctgtggg

SEQ ID NO: 3443765 - DNA, 22 bp, Homo sapiens
tctgagtgccttctgtggggac

SEQ ID NO: 3443766 - DNA, 18 bp, Homo sapiens
tctgataatatattttca

SEQ ID NO: 3443767 - DNA, 19 bp, Homo sapiens
tctgataatatattttcaa

SEQ ID NO: 3443768 - DNA, 15 bp, Homo sapiens
tctgatccctctggg

SEQ ID NO: 3443769 - DNA, 16 bp, Homo sapiens
tctgatccctctgggg

SEQ ID NO: 3443770 - DNA, 16 bp, Homo sapiens
tctgatgcttacatct

SEQ ID NO: 3443771 - DNA, 15 bp, Homo sapiens
tctgatggcttctcc

SEQ ID NO: 3443772 - DNA, 18 bp, Homo sapiens
tctgatggcttctccagg

SEQ ID NO: 3443773 - DNA, 20 bp, Homo sapiens
tctgattcccaagctctgct

SEQ ID NO: 3443774 - DNA, 12 bp, Homo sapiens
tctgattcttct

SEQ ID NO: 3443775 - DNA, 14 bp, Homo sapiens
tctgattttgcttc

SEQ ID NO: 3443776 - DNA, 22 bp, Homo sapiens
tctgcaaaatgaggaatgtata

SEQ ID NO: 3443777 - DNA, 22 bp, Homo sapiens
tctgcaagtatactagggagcc

SEQ ID NO: 3443778 - DNA, 23 bp, Homo sapiens
tctgcaagtatactagggagcca

SEQ ID NO: 3443779 - DNA, 13 bp, Homo sapiens
tctgcaagtgctc

SEQ ID NO: 3443780 - DNA, 16 bp, Homo sapiens
tctgcaagtgctcagg

SEQ ID NO: 3443781 - DNA, 15 bp, Homo sapiens
tctgcaatttctact

SEQ ID NO: 3443782 - DNA, 19 bp, Homo sapiens
tctgcacaagctgcaccct

SEQ ID NO: 3443783 - DNA, 16 bp, Homo sapiens
tctgcacccccctggg

SEQ ID NO: 3443784 - DNA, 22 bp, Homo sapiens
tctgcagaaggaaaaatgtgta

SEQ ID NO: 3443785 - DNA, 16 bp, Homo sapiens
tctgcagacttcccag

SEQ ID NO: 3443786 - DNA, 19 bp, Homo sapiens
tctgcagacttcccagcta

SEQ ID NO: 3443787 - DNA, 13 bp, Homo sapiens
tctgcagccttga

SEQ ID NO: 3443788 - DNA, 13 bp, Homo sapiens
tctgcaggcaggg

SEQ ID NO: 3443789 - DNA, 23 bp, Homo sapiens
tctgcaggcctaggtgcagctcc

SEQ ID NO: 3443790 - DNA, 21 bp, Homo sapiens
tctgcatatgttgaatacttt

SEQ ID NO: 3443791 - DNA, 22 bp, Homo sapiens
tctgcatccagagattcatttt

SEQ ID NO: 3443792 - DNA, 13 bp, Homo sapiens
tctgcatgtacta

SEQ ID NO: 3443793 - DNA, 20 bp, Homo sapiens
tctgcatttagctgtattca

SEQ ID NO: 3443794 - DNA, 18 bp, Homo sapiens
tctgcatttcggtggcta

SEQ ID NO: 3443795 - DNA, 19 bp, Homo sapiens
tctgcatttcggtggctag

SEQ ID NO: 3443796 - DNA, 23 bp, Homo sapiens
tctgccaggcccccaagcctgca

SEQ ID NO: 3443797 - DNA, 12 bp, Homo sapiens
tctgcccaaccc

SEQ ID NO: 3443798 - DNA, 20 bp, Homo sapiens
tctgccccccccccccatct

SEQ ID NO: 3443799 - DNA, 17 bp, Homo sapiens
tctgccggccctggggc

SEQ ID NO: 3443800 - DNA, 19 bp, Homo sapiens
tctgcctcttctgggaggg

SEQ ID NO: 3443801 - DNA, 20 bp, Homo sapiens
tctgcctgaacctggggtca

SEQ ID NO: 3443802 - DNA, 19 bp, Homo sapiens
tctgcctgaagtcacacag

SEQ ID NO: 3443803 - DNA, 21 bp, Homo sapiens
tctgcctgacaaggccagcac

SEQ ID NO: 3443804 - DNA, 18 bp, Homo sapiens
tctgcctgacaggctgtg

SEQ ID NO: 3443805 - DNA, 17 bp, Homo sapiens
tctgcctgccagctgca

SEQ ID NO: 3443806 - DNA, 16 bp, Homo sapiens
tctgcctgcccaggcc

SEQ ID NO: 3443807 - DNA, 13 bp, Homo sapiens
tctgcctgcctgc

SEQ ID NO: 3443808 - DNA, 23 bp, Homo sapiens
tctgcctggagacttagggcacc

SEQ ID NO: 3443809 - DNA, 13 bp, Homo sapiens
tctgcctggagtg

SEQ ID NO: 3443810 - DNA, 21 bp, Homo sapiens
tctgcctggagtgtatgactg

SEQ ID NO: 3443811 - DNA, 16 bp, Homo sapiens
tctgcctgtggaactg

SEQ ID NO: 3443812 - DNA, 16 bp, Homo sapiens
tctgcctttattgtgt

SEQ ID NO: 3443813 - DNA, 10 bp, Homo sapiens
tctgcctttg

SEQ ID NO: 3443814 - DNA, 16 bp, Homo sapiens
tctgcgtcatgcttgt

SEQ ID NO: 3443815 - DNA, 15 bp, Homo sapiens
tctgcgtgtcacctg

SEQ ID NO: 3443816 - DNA, 16 bp, Homo sapiens
tctgctcacatatctg

SEQ ID NO: 3443817 - DNA, 20 bp, Homo sapiens
tctgctcacatatctgtcat

SEQ ID NO: 3443818 - DNA, 14 bp, Homo sapiens
tctgctcatcattc

SEQ ID NO: 3443819 - DNA, 15 bp, Homo sapiens
tctgctcatcattct

SEQ ID NO: 3443820 - DNA, 16 bp, Homo sapiens
tctgctccccagggga

SEQ ID NO: 3443821 - DNA, 21 bp, Homo sapiens
tctgctcctctccccagcaag

SEQ ID NO: 3443822 - DNA, 18 bp, Homo sapiens
tctgctgacagacacagg

SEQ ID NO: 3443823 - DNA, 21 bp, Homo sapiens
tctgctgccgccccacccaga

SEQ ID NO: 3443824 - DNA, 20 bp, Homo sapiens
tctgctggcccagccaaacc

SEQ ID NO: 3443825 - DNA, 14 bp, Homo sapiens
tctgcttcagcctc

SEQ ID NO: 3443826 - DNA, 22 bp, Homo sapiens
tctgcttcccaggttcaagcga

SEQ ID NO: 3443827 - DNA, 14 bp, Homo sapiens
tctgcttgagtcag

SEQ ID NO: 3443828 - DNA, 14 bp, Homo sapiens
tctggaacccagac

SEQ ID NO: 3443829 - DNA, 15 bp, Homo sapiens
tctggaacccagact

SEQ ID NO: 3443830 - DNA, 17 bp, Homo sapiens
tctggaacccagactca

SEQ ID NO: 3443831 - DNA, 18 bp, Homo sapiens
tctggaacccagactcag

SEQ ID NO: 3443832 - DNA, 21 bp, Homo sapiens
tctggaacctcagcctggcca

SEQ ID NO: 3443833 - DNA, 18 bp, Homo sapiens
tctggaagattttcattg

SEQ ID NO: 3443834 - DNA, 19 bp, Homo sapiens
tctggaagattttcattga

SEQ ID NO: 3443835 - DNA, 13 bp, Homo sapiens
tctggaagtccaa

SEQ ID NO: 3443836 - DNA, 16 bp, Homo sapiens
tctggaatctgaggca

SEQ ID NO: 3443837 - DNA, 19 bp, Homo sapiens
tctggaatctggagaccag

SEQ ID NO: 3443838 - DNA, 16 bp, Homo sapiens
tctggaatgcagtggt

SEQ ID NO: 3443839 - DNA, 18 bp, Homo sapiens
tctggacagccccaccct

SEQ ID NO: 3443840 - DNA, 14 bp, Homo sapiens
tctggacaggcatg

SEQ ID NO: 3443841 - DNA, 20 bp, Homo sapiens
tctggagaccagggagcctt

SEQ ID NO: 3443842 - DNA, 16 bp, Homo sapiens
tctggagatggaagct

SEQ ID NO: 3443843 - DNA, 14 bp, Homo sapiens
tctggaggggaggg

SEQ ID NO: 3443844 - DNA, 14 bp, Homo sapiens
tctggagtggccac

SEQ ID NO: 3443845 - DNA, 19 bp, Homo sapiens
tctggagtggccactaagc

SEQ ID NO: 3443846 - DNA, 17 bp, Homo sapiens
tctggagttgatctgga

SEQ ID NO: 3443847 - DNA, 21 bp, Homo sapiens
tctggagttgatctggaaccc

SEQ ID NO: 3443848 - DNA, 22 bp, Homo sapiens
tctggatgcctgattgccaagc

SEQ ID NO: 3443849 - DNA, 18 bp, Homo sapiens
tctggatggtgtgccttc

SEQ ID NO: 3443850 - DNA, 17 bp, Homo sapiens
tctggattaggtctctg

SEQ ID NO: 3443851 - DNA, 17 bp, Homo sapiens
tctggattcccaggatg

SEQ ID NO: 3443852 - DNA, 21 bp, Homo sapiens
tctggattcccaggatgagca

SEQ ID NO: 3443853 - DNA, 18 bp, Homo sapiens
tctggcaggtcctcccct

SEQ ID NO: 3443854 - DNA, 12 bp, Homo sapiens
tctggccaaggg

SEQ ID NO: 3443855 - DNA, 16 bp, Homo sapiens
tctggccaagggccag

SEQ ID NO: 3443856 - DNA, 17 bp, Homo sapiens
tctggccaagggccaga

SEQ ID NO: 3443857 - DNA, 20 bp, Homo sapiens
tctggccaagggccagacag

SEQ ID NO: 3443858 - DNA, 11 bp, Homo sapiens
tctggccaggc

SEQ ID NO: 3443859 - DNA, 21 bp, Homo sapiens
tctggccgtccttgtctctgg

SEQ ID NO: 3443860 - DNA, 19 bp, Homo sapiens
tctggcttctggccaggaa

SEQ ID NO: 3443861 - DNA, 20 bp, Homo sapiens
tctggcttctggccaggaag

SEQ ID NO: 3443862 - DNA, 13 bp, Homo sapiens
tctggcttggcct

SEQ ID NO: 3443863 - DNA, 13 bp, Homo sapiens
tctgggacacagt

SEQ ID NO: 3443864 - DNA, 15 bp, Homo sapiens
tctgggactccaggt

SEQ ID NO: 3443865 - DNA, 13 bp, Homo sapiens
tctgggagaaaat

SEQ ID NO: 3443866 - DNA, 22 bp, Homo sapiens
tctgggagaaaatcatcaagaa

SEQ ID NO: 3443867 - DNA, 19 bp, Homo sapiens
tctgggaggaatggacaga

SEQ ID NO: 3443868 - DNA, 16 bp, Homo sapiens
tctgggagtcacacag

SEQ ID NO: 3443869 - DNA, 17 bp, Homo sapiens
tctgggagtcaggcccg

SEQ ID NO: 3443870 - DNA, 19 bp, Homo sapiens
tctgggagtcaggcccggc

SEQ ID NO: 3443871 - DNA, 14 bp, Homo sapiens
tctgggcaggactc

SEQ ID NO: 3443872 - DNA, 21 bp, Homo sapiens
tctgggcaggactcagctccc

SEQ ID NO: 3443873 - DNA, 21 bp, Homo sapiens
tctgggccattctccacagca

SEQ ID NO: 3443874 - DNA, 20 bp, Homo sapiens
tctgggcggcgggcggctgg

SEQ ID NO: 3443875 - DNA, 13 bp, Homo sapiens
tctgggctccaga

SEQ ID NO: 3443876 - DNA, 22 bp, Homo sapiens
tctggggaaaggggacaaggaa

SEQ ID NO: 3443877 - DNA, 23 bp, Homo sapiens
tctggggcagcaccctataaatc

SEQ ID NO: 3443878 - DNA, 16 bp, Homo sapiens
tctggggctctgggat

SEQ ID NO: 3443879 - DNA, 17 bp, Homo sapiens
tctgggggctctggcca

SEQ ID NO: 3443880 - DNA, 15 bp, Homo sapiens
tctgggtccttcctg

SEQ ID NO: 3443881 - DNA, 18 bp, Homo sapiens
tctgggtgctccctacca

SEQ ID NO: 3443882 - DNA, 16 bp, Homo sapiens
tctgggttcactgcaa

SEQ ID NO: 3443883 - DNA, 17 bp, Homo sapiens
tctgggtttgaagctgc

SEQ ID NO: 3443884 - DNA, 16 bp, Homo sapiens
tctggtcagagccaca

SEQ ID NO: 3443885 - DNA, 18 bp, Homo sapiens
tctggtcagagccacagg

SEQ ID NO: 3443886 - DNA, 19 bp, Homo sapiens
tctggtcagagccacaggg

SEQ ID NO: 3443887 - DNA, 13 bp, Homo sapiens
tctggtcctaccc

SEQ ID NO: 3443888 - DNA, 14 bp, Homo sapiens
tctggtcctaccca

SEQ ID NO: 3443889 - DNA, 18 bp, Homo sapiens
tctggtctctaggctggg

SEQ ID NO: 3443890 - DNA, 19 bp, Homo sapiens
tctggtctctaggctgggg

SEQ ID NO: 3443891 - DNA, 21 bp, Homo sapiens
tctggtctctaggctggggaa

SEQ ID NO: 3443892 - DNA, 12 bp, Homo sapiens
tctggtggcccc

SEQ ID NO: 3443893 - DNA, 16 bp, Homo sapiens
tctggtggtctgttgg

SEQ ID NO: 3443894 - DNA, 20 bp, Homo sapiens
tctggtggtttgattgttta

SEQ ID NO: 3443895 - DNA, 21 bp, Homo sapiens
tctggttccagggtccctctg

SEQ ID NO: 3443896 - DNA, 15 bp, Homo sapiens
tctggtttcaccgag

SEQ ID NO: 3443897 - DNA, 12 bp, Homo sapiens
tctgtaaaatct

SEQ ID NO: 3443898 - DNA, 23 bp, Homo sapiens
tctgtaaaatctttctttcttag

SEQ ID NO: 3443899 - DNA, 17 bp, Homo sapiens
tctgtaattgtgtgtga

SEQ ID NO: 3443900 - DNA, 14 bp, Homo sapiens
tctgtacttttcat

SEQ ID NO: 3443901 - DNA, 21 bp, Homo sapiens
tctgtagaaatggttgtatta

SEQ ID NO: 3443902 - DNA, 22 bp, Homo sapiens
tctgtagaaatggttgtattag

SEQ ID NO: 3443903 - DNA, 18 bp, Homo sapiens
tctgtataagtaagaaaa

SEQ ID NO: 3443904 - DNA, 21 bp, Homo sapiens
tctgtataagtaagaaaatat

SEQ ID NO: 3443905 - DNA, 17 bp, Homo sapiens
tctgtcaagagtagtta

SEQ ID NO: 3443906 - DNA, 20 bp, Homo sapiens
tctgtcaagagtagttatat

SEQ ID NO: 3443907 - DNA, 21 bp, Homo sapiens
tctgtcccacttggcatcagc

SEQ ID NO: 3443908 - DNA, 19 bp, Homo sapiens
tctgtccccttctctcatc

SEQ ID NO: 3443909 - DNA, 19 bp, Homo sapiens
tctgtcccttctgtccctc

SEQ ID NO: 3443910 - DNA, 20 bp, Homo sapiens
tctgtcctactctgtgtcag

SEQ ID NO: 3443911 - DNA, 19 bp, Homo sapiens
tctgtcctcagccttgcca

SEQ ID NO: 3443912 - DNA, 21 bp, Homo sapiens
tctgtcctcagccttgccaga

SEQ ID NO: 3443913 - DNA, 12 bp, Homo sapiens
tctgtcctggga

SEQ ID NO: 3443914 - DNA, 15 bp, Homo sapiens
tctgtctaaagatag

SEQ ID NO: 3443915 - DNA, 15 bp, Homo sapiens
tctgtctacttgctc

SEQ ID NO: 3443916 - DNA, 23 bp, Homo sapiens
tctgtctacttgctcaggtactt

SEQ ID NO: 3443917 - DNA, 17 bp, Homo sapiens
tctgtctcatccatcat

SEQ ID NO: 3443918 - DNA, 19 bp, Homo sapiens
tctgtctccttaacactga

SEQ ID NO: 3443919 - DNA, 13 bp, Homo sapiens
tctgtctggtggc

SEQ ID NO: 3443920 - DNA, 22 bp, Homo sapiens
tctgtcttcccaaacccagtct

SEQ ID NO: 3443921 - DNA, 14 bp, Homo sapiens
tctgtcttgttcat

SEQ ID NO: 3443922 - DNA, 21 bp, Homo sapiens
tctgtgaacgatttagaaaga

SEQ ID NO: 3443923 - DNA, 15 bp, Homo sapiens
tctgtgaattgcctg

SEQ ID NO: 3443924 - DNA, 21 bp, Homo sapiens
tctgtgagactcgagaacttt

SEQ ID NO: 3443925 - DNA, 15 bp, Homo sapiens
tctgtgccctcctga

SEQ ID NO: 3443926 - DNA, 12 bp, Homo sapiens
tctgtggggccc

SEQ ID NO: 3443927 - DNA, 15 bp, Homo sapiens
tctgtgggtctctgg

SEQ ID NO: 3443928 - DNA, 16 bp, Homo sapiens
tctgtgggtctctgga

SEQ ID NO: 3443929 - DNA, 17 bp, Homo sapiens
tctgtgtcaggtggggc

SEQ ID NO: 3443930 - DNA, 20 bp, Homo sapiens
tctgtgtcaggtggggcagc

SEQ ID NO: 3443931 - DNA, 12 bp, Homo sapiens
tctgtgtcttgt

SEQ ID NO: 3443932 - DNA, 13 bp, Homo sapiens
tctgttacccagg

SEQ ID NO: 3443933 - DNA, 20 bp, Homo sapiens
tctgttcccccttcacaaag

SEQ ID NO: 3443934 - DNA, 18 bp, Homo sapiens
tctgttggcaggctggcc

SEQ ID NO: 3443935 - DNA, 22 bp, Homo sapiens
tctgtttctggaaatgttcttt

SEQ ID NO: 3443936 - DNA, 21 bp, Homo sapiens
tctgtttggactgcagaagca

SEQ ID NO: 3443937 - DNA, 19 bp, Homo sapiens
tctgtttttaatgctattt

SEQ ID NO: 3443938 - DNA, 13 bp, Homo sapiens
tcttaaaaagtgg

SEQ ID NO: 3443939 - DNA, 23 bp, Homo sapiens
tcttaaccagatggttgtgtatg

SEQ ID NO: 3443940 - DNA, 19 bp, Homo sapiens
tcttaagatacaaatggtg

SEQ ID NO: 3443941 - DNA, 22 bp, Homo sapiens
tcttaaggaacatctctgcttt

SEQ ID NO: 3443942 - DNA, 15 bp, Homo sapiens
tcttaatataaattc

SEQ ID NO: 3443943 - DNA, 16 bp, Homo sapiens
tcttaatgaagtttga

SEQ ID NO: 3443944 - DNA, 23 bp, Homo sapiens
tcttaatgaagtttgaatgttaa

SEQ ID NO: 3443945 - DNA, 17 bp, Homo sapiens
tcttaatttctatcttg

SEQ ID NO: 3443946 - DNA, 16 bp, Homo sapiens
tcttacacaagagctg

SEQ ID NO: 3443947 - DNA, 12 bp, Homo sapiens
tcttacatgtat

SEQ ID NO: 3443948 - DNA, 14 bp, Homo sapiens
tcttacatgtataa

SEQ ID NO: 3443949 - DNA, 14 bp, Homo sapiens
tcttacatgttttc

SEQ ID NO: 3443950 - DNA, 14 bp, Homo sapiens
tcttactctttcct

SEQ ID NO: 3443951 - DNA, 15 bp, Homo sapiens
tcttactctttccta

SEQ ID NO: 3443952 - DNA, 13 bp, Homo sapiens
tcttactgaaggt

SEQ ID NO: 3443953 - DNA, 14 bp, Homo sapiens
tcttactgataatt

SEQ ID NO: 3443954 - DNA, 16 bp, Homo sapiens
tcttactgataatttt

SEQ ID NO: 3443955 - DNA, 21 bp, Homo sapiens
tcttacttggctttttactat

SEQ ID NO: 3443956 - DNA, 18 bp, Homo sapiens
tcttagatggattctcca

SEQ ID NO: 3443957 - DNA, 14 bp, Homo sapiens
tcttagctcccctc

SEQ ID NO: 3443958 - DNA, 15 bp, Homo sapiens
tcttaggaagagaaa

SEQ ID NO: 3443959 - DNA, 18 bp, Homo sapiens
tcttaggtgcgcagtggc

SEQ ID NO: 3443960 - DNA, 20 bp, Homo sapiens
tcttaggttggcaaaaaggc

SEQ ID NO: 3443961 - DNA, 23 bp, Homo sapiens
tcttaggttggcaaaaaggcagg

SEQ ID NO: 3443962 - DNA, 14 bp, Homo sapiens
tcttatactgtaca

SEQ ID NO: 3443963 - DNA, 16 bp, Homo sapiens
tcttatactgtacaat

SEQ ID NO: 3443964 - DNA, 16 bp, Homo sapiens
tcttatcaagcagcca

SEQ ID NO: 3443965 - DNA, 14 bp, Homo sapiens
tcttatggaattga

SEQ ID NO: 3443966 - DNA, 14 bp, Homo sapiens
tcttcaaatgcctg

SEQ ID NO: 3443967 - DNA, 15 bp, Homo sapiens
tcttcacatccattg

SEQ ID NO: 3443968 - DNA, 17 bp, Homo sapiens
tcttcaccatttggcaa

SEQ ID NO: 3443969 - DNA, 17 bp, Homo sapiens
tcttcacctcttccact

SEQ ID NO: 3443970 - DNA, 23 bp, Homo sapiens
tcttcacctgattcaactaaaaa

SEQ ID NO: 3443971 - DNA, 14 bp, Homo sapiens
tcttcacggcagga

SEQ ID NO: 3443972 - DNA, 20 bp, Homo sapiens
tcttcagaaagtgtgcttta

SEQ ID NO: 3443973 - DNA, 23 bp, Homo sapiens
tcttcagggcctggttgaagaag

SEQ ID NO: 3443974 - DNA, 16 bp, Homo sapiens
tcttcagttaattctt

SEQ ID NO: 3443975 - DNA, 17 bp, Homo sapiens
tcttcagtttaatgcaa

SEQ ID NO: 3443976 - DNA, 23 bp, Homo sapiens
tcttcataggtagaaacaaatac

SEQ ID NO: 3443977 - DNA, 23 bp, Homo sapiens
tcttcatgtctattccattccct

SEQ ID NO: 3443978 - DNA, 18 bp, Homo sapiens
tcttccacaaagaaaatt

SEQ ID NO: 3443979 - DNA, 23 bp, Homo sapiens
tcttccacaaagaaaattcctat

SEQ ID NO: 3443980 - DNA, 14 bp, Homo sapiens
tcttccatgatttt

SEQ ID NO: 3443981 - DNA, 13 bp, Homo sapiens
tcttccatttgca

SEQ ID NO: 3443982 - DNA, 19 bp, Homo sapiens
tcttccctacagttgaaaa

SEQ ID NO: 3443983 - DNA, 19 bp, Homo sapiens
tcttcccttttacatactg

SEQ ID NO: 3443984 - DNA, 21 bp, Homo sapiens
tcttccgactctttctgagtg

SEQ ID NO: 3443985 - DNA, 14 bp, Homo sapiens
tcttcctctgcaag

SEQ ID NO: 3443986 - DNA, 13 bp, Homo sapiens
tcttcctgtgtcc

SEQ ID NO: 3443987 - DNA, 16 bp, Homo sapiens
tcttcctgtgtcctga

SEQ ID NO: 3443988 - DNA, 21 bp, Homo sapiens
tcttccttgaagaactgcagg

SEQ ID NO: 3443989 - DNA, 22 bp, Homo sapiens
tcttctaaacttccccatcttc

SEQ ID NO: 3443990 - DNA, 14 bp, Homo sapiens
tcttctaaattaaa

SEQ ID NO: 3443991 - DNA, 12 bp, Homo sapiens
tcttctaccaga

SEQ ID NO: 3443992 - DNA, 12 bp, Homo sapiens
tcttctccaggc

SEQ ID NO: 3443993 - DNA, 11 bp, Homo sapiens
tcttctgagct

SEQ ID NO: 3443994 - DNA, 19 bp, Homo sapiens
tcttctgccggccctgggg

SEQ ID NO: 3443995 - DNA, 18 bp, Homo sapiens
tcttctggctcaaaaaga

SEQ ID NO: 3443996 - DNA, 21 bp, Homo sapiens
tcttctggctcaaaaagagaa

SEQ ID NO: 3443997 - DNA, 17 bp, Homo sapiens
tcttctgggagggcagc

SEQ ID NO: 3443998 - DNA, 20 bp, Homo sapiens
tcttctgggagggcagcagg

SEQ ID NO: 3443999 - DNA, 15 bp, Homo sapiens
tcttctgtacgtctg

SEQ ID NO: 3444000 - DNA, 22 bp, Homo sapiens
tcttctgtacgtctgacaggca

SEQ ID NO: 3444001 - DNA, 12 bp, Homo sapiens
tcttctgtccct

SEQ ID NO: 3444002 - DNA, 13 bp, Homo sapiens
tcttcttcaccat

SEQ ID NO: 3444003 - DNA, 17 bp, Homo sapiens
tcttcttgttctgagat

SEQ ID NO: 3444004 - DNA, 17 bp, Homo sapiens
tcttctttcagacttgc

SEQ ID NO: 3444005 - DNA, 13 bp, Homo sapiens
tcttctttcccaa

SEQ ID NO: 3444006 - DNA, 22 bp, Homo sapiens
tcttctttcccaaaattaggga

SEQ ID NO: 3444007 - DNA, 21 bp, Homo sapiens
tcttgaaattaagaaggcaaa

SEQ ID NO: 3444008 - DNA, 22 bp, Homo sapiens
tcttgaaattaagaaggcaaaa

SEQ ID NO: 3444009 - DNA, 20 bp, Homo sapiens
tcttgaagagaaaaaagtca

SEQ ID NO: 3444010 - DNA, 18 bp, Homo sapiens
tcttgaagtcctggcttc

SEQ ID NO: 3444011 - DNA, 22 bp, Homo sapiens
tcttgaagtcctggcttcaggc

SEQ ID NO: 3444012 - DNA, 17 bp, Homo sapiens
tcttgaatagcttatgt

SEQ ID NO: 3444013 - DNA, 13 bp, Homo sapiens
tcttgaatttaat

SEQ ID NO: 3444014 - DNA, 21 bp, Homo sapiens
tcttgaatttaataatctgta

SEQ ID NO: 3444015 - DNA, 23 bp, Homo sapiens
tcttgaatttttttctgcacagc

SEQ ID NO: 3444016 - DNA, 19 bp, Homo sapiens
tcttgaccaagcaggaagc

SEQ ID NO: 3444017 - DNA, 22 bp, Homo sapiens
tcttgaggagagagacagagag

SEQ ID NO: 3444018 - DNA, 14 bp, Homo sapiens
tcttgagtttgtcg

SEQ ID NO: 3444019 - DNA, 21 bp, Homo sapiens
tcttgagtttgtcgctcatgt

SEQ ID NO: 3444020 - DNA, 17 bp, Homo sapiens
tcttgatcaacatcttt

SEQ ID NO: 3444021 - DNA, 19 bp, Homo sapiens
tcttgatcaacatcttttc

SEQ ID NO: 3444022 - DNA, 23 bp, Homo sapiens
tcttgattatccatattgagtca

SEQ ID NO: 3444023 - DNA, 16 bp, Homo sapiens
tcttgcaatggcagcc

SEQ ID NO: 3444024 - DNA, 22 bp, Homo sapiens
tcttgcaatggcagccttggca

SEQ ID NO: 3444025 - DNA, 19 bp, Homo sapiens
tcttgcattgtgacaagaa

SEQ ID NO: 3444026 - DNA, 12 bp, Homo sapiens
tcttgccagcca

SEQ ID NO: 3444027 - DNA, 16 bp, Homo sapiens
tcttgcctctgtcccc

SEQ ID NO: 3444028 - DNA, 22 bp, Homo sapiens
tcttgcctctgtccccttctct

SEQ ID NO: 3444029 - DNA, 19 bp, Homo sapiens
tcttgcctctgtgctgtgt

SEQ ID NO: 3444030 - DNA, 18 bp, Homo sapiens
tcttgctatattgcccag

SEQ ID NO: 3444031 - DNA, 12 bp, Homo sapiens
tcttgctctgct

SEQ ID NO: 3444032 - DNA, 13 bp, Homo sapiens
tcttgctctgctg

SEQ ID NO: 3444033 - DNA, 14 bp, Homo sapiens
tcttgctctgctga

SEQ ID NO: 3444034 - DNA, 23 bp, Homo sapiens
tcttgctggctacgcctcttctg

SEQ ID NO: 3444035 - DNA, 15 bp, Homo sapiens
tcttgctgttgacat

SEQ ID NO: 3444036 - DNA, 13 bp, Homo sapiens
tcttggcagtcac

SEQ ID NO: 3444037 - DNA, 16 bp, Homo sapiens
tcttggcttaatcatt

SEQ ID NO: 3444038 - DNA, 18 bp, Homo sapiens
tcttggcttaatcatttt

SEQ ID NO: 3444039 - DNA, 19 bp, Homo sapiens
tcttggcttactgcagcct

SEQ ID NO: 3444040 - DNA, 17 bp, Homo sapiens
tcttggcttggtgagga

SEQ ID NO: 3444041 - DNA, 21 bp, Homo sapiens
tcttgggcagagctggctctg

SEQ ID NO: 3444042 - DNA, 17 bp, Homo sapiens
tcttggttggctggcct

SEQ ID NO: 3444043 - DNA, 13 bp, Homo sapiens
tcttgtaaataaa

SEQ ID NO: 3444044 - DNA, 17 bp, Homo sapiens
tcttgtaaataaagccc

SEQ ID NO: 3444045 - DNA, 19 bp, Homo sapiens
tcttgtaatccgaatctct

SEQ ID NO: 3444046 - DNA, 23 bp, Homo sapiens
tcttgtaggatctactttttgaa

SEQ ID NO: 3444047 - DNA, 16 bp, Homo sapiens
tcttgtattaaactct

SEQ ID NO: 3444048 - DNA, 17 bp, Homo sapiens
tcttgtctcaatgctca

SEQ ID NO: 3444049 - DNA, 15 bp, Homo sapiens
tcttgtctctgggct

SEQ ID NO: 3444050 - DNA, 18 bp, Homo sapiens
tcttgtgcttttcctgat

SEQ ID NO: 3444051 - DNA, 22 bp, Homo sapiens
tcttgtggaagtgcatctactt

SEQ ID NO: 3444052 - DNA, 24 bp, Homo sapiens
tcttgtggatggaaatgtagtgct

SEQ ID NO: 3444053 - DNA, 15 bp, Homo sapiens
tcttgttctgtcact

SEQ ID NO: 3444054 - DNA, 11 bp, Homo sapiens
tcttgttgctt

SEQ ID NO: 3444055 - DNA, 14 bp, Homo sapiens
tcttgttgctttgt

SEQ ID NO: 3444056 - DNA, 13 bp, Homo sapiens
tcttgttgttatt

SEQ ID NO: 3444057 - DNA, 15 bp, Homo sapiens
tctttaaaagagaga

SEQ ID NO: 3444058 - DNA, 23 bp, Homo sapiens
tctttaaaagagagagagagaaa

SEQ ID NO: 3444059 - DNA, 23 bp, Homo sapiens
tctttaaagtgactaatggcatg

SEQ ID NO: 3444060 - DNA, 14 bp, Homo sapiens
tctttaaatatata

SEQ ID NO: 3444061 - DNA, 23 bp, Homo sapiens
tctttactcctcacacttactgt

SEQ ID NO: 3444062 - DNA, 11 bp, Homo sapiens
tctttagaaca

SEQ ID NO: 3444063 - DNA, 12 bp, Homo sapiens
tctttagaattt

SEQ ID NO: 3444064 - DNA, 12 bp, Homo sapiens
tctttagagtta

SEQ ID NO: 3444065 - DNA, 23 bp, Homo sapiens
tctttagatggtggcacattcct

SEQ ID NO: 3444066 - DNA, 20 bp, Homo sapiens
tctttagccagaatctcatt

SEQ ID NO: 3444067 - DNA, 17 bp, Homo sapiens
tctttaggtctttgtaa

SEQ ID NO: 3444068 - DNA, 15 bp, Homo sapiens
tctttattatggaaa

SEQ ID NO: 3444069 - DNA, 20 bp, Homo sapiens
tctttattatggaaaacatt

SEQ ID NO: 3444070 - DNA, 21 bp, Homo sapiens
tctttattgaacttgaaatct

SEQ ID NO: 3444071 - DNA, 13 bp, Homo sapiens
tctttattgagaa

SEQ ID NO: 3444072 - DNA, 22 bp, Homo sapiens
tctttatttttgttaatattaa

SEQ ID NO: 3444073 - DNA, 10 bp, Homo sapiens
tctttcacat

SEQ ID NO: 3444074 - DNA, 21 bp, Homo sapiens
tctttcagtacttttttaaat

SEQ ID NO: 3444075 - DNA, 14 bp, Homo sapiens
tctttcatgagttt

SEQ ID NO: 3444076 - DNA, 17 bp, Homo sapiens
tctttcctaaggctgca

SEQ ID NO: 3444077 - DNA, 19 bp, Homo sapiens
tctttcctagatggcagtc

SEQ ID NO: 3444078 - DNA, 22 bp, Homo sapiens
tctttcctagatggcagtcact

SEQ ID NO: 3444079 - DNA, 12 bp, Homo sapiens
tctttcctcctt

SEQ ID NO: 3444080 - DNA, 15 bp, Homo sapiens
tctttcctccttcca

SEQ ID NO: 3444081 - DNA, 18 bp, Homo sapiens
tctttctgagtgccttct

SEQ ID NO: 3444082 - DNA, 13 bp, Homo sapiens
tctttctgtccct

SEQ ID NO: 3444083 - DNA, 14 bp, Homo sapiens
tctttcttagaaat

SEQ ID NO: 3444084 - DNA, 22 bp, Homo sapiens
tctttctttgggaatatttgaa

SEQ ID NO: 3444085 - DNA, 19 bp, Homo sapiens
tctttgattctccttcagc

SEQ ID NO: 3444086 - DNA, 23 bp, Homo sapiens
tctttgattctccttcagccctc

SEQ ID NO: 3444087 - DNA, 23 bp, Homo sapiens
tctttgcaaagtattgtaaatta

SEQ ID NO: 3444088 - DNA, 22 bp, Homo sapiens
tctttgcaggaggcccaacctc

SEQ ID NO: 3444089 - DNA, 21 bp, Homo sapiens
tctttgccagtcattcagcag

SEQ ID NO: 3444090 - DNA, 19 bp, Homo sapiens
tctttgctgtaagatgtct

SEQ ID NO: 3444091 - DNA, 13 bp, Homo sapiens
tctttgctttgcc

SEQ ID NO: 3444092 - DNA, 20 bp, Homo sapiens
tctttgggaatatttgaatc

SEQ ID NO: 3444093 - DNA, 16 bp, Homo sapiens
tctttgggccagacat

SEQ ID NO: 3444094 - DNA, 21 bp, Homo sapiens
tctttgtaagaactaaagaag

SEQ ID NO: 3444095 - DNA, 20 bp, Homo sapiens
tctttgtctaaaacaataaa

SEQ ID NO: 3444096 - DNA, 19 bp, Homo sapiens
tctttgtgggtttttcatc

SEQ ID NO: 3444097 - DNA, 21 bp, Homo sapiens
tctttgtgggtttttcatctt

SEQ ID NO: 3444098 - DNA, 16 bp, Homo sapiens
tctttgttcatagccc

SEQ ID NO: 3444099 - DNA, 19 bp, Homo sapiens
tcttttcccctttcctgtc

SEQ ID NO: 3444100 - DNA, 16 bp, Homo sapiens
tcttttctaaaagact

SEQ ID NO: 3444101 - DNA, 20 bp, Homo sapiens
tcttttcttgcctctgtccc

SEQ ID NO: 3444102 - DNA, 21 bp, Homo sapiens
tcttttgaggctctctcataa

SEQ ID NO: 3444103 - DNA, 18 bp, Homo sapiens
tcttttgcttttggcaaa

SEQ ID NO: 3444104 - DNA, 22 bp, Homo sapiens
tcttttgtatgtaaatgtgcat

SEQ ID NO: 3444105 - DNA, 20 bp, Homo sapiens
tcttttgttcgcatggtcac

SEQ ID NO: 3444106 - DNA, 14 bp, Homo sapiens
tcttttgtttcctt

SEQ ID NO: 3444107 - DNA, 15 bp, Homo sapiens
tctttttaagttaat

SEQ ID NO: 3444108 - DNA, 13 bp, Homo sapiens
tctttttattgaa

SEQ ID NO: 3444109 - DNA, 19 bp, Homo sapiens
tctttttcaggctcgccaa

SEQ ID NO: 3444110 - DNA, 23 bp, Homo sapiens
tctttttcaggctcgccaaggcc

SEQ ID NO: 3444111 - DNA, 12 bp, Homo sapiens
tctttttctacc

SEQ ID NO: 3444112 - DNA, 13 bp, Homo sapiens
tctttttgtttgt

SEQ ID NO: 3444113 - DNA, 22 bp, Homo sapiens
tgaaaaactatgtcagtatttt

SEQ ID NO: 3444114 - DNA, 16 bp, Homo sapiens
tgaaaaaggaggaaga

SEQ ID NO: 3444115 - DNA, 20 bp, Homo sapiens
tgaaaaaggaggaagagaaa

SEQ ID NO: 3444116 - DNA, 22 bp, Homo sapiens
tgaaaaaggaggaagagaaaaa

SEQ ID NO: 3444117 - DNA, 15 bp, Homo sapiens
tgaaaagaaaaatga

SEQ ID NO: 3444118 - DNA, 19 bp, Homo sapiens
tgaaaagaaaaatgagcct

SEQ ID NO: 3444119 - DNA, 15 bp, Homo sapiens
tgaaaagaaggaata

SEQ ID NO: 3444120 - DNA, 16 bp, Homo sapiens
tgaaaagagaatgatg

SEQ ID NO: 3444121 - DNA, 20 bp, Homo sapiens
tgaaaatcttataatttaaa

SEQ ID NO: 3444122 - DNA, 15 bp, Homo sapiens
tgaaaatgtcttgtg

SEQ ID NO: 3444123 - DNA, 16 bp, Homo sapiens
tgaaaatgtcttgtgt

SEQ ID NO: 3444124 - DNA, 14 bp, Homo sapiens
tgaaacaaagctgc

SEQ ID NO: 3444125 - DNA, 16 bp, Homo sapiens
tgaaacaacttggaaa

SEQ ID NO: 3444126 - DNA, 10 bp, Homo sapiens
tgaaacagct

SEQ ID NO: 3444127 - DNA, 15 bp, Homo sapiens
tgaaacagctgcctt

SEQ ID NO: 3444128 - DNA, 17 bp, Homo sapiens
tgaaacagctgccttag

SEQ ID NO: 3444129 - DNA, 20 bp, Homo sapiens
tgaaaccagtgttagggaag

SEQ ID NO: 3444130 - DNA, 11 bp, Homo sapiens
tgaaacccagt

SEQ ID NO: 3444131 - DNA, 15 bp, Homo sapiens
tgaaaccctggacca

SEQ ID NO: 3444132 - DNA, 16 bp, Homo sapiens
tgaaactcatctcatt

SEQ ID NO: 3444133 - DNA, 18 bp, Homo sapiens
tgaaactttgctttgggt

SEQ ID NO: 3444134 - DNA, 22 bp, Homo sapiens
tgaaagactgaagaaagtgtag

SEQ ID NO: 3444135 - DNA, 15 bp, Homo sapiens
tgaaagcggctgcct

SEQ ID NO: 3444136 - DNA, 17 bp, Homo sapiens
tgaaagcggctgcctcc

SEQ ID NO: 3444137 - DNA, 17 bp, Homo sapiens
tgaaagctggtggcaga

SEQ ID NO: 3444138 - DNA, 17 bp, Homo sapiens
tgaaaggcattctctga

SEQ ID NO: 3444139 - DNA, 19 bp, Homo sapiens
tgaaaggcattctctgaag

SEQ ID NO: 3444140 - DNA, 15 bp, Homo sapiens
tgaaagggcccagag

SEQ ID NO: 3444141 - DNA, 21 bp, Homo sapiens
tgaaaggtgccatggaagagg

SEQ ID NO: 3444142 - DNA, 19 bp, Homo sapiens
tgaaagtaaaacaatttat

SEQ ID NO: 3444143 - DNA, 16 bp, Homo sapiens
tgaaagtccagaaact

SEQ ID NO: 3444144 - DNA, 18 bp, Homo sapiens
tgaaagttgccattattc

SEQ ID NO: 3444145 - DNA, 22 bp, Homo sapiens
tgaaataaaactggctttggct

SEQ ID NO: 3444146 - DNA, 19 bp, Homo sapiens
tgaaataaattctgattct

SEQ ID NO: 3444147 - DNA, 14 bp, Homo sapiens
tgaaataactggaa

SEQ ID NO: 3444148 - DNA, 15 bp, Homo sapiens
tgaaatattcttagg

SEQ ID NO: 3444149 - DNA, 20 bp, Homo sapiens
tgaaatgaggtcagagcctg

SEQ ID NO: 3444150 - DNA, 19 bp, Homo sapiens
tgaaatgcagagtcaatga

SEQ ID NO: 3444151 - DNA, 14 bp, Homo sapiens
tgaaattaacctct

SEQ ID NO: 3444152 - DNA, 17 bp, Homo sapiens
tgaaattaacctctcac

SEQ ID NO: 3444153 - DNA, 19 bp, Homo sapiens
tgaaattaagaaggcaaaa

SEQ ID NO: 3444154 - DNA, 23 bp, Homo sapiens
tgaaattaagaaggcaaaaatgt

SEQ ID NO: 3444155 - DNA, 15 bp, Homo sapiens
tgaaattctcctgga

SEQ ID NO: 3444156 - DNA, 13 bp, Homo sapiens
tgaaattctgaat

SEQ ID NO: 3444157 - DNA, 14 bp, Homo sapiens
tgaaattctgaatt

SEQ ID NO: 3444158 - DNA, 20 bp, Homo sapiens
tgaaattctgaatttgcaaa

SEQ ID NO: 3444159 - DNA, 19 bp, Homo sapiens
tgaacacaaactgtaaata

SEQ ID NO: 3444160 - DNA, 15 bp, Homo sapiens
tgaacagcttgctgt

SEQ ID NO: 3444161 - DNA, 18 bp, Homo sapiens
tgaacagtcacgcctgaa

SEQ ID NO: 3444162 - DNA, 20 bp, Homo sapiens
tgaacagtcacgcctgaaac

SEQ ID NO: 3444163 - DNA, 22 bp, Homo sapiens
tgaacagtcacgcctgaaactt

SEQ ID NO: 3444164 - DNA, 17 bp, Homo sapiens
tgaaccattaaccagat

SEQ ID NO: 3444165 - DNA, 14 bp, Homo sapiens
tgaaccccaaatgc

SEQ ID NO: 3444166 - DNA, 21 bp, Homo sapiens
tgaaccccaaatgctctctct

SEQ ID NO: 3444167 - DNA, 15 bp, Homo sapiens
tgaacccctggctcc

SEQ ID NO: 3444168 - DNA, 20 bp, Homo sapiens
tgaacccctggctccttcac

SEQ ID NO: 3444169 - DNA, 21 bp, Homo sapiens
tgaacccctggctccttcacc

SEQ ID NO: 3444170 - DNA, 13 bp, Homo sapiens
tgaacccttgctt

SEQ ID NO: 3444171 - DNA, 21 bp, Homo sapiens
tgaacctaggagtgccccatt

SEQ ID NO: 3444172 - DNA, 21 bp, Homo sapiens
tgaactatggacggtgctcca

SEQ ID NO: 3444173 - DNA, 20 bp, Homo sapiens
tgaactcactttcctcctga

SEQ ID NO: 3444174 - DNA, 12 bp, Homo sapiens
tgaactcctggc

SEQ ID NO: 3444175 - DNA, 16 bp, Homo sapiens
tgaactcctggcctca

SEQ ID NO: 3444176 - DNA, 17 bp, Homo sapiens
tgaactccttccccact

SEQ ID NO: 3444177 - DNA, 18 bp, Homo sapiens
tgaactccttccccactt

SEQ ID NO: 3444178 - DNA, 15 bp, Homo sapiens
tgaactcttcactct

SEQ ID NO: 3444179 - DNA, 18 bp, Homo sapiens
tgaactgaaattaaaact

SEQ ID NO: 3444180 - DNA, 14 bp, Homo sapiens
tgaactgacttcaa

SEQ ID NO: 3444181 - DNA, 17 bp, Homo sapiens
tgaactggaccctgttg

SEQ ID NO: 3444182 - DNA, 19 bp, Homo sapiens
tgaactgggtacttgtgga

SEQ ID NO: 3444183 - DNA, 18 bp, Homo sapiens
tgaactggtcttcctttt

SEQ ID NO: 3444184 - DNA, 22 bp, Homo sapiens
tgaactgtgtgtaattgttcct

SEQ ID NO: 3444185 - DNA, 22 bp, Homo sapiens
tgaacttgtaaaggaatttaaa

SEQ ID NO: 3444186 - DNA, 17 bp, Homo sapiens
tgaactttgggaagcct

SEQ ID NO: 3444187 - DNA, 14 bp, Homo sapiens
tgaagaacatgtga

SEQ ID NO: 3444188 - DNA, 23 bp, Homo sapiens
tgaagaactgcaggccctggcct

SEQ ID NO: 3444189 - DNA, 16 bp, Homo sapiens
tgaagacacctgcagc

SEQ ID NO: 3444190 - DNA, 13 bp, Homo sapiens
tgaagacagaagt

SEQ ID NO: 3444191 - DNA, 19 bp, Homo sapiens
tgaagactcattcttctgt

SEQ ID NO: 3444192 - DNA, 20 bp, Homo sapiens
tgaagactcattcttctgta

SEQ ID NO: 3444193 - DNA, 15 bp, Homo sapiens
tgaagactggaagct

SEQ ID NO: 3444194 - DNA, 22 bp, Homo sapiens
tgaagagaaaaaggctgaaaag

SEQ ID NO: 3444195 - DNA, 23 bp, Homo sapiens
tgaagaggcctaagtcaaaactt

SEQ ID NO: 3444196 - DNA, 18 bp, Homo sapiens
tgaagattatttcattcg

SEQ ID NO: 3444197 - DNA, 21 bp, Homo sapiens
tgaagattctttcccaattca

SEQ ID NO: 3444198 - DNA, 15 bp, Homo sapiens
tgaagatttcagagg

SEQ ID NO: 3444199 - DNA, 19 bp, Homo sapiens
tgaagcagatgcaaagagg

SEQ ID NO: 3444200 - DNA, 20 bp, Homo sapiens
tgaagcagcctctccccagg

SEQ ID NO: 3444201 - DNA, 19 bp, Homo sapiens
tgaagccaattcagacagg

SEQ ID NO: 3444202 - DNA, 16 bp, Homo sapiens
tgaagctaatgaccaa

SEQ ID NO: 3444203 - DNA, 12 bp, Homo sapiens
tgaagctgctgt

SEQ ID NO: 3444204 - DNA, 12 bp, Homo sapiens
tgaagcttcctt

SEQ ID NO: 3444205 - DNA, 13 bp, Homo sapiens
tgaaggaatatat

SEQ ID NO: 3444206 - DNA, 21 bp, Homo sapiens
tgaaggaatatatggcagagt

SEQ ID NO: 3444207 - DNA, 22 bp, Homo sapiens
tgaaggaatatatggcagagtt

SEQ ID NO: 3444208 - DNA, 22 bp, Homo sapiens
tgaaggacattgcggacagcca

SEQ ID NO: 3444209 - DNA, 22 bp, Homo sapiens
tgaaggagaggcaacatccaaa

SEQ ID NO: 3444210 - DNA, 16 bp, Homo sapiens
tgaaggcaaaattgca

SEQ ID NO: 3444211 - DNA, 18 bp, Homo sapiens
tgaaggcaaaattgcaaa

SEQ ID NO: 3444212 - DNA, 17 bp, Homo sapiens
tgaaggctaaaaagcaa

SEQ ID NO: 3444213 - DNA, 20 bp, Homo sapiens
tgaaggctggcatgatccaa

SEQ ID NO: 3444214 - DNA, 15 bp, Homo sapiens
tgaaggcttctctct

SEQ ID NO: 3444215 - DNA, 22 bp, Homo sapiens
gggtggcctaagagttgagctc

SEQ ID NO: 3444216 - DNA, 11 bp, Homo sapiens
gggtggcctgt

SEQ ID NO: 3444217 - DNA, 14 bp, Homo sapiens
gggtgggccaggct

SEQ ID NO: 3444218 - DNA, 12 bp, Homo sapiens
gggtgggtataa

SEQ ID NO: 3444219 - DNA, 20 bp, Homo sapiens
gggtgggtcagaaccctgcc

SEQ ID NO: 3444220 - DNA, 17 bp, Homo sapiens
gggtgtcctgcctgtct

SEQ ID NO: 3444221 - DNA, 15 bp, Homo sapiens
gggtgtcttgggcag

SEQ ID NO: 3444222 - DNA, 21 bp, Homo sapiens
gggtgtcttgggcagagctgg

SEQ ID NO: 3444223 - DNA, 11 bp, Homo sapiens
gggtgtgggtt

SEQ ID NO: 3444224 - DNA, 16 bp, Homo sapiens
gggttaagaagacttt

SEQ ID NO: 3444225 - DNA, 15 bp, Homo sapiens
gggttaaggcctgaa

SEQ ID NO: 3444226 - DNA, 22 bp, Homo sapiens
gggttacagtatgcttgctcta

SEQ ID NO: 3444227 - DNA, 17 bp, Homo sapiens
gggttaggggtggagtc

SEQ ID NO: 3444228 - DNA, 22 bp, Homo sapiens
gggttcaagcgattcttctgct

SEQ ID NO: 3444229 - DNA, 14 bp, Homo sapiens
gggttcatttgtgt

SEQ ID NO: 3444230 - DNA, 16 bp, Homo sapiens
gggttcttgagccagc

SEQ ID NO: 3444231 - DNA, 15 bp, Homo sapiens
gggttgggctggtgt

SEQ ID NO: 3444232 - DNA, 23 bp, Homo sapiens
gggtttaatccccagtaaaattg

SEQ ID NO: 3444233 - DNA, 14 bp, Homo sapiens
gggttttatatttt

SEQ ID NO: 3444234 - DNA, 22 bp, Homo sapiens
ggtaaaattagatgcatgttga

SEQ ID NO: 3444235 - DNA, 20 bp, Homo sapiens
ggtaatcttgctctgcttga

SEQ ID NO: 3444236 - DNA, 15 bp, Homo sapiens
ggtacaaaaataaat

SEQ ID NO: 3444237 - DNA, 22 bp, Homo sapiens
ggtacaaacccaaaaaagaaca

SEQ ID NO: 3444238 - DNA, 22 bp, Homo sapiens
ggtacagcaacaggaatctcag

SEQ ID NO: 3444239 - DNA, 13 bp, Homo sapiens
ggtacccactgct

SEQ ID NO: 3444240 - DNA, 19 bp, Homo sapiens
ggtacccggggcccagggc

SEQ ID NO: 3444241 - DNA, 16 bp, Homo sapiens
ggtacttacccggaga

SEQ ID NO: 3444242 - DNA, 16 bp, Homo sapiens
ggtacttcttgaaggt

SEQ ID NO: 3444243 - DNA, 20 bp, Homo sapiens
ggtacttgtggacacagctc

SEQ ID NO: 3444244 - DNA, 14 bp, Homo sapiens
ggtagaggctggga

SEQ ID NO: 3444245 - DNA, 19 bp, Homo sapiens
ggtagcaattggcagccct

SEQ ID NO: 3444246 - DNA, 21 bp, Homo sapiens
ggtagccagcacacagggcag

SEQ ID NO: 3444247 - DNA, 15 bp, Homo sapiens
ggtagctagaggaac

SEQ ID NO: 3444248 - DNA, 17 bp, Homo sapiens
ggtagctagaggaacca

SEQ ID NO: 3444249 - DNA, 15 bp, Homo sapiens
ggtagctgcccctgg

SEQ ID NO: 3444250 - DNA, 18 bp, Homo sapiens
ggtaggttcagccaaggt

SEQ ID NO: 3444251 - DNA, 23 bp, Homo sapiens
ggtatagttcatgtctgctatca

SEQ ID NO: 3444252 - DNA, 18 bp, Homo sapiens
ggtatccccccatcttgc

SEQ ID NO: 3444253 - DNA, 22 bp, Homo sapiens
ggtatgatcacggctcactgca

SEQ ID NO: 3444254 - DNA, 14 bp, Homo sapiens
ggtattcctgcctc

SEQ ID NO: 3444255 - DNA, 12 bp, Homo sapiens
ggtcacttggga

SEQ ID NO: 3444256 - DNA, 23 bp, Homo sapiens
ggtcagagatgggctgaactgag

SEQ ID NO: 3444257 - DNA, 12 bp, Homo sapiens
ggtcagagccac

SEQ ID NO: 3444258 - DNA, 13 bp, Homo sapiens
ggtcagagccaca

SEQ ID NO: 3444259 - DNA, 11 bp, Homo sapiens
ggtcagagcct

SEQ ID NO: 3444260 - DNA, 15 bp, Homo sapiens
ggtcagagcctgcag

SEQ ID NO: 3444261 - DNA, 16 bp, Homo sapiens
ggtcagagcctgcagt

SEQ ID NO: 3444262 - DNA, 13 bp, Homo sapiens
ggtcaggcagggt

SEQ ID NO: 3444263 - DNA, 22 bp, Homo sapiens
ggtcataaagaggcgttgcttt

SEQ ID NO: 3444264 - DNA, 22 bp, Homo sapiens
ggtcatcgagatggagctacga

SEQ ID NO: 3444265 - DNA, 16 bp, Homo sapiens
ggtcatgccctcctct

SEQ ID NO: 3444266 - DNA, 17 bp, Homo sapiens
ggtcatgccctcctctc

SEQ ID NO: 3444267 - DNA, 23 bp, Homo sapiens
ggtccacacccaattccactctg

SEQ ID NO: 3444268 - DNA, 12 bp, Homo sapiens
ggtccacccagg

SEQ ID NO: 3444269 - DNA, 19 bp, Homo sapiens
ggtccacccaggagccccg

SEQ ID NO: 3444270 - DNA, 11 bp, Homo sapiens
ggtccaggaga

SEQ ID NO: 3444271 - DNA, 18 bp, Homo sapiens
ggtccaggccctgtggca

SEQ ID NO: 3444272 - DNA, 16 bp, Homo sapiens
ggtccatgggcagagc

SEQ ID NO: 3444273 - DNA, 12 bp, Homo sapiens
ggtcccactcag

SEQ ID NO: 3444274 - DNA, 20 bp, Homo sapiens
ggtccccagctccccaggac

SEQ ID NO: 3444275 - DNA, 16 bp, Homo sapiens
ggtcccggctctgtgg

SEQ ID NO: 3444276 - DNA, 19 bp, Homo sapiens
ggtcccggctctgtgggtg

SEQ ID NO: 3444277 - DNA, 14 bp, Homo sapiens
ggtccctctgtgta

SEQ ID NO: 3444278 - DNA, 20 bp, Homo sapiens
ggtcctacccatccccgcag

SEQ ID NO: 3444279 - DNA, 23 bp, Homo sapiens
ggtcctagaaattccccaccctg

SEQ ID NO: 3444280 - DNA, 13 bp, Homo sapiens
ggtcctctgtcag

SEQ ID NO: 3444281 - DNA, 19 bp, Homo sapiens
ggtcctcttctgggcctga

SEQ ID NO: 3444282 - DNA, 13 bp, Homo sapiens
ggtcctggccatc

SEQ ID NO: 3444283 - DNA, 17 bp, Homo sapiens
ggtcgacttcgggctgg

SEQ ID NO: 3444284 - DNA, 13 bp, Homo sapiens
ggtcgaggcagga

SEQ ID NO: 3444285 - DNA, 12 bp, Homo sapiens
ggtcgctcctgc

SEQ ID NO: 3444286 - DNA, 13 bp, Homo sapiens
ggtcgctcctgcc

SEQ ID NO: 3444287 - DNA, 15 bp, Homo sapiens
ggtcggaacccaagc

SEQ ID NO: 3444288 - DNA, 14 bp, Homo sapiens
ggtctaaagtgttt

SEQ ID NO: 3444289 - DNA, 17 bp, Homo sapiens
ggtctaaagtgtttagc

SEQ ID NO: 3444290 - DNA, 23 bp, Homo sapiens
ggtctcaaactcctgggctcagg

SEQ ID NO: 3444291 - DNA, 21 bp, Homo sapiens
ggtctcactatgttgcccagg

SEQ ID NO: 3444292 - DNA, 22 bp, Homo sapiens
ggtctcactatgttgcccaggc

SEQ ID NO: 3444293 - DNA, 12 bp, Homo sapiens
ggtctcactctg

SEQ ID NO: 3444294 - DNA, 15 bp, Homo sapiens
ggtctccaaactgat

SEQ ID NO: 3444295 - DNA, 19 bp, Homo sapiens
ggtctcctggatgggcctt

SEQ ID NO: 3444296 - DNA, 19 bp, Homo sapiens
ggtctcgctttgttgccca

SEQ ID NO: 3444297 - DNA, 18 bp, Homo sapiens
ggtctctaggctggggaa

SEQ ID NO: 3444298 - DNA, 15 bp, Homo sapiens
ggtctctccactgct

SEQ ID NO: 3444299 - DNA, 16 bp, Homo sapiens
ggtctctccactgctc

SEQ ID NO: 3444300 - DNA, 23 bp, Homo sapiens
ggtctctgcatttttctgcagaa

SEQ ID NO: 3444301 - DNA, 14 bp, Homo sapiens
ggtctctgctgccg

SEQ ID NO: 3444302 - DNA, 15 bp, Homo sapiens
ggtctgacccactgc

SEQ ID NO: 3444303 - DNA, 13 bp, Homo sapiens
ggtctgcaggcag

SEQ ID NO: 3444304 - DNA, 23 bp, Homo sapiens
ggtctgcctcttctgggagggca

SEQ ID NO: 3444305 - DNA, 22 bp, Homo sapiens
ggtctggcagcctcccatccag

SEQ ID NO: 3444306 - DNA, 19 bp, Homo sapiens
ggtctggccgtacttgtga

SEQ ID NO: 3444307 - DNA, 20 bp, Homo sapiens
ggtctgggagtcacacagtg

SEQ ID NO: 3444308 - DNA, 22 bp, Homo sapiens
ggtctgggcggcgggcggctgg

SEQ ID NO: 3444309 - DNA, 18 bp, Homo sapiens
ggtcttcagcctctttct

SEQ ID NO: 3444310 - DNA, 13 bp, Homo sapiens
ggtcttgaagtcc

SEQ ID NO: 3444311 - DNA, 19 bp, Homo sapiens
ggtgaacaaagcagccacg

SEQ ID NO: 3444312 - DNA, 23 bp, Homo sapiens
ggtgaaccatgtcagcaaaaagc

SEQ ID NO: 3444313 - DNA, 14 bp, Homo sapiens
ggtgaaggaatata

SEQ ID NO: 3444314 - DNA, 13 bp, Homo sapiens
ggtgaaggctggc

SEQ ID NO: 3444315 - DNA, 14 bp, Homo sapiens
ggtgacctctgcct

SEQ ID NO: 3444316 - DNA, 12 bp, Homo sapiens
ggtgagaaaaaa

SEQ ID NO: 3444317 - DNA, 15 bp, Homo sapiens
ggtgagaagcagagg

SEQ ID NO: 3444318 - DNA, 22 bp, Homo sapiens
ggtgagcccatggccctcccag

SEQ ID NO: 3444319 - DNA, 13 bp, Homo sapiens
ggtgagggccttc

SEQ ID NO: 3444320 - DNA, 17 bp, Homo sapiens
ggtgaggggctggcact

SEQ ID NO: 3444321 - DNA, 15 bp, Homo sapiens
ggtgataaggacatg

SEQ ID NO: 3444322 - DNA, 23 bp, Homo sapiens
ggtgatccacccacctcagcctc

SEQ ID NO: 3444323 - DNA, 13 bp, Homo sapiens
ggtgatggggagg

SEQ ID NO: 3444324 - DNA, 18 bp, Homo sapiens
ggtgatgtagcccatcct

SEQ ID NO: 3444325 - DNA, 13 bp, Homo sapiens
ggtgcagaggaag

SEQ ID NO: 3444326 - DNA, 13 bp, Homo sapiens
ggtgcagccagag

SEQ ID NO: 3444327 - DNA, 18 bp, Homo sapiens
ggtgccacaaataaaatg

SEQ ID NO: 3444328 - DNA, 18 bp, Homo sapiens
ggtgccatgtctgcagtg

SEQ ID NO: 3444329 - DNA, 21 bp, Homo sapiens
ggtgcccaagccagaggctgg

SEQ ID NO: 3444330 - DNA, 14 bp, Homo sapiens
ggtgcccacaggcc

SEQ ID NO: 3444331 - DNA, 22 bp, Homo sapiens
ggtgcccagctatacctgtgcc

SEQ ID NO: 3444332 - DNA, 15 bp, Homo sapiens
ggtgccccaggacca

SEQ ID NO: 3444333 - DNA, 16 bp, Homo sapiens
ggtgccccaggaccag

SEQ ID NO: 3444334 - DNA, 20 bp, Homo sapiens
ggtgccccaggaccagctca

SEQ ID NO: 3444335 - DNA, 21 bp, Homo sapiens
ggtgccccaggaccagctcag

SEQ ID NO: 3444336 - DNA, 19 bp, Homo sapiens
ggtgccctgttctctacca

SEQ ID NO: 3444337 - DNA, 18 bp, Homo sapiens
ggtgcccttggaggccag

SEQ ID NO: 3444338 - DNA, 18 bp, Homo sapiens
ggtgcctgccatagccag

SEQ ID NO: 3444339 - DNA, 20 bp, Homo sapiens
ggtgcctgccatagccagga

SEQ ID NO: 3444340 - DNA, 22 bp, Homo sapiens
ggtgcctgccatagccaggagc

SEQ ID NO: 3444341 - DNA, 19 bp, Homo sapiens
ggtgcctttcaaatttaga

SEQ ID NO: 3444342 - DNA, 23 bp, Homo sapiens
ggtgctacacccttttccagctg

SEQ ID NO: 3444343 - DNA, 15 bp, Homo sapiens
ggtgctccaggcagg

SEQ ID NO: 3444344 - DNA, 20 bp, Homo sapiens
ggtgctgacggccagggaga

SEQ ID NO: 3444345 - DNA, 13 bp, Homo sapiens
ggtgctgagaagc

SEQ ID NO: 3444346 - DNA, 18 bp, Homo sapiens
ggtgctggagcactgggc

SEQ ID NO: 3444347 - DNA, 23 bp, Homo sapiens
ggtgctgtcctcaggtggccatg

SEQ ID NO: 3444348 - DNA, 20 bp, Homo sapiens
ggtggaaaaactgagacagg

SEQ ID NO: 3444349 - DNA, 15 bp, Homo sapiens
ggtggacatggcccc

SEQ ID NO: 3444350 - DNA, 21 bp, Homo sapiens
ggtggatgcctggtggcagct

SEQ ID NO: 3444351 - DNA, 14 bp, Homo sapiens
ggtggatggcccca

SEQ ID NO: 3444352 - DNA, 22 bp, Homo sapiens
ggtggattctccctgggcctca

SEQ ID NO: 3444353 - DNA, 17 bp, Homo sapiens
ggtggcaaggctgtgct

SEQ ID NO: 3444354 - DNA, 14 bp, Homo sapiens
ggtggcaccagcag

SEQ ID NO: 3444355 - DNA, 20 bp, Homo sapiens
ggtggcaccagcagcctgga

SEQ ID NO: 3444356 - DNA, 13 bp, Homo sapiens
ggtggcactgcca

SEQ ID NO: 3444357 - DNA, 12 bp, Homo sapiens
ggtggcagctgc

SEQ ID NO: 3444358 - DNA, 10 bp, Homo sapiens
ggtggccatg

SEQ ID NO: 3444359 - DNA, 20 bp, Homo sapiens
ggtggccatgcctcagccct

SEQ ID NO: 3444360 - DNA, 22 bp, Homo sapiens
ggtggcccctgctgtctctctg

SEQ ID NO: 3444361 - DNA, 23 bp, Homo sapiens
ggtggcccctgctgtctctctgg

SEQ ID NO: 3444362 - DNA, 23 bp, Homo sapiens
ggtggcctctccttgtggcctgg

SEQ ID NO: 3444363 - DNA, 19 bp, Homo sapiens
ggtggcgggcacctgtaat

SEQ ID NO: 3444364 - DNA, 20 bp, Homo sapiens
ggtggctagtcaagctcctc

SEQ ID NO: 3444365 - DNA, 22 bp, Homo sapiens
ggtggctagtcaagctcctcct

SEQ ID NO: 3444366 - DNA, 19 bp, Homo sapiens
ggtggctcacacctgtaat

SEQ ID NO: 3444367 - DNA, 13 bp, Homo sapiens
ggtggctgggcag

SEQ ID NO: 3444368 - DNA, 12 bp, Homo sapiens
ggtgggaatcag

SEQ ID NO: 3444369 - DNA, 14 bp, Homo sapiens
ggtgggccaggctg

SEQ ID NO: 3444370 - DNA, 18 bp, Homo sapiens
ggtgggtcccggctctgt

SEQ ID NO: 3444371 - DNA, 14 bp, Homo sapiens
ggtggtaaccctgg

SEQ ID NO: 3444372 - DNA, 16 bp, Homo sapiens
ggtggtgacctctgcc

SEQ ID NO: 3444373 - DNA, 16 bp, Homo sapiens
ggtgtatggttctgtg

SEQ ID NO: 3444374 - DNA, 15 bp, Homo sapiens
ggtgtgcacatctct

SEQ ID NO: 3444375 - DNA, 12 bp, Homo sapiens
ggtgtgctggga

SEQ ID NO: 3444376 - DNA, 14 bp, Homo sapiens
ggtgtggagaagcg

SEQ ID NO: 3444377 - DNA, 16 bp, Homo sapiens
ggtgtggagccgaggc

SEQ ID NO: 3444378 - DNA, 19 bp, Homo sapiens
ggtgtgggtgtcctgcctg

SEQ ID NO: 3444379 - DNA, 15 bp, Homo sapiens
ggtgtggtgcagtgt

SEQ ID NO: 3444380 - DNA, 16 bp, Homo sapiens
ggttaatatttaacct

SEQ ID NO: 3444381 - DNA, 14 bp, Homo sapiens
ggttcaacttatta

SEQ ID NO: 3444382 - DNA, 15 bp, Homo sapiens
ggttcaagccttcca

SEQ ID NO: 3444383 - DNA, 12 bp, Homo sapiens
ggttcagcttgt

SEQ ID NO: 3444384 - DNA, 18 bp, Homo sapiens
ggttcagggttggcccct

SEQ ID NO: 3444385 - DNA, 23 bp, Homo sapiens
ggttccgcttggagcagaggggc

SEQ ID NO: 3444386 - DNA, 22 bp, Homo sapiens
ggttcgcgcaccaggtgtcttt

SEQ ID NO: 3444387 - DNA, 23 bp, Homo sapiens
ggttctacagccttgtccccctc

SEQ ID NO: 3444388 - DNA, 12 bp, Homo sapiens
ggttctcatctt

SEQ ID NO: 3444389 - DNA, 19 bp, Homo sapiens
ggttctccgttagctcctg

SEQ ID NO: 3444390 - DNA, 14 bp, Homo sapiens
ggttgaagcaccaa

SEQ ID NO: 3444391 - DNA, 20 bp, Homo sapiens
ggttggaactatgcagtgtg

SEQ ID NO: 3444392 - DNA, 11 bp, Homo sapiens
ggttggagccc

SEQ ID NO: 3444393 - DNA, 11 bp, Homo sapiens
ggttggctggc

SEQ ID NO: 3444394 - DNA, 14 bp, Homo sapiens
ggttgtcagctctc

SEQ ID NO: 3444395 - DNA, 17 bp, Homo sapiens
ggtttaattctgtcttg

SEQ ID NO: 3444396 - DNA, 19 bp, Homo sapiens
ggtttcaccatgttgccca

SEQ ID NO: 3444397 - DNA, 21 bp, Homo sapiens
ggtttctcagaatccaaagat

SEQ ID NO: 3444398 - DNA, 12 bp, Homo sapiens
ggtttgaagctg

SEQ ID NO: 3444399 - DNA, 11 bp, Homo sapiens
ggtttgattgt

SEQ ID NO: 3444400 - DNA, 14 bp, Homo sapiens
ggtttgattgttta

SEQ ID NO: 3444401 - DNA, 21 bp, Homo sapiens
ggtttgccaaaattcatttct

SEQ ID NO: 3444402 - DNA, 23 bp, Homo sapiens
ggtttgtcgggcaccagccagcg

SEQ ID NO: 3444403 - DNA, 17 bp, Homo sapiens
ggttttaggtagaaaaa

SEQ ID NO: 3444404 - DNA, 13 bp, Homo sapiens
ggttttcctgaaa

SEQ ID NO: 3444405 - DNA, 23 bp, Homo sapiens
ggttttgccatgttggccaggct

SEQ ID NO: 3444406 - DNA, 18 bp, Homo sapiens
ggttttgtattctctgag

SEQ ID NO: 3444407 - DNA, 12 bp, Homo sapiens
ggtttttccctg

SEQ ID NO: 3444408 - DNA, 13 bp, Homo sapiens
gtaaaaaattcac

SEQ ID NO: 3444409 - DNA, 18 bp, Homo sapiens
gtaaaaaattcacataat

SEQ ID NO: 3444410 - DNA, 20 bp, Homo sapiens
gtaaaaaattcacataataa

SEQ ID NO: 3444411 - DNA, 12 bp, Homo sapiens
gtaaaaatacaa

SEQ ID NO: 3444412 - DNA, 14 bp, Homo sapiens
gtaaaacaaaattt

SEQ ID NO: 3444413 - DNA, 19 bp, Homo sapiens
gtaaaagaaagaaagaaaa

SEQ ID NO: 3444414 - DNA, 20 bp, Homo sapiens
gtaaaatatagctgtacaaa

SEQ ID NO: 3444415 - DNA, 21 bp, Homo sapiens
gtaaaatatagctgtacaaat

SEQ ID NO: 3444416 - DNA, 14 bp, Homo sapiens
gtaaaatctttctt

SEQ ID NO: 3444417 - DNA, 16 bp, Homo sapiens
gtaaaattgaaaggca

SEQ ID NO: 3444418 - DNA, 14 bp, Homo sapiens
gtaaaattgccata

SEQ ID NO: 3444419 - DNA, 15 bp, Homo sapiens
gtaaaattgccatat

SEQ ID NO: 3444420 - DNA, 19 bp, Homo sapiens
gtaaaattgccatattgca

SEQ ID NO: 3444421 - DNA, 20 bp, Homo sapiens
gtaaaattgccatattgcac

SEQ ID NO: 3444422 - DNA, 19 bp, Homo sapiens
gtaaacaaaccacagcagg

SEQ ID NO: 3444423 - DNA, 22 bp, Homo sapiens
gtaaacccctttagtggcttca

SEQ ID NO: 3444424 - DNA, 12 bp, Homo sapiens
gtaaagccatgc

SEQ ID NO: 3444425 - DNA, 19 bp, Homo sapiens
gtaaagtgaagaatccttt

SEQ ID NO: 3444426 - DNA, 23 bp, Homo sapiens
gtaaagtgataatttctggaatt

SEQ ID NO: 3444427 - DNA, 15 bp, Homo sapiens
gtaaataaagccctg

SEQ ID NO: 3444428 - DNA, 20 bp, Homo sapiens
gtaaatagttactccagtgc

SEQ ID NO: 3444429 - DNA, 16 bp, Homo sapiens
gtaaatatatgaacat

SEQ ID NO: 3444430 - DNA, 16 bp, Homo sapiens
gtaaatatgaatctgc

SEQ ID NO: 3444431 - DNA, 17 bp, Homo sapiens
gtaaatcacatccttat

SEQ ID NO: 3444432 - DNA, 21 bp, Homo sapiens
gtaaatgtttgttaaaaataa

SEQ ID NO: 3444433 - DNA, 14 bp, Homo sapiens
gtaaattatatttg

SEQ ID NO: 3444434 - DNA, 15 bp, Homo sapiens
gtaaattatatttgt

SEQ ID NO: 3444435 - DNA, 18 bp, Homo sapiens
gtaacactgcaagaagtc

SEQ ID NO: 3444436 - DNA, 12 bp, Homo sapiens
gtaacaggcaga

SEQ ID NO: 3444437 - DNA, 21 bp, Homo sapiens
gtaaccctggtggttgctgtt

SEQ ID NO: 3444438 - DNA, 18 bp, Homo sapiens
gtaacctcttcagaggcc

SEQ ID NO: 3444439 - DNA, 14 bp, Homo sapiens
gtaacgtgcactgt

SEQ ID NO: 3444440 - DNA, 19 bp, Homo sapiens
gtaactgcattgagaactg

SEQ ID NO: 3444441 - DNA, 14 bp, Homo sapiens
gtaactgtgtcatg

SEQ ID NO: 3444442 - DNA, 18 bp, Homo sapiens
gtaacttcttatggaatt

SEQ ID NO: 3444443 - DNA, 17 bp, Homo sapiens
gtaactttttacattac

SEQ ID NO: 3444444 - DNA, 13 bp, Homo sapiens
gtaagaaaatatt

SEQ ID NO: 3444445 - DNA, 16 bp, Homo sapiens
gtaagaccttggtagg

SEQ ID NO: 3444446 - DNA, 23 bp, Homo sapiens
gtaaggtgtcttaatactgtcct

SEQ ID NO: 3444447 - DNA, 14 bp, Homo sapiens
gtaataaactattt

SEQ ID NO: 3444448 - DNA, 11 bp, Homo sapiens
gtaataacatt

SEQ ID NO: 3444449 - DNA, 13 bp, Homo sapiens
gtaataacattta

SEQ ID NO: 3444450 - DNA, 15 bp, Homo sapiens
gtaatcatttgttta

SEQ ID NO: 3444451 - DNA, 14 bp, Homo sapiens
gtaatcccagcact

SEQ ID NO: 3444452 - DNA, 15 bp, Homo sapiens
gtaatcccagctact

SEQ ID NO: 3444453 - DNA, 16 bp, Homo sapiens
gtaatctgatggcttc

SEQ ID NO: 3444454 - DNA, 15 bp, Homo sapiens
gtaattgaacttatc

SEQ ID NO: 3444455 - DNA, 15 bp, Homo sapiens
gtaattgacatgtgc

SEQ ID NO: 3444456 - DNA, 23 bp, Homo sapiens
gtaattgtactaaagccaaacat

SEQ ID NO: 3444457 - DNA, 12 bp, Homo sapiens
gtacaaaaataa

SEQ ID NO: 3444458 - DNA, 20 bp, Homo sapiens
gtacaaatataagaataaaa

SEQ ID NO: 3444459 - DNA, 22 bp, Homo sapiens
gtacaaatataagaataaaatg

SEQ ID NO: 3444460 - DNA, 11 bp, Homo sapiens
gtacaataaaa

SEQ ID NO: 3444461 - DNA, 18 bp, Homo sapiens
gtacaatggcccgacatt

SEQ ID NO: 3444462 - DNA, 22 bp, Homo sapiens
gtacaatggcccgacatttctt

SEQ ID NO: 3444463 - DNA, 15 bp, Homo sapiens
gtacacagagaaggc

SEQ ID NO: 3444464 - DNA, 14 bp, Homo sapiens
gtacagaatatttc

SEQ ID NO: 3444465 - DNA, 17 bp, Homo sapiens
gtacagacatatttaac

SEQ ID NO: 3444466 - DNA, 13 bp, Homo sapiens
gtacaggctggcg

SEQ ID NO: 3444467 - DNA, 20 bp, Homo sapiens
gtacagtggtgccatcattg

SEQ ID NO: 3444468 - DNA, 23 bp, Homo sapiens
gtacataaataagaaaaaccaaa

SEQ ID NO: 3444469 - DNA, 18 bp, Homo sapiens
gtacatatgtaaaataaa

SEQ ID NO: 3444470 - DNA, 14 bp, Homo sapiens
gtacatctggcctt

SEQ ID NO: 3444471 - DNA, 11 bp, Homo sapiens
gtacatgaaat

SEQ ID NO: 3444472 - DNA, 18 bp, Homo sapiens
gtacatgttcgggtgtgg

SEQ ID NO: 3444473 - DNA, 18 bp, Homo sapiens
gtacatttcaccatggcc

SEQ ID NO: 3444474 - DNA, 21 bp, Homo sapiens
gtaccagtgaatttttgcaat

SEQ ID NO: 3444475 - DNA, 23 bp, Homo sapiens
gtaccatctgtcttgccagccag

SEQ ID NO: 3444476 - DNA, 20 bp, Homo sapiens
gtaccatgaaacaaagctgc

SEQ ID NO: 3444477 - DNA, 18 bp, Homo sapiens
gtacccggggcccagggc

SEQ ID NO: 3444478 - DNA, 16 bp, Homo sapiens
gtacctatggctgcct

SEQ ID NO: 3444479 - DNA, 16 bp, Homo sapiens
gtacctcctctcagtg

SEQ ID NO: 3444480 - DNA, 19 bp, Homo sapiens
gtacctcctctcagtgttt

SEQ ID NO: 3444481 - DNA, 18 bp, Homo sapiens
gtaccttgacctttgtac

SEQ ID NO: 3444482 - DNA, 19 bp, Homo sapiens
gtaccttgacctttgtaca

SEQ ID NO: 3444483 - DNA, 14 bp, Homo sapiens
gtacgtctgacagg

SEQ ID NO: 3444484 - DNA, 13 bp, Homo sapiens
gtacgtgaccctc

SEQ ID NO: 3444485 - DNA, 15 bp, Homo sapiens
gtactcaaatgtagc

SEQ ID NO: 3444486 - DNA, 16 bp, Homo sapiens
gtactgtgggcaattt

SEQ ID NO: 3444487 - DNA, 21 bp, Homo sapiens
gtactgtgggcaatttagaaa

SEQ ID NO: 3444488 - DNA, 19 bp, Homo sapiens
gtactgtttaatgttctgt

SEQ ID NO: 3444489 - DNA, 13 bp, Homo sapiens
gtacttcccgggc

SEQ ID NO: 3444490 - DNA, 21 bp, Homo sapiens
gtacttcccgggccagggctg

SEQ ID NO: 3444491 - DNA, 14 bp, Homo sapiens
gtacttctccaccc

SEQ ID NO: 3444492 - DNA, 15 bp, Homo sapiens
gtacttctccaccct

SEQ ID NO: 3444493 - DNA, 16 bp, Homo sapiens
gtacttctccaccctg

SEQ ID NO: 3444494 - DNA, 17 bp, Homo sapiens
gtacttctccaccctgc

SEQ ID NO: 3444495 - DNA, 17 bp, Homo sapiens
gtacttgtcatatgtag

SEQ ID NO: 3444496 - DNA, 16 bp, Homo sapiens
gtacttgtttctctgt

SEQ ID NO: 3444497 - DNA, 10 bp, Homo sapiens
gtactttgtg

SEQ ID NO: 3444498 - DNA, 18 bp, Homo sapiens
gtacttttcattctcttt

SEQ ID NO: 3444499 - DNA, 21 bp, Homo sapiens
gtacttttcattctcttttaa

SEQ ID NO: 3444500 - DNA, 19 bp, Homo sapiens
gtagaaactgcagggaaaa

SEQ ID NO: 3444501 - DNA, 14 bp, Homo sapiens
gtagaaaggccttt

SEQ ID NO: 3444502 - DNA, 16 bp, Homo sapiens
gtagaaaggcctttaa

SEQ ID NO: 3444503 - DNA, 17 bp, Homo sapiens
gtagaaaggcctttaaa

SEQ ID NO: 3444504 - DNA, 17 bp, Homo sapiens
gtagaaatggttgtatt

SEQ ID NO: 3444505 - DNA, 22 bp, Homo sapiens
gtagacaagcaattagacaaga

SEQ ID NO: 3444506 - DNA, 13 bp, Homo sapiens
gtagacagttttg

SEQ ID NO: 3444507 - DNA, 21 bp, Homo sapiens
gtagaccttgttacttctgag

SEQ ID NO: 3444508 - DNA, 22 bp, Homo sapiens
gtagaccttgttacttctgagg

SEQ ID NO: 3444509 - DNA, 18 bp, Homo sapiens
gtagagccagggtctcac

SEQ ID NO: 3444510 - DNA, 15 bp, Homo sapiens
gtagagtgggagctg

SEQ ID NO: 3444511 - DNA, 21 bp, Homo sapiens
gtagatgggagggaggctcag

SEQ ID NO: 3444512 - DNA, 21 bp, Homo sapiens
gtagcactactaaaagtttag

SEQ ID NO: 3444513 - DNA, 20 bp, Homo sapiens
gtagcaggccatggctcatg

SEQ ID NO: 3444514 - DNA, 23 bp, Homo sapiens
gtagcagggggggaaatgcattt

SEQ ID NO: 3444515 - DNA, 11 bp, Homo sapiens
gtagcagtgta

SEQ ID NO: 3444516 - DNA, 18 bp, Homo sapiens
gtagccccctggcctctg

SEQ ID NO: 3444517 - DNA, 16 bp, Homo sapiens
gtagctgcccctggct

SEQ ID NO: 3444518 - DNA, 21 bp, Homo sapiens
gtagctgggactacaggcacc

SEQ ID NO: 3444519 - DNA, 19 bp, Homo sapiens
gtaggaaccaacaaggaaa

SEQ ID NO: 3444520 - DNA, 18 bp, Homo sapiens
gtaggaacggtaaatttc

SEQ ID NO: 3444521 - DNA, 21 bp, Homo sapiens
gtaggaacggtaaatttctgt

SEQ ID NO: 3444522 - DNA, 18 bp, Homo sapiens
gtaggagcccagctctga

SEQ ID NO: 3444523 - DNA, 23 bp, Homo sapiens
gtaggagctgccttggctcagac

SEQ ID NO: 3444524 - DNA, 20 bp, Homo sapiens
gtaggatattttgtcaccag

SEQ ID NO: 3444525 - DNA, 17 bp, Homo sapiens
gtaggatctaaggctgt

SEQ ID NO: 3444526 - DNA, 16 bp, Homo sapiens
gtagggaggaccacag

SEQ ID NO: 3444527 - DNA, 17 bp, Homo sapiens
gtaggttcagccaaggt

SEQ ID NO: 3444528 - DNA, 16 bp, Homo sapiens
gtagtaggcattttta

SEQ ID NO: 3444529 - DNA, 13 bp, Homo sapiens
gtagtatggcact

SEQ ID NO: 3444530 - DNA, 23 bp, Homo sapiens
gtagtccgtgctgacagctgctc

SEQ ID NO: 3444531 - DNA, 16 bp, Homo sapiens
gtagtcttgatgacca

SEQ ID NO: 3444532 - DNA, 19 bp, Homo sapiens
gtagtgtaagctagaagaa

SEQ ID NO: 3444533 - DNA, 18 bp, Homo sapiens
gtagttaggcctggctca

SEQ ID NO: 3444534 - DNA, 22 bp, Homo sapiens
gtagttaggcctggctcattct

SEQ ID NO: 3444535 - DNA, 18 bp, Homo sapiens
gtagttgcaatagaacag

SEQ ID NO: 3444536 - DNA, 11 bp, Homo sapiens
gtataaaagat

SEQ ID NO: 3444537 - DNA, 11 bp, Homo sapiens
gtataaaatgt

SEQ ID NO: 3444538 - DNA, 16 bp, Homo sapiens
gtataagtaagaaaat

SEQ ID NO: 3444539 - DNA, 22 bp, Homo sapiens
gtataagttatttttgtacatg

SEQ ID NO: 3444540 - DNA, 23 bp, Homo sapiens
gtatactagggagccatttgaga

SEQ ID NO: 3444541 - DNA, 13 bp, Homo sapiens
gtatacttcctta

SEQ ID NO: 3444542 - DNA, 13 bp, Homo sapiens
gtatattgtgttt

SEQ ID NO: 3444543 - DNA, 17 bp, Homo sapiens
gtatcaggacgagaatg

SEQ ID NO: 3444544 - DNA, 22 bp, Homo sapiens
gtatcaggtgctgccatccagg

SEQ ID NO: 3444545 - DNA, 17 bp, Homo sapiens
gtatcatgccctgtgca

SEQ ID NO: 3444546 - DNA, 18 bp, Homo sapiens
gtatcatgccctgtgcaa

SEQ ID NO: 3444547 - DNA, 17 bp, Homo sapiens
gtatccccccatcttgc

SEQ ID NO: 3444548 - DNA, 18 bp, Homo sapiens
gtatccccccatcttgct

SEQ ID NO: 3444549 - DNA, 15 bp, Homo sapiens
gtatcgatgttatgt

SEQ ID NO: 3444550 - DNA, 16 bp, Homo sapiens
gtatctccggctccca

SEQ ID NO: 3444551 - DNA, 22 bp, Homo sapiens
gtatctccggctcccagcctca

SEQ ID NO: 3444552 - DNA, 15 bp, Homo sapiens
gtatctcctcgcaag

SEQ ID NO: 3444553 - DNA, 12 bp, Homo sapiens
gtatgaatttga

SEQ ID NO: 3444554 - DNA, 14 bp, Homo sapiens
gtatgaatttgagc

SEQ ID NO: 3444555 - DNA, 22 bp, Homo sapiens
gtatgatcacggctcactgcag

SEQ ID NO: 3444556 - DNA, 23 bp, Homo sapiens
gtatgatgctgccggcacagctg

SEQ ID NO: 3444557 - DNA, 13 bp, Homo sapiens
gtatgctgatcat

SEQ ID NO: 3444558 - DNA, 21 bp, Homo sapiens
gtatgctgtggagtcccaacc

SEQ ID NO: 3444559 - DNA, 18 bp, Homo sapiens
gtatggagctcagagagg

SEQ ID NO: 3444560 - DNA, 11 bp, Homo sapiens
gtatgtaaatg

SEQ ID NO: 3444561 - DNA, 14 bp, Homo sapiens
gtatgtaaatgtgc

SEQ ID NO: 3444562 - DNA, 13 bp, Homo sapiens
gtatgtctgccat

SEQ ID NO: 3444563 - DNA, 15 bp, Homo sapiens
gtatgtgtgtgtgta

SEQ ID NO: 3444564 - DNA, 13 bp, Homo sapiens
gtatgttatagaa

SEQ ID NO: 3444565 - DNA, 15 bp, Homo sapiens
gtattaaaaaaaaca

SEQ ID NO: 3444566 - DNA, 18 bp, Homo sapiens
gtattaattttgatataa

SEQ ID NO: 3444567 - DNA, 15 bp, Homo sapiens
gtattaccatgtaaa

SEQ ID NO: 3444568 - DNA, 20 bp, Homo sapiens
gtattaccatgtaaataatc

SEQ ID NO: 3444569 - DNA, 22 bp, Homo sapiens
gtattaccatgtaaataatctg

SEQ ID NO: 3444570 - DNA, 12 bp, Homo sapiens
gtattagatgtt

SEQ ID NO: 3444571 - DNA, 14 bp, Homo sapiens
gtattagatgttct

SEQ ID NO: 3444572 - DNA, 17 bp, Homo sapiens
gtattagatgttctcta

SEQ ID NO: 3444573 - DNA, 18 bp, Homo sapiens
gtattagatgttctctat

SEQ ID NO: 3444574 - DNA, 21 bp, Homo sapiens
gtattagatgttctctatcat

SEQ ID NO: 3444575 - DNA, 16 bp, Homo sapiens
gtattagttgccaata

SEQ ID NO: 3444576 - DNA, 19 bp, Homo sapiens
gtattatcattgctcccct

SEQ ID NO: 3444577 - DNA, 18 bp, Homo sapiens
gtattcaatatcctttgc

SEQ ID NO: 3444578 - DNA, 16 bp, Homo sapiens
gtattcatatattgca

SEQ ID NO: 3444579 - DNA, 21 bp, Homo sapiens
gtattgtaaaaaattcacata

SEQ ID NO: 3444580 - DNA, 9 bp, Homo sapiens
gtatttaac

SEQ ID NO: 3444581 - DNA, 16 bp, Homo sapiens
gtatttaacaaaaagt

SEQ ID NO: 3444582 - DNA, 20 bp, Homo sapiens
gtatttaacaaaaagtgctt

SEQ ID NO: 3444583 - DNA, 12 bp, Homo sapiens
gtatttaattag

SEQ ID NO: 3444584 - DNA, 21 bp, Homo sapiens
gtatttaattagtgctaagtg

SEQ ID NO: 3444585 - DNA, 17 bp, Homo sapiens
gtatttacgctttgatt

SEQ ID NO: 3444586 - DNA, 16 bp, Homo sapiens
gtatttattcaataaa

SEQ ID NO: 3444587 - DNA, 19 bp, Homo sapiens
gtatttattcaataaagta

SEQ ID NO: 3444588 - DNA, 22 bp, Homo sapiens
gtatttcttatacgcttttctt

SEQ ID NO: 3444589 - DNA, 21 bp, Homo sapiens
gtattttagtaagagattcct

SEQ ID NO: 3444590 - DNA, 13 bp, Homo sapiens
gtattttgaaaat

SEQ ID NO: 3444591 - DNA, 19 bp, Homo sapiens
gtatttttaaaaaatatgt

SEQ ID NO: 3444592 - DNA, 15 bp, Homo sapiens
gtattttttgtttgt

SEQ ID NO: 3444593 - DNA, 16 bp, Homo sapiens
gtattttttgtttgta

SEQ ID NO: 3444594 - DNA, 22 bp, Homo sapiens
gtattttttgtttgtattgtaa

SEQ ID NO: 3444595 - DNA, 20 bp, Homo sapiens
gtcaaaaagtttggttctgt

SEQ ID NO: 3444596 - DNA, 22 bp, Homo sapiens
gtcaaatggtaggcatttccta

SEQ ID NO: 3444597 - DNA, 22 bp, Homo sapiens
gtcaacagttttcctatgcttt

SEQ ID NO: 3444598 - DNA, 12 bp, Homo sapiens
gtcaacattgtg

SEQ ID NO: 3444599 - DNA, 12 bp, Homo sapiens
gtcaagaagaaa

SEQ ID NO: 3444600 - DNA, 18 bp, Homo sapiens
gtcaagagggtctgagga

SEQ ID NO: 3444601 - DNA, 19 bp, Homo sapiens
gtcaagctgctctgagcca

SEQ ID NO: 3444602 - DNA, 20 bp, Homo sapiens
gtcaagctgctctgagccac

SEQ ID NO: 3444603 - DNA, 19 bp, Homo sapiens
gtcaagtcccccagcagaa

SEQ ID NO: 3444604 - DNA, 23 bp, Homo sapiens
gtcaagtcccccagcagaaccag

SEQ ID NO: 3444605 - DNA, 21 bp, Homo sapiens
gtcaagtctctgctggcccag

SEQ ID NO: 3444606 - DNA, 19 bp, Homo sapiens
gtcaagtgaaaaaggagga

SEQ ID NO: 3444607 - DNA, 19 bp, Homo sapiens
gtcaatacagtacaggcag

SEQ ID NO: 3444608 - DNA, 18 bp, Homo sapiens
gtcaatcaagtctgttta

SEQ ID NO: 3444609 - DNA, 22 bp, Homo sapiens
gtcaatccagatggtgggatgt

SEQ ID NO: 3444610 - DNA, 22 bp, Homo sapiens
gtcaatttctgtgttgccaagc

SEQ ID NO: 3444611 - DNA, 22 bp, Homo sapiens
gtcacacagtattacttctgct

SEQ ID NO: 3444612 - DNA, 19 bp, Homo sapiens
gtcacacagtgttggaggt

SEQ ID NO: 3444613 - DNA, 12 bp, Homo sapiens
gtcacaggcagg

SEQ ID NO: 3444614 - DNA, 13 bp, Homo sapiens
gtcacaggcaggt

SEQ ID NO: 3444615 - DNA, 12 bp, Homo sapiens
gtcaccaagccc

SEQ ID NO: 3444616 - DNA, 13 bp, Homo sapiens
gtcaccaaggaaa

SEQ ID NO: 3444617 - DNA, 17 bp, Homo sapiens
gtcaccacgactggcca

SEQ ID NO: 3444618 - DNA, 21 bp, Homo sapiens
gtcaccacgactggccagggc

SEQ ID NO: 3444619 - DNA, 23 bp, Homo sapiens
gtcaccatcttaagagatgcctc

SEQ ID NO: 3444620 - DNA, 17 bp, Homo sapiens
gtcaccattctgcattt

SEQ ID NO: 3444621 - DNA, 20 bp, Homo sapiens
gtcaccctagccctctccct

SEQ ID NO: 3444622 - DNA, 22 bp, Homo sapiens
gtcaccctagccctctccctct

SEQ ID NO: 3444623 - DNA, 16 bp, Homo sapiens
gtcaccggatcctggg

SEQ ID NO: 3444624 - DNA, 17 bp, Homo sapiens
gtcaccggatcctgggt

SEQ ID NO: 3444625 - DNA, 19 bp, Homo sapiens
gtcaccggatcctgggtgg

SEQ ID NO: 3444626 - DNA, 20 bp, Homo sapiens
gtcacctgaagactcattct

SEQ ID NO: 3444627 - DNA, 22 bp, Homo sapiens
gtcacgtggaggagcagtgcag

SEQ ID NO: 3444628 - DNA, 23 bp, Homo sapiens
gtcactcagatggaaccgcagga

SEQ ID NO: 3444629 - DNA, 14 bp, Homo sapiens
gtcactcattgctg

SEQ ID NO: 3444630 - DNA, 20 bp, Homo sapiens
gtcactcattgctgagcctc

SEQ ID NO: 3444631 - DNA, 21 bp, Homo sapiens
gtcactcattgctgagcctct

SEQ ID NO: 3444632 - DNA, 24 bp, Homo sapiens
gtcactcattgctgagcctctgct

SEQ ID NO: 3444633 - DNA, 15 bp, Homo sapiens
gtcagaaacaggacc

SEQ ID NO: 3444634 - DNA, 13 bp, Homo sapiens
gtcagagccacag

SEQ ID NO: 3444635 - DNA, 16 bp, Homo sapiens
gtcagagccacagggt

SEQ ID NO: 3444636 - DNA, 14 bp, Homo sapiens
gtcagagcctgcag

SEQ ID NO: 3444637 - DNA, 21 bp, Homo sapiens
gtcagatttccagtctccacc

SEQ ID NO: 3444638 - DNA, 15 bp, Homo sapiens
gtcagcaaaaagcaa

SEQ ID NO: 3444639 - DNA, 13 bp, Homo sapiens
gtcagccattgca

SEQ ID NO: 3444640 - DNA, 13 bp, Homo sapiens
gtcagctctctgc

SEQ ID NO: 3444641 - DNA, 14 bp, Homo sapiens
gtcagctctctgcc

SEQ ID NO: 3444642 - DNA, 16 bp, Homo sapiens
gtcagctctctgccct

SEQ ID NO: 3444643 - DNA, 18 bp, Homo sapiens
gtcagctctctgccctgt

SEQ ID NO: 3444644 - DNA, 17 bp, Homo sapiens
gtcaggaaacccagtcg

SEQ ID NO: 3444645 - DNA, 13 bp, Homo sapiens
gtcaggagttcct

SEQ ID NO: 3444646 - DNA, 18 bp, Homo sapiens
gtcaggtggggcagcttg

SEQ ID NO: 3444647 - DNA, 22 bp, Homo sapiens
gtcaggtggggcagcttgaggg

SEQ ID NO: 3444648 - DNA, 13 bp, Homo sapiens
gtcaggtttgagt

SEQ ID NO: 3444649 - DNA, 16 bp, Homo sapiens
gtcagtaccttcaaac

SEQ ID NO: 3444650 - DNA, 23 bp, Homo sapiens
gtcagtgctgtgctgtgctatgg

SEQ ID NO: 3444651 - DNA, 16 bp, Homo sapiens
gtcataccaatgaaaa

SEQ ID NO: 3444652 - DNA, 20 bp, Homo sapiens
gtcatactatctactctcct

SEQ ID NO: 3444653 - DNA, 12 bp, Homo sapiens
gtcatagaaatt

SEQ ID NO: 3444654 - DNA, 23 bp, Homo sapiens
gtcatctagcgcaattgaaggat

SEQ ID NO: 3444655 - DNA, 19 bp, Homo sapiens
gtcatctgattggacaggc

SEQ ID NO: 3444656 - DNA, 22 bp, Homo sapiens
gtcatcttgaccaagcaggaag

SEQ ID NO: 3444657 - DNA, 17 bp, Homo sapiens
gtcatgcaaaggctggg

SEQ ID NO: 3444658 - DNA, 18 bp, Homo sapiens
gtcatgcaaaggctggga

SEQ ID NO: 3444659 - DNA, 15 bp, Homo sapiens
gtcatgtgcctctgt

SEQ ID NO: 3444660 - DNA, 13 bp, Homo sapiens
gtcattagcctga

SEQ ID NO: 3444661 - DNA, 15 bp, Homo sapiens
gtcattctttattct

SEQ ID NO: 3444662 - DNA, 22 bp, Homo sapiens
gtcatttgagcagggctcagcg

SEQ ID NO: 3444663 - DNA, 22 bp, Homo sapiens
gtcatttgctgtgaactgaaat

SEQ ID NO: 3444664 - DNA, 16 bp, Homo sapiens
gtcatttgttaaaata

SEQ ID NO: 3444665 - DNA, 17 bp, Homo sapiens
gtccaaagcagggtctg

SEQ ID NO: 3444666 - DNA, 17 bp, Homo sapiens
gtccaaatctccaagtg

SEQ ID NO: 3444667 - DNA, 17 bp, Homo sapiens
gtccaatcctatgtttt

SEQ ID NO: 3444668 - DNA, 12 bp, Homo sapiens
gtccaatgtggc

SEQ ID NO: 3444669 - DNA, 16 bp, Homo sapiens
gtccaattttaattta

SEQ ID NO: 3444670 - DNA, 12 bp, Homo sapiens
gtccacccagga

SEQ ID NO: 3444671 - DNA, 19 bp, Homo sapiens
gtccagaaggagacaggca

SEQ ID NO: 3444672 - DNA, 20 bp, Homo sapiens
gtccagaaggagacaggcag

SEQ ID NO: 3444673 - DNA, 17 bp, Homo sapiens
gtccagagctggccagg

SEQ ID NO: 3444674 - DNA, 21 bp, Homo sapiens
gtccagatcttgcctccagag

SEQ ID NO: 3444675 - DNA, 18 bp, Homo sapiens
gtccagcattgctggact

SEQ ID NO: 3444676 - DNA, 19 bp, Homo sapiens
gtccagcattgctggactc

SEQ ID NO: 3444677 - DNA, 14 bp, Homo sapiens
gtccagctccaacc

SEQ ID NO: 3444678 - DNA, 18 bp, Homo sapiens
gtccagctcccgctgtgg

SEQ ID NO: 3444679 - DNA, 12 bp, Homo sapiens
gtccagctctgg

SEQ ID NO: 3444680 - DNA, 13 bp, Homo sapiens
gtccaggctgccg

SEQ ID NO: 3444681 - DNA, 21 bp, Homo sapiens
gtccagggagcattttcctcc

SEQ ID NO: 3444682 - DNA, 16 bp, Homo sapiens
gtccatgggcagagcc

SEQ ID NO: 3444683 - DNA, 16 bp, Homo sapiens
gtccattgtccaatcc

SEQ ID NO: 3444684 - DNA, 22 bp, Homo sapiens
gtcccaaggtgaaatgaagcaa

SEQ ID NO: 3444685 - DNA, 18 bp, Homo sapiens
gtcccaccttggctgcag

SEQ ID NO: 3444686 - DNA, 21 bp, Homo sapiens
gtcccagattggctcacactg

SEQ ID NO: 3444687 - DNA, 22 bp, Homo sapiens
gtcccagattggctcacactga

SEQ ID NO: 3444688 - DNA, 12 bp, Homo sapiens
gtcccagtgccg

SEQ ID NO: 3444689 - DNA, 16 bp, Homo sapiens
gtcccataggcccagt

SEQ ID NO: 3444690 - DNA, 18 bp, Homo sapiens
gtcccataggcccagtga

SEQ ID NO: 3444691 - DNA, 18 bp, Homo sapiens
gtcccatagtccctgcca

SEQ ID NO: 3444692 - DNA, 18 bp, Homo sapiens
gtccccagagaccaggct

SEQ ID NO: 3444693 - DNA, 15 bp, Homo sapiens
gtcccccagcagaac

SEQ ID NO: 3444694 - DNA, 13 bp, Homo sapiens
gtccccccaccct

SEQ ID NO: 3444695 - DNA, 13 bp, Homo sapiens
gtccccctctgtc

SEQ ID NO: 3444696 - DNA, 19 bp, Homo sapiens
gtccccctctgtccaggca

SEQ ID NO: 3444697 - DNA, 11 bp, Homo sapiens
gtccccttctc

SEQ ID NO: 3444698 - DNA, 12 bp, Homo sapiens
gtccccttctct

SEQ ID NO: 3444699 - DNA, 14 bp, Homo sapiens
gtccccttctctca

SEQ ID NO: 3444700 - DNA, 17 bp, Homo sapiens
gtccccttctctcatct

SEQ ID NO: 3444701 - DNA, 14 bp, Homo sapiens
gtcccggctctgtg

SEQ ID NO: 3444702 - DNA, 11 bp, Homo sapiens
gtccctctgcc

SEQ ID NO: 3444703 - DNA, 20 bp, Homo sapiens
gtccctctgccccatcctcc

SEQ ID NO: 3444704 - DNA, 14 bp, Homo sapiens
gtccctctgtgtat

SEQ ID NO: 3444705 - DNA, 22 bp, Homo sapiens
gtccctgaggatgggtcagagc

SEQ ID NO: 3444706 - DNA, 16 bp, Homo sapiens
gtccctgcacttgcag

SEQ ID NO: 3444707 - DNA, 19 bp, Homo sapiens
gtccctgcacttgcagact

SEQ ID NO: 3444708 - DNA, 21 bp, Homo sapiens
gtccctgcacttgcagactct

SEQ ID NO: 3444709 - DNA, 22 bp, Homo sapiens
gtccctggggctagggggagcc

SEQ ID NO: 3444710 - DNA, 22 bp, Homo sapiens
gtccgaaagggacttggaagct

SEQ ID NO: 3444711 - DNA, 13 bp, Homo sapiens
gtccgagctttga

SEQ ID NO: 3444712 - DNA, 21 bp, Homo sapiens
gtccggaggatattaaaatgc

SEQ ID NO: 3444713 - DNA, 21 bp, Homo sapiens
gtccggtccctgtcccagtgc

SEQ ID NO: 3444714 - DNA, 22 bp, Homo sapiens
gtccgtgctgacagctgctcct

SEQ ID NO: 3444715 - DNA, 19 bp, Homo sapiens
gtcctaattcttctgtcct

SEQ ID NO: 3444716 - DNA, 14 bp, Homo sapiens
gtcctacccatccc

SEQ ID NO: 3444717 - DNA, 13 bp, Homo sapiens
gtcctactctgtg

SEQ ID NO: 3444718 - DNA, 15 bp, Homo sapiens
gtcctactctgtgtc

SEQ ID NO: 3444719 - DNA, 23 bp, Homo sapiens
gtcctagaaattccccaccctga

SEQ ID NO: 3444720 - DNA, 19 bp, Homo sapiens
gtcctagaggccctttgct

SEQ ID NO: 3444721 - DNA, 20 bp, Homo sapiens
gtcctagaggccctttgctg

SEQ ID NO: 3444722 - DNA, 18 bp, Homo sapiens
gtcctaggcccctgccct

SEQ ID NO: 3444723 - DNA, 16 bp, Homo sapiens
gtcctatgaatgcttt

SEQ ID NO: 3444724 - DNA, 21 bp, Homo sapiens
gtcctcagccttgccagagat

SEQ ID NO: 3444725 - DNA, 14 bp, Homo sapiens
gtcctcaggtggcc

SEQ ID NO: 3444726 - DNA, 17 bp, Homo sapiens
gtcctcaggtggccatg

SEQ ID NO: 3444727 - DNA, 17 bp, Homo sapiens
gtcctcatttctccaga

SEQ ID NO: 3444728 - DNA, 20 bp, Homo sapiens
gtcctccctcaccccctcct

SEQ ID NO: 3444729 - DNA, 13 bp, Homo sapiens
gtcctctctctgt

SEQ ID NO: 3444730 - DNA, 18 bp, Homo sapiens
gtcctctctctgtggggc

SEQ ID NO: 3444731 - DNA, 19 bp, Homo sapiens
gtcctcttccctctctgca

SEQ ID NO: 3444732 - DNA, 16 bp, Homo sapiens
gtcctgccaccaccct

SEQ ID NO: 3444733 - DNA, 22 bp, Homo sapiens
gtcctgccaccaccctgtcttc

SEQ ID NO: 3444734 - DNA, 14 bp, Homo sapiens
gtcctgcctgtggc

SEQ ID NO: 3444735 - DNA, 18 bp, Homo sapiens
gtcctggccatcccacaa

SEQ ID NO: 3444736 - DNA, 16 bp, Homo sapiens
gtcctgggagtgagct

SEQ ID NO: 3444737 - DNA, 14 bp, Homo sapiens
gtcctgggcctgca

SEQ ID NO: 3444738 - DNA, 18 bp, Homo sapiens
gtcctgtatgtctgtcat

SEQ ID NO: 3444739 - DNA, 23 bp, Homo sapiens
gtcctgttaacgtcatctcaggg

SEQ ID NO: 3444740 - DNA, 15 bp, Homo sapiens
gtccttaatgaagag

SEQ ID NO: 3444741 - DNA, 17 bp, Homo sapiens
gtccttagaacatttta

SEQ ID NO: 3444742 - DNA, 14 bp, Homo sapiens
gtccttccacctcg

SEQ ID NO: 3444743 - DNA, 15 bp, Homo sapiens
gtccttcctgaaact

SEQ ID NO: 3444744 - DNA, 12 bp, Homo sapiens
gtccttttgtaa

SEQ ID NO: 3444745 - DNA, 13 bp, Homo sapiens
gtccttttgtaaa

SEQ ID NO: 3444746 - DNA, 21 bp, Homo sapiens
gtcgaatgggtaaaggagcat

SEQ ID NO: 3444747 - DNA, 17 bp, Homo sapiens
gtcgaccccaaaggaac

SEQ ID NO: 3444748 - DNA, 14 bp, Homo sapiens
gtcgaggacaggga

SEQ ID NO: 3444749 - DNA, 15 bp, Homo sapiens
gtcgccctcccaggc

SEQ ID NO: 3444750 - DNA, 16 bp, Homo sapiens
gtcgctcatgtgtgca

SEQ ID NO: 3444751 - DNA, 11 bp, Homo sapiens
gtcgctcctgc

SEQ ID NO: 3444752 - DNA, 17 bp, Homo sapiens
gtcgtggggtgtgctgg

SEQ ID NO: 3444753 - DNA, 19 bp, Homo sapiens
gtcgtggggtgtgctggga

SEQ ID NO: 3444754 - DNA, 21 bp, Homo sapiens
gtctaaagtgtttagctgtca

SEQ ID NO: 3444755 - DNA, 14 bp, Homo sapiens
gtctaacttttgtg

SEQ ID NO: 3444756 - DNA, 21 bp, Homo sapiens
gtctaatctagatatcgactt

SEQ ID NO: 3444757 - DNA, 15 bp, Homo sapiens
gtctactgcaagagc

SEQ ID NO: 3444758 - DNA, 13 bp, Homo sapiens
gtctagagaggga

SEQ ID NO: 3444759 - DNA, 15 bp, Homo sapiens
gtctagagagggagg

SEQ ID NO: 3444760 - DNA, 16 bp, Homo sapiens
gtctagagagggaggc

SEQ ID NO: 3444761 - DNA, 15 bp, Homo sapiens
gtctagatggctcct

SEQ ID NO: 3444762 - DNA, 16 bp, Homo sapiens
gtctagatggctcctc

SEQ ID NO: 3444763 - DNA, 19 bp, Homo sapiens
gtctagatggctcctctca

SEQ ID NO: 3444764 - DNA, 20 bp, Homo sapiens
gtctagatggctcctctcag

SEQ ID NO: 3444765 - DNA, 14 bp, Homo sapiens
gtctatgggactca

SEQ ID NO: 3444766 - DNA, 22 bp, Homo sapiens
gtctatgggactcaatgcactg

SEQ ID NO: 3444767 - DNA, 15 bp, Homo sapiens
gtctattccattccc

SEQ ID NO: 3444768 - DNA, 18 bp, Homo sapiens
gtctcactatgttgccca

SEQ ID NO: 3444769 - DNA, 23 bp, Homo sapiens
gtctcactatgttgcccaggcag

SEQ ID NO: 3444770 - DNA, 11 bp, Homo sapiens
gtctcactctg

SEQ ID NO: 3444771 - DNA, 23 bp, Homo sapiens
gtctcactgtgggaaggccagct

SEQ ID NO: 3444772 - DNA, 13 bp, Homo sapiens
gtctcactgttgc

SEQ ID NO: 3444773 - DNA, 21 bp, Homo sapiens
gtctcactgttgcccaggctg

SEQ ID NO: 3444774 - DNA, 15 bp, Homo sapiens
gtctcatccatcatc

SEQ ID NO: 3444775 - DNA, 12 bp, Homo sapiens
gtctcatcccat

SEQ ID NO: 3444776 - DNA, 16 bp, Homo sapiens
gtctccaaccccccag

SEQ ID NO: 3444777 - DNA, 12 bp, Homo sapiens
gtctccaccagg

SEQ ID NO: 3444778 - DNA, 20 bp, Homo sapiens
gtctccagccccttctcaga

SEQ ID NO: 3444779 - DNA, 13 bp, Homo sapiens
gtctcctctccat

SEQ ID NO: 3444780 - DNA, 15 bp, Homo sapiens
gtctcctctccattt

SEQ ID NO: 3444781 - DNA, 22 bp, Homo sapiens
gtctccttaacactgagctgtc

SEQ ID NO: 3444782 - DNA, 18 bp, Homo sapiens
gtctcctttcaccccagg

SEQ ID NO: 3444783 - DNA, 19 bp, Homo sapiens
gtctcgctttgttgcccag

SEQ ID NO: 3444784 - DNA, 22 bp, Homo sapiens
gtctcggggcttgccccactct

SEQ ID NO: 3444785 - DNA, 16 bp, Homo sapiens
gtctctagaagtgcca

SEQ ID NO: 3444786 - DNA, 13 bp, Homo sapiens
gtctctaggctgg

SEQ ID NO: 3444787 - DNA, 15 bp, Homo sapiens
gtctctaggctgggg

SEQ ID NO: 3444788 - DNA, 12 bp, Homo sapiens
gtctctgctgcc

SEQ ID NO: 3444789 - DNA, 16 bp, Homo sapiens
gtctctgctggcccag

SEQ ID NO: 3444790 - DNA, 17 bp, Homo sapiens
gtctctgctggcccagc

SEQ ID NO: 3444791 - DNA, 13 bp, Homo sapiens
gtctctgggccac

SEQ ID NO: 3444792 - DNA, 16 bp, Homo sapiens
gtctctggtagcctgc

SEQ ID NO: 3444793 - DNA, 13 bp, Homo sapiens
gtctcttgtaatc

SEQ ID NO: 3444794 - DNA, 22 bp, Homo sapiens
gtctctttaatgtcacaggcag

SEQ ID NO: 3444795 - DNA, 13 bp, Homo sapiens
gtctgacaggcaa

SEQ ID NO: 3444796 - DNA, 15 bp, Homo sapiens
gtctgacaggcaatg

SEQ ID NO: 3444797 - DNA, 22 bp, Homo sapiens
gtctgacaggcaatgctggctg

SEQ ID NO: 3444798 - DNA, 19 bp, Homo sapiens
gtctgaggaatccagaccc

SEQ ID NO: 3444799 - DNA, 21 bp, Homo sapiens
gtctgaggaatccagacccgg

SEQ ID NO: 3444800 - DNA, 15 bp, Homo sapiens
gtctgagtctatgtt

SEQ ID NO: 3444801 - DNA, 12 bp, Homo sapiens
gtctgcaggcag

SEQ ID NO: 3444802 - DNA, 11 bp, Homo sapiens
gtctgccaggg

SEQ ID NO: 3444803 - DNA, 21 bp, Homo sapiens
gtctgccatgttgcccctttc

SEQ ID NO: 3444804 - DNA, 12 bp, Homo sapiens
gtctgccccagc

SEQ ID NO: 3444805 - DNA, 14 bp, Homo sapiens
gtctgcctccagcc

SEQ ID NO: 3444806 - DNA, 21 bp, Homo sapiens
gtctggagttgatctggaacc

SEQ ID NO: 3444807 - DNA, 22 bp, Homo sapiens
gtctggcagcctcccatccagg

SEQ ID NO: 3444808 - DNA, 17 bp, Homo sapiens
gtctggcatctcccaca

SEQ ID NO: 3444809 - DNA, 16 bp, Homo sapiens
gtctggtcagagccac

SEQ ID NO: 3444810 - DNA, 20 bp, Homo sapiens
gtctggtggccccgtttctg

SEQ ID NO: 3444811 - DNA, 22 bp, Homo sapiens
gtctggtttcaccgaggacatg

SEQ ID NO: 3444812 - DNA, 14 bp, Homo sapiens
gtctgtaaaatctt

SEQ ID NO: 3444813 - DNA, 14 bp, Homo sapiens
gtctgtgttttaat

SEQ ID NO: 3444814 - DNA, 20 bp, Homo sapiens
gtctgtgtttttttggcagt

SEQ ID NO: 3444815 - DNA, 20 bp, Homo sapiens
gtctgttggcaggctggcca

SEQ ID NO: 3444816 - DNA, 12 bp, Homo sapiens
gtctgtttactg

SEQ ID NO: 3444817 - DNA, 13 bp, Homo sapiens
gtctgtttactgc

SEQ ID NO: 3444818 - DNA, 22 bp, Homo sapiens
gtcttcagcctctttctgtccc

SEQ ID NO: 3444819 - DNA, 14 bp, Homo sapiens
gtcttccacaaaga

SEQ ID NO: 3444820 - DNA, 17 bp, Homo sapiens
gtcttccacaaagaaaa

SEQ ID NO: 3444821 - DNA, 19 bp, Homo sapiens
gtcttccctcttccctcag

SEQ ID NO: 3444822 - DNA, 18 bp, Homo sapiens
gtcttctcacaagccagc

SEQ ID NO: 3444823 - DNA, 16 bp, Homo sapiens
gtcttgccagccagaa

SEQ ID NO: 3444824 - DNA, 20 bp, Homo sapiens
gtcttggcagcacctgtctc

SEQ ID NO: 3444825 - DNA, 21 bp, Homo sapiens
gtcttgggcagagctggctct

SEQ ID NO: 3444826 - DNA, 20 bp, Homo sapiens
gtcttgttgttattgatgtt

SEQ ID NO: 3444827 - DNA, 15 bp, Homo sapiens
gtctttaaaagagag

SEQ ID NO: 3444828 - DNA, 18 bp, Homo sapiens
gtctttaggtctttgtaa

SEQ ID NO: 3444829 - DNA, 11 bp, Homo sapiens
gtctttcagta

SEQ ID NO: 3444830 - DNA, 15 bp, Homo sapiens
gtctttcagtacttt

SEQ ID NO: 3444831 - DNA, 19 bp, Homo sapiens
gtctttgttaagttctatt

SEQ ID NO: 3444832 - DNA, 13 bp, Homo sapiens
gtcttttgacatt

SEQ ID NO: 3444833 - DNA, 16 bp, Homo sapiens
gtcttttgacatttta

SEQ ID NO: 3444834 - DNA, 13 bp, Homo sapiens
gtcttttgctttt

SEQ ID NO: 3444835 - DNA, 20 bp, Homo sapiens
gtctttttcgccaaactgtc

SEQ ID NO: 3444836 - DNA, 16 bp, Homo sapiens
gtctttttgtttgttt

SEQ ID NO: 3444837 - DNA, 23 bp, Homo sapiens
gtgaaaagaaaaatgagcctggc

SEQ ID NO: 3444838 - DNA, 24 bp, Homo sapiens
gtgaaacccagtcactgtgagctc

SEQ ID NO: 3444839 - DNA, 15 bp, Homo sapiens
gtgaaactcatctca

SEQ ID NO: 3444840 - DNA, 19 bp, Homo sapiens
gtgaaagaaaataacaata

SEQ ID NO: 3444841 - DNA, 15 bp, Homo sapiens
gtgaaagtgaggaaa

SEQ ID NO: 3444842 - DNA, 15 bp, Homo sapiens
gtgaaagttgccatt

SEQ ID NO: 3444843 - DNA, 16 bp, Homo sapiens
gtgaaataaattctga

SEQ ID NO: 3444844 - DNA, 19 bp, Homo sapiens
gtgaaataaattctgattc

SEQ ID NO: 3444845 - DNA, 21 bp, Homo sapiens
gtgaaatagttcaaagccaag

SEQ ID NO: 3444846 - DNA, 15 bp, Homo sapiens
gtgaacagcttgctg

SEQ ID NO: 3444847 - DNA, 14 bp, Homo sapiens
gtgaaccaatgcaa

SEQ ID NO: 3444848 - DNA, 23 bp, Homo sapiens
gtgaaccaccacacccagcccac

SEQ ID NO: 3444849 - DNA, 21 bp, Homo sapiens
gtgaaccctggggcctgactg

SEQ ID NO: 3444850 - DNA, 14 bp, Homo sapiens
gtgaacctgtataa

SEQ ID NO: 3444851 - DNA, 19 bp, Homo sapiens
gtgaactggaccctgttgc

SEQ ID NO: 3444852 - DNA, 20 bp, Homo sapiens
gtgaactggaccctgttgct

SEQ ID NO: 3444853 - DNA, 21 bp, Homo sapiens
gtgaactggaccctgttgcta

SEQ ID NO: 3444854 - DNA, 23 bp, Homo sapiens
gtgaactggaccctgttgctaag

SEQ ID NO: 3444855 - DNA, 20 bp, Homo sapiens
gtgaagccaattcagacagg

SEQ ID NO: 3444856 - DNA, 15 bp, Homo sapiens
gtgaaggaatatatg

SEQ ID NO: 3444857 - DNA, 13 bp, Homo sapiens
gtgaaggaccctt

SEQ ID NO: 3444858 - DNA, 14 bp, Homo sapiens
gtgaaggcttctct

SEQ ID NO: 3444859 - DNA, 22 bp, Homo sapiens
gtgaaggcttctctctgtggga

SEQ ID NO: 3444860 - DNA, 17 bp, Homo sapiens
gtgaagtatactgtatt

SEQ ID NO: 3444861 - DNA, 13 bp, Homo sapiens
gtgaatgctggga

SEQ ID NO: 3444862 - DNA, 15 bp, Homo sapiens
gtgaatgctgggact

SEQ ID NO: 3444863 - DNA, 21 bp, Homo sapiens
gtgaatgctgggactcagcct

SEQ ID NO: 3444864 - DNA, 13 bp, Homo sapiens
gtgaatttttgca

SEQ ID NO: 3444865 - DNA, 20 bp, Homo sapiens
gtgacacccaagagggctgc

SEQ ID NO: 3444866 - DNA, 12 bp, Homo sapiens
gtgacagaggca

SEQ ID NO: 3444867 - DNA, 19 bp, Homo sapiens
gtgacagaggcagccccat

SEQ ID NO: 3444868 - DNA, 20 bp, Homo sapiens
gtgacagagtgagactctgt

SEQ ID NO: 3444869 - DNA, 18 bp, Homo sapiens
gtgacagtggattgcatt

SEQ ID NO: 3444870 - DNA, 23 bp, Homo sapiens
gtgacataatatattctattttt

SEQ ID NO: 3444871 - DNA, 17 bp, Homo sapiens
gtgacatgcccaaggcc

SEQ ID NO: 3444872 - DNA, 19 bp, Homo sapiens
gtgacatgcccaaggccac

SEQ ID NO: 3444873 - DNA, 12 bp, Homo sapiens
gtgaccccaggt

SEQ ID NO: 3444874 - DNA, 16 bp, Homo sapiens
gtgacccccagctccg

SEQ ID NO: 3444875 - DNA, 21 bp, Homo sapiens
gtgaccctctgctgaagactt

SEQ ID NO: 3444876 - DNA, 19 bp, Homo sapiens
gtgaccggacttttctgca

SEQ ID NO: 3444877 - DNA, 20 bp, Homo sapiens
gtgacctatcagttattaat

SEQ ID NO: 3444878 - DNA, 22 bp, Homo sapiens
gtgagaagtgaatgctgggact

SEQ ID NO: 3444879 - DNA, 18 bp, Homo sapiens
gtgagacagtccagcctg

SEQ ID NO: 3444880 - DNA, 17 bp, Homo sapiens
gtgagactcgagaactt

SEQ ID NO: 3444881 - DNA, 12 bp, Homo sapiens
gtgagagctggg

SEQ ID NO: 3444882 - DNA, 16 bp, Homo sapiens
gtgagaggaagggtgg

SEQ ID NO: 3444883 - DNA, 21 bp, Homo sapiens
gtgagcactaaggtgtgctct

SEQ ID NO: 3444884 - DNA, 13 bp, Homo sapiens
gtgagcatgtttg

SEQ ID NO: 3444885 - DNA, 15 bp, Homo sapiens
gtgagcccagctggg

SEQ ID NO: 3444886 - DNA, 17 bp, Homo sapiens
gtgagctaggagaaggg

SEQ ID NO: 3444887 - DNA, 22 bp, Homo sapiens
gtgaggagaatgaaatgtatgt

SEQ ID NO: 3444888 - DNA, 17 bp, Homo sapiens
gtgaggagccccatctg

SEQ ID NO: 3444889 - DNA, 13 bp, Homo sapiens
gtgaggagctggg

SEQ ID NO: 3444890 - DNA, 18 bp, Homo sapiens
gtgaggatgtcactcaga

SEQ ID NO: 3444891 - DNA, 22 bp, Homo sapiens
gtgaggatgtcactcagatgga

SEQ ID NO: 3444892 - DNA, 17 bp, Homo sapiens
gtgagtcaccaagccca

SEQ ID NO: 3444893 - DNA, 15 bp, Homo sapiens
gtgagtcgaggacag

SEQ ID NO: 3444894 - DNA, 15 bp, Homo sapiens
gtgagtgtttctatg

SEQ ID NO: 3444895 - DNA, 16 bp, Homo sapiens
gtgagtgtttctatga

SEQ ID NO: 3444896 - DNA, 17 bp, Homo sapiens
gtgataaatcagtcaag

SEQ ID NO: 3444897 - DNA, 14 bp, Homo sapiens
gtgatacatttctg

SEQ ID NO: 3444898 - DNA, 14 bp, Homo sapiens
gtgatagcactttc

SEQ ID NO: 3444899 - DNA, 19 bp, Homo sapiens
gtgatatagaattagcttt

SEQ ID NO: 3444900 - DNA, 13 bp, Homo sapiens
gtgatatatttaa

SEQ ID NO: 3444901 - DNA, 18 bp, Homo sapiens
gtgatccacccacctcag

SEQ ID NO: 3444902 - DNA, 14 bp, Homo sapiens
gtgatcctcccacc

SEQ ID NO: 3444903 - DNA, 18 bp, Homo sapiens
gtgatcctcccacctcag

SEQ ID NO: 3444904 - DNA, 21 bp, Homo sapiens
gtgatcctctcacctcagcct

SEQ ID NO: 3444905 - DNA, 14 bp, Homo sapiens
gtgatctcagatca

SEQ ID NO: 3444906 - DNA, 15 bp, Homo sapiens
gtgatctcagatcag

SEQ ID NO: 3444907 - DNA, 22 bp, Homo sapiens
gtgatcttggcttactgcagcc

SEQ ID NO: 3444908 - DNA, 12 bp, Homo sapiens
gtgatgcggcag

SEQ ID NO: 3444909 - DNA, 20 bp, Homo sapiens
gtgatgtacacattttgtaa

SEQ ID NO: 3444910 - DNA, 15 bp, Homo sapiens
gtgatgttcatgggt

SEQ ID NO: 3444911 - DNA, 14 bp, Homo sapiens
gtgattctcctgcc

SEQ ID NO: 3444912 - DNA, 20 bp, Homo sapiens
gtgattctcctgcctcagcc

SEQ ID NO: 3444913 - DNA, 23 bp, Homo sapiens
gtgattctcctgcctcagcctcc

SEQ ID NO: 3444914 - DNA, 23 bp, Homo sapiens
gtgattgacagctttgctgctga

SEQ ID NO: 3444915 - DNA, 13 bp, Homo sapiens
gtgcaacctctgc

SEQ ID NO: 3444916 - DNA, 17 bp, Homo sapiens
gtgcaacctctgcttcc

SEQ ID NO: 3444917 - DNA, 15 bp, Homo sapiens
gtgcaagcccctgct

SEQ ID NO: 3444918 - DNA, 19 bp, Homo sapiens
gtgcaataaatctgaccca

SEQ ID NO: 3444919 - DNA, 23 bp, Homo sapiens
gtgcaataaatctgacccagtgc

SEQ ID NO: 3444920 - DNA, 16 bp, Homo sapiens
gtgcacccctccccat

SEQ ID NO: 3444921 - DNA, 18 bp, Homo sapiens
gtgcacctagagcttttt

SEQ ID NO: 3444922 - DNA, 19 bp, Homo sapiens
gtgcactgcccatggacag

SEQ ID NO: 3444923 - DNA, 21 bp, Homo sapiens
gtgcactgcccatggacaggc

SEQ ID NO: 3444924 - DNA, 12 bp, Homo sapiens
gtgcagaggaag

SEQ ID NO: 3444925 - DNA, 17 bp, Homo sapiens
gtgcagatgaggttgct

SEQ ID NO: 3444926 - DNA, 18 bp, Homo sapiens
gtgcagccgctgagcgag

SEQ ID NO: 3444927 - DNA, 22 bp, Homo sapiens
gtgcagtatcatgccctgtgca

SEQ ID NO: 3444928 - DNA, 20 bp, Homo sapiens
gtgcatatgcatgtgtgtgt

SEQ ID NO: 3444929 - DNA, 18 bp, Homo sapiens
gtgcatatgtacagaaga

SEQ ID NO: 3444930 - DNA, 19 bp, Homo sapiens
gtgcattcttttaaaagac

SEQ ID NO: 3444931 - DNA, 11 bp, Homo sapiens
gtgcattgtgc

SEQ ID NO: 3444932 - DNA, 15 bp, Homo sapiens
gtgcattgtttctgt

SEQ ID NO: 3444933 - DNA, 18 bp, Homo sapiens
gtgccaacactcaagaag

SEQ ID NO: 3444934 - DNA, 17 bp, Homo sapiens
gtgccagtcaagaagaa

SEQ ID NO: 3444935 - DNA, 18 bp, Homo sapiens
gtgccatgtataattttt

SEQ ID NO: 3444936 - DNA, 12 bp, Homo sapiens
gtgccatgtctg

SEQ ID NO: 3444937 - DNA, 21 bp, Homo sapiens
gtgcccacaggccgccctgcg

SEQ ID NO: 3444938 - DNA, 21 bp, Homo sapiens
gtgcccagctatacctgtgcc

SEQ ID NO: 3444939 - DNA, 14 bp, Homo sapiens
gtgccccaggacca

SEQ ID NO: 3444940 - DNA, 19 bp, Homo sapiens
gtgccccaggaccagctca

SEQ ID NO: 3444941 - DNA, 21 bp, Homo sapiens
gtgccccaggaccagctcagg

SEQ ID NO: 3444942 - DNA, 18 bp, Homo sapiens
gtgcccccactgaccaga

SEQ ID NO: 3444943 - DNA, 14 bp, Homo sapiens
gtgccgacagaagg

SEQ ID NO: 3444944 - DNA, 19 bp, Homo sapiens
gtgcctgccatagccagga

SEQ ID NO: 3444945 - DNA, 14 bp, Homo sapiens
gtgccttctgtggg

SEQ ID NO: 3444946 - DNA, 21 bp, Homo sapiens
gtgccttttgcagaagagggt

SEQ ID NO: 3444947 - DNA, 18 bp, Homo sapiens
gtgccttttttcacggaa

SEQ ID NO: 3444948 - DNA, 21 bp, Homo sapiens
gtgcgctgggcacttccctgc

SEQ ID NO: 3444949 - DNA, 14 bp, Homo sapiens
gtgcggccaccacc

SEQ ID NO: 3444950 - DNA, 15 bp, Homo sapiens
gtgcgtccacgagct

SEQ ID NO: 3444951 - DNA, 15 bp, Homo sapiens
gtgctacctgagcca

SEQ ID NO: 3444952 - DNA, 14 bp, Homo sapiens
gtgctatggtgctc

SEQ ID NO: 3444953 - DNA, 22 bp, Homo sapiens
gtgctcagggaaatggccttcc

SEQ ID NO: 3444954 - DNA, 20 bp, Homo sapiens
gtgctcgagtcacattctgc

SEQ ID NO: 3444955 - DNA, 14 bp, Homo sapiens
gtgctcgccccagc

SEQ ID NO: 3444956 - DNA, 16 bp, Homo sapiens
gtgctcgccccagcag

SEQ ID NO: 3444957 - DNA, 19 bp, Homo sapiens
gtgctcgctgttgctgaat

SEQ ID NO: 3444958 - DNA, 15 bp, Homo sapiens
gtgctgacagctgct

SEQ ID NO: 3444959 - DNA, 17 bp, Homo sapiens
gtgctgacagctgctcc

SEQ ID NO: 3444960 - DNA, 16 bp, Homo sapiens
gtgctgacggccaggg

SEQ ID NO: 3444961 - DNA, 23 bp, Homo sapiens
gtgctgactgaacattagttgca

SEQ ID NO: 3444962 - DNA, 14 bp, Homo sapiens
gtgctgagaagctt

SEQ ID NO: 3444963 - DNA, 18 bp, Homo sapiens
gtgctgcagctccctggc

SEQ ID NO: 3444964 - DNA, 12 bp, Homo sapiens
gtgctgcctcta

SEQ ID NO: 3444965 - DNA, 14 bp, Homo sapiens
gtgctgctgctgct

SEQ ID NO: 3444966 - DNA, 13 bp, Homo sapiens
gtgctggagaaat

SEQ ID NO: 3444967 - DNA, 16 bp, Homo sapiens
gtgctggagcactggg

SEQ ID NO: 3444968 - DNA, 19 bp, Homo sapiens
gtgctggagcactgggctc

SEQ ID NO: 3444969 - DNA, 21 bp, Homo sapiens
gtgctgggattacaagcgtga

SEQ ID NO: 3444970 - DNA, 20 bp, Homo sapiens
gtgctgggattacaggtgtg

SEQ ID NO: 3444971 - DNA, 21 bp, Homo sapiens
gtgctgtataaaatcagccaa

SEQ ID NO: 3444972 - DNA, 17 bp, Homo sapiens
gtgcttcgggcccttcc

SEQ ID NO: 3444973 - DNA, 14 bp, Homo sapiens
gtgcttgaaggccc

SEQ ID NO: 3444974 - DNA, 19 bp, Homo sapiens
gtgcttgaaggccctgctg

SEQ ID NO: 3444975 - DNA, 21 bp, Homo sapiens
gtgcttgaaggccctgctgag

SEQ ID NO: 3444976 - DNA, 20 bp, Homo sapiens
gtgcttgttccctctccctg

SEQ ID NO: 3444977 - DNA, 15 bp, Homo sapiens
gtgctttatgctgaa

SEQ ID NO: 3444978 - DNA, 19 bp, Homo sapiens
gtggaaaaactgagacagg

SEQ ID NO: 3444979 - DNA, 15 bp, Homo sapiens
gtggacacagctctt

SEQ ID NO: 3444980 - DNA, 17 bp, Homo sapiens
gtggacacagctcttct

SEQ ID NO: 3444981 - DNA, 22 bp, Homo sapiens
gtggacacagctcttctccagg

SEQ ID NO: 3444982 - DNA, 22 bp, Homo sapiens
gtggaccatcgctgtcatgagt

SEQ ID NO: 3444983 - DNA, 18 bp, Homo sapiens
gtggaccttaggccttcc

SEQ ID NO: 3444984 - DNA, 14 bp, Homo sapiens
gtggactaaaagat

SEQ ID NO: 3444985 - DNA, 18 bp, Homo sapiens
gtggactcagaaagccaa

SEQ ID NO: 3444986 - DNA, 14 bp, Homo sapiens
gtggactcagggca

SEQ ID NO: 3444987 - DNA, 16 bp, Homo sapiens
gtggactcagggcagc

SEQ ID NO: 3444988 - DNA, 19 bp, Homo sapiens
gtggacttgaactttcctg

SEQ ID NO: 3444989 - DNA, 17 bp, Homo sapiens
gtggagaagccacaggc

SEQ ID NO: 3444990 - DNA, 18 bp, Homo sapiens
gtggagacaatgtctgca

SEQ ID NO: 3444991 - DNA, 15 bp, Homo sapiens
gtggaggagcagtgc

SEQ ID NO: 3444992 - DNA, 17 bp, Homo sapiens
gtggaggagcagtgcag

SEQ ID NO: 3444993 - DNA, 19 bp, Homo sapiens
gtggaggattgctgccaga

SEQ ID NO: 3444994 - DNA, 21 bp, Homo sapiens
gtggaggattgctgccagaga

SEQ ID NO: 3444995 - DNA, 12 bp, Homo sapiens
gtggagggccac

SEQ ID NO: 3444996 - DNA, 21 bp, Homo sapiens
gtggaggttaaggctgaggaa

SEQ ID NO: 3444997 - DNA, 22 bp, Homo sapiens
gtggaggttaaggctgaggaaa

SEQ ID NO: 3444998 - DNA, 13 bp, Homo sapiens
gtggagtcccaac

SEQ ID NO: 3444999 - DNA, 19 bp, Homo sapiens
gtggagtgcagtggtgcga

SEQ ID NO: 3445000 - DNA, 15 bp, Homo sapiens
gtggatggccccagc

SEQ ID NO: 3445001 - DNA, 22 bp, Homo sapiens
gtggatggccccagcacagctt

SEQ ID NO: 3445002 - DNA, 18 bp, Homo sapiens
gtggatggccgtggatgc

SEQ ID NO: 3445003 - DNA, 17 bp, Homo sapiens
gtggcaagagtgtggag

SEQ ID NO: 3445004 - DNA, 13 bp, Homo sapiens
gtggcaaggctgt

SEQ ID NO: 3445005 - DNA, 15 bp, Homo sapiens
gtggcaaggctgtgc

SEQ ID NO: 3445006 - DNA, 14 bp, Homo sapiens
gtggcaccagcagc

SEQ ID NO: 3445007 - DNA, 18 bp, Homo sapiens
gtggcaccagcagcctgg

SEQ ID NO: 3445008 - DNA, 15 bp, Homo sapiens
gtggcagagcttgga

SEQ ID NO: 3445009 - DNA, 19 bp, Homo sapiens
gtggcagagcttggactgg

SEQ ID NO: 3445010 - DNA, 23 bp, Homo sapiens
gtggcagagcttggactggatgc

SEQ ID NO: 3445011 - DNA, 16 bp, Homo sapiens
gtggcaggggacagga

SEQ ID NO: 3445012 - DNA, 20 bp, Homo sapiens
gtggcaggggacaggagtcc

SEQ ID NO: 3445013 - DNA, 18 bp, Homo sapiens
gtggcagtggaggtgggg

SEQ ID NO: 3445014 - DNA, 19 bp, Homo sapiens
gtggcagtgggagctgcct

SEQ ID NO: 3445015 - DNA, 17 bp, Homo sapiens
gtggccaaggagctgct

SEQ ID NO: 3445016 - DNA, 18 bp, Homo sapiens
gtggccaaggagctgcta

SEQ ID NO: 3445017 - DNA, 16 bp, Homo sapiens
gtggccatggcctctg

SEQ ID NO: 3445018 - DNA, 15 bp, Homo sapiens
gtggccccaccctgg

SEQ ID NO: 3445019 - DNA, 18 bp, Homo sapiens
gtggccccaccctgggcc

SEQ ID NO: 3445020 - DNA, 19 bp, Homo sapiens
gtggccccaccctgggccc

SEQ ID NO: 3445021 - DNA, 20 bp, Homo sapiens
gtggccccaccctgggccct

SEQ ID NO: 3445022 - DNA, 16 bp, Homo sapiens
gtggccccgtttctgg

SEQ ID NO: 3445023 - DNA, 22 bp, Homo sapiens
gtggcccctgctgtctctctgg

SEQ ID NO: 3445024 - DNA, 23 bp, Homo sapiens
gtggcccctgctgtctctctggg

SEQ ID NO: 3445025 - DNA, 14 bp, Homo sapiens
gtggccctgtcctg

SEQ ID NO: 3445026 - DNA, 21 bp, Homo sapiens
gtggcctctccttgtggcctg

SEQ ID NO: 3445027 - DNA, 16 bp, Homo sapiens
gtggcctctttgtcta

SEQ ID NO: 3445028 - DNA, 21 bp, Homo sapiens
gtggcgccgtctccaggggct

SEQ ID NO: 3445029 - DNA, 22 bp, Homo sapiens
gtggcgccgtctccaggggctg

SEQ ID NO: 3445030 - DNA, 19 bp, Homo sapiens
gtggctagtcaagctcctc

SEQ ID NO: 3445031 - DNA, 22 bp, Homo sapiens
gtggctagtcaagctcctcctc

SEQ ID NO: 3445032 - DNA, 12 bp, Homo sapiens
gtggctgctgcc

SEQ ID NO: 3445033 - DNA, 12 bp, Homo sapiens
gtggctgtctgg

SEQ ID NO: 3445034 - DNA, 20 bp, Homo sapiens
gtggcttcattagagcaggc

SEQ ID NO: 3445035 - DNA, 22 bp, Homo sapiens
gtgggaaacctcattgttctgt

SEQ ID NO: 3445036 - DNA, 13 bp, Homo sapiens
gtgggacaggctc

SEQ ID NO: 3445037 - DNA, 14 bp, Homo sapiens
gtgggagctgcctg

SEQ ID NO: 3445038 - DNA, 20 bp, Homo sapiens
gtgggatgtggttttcttaa

SEQ ID NO: 3445039 - DNA, 16 bp, Homo sapiens
gtgggcacccaccctg

SEQ ID NO: 3445040 - DNA, 20 bp, Homo sapiens
gtgggcacccaccctgggac

SEQ ID NO: 3445041 - DNA, 15 bp, Homo sapiens
gtgggccagtctgtg

SEQ ID NO: 3445042 - DNA, 18 bp, Homo sapiens
gtgggccagtctgtggat

SEQ ID NO: 3445043 - DNA, 13 bp, Homo sapiens
gtgggctccctga

SEQ ID NO: 3445044 - DNA, 14 bp, Homo sapiens
gtgggctccctgac

SEQ ID NO: 3445045 - DNA, 16 bp, Homo sapiens
gtgggcttcccagtgg

SEQ ID NO: 3445046 - DNA, 23 bp, Homo sapiens
gtgggcttcccagtggctgctgc

SEQ ID NO: 3445047 - DNA, 14 bp, Homo sapiens
gtgggcttgattct

SEQ ID NO: 3445048 - DNA, 12 bp, Homo sapiens
gtggggcccctc

SEQ ID NO: 3445049 - DNA, 17 bp, Homo sapiens
gtggggccgccgcctct

SEQ ID NO: 3445050 - DNA, 17 bp, Homo sapiens
gtgggggaagacctggc

SEQ ID NO: 3445051 - DNA, 14 bp, Homo sapiens
gtgggggtgggtca

SEQ ID NO: 3445052 - DNA, 15 bp, Homo sapiens
gtggggttctaggca

SEQ ID NO: 3445053 - DNA, 14 bp, Homo sapiens
gtggggtttcctgg

SEQ ID NO: 3445054 - DNA, 16 bp, Homo sapiens
gtggggtttcctggca

SEQ ID NO: 3445055 - DNA, 17 bp, Homo sapiens
gtgggtatgcgagacca

SEQ ID NO: 3445056 - DNA, 14 bp, Homo sapiens
gtgggtcagaaccc

SEQ ID NO: 3445057 - DNA, 18 bp, Homo sapiens
gtgggtccatgggcagag

SEQ ID NO: 3445058 - DNA, 18 bp, Homo sapiens
gtgggtcccggctctgtg

SEQ ID NO: 3445059 - DNA, 13 bp, Homo sapiens
gtgggtctgggag

SEQ ID NO: 3445060 - DNA, 12 bp, Homo sapiens
gtgggtgcagtc

SEQ ID NO: 3445061 - DNA, 22 bp, Homo sapiens
gtgggtgtcctgcctgtctgcc

SEQ ID NO: 3445062 - DNA, 15 bp, Homo sapiens
gtgggtgtgtgactc

SEQ ID NO: 3445063 - DNA, 21 bp, Homo sapiens
gtgggttttcatcaagactgg

SEQ ID NO: 3445064 - DNA, 19 bp, Homo sapiens
gtggtatgatcacggctca

SEQ ID NO: 3445065 - DNA, 18 bp, Homo sapiens
gtggtattaattttgata

SEQ ID NO: 3445066 - DNA, 20 bp, Homo sapiens
gtggtctaaagtgtttagct

SEQ ID NO: 3445067 - DNA, 13 bp, Homo sapiens
gtggtctgttggc

SEQ ID NO: 3445068 - DNA, 20 bp, Homo sapiens
gtggtggtaaccctggtggt

SEQ ID NO: 3445069 - DNA, 23 bp, Homo sapiens
gtgtacttcccgggccagggctg

SEQ ID NO: 3445070 - DNA, 17 bp, Homo sapiens
gtgtagccacaccagga

SEQ ID NO: 3445071 - DNA, 14 bp, Homo sapiens
gtgtaggcagacac

SEQ ID NO: 3445072 - DNA, 15 bp, Homo sapiens
gtgtaggcagacaca

SEQ ID NO: 3445073 - DNA, 20 bp, Homo sapiens
gtgtatggagagaaaacaga

SEQ ID NO: 3445074 - DNA, 23 bp, Homo sapiens
gtgtatttttcaataaagcattt

SEQ ID NO: 3445075 - DNA, 20 bp, Homo sapiens
gtgtcaagagggtctgagga

SEQ ID NO: 3445076 - DNA, 22 bp, Homo sapiens
gtgtcactcaaggcggtgcttg

SEQ ID NO: 3445077 - DNA, 16 bp, Homo sapiens
gtgtcagctgaggctg

SEQ ID NO: 3445078 - DNA, 18 bp, Homo sapiens
gtgtcagctgaggctggg

SEQ ID NO: 3445079 - DNA, 18 bp, Homo sapiens
gtgtccctgcacttgcag

SEQ ID NO: 3445080 - DNA, 14 bp, Homo sapiens
gtgtcctaggagta

SEQ ID NO: 3445081 - DNA, 16 bp, Homo sapiens
gtgtcctccaggagct

SEQ ID NO: 3445082 - DNA, 18 bp, Homo sapiens
gtgtcctcttccctctct

SEQ ID NO: 3445083 - DNA, 16 bp, Homo sapiens
gtgtcctgcctgtctg

SEQ ID NO: 3445084 - DNA, 20 bp, Homo sapiens
gtgtcctgcctgtctgcccc

SEQ ID NO: 3445085 - DNA, 21 bp, Homo sapiens
gtgtctccaaccccccagcac

SEQ ID NO: 3445086 - DNA, 17 bp, Homo sapiens
gtgtctggattcccagg

SEQ ID NO: 3445087 - DNA, 16 bp, Homo sapiens
gtgtctgttttgagct

SEQ ID NO: 3445088 - DNA, 16 bp, Homo sapiens
gtgtcttgggcagagc

SEQ ID NO: 3445089 - DNA, 18 bp, Homo sapiens
gtgtcttgttctgtcact

SEQ ID NO: 3445090 - DNA, 15 bp, Homo sapiens
gtgtcttttgacatt

SEQ ID NO: 3445091 - DNA, 14 bp, Homo sapiens
gtgtgaaacatact

SEQ ID NO: 3445092 - DNA, 23 bp, Homo sapiens
gtgtgaaccaccacacccagccc

SEQ ID NO: 3445093 - DNA, 17 bp, Homo sapiens
gtgtgaactggaccctg

SEQ ID NO: 3445094 - DNA, 22 bp, Homo sapiens
gtgtgaactggaccctgttgct

SEQ ID NO: 3445095 - DNA, 22 bp, Homo sapiens
gtgtgacaattctgtttttaat

SEQ ID NO: 3445096 - DNA, 22 bp, Homo sapiens
gtgtgagaagtgaatgctggga

SEQ ID NO: 3445097 - DNA, 14 bp, Homo sapiens
gtgtgaggccaggg

SEQ ID NO: 3445098 - DNA, 13 bp, Homo sapiens
gtgtgagtcacca

SEQ ID NO: 3445099 - DNA, 18 bp, Homo sapiens
gtgtgataaatcagtcaa

SEQ ID NO: 3445100 - DNA, 18 bp, Homo sapiens
gtgtgatctcttcagggt

SEQ ID NO: 3445101 - DNA, 16 bp, Homo sapiens
gtgtgattgacagctt

SEQ ID NO: 3445102 - DNA, 18 bp, Homo sapiens
gtgtgcacccctccccat

SEQ ID NO: 3445103 - DNA, 23 bp, Homo sapiens
gtgtgcactaaggggcccggcca

SEQ ID NO: 3445104 - DNA, 22 bp, Homo sapiens
gtgtgcatatgcatgtgtgtgt

SEQ ID NO: 3445105 - DNA, 19 bp, Homo sapiens
gtgtgcctgactgcccagc

SEQ ID NO: 3445106 - DNA, 12 bp, Homo sapiens
gtgtgccttcca

SEQ ID NO: 3445107 - DNA, 19 bp, Homo sapiens
gtgtggccacttctgtcca

SEQ ID NO: 3445108 - DNA, 14 bp, Homo sapiens
gtgtgggtgtcctg

SEQ ID NO: 3445109 - DNA, 14 bp, Homo sapiens
gtgtggtgcagtgt

SEQ ID NO: 3445110 - DNA, 19 bp, Homo sapiens
gtgtggtgcagtgtgaaaa

SEQ ID NO: 3445111 - DNA, 13 bp, Homo sapiens
gtgtgtaattgtt

SEQ ID NO: 3445112 - DNA, 19 bp, Homo sapiens
gtgtgtccaaaactgcctc

SEQ ID NO: 3445113 - DNA, 19 bp, Homo sapiens
gtgtgtccacgactgtctc

SEQ ID NO: 3445114 - DNA, 17 bp, Homo sapiens
gtgtgtgaatgaacact

SEQ ID NO: 3445115 - DNA, 17 bp, Homo sapiens
gtgtgtgacaattctgt

SEQ ID NO: 3445116 - DNA, 10 bp, Homo sapiens
gtgtgtgtgt

SEQ ID NO: 3445117 - DNA, 15 bp, Homo sapiens
gtgtgttgccacagg

SEQ ID NO: 3445118 - DNA, 16 bp, Homo sapiens
gtgtgttgtctcttga

SEQ ID NO: 3445119 - DNA, 19 bp, Homo sapiens
gtgttactgctttgcaaag

SEQ ID NO: 3445120 - DNA, 15 bp, Homo sapiens
gtgttactgtaattc

SEQ ID NO: 3445121 - DNA, 16 bp, Homo sapiens
gtgttagggaagggcc

SEQ ID NO: 3445122 - DNA, 23 bp, Homo sapiens
gtgttccctgagaaacccaccag

SEQ ID NO: 3445123 - DNA, 14 bp, Homo sapiens
gtgttgccaagctc

SEQ ID NO: 3445124 - DNA, 18 bp, Homo sapiens
gtgttgccacaggacaca

SEQ ID NO: 3445125 - DNA, 17 bp, Homo sapiens
gtgttgttgctctagga

SEQ ID NO: 3445126 - DNA, 14 bp, Homo sapiens
gtgtttccatctca

SEQ ID NO: 3445127 - DNA, 13 bp, Homo sapiens
gtgtttgctttct

SEQ ID NO: 3445128 - DNA, 13 bp, Homo sapiens
gtgtttgtcatta

SEQ ID NO: 3445129 - DNA, 11 bp, Homo sapiens
gtgtttgtgtt

SEQ ID NO: 3445130 - DNA, 15 bp, Homo sapiens
gttaaaaaaatggca

SEQ ID NO: 3445131 - DNA, 21 bp, Homo sapiens
gttaaaataactagtgttgct

SEQ ID NO: 3445132 - DNA, 22 bp, Homo sapiens
gttaaaatacagttctgtcata

SEQ ID NO: 3445133 - DNA, 23 bp, Homo sapiens
gttaaaggctcgattttgtatct

SEQ ID NO: 3445134 - DNA, 20 bp, Homo sapiens
gttaaataaattgtatattc

SEQ ID NO: 3445135 - DNA, 20 bp, Homo sapiens
gttaaatagagtatatgcac

SEQ ID NO: 3445136 - DNA, 22 bp, Homo sapiens
gttaacccttcatcttcctgtg

SEQ ID NO: 3445137 - DNA, 16 bp, Homo sapiens
gttaacgtattagttg

SEQ ID NO: 3445138 - DNA, 22 bp, Homo sapiens
gttaactttgtggtctaaagtg

SEQ ID NO: 3445139 - DNA, 17 bp, Homo sapiens
gttaagacatgatttcc

SEQ ID NO: 3445140 - DNA, 13 bp, Homo sapiens
gttaagacctggc

SEQ ID NO: 3445141 - DNA, 16 bp, Homo sapiens
gttaagacctggcagc

SEQ ID NO: 3445142 - DNA, 12 bp, Homo sapiens
gttaaggcctga

SEQ ID NO: 3445143 - DNA, 17 bp, Homo sapiens
gttaaggttcaagacag

SEQ ID NO: 3445144 - DNA, 23 bp, Homo sapiens
gttaagtcctccctgacttttct

SEQ ID NO: 3445145 - DNA, 14 bp, Homo sapiens
gttaagttctattg

SEQ ID NO: 3445146 - DNA, 19 bp, Homo sapiens
gttaatgcttaagagggaa

SEQ ID NO: 3445147 - DNA, 18 bp, Homo sapiens
gttaattttttggtacaa

SEQ ID NO: 3445148 - DNA, 21 bp, Homo sapiens
gttaattttttggtacaaaaa

SEQ ID NO: 3445149 - DNA, 13 bp, Homo sapiens
gttacagagacct

SEQ ID NO: 3445150 - DNA, 17 bp, Homo sapiens
gttacagagacctatgt

SEQ ID NO: 3445151 - DNA, 22 bp, Homo sapiens
gttacagagacctatgtaagaa

SEQ ID NO: 3445152 - DNA, 21 bp, Homo sapiens
gttacagcctgttagtaacat

SEQ ID NO: 3445153 - DNA, 14 bp, Homo sapiens
gttacccatgaaaa

SEQ ID NO: 3445154 - DNA, 13 bp, Homo sapiens
gttacctgtgtgc

SEQ ID NO: 3445155 - DNA, 22 bp, Homo sapiens
gttactaaatagaaaacctaat

SEQ ID NO: 3445156 - DNA, 17 bp, Homo sapiens
gttactaactaaactct

SEQ ID NO: 3445157 - DNA, 20 bp, Homo sapiens
gttactaggtaacttcatat

SEQ ID NO: 3445158 - DNA, 16 bp, Homo sapiens
gttactgaagccttac

SEQ ID NO: 3445159 - DNA, 14 bp, Homo sapiens
gttacttctgaggt

SEQ ID NO: 3445160 - DNA, 18 bp, Homo sapiens
gttagcagacaggccccg

SEQ ID NO: 3445161 - DNA, 15 bp, Homo sapiens
gttagccaaacaaca

SEQ ID NO: 3445162 - DNA, 14 bp, Homo sapiens
gttagctcctgtgg

SEQ ID NO: 3445163 - DNA, 21 bp, Homo sapiens
gttaggtagagggagttgtca

SEQ ID NO: 3445164 - DNA, 20 bp, Homo sapiens
gttagtcgtgagctcttgtg

SEQ ID NO: 3445165 - DNA, 22 bp, Homo sapiens
gttagtcgtgagctcttgtgag

SEQ ID NO: 3445166 - DNA, 10 bp, Homo sapiens
gttatatttc

SEQ ID NO: 3445167 - DNA, 15 bp, Homo sapiens
gttatatttcagatg

SEQ ID NO: 3445168 - DNA, 19 bp, Homo sapiens
gttatcttatactgtacaa

SEQ ID NO: 3445169 - DNA, 22 bp, Homo sapiens
gttatgtactagtgttctgttt

SEQ ID NO: 3445170 - DNA, 17 bp, Homo sapiens
gttattatatttacaaa

SEQ ID NO: 3445171 - DNA, 19 bp, Homo sapiens
gttattatatttacaaatg

SEQ ID NO: 3445172 - DNA, 18 bp, Homo sapiens
gttattatatttgacatg

SEQ ID NO: 3445173 - DNA, 20 bp, Homo sapiens
gttattctagtactagaaac

SEQ ID NO: 3445174 - DNA, 20 bp, Homo sapiens
gttattggccttttctattc

SEQ ID NO: 3445175 - DNA, 15 bp, Homo sapiens
gttcaacccacagct

SEQ ID NO: 3445176 - DNA, 14 bp, Homo sapiens
gttcaacttattaa

SEQ ID NO: 3445177 - DNA, 18 bp, Homo sapiens
gttcaagccttccaggga

SEQ ID NO: 3445178 - DNA, 22 bp, Homo sapiens
gttcaaggaacttgaaaaatac

SEQ ID NO: 3445179 - DNA, 18 bp, Homo sapiens
gttcaaggccatccttcc

SEQ ID NO: 3445180 - DNA, 13 bp, Homo sapiens
gttcaattagaat

SEQ ID NO: 3445181 - DNA, 16 bp, Homo sapiens
gttcaattctcatttg

SEQ ID NO: 3445182 - DNA, 16 bp, Homo sapiens
gttcacagtgtttctt

SEQ ID NO: 3445183 - DNA, 19 bp, Homo sapiens
gttcactgcaacctccgcc

SEQ ID NO: 3445184 - DNA, 16 bp, Homo sapiens
gttcacttttgacaaa

SEQ ID NO: 3445185 - DNA, 20 bp, Homo sapiens
gttcagaaatttaaaagcag

SEQ ID NO: 3445186 - DNA, 12 bp, Homo sapiens
gttcagccaagg

SEQ ID NO: 3445187 - DNA, 15 bp, Homo sapiens
gttcagccaaggttt

SEQ ID NO: 3445188 - DNA, 17 bp, Homo sapiens
gttcagctccagctcac

SEQ ID NO: 3445189 - DNA, 18 bp, Homo sapiens
gttcagggttggcccctg

SEQ ID NO: 3445190 - DNA, 20 bp, Homo sapiens
gttcagggttggcccctgcc

SEQ ID NO: 3445191 - DNA, 13 bp, Homo sapiens
gttcaggtagctg

SEQ ID NO: 3445192 - DNA, 16 bp, Homo sapiens
gttcagtgtaaatagt

SEQ ID NO: 3445193 - DNA, 18 bp, Homo sapiens
gttcatggattacttctc

SEQ ID NO: 3445194 - DNA, 16 bp, Homo sapiens
gttccatgatgctggg

SEQ ID NO: 3445195 - DNA, 12 bp, Homo sapiens
gttccccagaga

SEQ ID NO: 3445196 - DNA, 13 bp, Homo sapiens
gttccccagagaa

SEQ ID NO: 3445197 - DNA, 14 bp, Homo sapiens
gttccccatgcaga

SEQ ID NO: 3445198 - DNA, 22 bp, Homo sapiens
gttcccctcctccactctcccc

SEQ ID NO: 3445199 - DNA, 15 bp, Homo sapiens
gttccccttccactg

SEQ ID NO: 3445200 - DNA, 22 bp, Homo sapiens
gttccctatttttctctcctgt

SEQ ID NO: 3445201 - DNA, 15 bp, Homo sapiens
gttcctagagtagag

SEQ ID NO: 3445202 - DNA, 22 bp, Homo sapiens
gttcctcattagcattttgcta

SEQ ID NO: 3445203 - DNA, 14 bp, Homo sapiens
gttcctggcagttt

SEQ ID NO: 3445204 - DNA, 14 bp, Homo sapiens
gttcctgtccctgc

SEQ ID NO: 3445205 - DNA, 21 bp, Homo sapiens
gttccttccgatgacagtgct

SEQ ID NO: 3445206 - DNA, 23 bp, Homo sapiens
gttccttgatctgtatatacaat

SEQ ID NO: 3445207 - DNA, 20 bp, Homo sapiens
gttcgcatggtcacacactg

SEQ ID NO: 3445208 - DNA, 15 bp, Homo sapiens
gttcgcctggagccc

SEQ ID NO: 3445209 - DNA, 16 bp, Homo sapiens
gttcgcctggagccct

SEQ ID NO: 3445210 - DNA, 18 bp, Homo sapiens
gttcggatttggggtgga

SEQ ID NO: 3445211 - DNA, 16 bp, Homo sapiens
gttcgggtgtgcaatg

SEQ ID NO: 3445212 - DNA, 19 bp, Homo sapiens
gttctaagtctttccattg

SEQ ID NO: 3445213 - DNA, 11 bp, Homo sapiens
gttctcatctt

SEQ ID NO: 3445214 - DNA, 16 bp, Homo sapiens
gttctcatctttcttg

SEQ ID NO: 3445215 - DNA, 19 bp, Homo sapiens
gttctcattcctgttcttt

SEQ ID NO: 3445216 - DNA, 16 bp, Homo sapiens
gttctctcctccccaa

SEQ ID NO: 3445217 - DNA, 12 bp, Homo sapiens
gttctctgagga

SEQ ID NO: 3445218 - DNA, 20 bp, Homo sapiens
gttctctgggagaaaatcat

SEQ ID NO: 3445219 - DNA, 13 bp, Homo sapiens
gttctgacttgac

SEQ ID NO: 3445220 - DNA, 17 bp, Homo sapiens
gttctgagagaaaaaga

SEQ ID NO: 3445221 - DNA, 17 bp, Homo sapiens
gttctgatgatgtgcct

SEQ ID NO: 3445222 - DNA, 16 bp, Homo sapiens
gttctgcaaaaatatt

SEQ ID NO: 3445223 - DNA, 11 bp, Homo sapiens
gttctgcctct

SEQ ID NO: 3445224 - DNA, 23 bp, Homo sapiens
gttctgcctgccagctgcactga

SEQ ID NO: 3445225 - DNA, 11 bp, Homo sapiens
gttctgcctta

SEQ ID NO: 3445226 - DNA, 15 bp, Homo sapiens
gttctgctcatcatt

SEQ ID NO: 3445227 - DNA, 23 bp, Homo sapiens
gttctgctcatcattctctgtct

SEQ ID NO: 3445228 - DNA, 12 bp, Homo sapiens
gttctggccaga

SEQ ID NO: 3445229 - DNA, 13 bp, Homo sapiens
gttctggccagaa

SEQ ID NO: 3445230 - DNA, 14 bp, Homo sapiens
gttctgggacacag

SEQ ID NO: 3445231 - DNA, 17 bp, Homo sapiens
gttctgggttttctgaa

SEQ ID NO: 3445232 - DNA, 16 bp, Homo sapiens
gttctgtacttagaaa

SEQ ID NO: 3445233 - DNA, 11 bp, Homo sapiens
gttctgtgcac

SEQ ID NO: 3445234 - DNA, 22 bp, Homo sapiens
gttctgtttgttattgttttgt

SEQ ID NO: 3445235 - DNA, 23 bp, Homo sapiens
gttctgtttgttattgttttgtt

SEQ ID NO: 3445236 - DNA, 20 bp, Homo sapiens
gttctttccataataaaagg

SEQ ID NO: 3445237 - DNA, 15 bp, Homo sapiens
gttctttgggccaga

SEQ ID NO: 3445238 - DNA, 16 bp, Homo sapiens
gttctttgggccagac

SEQ ID NO: 3445239 - DNA, 13 bp, Homo sapiens
gttctttgttcat

SEQ ID NO: 3445240 - DNA, 22 bp, Homo sapiens
gttgaagggaggtggcaagagt

SEQ ID NO: 3445241 - DNA, 21 bp, Homo sapiens
gttgaattttgttctctggga

SEQ ID NO: 3445242 - DNA, 15 bp, Homo sapiens
gttgacaattctgca

SEQ ID NO: 3445243 - DNA, 18 bp, Homo sapiens
gttgacatatttaatgtt

SEQ ID NO: 3445244 - DNA, 19 bp, Homo sapiens
gttgacatatttaatgttt

SEQ ID NO: 3445245 - DNA, 22 bp, Homo sapiens
gttgacatatttaatgttttaa

SEQ ID NO: 3445246 - DNA, 22 bp, Homo sapiens
gttgaccatgtctatgattcgt

SEQ ID NO: 3445247 - DNA, 16 bp, Homo sapiens
gttgagaaggtgcctg

SEQ ID NO: 3445248 - DNA, 18 bp, Homo sapiens
gttgagaaggtgcctgcc

SEQ ID NO: 3445249 - DNA, 16 bp, Homo sapiens
gttgagaatcccaaat

SEQ ID NO: 3445250 - DNA, 19 bp, Homo sapiens
gttgagcatgacagcctgc

SEQ ID NO: 3445251 - DNA, 17 bp, Homo sapiens
gttgagggaaagagctt

SEQ ID NO: 3445252 - DNA, 22 bp, Homo sapiens
gttgagttcaggtagctgcccc

SEQ ID NO: 3445253 - DNA, 22 bp, Homo sapiens
gttgatagcaagtgaatttttc

SEQ ID NO: 3445254 - DNA, 20 bp, Homo sapiens
gttgatatttcgaaagctgc

SEQ ID NO: 3445255 - DNA, 22 bp, Homo sapiens
gttgatcatgtactttttagta

SEQ ID NO: 3445256 - DNA, 15 bp, Homo sapiens
gttgatccatccagc

SEQ ID NO: 3445257 - DNA, 19 bp, Homo sapiens
gttgcacttatgatttcat

SEQ ID NO: 3445258 - DNA, 15 bp, Homo sapiens
gttgcaggacctcag

SEQ ID NO: 3445259 - DNA, 15 bp, Homo sapiens
gttgcagtgagctga

SEQ ID NO: 3445260 - DNA, 19 bp, Homo sapiens
gttgccaagctccaagccc

SEQ ID NO: 3445261 - DNA, 13 bp, Homo sapiens
gttgccacaggac

SEQ ID NO: 3445262 - DNA, 24 bp, Homo sapiens
gttgccattattctatgtagtggt

SEQ ID NO: 3445263 - DNA, 23 bp, Homo sapiens
gttgcccaggcaggtcttgaact

SEQ ID NO: 3445264 - DNA, 13 bp, Homo sapiens
gttgcccaggctg

SEQ ID NO: 3445265 - DNA, 15 bp, Homo sapiens
gttgcccaggctggc

SEQ ID NO: 3445266 - DNA, 16 bp, Homo sapiens
gttgccccgtctctgt

SEQ ID NO: 3445267 - DNA, 17 bp, Homo sapiens
gttgccccgtctctgtt

SEQ ID NO: 3445268 - DNA, 19 bp, Homo sapiens
gttgcccctttctcttttc

SEQ ID NO: 3445269 - DNA, 13 bp, Homo sapiens
gttgctgaatagg

SEQ ID NO: 3445270 - DNA, 20 bp, Homo sapiens
gttgctggttataagcagca

SEQ ID NO: 3445271 - DNA, 17 bp, Homo sapiens
gttggaccagaggaagc

SEQ ID NO: 3445272 - DNA, 16 bp, Homo sapiens
gttggaggagagagcc

SEQ ID NO: 3445273 - DNA, 14 bp, Homo sapiens
gttggcaaaaaggc

SEQ ID NO: 3445274 - DNA, 16 bp, Homo sapiens
gttggcaggctggcca

SEQ ID NO: 3445275 - DNA, 23 bp, Homo sapiens
gttggccaaagccaaagctaggc

SEQ ID NO: 3445276 - DNA, 19 bp, Homo sapiens
gttggccaggctggtctca

SEQ ID NO: 3445277 - DNA, 12 bp, Homo sapiens
gttggctggggg

SEQ ID NO: 3445278 - DNA, 19 bp, Homo sapiens
gttggctgggggcctcagt

SEQ ID NO: 3445279 - DNA, 13 bp, Homo sapiens
gttgggctggtgt

SEQ ID NO: 3445280 - DNA, 13 bp, Homo sapiens
gttgggtggatgc

SEQ ID NO: 3445281 - DNA, 13 bp, Homo sapiens
gttggtagtttct

SEQ ID NO: 3445282 - DNA, 14 bp, Homo sapiens
gttggtcctctctc

SEQ ID NO: 3445283 - DNA, 16 bp, Homo sapiens
gttggtcggtgggttg

SEQ ID NO: 3445284 - DNA, 22 bp, Homo sapiens
gttggttgaattttttttaatg

SEQ ID NO: 3445285 - DNA, 14 bp, Homo sapiens
gttggttggataag

SEQ ID NO: 3445286 - DNA, 17 bp, Homo sapiens
gttgtaattttactttt

SEQ ID NO: 3445287 - DNA, 14 bp, Homo sapiens
gttgtacttcattt

SEQ ID NO: 3445288 - DNA, 15 bp, Homo sapiens
gttgtattagatgtt

SEQ ID NO: 3445289 - DNA, 22 bp, Homo sapiens
gttgtcaagtctctgctggccc

SEQ ID NO: 3445290 - DNA, 13 bp, Homo sapiens
gttgtgtttggat

SEQ ID NO: 3445291 - DNA, 21 bp, Homo sapiens
gttgttactaactaaactctc

SEQ ID NO: 3445292 - DNA, 12 bp, Homo sapiens
gttgttgtagta

SEQ ID NO: 3445293 - DNA, 13 bp, Homo sapiens
gtttaaaaataca

SEQ ID NO: 3445294 - DNA, 17 bp, Homo sapiens
gtttaaaaatacacatg

SEQ ID NO: 3445295 - DNA, 19 bp, Homo sapiens
gtttaatccccagtaaaat

SEQ ID NO: 3445296 - DNA, 21 bp, Homo sapiens
gtttaatccccagtaaaattg

SEQ ID NO: 3445297 - DNA, 14 bp, Homo sapiens
gtttaatctgttat

SEQ ID NO: 3445298 - DNA, 15 bp, Homo sapiens
gtttacaatttacaa

SEQ ID NO: 3445299 - DNA, 16 bp, Homo sapiens
gtttacaatttacaaa

SEQ ID NO: 3445300 - DNA, 18 bp, Homo sapiens
gtttacaggatattccaa

SEQ ID NO: 3445301 - DNA, 17 bp, Homo sapiens
gtttactatgcctgtgt

SEQ ID NO: 3445302 - DNA, 20 bp, Homo sapiens
gtttactatgcctgtgtctt

SEQ ID NO: 3445303 - DNA, 17 bp, Homo sapiens
gtttagcagcagccttt

SEQ ID NO: 3445304 - DNA, 18 bp, Homo sapiens
gtttaggctggtggccca

SEQ ID NO: 3445305 - DNA, 21 bp, Homo sapiens
gtttaggctggtggcccagga

SEQ ID NO: 3445306 - DNA, 16 bp, Homo sapiens
gtttcaaaataaaaac

SEQ ID NO: 3445307 - DNA, 19 bp, Homo sapiens
gtttcaaaataaaaaccaa

SEQ ID NO: 3445308 - DNA, 19 bp, Homo sapiens
gtttcagagatggacagag

SEQ ID NO: 3445309 - DNA, 18 bp, Homo sapiens
gtttcagcgactccgttg

SEQ ID NO: 3445310 - DNA, 20 bp, Homo sapiens
gtttccagacttccttgaga

SEQ ID NO: 3445311 - DNA, 17 bp, Homo sapiens
gtttccagcagaagaca

SEQ ID NO: 3445312 - DNA, 21 bp, Homo sapiens
gtttcccccaacatataaaat

SEQ ID NO: 3445313 - DNA, 17 bp, Homo sapiens
gtttcctgacattgtct

SEQ ID NO: 3445314 - DNA, 17 bp, Homo sapiens
gtttccttccctaccca

SEQ ID NO: 3445315 - DNA, 23 bp, Homo sapiens
gtttccttccctacccagtcccc

SEQ ID NO: 3445316 - DNA, 15 bp, Homo sapiens
gtttccttttttccc

SEQ ID NO: 3445317 - DNA, 16 bp, Homo sapiens
gtttctggaaatgttc

SEQ ID NO: 3445318 - DNA, 23 bp, Homo sapiens
gtttctggaaatgttctttagat

SEQ ID NO: 3445319 - DNA, 14 bp, Homo sapiens
gtttctggtctcta

SEQ ID NO: 3445320 - DNA, 14 bp, Homo sapiens
gtttgaaattctga

SEQ ID NO: 3445321 - DNA, 15 bp, Homo sapiens
gtttgaaattctgaa

SEQ ID NO: 3445322 - DNA, 22 bp, Homo sapiens
gtttgaaattctgaatttgcaa

SEQ ID NO: 3445323 - DNA, 12 bp, Homo sapiens
gtttgaagctgc

SEQ ID NO: 3445324 - DNA, 13 bp, Homo sapiens
gtttgaagctgct

SEQ ID NO: 3445325 - DNA, 16 bp, Homo sapiens
gtttgaagctgctgtc

SEQ ID NO: 3445326 - DNA, 17 bp, Homo sapiens
gtttgaatgttaaataa

SEQ ID NO: 3445327 - DNA, 17 bp, Homo sapiens
gtttgaccaatttgcac

SEQ ID NO: 3445328 - DNA, 18 bp, Homo sapiens
gtttgagatcagcctggg

SEQ ID NO: 3445329 - DNA, 14 bp, Homo sapiens
gtttgattgtttac

SEQ ID NO: 3445330 - DNA, 15 bp, Homo sapiens
gtttgattgtttaca

SEQ ID NO: 3445331 - DNA, 18 bp, Homo sapiens
gtttgattgtttacagga

SEQ ID NO: 3445332 - DNA, 17 bp, Homo sapiens
gtttgcactatctttca

SEQ ID NO: 3445333 - DNA, 15 bp, Homo sapiens
gtttgccggatacaa

SEQ ID NO: 3445334 - DNA, 21 bp, Homo sapiens
gtttgctttctgatcaaggcc

SEQ ID NO: 3445335 - DNA, 21 bp, Homo sapiens
gtttggaggagcaaaggctga

SEQ ID NO: 3445336 - DNA, 14 bp, Homo sapiens
gtttggcctccatc

SEQ ID NO: 3445337 - DNA, 15 bp, Homo sapiens
gtttggcctccatcc

SEQ ID NO: 3445338 - DNA, 18 bp, Homo sapiens
gtttggtattgtatttat

SEQ ID NO: 3445339 - DNA, 14 bp, Homo sapiens
gtttggttttacat

SEQ ID NO: 3445340 - DNA, 15 bp, Homo sapiens
gtttgtaacttttta

SEQ ID NO: 3445341 - DNA, 19 bp, Homo sapiens
gtttgtattgtaaaaaatt

SEQ ID NO: 3445342 - DNA, 13 bp, Homo sapiens
gtttgtcattagc

SEQ ID NO: 3445343 - DNA, 21 bp, Homo sapiens
gtttgtcattagcctgagtag

SEQ ID NO: 3445344 - DNA, 22 bp, Homo sapiens
gtttgtcctgatgcttttgtct

SEQ ID NO: 3445345 - DNA, 19 bp, Homo sapiens
gtttgttaaaaataaatcc

SEQ ID NO: 3445346 - DNA, 23 bp, Homo sapiens
gtttgttggatccgtttgaccaa

SEQ ID NO: 3445347 - DNA, 16 bp, Homo sapiens
gtttgtttttcaaagc

SEQ ID NO: 3445348 - DNA, 22 bp, Homo sapiens
gttttaaagacctgacaccttt

SEQ ID NO: 3445349 - DNA, 14 bp, Homo sapiens
gttttaaatgtaca

SEQ ID NO: 3445350 - DNA, 14 bp, Homo sapiens
gttttaacaaaaac

SEQ ID NO: 3445351 - DNA, 22 bp, Homo sapiens
gttttaagtgaaagtgaggaaa

SEQ ID NO: 3445352 - DNA, 12 bp, Homo sapiens
gttttacattgt

SEQ ID NO: 3445353 - DNA, 15 bp, Homo sapiens
gttttactgcagctt

SEQ ID NO: 3445354 - DNA, 16 bp, Homo sapiens
gttttaggatacttaa

SEQ ID NO: 3445355 - DNA, 18 bp, Homo sapiens
gttttaggatacttaaca

SEQ ID NO: 3445356 - DNA, 20 bp, Homo sapiens
gttttaggatacttaacaaa

SEQ ID NO: 3445357 - DNA, 16 bp, Homo sapiens
gttttaggtagaaaaa

SEQ ID NO: 3445358 - DNA, 17 bp, Homo sapiens
gttttaggtagaaaaac

SEQ ID NO: 3445359 - DNA, 13 bp, Homo sapiens
gttttatttccta

SEQ ID NO: 3445360 - DNA, 20 bp, Homo sapiens
gttttcccttgaggaaacaa

SEQ ID NO: 3445361 - DNA, 17 bp, Homo sapiens
gttttcctatgctttga

SEQ ID NO: 3445362 - DNA, 21 bp, Homo sapiens
gttttcctatgctttgaaaca

SEQ ID NO: 3445363 - DNA, 13 bp, Homo sapiens
gttttcctccctt

SEQ ID NO: 3445364 - DNA, 12 bp, Homo sapiens
gttttctcttga

SEQ ID NO: 3445365 - DNA, 19 bp, Homo sapiens
gttttctcttgagagggtg

SEQ ID NO: 3445366 - DNA, 19 bp, Homo sapiens
gttttcttgttgctttgtt

SEQ ID NO: 3445367 - DNA, 22 bp, Homo sapiens
gttttcttgttgctttgttgca

SEQ ID NO: 3445368 - DNA, 18 bp, Homo sapiens
gttttctttcctcctttc

SEQ ID NO: 3445369 - DNA, 15 bp, Homo sapiens
gttttgaaggcaaaa

SEQ ID NO: 3445370 - DNA, 20 bp, Homo sapiens
gttttggctgaaattctcct

SEQ ID NO: 3445371 - DNA, 15 bp, Homo sapiens
gttttgtaccagtga

SEQ ID NO: 3445372 - DNA, 19 bp, Homo sapiens
gttttgtaccagtgaattt

SEQ ID NO: 3445373 - DNA, 14 bp, Homo sapiens
gttttgtagcagtg

SEQ ID NO: 3445374 - DNA, 15 bp, Homo sapiens
gttttgtattctctg

SEQ ID NO: 3445375 - DNA, 20 bp, Homo sapiens
gttttgttcccctcctccac

SEQ ID NO: 3445376 - DNA, 21 bp, Homo sapiens
gttttgttcccctcctccact

SEQ ID NO: 3445377 - DNA, 17 bp, Homo sapiens
gttttgtttattaaata

SEQ ID NO: 3445378 - DNA, 20 bp, Homo sapiens
gttttgtttggcaaggaaag

SEQ ID NO: 3445379 - DNA, 19 bp, Homo sapiens
gttttgtttggttttacat

SEQ ID NO: 3445380 - DNA, 19 bp, Homo sapiens
gtttttaaaaaatgttttc

SEQ ID NO: 3445381 - DNA, 13 bp, Homo sapiens
gtttttaagctgt

SEQ ID NO: 3445382 - DNA, 19 bp, Homo sapiens
gtttttaagctgtttccat

SEQ ID NO: 3445383 - DNA, 16 bp, Homo sapiens
gtttttccactactgc

SEQ ID NO: 3445384 - DNA, 18 bp, Homo sapiens
gtttttccactactgcta

SEQ ID NO: 3445385 - DNA, 15 bp, Homo sapiens
gtttttgcacatgtt

SEQ ID NO: 3445386 - DNA, 21 bp, Homo sapiens
gttttttaaaatatttatctg

SEQ ID NO: 3445387 - DNA, 15 bp, Homo sapiens
gttttttcaaaatag

SEQ ID NO: 3445388 - DNA, 20 bp, Homo sapiens
gttttttcctcagtgcattt

SEQ ID NO: 3445389 - DNA, 16 bp, Homo sapiens
gttttttcctttgctc

SEQ ID NO: 3445390 - DNA, 19 bp, Homo sapiens
gtttttttgtatagtaaag

SEQ ID NO: 3445391 - DNA, 18 bp, Homo sapiens
taaaaaaaacaaaaagaa

SEQ ID NO: 3445392 - DNA, 21 bp, Homo sapiens
taaaaaaaacaaaaagaacaa

SEQ ID NO: 3445393 - DNA, 17 bp, Homo sapiens
taaaaaaagaagagaaa

SEQ ID NO: 3445394 - DNA, 14 bp, Homo sapiens
taaaaaaatggcag

SEQ ID NO: 3445395 - DNA, 13 bp, Homo sapiens
taaaaaaattggt

SEQ ID NO: 3445396 - DNA, 20 bp, Homo sapiens
taaaaaactgctgactgttt

SEQ ID NO: 3445397 - DNA, 23 bp, Homo sapiens
taaaaaactgctgactgttttct

SEQ ID NO: 3445398 - DNA, 16 bp, Homo sapiens
taaaaaagcaaggcac

SEQ ID NO: 3445399 - DNA, 18 bp, Homo sapiens
taaaaaatattttctctg

SEQ ID NO: 3445400 - DNA, 14 bp, Homo sapiens
taaaaaatgttttc

SEQ ID NO: 3445401 - DNA, 19 bp, Homo sapiens
taaaaaattcacataataa

SEQ ID NO: 3445402 - DNA, 14 bp, Homo sapiens
taaaaactttgcta

SEQ ID NO: 3445403 - DNA, 15 bp, Homo sapiens
taaaaagtctgtatg

SEQ ID NO: 3445404 - DNA, 17 bp, Homo sapiens
taaaaataaatttggtt

SEQ ID NO: 3445405 - DNA, 15 bp, Homo sapiens
taaaaatataaaact

SEQ ID NO: 3445406 - DNA, 15 bp, Homo sapiens
taaaaatcaactttt

SEQ ID NO: 3445407 - DNA, 23 bp, Homo sapiens
taaaaatctgagaaactctacat

SEQ ID NO: 3445408 - DNA, 16 bp, Homo sapiens
taaaaatgcaaatcct

SEQ ID NO: 3445409 - DNA, 23 bp, Homo sapiens
taaaaatggaaaaataaacacta

SEQ ID NO: 3445410 - DNA, 21 bp, Homo sapiens
taaaacaaaacaaaacaacat

SEQ ID NO: 3445411 - DNA, 14 bp, Homo sapiens
taaaacaaaatttg

SEQ ID NO: 3445412 - DNA, 15 bp, Homo sapiens
taaaacaacactcac

SEQ ID NO: 3445413 - DNA, 17 bp, Homo sapiens
taaaacagcattagata

SEQ ID NO: 3445414 - DNA, 14 bp, Homo sapiens
taaaacagtatctc

SEQ ID NO: 3445415 - DNA, 16 bp, Homo sapiens
taaaacagtatctctt

SEQ ID NO: 3445416 - DNA, 17 bp, Homo sapiens
taaaacatcattactat

SEQ ID NO: 3445417 - DNA, 14 bp, Homo sapiens
taaaacattaagaa

SEQ ID NO: 3445418 - DNA, 13 bp, Homo sapiens
taaaacccaagtg

SEQ ID NO: 3445419 - DNA, 17 bp, Homo sapiens
taaaactggctttggct

SEQ ID NO: 3445420 - DNA, 20 bp, Homo sapiens
taaaacttctcaagatactg

SEQ ID NO: 3445421 - DNA, 14 bp, Homo sapiens
taaaactttgctgc

SEQ ID NO: 3445422 - DNA, 13 bp, Homo sapiens
taaaagaagcttt

SEQ ID NO: 3445423 - DNA, 20 bp, Homo sapiens
taaaagacaaatcaaagcag

SEQ ID NO: 3445424 - DNA, 19 bp, Homo sapiens
taaaagagagagagagaaa

SEQ ID NO: 3445425 - DNA, 16 bp, Homo sapiens
taaaagatataagtgc

SEQ ID NO: 3445426 - DNA, 19 bp, Homo sapiens
taaaagatataagtgctgt

SEQ ID NO: 3445427 - DNA, 21 bp, Homo sapiens
taaaagatataagtgctgtat

SEQ ID NO: 3445428 - DNA, 22 bp, Homo sapiens
taaaagatataagtgctgtata

SEQ ID NO: 3445429 - DNA, 14 bp, Homo sapiens
taaaagatgctttt

SEQ ID NO: 3445430 - DNA, 20 bp, Homo sapiens
taaaagatggggtctgtaaa

SEQ ID NO: 3445431 - DNA, 20 bp, Homo sapiens
taaaagatgtctctgcaaac

SEQ ID NO: 3445432 - DNA, 19 bp, Homo sapiens
taaaaggaagccaaagagt

SEQ ID NO: 3445433 - DNA, 12 bp, Homo sapiens
taaaaggagcca

SEQ ID NO: 3445434 - DNA, 20 bp, Homo sapiens
taaaaggccaaacctctgtt

SEQ ID NO: 3445435 - DNA, 22 bp, Homo sapiens
taaaagtgggcttgattctgca

SEQ ID NO: 3445436 - DNA, 12 bp, Homo sapiens
taaaagttcttt

SEQ ID NO: 3445437 - DNA, 23 bp, Homo sapiens
taaaataaatatatataaaccta

SEQ ID NO: 3445438 - DNA, 17 bp, Homo sapiens
taaaatagaatatagca

SEQ ID NO: 3445439 - DNA, 18 bp, Homo sapiens
taaaatagaatatagcat

SEQ ID NO: 3445440 - DNA, 17 bp, Homo sapiens
taaaatcaagttttaag

SEQ ID NO: 3445441 - DNA, 14 bp, Homo sapiens
taaaatcagccaat

SEQ ID NO: 3445442 - DNA, 17 bp, Homo sapiens
taaaatcagccaattat

SEQ ID NO: 3445443 - DNA, 23 bp, Homo sapiens
taaaatcagccaattatgttaaa

SEQ ID NO: 3445444 - DNA, 18 bp, Homo sapiens
taaaatctttctttctta

SEQ ID NO: 3445445 - DNA, 19 bp, Homo sapiens
taaaatctttctttcttag

SEQ ID NO: 3445446 - DNA, 22 bp, Homo sapiens
taaaatctttctttcttagaaa

SEQ ID NO: 3445447 - DNA, 18 bp, Homo sapiens
taaaatggatgccttgaa

SEQ ID NO: 3445448 - DNA, 18 bp, Homo sapiens
taaaatggctgtaatcat

SEQ ID NO: 3445449 - DNA, 16 bp, Homo sapiens
taaaatggtttgtcct

SEQ ID NO: 3445450 - DNA, 18 bp, Homo sapiens
taaaatggtttgtcctga

SEQ ID NO: 3445451 - DNA, 18 bp, Homo sapiens
taaaatgtaaagccatgc

SEQ ID NO: 3445452 - DNA, 23 bp, Homo sapiens
taaaatgtaaagccatgctggaa

SEQ ID NO: 3445453 - DNA, 17 bp, Homo sapiens
taaaatgtaacactgat

SEQ ID NO: 3445454 - DNA, 17 bp, Homo sapiens
taaaatgttgaaaagtc

SEQ ID NO: 3445455 - DNA, 19 bp, Homo sapiens
taaaatgttgaaaagtcaa

SEQ ID NO: 3445456 - DNA, 16 bp, Homo sapiens
taaaattagatgcatg

SEQ ID NO: 3445457 - DNA, 12 bp, Homo sapiens
taaaattgccat

SEQ ID NO: 3445458 - DNA, 14 bp, Homo sapiens
taaaattgccatat

SEQ ID NO: 3445459 - DNA, 18 bp, Homo sapiens
taaaattgccatattgca

SEQ ID NO: 3445460 - DNA, 19 bp, Homo sapiens
taaaattgccatattgcac

SEQ ID NO: 3445461 - DNA, 21 bp, Homo sapiens
taaaatttttttagaaagcat

SEQ ID NO: 3445462 - DNA, 16 bp, Homo sapiens
taaaattttttttcat

SEQ ID NO: 3445463 - DNA, 20 bp, Homo sapiens
taaaattttttttcatgttt

SEQ ID NO: 3445464 - DNA, 21 bp, Homo sapiens
taaacaatgctgatttggtga

SEQ ID NO: 3445465 - DNA, 12 bp, Homo sapiens
taaacacacaga

SEQ ID NO: 3445466 - DNA, 22 bp, Homo sapiens
taaacacacagatacacacaca

SEQ ID NO: 3445467 - DNA, 16 bp, Homo sapiens
taaacacttgcaacct

SEQ ID NO: 3445468 - DNA, 14 bp, Homo sapiens
taaacagatatctt

SEQ ID NO: 3445469 - DNA, 16 bp, Homo sapiens
taaacatgagaataaa

SEQ ID NO: 3445470 - DNA, 15 bp, Homo sapiens
taaaccaaggactga

SEQ ID NO: 3445471 - DNA, 22 bp, Homo sapiens
taaaccagaaaggtgattccag

SEQ ID NO: 3445472 - DNA, 16 bp, Homo sapiens
taaaccgccaaggctg

SEQ ID NO: 3445473 - DNA, 18 bp, Homo sapiens
taaaccgccaaggctggg

SEQ ID NO: 3445474 - DNA, 15 bp, Homo sapiens
taaacggattccaaa

SEQ ID NO: 3445475 - DNA, 16 bp, Homo sapiens
taaactccttcctggc

SEQ ID NO: 3445476 - DNA, 21 bp, Homo sapiens
taaactccttcctggcctgag

SEQ ID NO: 3445477 - DNA, 18 bp, Homo sapiens
taaactctctttgggaat

SEQ ID NO: 3445478 - DNA, 17 bp, Homo sapiens
taaactctgcatccaga

SEQ ID NO: 3445479 - DNA, 18 bp, Homo sapiens
taaactctgcatccagag

SEQ ID NO: 3445480 - DNA, 20 bp, Homo sapiens
taaactggtattttatcttt

SEQ ID NO: 3445481 - DNA, 12 bp, Homo sapiens
taaagaaaactg

SEQ ID NO: 3445482 - DNA, 19 bp, Homo sapiens
taaagaatacttgaacttg

SEQ ID NO: 3445483 - DNA, 19 bp, Homo sapiens
taaagaatatgacttttta

SEQ ID NO: 3445484 - DNA, 11 bp, Homo sapiens
taaagacaaag

SEQ ID NO: 3445485 - DNA, 20 bp, Homo sapiens
taaagacaaagacaaattct

SEQ ID NO: 3445486 - DNA, 22 bp, Homo sapiens
taaagacaaagacaaattctgt

SEQ ID NO: 3445487 - DNA, 18 bp, Homo sapiens
taaagacaatcactgcca

SEQ ID NO: 3445488 - DNA, 15 bp, Homo sapiens
taaagacagaggcag

SEQ ID NO: 3445489 - DNA, 20 bp, Homo sapiens
taaagaggcgttgctttcac

SEQ ID NO: 3445490 - DNA, 12 bp, Homo sapiens
taaagcatttat

SEQ ID NO: 3445491 - DNA, 23 bp, Homo sapiens
taaaggagcatttttttattcag

SEQ ID NO: 3445492 - DNA, 19 bp, Homo sapiens
taaaggctcgattttgtat

SEQ ID NO: 3445493 - DNA, 17 bp, Homo sapiens
taaaggttgtgaatgtt

SEQ ID NO: 3445494 - DNA, 15 bp, Homo sapiens
taaagtatagaaata

SEQ ID NO: 3445495 - DNA, 16 bp, Homo sapiens
taaagtatagaaatat

SEQ ID NO: 3445496 - DNA, 12 bp, Homo sapiens
taaagtatttaa

SEQ ID NO: 3445497 - DNA, 14 bp, Homo sapiens
taaagtatttaatt

SEQ ID NO: 3445498 - DNA, 17 bp, Homo sapiens
taaagtatttaattagt

SEQ ID NO: 3445499 - DNA, 19 bp, Homo sapiens
taaagtatttaattagtgc

SEQ ID NO: 3445500 - DNA, 22 bp, Homo sapiens
taaagtgaattgttgacaaatg

SEQ ID NO: 3445501 - DNA, 17 bp, Homo sapiens
taaagtgtttagctgtc

SEQ ID NO: 3445502 - DNA, 13 bp, Homo sapiens
taaagttatattt

SEQ ID NO: 3445503 - DNA, 16 bp, Homo sapiens
taaagttggttggata

SEQ ID NO: 3445504 - DNA, 14 bp, Homo sapiens
taaagttgtaacaa

SEQ ID NO: 3445505 - DNA, 15 bp, Homo sapiens
taaagtttttttcct

SEQ ID NO: 3445506 - DNA, 21 bp, Homo sapiens
taaagtttttttccttaaaaa

SEQ ID NO: 3445507 - DNA, 18 bp, Homo sapiens
taaataaaagttttacaa

SEQ ID NO: 3445508 - DNA, 22 bp, Homo sapiens
taaataaaagttttacaaaggg

SEQ ID NO: 3445509 - DNA, 22 bp, Homo sapiens
taaataaatgtatcttattcac

SEQ ID NO: 3445510 - DNA, 15 bp, Homo sapiens
taaataaattgtata

SEQ ID NO: 3445511 - DNA, 20 bp, Homo sapiens
taaataaattgtatattcac

SEQ ID NO: 3445512 - DNA, 18 bp, Homo sapiens
taaataatctgtgagtga

SEQ ID NO: 3445513 - DNA, 22 bp, Homo sapiens
taaataatctgtgagtgaaagt

SEQ ID NO: 3445514 - DNA, 22 bp, Homo sapiens
taaatacagtcttccatttgca

SEQ ID NO: 3445515 - DNA, 22 bp, Homo sapiens
taaatacatgtatttaaaaaaa

SEQ ID NO: 3445516 - DNA, 18 bp, Homo sapiens
taaatagagtatatgcac

SEQ ID NO: 3445517 - DNA, 11 bp, Homo sapiens
taaatatatat

SEQ ID NO: 3445518 - DNA, 13 bp, Homo sapiens
taaatatatataa

SEQ ID NO: 3445519 - DNA, 14 bp, Homo sapiens
taaatatatataaa

SEQ ID NO: 3445520 - DNA, 17 bp, Homo sapiens
taaatatatataaacct

SEQ ID NO: 3445521 - DNA, 19 bp, Homo sapiens
taaatatatattattctca

SEQ ID NO: 3445522 - DNA, 20 bp, Homo sapiens
taaatatatattattctcat

SEQ ID NO: 3445523 - DNA, 22 bp, Homo sapiens
taaatatatattattctcattt

SEQ ID NO: 3445524 - DNA, 23 bp, Homo sapiens
taaatatatattattctcattta

SEQ ID NO: 3445525 - DNA, 23 bp, Homo sapiens
taaatatgaatctgctcacttta

SEQ ID NO: 3445526 - DNA, 22 bp, Homo sapiens
taaatcagatgttttggtcaag

SEQ ID NO: 3445527 - DNA, 19 bp, Homo sapiens
taaatcagccgtgtaacca

SEQ ID NO: 3445528 - DNA, 14 bp, Homo sapiens
taaatctgacccag

SEQ ID NO: 3445529 - DNA, 14 bp, Homo sapiens
taaatcttttacaa

SEQ ID NO: 3445530 - DNA, 18 bp, Homo sapiens
taaatgtacagacatatt

SEQ ID NO: 3445531 - DNA, 19 bp, Homo sapiens
taaatgtgatgaatactgt

SEQ ID NO: 3445532 - DNA, 21 bp, Homo sapiens
taaatgtgcattcttttaaaa

SEQ ID NO: 3445533 - DNA, 13 bp, Homo sapiens
taaattacaattt

SEQ ID NO: 3445534 - DNA, 23 bp, Homo sapiens
taaattacaattttatctgtttc

SEQ ID NO: 3445535 - DNA, 18 bp, Homo sapiens
taaattcactttcatttt

SEQ ID NO: 3445536 - DNA, 14 bp, Homo sapiens
taaattcctctttg

SEQ ID NO: 3445537 - DNA, 17 bp, Homo sapiens
taaattcctctttgctt

SEQ ID NO: 3445538 - DNA, 20 bp, Homo sapiens
taaattcttaatgttcacat

SEQ ID NO: 3445539 - DNA, 15 bp, Homo sapiens
taaattgccataata

SEQ ID NO: 3445540 - DNA, 19 bp, Homo sapiens
taaattgccataatatgat

SEQ ID NO: 3445541 - DNA, 16 bp, Homo sapiens
taaattgctaatgttg

SEQ ID NO: 3445542 - DNA, 14 bp, Homo sapiens
taaattttgtaatg

SEQ ID NO: 3445543 - DNA, 22 bp, Homo sapiens
taacaaatacattcaaattctt

SEQ ID NO: 3445544 - DNA, 22 bp, Homo sapiens
taacaacgtctttttgtttgtt

SEQ ID NO: 3445545 - DNA, 14 bp, Homo sapiens
taacaatcagctcc

SEQ ID NO: 3445546 - DNA, 20 bp, Homo sapiens
taacaattaggcagactctt

SEQ ID NO: 3445547 - DNA, 15 bp, Homo sapiens
taacaattgtgaagt

SEQ ID NO: 3445548 - DNA, 13 bp, Homo sapiens
taacacacagcta

SEQ ID NO: 3445549 - DNA, 15 bp, Homo sapiens
taacacacagctccc

SEQ ID NO: 3445550 - DNA, 13 bp, Homo sapiens
taacactgatgat

SEQ ID NO: 3445551 - DNA, 13 bp, Homo sapiens
taacactgtttat

SEQ ID NO: 3445552 - DNA, 15 bp, Homo sapiens
taacactttacaatg

SEQ ID NO: 3445553 - DNA, 13 bp, Homo sapiens
taacagctcagga

SEQ ID NO: 3445554 - DNA, 14 bp, Homo sapiens
taacagctcaggat

SEQ ID NO: 3445555 - DNA, 17 bp, Homo sapiens
taacataataaattaaa

SEQ ID NO: 3445556 - DNA, 21 bp, Homo sapiens
taacatatgcagtgttctaca

SEQ ID NO: 3445557 - DNA, 18 bp, Homo sapiens
taacatgaggggacattt

SEQ ID NO: 3445558 - DNA, 18 bp, Homo sapiens
taacatttaatttagata

SEQ ID NO: 3445559 - DNA, 19 bp, Homo sapiens
taacatttaatttagatat

SEQ ID NO: 3445560 - DNA, 11 bp, Homo sapiens
taaccaaaggt

SEQ ID NO: 3445561 - DNA, 17 bp, Homo sapiens
taaccaaaggtgaagga

SEQ ID NO: 3445562 - DNA, 17 bp, Homo sapiens
taaccactgcaagtcct

SEQ ID NO: 3445563 - DNA, 18 bp, Homo sapiens
taaccactgcaagtcctt

SEQ ID NO: 3445564 - DNA, 16 bp, Homo sapiens
taaccacttcagctga

SEQ ID NO: 3445565 - DNA, 22 bp, Homo sapiens
taaccagatctagtcaatcaag

SEQ ID NO: 3445566 - DNA, 17 bp, Homo sapiens
taaccatcactggttgc

SEQ ID NO: 3445567 - DNA, 18 bp, Homo sapiens
taacccttcatcttcctg

SEQ ID NO: 3445568 - DNA, 18 bp, Homo sapiens
taacctcatcttcttcac

SEQ ID NO: 3445569 - DNA, 14 bp, Homo sapiens
taacctcgccctct

SEQ ID NO: 3445570 - DNA, 12 bp, Homo sapiens
taacctcttttt

SEQ ID NO: 3445571 - DNA, 20 bp, Homo sapiens
taacggtttaattctgtctt

SEQ ID NO: 3445572 - DNA, 17 bp, Homo sapiens
taactaaactctctttg

SEQ ID NO: 3445573 - DNA, 19 bp, Homo sapiens
taactagatggtgctgaga

SEQ ID NO: 3445574 - DNA, 21 bp, Homo sapiens
taactagatggtgctgagaag

SEQ ID NO: 3445575 - DNA, 17 bp, Homo sapiens
taactagtgttgcttgg

SEQ ID NO: 3445576 - DNA, 14 bp, Homo sapiens
taactcccttttta

SEQ ID NO: 3445577 - DNA, 16 bp, Homo sapiens
taactccctttttaca

SEQ ID NO: 3445578 - DNA, 11 bp, Homo sapiens
taactctgtct

SEQ ID NO: 3445579 - DNA, 14 bp, Homo sapiens
taactctgtcttca

SEQ ID NO: 3445580 - DNA, 13 bp, Homo sapiens
taactgacaactt

SEQ ID NO: 3445581 - DNA, 19 bp, Homo sapiens
taactgagggctgatcttt

SEQ ID NO: 3445582 - DNA, 23 bp, Homo sapiens
taactgccatcaagatgagagaa

SEQ ID NO: 3445583 - DNA, 17 bp, Homo sapiens
taactggaaggctgctt

SEQ ID NO: 3445584 - DNA, 17 bp, Homo sapiens
taacttcttatggaatt

SEQ ID NO: 3445585 - DNA, 22 bp, Homo sapiens
taactttgtggtctaaagtgtt

SEQ ID NO: 3445586 - DNA, 14 bp, Homo sapiens
taactttttaaaaa

SEQ ID NO: 3445587 - DNA, 24 bp, Homo sapiens
taactttttaaaaaaataaaacag

SEQ ID NO: 3445588 - DNA, 23 bp, Homo sapiens
taagaaaaaccaaaatactccaa

SEQ ID NO: 3445589 - DNA, 21 bp, Homo sapiens
taagaaaatattttgtctaaa

SEQ ID NO: 3445590 - DNA, 23 bp, Homo sapiens
taagaaaatattttgtctaaaat

SEQ ID NO: 3445591 - DNA, 16 bp, Homo sapiens
taagaactaaagaaga

SEQ ID NO: 3445592 - DNA, 21 bp, Homo sapiens
taagaactacaaacaaaattt

SEQ ID NO: 3445593 - DNA, 17 bp, Homo sapiens
taagaaggcaaaaatgt

SEQ ID NO: 3445594 - DNA, 21 bp, Homo sapiens
taagaataaaatgttgaaaag

SEQ ID NO: 3445595 - DNA, 13 bp, Homo sapiens
taagaataattta

SEQ ID NO: 3445596 - DNA, 15 bp, Homo sapiens
taagaataatttata

SEQ ID NO: 3445597 - DNA, 14 bp, Homo sapiens
taagaatggaaaag

SEQ ID NO: 3445598 - DNA, 21 bp, Homo sapiens
taagaattagacatcttcaga

SEQ ID NO: 3445599 - DNA, 14 bp, Homo sapiens
taagaattcaaact

SEQ ID NO: 3445600 - DNA, 18 bp, Homo sapiens
taagaattcaaactgggg

SEQ ID NO: 3445601 - DNA, 22 bp, Homo sapiens
taagaattcaaactggggcctc

SEQ ID NO: 3445602 - DNA, 20 bp, Homo sapiens
taagacagagaaacagacag

SEQ ID NO: 3445603 - DNA, 21 bp, Homo sapiens
taagacagagaaacagacaga

SEQ ID NO: 3445604 - DNA, 19 bp, Homo sapiens
taagacagtcccatcaaaa

SEQ ID NO: 3445605 - DNA, 16 bp, Homo sapiens
taagacatgatttcct

SEQ ID NO: 3445606 - DNA, 17 bp, Homo sapiens
taagaccaccacctcag

SEQ ID NO: 3445607 - DNA, 17 bp, Homo sapiens
taagacctggcagctct

SEQ ID NO: 3445608 - DNA, 17 bp, Homo sapiens
taagacgtatgtaacat

SEQ ID NO: 3445609 - DNA, 21 bp, Homo sapiens
taagagacagtcaccccagga

SEQ ID NO: 3445610 - DNA, 22 bp, Homo sapiens
taagaggcagggtctcactctg

SEQ ID NO: 3445611 - DNA, 20 bp, Homo sapiens
taagagggcacacactgtgt

SEQ ID NO: 3445612 - DNA, 16 bp, Homo sapiens
taagatcactgccaga

SEQ ID NO: 3445613 - DNA, 19 bp, Homo sapiens
taagatgtctgtttgctga

SEQ ID NO: 3445614 - DNA, 12 bp, Homo sapiens
taagatttctgt

SEQ ID NO: 3445615 - DNA, 15 bp, Homo sapiens
taagcaacagaaata

SEQ ID NO: 3445616 - DNA, 16 bp, Homo sapiens
taagcagaggaggggc

SEQ ID NO: 3445617 - DNA, 17 bp, Homo sapiens
taagcagctaaattttc

SEQ ID NO: 3445618 - DNA, 17 bp, Homo sapiens
taagcatactttgtaaa

SEQ ID NO: 3445619 - DNA, 22 bp, Homo sapiens
taagcatatcgtaaagctgttc

SEQ ID NO: 3445620 - DNA, 15 bp, Homo sapiens
taagcatctacttca

SEQ ID NO: 3445621 - DNA, 17 bp, Homo sapiens
taagccacttaaaatgt

SEQ ID NO: 3445622 - DNA, 22 bp, Homo sapiens
taagccccagcaagcaatccta

SEQ ID NO: 3445623 - DNA, 16 bp, Homo sapiens
taagcctaaaagtggg

SEQ ID NO: 3445624 - DNA, 14 bp, Homo sapiens
taagcctgtggctg

SEQ ID NO: 3445625 - DNA, 18 bp, Homo sapiens
taagcctgtggctgtgga

SEQ ID NO: 3445626 - DNA, 22 bp, Homo sapiens
taagctgttactgtcttcagta

SEQ ID NO: 3445627 - DNA, 19 bp, Homo sapiens
taaggaaatcaacttgctt

SEQ ID NO: 3445628 - DNA, 17 bp, Homo sapiens
taaggatactttacatg

SEQ ID NO: 3445629 - DNA, 16 bp, Homo sapiens
taaggatgtagctttt

SEQ ID NO: 3445630 - DNA, 16 bp, Homo sapiens
taaggcgtggagctgc

SEQ ID NO: 3445631 - DNA, 20 bp, Homo sapiens
taagggttagtttacaatca

SEQ ID NO: 3445632 - DNA, 17 bp, Homo sapiens
taaggtgaggcctgtct

SEQ ID NO: 3445633 - DNA, 19 bp, Homo sapiens
taaggtgtagccacaccag

SEQ ID NO: 3445634 - DNA, 15 bp, Homo sapiens
taaggtgtgctctga

SEQ ID NO: 3445635 - DNA, 15 bp, Homo sapiens
taagtaagaaaatat

SEQ ID NO: 3445636 - DNA, 18 bp, Homo sapiens
taagtacctcagcattta

SEQ ID NO: 3445637 - DNA, 13 bp, Homo sapiens
taagtatttcaaa

SEQ ID NO: 3445638 - DNA, 23 bp, Homo sapiens
taagtcagggaagagcagtgctg

SEQ ID NO: 3445639 - DNA, 13 bp, Homo sapiens
taagtcatttaac

SEQ ID NO: 3445640 - DNA, 13 bp, Homo sapiens
taagtccctgtca

SEQ ID NO: 3445641 - DNA, 15 bp, Homo sapiens
taagtccctgtcacc

SEQ ID NO: 3445642 - DNA, 22 bp, Homo sapiens
taagtcttatcaagcagccaag

SEQ ID NO: 3445643 - DNA, 15 bp, Homo sapiens
taagtgaaaatctta

SEQ ID NO: 3445644 - DNA, 17 bp, Homo sapiens
taagtgaagtaaaactt

SEQ ID NO: 3445645 - DNA, 19 bp, Homo sapiens
taagtgctgtataaaatca

SEQ ID NO: 3445646 - DNA, 20 bp, Homo sapiens
taagtggtgcttagaaaatt

SEQ ID NO: 3445647 - DNA, 18 bp, Homo sapiens
taagtgtatttttcaata

SEQ ID NO: 3445648 - DNA, 14 bp, Homo sapiens
taagtgtgaactgg

SEQ ID NO: 3445649 - DNA, 15 bp, Homo sapiens
taagtgtgaactgga

SEQ ID NO: 3445650 - DNA, 15 bp, Homo sapiens
taagttattttacct

SEQ ID NO: 3445651 - DNA, 18 bp, Homo sapiens
taagttatttttgtacat

SEQ ID NO: 3445652 - DNA, 15 bp, Homo sapiens
taagttttttttctg

SEQ ID NO: 3445653 - DNA, 13 bp, Homo sapiens
taataaaccagtt

SEQ ID NO: 3445654 - DNA, 20 bp, Homo sapiens
taataaacgatgttgtgatg

SEQ ID NO: 3445655 - DNA, 21 bp, Homo sapiens
taataaacgatgttgtgatgt

SEQ ID NO: 3445656 - DNA, 13 bp, Homo sapiens
taataaagatgat

SEQ ID NO: 3445657 - DNA, 16 bp, Homo sapiens
taataaagatgattga

SEQ ID NO: 3445658 - DNA, 16 bp, Homo sapiens
taataacatttaattt

SEQ ID NO: 3445659 - DNA, 21 bp, Homo sapiens
taataatatacttgtggacta

SEQ ID NO: 3445660 - DNA, 23 bp, Homo sapiens
taataatcttattagggagaaaa

SEQ ID NO: 3445661 - DNA, 15 bp, Homo sapiens
taatactaccttgaa

SEQ ID NO: 3445662 - DNA, 12 bp, Homo sapiens
taatactatatt

SEQ ID NO: 3445663 - DNA, 14 bp, Homo sapiens
taatactgctgaga

SEQ ID NO: 3445664 - DNA, 21 bp, Homo sapiens
taatactggtatttttactta

SEQ ID NO: 3445665 - DNA, 22 bp, Homo sapiens
taatagattttttcagacttgt

SEQ ID NO: 3445666 - DNA, 23 bp, Homo sapiens
taatagattttttcagacttgtc

SEQ ID NO: 3445667 - DNA, 14 bp, Homo sapiens
taatagggaatata

SEQ ID NO: 3445668 - DNA, 16 bp, Homo sapiens
taatagggaatatatc

SEQ ID NO: 3445669 - DNA, 23 bp, Homo sapiens
taatagtttgaacagatatgttt

SEQ ID NO: 3445670 - DNA, 15 bp, Homo sapiens
taatatacttgtgga

SEQ ID NO: 3445671 - DNA, 16 bp, Homo sapiens
taatatctaaagttat

SEQ ID NO: 3445672 - DNA, 15 bp, Homo sapiens
taatatgaaaactta

SEQ ID NO: 3445673 - DNA, 14 bp, Homo sapiens
taatatgatgcaaa

SEQ ID NO: 3445674 - DNA, 14 bp, Homo sapiens
taatatttgctgac

SEQ ID NO: 3445675 - DNA, 17 bp, Homo sapiens
taatcattttcattcct

SEQ ID NO: 3445676 - DNA, 18 bp, Homo sapiens
taatcattttcattccta

SEQ ID NO: 3445677 - DNA, 21 bp, Homo sapiens
taatcccagcattttgggaag

SEQ ID NO: 3445678 - DNA, 14 bp, Homo sapiens
taatcccagctact

SEQ ID NO: 3445679 - DNA, 20 bp, Homo sapiens
taatccccagtaaaattgcc

SEQ ID NO: 3445680 - DNA, 19 bp, Homo sapiens
taatccccagttcgcctgg

SEQ ID NO: 3445681 - DNA, 17 bp, Homo sapiens
taatctagatatcgact

SEQ ID NO: 3445682 - DNA, 19 bp, Homo sapiens
taatctgtgagtgaaagtt

SEQ ID NO: 3445683 - DNA, 17 bp, Homo sapiens
taatcttgctttcttta

SEQ ID NO: 3445684 - DNA, 14 bp, Homo sapiens
taatctttcaaacc

SEQ ID NO: 3445685 - DNA, 21 bp, Homo sapiens
taatctttcaaaccagcttca

SEQ ID NO: 3445686 - DNA, 17 bp, Homo sapiens
taatgaagaaagtggaa

SEQ ID NO: 3445687 - DNA, 23 bp, Homo sapiens
taatgaagaaagtggaaaacaag

SEQ ID NO: 3445688 - DNA, 13 bp, Homo sapiens
taatgaagtttga

SEQ ID NO: 3445689 - DNA, 21 bp, Homo sapiens
taatgaagtttgaatgttaaa

SEQ ID NO: 3445690 - DNA, 17 bp, Homo sapiens
taatgacactgtttcct

SEQ ID NO: 3445691 - DNA, 18 bp, Homo sapiens
taatgacactgtttcctg

SEQ ID NO: 3445692 - DNA, 19 bp, Homo sapiens
taatgacactgtttcctga

SEQ ID NO: 3445693 - DNA, 11 bp, Homo sapiens
taatgaccaac

SEQ ID NO: 3445694 - DNA, 23 bp, Homo sapiens
taatgaccaacctgtttctacct

SEQ ID NO: 3445695 - DNA, 22 bp, Homo sapiens
taatgatgacaaaaaatgtttt

SEQ ID NO: 3445696 - DNA, 22 bp, Homo sapiens
taatgcatcatcatagaaaaac

SEQ ID NO: 3445697 - DNA, 20 bp, Homo sapiens
taatgctcacctttatcacc

SEQ ID NO: 3445698 - DNA, 19 bp, Homo sapiens
taatggacacttttcacct

SEQ ID NO: 3445699 - DNA, 17 bp, Homo sapiens
taatggagcatcaagcc

SEQ ID NO: 3445700 - DNA, 15 bp, Homo sapiens
taatggggcggtgag

SEQ ID NO: 3445701 - DNA, 17 bp, Homo sapiens
taatggggtcctggcca

SEQ ID NO: 3445702 - DNA, 18 bp, Homo sapiens
taatggggtcctggccat

SEQ ID NO: 3445703 - DNA, 13 bp, Homo sapiens
taatgtaatttag

SEQ ID NO: 3445704 - DNA, 15 bp, Homo sapiens
taatgtaatttagtc

SEQ ID NO: 3445705 - DNA, 16 bp, Homo sapiens
taatgtcacaggcagg

SEQ ID NO: 3445706 - DNA, 17 bp, Homo sapiens
taatgtcacaggcaggt

SEQ ID NO: 3445707 - DNA, 11 bp, Homo sapiens
taatgtcttta

SEQ ID NO: 3445708 - DNA, 18 bp, Homo sapiens
taatgttctgtgatacag

SEQ ID NO: 3445709 - DNA, 20 bp, Homo sapiens
taatgttttaaatgtacaga

SEQ ID NO: 3445710 - DNA, 18 bp, Homo sapiens
taatgttttctttgcaaa

SEQ ID NO: 3445711 - DNA, 19 bp, Homo sapiens
taatgttttctttgcaaag

SEQ ID NO: 3445712 - DNA, 21 bp, Homo sapiens
taatgttttctttgcaaagta

SEQ ID NO: 3445713 - DNA, 10 bp, Homo sapiens
taatgttttt

SEQ ID NO: 3445714 - DNA, 14 bp, Homo sapiens
taattaggaaaaaa

SEQ ID NO: 3445715 - DNA, 21 bp, Homo sapiens
taattagtgctaagtgtgaac

SEQ ID NO: 3445716 - DNA, 15 bp, Homo sapiens
taattcatgtttctt

SEQ ID NO: 3445717 - DNA, 12 bp, Homo sapiens
taattctcaggc

SEQ ID NO: 3445718 - DNA, 17 bp, Homo sapiens
taattgaaagtataatt

SEQ ID NO: 3445719 - DNA, 21 bp, Homo sapiens
taattgcaaaaacatagaaat

SEQ ID NO: 3445720 - DNA, 22 bp, Homo sapiens
taattgcagataactttgactt

SEQ ID NO: 3445721 - DNA, 21 bp, Homo sapiens
taattgctttcctgcctcctt

SEQ ID NO: 3445722 - DNA, 14 bp, Homo sapiens
taattgttcctttt

SEQ ID NO: 3445723 - DNA, 14 bp, Homo sapiens
taatttaatgcatg

SEQ ID NO: 3445724 - DNA, 21 bp, Homo sapiens
taatttacaggttcttaggct

SEQ ID NO: 3445725 - DNA, 20 bp, Homo sapiens
taatttactggacaaagaat

SEQ ID NO: 3445726 - DNA, 15 bp, Homo sapiens
taatttagatatttt

SEQ ID NO: 3445727 - DNA, 18 bp, Homo sapiens
taatttagatattttcca

SEQ ID NO: 3445728 - DNA, 17 bp, Homo sapiens
taatttattaattgctt

SEQ ID NO: 3445729 - DNA, 19 bp, Homo sapiens
taatttattaattgctttg

SEQ ID NO: 3445730 - DNA, 12 bp, Homo sapiens
taatttcaaaat

SEQ ID NO: 3445731 - DNA, 15 bp, Homo sapiens
taatttcaaaatgct

SEQ ID NO: 3445732 - DNA, 16 bp, Homo sapiens
taatttgcattaaatt

SEQ ID NO: 3445733 - DNA, 12 bp, Homo sapiens
taatttggcagg

SEQ ID NO: 3445734 - DNA, 13 bp, Homo sapiens
taatttgtaaagt

SEQ ID NO: 3445735 - DNA, 16 bp, Homo sapiens
taatttgtaaagttgg

SEQ ID NO: 3445736 - DNA, 22 bp, Homo sapiens
taattttacatgtttataaatc

SEQ ID NO: 3445737 - DNA, 12 bp, Homo sapiens
taattttacttt

SEQ ID NO: 3445738 - DNA, 14 bp, Homo sapiens
taattttacttttt

SEQ ID NO: 3445739 - DNA, 19 bp, Homo sapiens
taattttgttctagttttc

SEQ ID NO: 3445740 - DNA, 19 bp, Homo sapiens
taatttttaatgatgacaa

SEQ ID NO: 3445741 - DNA, 21 bp, Homo sapiens
taatttttgtattatttttgt

SEQ ID NO: 3445742 - DNA, 17 bp, Homo sapiens
taattttttggtacaaa

SEQ ID NO: 3445743 - DNA, 22 bp, Homo sapiens
taatttttttaaccaaaggtga

SEQ ID NO: 3445744 - DNA, 13 bp, Homo sapiens
tacaaaaacactt

SEQ ID NO: 3445745 - DNA, 15 bp, Homo sapiens
tacaaaaataaattt

SEQ ID NO: 3445746 - DNA, 22 bp, Homo sapiens
tacaaaaataaatttatatgaa

SEQ ID NO: 3445747 - DNA, 19 bp, Homo sapiens
tacaaaataaagctgttct

SEQ ID NO: 3445748 - DNA, 16 bp, Homo sapiens
tacaaacaaaatttct

SEQ ID NO: 3445749 - DNA, 16 bp, Homo sapiens
tacaaactaaggtgct

SEQ ID NO: 3445750 - DNA, 15 bp, Homo sapiens
tacaaaggttccatt

SEQ ID NO: 3445751 - DNA, 18 bp, Homo sapiens
tacaaagtactagctaaa

SEQ ID NO: 3445752 - DNA, 15 bp, Homo sapiens
tacaaagtgtgtatt

SEQ ID NO: 3445753 - DNA, 12 bp, Homo sapiens
tacaaatataag

SEQ ID NO: 3445754 - DNA, 16 bp, Homo sapiens
tacaaatataagaata

SEQ ID NO: 3445755 - DNA, 21 bp, Homo sapiens
tacaaatggacataggactca

SEQ ID NO: 3445756 - DNA, 17 bp, Homo sapiens
tacaaatggtggaggat

SEQ ID NO: 3445757 - DNA, 13 bp, Homo sapiens
tacaaattagaaa

SEQ ID NO: 3445758 - DNA, 15 bp, Homo sapiens
tacaaattagaaaat

SEQ ID NO: 3445759 - DNA, 18 bp, Homo sapiens
tacaactcattccagatc

SEQ ID NO: 3445760 - DNA, 16 bp, Homo sapiens
tacaagatattatgta

SEQ ID NO: 3445761 - DNA, 17 bp, Homo sapiens
tacaagatattatgtat

SEQ ID NO: 3445762 - DNA, 20 bp, Homo sapiens
tacaagatattatgtataaa

SEQ ID NO: 3445763 - DNA, 21 bp, Homo sapiens
tacaagatattatgtataaaa

SEQ ID NO: 3445764 - DNA, 22 bp, Homo sapiens
tacaagatattatgtataaaat

SEQ ID NO: 3445765 - DNA, 13 bp, Homo sapiens
tacaataaaaaca

SEQ ID NO: 3445766 - DNA, 13 bp, Homo sapiens
tacaataaagtct

SEQ ID NO: 3445767 - DNA, 22 bp, Homo sapiens
tacaataaattgctaatgttgc

SEQ ID NO: 3445768 - DNA, 19 bp, Homo sapiens
tacaataatgtaatttagt

SEQ ID NO: 3445769 - DNA, 21 bp, Homo sapiens
tacaatggcccgacatttctt

SEQ ID NO: 3445770 - DNA, 22 bp, Homo sapiens
tacaatggcccgacatttcttc

SEQ ID NO: 3445771 - DNA, 17 bp, Homo sapiens
tacaatgtcatatactg

SEQ ID NO: 3445772 - DNA, 20 bp, Homo sapiens
tacaatgtgaactttattaa

SEQ ID NO: 3445773 - DNA, 21 bp, Homo sapiens
tacaatgtgaactttattaaa

SEQ ID NO: 3445774 - DNA, 15 bp, Homo sapiens
tacaatgttcatccc

SEQ ID NO: 3445775 - DNA, 13 bp, Homo sapiens
tacaatgttttat

SEQ ID NO: 3445776 - DNA, 16 bp, Homo sapiens
tacaatttacaaagtg

SEQ ID NO: 3445777 - DNA, 18 bp, Homo sapiens
tacacaactagttttgtt

SEQ ID NO: 3445778 - DNA, 17 bp, Homo sapiens
tacacaatggtttttaa

SEQ ID NO: 3445779 - DNA, 11 bp, Homo sapiens
tacacacacac

SEQ ID NO: 3445780 - DNA, 13 bp, Homo sapiens
tacacacacacac

SEQ ID NO: 3445781 - DNA, 15 bp, Homo sapiens
tacacacacatacac

SEQ ID NO: 3445782 - DNA, 15 bp, Homo sapiens
tacacagaaatgctg

SEQ ID NO: 3445783 - DNA, 18 bp, Homo sapiens
tacacagaaatgctgctg

SEQ ID NO: 3445784 - DNA, 21 bp, Homo sapiens
tacacagaaatgctgctggcc

SEQ ID NO: 3445785 - DNA, 14 bp, Homo sapiens
tacacagagaaggc

SEQ ID NO: 3445786 - DNA, 19 bp, Homo sapiens
tacaccagagataatatga

SEQ ID NO: 3445787 - DNA, 20 bp, Homo sapiens
tacaccagagataatatgag

SEQ ID NO: 3445788 - DNA, 18 bp, Homo sapiens
tacaccagcattcctttt

SEQ ID NO: 3445789 - DNA, 20 bp, Homo sapiens
tacaccccctcttctgagca

SEQ ID NO: 3445790 - DNA, 22 bp, Homo sapiens
tacaccccctcttctgagcaca

SEQ ID NO: 3445791 - DNA, 15 bp, Homo sapiens
tacacccttttccag

SEQ ID NO: 3445792 - DNA, 18 bp, Homo sapiens
tacacctttctcctttgt

SEQ ID NO: 3445793 - DNA, 19 bp, Homo sapiens
tacacctttctcctttgta

SEQ ID NO: 3445794 - DNA, 20 bp, Homo sapiens
tacacctttctcctttgtac

SEQ ID NO: 3445795 - DNA, 13 bp, Homo sapiens
tacagaatatttc

SEQ ID NO: 3445796 - DNA, 18 bp, Homo sapiens
tacagaatatttctattg

SEQ ID NO: 3445797 - DNA, 15 bp, Homo sapiens
tacagaattactgta

SEQ ID NO: 3445798 - DNA, 14 bp, Homo sapiens
tacagatgcctttt

SEQ ID NO: 3445799 - DNA, 17 bp, Homo sapiens
tacagattttgatagca

SEQ ID NO: 3445800 - DNA, 21 bp, Homo sapiens
tacagattttgatagcaaagc

SEQ ID NO: 3445801 - DNA, 12 bp, Homo sapiens
tacagcccagag

SEQ ID NO: 3445802 - DNA, 24 bp, Homo sapiens
tacagctgggtggcactgccatgc

SEQ ID NO: 3445803 - DNA, 21 bp, Homo sapiens
tacagctttctgaccttcagc

SEQ ID NO: 3445804 - DNA, 17 bp, Homo sapiens
tacaggaaaagctgctg

SEQ ID NO: 3445805 - DNA, 19 bp, Homo sapiens
tacaggaaaagctgctgac

SEQ ID NO: 3445806 - DNA, 18 bp, Homo sapiens
tacagtaggagcccagct

SEQ ID NO: 3445807 - DNA, 15 bp, Homo sapiens
tacagtatgcttgct

SEQ ID NO: 3445808 - DNA, 18 bp, Homo sapiens
tacagtcttccatttgca

SEQ ID NO: 3445809 - DNA, 18 bp, Homo sapiens
tacagtggtgccatcatt

SEQ ID NO: 3445810 - DNA, 18 bp, Homo sapiens
tacagtgtctgtgtgtgt

SEQ ID NO: 3445811 - DNA, 19 bp, Homo sapiens
tacagttgaaaaacagctg

SEQ ID NO: 3445812 - DNA, 20 bp, Homo sapiens
tacagttgaaaaacagctga

SEQ ID NO: 3445813 - DNA, 17 bp, Homo sapiens
tacataattcactctga

SEQ ID NO: 3445814 - DNA, 15 bp, Homo sapiens
tacatacaccagcat

SEQ ID NO: 3445815 - DNA, 20 bp, Homo sapiens
tacatacaccagcattcctt

SEQ ID NO: 3445816 - DNA, 20 bp, Homo sapiens
tacatacagaattactgtaa

SEQ ID NO: 3445817 - DNA, 12 bp, Homo sapiens
tacatactgctg

SEQ ID NO: 3445818 - DNA, 14 bp, Homo sapiens
tacataggatggct

SEQ ID NO: 3445819 - DNA, 22 bp, Homo sapiens
tacatagtgcattgtttctgtg

SEQ ID NO: 3445820 - DNA, 16 bp, Homo sapiens
tacatatgtaaaataa

SEQ ID NO: 3445821 - DNA, 17 bp, Homo sapiens
tacatatgtaaaataaa

SEQ ID NO: 3445822 - DNA, 20 bp, Homo sapiens
tacatccaaagcagacagct

SEQ ID NO: 3445823 - DNA, 19 bp, Homo sapiens
tacatcccgggcctcagtg

SEQ ID NO: 3445824 - DNA, 22 bp, Homo sapiens
tacatcccgggcctcagtgccc

SEQ ID NO: 3445825 - DNA, 20 bp, Homo sapiens
tacatctattttggattgta

SEQ ID NO: 3445826 - DNA, 22 bp, Homo sapiens
tacatctattttggattgtata

SEQ ID NO: 3445827 - DNA, 23 bp, Homo sapiens
tacatctattttggattgtatat

SEQ ID NO: 3445828 - DNA, 22 bp, Homo sapiens
tacatctggaatctgaggcatc

SEQ ID NO: 3445829 - DNA, 17 bp, Homo sapiens
tacatgagaacaaacag

SEQ ID NO: 3445830 - DNA, 13 bp, Homo sapiens
tacatgtaatttg

SEQ ID NO: 3445831 - DNA, 23 bp, Homo sapiens
tacattgtttgtctgtcttcata

SEQ ID NO: 3445832 - DNA, 21 bp, Homo sapiens
tacatttccaaattcacaagt

SEQ ID NO: 3445833 - DNA, 12 bp, Homo sapiens
tacatttctgaa

SEQ ID NO: 3445834 - DNA, 13 bp, Homo sapiens
tacatttctgaat

SEQ ID NO: 3445835 - DNA, 13 bp, Homo sapiens
tacattttagtta

SEQ ID NO: 3445836 - DNA, 17 bp, Homo sapiens
tacatttttcaactttg

SEQ ID NO: 3445837 - DNA, 21 bp, Homo sapiens
tacatttttcaactttgaata

SEQ ID NO: 3445838 - DNA, 17 bp, Homo sapiens
taccaaagtgtcttttg

SEQ ID NO: 3445839 - DNA, 22 bp, Homo sapiens
taccaaagtgtcttttgacatt

SEQ ID NO: 3445840 - DNA, 15 bp, Homo sapiens
taccaatgaaaaaat

SEQ ID NO: 3445841 - DNA, 17 bp, Homo sapiens
taccaatgaaaaaatgt

SEQ ID NO: 3445842 - DNA, 20 bp, Homo sapiens
taccacacatctgtggagat

SEQ ID NO: 3445843 - DNA, 18 bp, Homo sapiens
taccaggggaggcagtgt

SEQ ID NO: 3445844 - DNA, 20 bp, Homo sapiens
taccatagtaccatttatac

SEQ ID NO: 3445845 - DNA, 17 bp, Homo sapiens
taccatcccctgtagag

SEQ ID NO: 3445846 - DNA, 22 bp, Homo sapiens
taccatctgtcttgccagccag

SEQ ID NO: 3445847 - DNA, 13 bp, Homo sapiens
taccatgtaaata

SEQ ID NO: 3445848 - DNA, 18 bp, Homo sapiens
taccatgtaaataatctg

SEQ ID NO: 3445849 - DNA, 14 bp, Homo sapiens
taccattcagtgat

SEQ ID NO: 3445850 - DNA, 23 bp, Homo sapiens
taccattcagtgattactgtcaa

SEQ ID NO: 3445851 - DNA, 16 bp, Homo sapiens
taccattgctgttcta

SEQ ID NO: 3445852 - DNA, 15 bp, Homo sapiens
taccatttatacaaa

SEQ ID NO: 3445853 - DNA, 21 bp, Homo sapiens
taccatttcaaatatttacag

SEQ ID NO: 3445854 - DNA, 18 bp, Homo sapiens
taccattttacatttcta

SEQ ID NO: 3445855 - DNA, 19 bp, Homo sapiens
taccattttacatttctat

SEQ ID NO: 3445856 - DNA, 23 bp, Homo sapiens
tacccaacggccctgcagccagc

SEQ ID NO: 3445857 - DNA, 16 bp, Homo sapiens
tacccagcgagccctg

SEQ ID NO: 3445858 - DNA, 18 bp, Homo sapiens
tacccagcgagccctggt

SEQ ID NO: 3445859 - DNA, 16 bp, Homo sapiens
tacccagctaaataat

SEQ ID NO: 3445860 - DNA, 16 bp, Homo sapiens
tacccccagctgtgct

SEQ ID NO: 3445861 - DNA, 13 bp, Homo sapiens
taccccctccttc

SEQ ID NO: 3445862 - DNA, 17 bp, Homo sapiens
taccccctccttcagac

SEQ ID NO: 3445863 - DNA, 18 bp, Homo sapiens
tacccggggcccagggca

SEQ ID NO: 3445864 - DNA, 16 bp, Homo sapiens
taccctctttgctgca

SEQ ID NO: 3445865 - DNA, 17 bp, Homo sapiens
taccctgaggtcactgc

SEQ ID NO: 3445866 - DNA, 12 bp, Homo sapiens
taccctgcctcc

SEQ ID NO: 3445867 - DNA, 21 bp, Homo sapiens
taccctgcgcccagtccttcc

SEQ ID NO: 3445868 - DNA, 23 bp, Homo sapiens
tacctatatgcagtctctttatt

SEQ ID NO: 3445869 - DNA, 15 bp, Homo sapiens
tacctcccacactcc

SEQ ID NO: 3445870 - DNA, 17 bp, Homo sapiens
tacctcccacactccca

SEQ ID NO: 3445871 - DNA, 14 bp, Homo sapiens
tacctcctctcagt

SEQ ID NO: 3445872 - DNA, 20 bp, Homo sapiens
tacctctctgtcccttgctg

SEQ ID NO: 3445873 - DNA, 21 bp, Homo sapiens
tacctctctgtcccttgctgt

SEQ ID NO: 3445874 - DNA, 21 bp, Homo sapiens
tacctctcttatagaatattt

SEQ ID NO: 3445875 - DNA, 14 bp, Homo sapiens
tacctctgatacct

SEQ ID NO: 3445876 - DNA, 15 bp, Homo sapiens
tacctctgatacctc

SEQ ID NO: 3445877 - DNA, 13 bp, Homo sapiens
tacctgaaaacac

SEQ ID NO: 3445878 - DNA, 21 bp, Homo sapiens
tacctgaaaacactgtgcaca

SEQ ID NO: 3445879 - DNA, 14 bp, Homo sapiens
tacctgctgcttct

SEQ ID NO: 3445880 - DNA, 16 bp, Homo sapiens
tacctgtcattttgca

SEQ ID NO: 3445881 - DNA, 16 bp, Homo sapiens
tacctgtgcctcggct

SEQ ID NO: 3445882 - DNA, 13 bp, Homo sapiens
tacctgttgagca

SEQ ID NO: 3445883 - DNA, 16 bp, Homo sapiens
taccttcatatgcagt

SEQ ID NO: 3445884 - DNA, 16 bp, Homo sapiens
taccttgacctttgta

SEQ ID NO: 3445885 - DNA, 18 bp, Homo sapiens
taccttgacctttgtaca

SEQ ID NO: 3445886 - DNA, 13 bp, Homo sapiens
taccttgcagtgt

SEQ ID NO: 3445887 - DNA, 18 bp, Homo sapiens
taccttgccaattagtaa

SEQ ID NO: 3445888 - DNA, 13 bp, Homo sapiens
taccttggttccc

SEQ ID NO: 3445889 - DNA, 23 bp, Homo sapiens
taccttttttgttttttcaaaat

SEQ ID NO: 3445890 - DNA, 16 bp, Homo sapiens
tacgaaaggatgagca

SEQ ID NO: 3445891 - DNA, 18 bp, Homo sapiens
tacgaaaggatgagcaga

SEQ ID NO: 3445892 - DNA, 21 bp, Homo sapiens
tacgaaaggatgagcagagcc

SEQ ID NO: 3445893 - DNA, 21 bp, Homo sapiens
tacgagcacctccagcctgaa

SEQ ID NO: 3445894 - DNA, 23 bp, Homo sapiens
tacgatacgctactataaagaga

SEQ ID NO: 3445895 - DNA, 16 bp, Homo sapiens
tacgcccatctcagga

SEQ ID NO: 3445896 - DNA, 14 bp, Homo sapiens
tacgctttgattca

SEQ ID NO: 3445897 - DNA, 18 bp, Homo sapiens
tacgtagcaggccatggc

SEQ ID NO: 3445898 - DNA, 19 bp, Homo sapiens
tactaaaagtttagaactt

SEQ ID NO: 3445899 - DNA, 23 bp, Homo sapiens
tactaacaatcagctccttcctg

SEQ ID NO: 3445900 - DNA, 16 bp, Homo sapiens
tactaattccacacct

SEQ ID NO: 3445901 - DNA, 19 bp, Homo sapiens
tactactttgttaggattt

SEQ ID NO: 3445902 - DNA, 23 bp, Homo sapiens
tactactttgttaggattttcac

SEQ ID NO: 3445903 - DNA, 21 bp, Homo sapiens
tactagggatccctcatctgt

SEQ ID NO: 3445904 - DNA, 15 bp, Homo sapiens
tactagtgttctgtt

SEQ ID NO: 3445905 - DNA, 12 bp, Homo sapiens
tactattaaaaa

SEQ ID NO: 3445906 - DNA, 15 bp, Homo sapiens
tactattaaaatatt

SEQ ID NO: 3445907 - DNA, 14 bp, Homo sapiens
tactattaacatga

SEQ ID NO: 3445908 - DNA, 17 bp, Homo sapiens
tactattttaatttgta

SEQ ID NO: 3445909 - DNA, 15 bp, Homo sapiens
tactcaagcccgcgg

SEQ ID NO: 3445910 - DNA, 19 bp, Homo sapiens
tactccaaagatgacttcc

SEQ ID NO: 3445911 - DNA, 20 bp, Homo sapiens
tactccagtatgacagagga

SEQ ID NO: 3445912 - DNA, 15 bp, Homo sapiens
tactcctcacactta

SEQ ID NO: 3445913 - DNA, 13 bp, Homo sapiens
tactccttctgtt

SEQ ID NO: 3445914 - DNA, 20 bp, Homo sapiens
tactctaaagaattcttgaa

SEQ ID NO: 3445915 - DNA, 19 bp, Homo sapiens
tactctacaattcctctga

SEQ ID NO: 3445916 - DNA, 16 bp, Homo sapiens
tactctaccctcttag

SEQ ID NO: 3445917 - DNA, 22 bp, Homo sapiens
tactctccccacgagggctggc

SEQ ID NO: 3445918 - DNA, 16 bp, Homo sapiens
tactctcttcttctca

SEQ ID NO: 3445919 - DNA, 12 bp, Homo sapiens
tactctgatccc

SEQ ID NO: 3445920 - DNA, 19 bp, Homo sapiens
tactctgtccccccagcta

SEQ ID NO: 3445921 - DNA, 12 bp, Homo sapiens
tactctgtgtca

SEQ ID NO: 3445922 - DNA, 14 bp, Homo sapiens
tactctgttccttc

SEQ ID NO: 3445923 - DNA, 13 bp, Homo sapiens
tactcttacatgt

SEQ ID NO: 3445924 - DNA, 18 bp, Homo sapiens
tactcttaggaagagaaa

SEQ ID NO: 3445925 - DNA, 14 bp, Homo sapiens
tactctttctgtat

SEQ ID NO: 3445926 - DNA, 16 bp, Homo sapiens
tactctttctgtatat

SEQ ID NO: 3445927 - DNA, 22 bp, Homo sapiens
tactgaactgtgtgtaattgtt

SEQ ID NO: 3445928 - DNA, 15 bp, Homo sapiens
tactgaccctggggc

SEQ ID NO: 3445929 - DNA, 19 bp, Homo sapiens
tactgaccctggggctggc

SEQ ID NO: 3445930 - DNA, 14 bp, Homo sapiens
tactgagcttctct

SEQ ID NO: 3445931 - DNA, 18 bp, Homo sapiens
tactgagcttctctgtga

SEQ ID NO: 3445932 - DNA, 14 bp, Homo sapiens
tactgcaagaaaat

SEQ ID NO: 3445933 - DNA, 15 bp, Homo sapiens
tactgcaagaaaatg

SEQ ID NO: 3445934 - DNA, 19 bp, Homo sapiens
tactgccatgtactagttt

SEQ ID NO: 3445935 - DNA, 21 bp, Homo sapiens
tactgccatgtactagtttta

SEQ ID NO: 3445936 - DNA, 15 bp, Homo sapiens
tactgcctttagaaa

SEQ ID NO: 3445937 - DNA, 17 bp, Homo sapiens
tactgcgactttctgcc

SEQ ID NO: 3445938 - DNA, 18 bp, Homo sapiens
tactgcgactttctgcct

SEQ ID NO: 3445939 - DNA, 22 bp, Homo sapiens
tactgcgactttctgcctggag

SEQ ID NO: 3445940 - DNA, 13 bp, Homo sapiens
tactgcttcattt

SEQ ID NO: 3445941 - DNA, 18 bp, Homo sapiens
tactggcaaaaggatctt

SEQ ID NO: 3445942 - DNA, 19 bp, Homo sapiens
tactgtaagaataatttat

SEQ ID NO: 3445943 - DNA, 13 bp, Homo sapiens
tactgtaagacat

SEQ ID NO: 3445944 - DNA, 14 bp, Homo sapiens
tactgtaagacatt

SEQ ID NO: 3445945 - DNA, 15 bp, Homo sapiens
tactgtaagacatta

SEQ ID NO: 3445946 - DNA, 15 bp, Homo sapiens
tactgtaattcctca

SEQ ID NO: 3445947 - DNA, 16 bp, Homo sapiens
tactgtaattcctcaa

SEQ ID NO: 3445948 - DNA, 15 bp, Homo sapiens
tactgtacaataaaa

SEQ ID NO: 3445949 - DNA, 16 bp, Homo sapiens
tactgtatgtgatgaa

SEQ ID NO: 3445950 - DNA, 17 bp, Homo sapiens
tactgtattttgtattg

SEQ ID NO: 3445951 - DNA, 21 bp, Homo sapiens
tactgtcttcagtaagccgtg

SEQ ID NO: 3445952 - DNA, 18 bp, Homo sapiens
tactgtggaaaagaaaca

SEQ ID NO: 3445953 - DNA, 16 bp, Homo sapiens
tactgtgggcaattta

SEQ ID NO: 3445954 - DNA, 14 bp, Homo sapiens
tacttaacaaatac

SEQ ID NO: 3445955 - DNA, 18 bp, Homo sapiens
tacttaacaaatacattc

SEQ ID NO: 3445956 - DNA, 19 bp, Homo sapiens
tacttaacaaatacattca

SEQ ID NO: 3445957 - DNA, 15 bp, Homo sapiens
tacttaatccaatgg

SEQ ID NO: 3445958 - DNA, 17 bp, Homo sapiens
tacttagaaagtaagag

SEQ ID NO: 3445959 - DNA, 15 bp, Homo sapiens
tacttatccctgccc

SEQ ID NO: 3445960 - DNA, 17 bp, Homo sapiens
tacttatccctgcccat

SEQ ID NO: 3445961 - DNA, 21 bp, Homo sapiens
tacttatccctgcccatttca

SEQ ID NO: 3445962 - DNA, 16 bp, Homo sapiens
tacttcattttcagag

SEQ ID NO: 3445963 - DNA, 21 bp, Homo sapiens
tacttcccgggccagggctgc

SEQ ID NO: 3445964 - DNA, 20 bp, Homo sapiens
tacttctccaccctgctctc

SEQ ID NO: 3445965 - DNA, 18 bp, Homo sapiens
tacttctctataaaaaat

SEQ ID NO: 3445966 - DNA, 13 bp, Homo sapiens
tacttctgaggta

SEQ ID NO: 3445967 - DNA, 21 bp, Homo sapiens
tacttgaacttgcctctttta

SEQ ID NO: 3445968 - DNA, 13 bp, Homo sapiens
tacttgaacttgt

SEQ ID NO: 3445969 - DNA, 15 bp, Homo sapiens
tacttgaagggccag

SEQ ID NO: 3445970 - DNA, 17 bp, Homo sapiens
tacttgaagggccagag

SEQ ID NO: 3445971 - DNA, 19 bp, Homo sapiens
tacttgaagggccagagcc

SEQ ID NO: 3445972 - DNA, 20 bp, Homo sapiens
tacttgaagggccagagcca

SEQ ID NO: 3445973 - DNA, 21 bp, Homo sapiens
tacttgaagggccagagccag

SEQ ID NO: 3445974 - DNA, 22 bp, Homo sapiens
tacttgaagtctaaaagcagaa

SEQ ID NO: 3445975 - DNA, 23 bp, Homo sapiens
tacttgaagtctaaaagcagaaa

SEQ ID NO: 3445976 - DNA, 16 bp, Homo sapiens
tacttgctcaggtact

SEQ ID NO: 3445977 - DNA, 17 bp, Homo sapiens
tacttgctcaggtactt

SEQ ID NO: 3445978 - DNA, 15 bp, Homo sapiens
tacttgtggacacag

SEQ ID NO: 3445979 - DNA, 22 bp, Homo sapiens
tacttgtggactaaaagatata

SEQ ID NO: 3445980 - DNA, 23 bp, Homo sapiens
tacttgtggactaaaagatataa

SEQ ID NO: 3445981 - DNA, 20 bp, Homo sapiens
tacttgtttctctgttgtaa

SEQ ID NO: 3445982 - DNA, 14 bp, Homo sapiens
tactttagaagcac

SEQ ID NO: 3445983 - DNA, 14 bp, Homo sapiens
tactttgaagtcat

SEQ ID NO: 3445984 - DNA, 13 bp, Homo sapiens
tactttgtaaata

SEQ ID NO: 3445985 - DNA, 23 bp, Homo sapiens
tactttgtaaataggatttttag

SEQ ID NO: 3445986 - DNA, 19 bp, Homo sapiens
tacttttcccatttgtaat

SEQ ID NO: 3445987 - DNA, 16 bp, Homo sapiens
tacttttccttacctt

SEQ ID NO: 3445988 - DNA, 13 bp, Homo sapiens
tactttttctaat

SEQ ID NO: 3445989 - DNA, 23 bp, Homo sapiens
tactttttgaacttttcattccc

SEQ ID NO: 3445990 - DNA, 13 bp, Homo sapiens
tacttttttaaat

SEQ ID NO: 3445991 - DNA, 15 bp, Homo sapiens
tagaaaaataaaaat

SEQ ID NO: 3445992 - DNA, 21 bp, Homo sapiens
tagaaaacctaattaaggaag

SEQ ID NO: 3445993 - DNA, 14 bp, Homo sapiens
tagaaaagcacttg

SEQ ID NO: 3445994 - DNA, 14 bp, Homo sapiens
tagaaaagttatta

SEQ ID NO: 3445995 - DNA, 15 bp, Homo sapiens
tagaaacattgaaga

SEQ ID NO: 3445996 - DNA, 21 bp, Homo sapiens
tagaaagaagcccaatattat

SEQ ID NO: 3445997 - DNA, 23 bp, Homo sapiens
tagaaagaagcccaatattataa

SEQ ID NO: 3445998 - DNA, 14 bp, Homo sapiens
tagaaagcatttga

SEQ ID NO: 3445999 - DNA, 16 bp, Homo sapiens
tagaaagcatttgaat

SEQ ID NO: 3446000 - DNA, 17 bp, Homo sapiens
tagaaagcatttgaatg

SEQ ID NO: 3446001 - DNA, 21 bp, Homo sapiens
tagaaagcatttgaatgcatt

SEQ ID NO: 3446002 - DNA, 21 bp, Homo sapiens
tagaaagctgacattgccaaa

SEQ ID NO: 3446003 - DNA, 14 bp, Homo sapiens
tagaaaggccttta

SEQ ID NO: 3446004 - DNA, 15 bp, Homo sapiens
tagaaaggcctttaa

SEQ ID NO: 3446005 - DNA, 16 bp, Homo sapiens
tagaaaggcctttaaa

SEQ ID NO: 3446006 - DNA, 15 bp, Homo sapiens
tagaaataatatgca

SEQ ID NO: 3446007 - DNA, 12 bp, Homo sapiens
tagaaatgggaa

SEQ ID NO: 3446008 - DNA, 17 bp, Homo sapiens
tagaaatgggaatcatg

SEQ ID NO: 3446009 - DNA, 18 bp, Homo sapiens
tagaaatgggaatcatgg

SEQ ID NO: 3446010 - DNA, 15 bp, Homo sapiens
tagaaatggttgtat

SEQ ID NO: 3446011 - DNA, 16 bp, Homo sapiens
tagaaatggttgtatt

SEQ ID NO: 3446012 - DNA, 23 bp, Homo sapiens
tagaaatttatttcctagttctg

SEQ ID NO: 3446013 - DNA, 14 bp, Homo sapiens
tagaacatccctgc

SEQ ID NO: 3446014 - DNA, 19 bp, Homo sapiens
tagaacttgcagtgtcttt

SEQ ID NO: 3446015 - DNA, 22 bp, Homo sapiens
tagaactttgcatagcagctgc

SEQ ID NO: 3446016 - DNA, 21 bp, Homo sapiens
tagaagattgttggtgaattt

SEQ ID NO: 3446017 - DNA, 24 bp, Homo sapiens
tagaagcgatttaagttacaatgt

SEQ ID NO: 3446018 - DNA, 16 bp, Homo sapiens
tagaagctgcagtggt

SEQ ID NO: 3446019 - DNA, 17 bp, Homo sapiens
tagaaggatgtacattt

SEQ ID NO: 3446020 - DNA, 19 bp, Homo sapiens
tagaaggttgacacagttg

SEQ ID NO: 3446021 - DNA, 17 bp, Homo sapiens
tagaagtagaattgaca

SEQ ID NO: 3446022 - DNA, 15 bp, Homo sapiens
tagaagtcacacagt

SEQ ID NO: 3446023 - DNA, 16 bp, Homo sapiens
tagaagtcacacagta

SEQ ID NO: 3446024 - DNA, 18 bp, Homo sapiens
tagaagtctttcagatga

SEQ ID NO: 3446025 - DNA, 17 bp, Homo sapiens
tagaatatagcatcttt

SEQ ID NO: 3446026 - DNA, 20 bp, Homo sapiens
tagaatatagcatctttcat

SEQ ID NO: 3446027 - DNA, 23 bp, Homo sapiens
tagaatatagcatctttcatatg

SEQ ID NO: 3446028 - DNA, 24 bp, Homo sapiens
tagaatatagcatctttcatatgg

SEQ ID NO: 3446029 - DNA, 23 bp, Homo sapiens
tagaatccaaacttggatttttg

SEQ ID NO: 3446030 - DNA, 20 bp, Homo sapiens
tagaatccacgtattcccct

SEQ ID NO: 3446031 - DNA, 18 bp, Homo sapiens
tagaatgaaccactgccc

SEQ ID NO: 3446032 - DNA, 17 bp, Homo sapiens
tagaatgcatctcatca

SEQ ID NO: 3446033 - DNA, 14 bp, Homo sapiens
tagaattaaaaaag

SEQ ID NO: 3446034 - DNA, 14 bp, Homo sapiens
tagaattagctttt

SEQ ID NO: 3446035 - DNA, 20 bp, Homo sapiens
tagaatttattcaattcctc

SEQ ID NO: 3446036 - DNA, 22 bp, Homo sapiens
tagaatttattcaattcctctg

SEQ ID NO: 3446037 - DNA, 14 bp, Homo sapiens
tagacaagccagaa

SEQ ID NO: 3446038 - DNA, 15 bp, Homo sapiens
tagacaagccagaac

SEQ ID NO: 3446039 - DNA, 21 bp, Homo sapiens
tagacagagtctcactgttgc

SEQ ID NO: 3446040 - DNA, 20 bp, Homo sapiens
tagacagccaaaggctggcg

SEQ ID NO: 3446041 - DNA, 18 bp, Homo sapiens
tagacagtctcactttgt

SEQ ID NO: 3446042 - DNA, 16 bp, Homo sapiens
tagacagttttgagaa

SEQ ID NO: 3446043 - DNA, 17 bp, Homo sapiens
tagaccttgttacttct

SEQ ID NO: 3446044 - DNA, 19 bp, Homo sapiens
tagaccttgttacttctga

SEQ ID NO: 3446045 - DNA, 20 bp, Homo sapiens
tagaccttttttttttttcc

SEQ ID NO: 3446046 - DNA, 22 bp, Homo sapiens
tagaccttttttttttttccaa

SEQ ID NO: 3446047 - DNA, 23 bp, Homo sapiens
tagactaaggccattattgtact

SEQ ID NO: 3446048 - DNA, 15 bp, Homo sapiens
tagactttaggcttt

SEQ ID NO: 3446049 - DNA, 20 bp, Homo sapiens
tagagaacacgcgtatttac

SEQ ID NO: 3446050 - DNA, 14 bp, Homo sapiens
tagagaatgtgttt

SEQ ID NO: 3446051 - DNA, 17 bp, Homo sapiens
tagagaatgttccagac

SEQ ID NO: 3446052 - DNA, 18 bp, Homo sapiens
tagagactggaacactag

SEQ ID NO: 3446053 - DNA, 22 bp, Homo sapiens
tagagccctttgagaatacaag

SEQ ID NO: 3446054 - DNA, 17 bp, Homo sapiens
tagagcctcttggggaa

SEQ ID NO: 3446055 - DNA, 14 bp, Homo sapiens
tagagcctgaggga

SEQ ID NO: 3446056 - DNA, 20 bp, Homo sapiens
tagaggatccctctctggat

SEQ ID NO: 3446057 - DNA, 18 bp, Homo sapiens
tagaggccctttgctgtc

SEQ ID NO: 3446058 - DNA, 15 bp, Homo sapiens
tagaggctcatggcc

SEQ ID NO: 3446059 - DNA, 20 bp, Homo sapiens
tagagggacctctcccaggg

SEQ ID NO: 3446060 - DNA, 13 bp, Homo sapiens
tagagggaggggc

SEQ ID NO: 3446061 - DNA, 14 bp, Homo sapiens
tagagggaggggcc

SEQ ID NO: 3446062 - DNA, 14 bp, Homo sapiens
tagagtatatgcac

SEQ ID NO: 3446063 - DNA, 22 bp, Homo sapiens
tagagtccagatcttgcctcca

SEQ ID NO: 3446064 - DNA, 14 bp, Homo sapiens
tagagttagactgt

SEQ ID NO: 3446065 - DNA, 15 bp, Homo sapiens
tagataaactcagaa

SEQ ID NO: 3446066 - DNA, 14 bp, Homo sapiens
tagatacaataaat

SEQ ID NO: 3446067 - DNA, 22 bp, Homo sapiens
tagataggtcagtgcaaatact

SEQ ID NO: 3446068 - DNA, 15 bp, Homo sapiens
tagatagtcatgctg

SEQ ID NO: 3446069 - DNA, 18 bp, Homo sapiens
tagatagtcatgctgcta

SEQ ID NO: 3446070 - DNA, 13 bp, Homo sapiens
tagatattttcca

SEQ ID NO: 3446071 - DNA, 14 bp, Homo sapiens
tagatattttccat

SEQ ID NO: 3446072 - DNA, 17 bp, Homo sapiens
tagatattttccatata

SEQ ID NO: 3446073 - DNA, 20 bp, Homo sapiens
tagatattttccatatattg

SEQ ID NO: 3446074 - DNA, 14 bp, Homo sapiens
tagatcatttctag

SEQ ID NO: 3446075 - DNA, 16 bp, Homo sapiens
tagatctggcatgtta

SEQ ID NO: 3446076 - DNA, 16 bp, Homo sapiens
tagatgaagttttaca

SEQ ID NO: 3446077 - DNA, 13 bp, Homo sapiens
tagatgctggccc

SEQ ID NO: 3446078 - DNA, 15 bp, Homo sapiens
tagatgctggcccag

SEQ ID NO: 3446079 - DNA, 18 bp, Homo sapiens
tagatgctggcccagggc

SEQ ID NO: 3446080 - DNA, 21 bp, Homo sapiens
tagatgctggcccagggccca

SEQ ID NO: 3446081 - DNA, 22 bp, Homo sapiens
tagatgctggcccagggcccag

SEQ ID NO: 3446082 - DNA, 16 bp, Homo sapiens
tagatggtgctgagaa

SEQ ID NO: 3446083 - DNA, 19 bp, Homo sapiens
tagatggtgctgagaagct

SEQ ID NO: 3446084 - DNA, 12 bp, Homo sapiens
tagatggtggca

SEQ ID NO: 3446085 - DNA, 21 bp, Homo sapiens
tagatgttctaagtctttcca

SEQ ID NO: 3446086 - DNA, 19 bp, Homo sapiens
tagatgttctctatcattt

SEQ ID NO: 3446087 - DNA, 21 bp, Homo sapiens
tagatgttctctatcatttaa

SEQ ID NO: 3446088 - DNA, 23 bp, Homo sapiens
tagatgttctctatcatttaata

SEQ ID NO: 3446089 - DNA, 18 bp, Homo sapiens
tagattaagagatgggtt

SEQ ID NO: 3446090 - DNA, 22 bp, Homo sapiens
tagattttagaccctattgctg

SEQ ID NO: 3446091 - DNA, 12 bp, Homo sapiens
tagattttccaa

SEQ ID NO: 3446092 - DNA, 12 bp, Homo sapiens
tagattttttca

SEQ ID NO: 3446093 - DNA, 17 bp, Homo sapiens
tagcaaccatttgtaaa

SEQ ID NO: 3446094 - DNA, 20 bp, Homo sapiens
tagcaagattgcttaaaata

SEQ ID NO: 3446095 - DNA, 20 bp, Homo sapiens
tagcactactaaaagtttag

SEQ ID NO: 3446096 - DNA, 15 bp, Homo sapiens
tagcactcaggctct

SEQ ID NO: 3446097 - DNA, 19 bp, Homo sapiens
tagcagagaatgaaagggc

SEQ ID NO: 3446098 - DNA, 23 bp, Homo sapiens
tagcagagaatgaaagggcccag

SEQ ID NO: 3446099 - DNA, 18 bp, Homo sapiens
tagcagattttaattttg

SEQ ID NO: 3446100 - DNA, 20 bp, Homo sapiens
tagcagcagcctttaatgca

SEQ ID NO: 3446101 - DNA, 13 bp, Homo sapiens
tagcagctgcagt

SEQ ID NO: 3446102 - DNA, 19 bp, Homo sapiens
tagcagggggggaaatgca

SEQ ID NO: 3446103 - DNA, 18 bp, Homo sapiens
tagcatataattctatat

SEQ ID NO: 3446104 - DNA, 23 bp, Homo sapiens
tagcatatctgcctttattgtgt

SEQ ID NO: 3446105 - DNA, 14 bp, Homo sapiens
tagcatctgtacaa

SEQ ID NO: 3446106 - DNA, 21 bp, Homo sapiens
tagcatgtcgtcaaagctgaa

SEQ ID NO: 3446107 - DNA, 19 bp, Homo sapiens
tagccactggtttctcaga

SEQ ID NO: 3446108 - DNA, 19 bp, Homo sapiens
tagccagcacacagggcag

SEQ ID NO: 3446109 - DNA, 18 bp, Homo sapiens
tagccagctgctccccag

SEQ ID NO: 3446110 - DNA, 13 bp, Homo sapiens
tagccagctgtca

SEQ ID NO: 3446111 - DNA, 18 bp, Homo sapiens
tagccagctgtcaagggc

SEQ ID NO: 3446112 - DNA, 12 bp, Homo sapiens
tagccaggagcg

SEQ ID NO: 3446113 - DNA, 17 bp, Homo sapiens
tagccaggagcgcatct

SEQ ID NO: 3446114 - DNA, 14 bp, Homo sapiens
tagcccaaaaccaa

SEQ ID NO: 3446115 - DNA, 20 bp, Homo sapiens
tagcccagtgttttctttga

SEQ ID NO: 3446116 - DNA, 15 bp, Homo sapiens
tagccccctggcctc

SEQ ID NO: 3446117 - DNA, 18 bp, Homo sapiens
tagccctgcggagccggc

SEQ ID NO: 3446118 - DNA, 13 bp, Homo sapiens
tagcctgatgaga

SEQ ID NO: 3446119 - DNA, 23 bp, Homo sapiens
tagcctgcagaagtaagcctcat

SEQ ID NO: 3446120 - DNA, 12 bp, Homo sapiens
tagcctgctggt

SEQ ID NO: 3446121 - DNA, 13 bp, Homo sapiens
tagcctgtggccc

SEQ ID NO: 3446122 - DNA, 21 bp, Homo sapiens
tagccttagaagtcacacagt

SEQ ID NO: 3446123 - DNA, 20 bp, Homo sapiens
tagctaaacggattccaaag

SEQ ID NO: 3446124 - DNA, 17 bp, Homo sapiens
tagctaactgtaaatca

SEQ ID NO: 3446125 - DNA, 19 bp, Homo sapiens
tagctagtttgctttttgc

SEQ ID NO: 3446126 - DNA, 21 bp, Homo sapiens
tagctcaggtgtccctgcact

SEQ ID NO: 3446127 - DNA, 14 bp, Homo sapiens
tagctcccctccaa

SEQ ID NO: 3446128 - DNA, 12 bp, Homo sapiens
tagctcctgtgg

SEQ ID NO: 3446129 - DNA, 16 bp, Homo sapiens
tagctcctgtggcccc

SEQ ID NO: 3446130 - DNA, 15 bp, Homo sapiens
tagctctttgagata

SEQ ID NO: 3446131 - DNA, 21 bp, Homo sapiens
tagctgacccagccccttgag

SEQ ID NO: 3446132 - DNA, 17 bp, Homo sapiens
tagctgcaaaggacaga

SEQ ID NO: 3446133 - DNA, 15 bp, Homo sapiens
tagctgcccatttcg

SEQ ID NO: 3446134 - DNA, 18 bp, Homo sapiens
tagctgggggtgggccag

SEQ ID NO: 3446135 - DNA, 18 bp, Homo sapiens
tagctgtattcatatatt

SEQ ID NO: 3446136 - DNA, 22 bp, Homo sapiens
tagctgtattcatatattgcat

SEQ ID NO: 3446137 - DNA, 23 bp, Homo sapiens
tagctgtattcatatattgcatt

SEQ ID NO: 3446138 - DNA, 16 bp, Homo sapiens
tagctgttgagctgtt

SEQ ID NO: 3446139 - DNA, 15 bp, Homo sapiens
tagctttcaattccg

SEQ ID NO: 3446140 - DNA, 23 bp, Homo sapiens
tagctttcaattccgtagccagc

SEQ ID NO: 3446141 - DNA, 14 bp, Homo sapiens
tagctttgctctgc

SEQ ID NO: 3446142 - DNA, 13 bp, Homo sapiens
tagcttttcacct

SEQ ID NO: 3446143 - DNA, 23 bp, Homo sapiens
taggaaccaacaaggaaactttc

SEQ ID NO: 3446144 - DNA, 15 bp, Homo sapiens
taggaagagaaacca

SEQ ID NO: 3446145 - DNA, 14 bp, Homo sapiens
taggaatcagcaag

SEQ ID NO: 3446146 - DNA, 20 bp, Homo sapiens
taggacataaattagaggtc

SEQ ID NO: 3446147 - DNA, 17 bp, Homo sapiens
taggaccaagcatcttg

SEQ ID NO: 3446148 - DNA, 19 bp, Homo sapiens
taggactcaaagtttcaga

SEQ ID NO: 3446149 - DNA, 13 bp, Homo sapiens
taggagaagggct

SEQ ID NO: 3446150 - DNA, 15 bp, Homo sapiens
taggagatcagaaaa

SEQ ID NO: 3446151 - DNA, 23 bp, Homo sapiens
taggagctgccttggctcagaca

SEQ ID NO: 3446152 - DNA, 18 bp, Homo sapiens
taggagggagttatctaa

SEQ ID NO: 3446153 - DNA, 17 bp, Homo sapiens
taggagtgtgtgatttt

SEQ ID NO: 3446154 - DNA, 21 bp, Homo sapiens
taggatagctaactgtaaatc

SEQ ID NO: 3446155 - DNA, 20 bp, Homo sapiens
taggatctaaggctgtttgc

SEQ ID NO: 3446156 - DNA, 22 bp, Homo sapiens
taggattttttttaatgtttaa

SEQ ID NO: 3446157 - DNA, 22 bp, Homo sapiens
taggcagactctttatgcttgc

SEQ ID NO: 3446158 - DNA, 13 bp, Homo sapiens
taggcagaggctg

SEQ ID NO: 3446159 - DNA, 16 bp, Homo sapiens
taggcaggacatgctg

SEQ ID NO: 3446160 - DNA, 24 bp, Homo sapiens
taggcagtaggccggtgtgcctga

SEQ ID NO: 3446161 - DNA, 17 bp, Homo sapiens
taggcatctctgtactt

SEQ ID NO: 3446162 - DNA, 18 bp, Homo sapiens
taggcattaacacaaagg

SEQ ID NO: 3446163 - DNA, 16 bp, Homo sapiens
taggcatttcctgctg

SEQ ID NO: 3446164 - DNA, 20 bp, Homo sapiens
taggcatttcctgctgaacg

SEQ ID NO: 3446165 - DNA, 20 bp, Homo sapiens
taggcatttgctgaatacag

SEQ ID NO: 3446166 - DNA, 19 bp, Homo sapiens
taggcatttttaccatcac

SEQ ID NO: 3446167 - DNA, 19 bp, Homo sapiens
taggcccccacttgcctct

SEQ ID NO: 3446168 - DNA, 19 bp, Homo sapiens
taggccggtgtgcctgact

SEQ ID NO: 3446169 - DNA, 14 bp, Homo sapiens
taggcctcagccag

SEQ ID NO: 3446170 - DNA, 18 bp, Homo sapiens
taggcctcagccagagaa

SEQ ID NO: 3446171 - DNA, 18 bp, Homo sapiens
taggcctggccagatgca

SEQ ID NO: 3446172 - DNA, 22 bp, Homo sapiens
taggcctggctcattctgcacc

SEQ ID NO: 3446173 - DNA, 23 bp, Homo sapiens
taggccttcctctctccagatgt

SEQ ID NO: 3446174 - DNA, 14 bp, Homo sapiens
taggctattcacaa

SEQ ID NO: 3446175 - DNA, 12 bp, Homo sapiens
taggctctgcct

SEQ ID NO: 3446176 - DNA, 15 bp, Homo sapiens
taggctctgccttcg

SEQ ID NO: 3446177 - DNA, 21 bp, Homo sapiens
taggctgccccgggtccccag

SEQ ID NO: 3446178 - DNA, 19 bp, Homo sapiens
taggctggtggcccaggac

SEQ ID NO: 3446179 - DNA, 11 bp, Homo sapiens
tagggaaaaac

SEQ ID NO: 3446180 - DNA, 20 bp, Homo sapiens
tagggaagggtggtggagcc

SEQ ID NO: 3446181 - DNA, 13 bp, Homo sapiens
tagggagatattt

SEQ ID NO: 3446182 - DNA, 18 bp, Homo sapiens
tagggagggcggcagggg

SEQ ID NO: 3446183 - DNA, 17 bp, Homo sapiens
tagggatccctcatctg

SEQ ID NO: 3446184 - DNA, 15 bp, Homo sapiens
tagggcaccaggggt

SEQ ID NO: 3446185 - DNA, 13 bp, Homo sapiens
tagggccttggtt

SEQ ID NO: 3446186 - DNA, 15 bp, Homo sapiens
tagggtcggaaccca

SEQ ID NO: 3446187 - DNA, 16 bp, Homo sapiens
tagggtggagagccac

SEQ ID NO: 3446188 - DNA, 19 bp, Homo sapiens
tagggttggttcctttcca

SEQ ID NO: 3446189 - DNA, 19 bp, Homo sapiens
tagggtttaatccccagta

SEQ ID NO: 3446190 - DNA, 18 bp, Homo sapiens
taggtactttttgtgaag

SEQ ID NO: 3446191 - DNA, 21 bp, Homo sapiens
taggtatgtttgtaacttttt

SEQ ID NO: 3446192 - DNA, 14 bp, Homo sapiens
taggtctttgtaag

SEQ ID NO: 3446193 - DNA, 15 bp, Homo sapiens
taggtgaacagtcac

SEQ ID NO: 3446194 - DNA, 23 bp, Homo sapiens
taggtgacagagtgagactctgt

SEQ ID NO: 3446195 - DNA, 23 bp, Homo sapiens
taggttaataaagatgattgaat

SEQ ID NO: 3446196 - DNA, 21 bp, Homo sapiens
taggttggcaaaaaggcagga

SEQ ID NO: 3446197 - DNA, 14 bp, Homo sapiens
taggttgtagcaga

SEQ ID NO: 3446198 - DNA, 15 bp, Homo sapiens
taggtttttttgtat

SEQ ID NO: 3446199 - DNA, 11 bp, Homo sapiens
tagtaaatgtt

SEQ ID NO: 3446200 - DNA, 14 bp, Homo sapiens
tagtaactctttct

SEQ ID NO: 3446201 - DNA, 18 bp, Homo sapiens
tagtaacttcttatggaa

SEQ ID NO: 3446202 - DNA, 19 bp, Homo sapiens
tagtaacttcttatggaat

SEQ ID NO: 3446203 - DNA, 13 bp, Homo sapiens
tagtaagagcttt

SEQ ID NO: 3446204 - DNA, 17 bp, Homo sapiens
tagtaaggagttcattt

SEQ ID NO: 3446205 - DNA, 15 bp, Homo sapiens
tagtaatgagtttaa

SEQ ID NO: 3446206 - DNA, 14 bp, Homo sapiens
tagtaatttgtaaa

SEQ ID NO: 3446207 - DNA, 16 bp, Homo sapiens
tagtaccatttataca

SEQ ID NO: 3446208 - DNA, 18 bp, Homo sapiens
tagtaccatttatacaaa

SEQ ID NO: 3446209 - DNA, 20 bp, Homo sapiens
tagtaccatttatacaaatt

SEQ ID NO: 3446210 - DNA, 15 bp, Homo sapiens
tagtagagacagggt

SEQ ID NO: 3446211 - DNA, 14 bp, Homo sapiens
tagtatagacaata

SEQ ID NO: 3446212 - DNA, 12 bp, Homo sapiens
tagtatttgatt

SEQ ID NO: 3446213 - DNA, 20 bp, Homo sapiens
tagtatttgattcaaaatat

SEQ ID NO: 3446214 - DNA, 23 bp, Homo sapiens
tagtatttgattcaaaatattta

SEQ ID NO: 3446215 - DNA, 21 bp, Homo sapiens
tagtccgtgctgacagctgct

SEQ ID NO: 3446216 - DNA, 23 bp, Homo sapiens
tagtccgtgctgacagctgctcc

SEQ ID NO: 3446217 - DNA, 12 bp, Homo sapiens
tagtcgtgagct

SEQ ID NO: 3446218 - DNA, 13 bp, Homo sapiens
tagtctaacacag

SEQ ID NO: 3446219 - DNA, 20 bp, Homo sapiens
tagtctagatggctcctctc

SEQ ID NO: 3446220 - DNA, 21 bp, Homo sapiens
tagtctcttgtattaaactct

SEQ ID NO: 3446221 - DNA, 19 bp, Homo sapiens
tagtgaaggcttctctctg

SEQ ID NO: 3446222 - DNA, 21 bp, Homo sapiens
tagtgaaggcttctctctgtg

SEQ ID NO: 3446223 - DNA, 14 bp, Homo sapiens
tagtgatcacagca

SEQ ID NO: 3446224 - DNA, 15 bp, Homo sapiens
tagtgatcacagcag

SEQ ID NO: 3446225 - DNA, 14 bp, Homo sapiens
tagtgcaaatcata

SEQ ID NO: 3446226 - DNA, 20 bp, Homo sapiens
tagtgccctctttagccaga

SEQ ID NO: 3446227 - DNA, 19 bp, Homo sapiens
tagtgccttctaaaggtgt

SEQ ID NO: 3446228 - DNA, 15 bp, Homo sapiens
tagtgctaagtgtga

SEQ ID NO: 3446229 - DNA, 18 bp, Homo sapiens
tagtgctaagtgtgaact

SEQ ID NO: 3446230 - DNA, 18 bp, Homo sapiens
tagtgtaagctagaagaa

SEQ ID NO: 3446231 - DNA, 14 bp, Homo sapiens
tagtgtagtattct

SEQ ID NO: 3446232 - DNA, 19 bp, Homo sapiens
tagtgtagtattcttccct

SEQ ID NO: 3446233 - DNA, 12 bp, Homo sapiens
tagtgttctgtt

SEQ ID NO: 3446234 - DNA, 15 bp, Homo sapiens
tagtgttctgtttgt

SEQ ID NO: 3446235 - DNA, 21 bp, Homo sapiens
tagttaagacatgatttcctt

SEQ ID NO: 3446236 - DNA, 15 bp, Homo sapiens
tagttcacagacata

SEQ ID NO: 3446237 - DNA, 20 bp, Homo sapiens
tagttcctcattagcatttt

SEQ ID NO: 3446238 - DNA, 18 bp, Homo sapiens
tagttgacaattctgcat

SEQ ID NO: 3446239 - DNA, 19 bp, Homo sapiens
tagttgacaattctgcatg

SEQ ID NO: 3446240 - DNA, 20 bp, Homo sapiens
tagttgacaattctgcatgt

SEQ ID NO: 3446241 - DNA, 17 bp, Homo sapiens
tagttgcaatagaacag

SEQ ID NO: 3446242 - DNA, 12 bp, Homo sapiens
tagttgccaata

SEQ ID NO: 3446243 - DNA, 19 bp, Homo sapiens
tagttgccaatatgccagc

SEQ ID NO: 3446244 - DNA, 15 bp, Homo sapiens
tagttggttgaattt

SEQ ID NO: 3446245 - DNA, 22 bp, Homo sapiens
tagtttgaacagatatgttttt

SEQ ID NO: 3446246 - DNA, 16 bp, Homo sapiens
tagtttgggcttcagc

SEQ ID NO: 3446247 - DNA, 19 bp, Homo sapiens
tagtttgtgtgttgtctct

SEQ ID NO: 3446248 - DNA, 13 bp, Homo sapiens
tagttttattctt

SEQ ID NO: 3446249 - DNA, 20 bp, Homo sapiens
tagttttctttcctcctttc

SEQ ID NO: 3446250 - DNA, 23 bp, Homo sapiens
tagttttttttttttttatgtga

SEQ ID NO: 3446251 - DNA, 13 bp, Homo sapiens
tataaaaaatatg

SEQ ID NO: 3446252 - DNA, 15 bp, Homo sapiens
tataaaaaatatgta

SEQ ID NO: 3446253 - DNA, 12 bp, Homo sapiens
tataaaaacaaa

SEQ ID NO: 3446254 - DNA, 22 bp, Homo sapiens
tataaaagatggggtctgtaaa

SEQ ID NO: 3446255 - DNA, 23 bp, Homo sapiens
tataaaagatggggtctgtaaaa

SEQ ID NO: 3446256 - DNA, 13 bp, Homo sapiens
tataaaataaata

SEQ ID NO: 3446257 - DNA, 11 bp, Homo sapiens
tataaaataat

SEQ ID NO: 3446258 - DNA, 14 bp, Homo sapiens
tataaaatcagcca

SEQ ID NO: 3446259 - DNA, 21 bp, Homo sapiens
tataaaatcagccaattatgt

SEQ ID NO: 3446260 - DNA, 20 bp, Homo sapiens
tataaaatgtaacactgatg

SEQ ID NO: 3446261 - DNA, 20 bp, Homo sapiens
tataaacagacaatatgtga

SEQ ID NO: 3446262 - DNA, 16 bp, Homo sapiens
tataaacctaaaaaag

SEQ ID NO: 3446263 - DNA, 16 bp, Homo sapiens
tataaagctagatgct

SEQ ID NO: 3446264 - DNA, 18 bp, Homo sapiens
tataaagtagtcctgtga

SEQ ID NO: 3446265 - DNA, 22 bp, Homo sapiens
ggccctgcaaaaggactctcag

SEQ ID NO: 3446266 - DNA, 21 bp, Homo sapiens
ggccctgccagtggggaagga

SEQ ID NO: 3446267 - DNA, 20 bp, Homo sapiens
ggccctgctgagtcatctgt

SEQ ID NO: 3446268 - DNA, 19 bp, Homo sapiens
ggcccttcccacaggacat

SEQ ID NO: 3446269 - DNA, 13 bp, Homo sapiens
ggccctttgctgt

SEQ ID NO: 3446270 - DNA, 17 bp, Homo sapiens
ggccgattgggagaaag

SEQ ID NO: 3446271 - DNA, 15 bp, Homo sapiens
ggccgcctccaggag

SEQ ID NO: 3446272 - DNA, 22 bp, Homo sapiens
ggccgcgccaaataatgtctct

SEQ ID NO: 3446273 - DNA, 13 bp, Homo sapiens
ggccgctgccacc

SEQ ID NO: 3446274 - DNA, 19 bp, Homo sapiens
ggccgctgccacccacctc

SEQ ID NO: 3446275 - DNA, 21 bp, Homo sapiens
ggccggcagccccagcctgct

SEQ ID NO: 3446276 - DNA, 15 bp, Homo sapiens
ggccggcgagccctg

SEQ ID NO: 3446277 - DNA, 16 bp, Homo sapiens
ggccgtatctccggct

SEQ ID NO: 3446278 - DNA, 19 bp, Homo sapiens
ggccgtatctccggctccc

SEQ ID NO: 3446279 - DNA, 21 bp, Homo sapiens
ggccgtatctccggctcccag

SEQ ID NO: 3446280 - DNA, 22 bp, Homo sapiens
ggccgtatctccggctcccagc

SEQ ID NO: 3446281 - DNA, 20 bp, Homo sapiens
ggcctacagctttgatccct

SEQ ID NO: 3446282 - DNA, 16 bp, Homo sapiens
ggcctaccccgcagac

SEQ ID NO: 3446283 - DNA, 16 bp, Homo sapiens
ggcctagcaggcacag

SEQ ID NO: 3446284 - DNA, 20 bp, Homo sapiens
ggcctaggcctcagccagag

SEQ ID NO: 3446285 - DNA, 22 bp, Homo sapiens
ggcctattgcttgggtctctct

SEQ ID NO: 3446286 - DNA, 17 bp, Homo sapiens
ggcctcaactcctccca

SEQ ID NO: 3446287 - DNA, 18 bp, Homo sapiens
ggcctcaactcctcccat

SEQ ID NO: 3446288 - DNA, 13 bp, Homo sapiens
ggcctcacccacc

SEQ ID NO: 3446289 - DNA, 17 bp, Homo sapiens
ggcctcacccacccctg

SEQ ID NO: 3446290 - DNA, 18 bp, Homo sapiens
ggcctcacccacccctgc

SEQ ID NO: 3446291 - DNA, 15 bp, Homo sapiens
ggcctcagccagaga

SEQ ID NO: 3446292 - DNA, 13 bp, Homo sapiens
ggcctcagtgccc

SEQ ID NO: 3446293 - DNA, 14 bp, Homo sapiens
ggcctcagtgcccc

SEQ ID NO: 3446294 - DNA, 18 bp, Homo sapiens
ggcctcatctctgcctga

SEQ ID NO: 3446295 - DNA, 19 bp, Homo sapiens
ggcctcatctctgcctgac

SEQ ID NO: 3446296 - DNA, 15 bp, Homo sapiens
ggcctcatgtggctg

SEQ ID NO: 3446297 - DNA, 22 bp, Homo sapiens
ggcctccatcctcatctctctt

SEQ ID NO: 3446298 - DNA, 16 bp, Homo sapiens
ggcctcccacagactc

SEQ ID NO: 3446299 - DNA, 22 bp, Homo sapiens
ggcctcccctgccaccaggcca

SEQ ID NO: 3446300 - DNA, 14 bp, Homo sapiens
ggcctcctgtgtgt

SEQ ID NO: 3446301 - DNA, 21 bp, Homo sapiens
ggcctcttgaagagaaaaaag

SEQ ID NO: 3446302 - DNA, 13 bp, Homo sapiens
ggcctcttggcag

SEQ ID NO: 3446303 - DNA, 22 bp, Homo sapiens
ggcctgaaaggagcccttatct

SEQ ID NO: 3446304 - DNA, 18 bp, Homo sapiens
ggcctgaagccagctgcc

SEQ ID NO: 3446305 - DNA, 19 bp, Homo sapiens
ggcctgaatcatgagcctg

SEQ ID NO: 3446306 - DNA, 21 bp, Homo sapiens
ggcctgaatcatgagcctgct

SEQ ID NO: 3446307 - DNA, 23 bp, Homo sapiens
ggcctgaatgcttataggtggcc

SEQ ID NO: 3446308 - DNA, 13 bp, Homo sapiens
ggcctgactgctc

SEQ ID NO: 3446309 - DNA, 21 bp, Homo sapiens
ggcctgagagtcagctctctg

SEQ ID NO: 3446310 - DNA, 22 bp, Homo sapiens
ggcctgagatttcatctgctct

SEQ ID NO: 3446311 - DNA, 15 bp, Homo sapiens
ggcctgagcctggcc

SEQ ID NO: 3446312 - DNA, 12 bp, Homo sapiens
ggcctgagctgc

SEQ ID NO: 3446313 - DNA, 16 bp, Homo sapiens
ggcctgagctgcttca

SEQ ID NO: 3446314 - DNA, 20 bp, Homo sapiens
ggcctgatcagaccacggct

SEQ ID NO: 3446315 - DNA, 21 bp, Homo sapiens
ggcctgccgggctgagggcct

SEQ ID NO: 3446316 - DNA, 19 bp, Homo sapiens
ggcctgcctccagggctgg

SEQ ID NO: 3446317 - DNA, 15 bp, Homo sapiens
ggcctgctggaggcc

SEQ ID NO: 3446318 - DNA, 21 bp, Homo sapiens
ggcctgctggaggcctcaggt

SEQ ID NO: 3446319 - DNA, 16 bp, Homo sapiens
ggcctggcagctcagc

SEQ ID NO: 3446320 - DNA, 22 bp, Homo sapiens
ggcctggccagggcctggaaga

SEQ ID NO: 3446321 - DNA, 17 bp, Homo sapiens
ggcctgggacttccatg

SEQ ID NO: 3446322 - DNA, 15 bp, Homo sapiens
ggcctgggccgctgc

SEQ ID NO: 3446323 - DNA, 20 bp, Homo sapiens
ggcctgggggacccctggct

SEQ ID NO: 3446324 - DNA, 22 bp, Homo sapiens
ggcctgggggacccctggctct

SEQ ID NO: 3446325 - DNA, 11 bp, Homo sapiens
ggcctggtccc

SEQ ID NO: 3446326 - DNA, 14 bp, Homo sapiens
ggcctggtccctgt

SEQ ID NO: 3446327 - DNA, 17 bp, Homo sapiens
ggcctggttgaagaaga

SEQ ID NO: 3446328 - DNA, 21 bp, Homo sapiens
ggcctgttttagaaggttctc

SEQ ID NO: 3446329 - DNA, 23 bp, Homo sapiens
ggccttcagacacatgctatgtt

SEQ ID NO: 3446330 - DNA, 23 bp, Homo sapiens
ggccttcccgccggaggccagct

SEQ ID NO: 3446331 - DNA, 19 bp, Homo sapiens
ggccttctcccctcttctg

SEQ ID NO: 3446332 - DNA, 12 bp, Homo sapiens
ggccttctctga

SEQ ID NO: 3446333 - DNA, 18 bp, Homo sapiens
ggccttgatgactgcctt

SEQ ID NO: 3446334 - DNA, 14 bp, Homo sapiens
ggcctttggcttca

SEQ ID NO: 3446335 - DNA, 21 bp, Homo sapiens
ggcgagccctgtggatgagcc

SEQ ID NO: 3446336 - DNA, 23 bp, Homo sapiens
ggcgagtgaatgccagtgtgctg

SEQ ID NO: 3446337 - DNA, 18 bp, Homo sapiens
ggcgatcacaacgtgcat

SEQ ID NO: 3446338 - DNA, 20 bp, Homo sapiens
ggcgatcacaacgtgcattg

SEQ ID NO: 3446339 - DNA, 15 bp, Homo sapiens
ggcgcaaagggcatg

SEQ ID NO: 3446340 - DNA, 15 bp, Homo sapiens
ggcggagctggcccc

SEQ ID NO: 3446341 - DNA, 17 bp, Homo sapiens
ggcggagctggccccgc

SEQ ID NO: 3446342 - DNA, 21 bp, Homo sapiens
ggcggaggttccagtgagccg

SEQ ID NO: 3446343 - DNA, 18 bp, Homo sapiens
ggcggcaggggcctggag

SEQ ID NO: 3446344 - DNA, 17 bp, Homo sapiens
ggcgggcagagggctgg

SEQ ID NO: 3446345 - DNA, 23 bp, Homo sapiens
ggcggtgcccacaccggggacag

SEQ ID NO: 3446346 - DNA, 16 bp, Homo sapiens
ggcgtctgttccccct

SEQ ID NO: 3446347 - DNA, 19 bp, Homo sapiens
ggcgtgcagtggtgcgatc

SEQ ID NO: 3446348 - DNA, 12 bp, Homo sapiens
ggcgtggagctg

SEQ ID NO: 3446349 - DNA, 21 bp, Homo sapiens
ggctaaacatccaatattttc

SEQ ID NO: 3446350 - DNA, 13 bp, Homo sapiens
ggctacgcctctt

SEQ ID NO: 3446351 - DNA, 17 bp, Homo sapiens
ggctagtcaagctcctc

SEQ ID NO: 3446352 - DNA, 19 bp, Homo sapiens
ggctagtcaagctcctcct

SEQ ID NO: 3446353 - DNA, 22 bp, Homo sapiens
ggctagtcaagctcctcctccc

SEQ ID NO: 3446354 - DNA, 17 bp, Homo sapiens
ggctatggtgtggactg

SEQ ID NO: 3446355 - DNA, 18 bp, Homo sapiens
ggctcacacacctgtagc

SEQ ID NO: 3446356 - DNA, 16 bp, Homo sapiens
ggctcacacctgtaat

SEQ ID NO: 3446357 - DNA, 18 bp, Homo sapiens
ggctcacactgagaatgt

SEQ ID NO: 3446358 - DNA, 17 bp, Homo sapiens
ggctcacccccttctcc

SEQ ID NO: 3446359 - DNA, 22 bp, Homo sapiens
ggctcacccccttctccatcca

SEQ ID NO: 3446360 - DNA, 14 bp, Homo sapiens
ggctcactgcagcc

SEQ ID NO: 3446361 - DNA, 17 bp, Homo sapiens
ggctcactgcagcctca

SEQ ID NO: 3446362 - DNA, 19 bp, Homo sapiens
ggctcagcaaaagatgctt

SEQ ID NO: 3446363 - DNA, 19 bp, Homo sapiens
ggctcagcggggacagctc

SEQ ID NO: 3446364 - DNA, 20 bp, Homo sapiens
ggctcagcggggacagctcc

SEQ ID NO: 3446365 - DNA, 22 bp, Homo sapiens
ggctcagcggggacagctcctt

SEQ ID NO: 3446366 - DNA, 19 bp, Homo sapiens
ggctcagtgcaacctctgc

SEQ ID NO: 3446367 - DNA, 22 bp, Homo sapiens
ggctcattctgcaccttgccag

SEQ ID NO: 3446368 - DNA, 22 bp, Homo sapiens
ggctccagagggcactctgctt

SEQ ID NO: 3446369 - DNA, 18 bp, Homo sapiens
ggctccagatgcagggca

SEQ ID NO: 3446370 - DNA, 18 bp, Homo sapiens
ggctccagccatctcatg

SEQ ID NO: 3446371 - DNA, 12 bp, Homo sapiens
ggctccagctca

SEQ ID NO: 3446372 - DNA, 11 bp, Homo sapiens
ggctccaggct

SEQ ID NO: 3446373 - DNA, 16 bp, Homo sapiens
ggctcccagcctcagc

SEQ ID NO: 3446374 - DNA, 17 bp, Homo sapiens
ggctcccagcctcagcg

SEQ ID NO: 3446375 - DNA, 15 bp, Homo sapiens
ggctcccggaattcc

SEQ ID NO: 3446376 - DNA, 16 bp, Homo sapiens
ggctccctcttctttc

SEQ ID NO: 3446377 - DNA, 20 bp, Homo sapiens
ggctccctgtaacctcttca

SEQ ID NO: 3446378 - DNA, 21 bp, Homo sapiens
ggctccctgtaacctcttcag

SEQ ID NO: 3446379 - DNA, 20 bp, Homo sapiens
ggctccgaaattccaaggcc

SEQ ID NO: 3446380 - DNA, 12 bp, Homo sapiens
ggctcctctcag

SEQ ID NO: 3446381 - DNA, 11 bp, Homo sapiens
ggctcctctta

SEQ ID NO: 3446382 - DNA, 19 bp, Homo sapiens
ggctcctgagggagctcca

SEQ ID NO: 3446383 - DNA, 9 bp, Homo sapiens
ggctcctgc

SEQ ID NO: 3446384 - DNA, 20 bp, Homo sapiens
ggctcgaatctctgtgcctt

SEQ ID NO: 3446385 - DNA, 21 bp, Homo sapiens
ggctcgagcagtcctgcctca

SEQ ID NO: 3446386 - DNA, 18 bp, Homo sapiens
ggctctataaggcagcct

SEQ ID NO: 3446387 - DNA, 20 bp, Homo sapiens
ggctctatttcttcttcaca

SEQ ID NO: 3446388 - DNA, 16 bp, Homo sapiens
ggctctgaagcaaggc

SEQ ID NO: 3446389 - DNA, 15 bp, Homo sapiens
ggctctggccaaggg

SEQ ID NO: 3446390 - DNA, 17 bp, Homo sapiens
ggctcttctccccagag

SEQ ID NO: 3446391 - DNA, 20 bp, Homo sapiens
ggctcttctccttggaggac

SEQ ID NO: 3446392 - DNA, 12 bp, Homo sapiens
ggctcttttact

SEQ ID NO: 3446393 - DNA, 14 bp, Homo sapiens
ggctgaaccctcag

SEQ ID NO: 3446394 - DNA, 16 bp, Homo sapiens
ggctgaaccctcagcc

SEQ ID NO: 3446395 - DNA, 16 bp, Homo sapiens
ggctgaccacagcaca

SEQ ID NO: 3446396 - DNA, 21 bp, Homo sapiens
ggctgagggcctgctggaggc

SEQ ID NO: 3446397 - DNA, 22 bp, Homo sapiens
ggctgatgtcaatttctgtgtt

SEQ ID NO: 3446398 - DNA, 23 bp, Homo sapiens
ggctgcaaagggtatcaggtgct

SEQ ID NO: 3446399 - DNA, 19 bp, Homo sapiens
ggctgcagagtctgcccca

SEQ ID NO: 3446400 - DNA, 21 bp, Homo sapiens
ggctgccccgggtccccagct

SEQ ID NO: 3446401 - DNA, 22 bp, Homo sapiens
ggctgccccgggtccccagctc

SEQ ID NO: 3446402 - DNA, 16 bp, Homo sapiens
ggctgccgtggggccg

SEQ ID NO: 3446403 - DNA, 23 bp, Homo sapiens
ggctgccgtggggccgccgcctc

SEQ ID NO: 3446404 - DNA, 21 bp, Homo sapiens
ggctgctgacctccacagctt

SEQ ID NO: 3446405 - DNA, 11 bp, Homo sapiens
ggctgctggga

SEQ ID NO: 3446406 - DNA, 15 bp, Homo sapiens
ggctgcttcctcctg

SEQ ID NO: 3446407 - DNA, 16 bp, Homo sapiens
ggctgcttcctcctgg

SEQ ID NO: 3446408 - DNA, 18 bp, Homo sapiens
ggctgcttcctcctggaa

SEQ ID NO: 3446409 - DNA, 19 bp, Homo sapiens
ggctgcttcctcctggaaa

SEQ ID NO: 3446410 - DNA, 17 bp, Homo sapiens
ggctgctttctcctttc

SEQ ID NO: 3446411 - DNA, 20 bp, Homo sapiens
ggctggaatgcagtggtgcg

SEQ ID NO: 3446412 - DNA, 23 bp, Homo sapiens
ggctggagcccagggagcggaaa

SEQ ID NO: 3446413 - DNA, 14 bp, Homo sapiens
ggctggagtgagga

SEQ ID NO: 3446414 - DNA, 12 bp, Homo sapiens
ggctggcatgat

SEQ ID NO: 3446415 - DNA, 16 bp, Homo sapiens
ggctggccagtccagg

SEQ ID NO: 3446416 - DNA, 20 bp, Homo sapiens
ggctggcctcccaaatgagc

SEQ ID NO: 3446417 - DNA, 22 bp, Homo sapiens
ggctggctccagatgcagggca

SEQ ID NO: 3446418 - DNA, 14 bp, Homo sapiens
ggctgggaggagcc

SEQ ID NO: 3446419 - DNA, 21 bp, Homo sapiens
ggctgggcagcacaaggcctt

SEQ ID NO: 3446420 - DNA, 11 bp, Homo sapiens
ggctgggcttc

SEQ ID NO: 3446421 - DNA, 22 bp, Homo sapiens
ggctgggcttcagtggcagctg

SEQ ID NO: 3446422 - DNA, 18 bp, Homo sapiens
ggctggggaagtcctctg

SEQ ID NO: 3446423 - DNA, 15 bp, Homo sapiens
ggctgggggagagcc

SEQ ID NO: 3446424 - DNA, 16 bp, Homo sapiens
ggctgggggagagccg

SEQ ID NO: 3446425 - DNA, 15 bp, Homo sapiens
ggctgggggcctcag

SEQ ID NO: 3446426 - DNA, 19 bp, Homo sapiens
ggctgggggcctcagtgcc

SEQ ID NO: 3446427 - DNA, 16 bp, Homo sapiens
ggctggggtggcctgt

SEQ ID NO: 3446428 - DNA, 19 bp, Homo sapiens
ggctgggtggcaccagcag

SEQ ID NO: 3446429 - DNA, 16 bp, Homo sapiens
ggctggtgtcacctga

SEQ ID NO: 3446430 - DNA, 16 bp, Homo sapiens
ggctggttccatctag

SEQ ID NO: 3446431 - DNA, 15 bp, Homo sapiens
ggctgtgactcttct

SEQ ID NO: 3446432 - DNA, 19 bp, Homo sapiens
ggctgtgactcttctctca

SEQ ID NO: 3446433 - DNA, 20 bp, Homo sapiens
ggctgtgactcttctctcaa

SEQ ID NO: 3446434 - DNA, 19 bp, Homo sapiens
ggctgtgctacctgagcca

SEQ ID NO: 3446435 - DNA, 13 bp, Homo sapiens
ggctgtgctggga

SEQ ID NO: 3446436 - DNA, 13 bp, Homo sapiens
ggctgtggagaca

SEQ ID NO: 3446437 - DNA, 16 bp, Homo sapiens
ggctgtgtctaaactg

SEQ ID NO: 3446438 - DNA, 16 bp, Homo sapiens
ggctgttggctggggg

SEQ ID NO: 3446439 - DNA, 24 bp, Homo sapiens
ggcttcagcctagtggcttgtcct

SEQ ID NO: 3446440 - DNA, 16 bp, Homo sapiens
ggcttcagggcaggtg

SEQ ID NO: 3446441 - DNA, 13 bp, Homo sapiens
ggcttcaggtcca

SEQ ID NO: 3446442 - DNA, 17 bp, Homo sapiens
ggcttcagtggcagctg

SEQ ID NO: 3446443 - DNA, 20 bp, Homo sapiens
ggcttcagtggcagctgctt

SEQ ID NO: 3446444 - DNA, 19 bp, Homo sapiens
ggcttcatctctttagaga

SEQ ID NO: 3446445 - DNA, 20 bp, Homo sapiens
ggcttcccagtggctgctgc

SEQ ID NO: 3446446 - DNA, 21 bp, Homo sapiens
ggcttcccagtggctgctgcc

SEQ ID NO: 3446447 - DNA, 20 bp, Homo sapiens
ggcttgagcccccgcgccca

SEQ ID NO: 3446448 - DNA, 13 bp, Homo sapiens
ggcttgcctgcag

SEQ ID NO: 3446449 - DNA, 17 bp, Homo sapiens
ggcttggatcctgggct

SEQ ID NO: 3446450 - DNA, 19 bp, Homo sapiens
ggcttggatcctgggctgg

SEQ ID NO: 3446451 - DNA, 15 bp, Homo sapiens
ggcttggggcttcct

SEQ ID NO: 3446452 - DNA, 18 bp, Homo sapiens
ggctttatcctctttaga

SEQ ID NO: 3446453 - DNA, 19 bp, Homo sapiens
ggctttcgtccacagcttc

SEQ ID NO: 3446454 - DNA, 22 bp, Homo sapiens
ggctttcgtccacagcttcctg

SEQ ID NO: 3446455 - DNA, 22 bp, Homo sapiens
ggctttgattagttttcttgtt

SEQ ID NO: 3446456 - DNA, 21 bp, Homo sapiens
ggctttttactattaacatga

SEQ ID NO: 3446457 - DNA, 19 bp, Homo sapiens
gggaaacaggttgggatgg

SEQ ID NO: 3446458 - DNA, 12 bp, Homo sapiens
gggaaatgcatt

SEQ ID NO: 3446459 - DNA, 14 bp, Homo sapiens
gggaaatgcattta

SEQ ID NO: 3446460 - DNA, 13 bp, Homo sapiens
gggaaatggcctt

SEQ ID NO: 3446461 - DNA, 16 bp, Homo sapiens
gggaaatggccttccc

SEQ ID NO: 3446462 - DNA, 19 bp, Homo sapiens
gggaagaaaagagctttct

SEQ ID NO: 3446463 - DNA, 18 bp, Homo sapiens
gggaaggggacccccgcc

SEQ ID NO: 3446464 - DNA, 14 bp, Homo sapiens
gggaagtccccagg

SEQ ID NO: 3446465 - DNA, 18 bp, Homo sapiens
gggaatatttgaatcttg

SEQ ID NO: 3446466 - DNA, 17 bp, Homo sapiens
gggaatgcctgagtgcc

SEQ ID NO: 3446467 - DNA, 21 bp, Homo sapiens
gggaatgcctgagtgcctggc

SEQ ID NO: 3446468 - DNA, 19 bp, Homo sapiens
gggaatgtttgcctctgcc

SEQ ID NO: 3446469 - DNA, 21 bp, Homo sapiens
gggaatgtttgcctctgcctc

SEQ ID NO: 3446470 - DNA, 13 bp, Homo sapiens
gggacaaggaagg

SEQ ID NO: 3446471 - DNA, 20 bp, Homo sapiens
gggacagaggccccagcctc

SEQ ID NO: 3446472 - DNA, 13 bp, Homo sapiens
gggacagctcctt

SEQ ID NO: 3446473 - DNA, 16 bp, Homo sapiens
gggacagctccttctg

SEQ ID NO: 3446474 - DNA, 11 bp, Homo sapiens
gggacagctgt

SEQ ID NO: 3446475 - DNA, 17 bp, Homo sapiens
gggacagtgctgcagct

SEQ ID NO: 3446476 - DNA, 19 bp, Homo sapiens
gggacatcaggagactggg

SEQ ID NO: 3446477 - DNA, 14 bp, Homo sapiens
gggacccccgcccc

SEQ ID NO: 3446478 - DNA, 17 bp, Homo sapiens
gggacccccgccccctg

SEQ ID NO: 3446479 - DNA, 24 bp, Homo sapiens
gggacccccgccccctgccctccc

SEQ ID NO: 3446480 - DNA, 16 bp, Homo sapiens
gggacgcaggcccctc

SEQ ID NO: 3446481 - DNA, 21 bp, Homo sapiens
gggacgcctgggggtgccagg

SEQ ID NO: 3446482 - DNA, 18 bp, Homo sapiens
gggacgtggctcagccag

SEQ ID NO: 3446483 - DNA, 22 bp, Homo sapiens
gggacgtggctcagccagcact

SEQ ID NO: 3446484 - DNA, 23 bp, Homo sapiens
gggactcaatgcactgacattgt

SEQ ID NO: 3446485 - DNA, 22 bp, Homo sapiens
gggactcagccttcagacagag

SEQ ID NO: 3446486 - DNA, 17 bp, Homo sapiens
gggactccggctgtgct

SEQ ID NO: 3446487 - DNA, 18 bp, Homo sapiens
gggactccggctgtgctg

SEQ ID NO: 3446488 - DNA, 19 bp, Homo sapiens
gggactccggctgtgctgg

SEQ ID NO: 3446489 - DNA, 15 bp, Homo sapiens
gggacttggaagctc

SEQ ID NO: 3446490 - DNA, 15 bp, Homo sapiens
gggagaaaattcaat

SEQ ID NO: 3446491 - DNA, 13 bp, Homo sapiens
gggagacctggac

SEQ ID NO: 3446492 - DNA, 16 bp, Homo sapiens
gggagccactgccact

SEQ ID NO: 3446493 - DNA, 15 bp, Homo sapiens
gggagccatttgaga

SEQ ID NO: 3446494 - DNA, 19 bp, Homo sapiens
gggagccccttctgctcag

SEQ ID NO: 3446495 - DNA, 15 bp, Homo sapiens
gggagctagccagag

SEQ ID NO: 3446496 - DNA, 18 bp, Homo sapiens
gggagctagccagaggac

SEQ ID NO: 3446497 - DNA, 19 bp, Homo sapiens
gggagctccactctgcttc

SEQ ID NO: 3446498 - DNA, 23 bp, Homo sapiens
gggagctccactctgcttctctg

SEQ ID NO: 3446499 - DNA, 13 bp, Homo sapiens
gggagctgcctgt

SEQ ID NO: 3446500 - DNA, 22 bp, Homo sapiens
gggagctgcctgttcagctcca

SEQ ID NO: 3446501 - DNA, 23 bp, Homo sapiens
gggaggatctcttgagcctggga

SEQ ID NO: 3446502 - DNA, 18 bp, Homo sapiens
gggaggctgaggcggaag

SEQ ID NO: 3446503 - DNA, 22 bp, Homo sapiens
gggagggattctggttccaggg

SEQ ID NO: 3446504 - DNA, 11 bp, Homo sapiens
gggagggcagc

SEQ ID NO: 3446505 - DNA, 13 bp, Homo sapiens
gggagggctgcga

SEQ ID NO: 3446506 - DNA, 15 bp, Homo sapiens
gggaggtcgaggcag

SEQ ID NO: 3446507 - DNA, 16 bp, Homo sapiens
gggagtatgcaaaagt

SEQ ID NO: 3446508 - DNA, 21 bp, Homo sapiens
gggagtatgcaaaagttctga

SEQ ID NO: 3446509 - DNA, 14 bp, Homo sapiens
gggagtgagctggt

SEQ ID NO: 3446510 - DNA, 15 bp, Homo sapiens
gggagttaagacctg

SEQ ID NO: 3446511 - DNA, 17 bp, Homo sapiens
gggatccgactgctttg

SEQ ID NO: 3446512 - DNA, 16 bp, Homo sapiens
gggatgattcaagcca

SEQ ID NO: 3446513 - DNA, 20 bp, Homo sapiens
gggatgccactcctccctcc

SEQ ID NO: 3446514 - DNA, 16 bp, Homo sapiens
gggatgccctggaggt

SEQ ID NO: 3446515 - DNA, 19 bp, Homo sapiens
gggattctggttccagggt

SEQ ID NO: 3446516 - DNA, 14 bp, Homo sapiens
gggcaaagcctagt

SEQ ID NO: 3446517 - DNA, 13 bp, Homo sapiens
gggcacacactgt

SEQ ID NO: 3446518 - DNA, 15 bp, Homo sapiens
gggcacagcatctgt

SEQ ID NO: 3446519 - DNA, 20 bp, Homo sapiens
gggcactcagaagacactga

SEQ ID NO: 3446520 - DNA, 14 bp, Homo sapiens
gggcacttccctgc

SEQ ID NO: 3446521 - DNA, 14 bp, Homo sapiens
gggcagagcccaag

SEQ ID NO: 3446522 - DNA, 14 bp, Homo sapiens
gggcagagggctgg

SEQ ID NO: 3446523 - DNA, 15 bp, Homo sapiens
gggcagagggctgga

SEQ ID NO: 3446524 - DNA, 17 bp, Homo sapiens
gggcagagtgagaccca

SEQ ID NO: 3446525 - DNA, 14 bp, Homo sapiens
gggcagcagggcta

SEQ ID NO: 3446526 - DNA, 16 bp, Homo sapiens
gggcagcgccaggctg

SEQ ID NO: 3446527 - DNA, 23 bp, Homo sapiens
gggcaggactcagctccccagag

SEQ ID NO: 3446528 - DNA, 15 bp, Homo sapiens
gggcaggcatgaagt

SEQ ID NO: 3446529 - DNA, 12 bp, Homo sapiens
gggcagggagcg

SEQ ID NO: 3446530 - DNA, 14 bp, Homo sapiens
gggcatgtgggctt

SEQ ID NO: 3446531 - DNA, 23 bp, Homo sapiens
gggcattgatggggaaggaggct

SEQ ID NO: 3446532 - DNA, 17 bp, Homo sapiens
gggccaaacgctgagcc

SEQ ID NO: 3446533 - DNA, 13 bp, Homo sapiens
gggccaagccagc

SEQ ID NO: 3446534 - DNA, 23 bp, Homo sapiens
gggccacagagaaagtacttctc

SEQ ID NO: 3446535 - DNA, 16 bp, Homo sapiens
gggccacgctccagct

SEQ ID NO: 3446536 - DNA, 12 bp, Homo sapiens
gggccagagcca

SEQ ID NO: 3446537 - DNA, 16 bp, Homo sapiens
gggccagatccagcct

SEQ ID NO: 3446538 - DNA, 17 bp, Homo sapiens
gggccagatccagcctg

SEQ ID NO: 3446539 - DNA, 18 bp, Homo sapiens
gggccagatccagcctgg

SEQ ID NO: 3446540 - DNA, 12 bp, Homo sapiens
gggccagggctg

SEQ ID NO: 3446541 - DNA, 23 bp, Homo sapiens
gggccatgatggcaacagatctg

SEQ ID NO: 3446542 - DNA, 23 bp, Homo sapiens
gggccatgctgaggcctgggccg

SEQ ID NO: 3446543 - DNA, 17 bp, Homo sapiens
gggcccagagcccagct

SEQ ID NO: 3446544 - DNA, 14 bp, Homo sapiens
gggcccccatctca

SEQ ID NO: 3446545 - DNA, 15 bp, Homo sapiens
gggcccccctgccct

SEQ ID NO: 3446546 - DNA, 14 bp, Homo sapiens
gggccctctcttct

SEQ ID NO: 3446547 - DNA, 14 bp, Homo sapiens
gggccctgagccag

SEQ ID NO: 3446548 - DNA, 14 bp, Homo sapiens
gggccctgggctgg

SEQ ID NO: 3446549 - DNA, 18 bp, Homo sapiens
gggccgattgggagaaag

SEQ ID NO: 3446550 - DNA, 20 bp, Homo sapiens
gggccgtatctccggctccc

SEQ ID NO: 3446551 - DNA, 24 bp, Homo sapiens
gggccgtatctccggctcccagcc

SEQ ID NO: 3446552 - DNA, 14 bp, Homo sapiens
gggcctccagaact

SEQ ID NO: 3446553 - DNA, 21 bp, Homo sapiens
gggcctgccgggctgagggcc

SEQ ID NO: 3446554 - DNA, 17 bp, Homo sapiens
gggcctgctccagacct

SEQ ID NO: 3446555 - DNA, 12 bp, Homo sapiens
gggcctggggct

SEQ ID NO: 3446556 - DNA, 18 bp, Homo sapiens
gggcctggtcgttttcaa

SEQ ID NO: 3446557 - DNA, 14 bp, Homo sapiens
gggcctttgagcct

SEQ ID NO: 3446558 - DNA, 16 bp, Homo sapiens
gggcgcggtggctcac

SEQ ID NO: 3446559 - DNA, 16 bp, Homo sapiens
gggcggagaggctgca

SEQ ID NO: 3446560 - DNA, 17 bp, Homo sapiens
gggcggcaggggcctgg

SEQ ID NO: 3446561 - DNA, 17 bp, Homo sapiens
gggcgtctgttccccct

SEQ ID NO: 3446562 - DNA, 21 bp, Homo sapiens
gggctaccctgagctgaggca

SEQ ID NO: 3446563 - DNA, 10 bp, Homo sapiens
gggctcagca

SEQ ID NO: 3446564 - DNA, 13 bp, Homo sapiens
gggctcccagggc

SEQ ID NO: 3446565 - DNA, 15 bp, Homo sapiens
gggctcccgggcccc

SEQ ID NO: 3446566 - DNA, 18 bp, Homo sapiens
gggctccctgactgggag

SEQ ID NO: 3446567 - DNA, 18 bp, Homo sapiens
gggctcctgcacttactt

SEQ ID NO: 3446568 - DNA, 16 bp, Homo sapiens
gggctctggccaaggg

SEQ ID NO: 3446569 - DNA, 21 bp, Homo sapiens
gggctctggccaagggccaga

SEQ ID NO: 3446570 - DNA, 14 bp, Homo sapiens
gggctgaaccctca

SEQ ID NO: 3446571 - DNA, 18 bp, Homo sapiens
gggctgaaccctcagcct

SEQ ID NO: 3446572 - DNA, 12 bp, Homo sapiens
gggctgagggag

SEQ ID NO: 3446573 - DNA, 14 bp, Homo sapiens
gggctgagggagcc

SEQ ID NO: 3446574 - DNA, 13 bp, Homo sapiens
gggctgagggcct

SEQ ID NO: 3446575 - DNA, 14 bp, Homo sapiens
gggctgagggcctg

SEQ ID NO: 3446576 - DNA, 16 bp, Homo sapiens
gggctgagggcctgct

SEQ ID NO: 3446577 - DNA, 11 bp, Homo sapiens
gggctgcatga

SEQ ID NO: 3446578 - DNA, 20 bp, Homo sapiens
gggctgcccctaatctctgt

SEQ ID NO: 3446579 - DNA, 22 bp, Homo sapiens
gggctgcggcgtacaggctggc

SEQ ID NO: 3446580 - DNA, 17 bp, Homo sapiens
gggctgcttcctcctgg

SEQ ID NO: 3446581 - DNA, 20 bp, Homo sapiens
gggctgcttcctcctggaaa

SEQ ID NO: 3446582 - DNA, 15 bp, Homo sapiens
gggctggaggcccag

SEQ ID NO: 3446583 - DNA, 20 bp, Homo sapiens
gggctggcttttctgtttcc

SEQ ID NO: 3446584 - DNA, 23 bp, Homo sapiens
gggctggttctgtaattgtgtgt

SEQ ID NO: 3446585 - DNA, 18 bp, Homo sapiens
gggctgtaaaatgcatga

SEQ ID NO: 3446586 - DNA, 20 bp, Homo sapiens
gggctgtagtttggagacaa

SEQ ID NO: 3446587 - DNA, 19 bp, Homo sapiens
gggcttcagcctagtggct

SEQ ID NO: 3446588 - DNA, 18 bp, Homo sapiens
gggcttcagtggcagctg

SEQ ID NO: 3446589 - DNA, 20 bp, Homo sapiens
gggcttcatctctttagaga

SEQ ID NO: 3446590 - DNA, 21 bp, Homo sapiens
gggcttcatctctttagagaa

SEQ ID NO: 3446591 - DNA, 21 bp, Homo sapiens
gggcttcccagtggctgctgc

SEQ ID NO: 3446592 - DNA, 23 bp, Homo sapiens
gggcttcccagtggctgctgccc

SEQ ID NO: 3446593 - DNA, 16 bp, Homo sapiens
gggcttgccccactct

SEQ ID NO: 3446594 - DNA, 14 bp, Homo sapiens
ggggaaaaaaatgt

SEQ ID NO: 3446595 - DNA, 18 bp, Homo sapiens
ggggaactcagatccagg

SEQ ID NO: 3446596 - DNA, 13 bp, Homo sapiens
ggggacccccgcc

SEQ ID NO: 3446597 - DNA, 21 bp, Homo sapiens
ggggacccctggctctgggcc

SEQ ID NO: 3446598 - DNA, 15 bp, Homo sapiens
ggggacctaggctcc

SEQ ID NO: 3446599 - DNA, 20 bp, Homo sapiens
ggggaccttttgggggaggg

SEQ ID NO: 3446600 - DNA, 17 bp, Homo sapiens
ggggacgcaggcccctc

SEQ ID NO: 3446601 - DNA, 18 bp, Homo sapiens
ggggactccggctgtgct

SEQ ID NO: 3446602 - DNA, 22 bp, Homo sapiens
ggggactccggctgtgctggga

SEQ ID NO: 3446603 - DNA, 15 bp, Homo sapiens
ggggagggggatccg

SEQ ID NO: 3446604 - DNA, 14 bp, Homo sapiens
ggggagtagagaag

SEQ ID NO: 3446605 - DNA, 20 bp, Homo sapiens
ggggcagatcttggactcat

SEQ ID NO: 3446606 - DNA, 13 bp, Homo sapiens
ggggccagaggct

SEQ ID NO: 3446607 - DNA, 15 bp, Homo sapiens
ggggcccccctgccc

SEQ ID NO: 3446608 - DNA, 15 bp, Homo sapiens
ggggcccggccagcc

SEQ ID NO: 3446609 - DNA, 14 bp, Homo sapiens
ggggccgctgccac

SEQ ID NO: 3446610 - DNA, 23 bp, Homo sapiens
ggggcctacagctttgatccctg

SEQ ID NO: 3446611 - DNA, 23 bp, Homo sapiens
ggggcctaggcctcagccagaga

SEQ ID NO: 3446612 - DNA, 16 bp, Homo sapiens
ggggcctgggacttcc

SEQ ID NO: 3446613 - DNA, 17 bp, Homo sapiens
ggggccttatcgggctc

SEQ ID NO: 3446614 - DNA, 12 bp, Homo sapiens
ggggctctggga

SEQ ID NO: 3446615 - DNA, 14 bp, Homo sapiens
ggggctcttctcat

SEQ ID NO: 3446616 - DNA, 14 bp, Homo sapiens
ggggctgagctggg

SEQ ID NO: 3446617 - DNA, 19 bp, Homo sapiens
ggggctgaggtgggaggat

SEQ ID NO: 3446618 - DNA, 16 bp, Homo sapiens
ggggctgcttcctcct

SEQ ID NO: 3446619 - DNA, 21 bp, Homo sapiens
ggggcttcatctctttagaga

SEQ ID NO: 3446620 - DNA, 17 bp, Homo sapiens
gggggaactcagatcca

SEQ ID NO: 3446621 - DNA, 15 bp, Homo sapiens
gggggaccccttccc

SEQ ID NO: 3446622 - DNA, 17 bp, Homo sapiens
gggggatcacagcctct

SEQ ID NO: 3446623 - DNA, 15 bp, Homo sapiens
gggggcctcagtgcc

SEQ ID NO: 3446624 - DNA, 23 bp, Homo sapiens
gggggtggccgctgagtggcagg

SEQ ID NO: 3446625 - DNA, 14 bp, Homo sapiens
ggggtagaggctgg

SEQ ID NO: 3446626 - DNA, 18 bp, Homo sapiens
ggggtcctgccggagagg

SEQ ID NO: 3446627 - DNA, 13 bp, Homo sapiens
ggggtcctggcca

SEQ ID NO: 3446628 - DNA, 21 bp, Homo sapiens
ggggtctggagttgatctgga

SEQ ID NO: 3446629 - DNA, 23 bp, Homo sapiens
ggggtctgggaggaatggacaga

SEQ ID NO: 3446630 - DNA, 22 bp, Homo sapiens
ggggtctgggagtcaggcccgg

SEQ ID NO: 3446631 - DNA, 16 bp, Homo sapiens
ggggtgcttccttgta

SEQ ID NO: 3446632 - DNA, 13 bp, Homo sapiens
ggggtggcctgtg

SEQ ID NO: 3446633 - DNA, 20 bp, Homo sapiens
ggggtgtttgggaggctgcg

SEQ ID NO: 3446634 - DNA, 20 bp, Homo sapiens
gggtaatttagattgtaaac

SEQ ID NO: 3446635 - DNA, 13 bp, Homo sapiens
gggtacccactgc

SEQ ID NO: 3446636 - DNA, 19 bp, Homo sapiens
gggtacttgtggacacagc

SEQ ID NO: 3446637 - DNA, 22 bp, Homo sapiens
gggtacttgtggacacagctct

SEQ ID NO: 3446638 - DNA, 17 bp, Homo sapiens
gggtagaggctgggagg

SEQ ID NO: 3446639 - DNA, 16 bp, Homo sapiens
gggtagctagaggaac

SEQ ID NO: 3446640 - DNA, 20 bp, Homo sapiens
gggtatcaggtgctgccatc

SEQ ID NO: 3446641 - DNA, 16 bp, Homo sapiens
gggtcagaaacaggac

SEQ ID NO: 3446642 - DNA, 18 bp, Homo sapiens
gggtcagaaacaggaccg

SEQ ID NO: 3446643 - DNA, 20 bp, Homo sapiens
gggtcagaaccctgccatgg

SEQ ID NO: 3446644 - DNA, 14 bp, Homo sapiens
gggtccccagctcc

SEQ ID NO: 3446645 - DNA, 19 bp, Homo sapiens
gggtccccagctccccagg

SEQ ID NO: 3446646 - DNA, 16 bp, Homo sapiens
gggtcctggccatccc

SEQ ID NO: 3446647 - DNA, 17 bp, Homo sapiens
gggtcgacttcgggctg

SEQ ID NO: 3446648 - DNA, 23 bp, Homo sapiens
gggtcggaacccaagcttagaac

SEQ ID NO: 3446649 - DNA, 12 bp, Homo sapiens
gggtctcactct

SEQ ID NO: 3446650 - DNA, 12 bp, Homo sapiens
gggtctctgctg

SEQ ID NO: 3446651 - DNA, 14 bp, Homo sapiens
gggtctctgctgcc

SEQ ID NO: 3446652 - DNA, 15 bp, Homo sapiens
gggtctctgctgccg

SEQ ID NO: 3446653 - DNA, 21 bp, Homo sapiens
gggtctgaggaatccagaccc

SEQ ID NO: 3446654 - DNA, 18 bp, Homo sapiens
gggtctgagtctatgttc

SEQ ID NO: 3446655 - DNA, 20 bp, Homo sapiens
gggtctgagtctatgttcaa

SEQ ID NO: 3446656 - DNA, 20 bp, Homo sapiens
gggtctggagttgatctgga

SEQ ID NO: 3446657 - DNA, 22 bp, Homo sapiens
gggtctggagttgatctggaac

SEQ ID NO: 3446658 - DNA, 23 bp, Homo sapiens
gggtctgggcggcgggcggctgg

SEQ ID NO: 3446659 - DNA, 13 bp, Homo sapiens
gggtctgtaaaat

SEQ ID NO: 3446660 - DNA, 15 bp, Homo sapiens
gggtctgtaaaatct

SEQ ID NO: 3446661 - DNA, 17 bp, Homo sapiens
gggtctgtaaaatcttt

SEQ ID NO: 3446662 - DNA, 20 bp, Homo sapiens
gggtgaacaaagcagccacg

SEQ ID NO: 3446663 - DNA, 17 bp, Homo sapiens
gggtgagaacaaccaaa

SEQ ID NO: 3446664 - DNA, 14 bp, Homo sapiens
gggtgagggccttc

SEQ ID NO: 3446665 - DNA, 15 bp, Homo sapiens
gggtgagggccttct

SEQ ID NO: 3446666 - DNA, 15 bp, Homo sapiens
gggtgatggggaggg

SEQ ID NO: 3446667 - DNA, 23 bp, Homo sapiens
gggtgattttatgatcagtgttg

SEQ ID NO: 3446668 - DNA, 19 bp, Homo sapiens
gggtgcatatgtacagaag

SEQ ID NO: 3446669 - DNA, 20 bp, Homo sapiens
gggtgcatatgtacagaaga

SEQ ID NO: 3446670 - DNA, 14 bp, Homo sapiens
gggtgcccttttcc

SEQ ID NO: 3446671 - DNA, 16 bp, Homo sapiens
gggtgctccctaccac

SEQ ID NO: 3446672 - DNA, 15 bp, Homo sapiens
gggtggcaccagcag

SEQ ID NO: 3446673 - DNA, 23 bp, Homo sapiens
gggtggcccctgctgtctctctg

SEQ ID NO: 3446674 - DNA, 19 bp, Homo sapiens
gcttctctgtgaacgattt

SEQ ID NO: 3446675 - DNA, 12 bp, Homo sapiens
gcttctgcctgc

SEQ ID NO: 3446676 - DNA, 17 bp, Homo sapiens
gcttctggaatttgttc

SEQ ID NO: 3446677 - DNA, 14 bp, Homo sapiens
gcttctggccagga

SEQ ID NO: 3446678 - DNA, 11 bp, Homo sapiens
gcttctgtctc

SEQ ID NO: 3446679 - DNA, 18 bp, Homo sapiens
gcttcttctcctatgtgt

SEQ ID NO: 3446680 - DNA, 20 bp, Homo sapiens
gcttcttctcctatgtgtaa

SEQ ID NO: 3446681 - DNA, 13 bp, Homo sapiens
gcttcttgcctct

SEQ ID NO: 3446682 - DNA, 17 bp, Homo sapiens
gcttcttgcctctgtgc

SEQ ID NO: 3446683 - DNA, 18 bp, Homo sapiens
gcttcttgcctctgtgct

SEQ ID NO: 3446684 - DNA, 20 bp, Homo sapiens
gcttcttgcctctgtgctgt

SEQ ID NO: 3446685 - DNA, 16 bp, Homo sapiens
gcttgaaggccctgct

SEQ ID NO: 3446686 - DNA, 15 bp, Homo sapiens
gcttgacaacatctg

SEQ ID NO: 3446687 - DNA, 14 bp, Homo sapiens
gcttgacctgaggc

SEQ ID NO: 3446688 - DNA, 18 bp, Homo sapiens
gcttgagggttgggctgg

SEQ ID NO: 3446689 - DNA, 20 bp, Homo sapiens
gcttgagggttgggctggtg

SEQ ID NO: 3446690 - DNA, 22 bp, Homo sapiens
gcttgagggttgggctggtgtc

SEQ ID NO: 3446691 - DNA, 19 bp, Homo sapiens
gcttgagttaggaatgaga

SEQ ID NO: 3446692 - DNA, 13 bp, Homo sapiens
gcttgatacagga

SEQ ID NO: 3446693 - DNA, 20 bp, Homo sapiens
gcttgatagaaatgccaagc

SEQ ID NO: 3446694 - DNA, 19 bp, Homo sapiens
gcttgctctgtttgtgggg

SEQ ID NO: 3446695 - DNA, 17 bp, Homo sapiens
gcttgcttatgtgtagg

SEQ ID NO: 3446696 - DNA, 21 bp, Homo sapiens
gcttggaacccggtgctccct

SEQ ID NO: 3446697 - DNA, 12 bp, Homo sapiens
gcttggactgga

SEQ ID NO: 3446698 - DNA, 14 bp, Homo sapiens
gcttggagcagagg

SEQ ID NO: 3446699 - DNA, 16 bp, Homo sapiens
gcttggagcagagggg

SEQ ID NO: 3446700 - DNA, 19 bp, Homo sapiens
gcttggatcctgggctggg

SEQ ID NO: 3446701 - DNA, 16 bp, Homo sapiens
gcttggcctatctcct

SEQ ID NO: 3446702 - DNA, 22 bp, Homo sapiens
gcttgggaaaggtggtgtttct

SEQ ID NO: 3446703 - DNA, 17 bp, Homo sapiens
gcttgggcagcatcccc

SEQ ID NO: 3446704 - DNA, 13 bp, Homo sapiens
gcttggtctgttt

SEQ ID NO: 3446705 - DNA, 20 bp, Homo sapiens
gcttgtcactagcagctgca

SEQ ID NO: 3446706 - DNA, 21 bp, Homo sapiens
gcttgtcactagcagctgcag

SEQ ID NO: 3446707 - DNA, 16 bp, Homo sapiens
gcttgtcccctcctca

SEQ ID NO: 3446708 - DNA, 13 bp, Homo sapiens
gcttgttgtgctt

SEQ ID NO: 3446709 - DNA, 16 bp, Homo sapiens
gcttgttgtgctttta

SEQ ID NO: 3446710 - DNA, 12 bp, Homo sapiens
gcttgttttcca

SEQ ID NO: 3446711 - DNA, 15 bp, Homo sapiens
gctttaccttcctga

SEQ ID NO: 3446712 - DNA, 15 bp, Homo sapiens
gctttatcctcttta

SEQ ID NO: 3446713 - DNA, 17 bp, Homo sapiens
gctttatcctctttaga

SEQ ID NO: 3446714 - DNA, 20 bp, Homo sapiens
gctttatcctctttagagtt

SEQ ID NO: 3446715 - DNA, 13 bp, Homo sapiens
gctttatgctgaa

SEQ ID NO: 3446716 - DNA, 14 bp, Homo sapiens
gctttatgctgaaa

SEQ ID NO: 3446717 - DNA, 16 bp, Homo sapiens
gctttcaattccgtag

SEQ ID NO: 3446718 - DNA, 15 bp, Homo sapiens
gctttcatgtaaact

SEQ ID NO: 3446719 - DNA, 22 bp, Homo sapiens
gctttccaaaccttatctccac

SEQ ID NO: 3446720 - DNA, 13 bp, Homo sapiens
gctttcctgcctc

SEQ ID NO: 3446721 - DNA, 13 bp, Homo sapiens
gctttcgtccaca

SEQ ID NO: 3446722 - DNA, 19 bp, Homo sapiens
gctttcgtccacagcttcc

SEQ ID NO: 3446723 - DNA, 21 bp, Homo sapiens
gctttcgtccacagcttcctg

SEQ ID NO: 3446724 - DNA, 22 bp, Homo sapiens
gctttctacccagcgagccctg

SEQ ID NO: 3446725 - DNA, 21 bp, Homo sapiens
gctttctccccaatgagactt

SEQ ID NO: 3446726 - DNA, 13 bp, Homo sapiens
gctttctgctcag

SEQ ID NO: 3446727 - DNA, 18 bp, Homo sapiens
gctttctgctcagcttct

SEQ ID NO: 3446728 - DNA, 13 bp, Homo sapiens
gctttctttagaa

SEQ ID NO: 3446729 - DNA, 19 bp, Homo sapiens
gctttctttagaattttta

SEQ ID NO: 3446730 - DNA, 14 bp, Homo sapiens
gctttgatccctga

SEQ ID NO: 3446731 - DNA, 12 bp, Homo sapiens
gctttgcaaaga

SEQ ID NO: 3446732 - DNA, 12 bp, Homo sapiens
gctttgcccagc

SEQ ID NO: 3446733 - DNA, 14 bp, Homo sapiens
gctttgtctgtcgt

SEQ ID NO: 3446734 - DNA, 19 bp, Homo sapiens
gctttgtgtgaaggcagag

SEQ ID NO: 3446735 - DNA, 15 bp, Homo sapiens
gctttgttgcactga

SEQ ID NO: 3446736 - DNA, 21 bp, Homo sapiens
gctttgtttgttgtcagctga

SEQ ID NO: 3446737 - DNA, 23 bp, Homo sapiens
gctttgttttgcacactttgcca

SEQ ID NO: 3446738 - DNA, 21 bp, Homo sapiens
gcttttactgaagcctttctt

SEQ ID NO: 3446739 - DNA, 14 bp, Homo sapiens
gcttttacttaaac

SEQ ID NO: 3446740 - DNA, 14 bp, Homo sapiens
gcttttccaaaata

SEQ ID NO: 3446741 - DNA, 15 bp, Homo sapiens
gcttttccttggcat

SEQ ID NO: 3446742 - DNA, 21 bp, Homo sapiens
gcttttccttggggcaggcag

SEQ ID NO: 3446743 - DNA, 23 bp, Homo sapiens
gcttttccttggggcaggcagtg

SEQ ID NO: 3446744 - DNA, 17 bp, Homo sapiens
gcttttctgtttcctgt

SEQ ID NO: 3446745 - DNA, 13 bp, Homo sapiens
gcttttgccatta

SEQ ID NO: 3446746 - DNA, 12 bp, Homo sapiens
gcttttggcctg

SEQ ID NO: 3446747 - DNA, 19 bp, Homo sapiens
ggaaaaactgagacaggca

SEQ ID NO: 3446748 - DNA, 13 bp, Homo sapiens
ggaaaaataaaca

SEQ ID NO: 3446749 - DNA, 15 bp, Homo sapiens
ggaaaaatagcctgc

SEQ ID NO: 3446750 - DNA, 17 bp, Homo sapiens
ggaaaagaaagaagtta

SEQ ID NO: 3446751 - DNA, 14 bp, Homo sapiens
ggaaaagcagctct

SEQ ID NO: 3446752 - DNA, 19 bp, Homo sapiens
ggaaaataggcaggaagcc

SEQ ID NO: 3446753 - DNA, 15 bp, Homo sapiens
ggaaaatcagcctgc

SEQ ID NO: 3446754 - DNA, 19 bp, Homo sapiens
ggaaaatcagcctgctcca

SEQ ID NO: 3446755 - DNA, 16 bp, Homo sapiens
ggaaaatgcattgtat

SEQ ID NO: 3446756 - DNA, 18 bp, Homo sapiens
ggaaaccacagctgctgg

SEQ ID NO: 3446757 - DNA, 19 bp, Homo sapiens
ggaaaccacagctgctgga

SEQ ID NO: 3446758 - DNA, 14 bp, Homo sapiens
ggaaagcagctcaa

SEQ ID NO: 3446759 - DNA, 15 bp, Homo sapiens
ggaaagcagctcaaa

SEQ ID NO: 3446760 - DNA, 19 bp, Homo sapiens
ggaaagcagctcaaaggca

SEQ ID NO: 3446761 - DNA, 21 bp, Homo sapiens
ggaaaggagtagaaaaagcag

SEQ ID NO: 3446762 - DNA, 15 bp, Homo sapiens
ggaaaggccagctgg

SEQ ID NO: 3446763 - DNA, 18 bp, Homo sapiens
ggaaaggccagctggcag

SEQ ID NO: 3446764 - DNA, 20 bp, Homo sapiens
ggaaaggccagctggcagca

SEQ ID NO: 3446765 - DNA, 22 bp, Homo sapiens
ggaaaggccagctggcagcaga

SEQ ID NO: 3446766 - DNA, 12 bp, Homo sapiens
ggaaagggagga

SEQ ID NO: 3446767 - DNA, 20 bp, Homo sapiens
ggaaaggggtcggctgacca

SEQ ID NO: 3446768 - DNA, 17 bp, Homo sapiens
ggaaataacagagagaa

SEQ ID NO: 3446769 - DNA, 18 bp, Homo sapiens
ggaaatctcaccccatcc

SEQ ID NO: 3446770 - DNA, 16 bp, Homo sapiens
ggaaatggccttcccg

SEQ ID NO: 3446771 - DNA, 14 bp, Homo sapiens
ggaacactggcaga

SEQ ID NO: 3446772 - DNA, 13 bp, Homo sapiens
ggaacagaaattg

SEQ ID NO: 3446773 - DNA, 19 bp, Homo sapiens
ggaacagactggaagcaca

SEQ ID NO: 3446774 - DNA, 15 bp, Homo sapiens
ggaacatcatcaagg

SEQ ID NO: 3446775 - DNA, 23 bp, Homo sapiens
ggaaccaggagaagggctggggc

SEQ ID NO: 3446776 - DNA, 14 bp, Homo sapiens
ggaacccagactca

SEQ ID NO: 3446777 - DNA, 17 bp, Homo sapiens
ggaaccgcaggaagctg

SEQ ID NO: 3446778 - DNA, 18 bp, Homo sapiens
ggaaccgcaggaagctgc

SEQ ID NO: 3446779 - DNA, 12 bp, Homo sapiens
ggaacctcagcc

SEQ ID NO: 3446780 - DNA, 22 bp, Homo sapiens
ggaacctcagcctggccagaca

SEQ ID NO: 3446781 - DNA, 17 bp, Homo sapiens
ggaacctcgagtactgt

SEQ ID NO: 3446782 - DNA, 18 bp, Homo sapiens
ggaacctcgagtactgtg

SEQ ID NO: 3446783 - DNA, 17 bp, Homo sapiens
ggaactcatctggttga

SEQ ID NO: 3446784 - DNA, 15 bp, Homo sapiens
ggaactgtttccttc

SEQ ID NO: 3446785 - DNA, 11 bp, Homo sapiens
ggaacttgtct

SEQ ID NO: 3446786 - DNA, 11 bp, Homo sapiens
ggaagaacacc

SEQ ID NO: 3446787 - DNA, 16 bp, Homo sapiens
ggaagacaatgtgaaa

SEQ ID NO: 3446788 - DNA, 15 bp, Homo sapiens
ggaagacatttttcc

SEQ ID NO: 3446789 - DNA, 15 bp, Homo sapiens
ggaagagaaaaaata

SEQ ID NO: 3446790 - DNA, 13 bp, Homo sapiens
ggaagaggacttc

SEQ ID NO: 3446791 - DNA, 22 bp, Homo sapiens
ggaagatcctgcgggtggggct

SEQ ID NO: 3446792 - DNA, 20 bp, Homo sapiens
ggaagatctctgcagggccg

SEQ ID NO: 3446793 - DNA, 14 bp, Homo sapiens
ggaagccaaagagt

SEQ ID NO: 3446794 - DNA, 13 bp, Homo sapiens
ggaagcccccacc

SEQ ID NO: 3446795 - DNA, 21 bp, Homo sapiens
ggaagcccccaccgtgggcag

SEQ ID NO: 3446796 - DNA, 21 bp, Homo sapiens
ggaagcgtgaaggccgagaag

SEQ ID NO: 3446797 - DNA, 22 bp, Homo sapiens
ggaagcgtgaaggccgagaagc

SEQ ID NO: 3446798 - DNA, 13 bp, Homo sapiens
ggaagctcttctt

SEQ ID NO: 3446799 - DNA, 20 bp, Homo sapiens
ggaagctttggtgagaacct

SEQ ID NO: 3446800 - DNA, 13 bp, Homo sapiens
ggaaggagccagt

SEQ ID NO: 3446801 - DNA, 21 bp, Homo sapiens
ggaaggagccagtttgccgga

SEQ ID NO: 3446802 - DNA, 18 bp, Homo sapiens
ggaaggggcccgtgggag

SEQ ID NO: 3446803 - DNA, 11 bp, Homo sapiens
ggaaggtgggg

SEQ ID NO: 3446804 - DNA, 14 bp, Homo sapiens
ggaagtaacttttt

SEQ ID NO: 3446805 - DNA, 17 bp, Homo sapiens
ggaagtccaatgtggca

SEQ ID NO: 3446806 - DNA, 21 bp, Homo sapiens
ggaagtccccaggccccagga

SEQ ID NO: 3446807 - DNA, 13 bp, Homo sapiens
ggaagtcctctgg

SEQ ID NO: 3446808 - DNA, 15 bp, Homo sapiens
ggaatataccttttt

SEQ ID NO: 3446809 - DNA, 13 bp, Homo sapiens
ggaatatttgaat

SEQ ID NO: 3446810 - DNA, 13 bp, Homo sapiens
ggaatcagcttct

SEQ ID NO: 3446811 - DNA, 16 bp, Homo sapiens
ggaatccactcccagg

SEQ ID NO: 3446812 - DNA, 19 bp, Homo sapiens
ggaatccactcccaggcag

SEQ ID NO: 3446813 - DNA, 20 bp, Homo sapiens
ggaatccactcccaggcagc

SEQ ID NO: 3446814 - DNA, 16 bp, Homo sapiens
ggaatccagacccggc

SEQ ID NO: 3446815 - DNA, 16 bp, Homo sapiens
ggaatcctcctccagg

SEQ ID NO: 3446816 - DNA, 19 bp, Homo sapiens
ggaatcctcctccagggtg

SEQ ID NO: 3446817 - DNA, 21 bp, Homo sapiens
ggaatctgaggcatcctctga

SEQ ID NO: 3446818 - DNA, 19 bp, Homo sapiens
ggaatgcctgagtgcctgg

SEQ ID NO: 3446819 - DNA, 20 bp, Homo sapiens
ggaatgttggataaggaatt

SEQ ID NO: 3446820 - DNA, 19 bp, Homo sapiens
ggaattgatttgcattgaa

SEQ ID NO: 3446821 - DNA, 14 bp, Homo sapiens
ggaatttcccagga

SEQ ID NO: 3446822 - DNA, 13 bp, Homo sapiens
ggacaaagaacct

SEQ ID NO: 3446823 - DNA, 16 bp, Homo sapiens
ggacaagacccccagc

SEQ ID NO: 3446824 - DNA, 20 bp, Homo sapiens
ggacaagtggactcagggca

SEQ ID NO: 3446825 - DNA, 13 bp, Homo sapiens
ggacacagctctt

SEQ ID NO: 3446826 - DNA, 13 bp, Homo sapiens
ggacacaggcctg

SEQ ID NO: 3446827 - DNA, 13 bp, Homo sapiens
ggacacctggccg

SEQ ID NO: 3446828 - DNA, 17 bp, Homo sapiens
ggacactaaccacgctg

SEQ ID NO: 3446829 - DNA, 22 bp, Homo sapiens
ggacactcaaaagctgggcagg

SEQ ID NO: 3446830 - DNA, 15 bp, Homo sapiens
ggacactggggtctg

SEQ ID NO: 3446831 - DNA, 14 bp, Homo sapiens
ggacagagaacttt

SEQ ID NO: 3446832 - DNA, 16 bp, Homo sapiens
ggacagaggccccagc

SEQ ID NO: 3446833 - DNA, 17 bp, Homo sapiens
ggacagaggccccagcc

SEQ ID NO: 3446834 - DNA, 23 bp, Homo sapiens
ggacagaggccccagcctccctg

SEQ ID NO: 3446835 - DNA, 23 bp, Homo sapiens
ggacagatccagggactgaagcc

SEQ ID NO: 3446836 - DNA, 19 bp, Homo sapiens
ggacagccacggccaggcc

SEQ ID NO: 3446837 - DNA, 22 bp, Homo sapiens
ggacagccacggccaggccaga

SEQ ID NO: 3446838 - DNA, 15 bp, Homo sapiens
ggacagccccaccct

SEQ ID NO: 3446839 - DNA, 15 bp, Homo sapiens
ggacagctccttctg

SEQ ID NO: 3446840 - DNA, 17 bp, Homo sapiens
ggacagctccttctgtc

SEQ ID NO: 3446841 - DNA, 18 bp, Homo sapiens
ggacaggatgtgtttgct

SEQ ID NO: 3446842 - DNA, 20 bp, Homo sapiens
ggacaggatgtgtttgcttt

SEQ ID NO: 3446843 - DNA, 23 bp, Homo sapiens
ggacaggcatgttctctgaggac

SEQ ID NO: 3446844 - DNA, 22 bp, Homo sapiens
ggacaggctcttctttcccaaa

SEQ ID NO: 3446845 - DNA, 17 bp, Homo sapiens
ggacagggaggtgaccc

SEQ ID NO: 3446846 - DNA, 22 bp, Homo sapiens
ggacagggatgagcatggagct

SEQ ID NO: 3446847 - DNA, 23 bp, Homo sapiens
ggacataatggggtcctggccat

SEQ ID NO: 3446848 - DNA, 14 bp, Homo sapiens
ggacatcagctggt

SEQ ID NO: 3446849 - DNA, 22 bp, Homo sapiens
ggacatcagtgtttgttggatc

SEQ ID NO: 3446850 - DNA, 16 bp, Homo sapiens
ggacatcctcctccca

SEQ ID NO: 3446851 - DNA, 13 bp, Homo sapiens
ggacatgcctgtc

SEQ ID NO: 3446852 - DNA, 16 bp, Homo sapiens
ggacatgcctgtcctg

SEQ ID NO: 3446853 - DNA, 19 bp, Homo sapiens
ggacatgcggtagccagca

SEQ ID NO: 3446854 - DNA, 23 bp, Homo sapiens
ggaccagccagcagcagcccaag

SEQ ID NO: 3446855 - DNA, 16 bp, Homo sapiens
ggaccagctcaggaca

SEQ ID NO: 3446856 - DNA, 18 bp, Homo sapiens
ggaccagctcaggacaga

SEQ ID NO: 3446857 - DNA, 23 bp, Homo sapiens
ggaccaggcaatgtgactttgca

SEQ ID NO: 3446858 - DNA, 23 bp, Homo sapiens
ggaccatgcgacactgggaggcc

SEQ ID NO: 3446859 - DNA, 21 bp, Homo sapiens
ggacccagaggaaggggccag

SEQ ID NO: 3446860 - DNA, 22 bp, Homo sapiens
ggacccagggaacagccactcc

SEQ ID NO: 3446861 - DNA, 22 bp, Homo sapiens
ggacccatgagttggggtctgg

SEQ ID NO: 3446862 - DNA, 19 bp, Homo sapiens
ggacccccgccccctgccc

SEQ ID NO: 3446863 - DNA, 20 bp, Homo sapiens
ggacccccgccccctgccct

SEQ ID NO: 3446864 - DNA, 13 bp, Homo sapiens
ggaccccttccca

SEQ ID NO: 3446865 - DNA, 14 bp, Homo sapiens
ggaccccttcccac

SEQ ID NO: 3446866 - DNA, 23 bp, Homo sapiens
ggaccctgtgccctccttcccaa

SEQ ID NO: 3446867 - DNA, 17 bp, Homo sapiens
ggaccctgttgctaagc

SEQ ID NO: 3446868 - DNA, 13 bp, Homo sapiens
ggacctaggctcc

SEQ ID NO: 3446869 - DNA, 16 bp, Homo sapiens
ggacctagggtggcct

SEQ ID NO: 3446870 - DNA, 19 bp, Homo sapiens
ggacctcaggtgagaagca

SEQ ID NO: 3446871 - DNA, 18 bp, Homo sapiens
ggaccttaggccttcctc

SEQ ID NO: 3446872 - DNA, 21 bp, Homo sapiens
ggaccttaggccttcctctct

SEQ ID NO: 3446873 - DNA, 17 bp, Homo sapiens
ggaccttcgggctgtgc

SEQ ID NO: 3446874 - DNA, 19 bp, Homo sapiens
ggaccttcgggctgtgccc

SEQ ID NO: 3446875 - DNA, 20 bp, Homo sapiens
ggaccttcgggctgtgcccg

SEQ ID NO: 3446876 - DNA, 19 bp, Homo sapiens
ggacctttccaccacagcc

SEQ ID NO: 3446877 - DNA, 20 bp, Homo sapiens
ggacctttccaccacagcca

SEQ ID NO: 3446878 - DNA, 22 bp, Homo sapiens
ggacctttccaccacagccagc

SEQ ID NO: 3446879 - DNA, 22 bp, Homo sapiens
ggacgcagcaggaggccaggcc

SEQ ID NO: 3446880 - DNA, 15 bp, Homo sapiens
ggacggctgggcaca

SEQ ID NO: 3446881 - DNA, 16 bp, Homo sapiens
ggacgggttagacagc

SEQ ID NO: 3446882 - DNA, 17 bp, Homo sapiens
ggacggtgcccaagcca

SEQ ID NO: 3446883 - DNA, 14 bp, Homo sapiens
ggacggtgctccag

SEQ ID NO: 3446884 - DNA, 17 bp, Homo sapiens
ggacggtgctccaggca

SEQ ID NO: 3446885 - DNA, 18 bp, Homo sapiens
ggacggtgctccaggcag

SEQ ID NO: 3446886 - DNA, 21 bp, Homo sapiens
ggacgtgttacccactgccat

SEQ ID NO: 3446887 - DNA, 19 bp, Homo sapiens
ggactaaaagatataagtg

SEQ ID NO: 3446888 - DNA, 20 bp, Homo sapiens
ggactatatttgggcctgct

SEQ ID NO: 3446889 - DNA, 13 bp, Homo sapiens
ggactcaccctca

SEQ ID NO: 3446890 - DNA, 23 bp, Homo sapiens
ggactcaccctcataccatctgc

SEQ ID NO: 3446891 - DNA, 15 bp, Homo sapiens
ggactcagccttcag

SEQ ID NO: 3446892 - DNA, 22 bp, Homo sapiens
ggactcaggcgggacagtgctg

SEQ ID NO: 3446893 - DNA, 16 bp, Homo sapiens
ggactccggctgtgct

SEQ ID NO: 3446894 - DNA, 17 bp, Homo sapiens
ggactccggctgtgctg

SEQ ID NO: 3446895 - DNA, 14 bp, Homo sapiens
ggactgaggcctga

SEQ ID NO: 3446896 - DNA, 14 bp, Homo sapiens
ggactgcagagcag

SEQ ID NO: 3446897 - DNA, 15 bp, Homo sapiens
ggactggtgccctcc

SEQ ID NO: 3446898 - DNA, 18 bp, Homo sapiens
ggacttcctgtccagctc

SEQ ID NO: 3446899 - DNA, 13 bp, Homo sapiens
ggagaaaccctaa

SEQ ID NO: 3446900 - DNA, 20 bp, Homo sapiens
ggagaaccaaatctggaagc

SEQ ID NO: 3446901 - DNA, 19 bp, Homo sapiens
ggagaagccacaggcctga

SEQ ID NO: 3446902 - DNA, 20 bp, Homo sapiens
ggagaagccacaggcctgag

SEQ ID NO: 3446903 - DNA, 12 bp, Homo sapiens
ggagaagccagg

SEQ ID NO: 3446904 - DNA, 18 bp, Homo sapiens
ggagaagcccgtgtgaga

SEQ ID NO: 3446905 - DNA, 18 bp, Homo sapiens
ggagaagcggctggcagc

SEQ ID NO: 3446906 - DNA, 19 bp, Homo sapiens
ggagaagctcctctcccca

SEQ ID NO: 3446907 - DNA, 16 bp, Homo sapiens
ggagaaggccgctgcc

SEQ ID NO: 3446908 - DNA, 22 bp, Homo sapiens
ggagaaggccgctgccccagcc

SEQ ID NO: 3446909 - DNA, 12 bp, Homo sapiens
ggagaagggctg

SEQ ID NO: 3446910 - DNA, 13 bp, Homo sapiens
ggagaagggctgg

SEQ ID NO: 3446911 - DNA, 14 bp, Homo sapiens
ggagaagggctggg

SEQ ID NO: 3446912 - DNA, 18 bp, Homo sapiens
ggagaagggctggggccg

SEQ ID NO: 3446913 - DNA, 20 bp, Homo sapiens
ggagaatccagctgggctag

SEQ ID NO: 3446914 - DNA, 21 bp, Homo sapiens
ggagacacaacaactcctagg

SEQ ID NO: 3446915 - DNA, 17 bp, Homo sapiens
ggagacagcatcagggt

SEQ ID NO: 3446916 - DNA, 12 bp, Homo sapiens
ggagacagggtt

SEQ ID NO: 3446917 - DNA, 21 bp, Homo sapiens
ggagacctggacacaggcctg

SEQ ID NO: 3446918 - DNA, 17 bp, Homo sapiens
ggagactatcagcccaa

SEQ ID NO: 3446919 - DNA, 15 bp, Homo sapiens
ggagactgcccagct

SEQ ID NO: 3446920 - DNA, 18 bp, Homo sapiens
ggagagcatcggcctagg

SEQ ID NO: 3446921 - DNA, 20 bp, Homo sapiens
ggagagcatcggcctagggc

SEQ ID NO: 3446922 - DNA, 16 bp, Homo sapiens
ggagagcgcctgcccc

SEQ ID NO: 3446923 - DNA, 18 bp, Homo sapiens
ggagagcgcctgcccctc

SEQ ID NO: 3446924 - DNA, 22 bp, Homo sapiens
ggagagcgcctgcccctcccag

SEQ ID NO: 3446925 - DNA, 15 bp, Homo sapiens
ggagagctagcagca

SEQ ID NO: 3446926 - DNA, 22 bp, Homo sapiens
ggagagctggagcctggtgccc

SEQ ID NO: 3446927 - DNA, 15 bp, Homo sapiens
ggagaggaagagaca

SEQ ID NO: 3446928 - DNA, 17 bp, Homo sapiens
ggagaggggacgcaggc

SEQ ID NO: 3446929 - DNA, 20 bp, Homo sapiens
ggagaggggacgcaggcccc

SEQ ID NO: 3446930 - DNA, 12 bp, Homo sapiens
ggagatatttaa

SEQ ID NO: 3446931 - DNA, 21 bp, Homo sapiens
ggagatcagaaaaatggagca

SEQ ID NO: 3446932 - DNA, 14 bp, Homo sapiens
ggagcacacccagc

SEQ ID NO: 3446933 - DNA, 15 bp, Homo sapiens
ggagcacacccagcc

SEQ ID NO: 3446934 - DNA, 13 bp, Homo sapiens
ggagcactgggct

SEQ ID NO: 3446935 - DNA, 15 bp, Homo sapiens
ggagcactgggctcc

SEQ ID NO: 3446936 - DNA, 20 bp, Homo sapiens
ggagcactgggctcccgggc

SEQ ID NO: 3446937 - DNA, 13 bp, Homo sapiens
ggagcagcctcag

SEQ ID NO: 3446938 - DNA, 17 bp, Homo sapiens
ggagcatcaagccactc

SEQ ID NO: 3446939 - DNA, 22 bp, Homo sapiens
ggagccatgcgccccctccgcc

SEQ ID NO: 3446940 - DNA, 12 bp, Homo sapiens
ggagcccactgt

SEQ ID NO: 3446941 - DNA, 22 bp, Homo sapiens
ggagcccactgtcctgggcctg

SEQ ID NO: 3446942 - DNA, 15 bp, Homo sapiens
ggagcccagaaaacc

SEQ ID NO: 3446943 - DNA, 16 bp, Homo sapiens
ggagcccagccctccc

SEQ ID NO: 3446944 - DNA, 19 bp, Homo sapiens
ggagcccagccctccccat

SEQ ID NO: 3446945 - DNA, 13 bp, Homo sapiens
ggagcccagggca

SEQ ID NO: 3446946 - DNA, 15 bp, Homo sapiens
ggagcccagggcatc

SEQ ID NO: 3446947 - DNA, 18 bp, Homo sapiens
ggagcccctggacatgcc

SEQ ID NO: 3446948 - DNA, 19 bp, Homo sapiens
ggagcccctggacatgcct

SEQ ID NO: 3446949 - DNA, 18 bp, Homo sapiens
ggagccccttctgctcag

SEQ ID NO: 3446950 - DNA, 19 bp, Homo sapiens
ggagccccttctgctcagc

SEQ ID NO: 3446951 - DNA, 18 bp, Homo sapiens
ggagccgggtctgcctct

SEQ ID NO: 3446952 - DNA, 20 bp, Homo sapiens
ggagcctttggttctggcca

SEQ ID NO: 3446953 - DNA, 22 bp, Homo sapiens
ggagctacgaaaggatgagcag

SEQ ID NO: 3446954 - DNA, 15 bp, Homo sapiens
ggagctagccagagg

SEQ ID NO: 3446955 - DNA, 17 bp, Homo sapiens
ggagctcagagagggca

SEQ ID NO: 3446956 - DNA, 20 bp, Homo sapiens
ggagctccaactcagaaggg

SEQ ID NO: 3446957 - DNA, 20 bp, Homo sapiens
ggagctccactctgcttctc

SEQ ID NO: 3446958 - DNA, 16 bp, Homo sapiens
ggagctccggcctgct

SEQ ID NO: 3446959 - DNA, 22 bp, Homo sapiens
ggagctgcccctctctgggcct

SEQ ID NO: 3446960 - DNA, 18 bp, Homo sapiens
ggagctgccttggctcag

SEQ ID NO: 3446961 - DNA, 21 bp, Homo sapiens
ggagctgccttggctcagaca

SEQ ID NO: 3446962 - DNA, 12 bp, Homo sapiens
ggagctggcccc

SEQ ID NO: 3446963 - DNA, 18 bp, Homo sapiens
ggagctggccccgccgcc

SEQ ID NO: 3446964 - DNA, 20 bp, Homo sapiens
ggagcttcttgtttccttgt

SEQ ID NO: 3446965 - DNA, 23 bp, Homo sapiens
ggagcttgcaagaagcaggaagg

SEQ ID NO: 3446966 - DNA, 17 bp, Homo sapiens
ggagcttttggtgagaa

SEQ ID NO: 3446967 - DNA, 19 bp, Homo sapiens
ggaggaagaggctgcactg

SEQ ID NO: 3446968 - DNA, 21 bp, Homo sapiens
ggaggaaggcttacacccaca

SEQ ID NO: 3446969 - DNA, 13 bp, Homo sapiens
ggaggagagagcc

SEQ ID NO: 3446970 - DNA, 14 bp, Homo sapiens
ggaggagcccctgg

SEQ ID NO: 3446971 - DNA, 23 bp, Homo sapiens
ggaggatcacttgagtccagaag

SEQ ID NO: 3446972 - DNA, 21 bp, Homo sapiens
ggaggatctcttgagcctggg

SEQ ID NO: 3446973 - DNA, 15 bp, Homo sapiens
ggaggatgttctggg

SEQ ID NO: 3446974 - DNA, 17 bp, Homo sapiens
ggaggattgctgccaga

SEQ ID NO: 3446975 - DNA, 22 bp, Homo sapiens
ggaggcactttagggctgtaaa

SEQ ID NO: 3446976 - DNA, 18 bp, Homo sapiens
ggaggccaaggtgggagg

SEQ ID NO: 3446977 - DNA, 12 bp, Homo sapiens
ggaggccagcca

SEQ ID NO: 3446978 - DNA, 12 bp, Homo sapiens
ggaggccagcta

SEQ ID NO: 3446979 - DNA, 20 bp, Homo sapiens
ggaggccagctatctgcctg

SEQ ID NO: 3446980 - DNA, 17 bp, Homo sapiens
ggaggccagtgagccac

SEQ ID NO: 3446981 - DNA, 19 bp, Homo sapiens
ggaggcccagttcaccctg

SEQ ID NO: 3446982 - DNA, 17 bp, Homo sapiens
ggaggcccgtccggcag

SEQ ID NO: 3446983 - DNA, 18 bp, Homo sapiens
ggaggctccagagggcac

SEQ ID NO: 3446984 - DNA, 20 bp, Homo sapiens
ggaggctcccgaggggaagg

SEQ ID NO: 3446985 - DNA, 17 bp, Homo sapiens
ggagggcagcagggcta

SEQ ID NO: 3446986 - DNA, 21 bp, Homo sapiens
ggagggcggcaggggcctgga

SEQ ID NO: 3446987 - DNA, 17 bp, Homo sapiens
ggaggggaaaaaaatgt

SEQ ID NO: 3446988 - DNA, 13 bp, Homo sapiens
ggaggggaggggg

SEQ ID NO: 3446989 - DNA, 21 bp, Homo sapiens
ggaggggcaggagagcagtga

SEQ ID NO: 3446990 - DNA, 15 bp, Homo sapiens
ggaggggcctaggcc

SEQ ID NO: 3446991 - DNA, 14 bp, Homo sapiens
ggagggggatccga

SEQ ID NO: 3446992 - DNA, 18 bp, Homo sapiens
ggaggtatgggctggggg

SEQ ID NO: 3446993 - DNA, 20 bp, Homo sapiens
ggaggtcaaggctgcagtga

SEQ ID NO: 3446994 - DNA, 18 bp, Homo sapiens
ggaggtcggtaggttcag

SEQ ID NO: 3446995 - DNA, 17 bp, Homo sapiens
ggagtacaggtgaagca

SEQ ID NO: 3446996 - DNA, 15 bp, Homo sapiens
ggagtatgcaaaagt

SEQ ID NO: 3446997 - DNA, 16 bp, Homo sapiens
ggagtccactttgttt

SEQ ID NO: 3446998 - DNA, 20 bp, Homo sapiens
ggagtcccaccttggctgca

SEQ ID NO: 3446999 - DNA, 17 bp, Homo sapiens
ggagtgacagaggcagc

SEQ ID NO: 3447000 - DNA, 23 bp, Homo sapiens
ggagtgggtagatttcagggaga

SEQ ID NO: 3447001 - DNA, 20 bp, Homo sapiens
ggagtgtcctcttccctctc

SEQ ID NO: 3447002 - DNA, 16 bp, Homo sapiens
ggagtgttatgtattt

SEQ ID NO: 3447003 - DNA, 20 bp, Homo sapiens
ggagtgttccccttccactg

SEQ ID NO: 3447004 - DNA, 23 bp, Homo sapiens
ggagttaagacctggcagctctg

SEQ ID NO: 3447005 - DNA, 16 bp, Homo sapiens
ggagttagccaaacaa

SEQ ID NO: 3447006 - DNA, 21 bp, Homo sapiens
ggagttgatctggaacccaga

SEQ ID NO: 3447007 - DNA, 22 bp, Homo sapiens
ggagttgatctggaacccagac

SEQ ID NO: 3447008 - DNA, 22 bp, Homo sapiens
ggagttgtcaagtctctgctgg

SEQ ID NO: 3447009 - DNA, 16 bp, Homo sapiens
ggagttttttgtacca

SEQ ID NO: 3447010 - DNA, 13 bp, Homo sapiens
ggataaagcagct

SEQ ID NO: 3447011 - DNA, 12 bp, Homo sapiens
ggataaattgcc

SEQ ID NO: 3447012 - DNA, 19 bp, Homo sapiens
ggataaattgccataatat

SEQ ID NO: 3447013 - DNA, 23 bp, Homo sapiens
ggataagctatccgtgttgcagg

SEQ ID NO: 3447014 - DNA, 14 bp, Homo sapiens
ggatagatgctggc

SEQ ID NO: 3447015 - DNA, 19 bp, Homo sapiens
ggatatttgtactgtttaa

SEQ ID NO: 3447016 - DNA, 16 bp, Homo sapiens
ggatcaaagttctgct

SEQ ID NO: 3447017 - DNA, 22 bp, Homo sapiens
ggatcacaggtgtcagccattg

SEQ ID NO: 3447018 - DNA, 12 bp, Homo sapiens
ggatcagaatag

SEQ ID NO: 3447019 - DNA, 13 bp, Homo sapiens
ggatcaggaagcc

SEQ ID NO: 3447020 - DNA, 12 bp, Homo sapiens
ggatcagttttt

SEQ ID NO: 3447021 - DNA, 17 bp, Homo sapiens
ggatccgtttgaccaat

SEQ ID NO: 3447022 - DNA, 18 bp, Homo sapiens
ggatcctgggctgggtgg

SEQ ID NO: 3447023 - DNA, 17 bp, Homo sapiens
ggatctcattggaccct

SEQ ID NO: 3447024 - DNA, 16 bp, Homo sapiens
ggatctttgtggccaa

SEQ ID NO: 3447025 - DNA, 22 bp, Homo sapiens
ggatgagagttttggatgcagt

SEQ ID NO: 3447026 - DNA, 14 bp, Homo sapiens
ggatgcagtgctcg

SEQ ID NO: 3447027 - DNA, 17 bp, Homo sapiens
ggatgcattcgagatgg

SEQ ID NO: 3447028 - DNA, 18 bp, Homo sapiens
ggatgccactcctccctc

SEQ ID NO: 3447029 - DNA, 21 bp, Homo sapiens
ggatgccctggaggtggctga

SEQ ID NO: 3447030 - DNA, 17 bp, Homo sapiens
ggatgcctggtggcagc

SEQ ID NO: 3447031 - DNA, 18 bp, Homo sapiens
ggatgcctggtggcagct

SEQ ID NO: 3447032 - DNA, 22 bp, Homo sapiens
ggatggcaggacgtgggctggg

SEQ ID NO: 3447033 - DNA, 12 bp, Homo sapiens
ggatggccgtgg

SEQ ID NO: 3447034 - DNA, 21 bp, Homo sapiens
ggatggcctggccagggcctg

SEQ ID NO: 3447035 - DNA, 22 bp, Homo sapiens
ggatgggggaactcagatccag

SEQ ID NO: 3447036 - DNA, 14 bp, Homo sapiens
ggatgtaaggcctt

SEQ ID NO: 3447037 - DNA, 16 bp, Homo sapiens
ggatgtacatttccaa

SEQ ID NO: 3447038 - DNA, 18 bp, Homo sapiens
ggatgtcactcagatgga

SEQ ID NO: 3447039 - DNA, 16 bp, Homo sapiens
ggatgtccagagctgg

SEQ ID NO: 3447040 - DNA, 23 bp, Homo sapiens
ggatgttggccaccaggtgcctt

SEQ ID NO: 3447041 - DNA, 14 bp, Homo sapiens
ggattaatatgaaa

SEQ ID NO: 3447042 - DNA, 16 bp, Homo sapiens
ggattaatatgaaaac

SEQ ID NO: 3447043 - DNA, 19 bp, Homo sapiens
ggattacaagcgtgagcca

SEQ ID NO: 3447044 - DNA, 18 bp, Homo sapiens
ggattacttctctataaa

SEQ ID NO: 3447045 - DNA, 18 bp, Homo sapiens
ggattccccatctcaggc

SEQ ID NO: 3447046 - DNA, 14 bp, Homo sapiens
ggattctggttcca

SEQ ID NO: 3447047 - DNA, 18 bp, Homo sapiens
ggattctttaaatatata

SEQ ID NO: 3447048 - DNA, 12 bp, Homo sapiens
ggattgctgcca

SEQ ID NO: 3447049 - DNA, 19 bp, Homo sapiens
ggattgctgccagagaagt

SEQ ID NO: 3447050 - DNA, 23 bp, Homo sapiens
ggatttcctgctttgggaagccg

SEQ ID NO: 3447051 - DNA, 21 bp, Homo sapiens
ggattttgatccaagctggtc

SEQ ID NO: 3447052 - DNA, 23 bp, Homo sapiens
ggcaaaaggatctttgtggccaa

SEQ ID NO: 3447053 - DNA, 23 bp, Homo sapiens
ggcaaacaggcagttggccagag

SEQ ID NO: 3447054 - DNA, 12 bp, Homo sapiens
ggcaaataaaag

SEQ ID NO: 3447055 - DNA, 14 bp, Homo sapiens
ggcaaattcttttg

SEQ ID NO: 3447056 - DNA, 18 bp, Homo sapiens
ggcaacattccaagaata

SEQ ID NO: 3447057 - DNA, 18 bp, Homo sapiens
ggcaacccccagcctgct

SEQ ID NO: 3447058 - DNA, 18 bp, Homo sapiens
ggcaactgcattggcttt

SEQ ID NO: 3447059 - DNA, 17 bp, Homo sapiens
ggcaagcacctcctgcc

SEQ ID NO: 3447060 - DNA, 18 bp, Homo sapiens
ggcaagcacctcctgcct

SEQ ID NO: 3447061 - DNA, 19 bp, Homo sapiens
ggcaagcacctcctgcctc

SEQ ID NO: 3447062 - DNA, 21 bp, Homo sapiens
ggcaagcatgtaacttatatt

SEQ ID NO: 3447063 - DNA, 22 bp, Homo sapiens
ggcaaggaaaggggagaaggga

SEQ ID NO: 3447064 - DNA, 16 bp, Homo sapiens
ggcaaggacacagatg

SEQ ID NO: 3447065 - DNA, 13 bp, Homo sapiens
ggcaagtgtgggc

SEQ ID NO: 3447066 - DNA, 23 bp, Homo sapiens
ggcaatgctggctgttggctggg

SEQ ID NO: 3447067 - DNA, 21 bp, Homo sapiens
ggcaatgggagctgaggccac

SEQ ID NO: 3447068 - DNA, 13 bp, Homo sapiens
ggcaatttagaaa

SEQ ID NO: 3447069 - DNA, 18 bp, Homo sapiens
ggcacaagtcctggatgt

SEQ ID NO: 3447070 - DNA, 23 bp, Homo sapiens
ggcacaagtcctggatgttgtgt

SEQ ID NO: 3447071 - DNA, 12 bp, Homo sapiens
ggcacagctggg

SEQ ID NO: 3447072 - DNA, 19 bp, Homo sapiens
ggcacaggagtgtcctctt

SEQ ID NO: 3447073 - DNA, 19 bp, Homo sapiens
ggcacattcctttgggtat

SEQ ID NO: 3447074 - DNA, 20 bp, Homo sapiens
ggcaccagacacccaggact

SEQ ID NO: 3447075 - DNA, 14 bp, Homo sapiens
ggcaccagtccctg

SEQ ID NO: 3447076 - DNA, 23 bp, Homo sapiens
ggcacccaccatcatgtctggct

SEQ ID NO: 3447077 - DNA, 19 bp, Homo sapiens
ggcacccggcccctgctgg

SEQ ID NO: 3447078 - DNA, 20 bp, Homo sapiens
ggcacccggcccctgctggt

SEQ ID NO: 3447079 - DNA, 22 bp, Homo sapiens
ggcacctaatccaggcagatcc

SEQ ID NO: 3447080 - DNA, 16 bp, Homo sapiens
ggcacctcacaggccc

SEQ ID NO: 3447081 - DNA, 20 bp, Homo sapiens
ggcagacacagggacttgaa

SEQ ID NO: 3447082 - DNA, 20 bp, Homo sapiens
ggcagactctttatgcttgc

SEQ ID NO: 3447083 - DNA, 17 bp, Homo sapiens
ggcagagcttggactgg

SEQ ID NO: 3447084 - DNA, 12 bp, Homo sapiens
ggcagagggctg

SEQ ID NO: 3447085 - DNA, 15 bp, Homo sapiens
ggcagagttgtaaat

SEQ ID NO: 3447086 - DNA, 22 bp, Homo sapiens
ggcagagttgtaaatatataaa

SEQ ID NO: 3447087 - DNA, 23 bp, Homo sapiens
ggcagagttgtaaatatataaat

SEQ ID NO: 3447088 - DNA, 14 bp, Homo sapiens
ggcagatccaggac

SEQ ID NO: 3447089 - DNA, 21 bp, Homo sapiens
ggcagcacagagacccccgga

SEQ ID NO: 3447090 - DNA, 18 bp, Homo sapiens
ggcagcagggctaccctg

SEQ ID NO: 3447091 - DNA, 13 bp, Homo sapiens
ggcagccccagcc

SEQ ID NO: 3447092 - DNA, 14 bp, Homo sapiens
ggcagccccagcct

SEQ ID NO: 3447093 - DNA, 18 bp, Homo sapiens
ggcagccccagcctgcta

SEQ ID NO: 3447094 - DNA, 19 bp, Homo sapiens
ggcagccccagcctgctag

SEQ ID NO: 3447095 - DNA, 21 bp, Homo sapiens
ggcagccccattctgcctgcc

SEQ ID NO: 3447096 - DNA, 22 bp, Homo sapiens
ggcagcctcccatccagggccc

SEQ ID NO: 3447097 - DNA, 23 bp, Homo sapiens
ggcagctgcggtccacccaggag

SEQ ID NO: 3447098 - DNA, 22 bp, Homo sapiens
ggcagctgcttttgtctatggg

SEQ ID NO: 3447099 - DNA, 11 bp, Homo sapiens
ggcaggaaaag

SEQ ID NO: 3447100 - DNA, 18 bp, Homo sapiens
ggcaggacgtgggctggg

SEQ ID NO: 3447101 - DNA, 21 bp, Homo sapiens
ggcaggactcagctccccaga

SEQ ID NO: 3447102 - DNA, 15 bp, Homo sapiens
ggcaggactgcagag

SEQ ID NO: 3447103 - DNA, 14 bp, Homo sapiens
ggcaggcaggtgtt

SEQ ID NO: 3447104 - DNA, 11 bp, Homo sapiens
ggcaggctggc

SEQ ID NO: 3447105 - DNA, 16 bp, Homo sapiens
ggcagggccccaggca

SEQ ID NO: 3447106 - DNA, 22 bp, Homo sapiens
ggcagggcgggcagagggctgg

SEQ ID NO: 3447107 - DNA, 19 bp, Homo sapiens
ggcagggtctcactctgtc

SEQ ID NO: 3447108 - DNA, 21 bp, Homo sapiens
ggcaggtgctggagcactggg

SEQ ID NO: 3447109 - DNA, 22 bp, Homo sapiens
ggcaggtgtttattaaaattct

SEQ ID NO: 3447110 - DNA, 15 bp, Homo sapiens
ggcaggttggtgggg

SEQ ID NO: 3447111 - DNA, 14 bp, Homo sapiens
ggcagtaggccggt

SEQ ID NO: 3447112 - DNA, 19 bp, Homo sapiens
ggcagtattttgtgtcctc

SEQ ID NO: 3447113 - DNA, 15 bp, Homo sapiens
ggcagtccagccagc

SEQ ID NO: 3447114 - DNA, 19 bp, Homo sapiens
ggcagtcgatagagctgta

SEQ ID NO: 3447115 - DNA, 18 bp, Homo sapiens
ggcagtgggagctgcctg

SEQ ID NO: 3447116 - DNA, 19 bp, Homo sapiens
ggcagtgggagctgcctgt

SEQ ID NO: 3447117 - DNA, 21 bp, Homo sapiens
ggcagttctgggtgctcccta

SEQ ID NO: 3447118 - DNA, 14 bp, Homo sapiens
ggcagttggccaga

SEQ ID NO: 3447119 - DNA, 17 bp, Homo sapiens
ggcagtttcagagatgg

SEQ ID NO: 3447120 - DNA, 19 bp, Homo sapiens
ggcagtttgttgatctttt

SEQ ID NO: 3447121 - DNA, 13 bp, Homo sapiens
ggcatcagctggc

SEQ ID NO: 3447122 - DNA, 16 bp, Homo sapiens
ggcatcagctggcgtc

SEQ ID NO: 3447123 - DNA, 21 bp, Homo sapiens
ggcatcctctgactccactca

SEQ ID NO: 3447124 - DNA, 20 bp, Homo sapiens
ggcatccttcctcacaccag

SEQ ID NO: 3447125 - DNA, 21 bp, Homo sapiens
ggcatcgcaccattctgactc

SEQ ID NO: 3447126 - DNA, 16 bp, Homo sapiens
ggcatcttgctggcta

SEQ ID NO: 3447127 - DNA, 19 bp, Homo sapiens
ggcatggaaggggcttctg

SEQ ID NO: 3447128 - DNA, 20 bp, Homo sapiens
ggcatgggtcgggagagggg

SEQ ID NO: 3447129 - DNA, 19 bp, Homo sapiens
ggcatggtacggagatgtt

SEQ ID NO: 3447130 - DNA, 19 bp, Homo sapiens
ggcatgtccacgtgtgtgt

SEQ ID NO: 3447131 - DNA, 16 bp, Homo sapiens
ggcattgatggggaag

SEQ ID NO: 3447132 - DNA, 20 bp, Homo sapiens
ggcattgcctgtgactgagg

SEQ ID NO: 3447133 - DNA, 15 bp, Homo sapiens
ggcattgtcctgtga

SEQ ID NO: 3447134 - DNA, 20 bp, Homo sapiens
ggcatttgcagggtcctctt

SEQ ID NO: 3447135 - DNA, 21 bp, Homo sapiens
ggcatttgcagggtcctcttc

SEQ ID NO: 3447136 - DNA, 14 bp, Homo sapiens
ggccaaacagacag

SEQ ID NO: 3447137 - DNA, 15 bp, Homo sapiens
ggccaaagccaaagc

SEQ ID NO: 3447138 - DNA, 23 bp, Homo sapiens
ggccaacatggtgaaaccctgta

SEQ ID NO: 3447139 - DNA, 23 bp, Homo sapiens
ggccaacccttctcctcttgtaa

SEQ ID NO: 3447140 - DNA, 16 bp, Homo sapiens
ggccaagcagtgcctg

SEQ ID NO: 3447141 - DNA, 17 bp, Homo sapiens
ggccaagcagtgcctgc

SEQ ID NO: 3447142 - DNA, 16 bp, Homo sapiens
ggccaagccagctgcc

SEQ ID NO: 3447143 - DNA, 19 bp, Homo sapiens
ggccaagccagctgcctag

SEQ ID NO: 3447144 - DNA, 16 bp, Homo sapiens
ggccaaggagggtgag

SEQ ID NO: 3447145 - DNA, 13 bp, Homo sapiens
ggccaaggtggga

SEQ ID NO: 3447146 - DNA, 20 bp, Homo sapiens
ggccacagtagtcttgatga

SEQ ID NO: 3447147 - DNA, 18 bp, Homo sapiens
ggccacatgggaggctca

SEQ ID NO: 3447148 - DNA, 19 bp, Homo sapiens
ggccacatgggaggctcac

SEQ ID NO: 3447149 - DNA, 18 bp, Homo sapiens
ggccacgtgatgtggagg

SEQ ID NO: 3447150 - DNA, 11 bp, Homo sapiens
ggccactaagc

SEQ ID NO: 3447151 - DNA, 14 bp, Homo sapiens
ggccactgaagata

SEQ ID NO: 3447152 - DNA, 13 bp, Homo sapiens
ggccacttctgtc

SEQ ID NO: 3447153 - DNA, 15 bp, Homo sapiens
ggccagacatgccac

SEQ ID NO: 3447154 - DNA, 18 bp, Homo sapiens
ggccagacatgccacaag

SEQ ID NO: 3447155 - DNA, 21 bp, Homo sapiens
ggccagagagcctggtgctgc

SEQ ID NO: 3447156 - DNA, 11 bp, Homo sapiens
ggccagagcca

SEQ ID NO: 3447157 - DNA, 12 bp, Homo sapiens
ggccagagccag

SEQ ID NO: 3447158 - DNA, 14 bp, Homo sapiens
ggccagagccaggg

SEQ ID NO: 3447159 - DNA, 22 bp, Homo sapiens
ggccagagggagtgacagaggc

SEQ ID NO: 3447160 - DNA, 20 bp, Homo sapiens
ggccagatgcaccagccctt

SEQ ID NO: 3447161 - DNA, 18 bp, Homo sapiens
ggccagcacccaaagggt

SEQ ID NO: 3447162 - DNA, 14 bp, Homo sapiens
ggccagccatgtct

SEQ ID NO: 3447163 - DNA, 21 bp, Homo sapiens
ggccagcctgcgggaagctga

SEQ ID NO: 3447164 - DNA, 19 bp, Homo sapiens
ggccagctatctgcctgac

SEQ ID NO: 3447165 - DNA, 20 bp, Homo sapiens
ggccagctatctgcctgaca

SEQ ID NO: 3447166 - DNA, 19 bp, Homo sapiens
ggccagctgccccagccag

SEQ ID NO: 3447167 - DNA, 14 bp, Homo sapiens
ggccaggctggtct

SEQ ID NO: 3447168 - DNA, 12 bp, Homo sapiens
ggccagggcctg

SEQ ID NO: 3447169 - DNA, 17 bp, Homo sapiens
ggccagggcctggaaga

SEQ ID NO: 3447170 - DNA, 18 bp, Homo sapiens
ggccagtacctttccatt

SEQ ID NO: 3447171 - DNA, 14 bp, Homo sapiens
ggccagtccaggct

SEQ ID NO: 3447172 - DNA, 23 bp, Homo sapiens
ggccagtctgtggatcagagatg

SEQ ID NO: 3447173 - DNA, 15 bp, Homo sapiens
ggccatgctgaggcc

SEQ ID NO: 3447174 - DNA, 22 bp, Homo sapiens
ggccatgctgaggcctgggccg

SEQ ID NO: 3447175 - DNA, 13 bp, Homo sapiens
ggccatgggcctc

SEQ ID NO: 3447176 - DNA, 16 bp, Homo sapiens
ggccatgggcctcctg

SEQ ID NO: 3447177 - DNA, 14 bp, Homo sapiens
ggccattaggaaac

SEQ ID NO: 3447178 - DNA, 17 bp, Homo sapiens
ggccattgtgaaccaat

SEQ ID NO: 3447179 - DNA, 23 bp, Homo sapiens
ggcccaaatccagtgtgcacccc

SEQ ID NO: 3447180 - DNA, 18 bp, Homo sapiens
ggcccagaccggcttctc

SEQ ID NO: 3447181 - DNA, 13 bp, Homo sapiens
ggcccagagccca

SEQ ID NO: 3447182 - DNA, 22 bp, Homo sapiens
ggcccaggaccatcatcctact

SEQ ID NO: 3447183 - DNA, 14 bp, Homo sapiens
ggcccaggctggga

SEQ ID NO: 3447184 - DNA, 21 bp, Homo sapiens
ggcccagggcccagagcccag

SEQ ID NO: 3447185 - DNA, 13 bp, Homo sapiens
ggccccaccctgg

SEQ ID NO: 3447186 - DNA, 23 bp, Homo sapiens
ggccccaccctgggccctgggct

SEQ ID NO: 3447187 - DNA, 12 bp, Homo sapiens
ggccccactggg

SEQ ID NO: 3447188 - DNA, 13 bp, Homo sapiens
ggccccagcctcc

SEQ ID NO: 3447189 - DNA, 15 bp, Homo sapiens
ggccccaggaagccg

SEQ ID NO: 3447190 - DNA, 21 bp, Homo sapiens
ggccccaggacctggctgcca

SEQ ID NO: 3447191 - DNA, 22 bp, Homo sapiens
ggccccaggcattgccaagggc

SEQ ID NO: 3447192 - DNA, 11 bp, Homo sapiens
ggcccccacag

SEQ ID NO: 3447193 - DNA, 12 bp, Homo sapiens
ggcccccacagg

SEQ ID NO: 3447194 - DNA, 16 bp, Homo sapiens
ggcccccacttgcctc

SEQ ID NO: 3447195 - DNA, 17 bp, Homo sapiens
ggccccccgcagcaccc

SEQ ID NO: 3447196 - DNA, 22 bp, Homo sapiens
ggcccctatgtagtccgtgctg

SEQ ID NO: 3447197 - DNA, 15 bp, Homo sapiens
ggcccctcacctact

SEQ ID NO: 3447198 - DNA, 16 bp, Homo sapiens
ggcccctccccctgag

SEQ ID NO: 3447199 - DNA, 12 bp, Homo sapiens
ggcccctctcct

SEQ ID NO: 3447200 - DNA, 12 bp, Homo sapiens
ggcccctgccac

SEQ ID NO: 3447201 - DNA, 17 bp, Homo sapiens
ggcccctgccaccctgg

SEQ ID NO: 3447202 - DNA, 20 bp, Homo sapiens
ggcccctgcccggctgcgga

SEQ ID NO: 3447203 - DNA, 14 bp, Homo sapiens
ggcccctgctggtt

SEQ ID NO: 3447204 - DNA, 22 bp, Homo sapiens
ggcccctggaggctgcctccca

SEQ ID NO: 3447205 - DNA, 12 bp, Homo sapiens
ggcccctggccc

SEQ ID NO: 3447206 - DNA, 13 bp, Homo sapiens
ggcccctgtgagt

SEQ ID NO: 3447207 - DNA, 16 bp, Homo sapiens
ggccccttgctggagt

SEQ ID NO: 3447208 - DNA, 18 bp, Homo sapiens
ggcccgcgccacaggacc

SEQ ID NO: 3447209 - DNA, 12 bp, Homo sapiens
ggcccggccagc

SEQ ID NO: 3447210 - DNA, 13 bp, Homo sapiens
ggcccggctccag

SEQ ID NO: 3447211 - DNA, 21 bp, Homo sapiens
ggccctaattcagccatgtac

SEQ ID NO: 3447212 - DNA, 22 bp, Homo sapiens
ggccctagactcggggtgcttc

SEQ ID NO: 3447213 - DNA, 14 bp, Homo sapiens
ggccctcccagtac

SEQ ID NO: 3447214 - DNA, 20 bp, Homo sapiens
ggccctcctaccctgcgccc

SEQ ID NO: 3447215 - DNA, 15 bp, Homo sapiens
ggccctcgctgccag

SEQ ID NO: 3447216 - DNA, 15 bp, Homo sapiens
ggccctctctgctct

SEQ ID NO: 3447217 - DNA, 12 bp, Homo sapiens
ggccctctcttc

SEQ ID NO: 3447218 - DNA, 20 bp, Homo sapiens
ggccctctcttctcaccttt

SEQ ID NO: 3447219 - DNA, 23 bp, Homo sapiens
ggccctgagccagagacaaggtc

SEQ ID NO: 3447220 - DNA, 18 bp, Homo sapiens
gctgagcaaatcaccaca

SEQ ID NO: 3447221 - DNA, 13 bp, Homo sapiens
gctgagccacctg

SEQ ID NO: 3447222 - DNA, 16 bp, Homo sapiens
gctgagccacctgccc

SEQ ID NO: 3447223 - DNA, 15 bp, Homo sapiens
gctgagcccctgtct

SEQ ID NO: 3447224 - DNA, 20 bp, Homo sapiens
gctgagcctctgctccccag

SEQ ID NO: 3447225 - DNA, 23 bp, Homo sapiens
gctgagcgaggagatgctccttg

SEQ ID NO: 3447226 - DNA, 13 bp, Homo sapiens
gctgagctgggga

SEQ ID NO: 3447227 - DNA, 17 bp, Homo sapiens
gctgaggaaaggccagc

SEQ ID NO: 3447228 - DNA, 19 bp, Homo sapiens
gctgaggccacactcagca

SEQ ID NO: 3447229 - DNA, 22 bp, Homo sapiens
gctgaggccccttctaggtggc

SEQ ID NO: 3447230 - DNA, 16 bp, Homo sapiens
gctgaggcctgggccg

SEQ ID NO: 3447231 - DNA, 15 bp, Homo sapiens
gctgaggctggcaca

SEQ ID NO: 3447232 - DNA, 23 bp, Homo sapiens
gctgaggctgggggagagccgtg

SEQ ID NO: 3447233 - DNA, 16 bp, Homo sapiens
gctgagggatgactta

SEQ ID NO: 3447234 - DNA, 15 bp, Homo sapiens
gctgagggcctgctg

SEQ ID NO: 3447235 - DNA, 23 bp, Homo sapiens
gctgagggcctgctggaggcctc

SEQ ID NO: 3447236 - DNA, 21 bp, Homo sapiens
gctgagggtgcccttttccag

SEQ ID NO: 3447237 - DNA, 18 bp, Homo sapiens
gctgatcatcgccagagg

SEQ ID NO: 3447238 - DNA, 22 bp, Homo sapiens
gctgatcatcgccagaggtgct

SEQ ID NO: 3447239 - DNA, 19 bp, Homo sapiens
gctgatctttaactggaag

SEQ ID NO: 3447240 - DNA, 23 bp, Homo sapiens
gctgatgtcaatttctgtgttgc

SEQ ID NO: 3447241 - DNA, 13 bp, Homo sapiens
gctgattctcagg

SEQ ID NO: 3447242 - DNA, 17 bp, Homo sapiens
gctgatttggtgaccaa

SEQ ID NO: 3447243 - DNA, 13 bp, Homo sapiens
gctgcaaagtgtt

SEQ ID NO: 3447244 - DNA, 19 bp, Homo sapiens
gctgcaaggtttaggctgg

SEQ ID NO: 3447245 - DNA, 21 bp, Homo sapiens
gctgcaaggtttaggctggtg

SEQ ID NO: 3447246 - DNA, 13 bp, Homo sapiens
gctgcaccctcag

SEQ ID NO: 3447247 - DNA, 18 bp, Homo sapiens
gctgcaccctcaggcagg

SEQ ID NO: 3447248 - DNA, 23 bp, Homo sapiens
gctgcagagtcacaagcctcgag

SEQ ID NO: 3447249 - DNA, 14 bp, Homo sapiens
gctgcagctccctg

SEQ ID NO: 3447250 - DNA, 18 bp, Homo sapiens
gctgcagtcaacagttca

SEQ ID NO: 3447251 - DNA, 23 bp, Homo sapiens
gctgcagtcaacagttcaaagaa

SEQ ID NO: 3447252 - DNA, 22 bp, Homo sapiens
gctgcatcccccccacctctcc

SEQ ID NO: 3447253 - DNA, 21 bp, Homo sapiens
gctgcatgccctctcaggccg

SEQ ID NO: 3447254 - DNA, 17 bp, Homo sapiens
gctgccacccacctccc

SEQ ID NO: 3447255 - DNA, 22 bp, Homo sapiens
gctgccacccacctccctgcct

SEQ ID NO: 3447256 - DNA, 17 bp, Homo sapiens
gctgccagctctgtatc

SEQ ID NO: 3447257 - DNA, 18 bp, Homo sapiens
gctgccagctctgtatca

SEQ ID NO: 3447258 - DNA, 13 bp, Homo sapiens
gctgccagggctt

SEQ ID NO: 3447259 - DNA, 12 bp, Homo sapiens
gctgccatccag

SEQ ID NO: 3447260 - DNA, 18 bp, Homo sapiens
gctgccccatcagtgctc

SEQ ID NO: 3447261 - DNA, 22 bp, Homo sapiens
gctgccccatctcccctcagct

SEQ ID NO: 3447262 - DNA, 13 bp, Homo sapiens
gctgccccgcttc

SEQ ID NO: 3447263 - DNA, 20 bp, Homo sapiens
gctgccccgcttccccacag

SEQ ID NO: 3447264 - DNA, 22 bp, Homo sapiens
gctgccccgcttccccacagaa

SEQ ID NO: 3447265 - DNA, 15 bp, Homo sapiens
gctgccccggcccct

SEQ ID NO: 3447266 - DNA, 22 bp, Homo sapiens
gctgccccggcccctccccctg

SEQ ID NO: 3447267 - DNA, 19 bp, Homo sapiens
gctgcccctaatctctgta

SEQ ID NO: 3447268 - DNA, 14 bp, Homo sapiens
gctgcccctctctg

SEQ ID NO: 3447269 - DNA, 16 bp, Homo sapiens
gctgcccctctctggg

SEQ ID NO: 3447270 - DNA, 17 bp, Homo sapiens
gctgcccctctctgggc

SEQ ID NO: 3447271 - DNA, 23 bp, Homo sapiens
gctgcccctctctgggcctcaga

SEQ ID NO: 3447272 - DNA, 20 bp, Homo sapiens
gctgcccgctcagcccagct

SEQ ID NO: 3447273 - DNA, 17 bp, Homo sapiens
gctgccctatgggcctg

SEQ ID NO: 3447274 - DNA, 23 bp, Homo sapiens
gctgccctcccctccggactggt

SEQ ID NO: 3447275 - DNA, 22 bp, Homo sapiens
gctgccgagacagaccctctgc

SEQ ID NO: 3447276 - DNA, 17 bp, Homo sapiens
gctgccgccccacccag

SEQ ID NO: 3447277 - DNA, 15 bp, Homo sapiens
gctgccggcacagct

SEQ ID NO: 3447278 - DNA, 17 bp, Homo sapiens
gctgccggcacagctgg

SEQ ID NO: 3447279 - DNA, 22 bp, Homo sapiens
gctgccgtggggccgccgcctc

SEQ ID NO: 3447280 - DNA, 12 bp, Homo sapiens
gctgcctcccaa

SEQ ID NO: 3447281 - DNA, 22 bp, Homo sapiens
gctgcctcccaacagtggggaa

SEQ ID NO: 3447282 - DNA, 14 bp, Homo sapiens
gctgcctgcccaca

SEQ ID NO: 3447283 - DNA, 18 bp, Homo sapiens
gctgcctgcccacacagg

SEQ ID NO: 3447284 - DNA, 13 bp, Homo sapiens
gctgcctgcccgt

SEQ ID NO: 3447285 - DNA, 20 bp, Homo sapiens
gctgcctgttcagctccagc

SEQ ID NO: 3447286 - DNA, 23 bp, Homo sapiens
gctgccttggctcagacatgttt

SEQ ID NO: 3447287 - DNA, 18 bp, Homo sapiens
gctgcgacgcttgctctg

SEQ ID NO: 3447288 - DNA, 15 bp, Homo sapiens
gctgcggtccaccca

SEQ ID NO: 3447289 - DNA, 22 bp, Homo sapiens
gctgcggtccacccaggagccc

SEQ ID NO: 3447290 - DNA, 15 bp, Homo sapiens
gctgctatagcctgg

SEQ ID NO: 3447291 - DNA, 17 bp, Homo sapiens
gctgctatagcctgggg

SEQ ID NO: 3447292 - DNA, 19 bp, Homo sapiens
gctgctccccagcagcgga

SEQ ID NO: 3447293 - DNA, 19 bp, Homo sapiens
gctgctcctagagggaggg

SEQ ID NO: 3447294 - DNA, 18 bp, Homo sapiens
gctgctgacctccacagc

SEQ ID NO: 3447295 - DNA, 16 bp, Homo sapiens
gctgctgccagggctt

SEQ ID NO: 3447296 - DNA, 18 bp, Homo sapiens
gctgctgccagggcttcc

SEQ ID NO: 3447297 - DNA, 12 bp, Homo sapiens
gctgctgcccag

SEQ ID NO: 3447298 - DNA, 13 bp, Homo sapiens
gctgctgcccagg

SEQ ID NO: 3447299 - DNA, 15 bp, Homo sapiens
gctgctgcccaggcc

SEQ ID NO: 3447300 - DNA, 16 bp, Homo sapiens
gctgctgcctgcctgg

SEQ ID NO: 3447301 - DNA, 13 bp, Homo sapiens
gctgctggagact

SEQ ID NO: 3447302 - DNA, 21 bp, Homo sapiens
gctgctggccaaatagcaaag

SEQ ID NO: 3447303 - DNA, 17 bp, Homo sapiens
gctgctgtcacctctcc

SEQ ID NO: 3447304 - DNA, 14 bp, Homo sapiens
gctgctgtccagtg

SEQ ID NO: 3447305 - DNA, 16 bp, Homo sapiens
gctgctgtccagtgcc

SEQ ID NO: 3447306 - DNA, 21 bp, Homo sapiens
gctgctgtccagtgcctacat

SEQ ID NO: 3447307 - DNA, 20 bp, Homo sapiens
gctgcttagaatccaaactt

SEQ ID NO: 3447308 - DNA, 16 bp, Homo sapiens
gctgcttccaggctgg

SEQ ID NO: 3447309 - DNA, 17 bp, Homo sapiens
gctgcttccaggctggg

SEQ ID NO: 3447310 - DNA, 13 bp, Homo sapiens
gctgcttcctcct

SEQ ID NO: 3447311 - DNA, 15 bp, Homo sapiens
gctgcttcctcctgg

SEQ ID NO: 3447312 - DNA, 20 bp, Homo sapiens
gctggaaacagactcgattc

SEQ ID NO: 3447313 - DNA, 21 bp, Homo sapiens
gctggaacctgcaaaaaatac

SEQ ID NO: 3447314 - DNA, 14 bp, Homo sapiens
gctggaagatcctg

SEQ ID NO: 3447315 - DNA, 20 bp, Homo sapiens
gctggaatgcagtggtgcga

SEQ ID NO: 3447316 - DNA, 20 bp, Homo sapiens
gctggacagtatcactgtct

SEQ ID NO: 3447317 - DNA, 18 bp, Homo sapiens
gctggaccttgaactggg

SEQ ID NO: 3447318 - DNA, 22 bp, Homo sapiens
gctggaccttgaactgggtact

SEQ ID NO: 3447319 - DNA, 19 bp, Homo sapiens
gctggacgggttagacagc

SEQ ID NO: 3447320 - DNA, 22 bp, Homo sapiens
gctggactctcagtctctgagc

SEQ ID NO: 3447321 - DNA, 13 bp, Homo sapiens
gctggactgaggc

SEQ ID NO: 3447322 - DNA, 14 bp, Homo sapiens
gctggactgaggcc

SEQ ID NO: 3447323 - DNA, 16 bp, Homo sapiens
gctggactgaggcctg

SEQ ID NO: 3447324 - DNA, 17 bp, Homo sapiens
gctggactgaggcctga

SEQ ID NO: 3447325 - DNA, 18 bp, Homo sapiens
gctggactgaggcctgag

SEQ ID NO: 3447326 - DNA, 17 bp, Homo sapiens
gctggagaaatcttgaa

SEQ ID NO: 3447327 - DNA, 18 bp, Homo sapiens
gctggagactcctaggca

SEQ ID NO: 3447328 - DNA, 20 bp, Homo sapiens
gctggagactcctaggcagg

SEQ ID NO: 3447329 - DNA, 16 bp, Homo sapiens
gctggagcactgggct

SEQ ID NO: 3447330 - DNA, 18 bp, Homo sapiens
gctggagcactgggctcc

SEQ ID NO: 3447331 - DNA, 22 bp, Homo sapiens
gctggagcccagggagcggaaa

SEQ ID NO: 3447332 - DNA, 17 bp, Homo sapiens
gctggagcctggtgccc

SEQ ID NO: 3447333 - DNA, 12 bp, Homo sapiens
gctggaggccca

SEQ ID NO: 3447334 - DNA, 14 bp, Homo sapiens
gctggaggcccagg

SEQ ID NO: 3447335 - DNA, 12 bp, Homo sapiens
gctggaggcctc

SEQ ID NO: 3447336 - DNA, 15 bp, Homo sapiens
gctggagtgcagtgg

SEQ ID NO: 3447337 - DNA, 15 bp, Homo sapiens
gctggatgatggtct

SEQ ID NO: 3447338 - DNA, 22 bp, Homo sapiens
gctggatgctccttccaacagg

SEQ ID NO: 3447339 - DNA, 19 bp, Homo sapiens
gctggcaacacagaggcag

SEQ ID NO: 3447340 - DNA, 15 bp, Homo sapiens
gctggcagcagagtg

SEQ ID NO: 3447341 - DNA, 16 bp, Homo sapiens
gctggccaaagagcct

SEQ ID NO: 3447342 - DNA, 16 bp, Homo sapiens
gctggccagtccaggc

SEQ ID NO: 3447343 - DNA, 23 bp, Homo sapiens
gctggccatctggttaggatggc

SEQ ID NO: 3447344 - DNA, 15 bp, Homo sapiens
gctggcccagggccc

SEQ ID NO: 3447345 - DNA, 19 bp, Homo sapiens
gctggcccagggcccagag

SEQ ID NO: 3447346 - DNA, 20 bp, Homo sapiens
gctggcccagggcccagagc

SEQ ID NO: 3447347 - DNA, 13 bp, Homo sapiens
gctggccccgccg

SEQ ID NO: 3447348 - DNA, 21 bp, Homo sapiens
gctggcctcacccacccctgc

SEQ ID NO: 3447349 - DNA, 22 bp, Homo sapiens
gctggcctcccaaatgagccat

SEQ ID NO: 3447350 - DNA, 15 bp, Homo sapiens
gctggcgagagtctg

SEQ ID NO: 3447351 - DNA, 20 bp, Homo sapiens
gctggcgagagtctggccct

SEQ ID NO: 3447352 - DNA, 18 bp, Homo sapiens
gctggcgtgcagtggtgc

SEQ ID NO: 3447353 - DNA, 21 bp, Homo sapiens
gctggctctataaggcagcct

SEQ ID NO: 3447354 - DNA, 13 bp, Homo sapiens
gctggctctgagc

SEQ ID NO: 3447355 - DNA, 16 bp, Homo sapiens
gctggctctgagcgcc

SEQ ID NO: 3447356 - DNA, 15 bp, Homo sapiens
gctggctgttggctg

SEQ ID NO: 3447357 - DNA, 17 bp, Homo sapiens
gctggctgttggctggg

SEQ ID NO: 3447358 - DNA, 19 bp, Homo sapiens
gctggctgttggctggggg

SEQ ID NO: 3447359 - DNA, 15 bp, Homo sapiens
gctggcttgggcagc

SEQ ID NO: 3447360 - DNA, 14 bp, Homo sapiens
gctggcttttctgt

SEQ ID NO: 3447361 - DNA, 21 bp, Homo sapiens
gctggcttttctgtttcctgt

SEQ ID NO: 3447362 - DNA, 23 bp, Homo sapiens
gctgggaactcacctggggctgc

SEQ ID NO: 3447363 - DNA, 17 bp, Homo sapiens
gctgggacgtggctcag

SEQ ID NO: 3447364 - DNA, 19 bp, Homo sapiens
gctgggacgtggctcagcc

SEQ ID NO: 3447365 - DNA, 21 bp, Homo sapiens
gctgggacgtggctcagccag

SEQ ID NO: 3447366 - DNA, 19 bp, Homo sapiens
gctgggactacaggcaccc

SEQ ID NO: 3447367 - DNA, 15 bp, Homo sapiens
gctgggactcagcct

SEQ ID NO: 3447368 - DNA, 19 bp, Homo sapiens
gctgggactcagccttcag

SEQ ID NO: 3447369 - DNA, 20 bp, Homo sapiens
gctgggagctccactctgct

SEQ ID NO: 3447370 - DNA, 24 bp, Homo sapiens
gctgggaggagcccctggacatgc

SEQ ID NO: 3447371 - DNA, 16 bp, Homo sapiens
gctgggattacaggtg

SEQ ID NO: 3447372 - DNA, 15 bp, Homo sapiens
gctgggcacttccct

SEQ ID NO: 3447373 - DNA, 18 bp, Homo sapiens
gctgggcacttccctgct

SEQ ID NO: 3447374 - DNA, 19 bp, Homo sapiens
gctgggcacttccctgctg

SEQ ID NO: 3447375 - DNA, 17 bp, Homo sapiens
gctgggccctctcttct

SEQ ID NO: 3447376 - DNA, 17 bp, Homo sapiens
gctgggcttcagtggca

SEQ ID NO: 3447377 - DNA, 20 bp, Homo sapiens
gctgggcttcagtggcagct

SEQ ID NO: 3447378 - DNA, 18 bp, Homo sapiens
gctgggggcctcagtgcc

SEQ ID NO: 3447379 - DNA, 19 bp, Homo sapiens
gctggggtggcctgtgtgg

SEQ ID NO: 3447380 - DNA, 20 bp, Homo sapiens
gctggggtttttgttttgtt

SEQ ID NO: 3447381 - DNA, 17 bp, Homo sapiens
gctgggtattaccatgt

SEQ ID NO: 3447382 - DNA, 13 bp, Homo sapiens
gctgggtcaggca

SEQ ID NO: 3447383 - DNA, 14 bp, Homo sapiens
gctgggtcaggcag

SEQ ID NO: 3447384 - DNA, 16 bp, Homo sapiens
gctgggtcaggcaggg

SEQ ID NO: 3447385 - DNA, 21 bp, Homo sapiens
gctgggttggagggtgtccca

SEQ ID NO: 3447386 - DNA, 15 bp, Homo sapiens
gctggtccgtgggac

SEQ ID NO: 3447387 - DNA, 20 bp, Homo sapiens
gctggtgagtgatgcggcag

SEQ ID NO: 3447388 - DNA, 16 bp, Homo sapiens
gctggtggacccaggg

SEQ ID NO: 3447389 - DNA, 12 bp, Homo sapiens
gctggtggccca

SEQ ID NO: 3447390 - DNA, 13 bp, Homo sapiens
gctggtggcccag

SEQ ID NO: 3447391 - DNA, 14 bp, Homo sapiens
gctggtggcccagg

SEQ ID NO: 3447392 - DNA, 15 bp, Homo sapiens
gctggtgtcacctga

SEQ ID NO: 3447393 - DNA, 16 bp, Homo sapiens
gctggtgtcacctgaa

SEQ ID NO: 3447394 - DNA, 23 bp, Homo sapiens
gctggttcagggttggcccctgc

SEQ ID NO: 3447395 - DNA, 21 bp, Homo sapiens
gctggttcggatttggggtgg

SEQ ID NO: 3447396 - DNA, 12 bp, Homo sapiens
gctggttctgta

SEQ ID NO: 3447397 - DNA, 16 bp, Homo sapiens
gctgtaaaatgcatga

SEQ ID NO: 3447398 - DNA, 20 bp, Homo sapiens
gctgtaaaatgcatgatttt

SEQ ID NO: 3447399 - DNA, 21 bp, Homo sapiens
gctgtacaaatataagaataa

SEQ ID NO: 3447400 - DNA, 16 bp, Homo sapiens
gctgtacatctatttt

SEQ ID NO: 3447401 - DNA, 23 bp, Homo sapiens
gctgtacatctattttggattgt

SEQ ID NO: 3447402 - DNA, 16 bp, Homo sapiens
gctgtagtaggcattt

SEQ ID NO: 3447403 - DNA, 18 bp, Homo sapiens
gctgtataaaatcagcca

SEQ ID NO: 3447404 - DNA, 15 bp, Homo sapiens
gctgtataagttatt

SEQ ID NO: 3447405 - DNA, 19 bp, Homo sapiens
gctgtatcccatgagcctc

SEQ ID NO: 3447406 - DNA, 23 bp, Homo sapiens
gctgtatcccatgagcctcagca

SEQ ID NO: 3447407 - DNA, 20 bp, Homo sapiens
gctgtatcttgatgtttaga

SEQ ID NO: 3447408 - DNA, 16 bp, Homo sapiens
gctgtatcttgttttt

SEQ ID NO: 3447409 - DNA, 17 bp, Homo sapiens
gctgtattaagccactt

SEQ ID NO: 3447410 - DNA, 20 bp, Homo sapiens
gctgtattcatatattgcat

SEQ ID NO: 3447411 - DNA, 23 bp, Homo sapiens
gctgtattcatatattgcatttc

SEQ ID NO: 3447412 - DNA, 13 bp, Homo sapiens
gctgtattcttct

SEQ ID NO: 3447413 - DNA, 22 bp, Homo sapiens
gctgtcaagccggatgcctaag

SEQ ID NO: 3447414 - DNA, 16 bp, Homo sapiens
gctgtcaccaaggaaa

SEQ ID NO: 3447415 - DNA, 15 bp, Homo sapiens
gctgtcacctctccc

SEQ ID NO: 3447416 - DNA, 16 bp, Homo sapiens
gctgtcacttcttcac

SEQ ID NO: 3447417 - DNA, 13 bp, Homo sapiens
gctgtccagtgcc

SEQ ID NO: 3447418 - DNA, 14 bp, Homo sapiens
gctgtccagtgcct

SEQ ID NO: 3447419 - DNA, 15 bp, Homo sapiens
gctgtccagtgccta

SEQ ID NO: 3447420 - DNA, 18 bp, Homo sapiens
gctgtccagtgcctacat

SEQ ID NO: 3447421 - DNA, 19 bp, Homo sapiens
gctgtccagtgcctacatc

SEQ ID NO: 3447422 - DNA, 13 bp, Homo sapiens
gctgtccctcact

SEQ ID NO: 3447423 - DNA, 19 bp, Homo sapiens
gctgtcctcaggtggccat

SEQ ID NO: 3447424 - DNA, 15 bp, Homo sapiens
gctgtcggcgctgcc

SEQ ID NO: 3447425 - DNA, 14 bp, Homo sapiens
gctgtctctagaag

SEQ ID NO: 3447426 - DNA, 12 bp, Homo sapiens
gctgtctctctg

SEQ ID NO: 3447427 - DNA, 19 bp, Homo sapiens
gctgtctctctgggctgca

SEQ ID NO: 3447428 - DNA, 13 bp, Homo sapiens
gctgtgaaccctg

SEQ ID NO: 3447429 - DNA, 20 bp, Homo sapiens
gctgtgaaccctggggcctg

SEQ ID NO: 3447430 - DNA, 23 bp, Homo sapiens
gctgtgaaccctggggcctgact

SEQ ID NO: 3447431 - DNA, 17 bp, Homo sapiens
gctgtgaactgaaatta

SEQ ID NO: 3447432 - DNA, 18 bp, Homo sapiens
gctgtgacagcctctgca

SEQ ID NO: 3447433 - DNA, 20 bp, Homo sapiens
gctgtgactcttctctcaac

SEQ ID NO: 3447434 - DNA, 16 bp, Homo sapiens
gctgtgctatggtgct

SEQ ID NO: 3447435 - DNA, 18 bp, Homo sapiens
gctgtgctctggacaggc

SEQ ID NO: 3447436 - DNA, 21 bp, Homo sapiens
gctgtgctctggacaggcatg

SEQ ID NO: 3447437 - DNA, 17 bp, Homo sapiens
gctgtgcttatggtacc

SEQ ID NO: 3447438 - DNA, 20 bp, Homo sapiens
gctgtggagacaatgtctgc

SEQ ID NO: 3447439 - DNA, 21 bp, Homo sapiens
gctgtggagacaatgtctgca

SEQ ID NO: 3447440 - DNA, 18 bp, Homo sapiens
gctgtgggaaacctcatt

SEQ ID NO: 3447441 - DNA, 23 bp, Homo sapiens
gctgtgtttggctttcagggagg

SEQ ID NO: 3447442 - DNA, 15 bp, Homo sapiens
gctgttctacttttt

SEQ ID NO: 3447443 - DNA, 19 bp, Homo sapiens
gctgttctcattcctgttc

SEQ ID NO: 3447444 - DNA, 16 bp, Homo sapiens
gctgttgaagtctcag

SEQ ID NO: 3447445 - DNA, 16 bp, Homo sapiens
gctgttgagctgtttt

SEQ ID NO: 3447446 - DNA, 13 bp, Homo sapiens
gctgttgctgaat

SEQ ID NO: 3447447 - DNA, 16 bp, Homo sapiens
gctgttgctgaatagg

SEQ ID NO: 3447448 - DNA, 13 bp, Homo sapiens
gctgttggctggg

SEQ ID NO: 3447449 - DNA, 14 bp, Homo sapiens
gctgttggctgggg

SEQ ID NO: 3447450 - DNA, 16 bp, Homo sapiens
gctgttggctgggggc

SEQ ID NO: 3447451 - DNA, 22 bp, Homo sapiens
gctgttggctgggggcctcagt

SEQ ID NO: 3447452 - DNA, 15 bp, Homo sapiens
gctgtttactaggga

SEQ ID NO: 3447453 - DNA, 15 bp, Homo sapiens
gctgttttcctccct

SEQ ID NO: 3447454 - DNA, 20 bp, Homo sapiens
gctgttttcctcccttctgc

SEQ ID NO: 3447455 - DNA, 18 bp, Homo sapiens
gcttaatgacactagcta

SEQ ID NO: 3447456 - DNA, 23 bp, Homo sapiens
gcttaattttctgtggatcattt

SEQ ID NO: 3447457 - DNA, 13 bp, Homo sapiens
gcttagagacagt

SEQ ID NO: 3447458 - DNA, 12 bp, Homo sapiens
gcttagagcagt

SEQ ID NO: 3447459 - DNA, 18 bp, Homo sapiens
gcttagctttgctctgcc

SEQ ID NO: 3447460 - DNA, 16 bp, Homo sapiens
gcttagtttgtgtgtt

SEQ ID NO: 3447461 - DNA, 20 bp, Homo sapiens
gcttatggtaccagatgcag

SEQ ID NO: 3447462 - DNA, 19 bp, Homo sapiens
gcttcaatagttcaaggaa

SEQ ID NO: 3447463 - DNA, 19 bp, Homo sapiens
gcttcaccccaatcccagc

SEQ ID NO: 3447464 - DNA, 18 bp, Homo sapiens
gcttcacggaagagcctt

SEQ ID NO: 3447465 - DNA, 15 bp, Homo sapiens
gcttcactagggaat

SEQ ID NO: 3447466 - DNA, 14 bp, Homo sapiens
gcttcaggaacctc

SEQ ID NO: 3447467 - DNA, 22 bp, Homo sapiens
gcttcaggaacctcgagtactg

SEQ ID NO: 3447468 - DNA, 17 bp, Homo sapiens
gcttcaggatacgctgc

SEQ ID NO: 3447469 - DNA, 20 bp, Homo sapiens
gcttcagtggcagctgcttt

SEQ ID NO: 3447470 - DNA, 17 bp, Homo sapiens
gcttcatcattccctct

SEQ ID NO: 3447471 - DNA, 19 bp, Homo sapiens
gcttcatcattccctctca

SEQ ID NO: 3447472 - DNA, 17 bp, Homo sapiens
gcttcattagagcaggc

SEQ ID NO: 3447473 - DNA, 18 bp, Homo sapiens
gcttcattagagcaggcg

SEQ ID NO: 3447474 - DNA, 17 bp, Homo sapiens
gcttcatttcctgtgtc

SEQ ID NO: 3447475 - DNA, 17 bp, Homo sapiens
gcttcatttttgtaata

SEQ ID NO: 3447476 - DNA, 19 bp, Homo sapiens
gcttccaggctgggcagca

SEQ ID NO: 3447477 - DNA, 18 bp, Homo sapiens
gcttcccagtggctgctg

SEQ ID NO: 3447478 - DNA, 19 bp, Homo sapiens
gcttcccagtggctgctgc

SEQ ID NO: 3447479 - DNA, 13 bp, Homo sapiens
gcttccccacaga

SEQ ID NO: 3447480 - DNA, 21 bp, Homo sapiens
gcttccccacagaactgctta

SEQ ID NO: 3447481 - DNA, 14 bp, Homo sapiens
gcttcccctctctc

SEQ ID NO: 3447482 - DNA, 16 bp, Homo sapiens
gcttcccctctctcct

SEQ ID NO: 3447483 - DNA, 13 bp, Homo sapiens
gcttccctaatct

SEQ ID NO: 3447484 - DNA, 14 bp, Homo sapiens
gcttccctaatcta

SEQ ID NO: 3447485 - DNA, 15 bp, Homo sapiens
gcttccctccatccc

SEQ ID NO: 3447486 - DNA, 17 bp, Homo sapiens
gcttccctgaaagactg

SEQ ID NO: 3447487 - DNA, 21 bp, Homo sapiens
gcttcctgtcctcccagctcc

SEQ ID NO: 3447488 - DNA, 18 bp, Homo sapiens
gcttcgggcccttcccac

SEQ ID NO: 3447489 - DNA, 16 bp, Homo sapiens
gcttctcatcctgcag

SEQ ID NO: 3447490 - DNA, 20 bp, Homo sapiens
gcttctctatgataattaca

SEQ ID NO: 3447491 - DNA, 22 bp, Homo sapiens
gcttctctgacttctgcctgga

SEQ ID NO: 3447492 - DNA, 17 bp, Homo sapiens
gcctcttttcctgaaga

SEQ ID NO: 3447493 - DNA, 19 bp, Homo sapiens
gcctcttttcctgaagaaa

SEQ ID NO: 3447494 - DNA, 22 bp, Homo sapiens
gcctgaaactttgaggataact

SEQ ID NO: 3447495 - DNA, 20 bp, Homo sapiens
gcctgaacagaagctcttac

SEQ ID NO: 3447496 - DNA, 11 bp, Homo sapiens
gcctgaagagc

SEQ ID NO: 3447497 - DNA, 15 bp, Homo sapiens
gcctgaagccagctg

SEQ ID NO: 3447498 - DNA, 22 bp, Homo sapiens
gcctgaaggggcgtctgttccc

SEQ ID NO: 3447499 - DNA, 19 bp, Homo sapiens
gcctgaatcatgagcctgc

SEQ ID NO: 3447500 - DNA, 21 bp, Homo sapiens
gcctgacagtgtgggacaggc

SEQ ID NO: 3447501 - DNA, 19 bp, Homo sapiens
gcctgactagggagccatg

SEQ ID NO: 3447502 - DNA, 20 bp, Homo sapiens
gcctgactagggagccatgt

SEQ ID NO: 3447503 - DNA, 14 bp, Homo sapiens
gcctgactgctcag

SEQ ID NO: 3447504 - DNA, 15 bp, Homo sapiens
gcctgactgctcaga

SEQ ID NO: 3447505 - DNA, 16 bp, Homo sapiens
gcctgagatttcatct

SEQ ID NO: 3447506 - DNA, 13 bp, Homo sapiens
gcctgagctgctt

SEQ ID NO: 3447507 - DNA, 15 bp, Homo sapiens
gcctgagtgcctggc

SEQ ID NO: 3447508 - DNA, 20 bp, Homo sapiens
gcctgattgccaagctcagg

SEQ ID NO: 3447509 - DNA, 19 bp, Homo sapiens
gcctgcaaacgctgcctgc

SEQ ID NO: 3447510 - DNA, 16 bp, Homo sapiens
gcctgcaggacctgcc

SEQ ID NO: 3447511 - DNA, 17 bp, Homo sapiens
gcctgcaggacctgcct

SEQ ID NO: 3447512 - DNA, 19 bp, Homo sapiens
gcctgcaggacctgcctgt

SEQ ID NO: 3447513 - DNA, 14 bp, Homo sapiens
gcctgccagctgca

SEQ ID NO: 3447514 - DNA, 15 bp, Homo sapiens
gcctgccatagccag

SEQ ID NO: 3447515 - DNA, 16 bp, Homo sapiens
gcctgccatagccagg

SEQ ID NO: 3447516 - DNA, 13 bp, Homo sapiens
gcctgcccaggcc

SEQ ID NO: 3447517 - DNA, 14 bp, Homo sapiens
gcctgcccctccca

SEQ ID NO: 3447518 - DNA, 14 bp, Homo sapiens
gcctgccgggctga

SEQ ID NO: 3447519 - DNA, 17 bp, Homo sapiens
gcctgccgggctgaggg

SEQ ID NO: 3447520 - DNA, 11 bp, Homo sapiens
gcctgcctcca

SEQ ID NO: 3447521 - DNA, 18 bp, Homo sapiens
gcctgcctccagggctgg

SEQ ID NO: 3447522 - DNA, 16 bp, Homo sapiens
gcctgcctggcaggct

SEQ ID NO: 3447523 - DNA, 17 bp, Homo sapiens
gcctgcctggcaggctg

SEQ ID NO: 3447524 - DNA, 20 bp, Homo sapiens
gcctgccttaccgagagcca

SEQ ID NO: 3447525 - DNA, 13 bp, Homo sapiens
gcctgcgcctgct

SEQ ID NO: 3447526 - DNA, 16 bp, Homo sapiens
gcctgcgcctgctgca

SEQ ID NO: 3447527 - DNA, 22 bp, Homo sapiens
gcctgcgcctgctgcatgccct

SEQ ID NO: 3447528 - DNA, 14 bp, Homo sapiens
gcctgctccagacc

SEQ ID NO: 3447529 - DNA, 13 bp, Homo sapiens
gcctgctccagct

SEQ ID NO: 3447530 - DNA, 15 bp, Homo sapiens
gcctgctccagctgt

SEQ ID NO: 3447531 - DNA, 18 bp, Homo sapiens
gcctgctgcatgccctct

SEQ ID NO: 3447532 - DNA, 22 bp, Homo sapiens
gcctgctgcatgccctctcagg

SEQ ID NO: 3447533 - DNA, 19 bp, Homo sapiens
gcctgctggaagcccagcc

SEQ ID NO: 3447534 - DNA, 17 bp, Homo sapiens
gcctgctggaggcctca

SEQ ID NO: 3447535 - DNA, 19 bp, Homo sapiens
gcctgctggaggcctcagg

SEQ ID NO: 3447536 - DNA, 23 bp, Homo sapiens
gcctgctggttttatctgagtga

SEQ ID NO: 3447537 - DNA, 21 bp, Homo sapiens
gcctgctgtcaagtcccccag

SEQ ID NO: 3447538 - DNA, 13 bp, Homo sapiens
gcctggaagacag

SEQ ID NO: 3447539 - DNA, 20 bp, Homo sapiens
gcctggagatcctcctgcag

SEQ ID NO: 3447540 - DNA, 22 bp, Homo sapiens
gcctggagatcctcctgcagac

SEQ ID NO: 3447541 - DNA, 14 bp, Homo sapiens
gcctggcaggctgt

SEQ ID NO: 3447542 - DNA, 15 bp, Homo sapiens
gcctggccaaaggga

SEQ ID NO: 3447543 - DNA, 13 bp, Homo sapiens
gcctggccagaca

SEQ ID NO: 3447544 - DNA, 21 bp, Homo sapiens
gcctggccagacacaggccct

SEQ ID NO: 3447545 - DNA, 14 bp, Homo sapiens
gcctggccagatgc

SEQ ID NO: 3447546 - DNA, 15 bp, Homo sapiens
gcctggccagatgca

SEQ ID NO: 3447547 - DNA, 20 bp, Homo sapiens
gcctggccagatgcaccagc

SEQ ID NO: 3447548 - DNA, 17 bp, Homo sapiens
gcctgggacttccatgc

SEQ ID NO: 3447549 - DNA, 17 bp, Homo sapiens
gcctgggccgctgccac

SEQ ID NO: 3447550 - DNA, 18 bp, Homo sapiens
gcctgggccgctgccacg

SEQ ID NO: 3447551 - DNA, 23 bp, Homo sapiens
gcctggggctccgaaattccaag

SEQ ID NO: 3447552 - DNA, 14 bp, Homo sapiens
gcctggggctggcc

SEQ ID NO: 3447553 - DNA, 17 bp, Homo sapiens
gcctggggctggcctcc

SEQ ID NO: 3447554 - DNA, 20 bp, Homo sapiens
gcctgggggacccctggctc

SEQ ID NO: 3447555 - DNA, 23 bp, Homo sapiens
gcctgggggacccctggctctgg

SEQ ID NO: 3447556 - DNA, 16 bp, Homo sapiens
gcctgggggtgccagg

SEQ ID NO: 3447557 - DNA, 20 bp, Homo sapiens
gcctgggtgacaagagcgaa

SEQ ID NO: 3447558 - DNA, 15 bp, Homo sapiens
gcctgggtggacatg

SEQ ID NO: 3447559 - DNA, 20 bp, Homo sapiens
gcctgggtttaaggggagag

SEQ ID NO: 3447560 - DNA, 15 bp, Homo sapiens
gcctggtggcagctg

SEQ ID NO: 3447561 - DNA, 17 bp, Homo sapiens
gcctggtggcagctgcg

SEQ ID NO: 3447562 - DNA, 21 bp, Homo sapiens
gcctggtggcagctgcggtcc

SEQ ID NO: 3447563 - DNA, 15 bp, Homo sapiens
gcctggttgaagaag

SEQ ID NO: 3447564 - DNA, 19 bp, Homo sapiens
gcctggttgaagaagatga

SEQ ID NO: 3447565 - DNA, 19 bp, Homo sapiens
gcctgtaatcccagcactt

SEQ ID NO: 3447566 - DNA, 13 bp, Homo sapiens
gcctgtagcccac

SEQ ID NO: 3447567 - DNA, 22 bp, Homo sapiens
gcctgtagcccactctgctcgc

SEQ ID NO: 3447568 - DNA, 22 bp, Homo sapiens
gcctgtcctccaacaccaagca

SEQ ID NO: 3447569 - DNA, 22 bp, Homo sapiens
gcctgtcctgaaagcggctgcc

SEQ ID NO: 3447570 - DNA, 19 bp, Homo sapiens
gcctgtctttcagcattca

SEQ ID NO: 3447571 - DNA, 19 bp, Homo sapiens
gcctgtggcgccgtctcca

SEQ ID NO: 3447572 - DNA, 16 bp, Homo sapiens
gcctgtggctgtggag

SEQ ID NO: 3447573 - DNA, 21 bp, Homo sapiens
gcctgtgtccatgcgctcagg

SEQ ID NO: 3447574 - DNA, 20 bp, Homo sapiens
gcctgttcagctccagctca

SEQ ID NO: 3447575 - DNA, 19 bp, Homo sapiens
gccttaataaaaaatgaaa

SEQ ID NO: 3447576 - DNA, 23 bp, Homo sapiens
gccttaccgagagccaaacagag

SEQ ID NO: 3447577 - DNA, 17 bp, Homo sapiens
gccttagaagtcacaca

SEQ ID NO: 3447578 - DNA, 19 bp, Homo sapiens
gccttagaagtcacacagt

SEQ ID NO: 3447579 - DNA, 17 bp, Homo sapiens
gccttagcttcaggaac

SEQ ID NO: 3447580 - DNA, 18 bp, Homo sapiens
gccttagcttcaggaacc

SEQ ID NO: 3447581 - DNA, 19 bp, Homo sapiens
gccttatcgggctccagcc

SEQ ID NO: 3447582 - DNA, 22 bp, Homo sapiens
gccttatctaaatcaccagaga

SEQ ID NO: 3447583 - DNA, 22 bp, Homo sapiens
gccttcacacagatagaccttt

SEQ ID NO: 3447584 - DNA, 18 bp, Homo sapiens
gccttcacattcccctgg

SEQ ID NO: 3447585 - DNA, 22 bp, Homo sapiens
gccttcacattcccctggggac

SEQ ID NO: 3447586 - DNA, 22 bp, Homo sapiens
gccttcagacacatgctatgtt

SEQ ID NO: 3447587 - DNA, 22 bp, Homo sapiens
gccttccagatcctctctgggg

SEQ ID NO: 3447588 - DNA, 19 bp, Homo sapiens
gccttcccgccggaggcca

SEQ ID NO: 3447589 - DNA, 18 bp, Homo sapiens
gccttcctaagcctgtgg

SEQ ID NO: 3447590 - DNA, 19 bp, Homo sapiens
gccttcctaagcctgtggc

SEQ ID NO: 3447591 - DNA, 22 bp, Homo sapiens
gccttcctcctgggccctctct

SEQ ID NO: 3447592 - DNA, 17 bp, Homo sapiens
gccttctcaccagctgc

SEQ ID NO: 3447593 - DNA, 18 bp, Homo sapiens
gccttctcaccagctgca

SEQ ID NO: 3447594 - DNA, 19 bp, Homo sapiens
gccttctcaccagctgcaa

SEQ ID NO: 3447595 - DNA, 22 bp, Homo sapiens
gccttctcccctcttctgagct

SEQ ID NO: 3447596 - DNA, 14 bp, Homo sapiens
gccttcttcagggc

SEQ ID NO: 3447597 - DNA, 15 bp, Homo sapiens
gccttcttcagggcc

SEQ ID NO: 3447598 - DNA, 18 bp, Homo sapiens
gccttcttcagggcctgg

SEQ ID NO: 3447599 - DNA, 23 bp, Homo sapiens
gccttcttttgggggtcaacagt

SEQ ID NO: 3447600 - DNA, 19 bp, Homo sapiens
gccttgaaaaacaagtctt

SEQ ID NO: 3447601 - DNA, 16 bp, Homo sapiens
gccttgaactctgggc

SEQ ID NO: 3447602 - DNA, 16 bp, Homo sapiens
gccttgatgactgcct

SEQ ID NO: 3447603 - DNA, 17 bp, Homo sapiens
gccttgatgactgcctt

SEQ ID NO: 3447604 - DNA, 12 bp, Homo sapiens
gccttgccagag

SEQ ID NO: 3447605 - DNA, 14 bp, Homo sapiens
gccttgccagagat

SEQ ID NO: 3447606 - DNA, 12 bp, Homo sapiens
gccttgcctcct

SEQ ID NO: 3447607 - DNA, 15 bp, Homo sapiens
gccttgcctcctcag

SEQ ID NO: 3447608 - DNA, 19 bp, Homo sapiens
gccttggaagttgcatggc

SEQ ID NO: 3447609 - DNA, 13 bp, Homo sapiens
gccttgggagcca

SEQ ID NO: 3447610 - DNA, 16 bp, Homo sapiens
gccttgggagccactg

SEQ ID NO: 3447611 - DNA, 17 bp, Homo sapiens
gccttgggagccactgc

SEQ ID NO: 3447612 - DNA, 18 bp, Homo sapiens
gccttgggagccactgcc

SEQ ID NO: 3447613 - DNA, 19 bp, Homo sapiens
gccttgggagccactgcca

SEQ ID NO: 3447614 - DNA, 22 bp, Homo sapiens
gccttgggagccactgccactc

SEQ ID NO: 3447615 - DNA, 17 bp, Homo sapiens
gccttgtcccagaggct

SEQ ID NO: 3447616 - DNA, 21 bp, Homo sapiens
gcctttactgaccctggggct

SEQ ID NO: 3447617 - DNA, 19 bp, Homo sapiens
gcctttagtgatcacagca

SEQ ID NO: 3447618 - DNA, 21 bp, Homo sapiens
gcctttagtgatcacagcagc

SEQ ID NO: 3447619 - DNA, 22 bp, Homo sapiens
gcctttagtgatcacagcagct

SEQ ID NO: 3447620 - DNA, 14 bp, Homo sapiens
gcctttattgtgtt

SEQ ID NO: 3447621 - DNA, 22 bp, Homo sapiens
gcctttattgtgtttgtcatta

SEQ ID NO: 3447622 - DNA, 23 bp, Homo sapiens
gcctttattgtgtttgtcattag

SEQ ID NO: 3447623 - DNA, 14 bp, Homo sapiens
gcctttcctctcta

SEQ ID NO: 3447624 - DNA, 19 bp, Homo sapiens
gcctttcgaggcctgaagc

SEQ ID NO: 3447625 - DNA, 11 bp, Homo sapiens
gcctttgaatg

SEQ ID NO: 3447626 - DNA, 15 bp, Homo sapiens
gcctttgaatgtaac

SEQ ID NO: 3447627 - DNA, 14 bp, Homo sapiens
gcctttgaatgtta

SEQ ID NO: 3447628 - DNA, 15 bp, Homo sapiens
gcctttgaatgttaa

SEQ ID NO: 3447629 - DNA, 13 bp, Homo sapiens
gcctttgagcctg

SEQ ID NO: 3447630 - DNA, 13 bp, Homo sapiens
gcctttggcttca

SEQ ID NO: 3447631 - DNA, 13 bp, Homo sapiens
gcctttgggaaat

SEQ ID NO: 3447632 - DNA, 12 bp, Homo sapiens
gccttttctatt

SEQ ID NO: 3447633 - DNA, 20 bp, Homo sapiens
gccttttttcacggaagttt

SEQ ID NO: 3447634 - DNA, 13 bp, Homo sapiens
gcgactaatttca

SEQ ID NO: 3447635 - DNA, 18 bp, Homo sapiens
gcgactccgttggccact

SEQ ID NO: 3447636 - DNA, 20 bp, Homo sapiens
gcgagaacctaagtttcagt

SEQ ID NO: 3447637 - DNA, 19 bp, Homo sapiens
gcgagcccctcggctctgg

SEQ ID NO: 3447638 - DNA, 15 bp, Homo sapiens
gcgaggaggctccag

SEQ ID NO: 3447639 - DNA, 17 bp, Homo sapiens
gcgaggaggctccagag

SEQ ID NO: 3447640 - DNA, 16 bp, Homo sapiens
gcgaggtgcggccacc

SEQ ID NO: 3447641 - DNA, 17 bp, Homo sapiens
gcgatccacctgtctca

SEQ ID NO: 3447642 - DNA, 16 bp, Homo sapiens
gcgatctcggctcagt

SEQ ID NO: 3447643 - DNA, 12 bp, Homo sapiens
gcgatgggtcag

SEQ ID NO: 3447644 - DNA, 22 bp, Homo sapiens
gcgattcttctgcttcagcctc

SEQ ID NO: 3447645 - DNA, 22 bp, Homo sapiens
gcgcactgtgacccccagctcc

SEQ ID NO: 3447646 - DNA, 22 bp, Homo sapiens
gcgcatgtaatcccagctactc

SEQ ID NO: 3447647 - DNA, 21 bp, Homo sapiens
gcgccaggatggaacacggcc

SEQ ID NO: 3447648 - DNA, 13 bp, Homo sapiens
gcgccagtcctgc

SEQ ID NO: 3447649 - DNA, 17 bp, Homo sapiens
gcgcccagtccttccac

SEQ ID NO: 3447650 - DNA, 22 bp, Homo sapiens
gcgcccagtccttccacctcga

SEQ ID NO: 3447651 - DNA, 12 bp, Homo sapiens
gcgccccccttt

SEQ ID NO: 3447652 - DNA, 12 bp, Homo sapiens
gcgcccctagcc

SEQ ID NO: 3447653 - DNA, 14 bp, Homo sapiens
gcgcctttcccaac

SEQ ID NO: 3447654 - DNA, 22 bp, Homo sapiens
gcgcgcatgtaatcccagctac

SEQ ID NO: 3447655 - DNA, 15 bp, Homo sapiens
gcgcgcccctagccg

SEQ ID NO: 3447656 - DNA, 20 bp, Homo sapiens
gcgctattgcactccagtct

SEQ ID NO: 3447657 - DNA, 18 bp, Homo sapiens
gcgctgtttttgttgtgt

SEQ ID NO: 3447658 - DNA, 14 bp, Homo sapiens
gcgcttcccagcac

SEQ ID NO: 3447659 - DNA, 19 bp, Homo sapiens
gcggaatgaaccacatctt

SEQ ID NO: 3447660 - DNA, 11 bp, Homo sapiens
gcggacagcca

SEQ ID NO: 3447661 - DNA, 13 bp, Homo sapiens
gcggacagccacg

SEQ ID NO: 3447662 - DNA, 16 bp, Homo sapiens
gcggacagccacggcc

SEQ ID NO: 3447663 - DNA, 16 bp, Homo sapiens
gcggacatcagctggt

SEQ ID NO: 3447664 - DNA, 19 bp, Homo sapiens
gcggagacggagtcccacc

SEQ ID NO: 3447665 - DNA, 22 bp, Homo sapiens
gcggagagaggccttgtcccag

SEQ ID NO: 3447666 - DNA, 21 bp, Homo sapiens
gcggatggatggaaggttgga

SEQ ID NO: 3447667 - DNA, 13 bp, Homo sapiens
gcggatggccgga

SEQ ID NO: 3447668 - DNA, 15 bp, Homo sapiens
gcggcaggggcctgg

SEQ ID NO: 3447669 - DNA, 19 bp, Homo sapiens
gcggcaggggcctggagat

SEQ ID NO: 3447670 - DNA, 13 bp, Homo sapiens
gcggccaccaccc

SEQ ID NO: 3447671 - DNA, 12 bp, Homo sapiens
gcggccagagcc

SEQ ID NO: 3447672 - DNA, 13 bp, Homo sapiens
gcggccggccagc

SEQ ID NO: 3447673 - DNA, 16 bp, Homo sapiens
gcggcctttggcttca

SEQ ID NO: 3447674 - DNA, 16 bp, Homo sapiens
gcggcggagctggccc

SEQ ID NO: 3447675 - DNA, 18 bp, Homo sapiens
gcggcggagctggccccg

SEQ ID NO: 3447676 - DNA, 20 bp, Homo sapiens
gcggcggagctggccccgcc

SEQ ID NO: 3447677 - DNA, 17 bp, Homo sapiens
gcggcgtacaggctggc

SEQ ID NO: 3447678 - DNA, 16 bp, Homo sapiens
gcgggacagtgctgca

SEQ ID NO: 3447679 - DNA, 20 bp, Homo sapiens
gcgggaggatgttctgggac

SEQ ID NO: 3447680 - DNA, 22 bp, Homo sapiens
gcgggaggatgttctgggacac

SEQ ID NO: 3447681 - DNA, 14 bp, Homo sapiens
gcgggcccagcact

SEQ ID NO: 3447682 - DNA, 16 bp, Homo sapiens
gcgggccgggcggggg

SEQ ID NO: 3447683 - DNA, 21 bp, Homo sapiens
gcgggccgggcgggggatcgg

SEQ ID NO: 3447684 - DNA, 23 bp, Homo sapiens
gcggggacagctccttctgtcct

SEQ ID NO: 3447685 - DNA, 16 bp, Homo sapiens
gcgtacacagagaagg

SEQ ID NO: 3447686 - DNA, 16 bp, Homo sapiens
gcgtcgccctcccagg

SEQ ID NO: 3447687 - DNA, 21 bp, Homo sapiens
gcgtctggaagtccaatgtgg

SEQ ID NO: 3447688 - DNA, 16 bp, Homo sapiens
gcgtctgttccccctt

SEQ ID NO: 3447689 - DNA, 13 bp, Homo sapiens
gcgtgaaggccga

SEQ ID NO: 3447690 - DNA, 20 bp, Homo sapiens
gcgtgcacacaccagagccc

SEQ ID NO: 3447691 - DNA, 16 bp, Homo sapiens
gcgtgcccctgctgct

SEQ ID NO: 3447692 - DNA, 12 bp, Homo sapiens
gcgtggagctgc

SEQ ID NO: 3447693 - DNA, 17 bp, Homo sapiens
gcgtgtcacctgtgctt

SEQ ID NO: 3447694 - DNA, 15 bp, Homo sapiens
gcgttggtctctgca

SEQ ID NO: 3447695 - DNA, 17 bp, Homo sapiens
gctaaactccttcctgg

SEQ ID NO: 3447696 - DNA, 19 bp, Homo sapiens
gctaaagcaatatgcattt

SEQ ID NO: 3447697 - DNA, 18 bp, Homo sapiens
gctaaataatcttactct

SEQ ID NO: 3447698 - DNA, 13 bp, Homo sapiens
gctaaattttctg

SEQ ID NO: 3447699 - DNA, 20 bp, Homo sapiens
gctaacacacagctcccata

SEQ ID NO: 3447700 - DNA, 17 bp, Homo sapiens
gctaagaacctggaact

SEQ ID NO: 3447701 - DNA, 11 bp, Homo sapiens
gctaaggaaag

SEQ ID NO: 3447702 - DNA, 16 bp, Homo sapiens
gctaaggcgtggagct

SEQ ID NO: 3447703 - DNA, 17 bp, Homo sapiens
gctaaggcgtggagctg

SEQ ID NO: 3447704 - DNA, 18 bp, Homo sapiens
gctaagtgatcctcccac

SEQ ID NO: 3447705 - DNA, 22 bp, Homo sapiens
gctaatgaccaacctgtttcta

SEQ ID NO: 3447706 - DNA, 13 bp, Homo sapiens
gctaatgggacac

SEQ ID NO: 3447707 - DNA, 16 bp, Homo sapiens
gctaatttttgtaatt

SEQ ID NO: 3447708 - DNA, 14 bp, Homo sapiens
gctaccgttgactt

SEQ ID NO: 3447709 - DNA, 22 bp, Homo sapiens
gctacgaaaggatgagcagagc

SEQ ID NO: 3447710 - DNA, 15 bp, Homo sapiens
gctacgcctcttctg

SEQ ID NO: 3447711 - DNA, 16 bp, Homo sapiens
gctactataaagagaa

SEQ ID NO: 3447712 - DNA, 20 bp, Homo sapiens
gctactcataagttggacca

SEQ ID NO: 3447713 - DNA, 23 bp, Homo sapiens
gctactctccccacgagggctgg

SEQ ID NO: 3447714 - DNA, 18 bp, Homo sapiens
gctactctgttccttcac

SEQ ID NO: 3447715 - DNA, 18 bp, Homo sapiens
gctactgtaattttatat

SEQ ID NO: 3447716 - DNA, 19 bp, Homo sapiens
gctactgtgtgtgtgaatg

SEQ ID NO: 3447717 - DNA, 13 bp, Homo sapiens
gctacttgggagg

SEQ ID NO: 3447718 - DNA, 20 bp, Homo sapiens
gctagaggaaccaaccccca

SEQ ID NO: 3447719 - DNA, 12 bp, Homo sapiens
gctagccagagg

SEQ ID NO: 3447720 - DNA, 13 bp, Homo sapiens
gctagccagagga

SEQ ID NO: 3447721 - DNA, 20 bp, Homo sapiens
gctaggaagagcaggactcc

SEQ ID NO: 3447722 - DNA, 16 bp, Homo sapiens
gctaggagaagggctg

SEQ ID NO: 3447723 - DNA, 15 bp, Homo sapiens
gctaggcctggccag

SEQ ID NO: 3447724 - DNA, 23 bp, Homo sapiens
gctaggcctggccagatgcacca

SEQ ID NO: 3447725 - DNA, 17 bp, Homo sapiens
gctagtgtacctcctct

SEQ ID NO: 3447726 - DNA, 16 bp, Homo sapiens
gctagttgggcttcct

SEQ ID NO: 3447727 - DNA, 20 bp, Homo sapiens
gctagttggttgaatttttt

SEQ ID NO: 3447728 - DNA, 18 bp, Homo sapiens
gctataaattcctctttg

SEQ ID NO: 3447729 - DNA, 16 bp, Homo sapiens
gctatacctgtgcctc

SEQ ID NO: 3447730 - DNA, 17 bp, Homo sapiens
gctatacctgtgcctcg

SEQ ID NO: 3447731 - DNA, 19 bp, Homo sapiens
gctatagacccgaggaaac

SEQ ID NO: 3447732 - DNA, 23 bp, Homo sapiens
gctatagacccgaggaaactcag

SEQ ID NO: 3447733 - DNA, 16 bp, Homo sapiens
gctatagtatttgatt

SEQ ID NO: 3447734 - DNA, 20 bp, Homo sapiens
gctatagtatttgattcaaa

SEQ ID NO: 3447735 - DNA, 20 bp, Homo sapiens
gctatcctgccaaaatcatt

SEQ ID NO: 3447736 - DNA, 17 bp, Homo sapiens
gctatctgcctgacagg

SEQ ID NO: 3447737 - DNA, 18 bp, Homo sapiens
gctatctgcctgacaggc

SEQ ID NO: 3447738 - DNA, 23 bp, Homo sapiens
gctatgtaaacaaaccacagcag

SEQ ID NO: 3447739 - DNA, 12 bp, Homo sapiens
gctcaaaatctt

SEQ ID NO: 3447740 - DNA, 15 bp, Homo sapiens
gctcaaaatctttcc

SEQ ID NO: 3447741 - DNA, 16 bp, Homo sapiens
gctcaaaggcacagtg

SEQ ID NO: 3447742 - DNA, 14 bp, Homo sapiens
gctcaagatgacag

SEQ ID NO: 3447743 - DNA, 18 bp, Homo sapiens
gctcaagatgacagctct

SEQ ID NO: 3447744 - DNA, 19 bp, Homo sapiens
gctcaagatgacagctctt

SEQ ID NO: 3447745 - DNA, 18 bp, Homo sapiens
gctcaagcgattctcctg

SEQ ID NO: 3447746 - DNA, 17 bp, Homo sapiens
gctcaaggaaaggcctg

SEQ ID NO: 3447747 - DNA, 19 bp, Homo sapiens
gctcaagtcctcttttctg

SEQ ID NO: 3447748 - DNA, 14 bp, Homo sapiens
gctcacacctgtaa

SEQ ID NO: 3447749 - DNA, 13 bp, Homo sapiens
gctcacactgaga

SEQ ID NO: 3447750 - DNA, 16 bp, Homo sapiens
gctcacatatctgtca

SEQ ID NO: 3447751 - DNA, 14 bp, Homo sapiens
gctcaccagcccca

SEQ ID NO: 3447752 - DNA, 20 bp, Homo sapiens
gctcaccagccccagtgccc

SEQ ID NO: 3447753 - DNA, 20 bp, Homo sapiens
gctcacccccttctccatcc

SEQ ID NO: 3447754 - DNA, 22 bp, Homo sapiens
gctcacccccttctccatccac

SEQ ID NO: 3447755 - DNA, 22 bp, Homo sapiens
gctcacctggggtgtgggaggc

SEQ ID NO: 3447756 - DNA, 23 bp, Homo sapiens
gctcacgcctgtaatcccagcac

SEQ ID NO: 3447757 - DNA, 15 bp, Homo sapiens
gctcactgcagcctc

SEQ ID NO: 3447758 - DNA, 21 bp, Homo sapiens
gctcagacatgttttccgtga

SEQ ID NO: 3447759 - DNA, 12 bp, Homo sapiens
gctcagacattt

SEQ ID NO: 3447760 - DNA, 13 bp, Homo sapiens
gctcagagagggc

SEQ ID NO: 3447761 - DNA, 18 bp, Homo sapiens
gctcagaggcgcactgtg

SEQ ID NO: 3447762 - DNA, 22 bp, Homo sapiens
gctcagcaaaagatgcttctca

SEQ ID NO: 3447763 - DNA, 23 bp, Homo sapiens
gctcagcaaaagatgcttctcac

SEQ ID NO: 3447764 - DNA, 15 bp, Homo sapiens
gctcagccagcactt

SEQ ID NO: 3447765 - DNA, 17 bp, Homo sapiens
gctcagcggggacagct

SEQ ID NO: 3447766 - DNA, 17 bp, Homo sapiens
gctcagctctgggccat

SEQ ID NO: 3447767 - DNA, 14 bp, Homo sapiens
gctcagctctggtc

SEQ ID NO: 3447768 - DNA, 12 bp, Homo sapiens
gctcagcttctc

SEQ ID NO: 3447769 - DNA, 20 bp, Homo sapiens
gctcaggacagatgccacac

SEQ ID NO: 3447770 - DNA, 14 bp, Homo sapiens
gctcaggaccaggc

SEQ ID NO: 3447771 - DNA, 15 bp, Homo sapiens
gctcaggaccaggca

SEQ ID NO: 3447772 - DNA, 18 bp, Homo sapiens
gctcaggactcagaagcc

SEQ ID NO: 3447773 - DNA, 18 bp, Homo sapiens
gctcaggatctcttagca

SEQ ID NO: 3447774 - DNA, 22 bp, Homo sapiens
gctcaggctactataggtccag

SEQ ID NO: 3447775 - DNA, 17 bp, Homo sapiens
gctcagggaaaagcagc

SEQ ID NO: 3447776 - DNA, 19 bp, Homo sapiens
gctcagggaaatggccttc

SEQ ID NO: 3447777 - DNA, 22 bp, Homo sapiens
gctcagggaaatggccttcccg

SEQ ID NO: 3447778 - DNA, 15 bp, Homo sapiens
gctcaggtccctggg

SEQ ID NO: 3447779 - DNA, 19 bp, Homo sapiens
gctcagtgcaacctctgct

SEQ ID NO: 3447780 - DNA, 20 bp, Homo sapiens
gctcagtgcaacctctgctt

SEQ ID NO: 3447781 - DNA, 15 bp, Homo sapiens
gctcagttctgcctt

SEQ ID NO: 3447782 - DNA, 18 bp, Homo sapiens
gctcatcattctctgtct

SEQ ID NO: 3447783 - DNA, 16 bp, Homo sapiens
gctcatctctgtccca

SEQ ID NO: 3447784 - DNA, 16 bp, Homo sapiens
gctcatctgctggtcc

SEQ ID NO: 3447785 - DNA, 22 bp, Homo sapiens
gctcatgtgtgcaacagggtat

SEQ ID NO: 3447786 - DNA, 22 bp, Homo sapiens
gctcattctgcaccttgccagg

SEQ ID NO: 3447787 - DNA, 21 bp, Homo sapiens
gctccaacctgcaaagatctg

SEQ ID NO: 3447788 - DNA, 23 bp, Homo sapiens
gctccaaggggaatcagaactca

SEQ ID NO: 3447789 - DNA, 13 bp, Homo sapiens
gctccactctgct

SEQ ID NO: 3447790 - DNA, 23 bp, Homo sapiens
gctccagacctgatcctggaggc

SEQ ID NO: 3447791 - DNA, 17 bp, Homo sapiens
gctccagatgcagggca

SEQ ID NO: 3447792 - DNA, 13 bp, Homo sapiens
gctccagccatct

SEQ ID NO: 3447793 - DNA, 14 bp, Homo sapiens
gctccagccatctc

SEQ ID NO: 3447794 - DNA, 17 bp, Homo sapiens
gctccagctcaccagcc

SEQ ID NO: 3447795 - DNA, 18 bp, Homo sapiens
gctccagctcaccagccc

SEQ ID NO: 3447796 - DNA, 12 bp, Homo sapiens
gctccaggctcc

SEQ ID NO: 3447797 - DNA, 13 bp, Homo sapiens
gctccaggctcct

SEQ ID NO: 3447798 - DNA, 16 bp, Homo sapiens
gctccaggctccttta

SEQ ID NO: 3447799 - DNA, 23 bp, Homo sapiens
gctccaggctcctttagcgccca

SEQ ID NO: 3447800 - DNA, 19 bp, Homo sapiens
gctccagggatgattcaag

SEQ ID NO: 3447801 - DNA, 19 bp, Homo sapiens
gctccagtttccccatggg

SEQ ID NO: 3447802 - DNA, 22 bp, Homo sapiens
gctccagtttccccatggggct

SEQ ID NO: 3447803 - DNA, 22 bp, Homo sapiens
gctccatactctgtccccccag

SEQ ID NO: 3447804 - DNA, 12 bp, Homo sapiens
gctcccaaggga

SEQ ID NO: 3447805 - DNA, 23 bp, Homo sapiens
gctcccaagggatggtgccctgt

SEQ ID NO: 3447806 - DNA, 15 bp, Homo sapiens
gctcccagcctcagc

SEQ ID NO: 3447807 - DNA, 12 bp, Homo sapiens
gctcccagggca

SEQ ID NO: 3447808 - DNA, 19 bp, Homo sapiens
gctcccaggtgcagccaga

SEQ ID NO: 3447809 - DNA, 14 bp, Homo sapiens
gctccccaggactc

SEQ ID NO: 3447810 - DNA, 13 bp, Homo sapiens
gctcccccaggcc

SEQ ID NO: 3447811 - DNA, 19 bp, Homo sapiens
gctcccccaggcctgagct

SEQ ID NO: 3447812 - DNA, 16 bp, Homo sapiens
gctcccccgccctgcc

SEQ ID NO: 3447813 - DNA, 20 bp, Homo sapiens
gctcccctctgcacggacca

SEQ ID NO: 3447814 - DNA, 16 bp, Homo sapiens
gctccctaccacctcc

SEQ ID NO: 3447815 - DNA, 19 bp, Homo sapiens
gctccctcccaggactctg

SEQ ID NO: 3447816 - DNA, 13 bp, Homo sapiens
gctccgcaggact

SEQ ID NO: 3447817 - DNA, 17 bp, Homo sapiens
gctccgcaggacttccc

SEQ ID NO: 3447818 - DNA, 16 bp, Homo sapiens
gctcctagagggaggg

SEQ ID NO: 3447819 - DNA, 18 bp, Homo sapiens
gctcctagagggaggggc

SEQ ID NO: 3447820 - DNA, 21 bp, Homo sapiens
gctcctcatccagggctctga

SEQ ID NO: 3447821 - DNA, 16 bp, Homo sapiens
gctcctcctccctgca

SEQ ID NO: 3447822 - DNA, 18 bp, Homo sapiens
gctcctcctccctgcatc

SEQ ID NO: 3447823 - DNA, 12 bp, Homo sapiens
gctcctctcagt

SEQ ID NO: 3447824 - DNA, 19 bp, Homo sapiens
gctcctgagggagctccaa

SEQ ID NO: 3447825 - DNA, 12 bp, Homo sapiens
gctcctgcccac

SEQ ID NO: 3447826 - DNA, 15 bp, Homo sapiens
gctcctgccgcagag

SEQ ID NO: 3447827 - DNA, 18 bp, Homo sapiens
gctcctgccgcagagctg

SEQ ID NO: 3447828 - DNA, 19 bp, Homo sapiens
gctcctgccgcagagctgg

SEQ ID NO: 3447829 - DNA, 17 bp, Homo sapiens
gctcctgggcagcttga

SEQ ID NO: 3447830 - DNA, 21 bp, Homo sapiens
gctcctgtggccccaccctgg

SEQ ID NO: 3447831 - DNA, 13 bp, Homo sapiens
gctcctgtgtctt

SEQ ID NO: 3447832 - DNA, 17 bp, Homo sapiens
gctcctttagcgcccag

SEQ ID NO: 3447833 - DNA, 13 bp, Homo sapiens
gctcctttcccct

SEQ ID NO: 3447834 - DNA, 15 bp, Homo sapiens
gctcgaatctctgtg

SEQ ID NO: 3447835 - DNA, 19 bp, Homo sapiens
gctcgaatctctgtgcctt

SEQ ID NO: 3447836 - DNA, 15 bp, Homo sapiens
gctcgccaaggccta

SEQ ID NO: 3447837 - DNA, 21 bp, Homo sapiens
gctcgctgttgctgaataggc

SEQ ID NO: 3447838 - DNA, 12 bp, Homo sapiens
gctctaatacat

SEQ ID NO: 3447839 - DNA, 20 bp, Homo sapiens
gctctaccctgtgctaagca

SEQ ID NO: 3447840 - DNA, 22 bp, Homo sapiens
gctctaccctgtgctaagcacg

SEQ ID NO: 3447841 - DNA, 17 bp, Homo sapiens
gctctagatgagctggg

SEQ ID NO: 3447842 - DNA, 18 bp, Homo sapiens
gctctagatgagctgggc

SEQ ID NO: 3447843 - DNA, 13 bp, Homo sapiens
gctctagttcaaa

SEQ ID NO: 3447844 - DNA, 19 bp, Homo sapiens
gctctatcgcccaggctgg

SEQ ID NO: 3447845 - DNA, 17 bp, Homo sapiens
gctctatgctttccaaa

SEQ ID NO: 3447846 - DNA, 15 bp, Homo sapiens
gctctatgtttacaa

SEQ ID NO: 3447847 - DNA, 16 bp, Homo sapiens
gctctcaaatccctct

SEQ ID NO: 3447848 - DNA, 13 bp, Homo sapiens
gctctcagcctcc

SEQ ID NO: 3447849 - DNA, 14 bp, Homo sapiens
gctctcagcctccc

SEQ ID NO: 3447850 - DNA, 23 bp, Homo sapiens
gctctcagcctcccaaccccagg

SEQ ID NO: 3447851 - DNA, 17 bp, Homo sapiens
gctctccgaccagacac

SEQ ID NO: 3447852 - DNA, 16 bp, Homo sapiens
gctctcctgactttta

SEQ ID NO: 3447853 - DNA, 19 bp, Homo sapiens
gctctcggaactgcatgct

SEQ ID NO: 3447854 - DNA, 21 bp, Homo sapiens
gctctctcttcttattaccca

SEQ ID NO: 3447855 - DNA, 21 bp, Homo sapiens
gctctctgagtcctggcccaa

SEQ ID NO: 3447856 - DNA, 12 bp, Homo sapiens
gctctctgccct

SEQ ID NO: 3447857 - DNA, 23 bp, Homo sapiens
gctctctttttctccagggtcag

SEQ ID NO: 3447858 - DNA, 18 bp, Homo sapiens
gctctgagcgcctccatc

SEQ ID NO: 3447859 - DNA, 22 bp, Homo sapiens
gctctgatccctctacagagct

SEQ ID NO: 3447860 - DNA, 23 bp, Homo sapiens
gctctgcaagaattgaagcagga

SEQ ID NO: 3447861 - DNA, 14 bp, Homo sapiens
gctctgctcctctc

SEQ ID NO: 3447862 - DNA, 13 bp, Homo sapiens
gctctgctgacag

SEQ ID NO: 3447863 - DNA, 19 bp, Homo sapiens
gctctgctgacagacacag

SEQ ID NO: 3447864 - DNA, 16 bp, Homo sapiens
gctctggacagcccca

SEQ ID NO: 3447865 - DNA, 14 bp, Homo sapiens
gctctggacaggca

SEQ ID NO: 3447866 - DNA, 15 bp, Homo sapiens
gctctggaggggagg

SEQ ID NO: 3447867 - DNA, 14 bp, Homo sapiens
gctctggccaaggg

SEQ ID NO: 3447868 - DNA, 18 bp, Homo sapiens
gctctggccccaggcttg

SEQ ID NO: 3447869 - DNA, 21 bp, Homo sapiens
gctctgggccgggcctggggc

SEQ ID NO: 3447870 - DNA, 19 bp, Homo sapiens
gctctgtatcaggacccag

SEQ ID NO: 3447871 - DNA, 22 bp, Homo sapiens
gctctgtatcaggacccagagg

SEQ ID NO: 3447872 - DNA, 14 bp, Homo sapiens
gctctgtcctggga

SEQ ID NO: 3447873 - DNA, 19 bp, Homo sapiens
gctctgtctacttgctcag

SEQ ID NO: 3447874 - DNA, 23 bp, Homo sapiens
gctctgtgggtgatggggagggg

SEQ ID NO: 3447875 - DNA, 17 bp, Homo sapiens
gctctgttacccagggt

SEQ ID NO: 3447876 - DNA, 23 bp, Homo sapiens
gctctgttacccagggtggagtg

SEQ ID NO: 3447877 - DNA, 20 bp, Homo sapiens
gctcttctcatttcacccct

SEQ ID NO: 3447878 - DNA, 12 bp, Homo sapiens
gctcttctccag

SEQ ID NO: 3447879 - DNA, 19 bp, Homo sapiens
gctcttctccttggaggac

SEQ ID NO: 3447880 - DNA, 22 bp, Homo sapiens
gctcttctccttggaggacagt

SEQ ID NO: 3447881 - DNA, 12 bp, Homo sapiens
gctcttgacaga

SEQ ID NO: 3447882 - DNA, 18 bp, Homo sapiens
gctcttgaccttgtagag

SEQ ID NO: 3447883 - DNA, 16 bp, Homo sapiens
gctcttgtgaggaaag

SEQ ID NO: 3447884 - DNA, 14 bp, Homo sapiens
gctctttcctcctt

SEQ ID NO: 3447885 - DNA, 16 bp, Homo sapiens
gctgaaacagaatact

SEQ ID NO: 3447886 - DNA, 17 bp, Homo sapiens
gctgaaattctcctgga

SEQ ID NO: 3447887 - DNA, 18 bp, Homo sapiens
gctgacacaaacctgcct

SEQ ID NO: 3447888 - DNA, 18 bp, Homo sapiens
gctgacagctgctcctag

SEQ ID NO: 3447889 - DNA, 14 bp, Homo sapiens
gctgaccacagcac

SEQ ID NO: 3447890 - DNA, 17 bp, Homo sapiens
gctgaccacagcacagc

SEQ ID NO: 3447891 - DNA, 19 bp, Homo sapiens
gctgaccacagcacagcca

SEQ ID NO: 3447892 - DNA, 22 bp, Homo sapiens
gctgaccatgctcatctgctgg

SEQ ID NO: 3447893 - DNA, 22 bp, Homo sapiens
gctgacccagccccttgagaaa

SEQ ID NO: 3447894 - DNA, 15 bp, Homo sapiens
gctgacgaacttcca

SEQ ID NO: 3447895 - DNA, 13 bp, Homo sapiens
gctgacggccagg

SEQ ID NO: 3447896 - DNA, 15 bp, Homo sapiens
gctgacggccaggga

SEQ ID NO: 3447897 - DNA, 17 bp, Homo sapiens
gctgactggatgtccag

SEQ ID NO: 3447898 - DNA, 22 bp, Homo sapiens
gctgactgttttctcttgagag

SEQ ID NO: 3447899 - DNA, 24 bp, Homo sapiens
gctgacttcatctcccacctagca

SEQ ID NO: 3447900 - DNA, 20 bp, Homo sapiens
gccctccctgttccccagag

SEQ ID NO: 3447901 - DNA, 17 bp, Homo sapiens
gccctcctaccctgcgc

SEQ ID NO: 3447902 - DNA, 18 bp, Homo sapiens
gccctcctaccctgcgcc

SEQ ID NO: 3447903 - DNA, 19 bp, Homo sapiens
gccctcctaccctgcgccc

SEQ ID NO: 3447904 - DNA, 12 bp, Homo sapiens
gccctcctctcc

SEQ ID NO: 3447905 - DNA, 13 bp, Homo sapiens
gccctccttccca

SEQ ID NO: 3447906 - DNA, 14 bp, Homo sapiens
gccctccttcccaa

SEQ ID NO: 3447907 - DNA, 24 bp, Homo sapiens
gccctctccctctaggctctgcct

SEQ ID NO: 3447908 - DNA, 11 bp, Homo sapiens
gccctctcttc

SEQ ID NO: 3447909 - DNA, 14 bp, Homo sapiens
gccctctggagtgg

SEQ ID NO: 3447910 - DNA, 14 bp, Homo sapiens
gccctgaccctgtg

SEQ ID NO: 3447911 - DNA, 14 bp, Homo sapiens
gccctgcagccagc

SEQ ID NO: 3447912 - DNA, 21 bp, Homo sapiens
gccctgccagagcagggggac

SEQ ID NO: 3447913 - DNA, 18 bp, Homo sapiens
gccctgccctgccctcac

SEQ ID NO: 3447914 - DNA, 13 bp, Homo sapiens
gccctgctgagtc

SEQ ID NO: 3447915 - DNA, 21 bp, Homo sapiens
gccctggcctcccctgccacc

SEQ ID NO: 3447916 - DNA, 18 bp, Homo sapiens
gccctggtggcagtggga

SEQ ID NO: 3447917 - DNA, 22 bp, Homo sapiens
gccctggtggcagtgggagctg

SEQ ID NO: 3447918 - DNA, 23 bp, Homo sapiens
gccctggtggcagtgggagctgc

SEQ ID NO: 3447919 - DNA, 17 bp, Homo sapiens
gccctgtagttaggcct

SEQ ID NO: 3447920 - DNA, 18 bp, Homo sapiens
gccctgtagttaggcctg

SEQ ID NO: 3447921 - DNA, 23 bp, Homo sapiens
gccctgtagttaggcctggctca

SEQ ID NO: 3447922 - DNA, 16 bp, Homo sapiens
gccctgtcgggctttg

SEQ ID NO: 3447923 - DNA, 17 bp, Homo sapiens
gccctgtcgggctttgt

SEQ ID NO: 3447924 - DNA, 20 bp, Homo sapiens
gccctgtgccccttgacaac

SEQ ID NO: 3447925 - DNA, 22 bp, Homo sapiens
gccctgtgccccttgacaactg

SEQ ID NO: 3447926 - DNA, 21 bp, Homo sapiens
gccctgtggatgagccctcag

SEQ ID NO: 3447927 - DNA, 20 bp, Homo sapiens
gccctgttgaattttgttct

SEQ ID NO: 3447928 - DNA, 21 bp, Homo sapiens
gccctgttgacacaggtcttt

SEQ ID NO: 3447929 - DNA, 22 bp, Homo sapiens
gcccttagcagggaaacagcta

SEQ ID NO: 3447930 - DNA, 19 bp, Homo sapiens
gcccttatctgtgctcagg

SEQ ID NO: 3447931 - DNA, 12 bp, Homo sapiens
gcccttgtccca

SEQ ID NO: 3447932 - DNA, 15 bp, Homo sapiens
gccctttcctcctca

SEQ ID NO: 3447933 - DNA, 13 bp, Homo sapiens
gccctttgctgtc

SEQ ID NO: 3447934 - DNA, 20 bp, Homo sapiens
gcccttttttctgcctcctt

SEQ ID NO: 3447935 - DNA, 13 bp, Homo sapiens
gccgagaagcaag

SEQ ID NO: 3447936 - DNA, 16 bp, Homo sapiens
gccgagatcacgccac

SEQ ID NO: 3447937 - DNA, 21 bp, Homo sapiens
gccgagatcacgccactgcac

SEQ ID NO: 3447938 - DNA, 22 bp, Homo sapiens
gccgagatcacgccactgcact

SEQ ID NO: 3447939 - DNA, 17 bp, Homo sapiens
gccgatatactctagat

SEQ ID NO: 3447940 - DNA, 22 bp, Homo sapiens
gccgatatactctagatgaagt

SEQ ID NO: 3447941 - DNA, 19 bp, Homo sapiens
gccgcaaaccacactggac

SEQ ID NO: 3447942 - DNA, 14 bp, Homo sapiens
gccgccccacccag

SEQ ID NO: 3447943 - DNA, 15 bp, Homo sapiens
gccgccccacccaga

SEQ ID NO: 3447944 - DNA, 22 bp, Homo sapiens
gccgcctccaggagcctacccc

SEQ ID NO: 3447945 - DNA, 15 bp, Homo sapiens
gccgcctggtactca

SEQ ID NO: 3447946 - DNA, 17 bp, Homo sapiens
gccgcgtcgccctccca

SEQ ID NO: 3447947 - DNA, 17 bp, Homo sapiens
gccgctgagcgaggaga

SEQ ID NO: 3447948 - DNA, 17 bp, Homo sapiens
gccgctgccacccacct

SEQ ID NO: 3447949 - DNA, 18 bp, Homo sapiens
gccggagaggaagagaca

SEQ ID NO: 3447950 - DNA, 17 bp, Homo sapiens
gccggaggccagctatc

SEQ ID NO: 3447951 - DNA, 23 bp, Homo sapiens
gccggaggccagctatctgcctg

SEQ ID NO: 3447952 - DNA, 15 bp, Homo sapiens
gccggcacagctggg

SEQ ID NO: 3447953 - DNA, 15 bp, Homo sapiens
gccggcagccccagc

SEQ ID NO: 3447954 - DNA, 17 bp, Homo sapiens
gccggcagccccagcct

SEQ ID NO: 3447955 - DNA, 15 bp, Homo sapiens
gccggcgagccctgt

SEQ ID NO: 3447956 - DNA, 16 bp, Homo sapiens
gccgggctagagcctt

SEQ ID NO: 3447957 - DNA, 13 bp, Homo sapiens
gccgggctgaggg

SEQ ID NO: 3447958 - DNA, 23 bp, Homo sapiens
gccggggccttatcgggctccag

SEQ ID NO: 3447959 - DNA, 21 bp, Homo sapiens
gccgggtctgcctcttctggg

SEQ ID NO: 3447960 - DNA, 23 bp, Homo sapiens
gccgtctccaggggctgcttcct

SEQ ID NO: 3447961 - DNA, 20 bp, Homo sapiens
gccgtgctcgccccagcagg

SEQ ID NO: 3447962 - DNA, 18 bp, Homo sapiens
gccgtggatggccgtgga

SEQ ID NO: 3447963 - DNA, 23 bp, Homo sapiens
gccgtggggccgccgcctctttc

SEQ ID NO: 3447964 - DNA, 15 bp, Homo sapiens
gccgtggtccctgag

SEQ ID NO: 3447965 - DNA, 20 bp, Homo sapiens
gccgttgatgttggctggga

SEQ ID NO: 3447966 - DNA, 17 bp, Homo sapiens
gcctaaatttattaaat

SEQ ID NO: 3447967 - DNA, 18 bp, Homo sapiens
gcctaaatttattaaata

SEQ ID NO: 3447968 - DNA, 22 bp, Homo sapiens
gcctacagctttgatccctgac

SEQ ID NO: 3447969 - DNA, 23 bp, Homo sapiens
gcctacagctttgatccctgaca

SEQ ID NO: 3447970 - DNA, 19 bp, Homo sapiens
gcctacatcccgggcctca

SEQ ID NO: 3447971 - DNA, 14 bp, Homo sapiens
gcctaccccctgaa

SEQ ID NO: 3447972 - DNA, 17 bp, Homo sapiens
gcctaccccgcagacac

SEQ ID NO: 3447973 - DNA, 13 bp, Homo sapiens
gcctagcaggcac

SEQ ID NO: 3447974 - DNA, 17 bp, Homo sapiens
gcctagggcccccacag

SEQ ID NO: 3447975 - DNA, 14 bp, Homo sapiens
gcctaggtgacaga

SEQ ID NO: 3447976 - DNA, 17 bp, Homo sapiens
gcctaggtgcagctcct

SEQ ID NO: 3447977 - DNA, 19 bp, Homo sapiens
gcctagtgaaggcttctct

SEQ ID NO: 3447978 - DNA, 22 bp, Homo sapiens
gcctagtgaaggcttctctctg

SEQ ID NO: 3447979 - DNA, 20 bp, Homo sapiens
gcctatcaacctaagcaaca

SEQ ID NO: 3447980 - DNA, 18 bp, Homo sapiens
gcctcaaaaacgccctca

SEQ ID NO: 3447981 - DNA, 17 bp, Homo sapiens
gcctcaactcctcccat

SEQ ID NO: 3447982 - DNA, 24 bp, Homo sapiens
gcctcaagtgattctcctgcctca

SEQ ID NO: 3447983 - DNA, 23 bp, Homo sapiens
gcctcacacggtttgaagcctgg

SEQ ID NO: 3447984 - DNA, 15 bp, Homo sapiens
gcctcacccacccct

SEQ ID NO: 3447985 - DNA, 17 bp, Homo sapiens
gcctcacccacccctgc

SEQ ID NO: 3447986 - DNA, 19 bp, Homo sapiens
gcctcacccacccctgcac

SEQ ID NO: 3447987 - DNA, 15 bp, Homo sapiens
gcctcagcctcccga

SEQ ID NO: 3447988 - DNA, 16 bp, Homo sapiens
gcctcagcctcccgag

SEQ ID NO: 3447989 - DNA, 12 bp, Homo sapiens
gcctcaggtgct

SEQ ID NO: 3447990 - DNA, 17 bp, Homo sapiens
gcctcaggtgctgtcca

SEQ ID NO: 3447991 - DNA, 20 bp, Homo sapiens
gcctcaggtgctgtccatgg

SEQ ID NO: 3447992 - DNA, 20 bp, Homo sapiens
gcctcagtaagacgacaagg

SEQ ID NO: 3447993 - DNA, 12 bp, Homo sapiens
gcctcagtgcca

SEQ ID NO: 3447994 - DNA, 21 bp, Homo sapiens
gcctcatcatcagagcctttc

SEQ ID NO: 3447995 - DNA, 14 bp, Homo sapiens
gcctcatgtggctg

SEQ ID NO: 3447996 - DNA, 20 bp, Homo sapiens
gcctccagccaaacgggagc

SEQ ID NO: 3447997 - DNA, 19 bp, Homo sapiens
gcctccaggaaccacacca

SEQ ID NO: 3447998 - DNA, 19 bp, Homo sapiens
gcctccagggctggactga

SEQ ID NO: 3447999 - DNA, 20 bp, Homo sapiens
gcctccagggctggactgag

SEQ ID NO: 3448000 - DNA, 24 bp, Homo sapiens
gcctccagggctggactgaggcct

SEQ ID NO: 3448001 - DNA, 15 bp, Homo sapiens
gcctccatcagctaa

SEQ ID NO: 3448002 - DNA, 15 bp, Homo sapiens
gcctccatccaaggc

SEQ ID NO: 3448003 - DNA, 18 bp, Homo sapiens
gcctccatcctcatctct

SEQ ID NO: 3448004 - DNA, 20 bp, Homo sapiens
gcctccatcctcatctctct

SEQ ID NO: 3448005 - DNA, 20 bp, Homo sapiens
gcctccattatccattccca

SEQ ID NO: 3448006 - DNA, 18 bp, Homo sapiens
gcctcccaaagtgctggg

SEQ ID NO: 3448007 - DNA, 18 bp, Homo sapiens
gcctcccaaccccagggc

SEQ ID NO: 3448008 - DNA, 14 bp, Homo sapiens
gcctcccacgactg

SEQ ID NO: 3448009 - DNA, 13 bp, Homo sapiens
gcctcccactggg

SEQ ID NO: 3448010 - DNA, 19 bp, Homo sapiens
gcctcccctctccttcctg

SEQ ID NO: 3448011 - DNA, 17 bp, Homo sapiens
gcctcccctgccagggc

SEQ ID NO: 3448012 - DNA, 18 bp, Homo sapiens
gcctcccctgccagggca

SEQ ID NO: 3448013 - DNA, 23 bp, Homo sapiens
gcctcccgaatagctgggactac

SEQ ID NO: 3448014 - DNA, 13 bp, Homo sapiens
gcctccctgaagc

SEQ ID NO: 3448015 - DNA, 14 bp, Homo sapiens
gcctcctactccag

SEQ ID NO: 3448016 - DNA, 20 bp, Homo sapiens
gcctcgaactggctgcaaag

SEQ ID NO: 3448017 - DNA, 22 bp, Homo sapiens
gcctcgaactggctgcaaaggg

SEQ ID NO: 3448018 - DNA, 20 bp, Homo sapiens
gcctcgctctgttacccagg

SEQ ID NO: 3448019 - DNA, 23 bp, Homo sapiens
gcctcgctctgttacccagggtg

SEQ ID NO: 3448020 - DNA, 17 bp, Homo sapiens
gcctctgacacacagct

SEQ ID NO: 3448021 - DNA, 18 bp, Homo sapiens
gcctctgacacacagctc

SEQ ID NO: 3448022 - DNA, 13 bp, Homo sapiens
gcctctgcctccc

SEQ ID NO: 3448023 - DNA, 18 bp, Homo sapiens
gcctctgcctctgacaca

SEQ ID NO: 3448024 - DNA, 18 bp, Homo sapiens
gcctctgtccccttctct

SEQ ID NO: 3448025 - DNA, 19 bp, Homo sapiens
gcctctgtccccttctctc

SEQ ID NO: 3448026 - DNA, 20 bp, Homo sapiens
gcctctgtccccttctctca

SEQ ID NO: 3448027 - DNA, 11 bp, Homo sapiens
gcctctgtgct

SEQ ID NO: 3448028 - DNA, 12 bp, Homo sapiens
gcctctgtgctg

SEQ ID NO: 3448029 - DNA, 18 bp, Homo sapiens
gcctctgtgctgtgtgtg

SEQ ID NO: 3448030 - DNA, 18 bp, Homo sapiens
gcctcttctgggagggca

SEQ ID NO: 3448031 - DNA, 19 bp, Homo sapiens
gcctctttgtctaaaacaa

SEQ ID NO: 3448032 - DNA, 17 bp, Homo sapiens
gcctcttttacctgctg

SEQ ID NO: 3448033 - DNA, 19 bp, Homo sapiens
gcctcttttacctgctgct

SEQ ID NO: 3448034 - DNA, 22 bp, Homo sapiens
gcctcttttacctgctgcttct

SEQ ID NO: 3448035 - DNA, 14 bp, Homo sapiens
gcccacttctgcca

SEQ ID NO: 3448036 - DNA, 16 bp, Homo sapiens
gcccagaccggcttct

SEQ ID NO: 3448037 - DNA, 20 bp, Homo sapiens
gcccagaccggcttctcggc

SEQ ID NO: 3448038 - DNA, 10 bp, Homo sapiens
gcccagagac

SEQ ID NO: 3448039 - DNA, 23 bp, Homo sapiens
gcccagagacatacttgaagggc

SEQ ID NO: 3448040 - DNA, 14 bp, Homo sapiens
gcccagagcccagc

SEQ ID NO: 3448041 - DNA, 16 bp, Homo sapiens
gcccagagcccagctc

SEQ ID NO: 3448042 - DNA, 21 bp, Homo sapiens
gcccagaggccaacactgtgg

SEQ ID NO: 3448043 - DNA, 23 bp, Homo sapiens
gcccagaggccaacactgtgggt

SEQ ID NO: 3448044 - DNA, 19 bp, Homo sapiens
gcccagattcccctgtgtc

SEQ ID NO: 3448045 - DNA, 20 bp, Homo sapiens
gcccagcactgcttgaggaa

SEQ ID NO: 3448046 - DNA, 16 bp, Homo sapiens
gcccagccaggcccca

SEQ ID NO: 3448047 - DNA, 19 bp, Homo sapiens
gcccagcccctactgctgt

SEQ ID NO: 3448048 - DNA, 14 bp, Homo sapiens
gcccagctgggtca

SEQ ID NO: 3448049 - DNA, 15 bp, Homo sapiens
gcccagctgggtcag

SEQ ID NO: 3448050 - DNA, 19 bp, Homo sapiens
gcccagctgggtcaggcag

SEQ ID NO: 3448051 - DNA, 18 bp, Homo sapiens
gcccaggaccatcatcct

SEQ ID NO: 3448052 - DNA, 16 bp, Homo sapiens
gcccaggcactgcaaa

SEQ ID NO: 3448053 - DNA, 12 bp, Homo sapiens
gcccaggcaggt

SEQ ID NO: 3448054 - DNA, 23 bp, Homo sapiens
gcccaggcccctgccaccctggg

SEQ ID NO: 3448055 - DNA, 20 bp, Homo sapiens
gcccaggctggagtgcagtg

SEQ ID NO: 3448056 - DNA, 15 bp, Homo sapiens
gcccaggctgggaac

SEQ ID NO: 3448057 - DNA, 12 bp, Homo sapiens
gcccaggctggt

SEQ ID NO: 3448058 - DNA, 16 bp, Homo sapiens
gcccaggctggtttcg

SEQ ID NO: 3448059 - DNA, 16 bp, Homo sapiens
gcccagggagactccg

SEQ ID NO: 3448060 - DNA, 18 bp, Homo sapiens
gcccagggcaagctccgc

SEQ ID NO: 3448061 - DNA, 19 bp, Homo sapiens
gcccagggcaagctccgca

SEQ ID NO: 3448062 - DNA, 23 bp, Homo sapiens
gcccagggcaagctccgcaggac

SEQ ID NO: 3448063 - DNA, 20 bp, Homo sapiens
gcccagggcatcttgctggc

SEQ ID NO: 3448064 - DNA, 14 bp, Homo sapiens
gcccagggcccaga

SEQ ID NO: 3448065 - DNA, 17 bp, Homo sapiens
gcccagggcccagagcc

SEQ ID NO: 3448066 - DNA, 21 bp, Homo sapiens
gcccagggcccagagcccagc

SEQ ID NO: 3448067 - DNA, 21 bp, Homo sapiens
gcccaggtgagtcctagagct

SEQ ID NO: 3448068 - DNA, 23 bp, Homo sapiens
gcccaggtttctggtctctaggc

SEQ ID NO: 3448069 - DNA, 17 bp, Homo sapiens
gcccagtagaccttgtt

SEQ ID NO: 3448070 - DNA, 15 bp, Homo sapiens
gcccagtccttccac

SEQ ID NO: 3448071 - DNA, 14 bp, Homo sapiens
gcccagtcgacccc

SEQ ID NO: 3448072 - DNA, 15 bp, Homo sapiens
gcccagtcgacccca

SEQ ID NO: 3448073 - DNA, 19 bp, Homo sapiens
gcccagtctggaatgcagt

SEQ ID NO: 3448074 - DNA, 15 bp, Homo sapiens
gcccagtctgttgag

SEQ ID NO: 3448075 - DNA, 16 bp, Homo sapiens
gcccagtgttttcttt

SEQ ID NO: 3448076 - DNA, 21 bp, Homo sapiens
gcccagtgttttctttgagga

SEQ ID NO: 3448077 - DNA, 15 bp, Homo sapiens
gcccagttgggtgga

SEQ ID NO: 3448078 - DNA, 22 bp, Homo sapiens
gcccatctatgtcccttgctgt

SEQ ID NO: 3448079 - DNA, 19 bp, Homo sapiens
gcccatggacaggctggct

SEQ ID NO: 3448080 - DNA, 18 bp, Homo sapiens
gcccatttcatattcttt

SEQ ID NO: 3448081 - DNA, 19 bp, Homo sapiens
gccccaaacaaatatgcaa

SEQ ID NO: 3448082 - DNA, 12 bp, Homo sapiens
gccccacccaga

SEQ ID NO: 3448083 - DNA, 13 bp, Homo sapiens
gccccacccagat

SEQ ID NO: 3448084 - DNA, 15 bp, Homo sapiens
gccccaccctgggcc

SEQ ID NO: 3448085 - DNA, 19 bp, Homo sapiens
gccccaccctgggccctgg

SEQ ID NO: 3448086 - DNA, 17 bp, Homo sapiens
gccccactctgcctgcc

SEQ ID NO: 3448087 - DNA, 13 bp, Homo sapiens
gccccagcacagc

SEQ ID NO: 3448088 - DNA, 20 bp, Homo sapiens
gccccagcacagcttgacct

SEQ ID NO: 3448089 - DNA, 11 bp, Homo sapiens
gccccagccag

SEQ ID NO: 3448090 - DNA, 13 bp, Homo sapiens
gccccagcccaga

SEQ ID NO: 3448091 - DNA, 21 bp, Homo sapiens
gccccagccccgttccttccg

SEQ ID NO: 3448092 - DNA, 11 bp, Homo sapiens
gccccagcctg

SEQ ID NO: 3448093 - DNA, 22 bp, Homo sapiens
gccccagcctgctagctagctc

SEQ ID NO: 3448094 - DNA, 23 bp, Homo sapiens
gccccaggaccagctcaggacag

SEQ ID NO: 3448095 - DNA, 20 bp, Homo sapiens
gccccaggacctggctgcca

SEQ ID NO: 3448096 - DNA, 22 bp, Homo sapiens
gccccaggacctggctgccata

SEQ ID NO: 3448097 - DNA, 15 bp, Homo sapiens
gccccatcttcaccc

SEQ ID NO: 3448098 - DNA, 12 bp, Homo sapiens
gccccattcctg

SEQ ID NO: 3448099 - DNA, 15 bp, Homo sapiens
gccccattcctggga

SEQ ID NO: 3448100 - DNA, 17 bp, Homo sapiens
gccccattctgcctgcc

SEQ ID NO: 3448101 - DNA, 18 bp, Homo sapiens
gccccattctgcctgccc

SEQ ID NO: 3448102 - DNA, 20 bp, Homo sapiens
gccccattcttttgtaattt

SEQ ID NO: 3448103 - DNA, 17 bp, Homo sapiens
gcccccaccgtgggcag

SEQ ID NO: 3448104 - DNA, 17 bp, Homo sapiens
gcccccacttgcctctt

SEQ ID NO: 3448105 - DNA, 15 bp, Homo sapiens
gcccccagctaagaa

SEQ ID NO: 3448106 - DNA, 23 bp, Homo sapiens
gcccccagctaagaacctggaac

SEQ ID NO: 3448107 - DNA, 14 bp, Homo sapiens
gcccccaggactgg

SEQ ID NO: 3448108 - DNA, 18 bp, Homo sapiens
gcccccaggactgggcca

SEQ ID NO: 3448109 - DNA, 17 bp, Homo sapiens
gcccccatttcacccat

SEQ ID NO: 3448110 - DNA, 16 bp, Homo sapiens
gcccccccccacccct

SEQ ID NO: 3448111 - DNA, 13 bp, Homo sapiens
gcccccccttcca

SEQ ID NO: 3448112 - DNA, 19 bp, Homo sapiens
gccccccgcagcaccctgc

SEQ ID NO: 3448113 - DNA, 20 bp, Homo sapiens
gccccccgcagcaccctgca

SEQ ID NO: 3448114 - DNA, 15 bp, Homo sapiens
gcccccctgccctgt

SEQ ID NO: 3448115 - DNA, 19 bp, Homo sapiens
gcccccgtcacgtgcgctg

SEQ ID NO: 3448116 - DNA, 17 bp, Homo sapiens
gccccctggcctctgtg

SEQ ID NO: 3448117 - DNA, 15 bp, Homo sapiens
gccccgaggccttct

SEQ ID NO: 3448118 - DNA, 15 bp, Homo sapiens
gccccgcttccccac

SEQ ID NO: 3448119 - DNA, 17 bp, Homo sapiens
gccccgcttccccacag

SEQ ID NO: 3448120 - DNA, 21 bp, Homo sapiens
gccccgcttccccacagaact

SEQ ID NO: 3448121 - DNA, 14 bp, Homo sapiens
gccccgtctctgtt

SEQ ID NO: 3448122 - DNA, 15 bp, Homo sapiens
gcccctactgctgtg

SEQ ID NO: 3448123 - DNA, 19 bp, Homo sapiens
gcccctagccggttcctgt

SEQ ID NO: 3448124 - DNA, 14 bp, Homo sapiens
gcccctcacctact

SEQ ID NO: 3448125 - DNA, 11 bp, Homo sapiens
gcccctctcct

SEQ ID NO: 3448126 - DNA, 12 bp, Homo sapiens
gcccctctctgg

SEQ ID NO: 3448127 - DNA, 14 bp, Homo sapiens
gcccctctctgggc

SEQ ID NO: 3448128 - DNA, 13 bp, Homo sapiens
gcccctgccaccc

SEQ ID NO: 3448129 - DNA, 15 bp, Homo sapiens
gcccctgccaccctg

SEQ ID NO: 3448130 - DNA, 17 bp, Homo sapiens
gcccctgccaccctggg

SEQ ID NO: 3448131 - DNA, 13 bp, Homo sapiens
gcccctgcccggc

SEQ ID NO: 3448132 - DNA, 15 bp, Homo sapiens
gcccctgcccggctg

SEQ ID NO: 3448133 - DNA, 17 bp, Homo sapiens
gcccctgctgtctctct

SEQ ID NO: 3448134 - DNA, 19 bp, Homo sapiens
gcccctgctgtctctctgg

SEQ ID NO: 3448135 - DNA, 22 bp, Homo sapiens
gcccctggaggctgcctcccaa

SEQ ID NO: 3448136 - DNA, 22 bp, Homo sapiens
gcccctggccccgcctgcctgc

SEQ ID NO: 3448137 - DNA, 16 bp, Homo sapiens
gcccctggctgggacg

SEQ ID NO: 3448138 - DNA, 23 bp, Homo sapiens
gcccctggctgggacgtggctca

SEQ ID NO: 3448139 - DNA, 21 bp, Homo sapiens
gcccctggggtggccaccagt

SEQ ID NO: 3448140 - DNA, 18 bp, Homo sapiens
gcccctgtctagagaggg

SEQ ID NO: 3448141 - DNA, 15 bp, Homo sapiens
gcccctgtctcgggg

SEQ ID NO: 3448142 - DNA, 16 bp, Homo sapiens
gcccctgtctcggggc

SEQ ID NO: 3448143 - DNA, 21 bp, Homo sapiens
gccccttcattgatttcctgt

SEQ ID NO: 3448144 - DNA, 22 bp, Homo sapiens
gccccttcattgatttcctgtg

SEQ ID NO: 3448145 - DNA, 23 bp, Homo sapiens
gccccttctaggtggcaaggctg

SEQ ID NO: 3448146 - DNA, 18 bp, Homo sapiens
gccccttctgctcagctc

SEQ ID NO: 3448147 - DNA, 22 bp, Homo sapiens
gcccgaggaaggtgtgtggaga

SEQ ID NO: 3448148 - DNA, 22 bp, Homo sapiens
gcccgagggaggggaagcttct

SEQ ID NO: 3448149 - DNA, 23 bp, Homo sapiens
gcccgagggaggggaagcttctg

SEQ ID NO: 3448150 - DNA, 16 bp, Homo sapiens
gcccgcagacctctgg

SEQ ID NO: 3448151 - DNA, 22 bp, Homo sapiens
gcccgcagagcgcgcccctagc

SEQ ID NO: 3448152 - DNA, 17 bp, Homo sapiens
gcccgcgccacaggacc

SEQ ID NO: 3448153 - DNA, 23 bp, Homo sapiens
gcccgcgccacaggaccctcgcc

SEQ ID NO: 3448154 - DNA, 18 bp, Homo sapiens
gcccggccagccatgtct

SEQ ID NO: 3448155 - DNA, 18 bp, Homo sapiens
gcccggctaatttttgta

SEQ ID NO: 3448156 - DNA, 12 bp, Homo sapiens
gcccggctccag

SEQ ID NO: 3448157 - DNA, 13 bp, Homo sapiens
gcccggctccagg

SEQ ID NO: 3448158 - DNA, 15 bp, Homo sapiens
gcccgtcctgcctgt

SEQ ID NO: 3448159 - DNA, 17 bp, Homo sapiens
gcccgtgtacatagtgc

SEQ ID NO: 3448160 - DNA, 21 bp, Homo sapiens
gccctaacctctgagtcacca

SEQ ID NO: 3448161 - DNA, 15 bp, Homo sapiens
gccctaattcagcca

SEQ ID NO: 3448162 - DNA, 16 bp, Homo sapiens
gccctatgggcctgcc

SEQ ID NO: 3448163 - DNA, 21 bp, Homo sapiens
gccctatgggcctgccgggct

SEQ ID NO: 3448164 - DNA, 22 bp, Homo sapiens
gccctcacccctggttctcatc

SEQ ID NO: 3448165 - DNA, 18 bp, Homo sapiens
gccctcagaacccttggc

SEQ ID NO: 3448166 - DNA, 23 bp, Homo sapiens
gccctcagaacccttggcttgcc

SEQ ID NO: 3448167 - DNA, 12 bp, Homo sapiens
gccctcatcccg

SEQ ID NO: 3448168 - DNA, 19 bp, Homo sapiens
gccctccccatggagccag

SEQ ID NO: 3448169 - DNA, 18 bp, Homo sapiens
gccctcccctctctgcac

SEQ ID NO: 3448170 - DNA, 18 bp, Homo sapiens
gccctccctgttccccag

SEQ ID NO: 3448171 - DNA, 12 bp, Homo sapiens
gcatctttcata

SEQ ID NO: 3448172 - DNA, 22 bp, Homo sapiens
gcatctttcatatggtaggaac

SEQ ID NO: 3448173 - DNA, 14 bp, Homo sapiens
gcatgacaaaaatt

SEQ ID NO: 3448174 - DNA, 14 bp, Homo sapiens
gcatgacagcctgc

SEQ ID NO: 3448175 - DNA, 16 bp, Homo sapiens
gcatgacagcctgcag

SEQ ID NO: 3448176 - DNA, 14 bp, Homo sapiens
gcatgagaaataca

SEQ ID NO: 3448177 - DNA, 19 bp, Homo sapiens
gcatgatccaagcaagact

SEQ ID NO: 3448178 - DNA, 23 bp, Homo sapiens
gcatgatccaagcaagactgagg

SEQ ID NO: 3448179 - DNA, 13 bp, Homo sapiens
gcatgatgtttgc

SEQ ID NO: 3448180 - DNA, 18 bp, Homo sapiens
gcatgatgtttgcccaaa

SEQ ID NO: 3448181 - DNA, 16 bp, Homo sapiens
gcatgccctctcaggc

SEQ ID NO: 3448182 - DNA, 16 bp, Homo sapiens
gcatgctgctggacag

SEQ ID NO: 3448183 - DNA, 18 bp, Homo sapiens
gcatggaaggggcttctg

SEQ ID NO: 3448184 - DNA, 18 bp, Homo sapiens
gcatggcatcacctccac

SEQ ID NO: 3448185 - DNA, 21 bp, Homo sapiens
gcatgggggaccccttcccac

SEQ ID NO: 3448186 - DNA, 22 bp, Homo sapiens
gcatgggggaccccttcccaca

SEQ ID NO: 3448187 - DNA, 17 bp, Homo sapiens
gcatgggtcgggagagg

SEQ ID NO: 3448188 - DNA, 21 bp, Homo sapiens
gcatgggtcgggagaggggac

SEQ ID NO: 3448189 - DNA, 23 bp, Homo sapiens
gcatgggtcgggagaggggacgc

SEQ ID NO: 3448190 - DNA, 20 bp, Homo sapiens
gcatggtcacaagcacaaag

SEQ ID NO: 3448191 - DNA, 18 bp, Homo sapiens
gcatggtcacacactgat

SEQ ID NO: 3448192 - DNA, 14 bp, Homo sapiens
gcatgtcttttaaa

SEQ ID NO: 3448193 - DNA, 17 bp, Homo sapiens
gcatgtcttttaaaatg

SEQ ID NO: 3448194 - DNA, 20 bp, Homo sapiens
gcatgtgactctgaagctga

SEQ ID NO: 3448195 - DNA, 21 bp, Homo sapiens
gcatgtgactctgaagctgac

SEQ ID NO: 3448196 - DNA, 15 bp, Homo sapiens
gcatgtgggcttcaa

SEQ ID NO: 3448197 - DNA, 20 bp, Homo sapiens
gcatgttgaccatgtctatg

SEQ ID NO: 3448198 - DNA, 21 bp, Homo sapiens
gcatgttgtgatgtacacatt

SEQ ID NO: 3448199 - DNA, 23 bp, Homo sapiens
gcatgttgtgatgtacacatttt

SEQ ID NO: 3448200 - DNA, 18 bp, Homo sapiens
gcattaaattcacaaact

SEQ ID NO: 3448201 - DNA, 22 bp, Homo sapiens
gcattaaattcacaaactttta

SEQ ID NO: 3448202 - DNA, 18 bp, Homo sapiens
gcattaccgcgttgtaaa

SEQ ID NO: 3448203 - DNA, 16 bp, Homo sapiens
gcattctcctggatgc

SEQ ID NO: 3448204 - DNA, 22 bp, Homo sapiens
gcattcttaacaaactcttcag

SEQ ID NO: 3448205 - DNA, 21 bp, Homo sapiens
gcattcttggttggctggcct

SEQ ID NO: 3448206 - DNA, 12 bp, Homo sapiens
gcattgagaact

SEQ ID NO: 3448207 - DNA, 18 bp, Homo sapiens
gcattgatggggaaggag

SEQ ID NO: 3448208 - DNA, 14 bp, Homo sapiens
gcattgccaagggc

SEQ ID NO: 3448209 - DNA, 16 bp, Homo sapiens
gcattgctctggatct

SEQ ID NO: 3448210 - DNA, 15 bp, Homo sapiens
gcattgtatcgatgt

SEQ ID NO: 3448211 - DNA, 20 bp, Homo sapiens
gcatttagctgtattcatat

SEQ ID NO: 3448212 - DNA, 15 bp, Homo sapiens
gcatttatagatcat

SEQ ID NO: 3448213 - DNA, 16 bp, Homo sapiens
gcatttatagatcatt

SEQ ID NO: 3448214 - DNA, 22 bp, Homo sapiens
gcatttcacaaaacagcctttg

SEQ ID NO: 3448215 - DNA, 12 bp, Homo sapiens
gcatttcctaag

SEQ ID NO: 3448216 - DNA, 12 bp, Homo sapiens
gcatttcctgct

SEQ ID NO: 3448217 - DNA, 14 bp, Homo sapiens
gcatttcctgctga

SEQ ID NO: 3448218 - DNA, 10 bp, Homo sapiens
gcatttgaat

SEQ ID NO: 3448219 - DNA, 12 bp, Homo sapiens
gcatttgaatgc

SEQ ID NO: 3448220 - DNA, 17 bp, Homo sapiens
gcatttgtgctagaaat

SEQ ID NO: 3448221 - DNA, 21 bp, Homo sapiens
gcatttgtgctagaaattttc

SEQ ID NO: 3448222 - DNA, 18 bp, Homo sapiens
gcattttcaccccaccct

SEQ ID NO: 3448223 - DNA, 18 bp, Homo sapiens
gcattttgtttggtattg

SEQ ID NO: 3448224 - DNA, 23 bp, Homo sapiens
gccaaacaacaacaaaaacaaaa

SEQ ID NO: 3448225 - DNA, 14 bp, Homo sapiens
gccaaacctctgtt

SEQ ID NO: 3448226 - DNA, 16 bp, Homo sapiens
gccaaacctctgttca

SEQ ID NO: 3448227 - DNA, 17 bp, Homo sapiens
gccaaacctctgttcag

SEQ ID NO: 3448228 - DNA, 22 bp, Homo sapiens
gccaaacctctgttcagtgtaa

SEQ ID NO: 3448229 - DNA, 13 bp, Homo sapiens
gccaaagccaaag

SEQ ID NO: 3448230 - DNA, 16 bp, Homo sapiens
gccaaagcctcctcca

SEQ ID NO: 3448231 - DNA, 19 bp, Homo sapiens
gccaaagcctcctccagcc

SEQ ID NO: 3448232 - DNA, 16 bp, Homo sapiens
gccaaagctaggcctg

SEQ ID NO: 3448233 - DNA, 13 bp, Homo sapiens
gccaaaggctggc

SEQ ID NO: 3448234 - DNA, 18 bp, Homo sapiens
gccaaataatgtctctgt

SEQ ID NO: 3448235 - DNA, 22 bp, Homo sapiens
gccaaataatgtctctgtgaga

SEQ ID NO: 3448236 - DNA, 14 bp, Homo sapiens
gccaaatagcaaag

SEQ ID NO: 3448237 - DNA, 22 bp, Homo sapiens
gccaaatggtttaacttctgcc

SEQ ID NO: 3448238 - DNA, 17 bp, Homo sapiens
gccaacacgcacctgcc

SEQ ID NO: 3448239 - DNA, 21 bp, Homo sapiens
gccaacacgcacctgcctcag

SEQ ID NO: 3448240 - DNA, 23 bp, Homo sapiens
gccaacacgcacctgcctcagga

SEQ ID NO: 3448241 - DNA, 20 bp, Homo sapiens
gccaacactcaagaagcagg

SEQ ID NO: 3448242 - DNA, 20 bp, Homo sapiens
gccaacatggtgaaaccctg

SEQ ID NO: 3448243 - DNA, 22 bp, Homo sapiens
gccaacccttctcctcttgtaa

SEQ ID NO: 3448244 - DNA, 16 bp, Homo sapiens
gccaacctattttgaa

SEQ ID NO: 3448245 - DNA, 12 bp, Homo sapiens
gccaagcagcca

SEQ ID NO: 3448246 - DNA, 16 bp, Homo sapiens
gccaagccagctgcct

SEQ ID NO: 3448247 - DNA, 18 bp, Homo sapiens
gccaagccagctgcctag

SEQ ID NO: 3448248 - DNA, 21 bp, Homo sapiens
gccaagcttcaaccctcagcc

SEQ ID NO: 3448249 - DNA, 11 bp, Homo sapiens
gccaaggagct

SEQ ID NO: 3448250 - DNA, 15 bp, Homo sapiens
gccaaggagctgcta

SEQ ID NO: 3448251 - DNA, 12 bp, Homo sapiens
gccaaggcctag

SEQ ID NO: 3448252 - DNA, 16 bp, Homo sapiens
gccaaggcctaggacc

SEQ ID NO: 3448253 - DNA, 18 bp, Homo sapiens
gccaagggaacctgtgtc

SEQ ID NO: 3448254 - DNA, 21 bp, Homo sapiens
gccaagggatgaaagagaagg

SEQ ID NO: 3448255 - DNA, 18 bp, Homo sapiens
gccaaggggcttcaggtc

SEQ ID NO: 3448256 - DNA, 20 bp, Homo sapiens
gccaaggttttataaggctg

SEQ ID NO: 3448257 - DNA, 14 bp, Homo sapiens
gccaattatgttaa

SEQ ID NO: 3448258 - DNA, 16 bp, Homo sapiens
gccaattatgttaaac

SEQ ID NO: 3448259 - DNA, 19 bp, Homo sapiens
gccaattatgttaaactag

SEQ ID NO: 3448260 - DNA, 15 bp, Homo sapiens
gccaattcagacagg

SEQ ID NO: 3448261 - DNA, 14 bp, Homo sapiens
gccacaaggacttc

SEQ ID NO: 3448262 - DNA, 18 bp, Homo sapiens
gccacaaggacttcctgt

SEQ ID NO: 3448263 - DNA, 23 bp, Homo sapiens
gccacaaggtggtgcttctgcca

SEQ ID NO: 3448264 - DNA, 16 bp, Homo sapiens
gccacaccaggataga

SEQ ID NO: 3448265 - DNA, 22 bp, Homo sapiens
gccacactctgggctccagagt

SEQ ID NO: 3448266 - DNA, 23 bp, Homo sapiens
gccacagagaaagtacttctcca

SEQ ID NO: 3448267 - DNA, 18 bp, Homo sapiens
gccacaggacacagtcag

SEQ ID NO: 3448268 - DNA, 11 bp, Homo sapiens
gccacaggacc

SEQ ID NO: 3448269 - DNA, 15 bp, Homo sapiens
gccacaggcctgaga

SEQ ID NO: 3448270 - DNA, 17 bp, Homo sapiens
gccacagggtctgcctc

SEQ ID NO: 3448271 - DNA, 19 bp, Homo sapiens
gccacagggtctgcctcca

SEQ ID NO: 3448272 - DNA, 23 bp, Homo sapiens
gccacagggtctgcctccagcca

SEQ ID NO: 3448273 - DNA, 20 bp, Homo sapiens
gccacagtgggatgaaccag

SEQ ID NO: 3448274 - DNA, 15 bp, Homo sapiens
gccacatcaaagagg

SEQ ID NO: 3448275 - DNA, 15 bp, Homo sapiens
gccacatgggaggct

SEQ ID NO: 3448276 - DNA, 14 bp, Homo sapiens
gccaccaagaggga

SEQ ID NO: 3448277 - DNA, 17 bp, Homo sapiens
gccaccaccctgtcttc

SEQ ID NO: 3448278 - DNA, 23 bp, Homo sapiens
gccaccaccctgtcttcctctgc

SEQ ID NO: 3448279 - DNA, 12 bp, Homo sapiens
gccaccaggcca

SEQ ID NO: 3448280 - DNA, 15 bp, Homo sapiens
gccaccaggccacct

SEQ ID NO: 3448281 - DNA, 21 bp, Homo sapiens
gccaccaggtgcctttcaaat

SEQ ID NO: 3448282 - DNA, 14 bp, Homo sapiens
gccaccatggccag

SEQ ID NO: 3448283 - DNA, 16 bp, Homo sapiens
gccaccatggccagcc

SEQ ID NO: 3448284 - DNA, 17 bp, Homo sapiens
gccaccatggccagcca

SEQ ID NO: 3448285 - DNA, 21 bp, Homo sapiens
gccacccacctccctgcctcc

SEQ ID NO: 3448286 - DNA, 20 bp, Homo sapiens
gccacccccccaccccaggc

SEQ ID NO: 3448287 - DNA, 11 bp, Homo sapiens
gccacctgccc

SEQ ID NO: 3448288 - DNA, 17 bp, Homo sapiens
gccacgctccagctgcc

SEQ ID NO: 3448289 - DNA, 21 bp, Homo sapiens
gccacgtgggcaaacaggcag

SEQ ID NO: 3448290 - DNA, 15 bp, Homo sapiens
gccactaagcagagg

SEQ ID NO: 3448291 - DNA, 16 bp, Homo sapiens
gccactaagcagagga

SEQ ID NO: 3448292 - DNA, 20 bp, Homo sapiens
gccactaagcagaggagggg

SEQ ID NO: 3448293 - DNA, 19 bp, Homo sapiens
gccactcactaggccccca

SEQ ID NO: 3448294 - DNA, 23 bp, Homo sapiens
gccactcactaggcccccacttg

SEQ ID NO: 3448295 - DNA, 16 bp, Homo sapiens
gccactcccctccact

SEQ ID NO: 3448296 - DNA, 13 bp, Homo sapiens
gccactcctctga

SEQ ID NO: 3448297 - DNA, 15 bp, Homo sapiens
gccactcctctgact

SEQ ID NO: 3448298 - DNA, 23 bp, Homo sapiens
gccactcctctgactcagggctc

SEQ ID NO: 3448299 - DNA, 15 bp, Homo sapiens
gccactgaaatctgt

SEQ ID NO: 3448300 - DNA, 22 bp, Homo sapiens
gccactgcaccgggccacagag

SEQ ID NO: 3448301 - DNA, 23 bp, Homo sapiens
gccactgcaccgggccacagaga

SEQ ID NO: 3448302 - DNA, 21 bp, Homo sapiens
gccactgcactatagcctagg

SEQ ID NO: 3448303 - DNA, 19 bp, Homo sapiens
gccactgcataccaacctg

SEQ ID NO: 3448304 - DNA, 22 bp, Homo sapiens
gccactgccactccagtcctgc

SEQ ID NO: 3448305 - DNA, 18 bp, Homo sapiens
gccactgccttcgcttct

SEQ ID NO: 3448306 - DNA, 19 bp, Homo sapiens
gccactggtttctcagaat

SEQ ID NO: 3448307 - DNA, 18 bp, Homo sapiens
gccactgtgaagagaacc

SEQ ID NO: 3448308 - DNA, 18 bp, Homo sapiens
gccacttaaaatgttcac

SEQ ID NO: 3448309 - DNA, 20 bp, Homo sapiens
gccacttctgggtggggcag

SEQ ID NO: 3448310 - DNA, 13 bp, Homo sapiens
gccacttggagtg

SEQ ID NO: 3448311 - DNA, 19 bp, Homo sapiens
gccagaagcctctgcctcc

SEQ ID NO: 3448312 - DNA, 12 bp, Homo sapiens
gccagaagctga

SEQ ID NO: 3448313 - DNA, 18 bp, Homo sapiens
gccagaatctcattactg

SEQ ID NO: 3448314 - DNA, 16 bp, Homo sapiens
gccagacacaggccct

SEQ ID NO: 3448315 - DNA, 20 bp, Homo sapiens
gccagagatccaaaagaagc

SEQ ID NO: 3448316 - DNA, 21 bp, Homo sapiens
gccagagatccaaaagaagcc

SEQ ID NO: 3448317 - DNA, 12 bp, Homo sapiens
gccagagcaggg

SEQ ID NO: 3448318 - DNA, 12 bp, Homo sapiens
gccagagccaaa

SEQ ID NO: 3448319 - DNA, 12 bp, Homo sapiens
gccagagccagg

SEQ ID NO: 3448320 - DNA, 14 bp, Homo sapiens
gccagagccagggg

SEQ ID NO: 3448321 - DNA, 17 bp, Homo sapiens
gccagagctgaagagtt

SEQ ID NO: 3448322 - DNA, 14 bp, Homo sapiens
gccagaggccccca

SEQ ID NO: 3448323 - DNA, 16 bp, Homo sapiens
gccagaggcccccagc

SEQ ID NO: 3448324 - DNA, 13 bp, Homo sapiens
gccagaggctggg

SEQ ID NO: 3448325 - DNA, 19 bp, Homo sapiens
gccagagggagtgacagag

SEQ ID NO: 3448326 - DNA, 19 bp, Homo sapiens
gccagaggtgcttcaccct

SEQ ID NO: 3448327 - DNA, 14 bp, Homo sapiens
gccagatccagcct

SEQ ID NO: 3448328 - DNA, 15 bp, Homo sapiens
gccagatgcaccagc

SEQ ID NO: 3448329 - DNA, 17 bp, Homo sapiens
gccagatgcaccagccc

SEQ ID NO: 3448330 - DNA, 22 bp, Homo sapiens
gccagatggactccagcctgcc

SEQ ID NO: 3448331 - DNA, 12 bp, Homo sapiens
gccagcacacag

SEQ ID NO: 3448332 - DNA, 17 bp, Homo sapiens
gccagcacacagggcag

SEQ ID NO: 3448333 - DNA, 19 bp, Homo sapiens
gccagcacccaaagggtta

SEQ ID NO: 3448334 - DNA, 19 bp, Homo sapiens
gccagcacttgtccagctg

SEQ ID NO: 3448335 - DNA, 20 bp, Homo sapiens
gccagcacttgtccagctga

SEQ ID NO: 3448336 - DNA, 19 bp, Homo sapiens
gccagccagtgacctgagg

SEQ ID NO: 3448337 - DNA, 14 bp, Homo sapiens
gccagcccctggcc

SEQ ID NO: 3448338 - DNA, 19 bp, Homo sapiens
gccagcccctggccccagg

SEQ ID NO: 3448339 - DNA, 20 bp, Homo sapiens
gccagcccctggccccagga

SEQ ID NO: 3448340 - DNA, 22 bp, Homo sapiens
gccagcgtcctcctctgtgacc

SEQ ID NO: 3448341 - DNA, 16 bp, Homo sapiens
gccagctatctgcctg

SEQ ID NO: 3448342 - DNA, 18 bp, Homo sapiens
gccagctatctgcctgac

SEQ ID NO: 3448343 - DNA, 21 bp, Homo sapiens
gccagctatctgcctgacagg

SEQ ID NO: 3448344 - DNA, 23 bp, Homo sapiens
gccagctatctgcctgacaggct

SEQ ID NO: 3448345 - DNA, 17 bp, Homo sapiens
gccagctcacagtgctg

SEQ ID NO: 3448346 - DNA, 13 bp, Homo sapiens
gccagctccctct

SEQ ID NO: 3448347 - DNA, 17 bp, Homo sapiens
gccagctcctgggcagc

SEQ ID NO: 3448348 - DNA, 19 bp, Homo sapiens
gccagctcctgggcagctt

SEQ ID NO: 3448349 - DNA, 21 bp, Homo sapiens
gccagctcctgggcagcttga

SEQ ID NO: 3448350 - DNA, 20 bp, Homo sapiens
gccagctgccctatgggcct

SEQ ID NO: 3448351 - DNA, 21 bp, Homo sapiens
gccagctgccctatgggcctg

SEQ ID NO: 3448352 - DNA, 14 bp, Homo sapiens
gccagctgctcccc

SEQ ID NO: 3448353 - DNA, 15 bp, Homo sapiens
gccagctgctcccca

SEQ ID NO: 3448354 - DNA, 17 bp, Homo sapiens
gccagcttcgagctaca

SEQ ID NO: 3448355 - DNA, 22 bp, Homo sapiens
gccaggaagctttggtgagaac

SEQ ID NO: 3448356 - DNA, 18 bp, Homo sapiens
gccaggaatttcccagga

SEQ ID NO: 3448357 - DNA, 19 bp, Homo sapiens
gccaggaatttcccaggac

SEQ ID NO: 3448358 - DNA, 17 bp, Homo sapiens
gccaggagcgcatctca

SEQ ID NO: 3448359 - DNA, 23 bp, Homo sapiens
gccaggagctgtcaccaaggaaa

SEQ ID NO: 3448360 - DNA, 22 bp, Homo sapiens
gccaggagggcgttcttaggct

SEQ ID NO: 3448361 - DNA, 22 bp, Homo sapiens
gccaggatggaacacggccaca

SEQ ID NO: 3448362 - DNA, 19 bp, Homo sapiens
gccaggcaggcgggcgcca

SEQ ID NO: 3448363 - DNA, 13 bp, Homo sapiens
gccaggccagagg

SEQ ID NO: 3448364 - DNA, 15 bp, Homo sapiens
gccaggccagaggga

SEQ ID NO: 3448365 - DNA, 13 bp, Homo sapiens
gccaggccccagg

SEQ ID NO: 3448366 - DNA, 20 bp, Homo sapiens
gccaggccggcgagccctgt

SEQ ID NO: 3448367 - DNA, 23 bp, Homo sapiens
gccaggccggcgagccctgtgga

SEQ ID NO: 3448368 - DNA, 19 bp, Homo sapiens
gccaggctgaccacagcac

SEQ ID NO: 3448369 - DNA, 15 bp, Homo sapiens
gccaggctgatctcg

SEQ ID NO: 3448370 - DNA, 22 bp, Homo sapiens
gccagggagacctggacacagg

SEQ ID NO: 3448371 - DNA, 20 bp, Homo sapiens
gccagggcaatgatgaatga

SEQ ID NO: 3448372 - DNA, 21 bp, Homo sapiens
gccagggcagagtgagaccca

SEQ ID NO: 3448373 - DNA, 22 bp, Homo sapiens
gccagggccacgctccagctgc

SEQ ID NO: 3448374 - DNA, 15 bp, Homo sapiens
gccagggcctggaag

SEQ ID NO: 3448375 - DNA, 22 bp, Homo sapiens
gccagggcctggaagacagaga

SEQ ID NO: 3448376 - DNA, 23 bp, Homo sapiens
gccagggcttcctcttccgggca

SEQ ID NO: 3448377 - DNA, 17 bp, Homo sapiens
gccaggggaaaatcagc

SEQ ID NO: 3448378 - DNA, 13 bp, Homo sapiens
gccaggggcgagg

SEQ ID NO: 3448379 - DNA, 15 bp, Homo sapiens
gccagggggatgcca

SEQ ID NO: 3448380 - DNA, 21 bp, Homo sapiens
gccaggggggtgaggagctgg

SEQ ID NO: 3448381 - DNA, 22 bp, Homo sapiens
gccagtcctaggcccctgccct

SEQ ID NO: 3448382 - DNA, 15 bp, Homo sapiens
gccagtcctgctacc

SEQ ID NO: 3448383 - DNA, 22 bp, Homo sapiens
gccagtcctgctacctcccttg

SEQ ID NO: 3448384 - DNA, 12 bp, Homo sapiens
gccagtctgtgg

SEQ ID NO: 3448385 - DNA, 20 bp, Homo sapiens
gccagtcttgacgagtgtga

SEQ ID NO: 3448386 - DNA, 17 bp, Homo sapiens
gccagtgtgctgatggg

SEQ ID NO: 3448387 - DNA, 18 bp, Homo sapiens
gccagtgtgctgatgggc

SEQ ID NO: 3448388 - DNA, 22 bp, Homo sapiens
gccataaaacaggtaatataaa

SEQ ID NO: 3448389 - DNA, 16 bp, Homo sapiens
gccatatgaaaaggct

SEQ ID NO: 3448390 - DNA, 19 bp, Homo sapiens
gccatattctgttggccag

SEQ ID NO: 3448391 - DNA, 21 bp, Homo sapiens
gccatattgcacatgtcttaa

SEQ ID NO: 3448392 - DNA, 22 bp, Homo sapiens
gccatattgcacatgtcttaat

SEQ ID NO: 3448393 - DNA, 23 bp, Homo sapiens
gccatcatctcctgccttcctcc

SEQ ID NO: 3448394 - DNA, 14 bp, Homo sapiens
gccatcattgctgt

SEQ ID NO: 3448395 - DNA, 18 bp, Homo sapiens
gccatcattgctgtctgc

SEQ ID NO: 3448396 - DNA, 19 bp, Homo sapiens
gccatcattgctgtctgca

SEQ ID NO: 3448397 - DNA, 18 bp, Homo sapiens
gccatcctcaaacactgc

SEQ ID NO: 3448398 - DNA, 19 bp, Homo sapiens
gccatcctcaaacactgca

SEQ ID NO: 3448399 - DNA, 23 bp, Homo sapiens
gccatcctcaaacactgcaggca

SEQ ID NO: 3448400 - DNA, 23 bp, Homo sapiens
gccatctcaattgtgctttgtat

SEQ ID NO: 3448401 - DNA, 18 bp, Homo sapiens
gccatctcatgaggggag

SEQ ID NO: 3448402 - DNA, 19 bp, Homo sapiens
gccatctcatgaggggaga

SEQ ID NO: 3448403 - DNA, 20 bp, Homo sapiens
gccatctcatgaggggagag

SEQ ID NO: 3448404 - DNA, 19 bp, Homo sapiens
gccatctctggatgcctga

SEQ ID NO: 3448405 - DNA, 23 bp, Homo sapiens
gccatgagatgatacatccaaag

SEQ ID NO: 3448406 - DNA, 13 bp, Homo sapiens
gccatgatgcctc

SEQ ID NO: 3448407 - DNA, 18 bp, Homo sapiens
gccatgatgcctctgtct

SEQ ID NO: 3448408 - DNA, 19 bp, Homo sapiens
gccatgatggcaacagatc

SEQ ID NO: 3448409 - DNA, 20 bp, Homo sapiens
gccatgcgccccctccgccc

SEQ ID NO: 3448410 - DNA, 14 bp, Homo sapiens
gccatgctcctggc

SEQ ID NO: 3448411 - DNA, 14 bp, Homo sapiens
gccatgctggctca

SEQ ID NO: 3448412 - DNA, 16 bp, Homo sapiens
gccatggagagctgga

SEQ ID NO: 3448413 - DNA, 21 bp, Homo sapiens
gccatgtaaatccccactggg

SEQ ID NO: 3448414 - DNA, 22 bp, Homo sapiens
gccatgtaaatccccactggga

SEQ ID NO: 3448415 - DNA, 17 bp, Homo sapiens
gccatgtactagtttta

SEQ ID NO: 3448416 - DNA, 23 bp, Homo sapiens
gccatgtctgcagtgtgcccccc

SEQ ID NO: 3448417 - DNA, 20 bp, Homo sapiens
gccatgtgaaactcatctca

SEQ ID NO: 3448418 - DNA, 19 bp, Homo sapiens
gccatgttggccaggctgg

SEQ ID NO: 3448419 - DNA, 24 bp, Homo sapiens
gccatgttggccaggctggtctca

SEQ ID NO: 3448420 - DNA, 18 bp, Homo sapiens
gccattacccagctaaat

SEQ ID NO: 3448421 - DNA, 19 bp, Homo sapiens
gccatttttcaaagcaatt

SEQ ID NO: 3448422 - DNA, 21 bp, Homo sapiens
gcccaaaatttattttataag

SEQ ID NO: 3448423 - DNA, 23 bp, Homo sapiens
gcccaaaatttattttataagaa

SEQ ID NO: 3448424 - DNA, 13 bp, Homo sapiens
gcccaagatgctt

SEQ ID NO: 3448425 - DNA, 18 bp, Homo sapiens
gcccaagccagaggctgg

SEQ ID NO: 3448426 - DNA, 23 bp, Homo sapiens
gcccaagccagaggctgggttca

SEQ ID NO: 3448427 - DNA, 18 bp, Homo sapiens
gcccaagcttccctccat

SEQ ID NO: 3448428 - DNA, 23 bp, Homo sapiens
gcccaagggaaagaaaaggaagg

SEQ ID NO: 3448429 - DNA, 18 bp, Homo sapiens
gcccaagggatctggtcc

SEQ ID NO: 3448430 - DNA, 20 bp, Homo sapiens
gcccaagtggcagagcttgg

SEQ ID NO: 3448431 - DNA, 18 bp, Homo sapiens
gcccaatattataatttt

SEQ ID NO: 3448432 - DNA, 13 bp, Homo sapiens
gcccacaggatca

SEQ ID NO: 3448433 - DNA, 19 bp, Homo sapiens
gcccacaggatcagtctga

SEQ ID NO: 3448434 - DNA, 15 bp, Homo sapiens
gcccacgctggagtg

SEQ ID NO: 3448435 - DNA, 16 bp, Homo sapiens
gcccacgctggagtgc

SEQ ID NO: 3448436 - DNA, 23 bp, Homo sapiens
gcccacgctggagtgcagtgagc

SEQ ID NO: 3448437 - DNA, 15 bp, Homo sapiens
gcccactgtcctggg

SEQ ID NO: 3448438 - DNA, 18 bp, Homo sapiens
gcccactgtcctgggcct

SEQ ID NO: 3448439 - DNA, 23 bp, Homo sapiens
gcccactgtcctgggcctgcaga

SEQ ID NO: 3448440 - DNA, 13 bp, Homo sapiens
gcccacttctgcc

SEQ ID NO: 3448441 - DNA, 21 bp, Homo sapiens
gcagaggaggggccgctgcca

SEQ ID NO: 3448442 - DNA, 20 bp, Homo sapiens
gcagagggctggaggcccag

SEQ ID NO: 3448443 - DNA, 23 bp, Homo sapiens
gcagagggctggaggcccaggct

SEQ ID NO: 3448444 - DNA, 24 bp, Homo sapiens
gcagagggctggaggcccaggctg

SEQ ID NO: 3448445 - DNA, 19 bp, Homo sapiens
gcagaggtctccaaactga

SEQ ID NO: 3448446 - DNA, 16 bp, Homo sapiens
gcagagttgtaaatat

SEQ ID NO: 3448447 - DNA, 17 bp, Homo sapiens
gcagagttgtaaatata

SEQ ID NO: 3448448 - DNA, 22 bp, Homo sapiens
gcagatacaggaaaagctgctg

SEQ ID NO: 3448449 - DNA, 15 bp, Homo sapiens
gcagatactgtctct

SEQ ID NO: 3448450 - DNA, 14 bp, Homo sapiens
gcagatccaggact

SEQ ID NO: 3448451 - DNA, 16 bp, Homo sapiens
gcagatgcaaagaggc

SEQ ID NO: 3448452 - DNA, 15 bp, Homo sapiens
gcagcaccctgcaga

SEQ ID NO: 3448453 - DNA, 21 bp, Homo sapiens
gcagcaggaatatatgtgtgc

SEQ ID NO: 3448454 - DNA, 20 bp, Homo sapiens
gcagcagggagggcttctgc

SEQ ID NO: 3448455 - DNA, 12 bp, Homo sapiens
gcagcagggcta

SEQ ID NO: 3448456 - DNA, 17 bp, Homo sapiens
gcagcagggctaccctg

SEQ ID NO: 3448457 - DNA, 19 bp, Homo sapiens
gcagcagggctaccctgag

SEQ ID NO: 3448458 - DNA, 19 bp, Homo sapiens
gcagcagtgtgaggccagg

SEQ ID NO: 3448459 - DNA, 23 bp, Homo sapiens
gcagcagtgtgaggccagggcag

SEQ ID NO: 3448460 - DNA, 20 bp, Homo sapiens
gcagccaagctccttgggag

SEQ ID NO: 3448461 - DNA, 14 bp, Homo sapiens
gcagccccagcctg

SEQ ID NO: 3448462 - DNA, 21 bp, Homo sapiens
gcagccccattctgcctgccc

SEQ ID NO: 3448463 - DNA, 20 bp, Homo sapiens
gcagcctcccatccagggcc

SEQ ID NO: 3448464 - DNA, 16 bp, Homo sapiens
gcagcctctccccagg

SEQ ID NO: 3448465 - DNA, 13 bp, Homo sapiens
gcagcctgagtcc

SEQ ID NO: 3448466 - DNA, 17 bp, Homo sapiens
gcagcctggggctggcc

SEQ ID NO: 3448467 - DNA, 19 bp, Homo sapiens
gcagccttgaactctgggc

SEQ ID NO: 3448468 - DNA, 15 bp, Homo sapiens
gcagccttggcaaac

SEQ ID NO: 3448469 - DNA, 18 bp, Homo sapiens
gcagcctttgcctccccg

SEQ ID NO: 3448470 - DNA, 15 bp, Homo sapiens
gcagctcagcttccc

SEQ ID NO: 3448471 - DNA, 13 bp, Homo sapiens
gcagctccctggc

SEQ ID NO: 3448472 - DNA, 21 bp, Homo sapiens
gcagctccctggcttctgtgg

SEQ ID NO: 3448473 - DNA, 13 bp, Homo sapiens
gcagctgcttttg

SEQ ID NO: 3448474 - DNA, 16 bp, Homo sapiens
gcagcttgagggttgg

SEQ ID NO: 3448475 - DNA, 23 bp, Homo sapiens
gcaggaaaaggtgatatccattc

SEQ ID NO: 3448476 - DNA, 21 bp, Homo sapiens
gcaggaatatatgtgtgccta

SEQ ID NO: 3448477 - DNA, 22 bp, Homo sapiens
gcaggaccagccagcagcagcc

SEQ ID NO: 3448478 - DNA, 20 bp, Homo sapiens
gcaggaccttcgggctgtgc

SEQ ID NO: 3448479 - DNA, 17 bp, Homo sapiens
gcaggacgtgggctggg

SEQ ID NO: 3448480 - DNA, 17 bp, Homo sapiens
gcaggactccaggccca

SEQ ID NO: 3448481 - DNA, 18 bp, Homo sapiens
gcaggactccaggcccaa

SEQ ID NO: 3448482 - DNA, 16 bp, Homo sapiens
gcaggactgcagagca

SEQ ID NO: 3448483 - DNA, 23 bp, Homo sapiens
gcaggaggatcacttgagtccag

SEQ ID NO: 3448484 - DNA, 15 bp, Homo sapiens
gcaggaggccaggcc

SEQ ID NO: 3448485 - DNA, 17 bp, Homo sapiens
gcaggaggccaggccgg

SEQ ID NO: 3448486 - DNA, 19 bp, Homo sapiens
gcaggatttgttctctgtc

SEQ ID NO: 3448487 - DNA, 23 bp, Homo sapiens
gcaggcagacacggatctgagaa

SEQ ID NO: 3448488 - DNA, 15 bp, Homo sapiens
gcaggcaggctccca

SEQ ID NO: 3448489 - DNA, 18 bp, Homo sapiens
gcaggcaggctcccaggg

SEQ ID NO: 3448490 - DNA, 15 bp, Homo sapiens
gcaggccaggccagc

SEQ ID NO: 3448491 - DNA, 13 bp, Homo sapiens
gcaggcccctctc

SEQ ID NO: 3448492 - DNA, 14 bp, Homo sapiens
gcaggcccctctcc

SEQ ID NO: 3448493 - DNA, 15 bp, Homo sapiens
gcaggcccctctcct

SEQ ID NO: 3448494 - DNA, 21 bp, Homo sapiens
gcaggcccctctcctccgtgg

SEQ ID NO: 3448495 - DNA, 12 bp, Homo sapiens
gcaggccctggc

SEQ ID NO: 3448496 - DNA, 17 bp, Homo sapiens
gcaggccgaggcaggtg

SEQ ID NO: 3448497 - DNA, 23 bp, Homo sapiens
gcaggcggtgggcacccaccctg

SEQ ID NO: 3448498 - DNA, 19 bp, Homo sapiens
gcaggcgttcagctcactg

SEQ ID NO: 3448499 - DNA, 17 bp, Homo sapiens
gcaggctaaggcgtgga

SEQ ID NO: 3448500 - DNA, 12 bp, Homo sapiens
gcaggctggcca

SEQ ID NO: 3448501 - DNA, 14 bp, Homo sapiens
gcaggctggccagt

SEQ ID NO: 3448502 - DNA, 22 bp, Homo sapiens
gcaggctggccagtccaggctg

SEQ ID NO: 3448503 - DNA, 20 bp, Homo sapiens
gcaggctgtggggcagctga

SEQ ID NO: 3448504 - DNA, 22 bp, Homo sapiens
gcagggaaacagctaatgggac

SEQ ID NO: 3448505 - DNA, 18 bp, Homo sapiens
gcagggagggcagttttc

SEQ ID NO: 3448506 - DNA, 21 bp, Homo sapiens
gcagggatgccctggaggtgg

SEQ ID NO: 3448507 - DNA, 23 bp, Homo sapiens
gcagggatgccctggaggtggct

SEQ ID NO: 3448508 - DNA, 21 bp, Homo sapiens
gcagggccccaggcattgcca

SEQ ID NO: 3448509 - DNA, 15 bp, Homo sapiens
gcagggccgccaggg

SEQ ID NO: 3448510 - DNA, 17 bp, Homo sapiens
gcagggcgggcagaggg

SEQ ID NO: 3448511 - DNA, 20 bp, Homo sapiens
gcagggcgggcagagggctg

SEQ ID NO: 3448512 - DNA, 21 bp, Homo sapiens
gcagggcgggcagagggctgg

SEQ ID NO: 3448513 - DNA, 22 bp, Homo sapiens
gcagggcgggcagagggctgga

SEQ ID NO: 3448514 - DNA, 17 bp, Homo sapiens
gcagggctaccctgagc

SEQ ID NO: 3448515 - DNA, 20 bp, Homo sapiens
gcagggctaccctgagctga

SEQ ID NO: 3448516 - DNA, 12 bp, Homo sapiens
gcagggctcagc

SEQ ID NO: 3448517 - DNA, 14 bp, Homo sapiens
gcagggctcagcgg

SEQ ID NO: 3448518 - DNA, 21 bp, Homo sapiens
gcagggctcagcggggacagc

SEQ ID NO: 3448519 - DNA, 22 bp, Homo sapiens
gcagggctcagcggggacagct

SEQ ID NO: 3448520 - DNA, 14 bp, Homo sapiens
gcaggggcctggag

SEQ ID NO: 3448521 - DNA, 22 bp, Homo sapiens
gcaggggtggctgcctcattta

SEQ ID NO: 3448522 - DNA, 17 bp, Homo sapiens
gcagggtctcactctgt

SEQ ID NO: 3448523 - DNA, 21 bp, Homo sapiens
gcagggtctgtttggactgca

SEQ ID NO: 3448524 - DNA, 19 bp, Homo sapiens
gcaggtcttgaactcctgg

SEQ ID NO: 3448525 - DNA, 16 bp, Homo sapiens
gcaggtgctggagcac

SEQ ID NO: 3448526 - DNA, 21 bp, Homo sapiens
gcaggtgctggagcactgggc

SEQ ID NO: 3448527 - DNA, 21 bp, Homo sapiens
gcaggtggggagactgggctg

SEQ ID NO: 3448528 - DNA, 13 bp, Homo sapiens
gcaggttcccaag

SEQ ID NO: 3448529 - DNA, 15 bp, Homo sapiens
gcaggttcccaagct

SEQ ID NO: 3448530 - DNA, 16 bp, Homo sapiens
gcaggttcccaagctc

SEQ ID NO: 3448531 - DNA, 13 bp, Homo sapiens
gcagtcactgaat

SEQ ID NO: 3448532 - DNA, 21 bp, Homo sapiens
gcagtcacttcggccagagct

SEQ ID NO: 3448533 - DNA, 14 bp, Homo sapiens
gcagtccagccagc

SEQ ID NO: 3448534 - DNA, 17 bp, Homo sapiens
gcagtccagccagctcc

SEQ ID NO: 3448535 - DNA, 18 bp, Homo sapiens
gcagtccagccagctcct

SEQ ID NO: 3448536 - DNA, 18 bp, Homo sapiens
gcagtcgtgcctgtgtcc

SEQ ID NO: 3448537 - DNA, 17 bp, Homo sapiens
gcagtctgtccaggctc

SEQ ID NO: 3448538 - DNA, 18 bp, Homo sapiens
gcagtgcaggcacagtat

SEQ ID NO: 3448539 - DNA, 17 bp, Homo sapiens
gcagtgctcgctgttgc

SEQ ID NO: 3448540 - DNA, 22 bp, Homo sapiens
gcagtggactcagaaagccaac

SEQ ID NO: 3448541 - DNA, 14 bp, Homo sapiens
gcagtggaggtggg

SEQ ID NO: 3448542 - DNA, 11 bp, Homo sapiens
gcagtgggagc

SEQ ID NO: 3448543 - DNA, 12 bp, Homo sapiens
gcagtgggagct

SEQ ID NO: 3448544 - DNA, 14 bp, Homo sapiens
gcagtgggagctgc

SEQ ID NO: 3448545 - DNA, 17 bp, Homo sapiens
gcagtgggagctgcctg

SEQ ID NO: 3448546 - DNA, 22 bp, Homo sapiens
gcagtgggaggcaaatgggatg

SEQ ID NO: 3448547 - DNA, 21 bp, Homo sapiens
gcagtgtgcactaaggggccc

SEQ ID NO: 3448548 - DNA, 19 bp, Homo sapiens
gcagttctgggtgctccct

SEQ ID NO: 3448549 - DNA, 22 bp, Homo sapiens
gcagttggccagagagcctggt

SEQ ID NO: 3448550 - DNA, 20 bp, Homo sapiens
gcagtttctgtcctgctggt

SEQ ID NO: 3448551 - DNA, 13 bp, Homo sapiens
gcagtttgaaatt

SEQ ID NO: 3448552 - DNA, 18 bp, Homo sapiens
gcagtttgaaattctgaa

SEQ ID NO: 3448553 - DNA, 22 bp, Homo sapiens
gcagtttgaaattctgaatttg

SEQ ID NO: 3448554 - DNA, 18 bp, Homo sapiens
gcatacccaaaccaggtg

SEQ ID NO: 3448555 - DNA, 19 bp, Homo sapiens
gcatagatgcaggtgagcc

SEQ ID NO: 3448556 - DNA, 17 bp, Homo sapiens
gcataggtttaataatt

SEQ ID NO: 3448557 - DNA, 12 bp, Homo sapiens
gcatatctgcct

SEQ ID NO: 3448558 - DNA, 15 bp, Homo sapiens
gcatatctgccttta

SEQ ID NO: 3448559 - DNA, 22 bp, Homo sapiens
gcatatctgcctttattgtgtt

SEQ ID NO: 3448560 - DNA, 16 bp, Homo sapiens
gcatatgaaaggagag

SEQ ID NO: 3448561 - DNA, 19 bp, Homo sapiens
gcatatgttgaatactttt

SEQ ID NO: 3448562 - DNA, 20 bp, Homo sapiens
gcatatgttgaatacttttt

SEQ ID NO: 3448563 - DNA, 21 bp, Homo sapiens
gcatatgttgaatacttttta

SEQ ID NO: 3448564 - DNA, 20 bp, Homo sapiens
gcatcaccttaggcagggaa

SEQ ID NO: 3448565 - DNA, 21 bp, Homo sapiens
gcatcatggaaagactgggac

SEQ ID NO: 3448566 - DNA, 18 bp, Homo sapiens
gcatccagcagtctctgc

SEQ ID NO: 3448567 - DNA, 19 bp, Homo sapiens
gcatccagcagtctctgcc

SEQ ID NO: 3448568 - DNA, 20 bp, Homo sapiens
gcatccagcagtctctgcct

SEQ ID NO: 3448569 - DNA, 20 bp, Homo sapiens
gcatccgcaggtgctggtcc

SEQ ID NO: 3448570 - DNA, 12 bp, Homo sapiens
gcatcctctgac

SEQ ID NO: 3448571 - DNA, 23 bp, Homo sapiens
gcatcctttagggttctgcctct

SEQ ID NO: 3448572 - DNA, 14 bp, Homo sapiens
gcatcggcctaggg

SEQ ID NO: 3448573 - DNA, 23 bp, Homo sapiens
gcatctcaatggaaacatcactg

SEQ ID NO: 3448574 - DNA, 12 bp, Homo sapiens
gcatctggggcc

SEQ ID NO: 3448575 - DNA, 23 bp, Homo sapiens
gcatcttactgaaggtaaaattg

SEQ ID NO: 3448576 - DNA, 14 bp, Homo sapiens
gatgtgaagccaat

SEQ ID NO: 3448577 - DNA, 13 bp, Homo sapiens
gatgtgcctgggt

SEQ ID NO: 3448578 - DNA, 13 bp, Homo sapiens
gatgtggggctga

SEQ ID NO: 3448579 - DNA, 18 bp, Homo sapiens
gatgtggggctgagctgg

SEQ ID NO: 3448580 - DNA, 20 bp, Homo sapiens
gatgtgggggaagacctggc

SEQ ID NO: 3448581 - DNA, 15 bp, Homo sapiens
gatgtgtcatctaat

SEQ ID NO: 3448582 - DNA, 18 bp, Homo sapiens
gatgtgtttgctttctga

SEQ ID NO: 3448583 - DNA, 19 bp, Homo sapiens
gatgtttcttttgtatgta

SEQ ID NO: 3448584 - DNA, 20 bp, Homo sapiens
gatgtttcttttgtatgtaa

SEQ ID NO: 3448585 - DNA, 13 bp, Homo sapiens
gatgtttgcccaa

SEQ ID NO: 3448586 - DNA, 14 bp, Homo sapiens
gatgtttgcccaaa

SEQ ID NO: 3448587 - DNA, 12 bp, Homo sapiens
gattaacatttg

SEQ ID NO: 3448588 - DNA, 14 bp, Homo sapiens
gattaattgctgca

SEQ ID NO: 3448589 - DNA, 21 bp, Homo sapiens
gattacaagcgtgagccactg

SEQ ID NO: 3448590 - DNA, 14 bp, Homo sapiens
gattacatgcatgt

SEQ ID NO: 3448591 - DNA, 18 bp, Homo sapiens
gattacttctctataaaa

SEQ ID NO: 3448592 - DNA, 19 bp, Homo sapiens
gattacttctctataaaaa

SEQ ID NO: 3448593 - DNA, 13 bp, Homo sapiens
gattaggtatgtt

SEQ ID NO: 3448594 - DNA, 20 bp, Homo sapiens
gattatctatttgtgtgtgt

SEQ ID NO: 3448595 - DNA, 15 bp, Homo sapiens
gattattcagtgtca

SEQ ID NO: 3448596 - DNA, 13 bp, Homo sapiens
gattcaaaatatt

SEQ ID NO: 3448597 - DNA, 14 bp, Homo sapiens
gattcaaaatattt

SEQ ID NO: 3448598 - DNA, 23 bp, Homo sapiens
gattcaaaatatttaaaaatgtc

SEQ ID NO: 3448599 - DNA, 21 bp, Homo sapiens
gattcaatattgaatttttcc

SEQ ID NO: 3448600 - DNA, 18 bp, Homo sapiens
gattcaggtgcagaggaa

SEQ ID NO: 3448601 - DNA, 18 bp, Homo sapiens
gattccaaaaagcacata

SEQ ID NO: 3448602 - DNA, 23 bp, Homo sapiens
gattccaaagagtagaattgcat

SEQ ID NO: 3448603 - DNA, 22 bp, Homo sapiens
gattccatttggcagagcttct

SEQ ID NO: 3448604 - DNA, 15 bp, Homo sapiens
gattcccaagctctg

SEQ ID NO: 3448605 - DNA, 17 bp, Homo sapiens
gattcccaggatgagca

SEQ ID NO: 3448606 - DNA, 21 bp, Homo sapiens
gattccctcctgctactctgt

SEQ ID NO: 3448607 - DNA, 17 bp, Homo sapiens
gattcggtatcccccca

SEQ ID NO: 3448608 - DNA, 19 bp, Homo sapiens
gattctaatttttaagcaa

SEQ ID NO: 3448609 - DNA, 20 bp, Homo sapiens
gattctatttatatgtacat

SEQ ID NO: 3448610 - DNA, 12 bp, Homo sapiens
gattctcagggt

SEQ ID NO: 3448611 - DNA, 17 bp, Homo sapiens
gattctcagggtctctg

SEQ ID NO: 3448612 - DNA, 21 bp, Homo sapiens
gattctcagggtctctgctgc

SEQ ID NO: 3448613 - DNA, 17 bp, Homo sapiens
gattctcctgcctcagc

SEQ ID NO: 3448614 - DNA, 18 bp, Homo sapiens
gattctcctgcctcagcc

SEQ ID NO: 3448615 - DNA, 13 bp, Homo sapiens
gattctccttcag

SEQ ID NO: 3448616 - DNA, 17 bp, Homo sapiens
gattctccttcagccct

SEQ ID NO: 3448617 - DNA, 18 bp, Homo sapiens
gattctgcagtaaatctt

SEQ ID NO: 3448618 - DNA, 19 bp, Homo sapiens
gattctgcagtaaatcttt

SEQ ID NO: 3448619 - DNA, 21 bp, Homo sapiens
gattctgcagtaaatctttta

SEQ ID NO: 3448620 - DNA, 19 bp, Homo sapiens
gattctggacagtcagctc

SEQ ID NO: 3448621 - DNA, 17 bp, Homo sapiens
gattctggttccagggt

SEQ ID NO: 3448622 - DNA, 16 bp, Homo sapiens
gattgagtctgtgcca

SEQ ID NO: 3448623 - DNA, 15 bp, Homo sapiens
gattgatttgaagaa

SEQ ID NO: 3448624 - DNA, 17 bp, Homo sapiens
gattgcaacaggctggg

SEQ ID NO: 3448625 - DNA, 15 bp, Homo sapiens
gattgcacgtgcctg

SEQ ID NO: 3448626 - DNA, 21 bp, Homo sapiens
gattgctgccccatcagtgct

SEQ ID NO: 3448627 - DNA, 18 bp, Homo sapiens
gattgcttaaaatagcaa

SEQ ID NO: 3448628 - DNA, 13 bp, Homo sapiens
gattgggacagag

SEQ ID NO: 3448629 - DNA, 19 bp, Homo sapiens
gattgggtgggcaggaaaa

SEQ ID NO: 3448630 - DNA, 16 bp, Homo sapiens
gattgtggaatgttgg

SEQ ID NO: 3448631 - DNA, 13 bp, Homo sapiens
gattgtggatgtg

SEQ ID NO: 3448632 - DNA, 18 bp, Homo sapiens
gattgttcgggtgtgcaa

SEQ ID NO: 3448633 - DNA, 21 bp, Homo sapiens
gattgtttacaggatattcca

SEQ ID NO: 3448634 - DNA, 16 bp, Homo sapiens
gatttaaacaaacaaa

SEQ ID NO: 3448635 - DNA, 16 bp, Homo sapiens
gatttaaacacacaga

SEQ ID NO: 3448636 - DNA, 13 bp, Homo sapiens
gatttagtagtgt

SEQ ID NO: 3448637 - DNA, 14 bp, Homo sapiens
gatttataaacaga

SEQ ID NO: 3448638 - DNA, 16 bp, Homo sapiens
gatttcagaggctgca

SEQ ID NO: 3448639 - DNA, 12 bp, Homo sapiens
gatttcatctgc

SEQ ID NO: 3448640 - DNA, 15 bp, Homo sapiens
gatttcatctgctct

SEQ ID NO: 3448641 - DNA, 15 bp, Homo sapiens
gatttccagccaggg

SEQ ID NO: 3448642 - DNA, 18 bp, Homo sapiens
gatttccagccagggctg

SEQ ID NO: 3448643 - DNA, 19 bp, Homo sapiens
gatttccagccagggctgc

SEQ ID NO: 3448644 - DNA, 17 bp, Homo sapiens
gatttccttgaatgtgg

SEQ ID NO: 3448645 - DNA, 17 bp, Homo sapiens
gatttctgtaaactctg

SEQ ID NO: 3448646 - DNA, 20 bp, Homo sapiens
gatttgaagaacatgtgaga

SEQ ID NO: 3448647 - DNA, 17 bp, Homo sapiens
gatttgcattgaacaca

SEQ ID NO: 3448648 - DNA, 12 bp, Homo sapiens
gatttgcctcac

SEQ ID NO: 3448649 - DNA, 15 bp, Homo sapiens
gatttgcctcacctt

SEQ ID NO: 3448650 - DNA, 23 bp, Homo sapiens
gatttgggctggaacagattcac

SEQ ID NO: 3448651 - DNA, 14 bp, Homo sapiens
gattttaactctgt

SEQ ID NO: 3448652 - DNA, 13 bp, Homo sapiens
gattttaattttg

SEQ ID NO: 3448653 - DNA, 13 bp, Homo sapiens
gattttccaaatg

SEQ ID NO: 3448654 - DNA, 18 bp, Homo sapiens
gattttgatagcaaagcg

SEQ ID NO: 3448655 - DNA, 19 bp, Homo sapiens
gattttgatccaagctggt

SEQ ID NO: 3448656 - DNA, 13 bp, Homo sapiens
gattttgtaaccc

SEQ ID NO: 3448657 - DNA, 23 bp, Homo sapiens
gattttgtatctgcaggcagaca

SEQ ID NO: 3448658 - DNA, 19 bp, Homo sapiens
gattttttgcattcctgac

SEQ ID NO: 3448659 - DNA, 16 bp, Homo sapiens
gcaaaaaagtccaatt

SEQ ID NO: 3448660 - DNA, 21 bp, Homo sapiens
gcaaaaaagtccaattttaat

SEQ ID NO: 3448661 - DNA, 12 bp, Homo sapiens
gcaaaaaatact

SEQ ID NO: 3448662 - DNA, 20 bp, Homo sapiens
gcaaaaaatactttttctaa

SEQ ID NO: 3448663 - DNA, 14 bp, Homo sapiens
gcaaaaaggcagga

SEQ ID NO: 3448664 - DNA, 12 bp, Homo sapiens
gcaaaagaaaaa

SEQ ID NO: 3448665 - DNA, 20 bp, Homo sapiens
gcaaaaggatctttgtggcc

SEQ ID NO: 3448666 - DNA, 21 bp, Homo sapiens
gcaaaaggatctttgtggcca

SEQ ID NO: 3448667 - DNA, 21 bp, Homo sapiens
gcaaaaggttcactaaagcag

SEQ ID NO: 3448668 - DNA, 17 bp, Homo sapiens
gcaaaatgaggaatgta

SEQ ID NO: 3448669 - DNA, 17 bp, Homo sapiens
gcaaaccacactggact

SEQ ID NO: 3448670 - DNA, 22 bp, Homo sapiens
gcaaaccacactggactccggc

SEQ ID NO: 3448671 - DNA, 16 bp, Homo sapiens
gcaaaccatttttaaa

SEQ ID NO: 3448672 - DNA, 14 bp, Homo sapiens
gcaaacgctgcctg

SEQ ID NO: 3448673 - DNA, 16 bp, Homo sapiens
gcaaacgctgcctgcc

SEQ ID NO: 3448674 - DNA, 17 bp, Homo sapiens
gcaaacgctgcctgccg

SEQ ID NO: 3448675 - DNA, 15 bp, Homo sapiens
gcaaactgtgcttct

SEQ ID NO: 3448676 - DNA, 16 bp, Homo sapiens
gcaaactgtgcttctc

SEQ ID NO: 3448677 - DNA, 14 bp, Homo sapiens
gcaaagaggcaaga

SEQ ID NO: 3448678 - DNA, 19 bp, Homo sapiens
gcaaagatctgtcctcagc

SEQ ID NO: 3448679 - DNA, 15 bp, Homo sapiens
gcaaaggaaggtgga

SEQ ID NO: 3448680 - DNA, 20 bp, Homo sapiens
gcaaaggaaggtggatggcc

SEQ ID NO: 3448681 - DNA, 15 bp, Homo sapiens
gcaaagggcatgggt

SEQ ID NO: 3448682 - DNA, 22 bp, Homo sapiens
gcaaagggtccagaaggagaca

SEQ ID NO: 3448683 - DNA, 16 bp, Homo sapiens
gcaaagtattgtaaat

SEQ ID NO: 3448684 - DNA, 18 bp, Homo sapiens
gcaaagtattgtaaatta

SEQ ID NO: 3448685 - DNA, 14 bp, Homo sapiens
gcaaagtgttttgt

SEQ ID NO: 3448686 - DNA, 15 bp, Homo sapiens
gcaaatcctatgtga

SEQ ID NO: 3448687 - DNA, 14 bp, Homo sapiens
gcaaatgcccaagg

SEQ ID NO: 3448688 - DNA, 12 bp, Homo sapiens
gcaaattctttt

SEQ ID NO: 3448689 - DNA, 20 bp, Homo sapiens
gcaaattcttttgaattgtt

SEQ ID NO: 3448690 - DNA, 22 bp, Homo sapiens
gcaacaagaccaccacttcgaa

SEQ ID NO: 3448691 - DNA, 17 bp, Homo sapiens
gcaacactctatattta

SEQ ID NO: 3448692 - DNA, 13 bp, Homo sapiens
gcaacagatctgg

SEQ ID NO: 3448693 - DNA, 14 bp, Homo sapiens
gcaacagatctgga

SEQ ID NO: 3448694 - DNA, 16 bp, Homo sapiens
gcaacagatctggaac

SEQ ID NO: 3448695 - DNA, 22 bp, Homo sapiens
gcaacagatctggaacctcagc

SEQ ID NO: 3448696 - DNA, 19 bp, Homo sapiens
gcaacagcaaatcacgacc

SEQ ID NO: 3448697 - DNA, 19 bp, Homo sapiens
gcaacagcctttgaatgta

SEQ ID NO: 3448698 - DNA, 23 bp, Homo sapiens
gcaacagcctttgaatgtaacca

SEQ ID NO: 3448699 - DNA, 21 bp, Homo sapiens
gcaacaggaatctcagagaca

SEQ ID NO: 3448700 - DNA, 15 bp, Homo sapiens
gcaacaggctgggct

SEQ ID NO: 3448701 - DNA, 19 bp, Homo sapiens
gcaacattttcttgaattt

SEQ ID NO: 3448702 - DNA, 20 bp, Homo sapiens
gcaacattttcttgaatttt

SEQ ID NO: 3448703 - DNA, 14 bp, Homo sapiens
gcaaccactaagaa

SEQ ID NO: 3448704 - DNA, 14 bp, Homo sapiens
gcaacccccagcct

SEQ ID NO: 3448705 - DNA, 16 bp, Homo sapiens
gcaacccccagcctgc

SEQ ID NO: 3448706 - DNA, 17 bp, Homo sapiens
gcaacccccagcctgct

SEQ ID NO: 3448707 - DNA, 18 bp, Homo sapiens
gcaacctacccagcgtgg

SEQ ID NO: 3448708 - DNA, 19 bp, Homo sapiens
gcaacctacctgttgagca

SEQ ID NO: 3448709 - DNA, 20 bp, Homo sapiens
gcaacctctgcttcccaggt

SEQ ID NO: 3448710 - DNA, 15 bp, Homo sapiens
gcaactcttgattat

SEQ ID NO: 3448711 - DNA, 18 bp, Homo sapiens
gcaactgcattggctttg

SEQ ID NO: 3448712 - DNA, 22 bp, Homo sapiens
gcaagaactcatcactgtggct

SEQ ID NO: 3448713 - DNA, 19 bp, Homo sapiens
gcaagagtgtggaggctga

SEQ ID NO: 3448714 - DNA, 15 bp, Homo sapiens
gcaagcacctcctgc

SEQ ID NO: 3448715 - DNA, 16 bp, Homo sapiens
gcaagcacctcctgcc

SEQ ID NO: 3448716 - DNA, 15 bp, Homo sapiens
gcaagccctgttgac

SEQ ID NO: 3448717 - DNA, 13 bp, Homo sapiens
gcaagctcccaag

SEQ ID NO: 3448718 - DNA, 19 bp, Homo sapiens
gcaagctcccaagggatgg

SEQ ID NO: 3448719 - DNA, 18 bp, Homo sapiens
gcaagctccgcaggactt

SEQ ID NO: 3448720 - DNA, 22 bp, Homo sapiens
gcaagctgccgaaccaaaagaa

SEQ ID NO: 3448721 - DNA, 9 bp, Homo sapiens
gcaaggaaa

SEQ ID NO: 3448722 - DNA, 18 bp, Homo sapiens
gcaaggtccggcccatcc

SEQ ID NO: 3448723 - DNA, 20 bp, Homo sapiens
gcaaggtttaggctggtggc

SEQ ID NO: 3448724 - DNA, 21 bp, Homo sapiens
gcaaggtttaggctggtggcc

SEQ ID NO: 3448725 - DNA, 22 bp, Homo sapiens
gcaaggtttaggctggtggccc

SEQ ID NO: 3448726 - DNA, 24 bp, Homo sapiens
gcaaggtttaggctggtggcccag

SEQ ID NO: 3448727 - DNA, 19 bp, Homo sapiens
gcaagtccttttgtaaagt

SEQ ID NO: 3448728 - DNA, 11 bp, Homo sapiens
gcaagtctctt

SEQ ID NO: 3448729 - DNA, 22 bp, Homo sapiens
gcaagtctttaggtctttgtaa

SEQ ID NO: 3448730 - DNA, 13 bp, Homo sapiens
gcaagtgagagct

SEQ ID NO: 3448731 - DNA, 15 bp, Homo sapiens
gcaagtgagagctgg

SEQ ID NO: 3448732 - DNA, 16 bp, Homo sapiens
gcaagtgagagctggg

SEQ ID NO: 3448733 - DNA, 18 bp, Homo sapiens
gcaagtgagagctgggtg

SEQ ID NO: 3448734 - DNA, 20 bp, Homo sapiens
gcaagtgattgggacagagg

SEQ ID NO: 3448735 - DNA, 14 bp, Homo sapiens
gcaagtgctcaggg

SEQ ID NO: 3448736 - DNA, 12 bp, Homo sapiens
gcaataatgcag

SEQ ID NO: 3448737 - DNA, 18 bp, Homo sapiens
gcaatcgggataaaacag

SEQ ID NO: 3448738 - DNA, 14 bp, Homo sapiens
gcaatgaagaatat

SEQ ID NO: 3448739 - DNA, 18 bp, Homo sapiens
gcaatgccatcatctcct

SEQ ID NO: 3448740 - DNA, 14 bp, Homo sapiens
gcaatgctggctgt

SEQ ID NO: 3448741 - DNA, 23 bp, Homo sapiens
gcaatgctggctgttggctgggg

SEQ ID NO: 3448742 - DNA, 17 bp, Homo sapiens
gcaatgtaagcatactt

SEQ ID NO: 3448743 - DNA, 15 bp, Homo sapiens
gcaatgtgggcagag

SEQ ID NO: 3448744 - DNA, 15 bp, Homo sapiens
gcaattgaaatgcat

SEQ ID NO: 3448745 - DNA, 19 bp, Homo sapiens
gcaatttatacaatatcat

SEQ ID NO: 3448746 - DNA, 13 bp, Homo sapiens
gcacaaaacccag

SEQ ID NO: 3448747 - DNA, 17 bp, Homo sapiens
gcacaaagctcaagatg

SEQ ID NO: 3448748 - DNA, 19 bp, Homo sapiens
gcacaactctactgttgca

SEQ ID NO: 3448749 - DNA, 19 bp, Homo sapiens
gcacaactttaagaggaca

SEQ ID NO: 3448750 - DNA, 21 bp, Homo sapiens
gcacaaggccttgcctggcct

SEQ ID NO: 3448751 - DNA, 23 bp, Homo sapiens
gcacaaggccttgcctggcctga

SEQ ID NO: 3448752 - DNA, 20 bp, Homo sapiens
gcacaatagtaacctgggta

SEQ ID NO: 3448753 - DNA, 18 bp, Homo sapiens
gcacacagaggggagtca

SEQ ID NO: 3448754 - DNA, 19 bp, Homo sapiens
gcacacaggtacagcaaca

SEQ ID NO: 3448755 - DNA, 22 bp, Homo sapiens
gcacacaggtacagcaacagga

SEQ ID NO: 3448756 - DNA, 17 bp, Homo sapiens
gcacacccactcagctc

SEQ ID NO: 3448757 - DNA, 22 bp, Homo sapiens
gcacactttgccatattttcac

SEQ ID NO: 3448758 - DNA, 17 bp, Homo sapiens
gcacagaagcacatgca

SEQ ID NO: 3448759 - DNA, 19 bp, Homo sapiens
gcacagaagtcctgtatgt

SEQ ID NO: 3448760 - DNA, 22 bp, Homo sapiens
gcacagcagcctggggctggcc

SEQ ID NO: 3448761 - DNA, 16 bp, Homo sapiens
gcacagctgtagtggg

SEQ ID NO: 3448762 - DNA, 19 bp, Homo sapiens
gcacagcttgacctgaggc

SEQ ID NO: 3448763 - DNA, 17 bp, Homo sapiens
gcacagcttttccaaaa

SEQ ID NO: 3448764 - DNA, 20 bp, Homo sapiens
gcacaggagtgtcctcttcc

SEQ ID NO: 3448765 - DNA, 22 bp, Homo sapiens
gcacatccatcagcaccccagt

SEQ ID NO: 3448766 - DNA, 13 bp, Homo sapiens
gcacatctgcatt

SEQ ID NO: 3448767 - DNA, 17 bp, Homo sapiens
gcacatctgtgtcttgt

SEQ ID NO: 3448768 - DNA, 13 bp, Homo sapiens
gcacatgcttcaa

SEQ ID NO: 3448769 - DNA, 13 bp, Homo sapiens
gcacatgtcttaa

SEQ ID NO: 3448770 - DNA, 22 bp, Homo sapiens
gcacatgtcttaatgaagtttg

SEQ ID NO: 3448771 - DNA, 22 bp, Homo sapiens
gcacatgttggaggagagagcc

SEQ ID NO: 3448772 - DNA, 12 bp, Homo sapiens
gcacatgtttcc

SEQ ID NO: 3448773 - DNA, 14 bp, Homo sapiens
gcacattcctttgg

SEQ ID NO: 3448774 - DNA, 19 bp, Homo sapiens
gcacattcctttgggtatg

SEQ ID NO: 3448775 - DNA, 23 bp, Homo sapiens
gcacatttaagagacagtcaccc

SEQ ID NO: 3448776 - DNA, 22 bp, Homo sapiens
gcaccactgcactccagcctgg

SEQ ID NO: 3448777 - DNA, 15 bp, Homo sapiens
gcaccagcagcctgg

SEQ ID NO: 3448778 - DNA, 12 bp, Homo sapiens
gcaccagccagc

SEQ ID NO: 3448779 - DNA, 14 bp, Homo sapiens
gcaccagtccctgt

SEQ ID NO: 3448780 - DNA, 21 bp, Homo sapiens
gcaccatccctttttgaagtg

SEQ ID NO: 3448781 - DNA, 22 bp, Homo sapiens
gcaccatccctttttgaagtgt

SEQ ID NO: 3448782 - DNA, 17 bp, Homo sapiens
gcacccaagacctcagg

SEQ ID NO: 3448783 - DNA, 22 bp, Homo sapiens
gcacccaccatcatgtctggct

SEQ ID NO: 3448784 - DNA, 16 bp, Homo sapiens
gcacccctactcacat

SEQ ID NO: 3448785 - DNA, 19 bp, Homo sapiens
gcacccggcccctgctggt

SEQ ID NO: 3448786 - DNA, 13 bp, Homo sapiens
gcaccctataaat

SEQ ID NO: 3448787 - DNA, 14 bp, Homo sapiens
gcaccctataaatc

SEQ ID NO: 3448788 - DNA, 14 bp, Homo sapiens
gcaccgtactgtgg

SEQ ID NO: 3448789 - DNA, 20 bp, Homo sapiens
gcaccgtgtcaagctgctct

SEQ ID NO: 3448790 - DNA, 21 bp, Homo sapiens
gcaccgtgtcaagctgctctg

SEQ ID NO: 3448791 - DNA, 14 bp, Homo sapiens
gcaccgttctgtgc

SEQ ID NO: 3448792 - DNA, 19 bp, Homo sapiens
gcacctacatccccaggtc

SEQ ID NO: 3448793 - DNA, 15 bp, Homo sapiens
gcacctccagcctga

SEQ ID NO: 3448794 - DNA, 11 bp, Homo sapiens
gcacctcccat

SEQ ID NO: 3448795 - DNA, 14 bp, Homo sapiens
gcacctcccatcct

SEQ ID NO: 3448796 - DNA, 15 bp, Homo sapiens
gcacctgcctcagga

SEQ ID NO: 3448797 - DNA, 16 bp, Homo sapiens
gcacctgcctcaggac

SEQ ID NO: 3448798 - DNA, 22 bp, Homo sapiens
gcacctttggaaacaacattta

SEQ ID NO: 3448799 - DNA, 18 bp, Homo sapiens
gcacggtacaaacccaaa

SEQ ID NO: 3448800 - DNA, 14 bp, Homo sapiens
gcactaaggggccc

SEQ ID NO: 3448801 - DNA, 20 bp, Homo sapiens
gcactaaggtgtgctctgat

SEQ ID NO: 3448802 - DNA, 16 bp, Homo sapiens
gcactacattcattta

SEQ ID NO: 3448803 - DNA, 21 bp, Homo sapiens
gcactaccactcctgccaagg

SEQ ID NO: 3448804 - DNA, 17 bp, Homo sapiens
gcactatgctttccttc

SEQ ID NO: 3448805 - DNA, 16 bp, Homo sapiens
gcactcagaagacact

SEQ ID NO: 3448806 - DNA, 20 bp, Homo sapiens
gcactcagaagacactgatg

SEQ ID NO: 3448807 - DNA, 14 bp, Homo sapiens
gcactccagcctgg

SEQ ID NO: 3448808 - DNA, 14 bp, Homo sapiens
gcactccagtctgg

SEQ ID NO: 3448809 - DNA, 14 bp, Homo sapiens
gcactgccatgcag

SEQ ID NO: 3448810 - DNA, 15 bp, Homo sapiens
gcactgccatgcagg

SEQ ID NO: 3448811 - DNA, 21 bp, Homo sapiens
gcactgcccatggacaggctg

SEQ ID NO: 3448812 - DNA, 11 bp, Homo sapiens
gcactgcctga

SEQ ID NO: 3448813 - DNA, 18 bp, Homo sapiens
gcactgcctgatggacct

SEQ ID NO: 3448814 - DNA, 16 bp, Homo sapiens
gcactgcgtacaaaca

SEQ ID NO: 3448815 - DNA, 18 bp, Homo sapiens
gcactgggctcccgggcc

SEQ ID NO: 3448816 - DNA, 20 bp, Homo sapiens
gcactgtaagacgtatgtaa

SEQ ID NO: 3448817 - DNA, 14 bp, Homo sapiens
gcactgtgaaggac

SEQ ID NO: 3448818 - DNA, 18 bp, Homo sapiens
gcactgtgaaggaccctt

SEQ ID NO: 3448819 - DNA, 16 bp, Homo sapiens
gcactgtgtgctgact

SEQ ID NO: 3448820 - DNA, 20 bp, Homo sapiens
gcactgttccccctgtgcag

SEQ ID NO: 3448821 - DNA, 13 bp, Homo sapiens
gcacttccctgct

SEQ ID NO: 3448822 - DNA, 22 bp, Homo sapiens
gcacttcgggaggtcgaggcag

SEQ ID NO: 3448823 - DNA, 23 bp, Homo sapiens
gcacttctttttctcgctgtcct

SEQ ID NO: 3448824 - DNA, 16 bp, Homo sapiens
gcacttgcagactcta

SEQ ID NO: 3448825 - DNA, 23 bp, Homo sapiens
gcacttgtgattatttattattt

SEQ ID NO: 3448826 - DNA, 21 bp, Homo sapiens
gcagaaaggaaaagattcctg

SEQ ID NO: 3448827 - DNA, 16 bp, Homo sapiens
gcagaaatacagtctt

SEQ ID NO: 3448828 - DNA, 22 bp, Homo sapiens
gcagaacgaaccttggcctggg

SEQ ID NO: 3448829 - DNA, 21 bp, Homo sapiens
gcagaactaaactcatttata

SEQ ID NO: 3448830 - DNA, 16 bp, Homo sapiens
gcagaagacaaaaaga

SEQ ID NO: 3448831 - DNA, 20 bp, Homo sapiens
gcagaaggaaaaatgtgtaa

SEQ ID NO: 3448832 - DNA, 17 bp, Homo sapiens
gcagaagtaagcctcat

SEQ ID NO: 3448833 - DNA, 19 bp, Homo sapiens
gcagacacagggacttgaa

SEQ ID NO: 3448834 - DNA, 15 bp, Homo sapiens
gcagacaccttggac

SEQ ID NO: 3448835 - DNA, 16 bp, Homo sapiens
gcagacacggatctga

SEQ ID NO: 3448836 - DNA, 12 bp, Homo sapiens
gcagacaggcaa

SEQ ID NO: 3448837 - DNA, 14 bp, Homo sapiens
gcagacaggcaagc

SEQ ID NO: 3448838 - DNA, 20 bp, Homo sapiens
gcagaccacgcccgtcctgc

SEQ ID NO: 3448839 - DNA, 22 bp, Homo sapiens
gcagacctgtcaccctgcagga

SEQ ID NO: 3448840 - DNA, 23 bp, Homo sapiens
gcagactgtgtaaaatgtaatgc

SEQ ID NO: 3448841 - DNA, 21 bp, Homo sapiens
gcagagaaacttaagcaaagg

SEQ ID NO: 3448842 - DNA, 20 bp, Homo sapiens
gcagagaatgaaagggccca

SEQ ID NO: 3448843 - DNA, 21 bp, Homo sapiens
gcagagaatgaaagggcccag

SEQ ID NO: 3448844 - DNA, 13 bp, Homo sapiens
gcagagagcacag

SEQ ID NO: 3448845 - DNA, 21 bp, Homo sapiens
gcagagcattttttatgatat

SEQ ID NO: 3448846 - DNA, 14 bp, Homo sapiens
gcagagctggctct

SEQ ID NO: 3448847 - DNA, 17 bp, Homo sapiens
gcagagctggctctgag

SEQ ID NO: 3448848 - DNA, 17 bp, Homo sapiens
gcagagcttggactgga

SEQ ID NO: 3448849 - DNA, 16 bp, Homo sapiens
gaacctggaacttggg

SEQ ID NO: 3448850 - DNA, 12 bp, Homo sapiens
gaacctgtgtcc

SEQ ID NO: 3448851 - DNA, 18 bp, Homo sapiens
gaaccttctggcctccca

SEQ ID NO: 3448852 - DNA, 13 bp, Homo sapiens
gaaccttggcctg

SEQ ID NO: 3448853 - DNA, 17 bp, Homo sapiens
gaaccttggcctgggcc

SEQ ID NO: 3448854 - DNA, 13 bp, Homo sapiens
gaaccttgttatt

SEQ ID NO: 3448855 - DNA, 18 bp, Homo sapiens
gaaccttgttatttctca

SEQ ID NO: 3448856 - DNA, 22 bp, Homo sapiens
gaacggggctcttctcatttca

SEQ ID NO: 3448857 - DNA, 23 bp, Homo sapiens
gaactacaaacaaaatttctatt

SEQ ID NO: 3448858 - DNA, 16 bp, Homo sapiens
gaactcaaatggggcc

SEQ ID NO: 3448859 - DNA, 19 bp, Homo sapiens
gaactcaaatggggccaga

SEQ ID NO: 3448860 - DNA, 20 bp, Homo sapiens
gaactcaaatggggccagat

SEQ ID NO: 3448861 - DNA, 23 bp, Homo sapiens
gaactcaaatggggccagatcca

SEQ ID NO: 3448862 - DNA, 16 bp, Homo sapiens
gaactcacctggggct

SEQ ID NO: 3448863 - DNA, 22 bp, Homo sapiens
gaactcacctggggctgctggc

SEQ ID NO: 3448864 - DNA, 18 bp, Homo sapiens
gaactcagatccagggac

SEQ ID NO: 3448865 - DNA, 16 bp, Homo sapiens
gaactcatcactgtgg

SEQ ID NO: 3448866 - DNA, 17 bp, Homo sapiens
gaactcatcactgtggc

SEQ ID NO: 3448867 - DNA, 18 bp, Homo sapiens
gaactcatcactgtggct

SEQ ID NO: 3448868 - DNA, 18 bp, Homo sapiens
gaactcatccctaatgct

SEQ ID NO: 3448869 - DNA, 22 bp, Homo sapiens
gaactcatccctaatgctgcag

SEQ ID NO: 3448870 - DNA, 14 bp, Homo sapiens
gaactctgggctca

SEQ ID NO: 3448871 - DNA, 22 bp, Homo sapiens
gaactctgggctcaagcaatcc

SEQ ID NO: 3448872 - DNA, 18 bp, Homo sapiens
gaactctggtggcacagg

SEQ ID NO: 3448873 - DNA, 19 bp, Homo sapiens
gaactgagcctagctacct

SEQ ID NO: 3448874 - DNA, 12 bp, Homo sapiens
gaactgcaggcc

SEQ ID NO: 3448875 - DNA, 17 bp, Homo sapiens
gaactgcaggccctggc

SEQ ID NO: 3448876 - DNA, 21 bp, Homo sapiens
gaactgcatatgtttcgctga

SEQ ID NO: 3448877 - DNA, 19 bp, Homo sapiens
gaactgcatgctgctggac

SEQ ID NO: 3448878 - DNA, 17 bp, Homo sapiens
gaactgcttactagccc

SEQ ID NO: 3448879 - DNA, 20 bp, Homo sapiens
gaactgcttactagccctgc

SEQ ID NO: 3448880 - DNA, 14 bp, Homo sapiens
gaactggtcttcct

SEQ ID NO: 3448881 - DNA, 22 bp, Homo sapiens
gaacttgaaatatcctgcttga

SEQ ID NO: 3448882 - DNA, 15 bp, Homo sapiens
gaacttgaccctgag

SEQ ID NO: 3448883 - DNA, 15 bp, Homo sapiens
gaacttggaggcacc

SEQ ID NO: 3448884 - DNA, 22 bp, Homo sapiens
gaacttggggagttaagacctg

SEQ ID NO: 3448885 - DNA, 21 bp, Homo sapiens
gaacttgtaaaggaatttaaa

SEQ ID NO: 3448886 - DNA, 12 bp, Homo sapiens
gaactttcattt

SEQ ID NO: 3448887 - DNA, 22 bp, Homo sapiens
gaagaaaacatctattctctcc

SEQ ID NO: 3448888 - DNA, 13 bp, Homo sapiens
gaagaacggggct

SEQ ID NO: 3448889 - DNA, 20 bp, Homo sapiens
gaagaacggggctcttctca

SEQ ID NO: 3448890 - DNA, 22 bp, Homo sapiens
gaagaactgtgtttcaagttca

SEQ ID NO: 3448891 - DNA, 18 bp, Homo sapiens
gaagaaggggacaatggc

SEQ ID NO: 3448892 - DNA, 14 bp, Homo sapiens
gaagacaattgaca

SEQ ID NO: 3448893 - DNA, 21 bp, Homo sapiens
gaagacactgatgggcaaccc

SEQ ID NO: 3448894 - DNA, 16 bp, Homo sapiens
gaagactcattcttct

SEQ ID NO: 3448895 - DNA, 17 bp, Homo sapiens
gaagactcattcttctg

SEQ ID NO: 3448896 - DNA, 15 bp, Homo sapiens
gaagactggaagcta

SEQ ID NO: 3448897 - DNA, 19 bp, Homo sapiens
gaagacttaaaagagctca

SEQ ID NO: 3448898 - DNA, 23 bp, Homo sapiens
gaagagaaaaaggctgaaaagaa

SEQ ID NO: 3448899 - DNA, 12 bp, Homo sapiens
gaagagaaacca

SEQ ID NO: 3448900 - DNA, 15 bp, Homo sapiens
gaagagaaggggaga

SEQ ID NO: 3448901 - DNA, 16 bp, Homo sapiens
gaagagaaggggagaa

SEQ ID NO: 3448902 - DNA, 18 bp, Homo sapiens
gaagagcaggactccagg

SEQ ID NO: 3448903 - DNA, 22 bp, Homo sapiens
gaagagcaggactccaggccca

SEQ ID NO: 3448904 - DNA, 17 bp, Homo sapiens
gaagagcccagtctgtt

SEQ ID NO: 3448905 - DNA, 12 bp, Homo sapiens
gaagagccttgc

SEQ ID NO: 3448906 - DNA, 12 bp, Homo sapiens
gaagaggaacca

SEQ ID NO: 3448907 - DNA, 18 bp, Homo sapiens
gaagagggtgtgtttgaa

SEQ ID NO: 3448908 - DNA, 20 bp, Homo sapiens
gaagataatattaaggaaga

SEQ ID NO: 3448909 - DNA, 22 bp, Homo sapiens
gaagatataactattgcccagg

SEQ ID NO: 3448910 - DNA, 17 bp, Homo sapiens
gaagatcctaaaacaaa

SEQ ID NO: 3448911 - DNA, 14 bp, Homo sapiens
gaagatcctgtgag

SEQ ID NO: 3448912 - DNA, 19 bp, Homo sapiens
gaagatctctgcagggccg

SEQ ID NO: 3448913 - DNA, 13 bp, Homo sapiens
gaagatctgtaat

SEQ ID NO: 3448914 - DNA, 14 bp, Homo sapiens
gaagcaaggcggtg

SEQ ID NO: 3448915 - DNA, 13 bp, Homo sapiens
gaagcacagcttc

SEQ ID NO: 3448916 - DNA, 14 bp, Homo sapiens
gaagcacagcttca

SEQ ID NO: 3448917 - DNA, 18 bp, Homo sapiens
gaagcactgggatcacag

SEQ ID NO: 3448918 - DNA, 23 bp, Homo sapiens
gaagcagatgcaaagaggcaaga

SEQ ID NO: 3448919 - DNA, 22 bp, Homo sapiens
gaagcagcctctccccaggtcc

SEQ ID NO: 3448920 - DNA, 18 bp, Homo sapiens
gaagcatttactttgtgt

SEQ ID NO: 3448921 - DNA, 18 bp, Homo sapiens
gaagccaattcagacagg

SEQ ID NO: 3448922 - DNA, 15 bp, Homo sapiens
gaagccacaggcctg

SEQ ID NO: 3448923 - DNA, 19 bp, Homo sapiens
gaagccaggaatttcccag

SEQ ID NO: 3448924 - DNA, 16 bp, Homo sapiens
gaagccgtgccctgcc

SEQ ID NO: 3448925 - DNA, 21 bp, Homo sapiens
gaagcctctgggtcagtggtc

SEQ ID NO: 3448926 - DNA, 13 bp, Homo sapiens
gaagcctggaaca

SEQ ID NO: 3448927 - DNA, 19 bp, Homo sapiens
gaagcctttactgaccctg

SEQ ID NO: 3448928 - DNA, 23 bp, Homo sapiens
gaagcgaaaggggatggagtgag

SEQ ID NO: 3448929 - DNA, 15 bp, Homo sapiens
gaagctaatgaccaa

SEQ ID NO: 3448930 - DNA, 17 bp, Homo sapiens
gaagctaatttgcatta

SEQ ID NO: 3448931 - DNA, 15 bp, Homo sapiens
gaagctcattcccaa

SEQ ID NO: 3448932 - DNA, 18 bp, Homo sapiens
gaagctcattcccaacgt

SEQ ID NO: 3448933 - DNA, 19 bp, Homo sapiens
gaagctcctctccccagcc

SEQ ID NO: 3448934 - DNA, 23 bp, Homo sapiens
gaagctcctctccccagcccaga

SEQ ID NO: 3448935 - DNA, 21 bp, Homo sapiens
gaagcttgttgaaaacccaga

SEQ ID NO: 3448936 - DNA, 12 bp, Homo sapiens
gaaggaaaagaa

SEQ ID NO: 3448937 - DNA, 21 bp, Homo sapiens
gaaggaacttgtctcttcatc

SEQ ID NO: 3448938 - DNA, 19 bp, Homo sapiens
gaaggaatatatggcagag

SEQ ID NO: 3448939 - DNA, 19 bp, Homo sapiens
gaaggaccctgtgccctcc

SEQ ID NO: 3448940 - DNA, 15 bp, Homo sapiens
gaaggatgtacattt

SEQ ID NO: 3448941 - DNA, 17 bp, Homo sapiens
gaaggcagagaaaggga

SEQ ID NO: 3448942 - DNA, 18 bp, Homo sapiens
gaaggccctgctgagtca

SEQ ID NO: 3448943 - DNA, 21 bp, Homo sapiens
gaaggccgctgccccagcccc

SEQ ID NO: 3448944 - DNA, 23 bp, Homo sapiens
gaaggctcttctccccagagttc

SEQ ID NO: 3448945 - DNA, 14 bp, Homo sapiens
gaaggctggcatga

SEQ ID NO: 3448946 - DNA, 18 bp, Homo sapiens
gaaggctggcatgatcca

SEQ ID NO: 3448947 - DNA, 13 bp, Homo sapiens
gaagggaggtggc

SEQ ID NO: 3448948 - DNA, 16 bp, Homo sapiens
gaagggccagagccag

SEQ ID NO: 3448949 - DNA, 18 bp, Homo sapiens
gaagggccagagccaggg

SEQ ID NO: 3448950 - DNA, 21 bp, Homo sapiens
gaagggctgaaccctcagcct

SEQ ID NO: 3448951 - DNA, 16 bp, Homo sapiens
gaaggggccagaggct

SEQ ID NO: 3448952 - DNA, 19 bp, Homo sapiens
gaagggggctcttttactg

SEQ ID NO: 3448953 - DNA, 19 bp, Homo sapiens
gaagggggtggtgtctcca

SEQ ID NO: 3448954 - DNA, 18 bp, Homo sapiens
gaaggtgcctgccatagc

SEQ ID NO: 3448955 - DNA, 23 bp, Homo sapiens
gaaggtgcctgccatagccagga

SEQ ID NO: 3448956 - DNA, 18 bp, Homo sapiens
gaaggtgctgacggccag

SEQ ID NO: 3448957 - DNA, 19 bp, Homo sapiens
gaaggtgctgacggccagg

SEQ ID NO: 3448958 - DNA, 22 bp, Homo sapiens
gaaggttggtgaatttcacaag

SEQ ID NO: 3448959 - DNA, 15 bp, Homo sapiens
gaagtcaaagcaagg

SEQ ID NO: 3448960 - DNA, 16 bp, Homo sapiens
gaagtcaaagcaagga

SEQ ID NO: 3448961 - DNA, 18 bp, Homo sapiens
gaagtcgtcttaactcac

SEQ ID NO: 3448962 - DNA, 17 bp, Homo sapiens
gaagtctggtcagagcc

SEQ ID NO: 3448963 - DNA, 15 bp, Homo sapiens
gaagtgccatctcaa

SEQ ID NO: 3448964 - DNA, 15 bp, Homo sapiens
gaagtgtaggcagac

SEQ ID NO: 3448965 - DNA, 22 bp, Homo sapiens
gaagttgttactaactaaactc

SEQ ID NO: 3448966 - DNA, 12 bp, Homo sapiens
gaagtttgaatg

SEQ ID NO: 3448967 - DNA, 17 bp, Homo sapiens
gaagtttgaatgttaaa

SEQ ID NO: 3448968 - DNA, 20 bp, Homo sapiens
gaagtttgaatgttaaataa

SEQ ID NO: 3448969 - DNA, 23 bp, Homo sapiens
gaataaaatgttgaaaagtcaaa

SEQ ID NO: 3448970 - DNA, 11 bp, Homo sapiens
gaataaagaat

SEQ ID NO: 3448971 - DNA, 19 bp, Homo sapiens
gaataaagaatacttgaac

SEQ ID NO: 3448972 - DNA, 22 bp, Homo sapiens
gaataaataaatgtatcttatt

SEQ ID NO: 3448973 - DNA, 16 bp, Homo sapiens
gaataagtgtctttct

SEQ ID NO: 3448974 - DNA, 17 bp, Homo sapiens
gaataatacagtatctc

SEQ ID NO: 3448975 - DNA, 19 bp, Homo sapiens
gaataatttatagtaatga

SEQ ID NO: 3448976 - DNA, 22 bp, Homo sapiens
gaatacaagatattatgtataa

SEQ ID NO: 3448977 - DNA, 14 bp, Homo sapiens
gaatactttttaca

SEQ ID NO: 3448978 - DNA, 23 bp, Homo sapiens
gaatagctgggactacaggtgtg

SEQ ID NO: 3448979 - DNA, 16 bp, Homo sapiens
gaataggcgatcacaa

SEQ ID NO: 3448980 - DNA, 22 bp, Homo sapiens
gaataggcgatcacaacgtgca

SEQ ID NO: 3448981 - DNA, 16 bp, Homo sapiens
gaatataatactgtat

SEQ ID NO: 3448982 - DNA, 20 bp, Homo sapiens
gaatatagcatctttcatat

SEQ ID NO: 3448983 - DNA, 21 bp, Homo sapiens
gaatatatggcagagttgtaa

SEQ ID NO: 3448984 - DNA, 16 bp, Homo sapiens
gaatatatttaagcaa

SEQ ID NO: 3448985 - DNA, 13 bp, Homo sapiens
gaatatcaatata

SEQ ID NO: 3448986 - DNA, 13 bp, Homo sapiens
gaatatcatcttt

SEQ ID NO: 3448987 - DNA, 19 bp, Homo sapiens
gaatatccatgtacttgtt

SEQ ID NO: 3448988 - DNA, 12 bp, Homo sapiens
gaatatgtctgc

SEQ ID NO: 3448989 - DNA, 18 bp, Homo sapiens
gaatatttattacctctg

SEQ ID NO: 3448990 - DNA, 19 bp, Homo sapiens
gaatatttattacctctga

SEQ ID NO: 3448991 - DNA, 11 bp, Homo sapiens
gaatatttgaa

SEQ ID NO: 3448992 - DNA, 16 bp, Homo sapiens
gaatatttgaatcttg

SEQ ID NO: 3448993 - DNA, 14 bp, Homo sapiens
gaatattttatctt

SEQ ID NO: 3448994 - DNA, 17 bp, Homo sapiens
gaatcatgagcctgctg

SEQ ID NO: 3448995 - DNA, 19 bp, Homo sapiens
gaatcatgagcctgctgga

SEQ ID NO: 3448996 - DNA, 20 bp, Homo sapiens
gaatcatgagcctgctggaa

SEQ ID NO: 3448997 - DNA, 22 bp, Homo sapiens
gaatcatttctatttctcctcc

SEQ ID NO: 3448998 - DNA, 20 bp, Homo sapiens
gaatccctagactttaggct

SEQ ID NO: 3448999 - DNA, 16 bp, Homo sapiens
gaatctacccaaagga

SEQ ID NO: 3449000 - DNA, 17 bp, Homo sapiens
gaatctacccaaaggat

SEQ ID NO: 3449001 - DNA, 19 bp, Homo sapiens
gaatctcaagatgggggca

SEQ ID NO: 3449002 - DNA, 23 bp, Homo sapiens
gaatctcagttgattttctggat

SEQ ID NO: 3449003 - DNA, 21 bp, Homo sapiens
gaatctgaggcatcctctgac

SEQ ID NO: 3449004 - DNA, 13 bp, Homo sapiens
gaatctgctcact

SEQ ID NO: 3449005 - DNA, 18 bp, Homo sapiens
gaatctggagaccaggga

SEQ ID NO: 3449006 - DNA, 20 bp, Homo sapiens
gaatctgtgggtctgggagt

SEQ ID NO: 3449007 - DNA, 21 bp, Homo sapiens
gaatcttaaggtgtagccaca

SEQ ID NO: 3449008 - DNA, 22 bp, Homo sapiens
gaatcttaaggtgtagccacac

SEQ ID NO: 3449009 - DNA, 20 bp, Homo sapiens
gaatcttggtttgccttcca

SEQ ID NO: 3449010 - DNA, 20 bp, Homo sapiens
gaatcttgtctcaatgctca

SEQ ID NO: 3449011 - DNA, 19 bp, Homo sapiens
gaatctttaaaagatgctt

SEQ ID NO: 3449012 - DNA, 15 bp, Homo sapiens
gaatgaaaaaacagt

SEQ ID NO: 3449013 - DNA, 19 bp, Homo sapiens
gaatgagaagtagccacag

SEQ ID NO: 3449014 - DNA, 17 bp, Homo sapiens
gaatgagaatgtgccat

SEQ ID NO: 3449015 - DNA, 19 bp, Homo sapiens
gaatgagagcgacacagac

SEQ ID NO: 3449016 - DNA, 15 bp, Homo sapiens
gaatgatatgcattt

SEQ ID NO: 3449017 - DNA, 21 bp, Homo sapiens
gaatgatcaagtcctttgtga

SEQ ID NO: 3449018 - DNA, 23 bp, Homo sapiens
gaatgatgctcaaaatctttcca

SEQ ID NO: 3449019 - DNA, 14 bp, Homo sapiens
gaatgcattttgtt

SEQ ID NO: 3449020 - DNA, 21 bp, Homo sapiens
gaatgccactgccttcgcttc

SEQ ID NO: 3449021 - DNA, 20 bp, Homo sapiens
gaatgccagtgtgctgatgg

SEQ ID NO: 3449022 - DNA, 18 bp, Homo sapiens
gaatgccgcgatgggtca

SEQ ID NO: 3449023 - DNA, 14 bp, Homo sapiens
gaatgctgggactc

SEQ ID NO: 3449024 - DNA, 18 bp, Homo sapiens
gaatgcttataggtggcc

SEQ ID NO: 3449025 - DNA, 13 bp, Homo sapiens
gaatggcagctgc

SEQ ID NO: 3449026 - DNA, 16 bp, Homo sapiens
gaatggcagctgccac

SEQ ID NO: 3449027 - DNA, 23 bp, Homo sapiens
gaatgggaggttgatcagatctg

SEQ ID NO: 3449028 - DNA, 17 bp, Homo sapiens
gaatgggatcatgaaag

SEQ ID NO: 3449029 - DNA, 21 bp, Homo sapiens
gaatgggatcatgaaagtaga

SEQ ID NO: 3449030 - DNA, 11 bp, Homo sapiens
gaatgtaacca

SEQ ID NO: 3449031 - DNA, 13 bp, Homo sapiens
gaatgtaaccaat

SEQ ID NO: 3449032 - DNA, 21 bp, Homo sapiens
gaatgtatatgttttgtggga

SEQ ID NO: 3449033 - DNA, 23 bp, Homo sapiens
gaatgtatttatttgggagaccg

SEQ ID NO: 3449034 - DNA, 19 bp, Homo sapiens
gaatgtgataaggaaatca

SEQ ID NO: 3449035 - DNA, 13 bp, Homo sapiens
gaatgtgccatgt

SEQ ID NO: 3449036 - DNA, 18 bp, Homo sapiens
gaatgttaaataaattgt

SEQ ID NO: 3449037 - DNA, 13 bp, Homo sapiens
gaatgttaatttt

SEQ ID NO: 3449038 - DNA, 22 bp, Homo sapiens
gaatgttaattttttggtacaa

SEQ ID NO: 3449039 - DNA, 20 bp, Homo sapiens
gaatgttacattgtttgtct

SEQ ID NO: 3449040 - DNA, 20 bp, Homo sapiens
gaatgttgattacagtgcag

SEQ ID NO: 3449041 - DNA, 20 bp, Homo sapiens
gaatgttggataaggaatta

SEQ ID NO: 3449042 - DNA, 15 bp, Homo sapiens
gaatgtttgcctctg

SEQ ID NO: 3449043 - DNA, 18 bp, Homo sapiens
gaatgtttgcctctgcct

SEQ ID NO: 3449044 - DNA, 19 bp, Homo sapiens
gaatgtttgcctctgcctc

SEQ ID NO: 3449045 - DNA, 15 bp, Homo sapiens
gaatgttttaaattc

SEQ ID NO: 3449046 - DNA, 21 bp, Homo sapiens
gaattacatgtaaaacattat

SEQ ID NO: 3449047 - DNA, 20 bp, Homo sapiens
gaattaccctttcattcagc

SEQ ID NO: 3449048 - DNA, 15 bp, Homo sapiens
gaattagctgcttct

SEQ ID NO: 3449049 - DNA, 16 bp, Homo sapiens
gaattcaaactggggc

SEQ ID NO: 3449050 - DNA, 20 bp, Homo sapiens
gaattcattccccagctcca

SEQ ID NO: 3449051 - DNA, 15 bp, Homo sapiens
gaattccaaagcaaa

SEQ ID NO: 3449052 - DNA, 17 bp, Homo sapiens
gaattcggtgtgcacca

SEQ ID NO: 3449053 - DNA, 18 bp, Homo sapiens
gaattcttacatgttttc

SEQ ID NO: 3449054 - DNA, 19 bp, Homo sapiens
gaattcttacatgttttct

SEQ ID NO: 3449055 - DNA, 14 bp, Homo sapiens
gaattgaagcagga

SEQ ID NO: 3449056 - DNA, 13 bp, Homo sapiens
gaattgatttgca

SEQ ID NO: 3449057 - DNA, 14 bp, Homo sapiens
gaattgatttgcat

SEQ ID NO: 3449058 - DNA, 15 bp, Homo sapiens
gaattgatttgcatt

SEQ ID NO: 3449059 - DNA, 18 bp, Homo sapiens
gaattgatttgcattgaa

SEQ ID NO: 3449060 - DNA, 14 bp, Homo sapiens
gaattgcagagtac

SEQ ID NO: 3449061 - DNA, 22 bp, Homo sapiens
gaattggcaaacccactgcagc

SEQ ID NO: 3449062 - DNA, 17 bp, Homo sapiens
gaattgggcggctctga

SEQ ID NO: 3449063 - DNA, 16 bp, Homo sapiens
gaattgtaactgttct

SEQ ID NO: 3449064 - DNA, 12 bp, Homo sapiens
gaattgttacat

SEQ ID NO: 3449065 - DNA, 19 bp, Homo sapiens
gaatttaggtttttattag

SEQ ID NO: 3449066 - DNA, 19 bp, Homo sapiens
gaatttctgtgccctcctg

SEQ ID NO: 3449067 - DNA, 14 bp, Homo sapiens
gaatttgcaaagta

SEQ ID NO: 3449068 - DNA, 18 bp, Homo sapiens
gaatttgcaaagtactgt

SEQ ID NO: 3449069 - DNA, 21 bp, Homo sapiens
gaatttgtgttgaaggaactt

SEQ ID NO: 3449070 - DNA, 15 bp, Homo sapiens
gaattttcaaggcct

SEQ ID NO: 3449071 - DNA, 16 bp, Homo sapiens
gaattttgttctctgg

SEQ ID NO: 3449072 - DNA, 18 bp, Homo sapiens
gaattttgttctctggga

SEQ ID NO: 3449073 - DNA, 14 bp, Homo sapiens
gaatttttaaaata

SEQ ID NO: 3449074 - DNA, 20 bp, Homo sapiens
gaatttttaaaataaactgt

SEQ ID NO: 3449075 - DNA, 14 bp, Homo sapiens
gaatttttcctatg

SEQ ID NO: 3449076 - DNA, 22 bp, Homo sapiens
gaatttttcctatgctattgac

SEQ ID NO: 3449077 - DNA, 14 bp, Homo sapiens
gaatttttctctaa

SEQ ID NO: 3449078 - DNA, 14 bp, Homo sapiens
gaatttttgcaata

SEQ ID NO: 3449079 - DNA, 17 bp, Homo sapiens
gaatttttgcaataatg

SEQ ID NO: 3449080 - DNA, 15 bp, Homo sapiens
gaatttttttctgca

SEQ ID NO: 3449081 - DNA, 16 bp, Homo sapiens
gaatttttttctgcac

SEQ ID NO: 3449082 - DNA, 19 bp, Homo sapiens
gaattttttttaatgctta

SEQ ID NO: 3449083 - DNA, 21 bp, Homo sapiens
gacaaagaattccaaagcaaa

SEQ ID NO: 3449084 - DNA, 21 bp, Homo sapiens
gacaaagacaaattctgtttc

SEQ ID NO: 3449085 - DNA, 16 bp, Homo sapiens
gacaaatgtaaacatt

SEQ ID NO: 3449086 - DNA, 12 bp, Homo sapiens
gacaaattctgt

SEQ ID NO: 3449087 - DNA, 12 bp, Homo sapiens
gacaaccatgac

SEQ ID NO: 3449088 - DNA, 14 bp, Homo sapiens
gacaacgaggaagc

SEQ ID NO: 3449089 - DNA, 16 bp, Homo sapiens
gacaactggcaggcag

SEQ ID NO: 3449090 - DNA, 17 bp, Homo sapiens
gacaactggcaggcagg

SEQ ID NO: 3449091 - DNA, 16 bp, Homo sapiens
gacaagacccccagca

SEQ ID NO: 3449092 - DNA, 20 bp, Homo sapiens
gacaagacttcagtatgttg

SEQ ID NO: 3449093 - DNA, 12 bp, Homo sapiens
gacaagagggaa

SEQ ID NO: 3449094 - DNA, 19 bp, Homo sapiens
gacaaggaaaggcaaatgc

SEQ ID NO: 3449095 - DNA, 19 bp, Homo sapiens
gacaaggagaagagcaagg

SEQ ID NO: 3449096 - DNA, 13 bp, Homo sapiens
gacaataatttca

SEQ ID NO: 3449097 - DNA, 21 bp, Homo sapiens
gacaatatgtgccaatcaata

SEQ ID NO: 3449098 - DNA, 18 bp, Homo sapiens
gacaatgtgaaaagaaaa

SEQ ID NO: 3449099 - DNA, 19 bp, Homo sapiens
gacaatgtgaaaagaaaaa

SEQ ID NO: 3449100 - DNA, 14 bp, Homo sapiens
gacacaacaactcc

SEQ ID NO: 3449101 - DNA, 15 bp, Homo sapiens
gacacacagctctgt

SEQ ID NO: 3449102 - DNA, 21 bp, Homo sapiens
gacacagaaaatgttgagaat

SEQ ID NO: 3449103 - DNA, 21 bp, Homo sapiens
gacacagctcttctccaggct

SEQ ID NO: 3449104 - DNA, 20 bp, Homo sapiens
gacacaggatgaaggcaatg

SEQ ID NO: 3449105 - DNA, 18 bp, Homo sapiens
gacacaggcccggctcca

SEQ ID NO: 3449106 - DNA, 20 bp, Homo sapiens
gacacaggcccggctccagg

SEQ ID NO: 3449107 - DNA, 18 bp, Homo sapiens
gacacagggacttgaagt

SEQ ID NO: 3449108 - DNA, 19 bp, Homo sapiens
gacacagggacttgaagtt

SEQ ID NO: 3449109 - DNA, 20 bp, Homo sapiens
gacacagggacttgaagttg

SEQ ID NO: 3449110 - DNA, 21 bp, Homo sapiens
gacacagggacttgaagttgt

SEQ ID NO: 3449111 - DNA, 16 bp, Homo sapiens
gacacaggtctttcct

SEQ ID NO: 3449112 - DNA, 17 bp, Homo sapiens
gacacaggtctttccta

SEQ ID NO: 3449113 - DNA, 16 bp, Homo sapiens
gacacatatgaggggg

SEQ ID NO: 3449114 - DNA, 17 bp, Homo sapiens
gacacatgctatgttct

SEQ ID NO: 3449115 - DNA, 19 bp, Homo sapiens
gacacctggccgcctccag

SEQ ID NO: 3449116 - DNA, 21 bp, Homo sapiens
gacacctggccgcctccagga

SEQ ID NO: 3449117 - DNA, 14 bp, Homo sapiens
gacaccttggacat

SEQ ID NO: 3449118 - DNA, 15 bp, Homo sapiens
gacacggagcccagc

SEQ ID NO: 3449119 - DNA, 15 bp, Homo sapiens
gacactaaccacgct

SEQ ID NO: 3449120 - DNA, 18 bp, Homo sapiens
gacactaaccacgctgga

SEQ ID NO: 3449121 - DNA, 13 bp, Homo sapiens
gacactgatgggc

SEQ ID NO: 3449122 - DNA, 15 bp, Homo sapiens
gacactgatgggcaa

SEQ ID NO: 3449123 - DNA, 17 bp, Homo sapiens
gacactgggaggccagt

SEQ ID NO: 3449124 - DNA, 20 bp, Homo sapiens
gacactggggtctgtttctg

SEQ ID NO: 3449125 - DNA, 20 bp, Homo sapiens
gacactggtattcctgcctc

SEQ ID NO: 3449126 - DNA, 20 bp, Homo sapiens
gacacttaatactaccttga

SEQ ID NO: 3449127 - DNA, 17 bp, Homo sapiens
gacacttccattgttta

SEQ ID NO: 3449128 - DNA, 19 bp, Homo sapiens
gacacttttttgagtggat

SEQ ID NO: 3449129 - DNA, 15 bp, Homo sapiens
gacagaaagagacac

SEQ ID NO: 3449130 - DNA, 12 bp, Homo sapiens
gacagaaagcag

SEQ ID NO: 3449131 - DNA, 13 bp, Homo sapiens
gacagaaagcagt

SEQ ID NO: 3449132 - DNA, 13 bp, Homo sapiens
gacagaccttcac

SEQ ID NO: 3449133 - DNA, 18 bp, Homo sapiens
gacagaccttcacagatg

SEQ ID NO: 3449134 - DNA, 16 bp, Homo sapiens
gacagagaggactgta

SEQ ID NO: 3449135 - DNA, 19 bp, Homo sapiens
gacagagaggactgtaggg

SEQ ID NO: 3449136 - DNA, 16 bp, Homo sapiens
gacagaggcagcccca

SEQ ID NO: 3449137 - DNA, 23 bp, Homo sapiens
gacagaggcagccccattctgcc

SEQ ID NO: 3449138 - DNA, 13 bp, Homo sapiens
gacagagggaaga

SEQ ID NO: 3449139 - DNA, 16 bp, Homo sapiens
gacagagtgagactct

SEQ ID NO: 3449140 - DNA, 20 bp, Homo sapiens
gacagagtgagactctgtct

SEQ ID NO: 3449141 - DNA, 22 bp, Homo sapiens
gacagagtgagactctgtctca

SEQ ID NO: 3449142 - DNA, 17 bp, Homo sapiens
gacagccaaaggctggc

SEQ ID NO: 3449143 - DNA, 18 bp, Homo sapiens
gacagccacggccaggcc

SEQ ID NO: 3449144 - DNA, 20 bp, Homo sapiens
gacagccacggccaggccag

SEQ ID NO: 3449145 - DNA, 16 bp, Homo sapiens
gacagccagagcctgt

SEQ ID NO: 3449146 - DNA, 17 bp, Homo sapiens
gacagccagagcctgtc

SEQ ID NO: 3449147 - DNA, 17 bp, Homo sapiens
gacagctccttctgtcc

SEQ ID NO: 3449148 - DNA, 11 bp, Homo sapiens
gacagctgctc

SEQ ID NO: 3449149 - DNA, 14 bp, Homo sapiens
gacagctgctccta

SEQ ID NO: 3449150 - DNA, 12 bp, Homo sapiens
gacagctttgct

SEQ ID NO: 3449151 - DNA, 18 bp, Homo sapiens
gacaggatgtgtttgctt

SEQ ID NO: 3449152 - DNA, 16 bp, Homo sapiens
gacaggcaaataaaag

SEQ ID NO: 3449153 - DNA, 17 bp, Homo sapiens
gacaggcaagcacctcc

SEQ ID NO: 3449154 - DNA, 18 bp, Homo sapiens
gacaggcaatgctggctg

SEQ ID NO: 3449155 - DNA, 11 bp, Homo sapiens
gacaggcagtt

SEQ ID NO: 3449156 - DNA, 18 bp, Homo sapiens
gacaggcagtttcagaga

SEQ ID NO: 3449157 - DNA, 20 bp, Homo sapiens
gacaggctcttctttcccaa

SEQ ID NO: 3449158 - DNA, 21 bp, Homo sapiens
gacaggctggctccagatgca

SEQ ID NO: 3449159 - DNA, 22 bp, Homo sapiens
gacaggctggctccagatgcag

SEQ ID NO: 3449160 - DNA, 16 bp, Homo sapiens
gacagggaggtgaccc

SEQ ID NO: 3449161 - DNA, 21 bp, Homo sapiens
gacagggatgagcatggagct

SEQ ID NO: 3449162 - DNA, 23 bp, Homo sapiens
gacagggatgagcatggagctgg

SEQ ID NO: 3449163 - DNA, 14 bp, Homo sapiens
gacaggggattggc

SEQ ID NO: 3449164 - DNA, 20 bp, Homo sapiens
gacagggtttggctgtgtct

SEQ ID NO: 3449165 - DNA, 17 bp, Homo sapiens
gacagtccagcctggag

SEQ ID NO: 3449166 - DNA, 19 bp, Homo sapiens
gacagtccagcctggagat

SEQ ID NO: 3449167 - DNA, 23 bp, Homo sapiens
gacagtctgctctagatgagctg

SEQ ID NO: 3449168 - DNA, 21 bp, Homo sapiens
gacagtgctgcagctccctgg

SEQ ID NO: 3449169 - DNA, 22 bp, Homo sapiens
gacagtgctgcagctccctggc

SEQ ID NO: 3449170 - DNA, 24 bp, Homo sapiens
gacagtgtgggacaggctcttctt

SEQ ID NO: 3449171 - DNA, 19 bp, Homo sapiens
gacagttgggtgagaacaa

SEQ ID NO: 3449172 - DNA, 17 bp, Homo sapiens
gacatacttgaagggcc

SEQ ID NO: 3449173 - DNA, 23 bp, Homo sapiens
gacatacttgaagggccagagcc

SEQ ID NO: 3449174 - DNA, 23 bp, Homo sapiens
gacatccccccgccaaaagctgc

SEQ ID NO: 3449175 - DNA, 15 bp, Homo sapiens
gacatcctcctccca

SEQ ID NO: 3449176 - DNA, 18 bp, Homo sapiens
gacatctggaatctggag

SEQ ID NO: 3449177 - DNA, 19 bp, Homo sapiens
gacatgagtgcgtgctcag

SEQ ID NO: 3449178 - DNA, 16 bp, Homo sapiens
gacatgattccttcct

SEQ ID NO: 3449179 - DNA, 19 bp, Homo sapiens
gacatgatttccttgaatg

SEQ ID NO: 3449180 - DNA, 19 bp, Homo sapiens
gacatgcggtagccagcac

SEQ ID NO: 3449181 - DNA, 22 bp, Homo sapiens
gacatgcggtagccagcacaca

SEQ ID NO: 3449182 - DNA, 20 bp, Homo sapiens
gacattagtaacataataaa

SEQ ID NO: 3449183 - DNA, 23 bp, Homo sapiens
gacattagtaacataataaatta

SEQ ID NO: 3449184 - DNA, 16 bp, Homo sapiens
gacattcacctgcccc

SEQ ID NO: 3449185 - DNA, 21 bp, Homo sapiens
gacattcacctgccccaactc

SEQ ID NO: 3449186 - DNA, 21 bp, Homo sapiens
gacattccttctcccatctct

SEQ ID NO: 3449187 - DNA, 20 bp, Homo sapiens
gacattctcgcttccctgaa

SEQ ID NO: 3449188 - DNA, 17 bp, Homo sapiens
gacattctgccaggccc

SEQ ID NO: 3449189 - DNA, 18 bp, Homo sapiens
gacattgccaaaaaggat

SEQ ID NO: 3449190 - DNA, 15 bp, Homo sapiens
gacattgcggacagc

SEQ ID NO: 3449191 - DNA, 23 bp, Homo sapiens
gacattggcacctaatccaggca

SEQ ID NO: 3449192 - DNA, 16 bp, Homo sapiens
gacatttggagagggg

SEQ ID NO: 3449193 - DNA, 11 bp, Homo sapiens
gacattttatt

SEQ ID NO: 3449194 - DNA, 14 bp, Homo sapiens
gacattttcttttt

SEQ ID NO: 3449195 - DNA, 14 bp, Homo sapiens
gaccaactgtcact

SEQ ID NO: 3449196 - DNA, 15 bp, Homo sapiens
gaccaagcaggaagc

SEQ ID NO: 3449197 - DNA, 16 bp, Homo sapiens
gaccaagcaggaagct

SEQ ID NO: 3449198 - DNA, 19 bp, Homo sapiens
gaccaagcaggaagctcag

SEQ ID NO: 3449199 - DNA, 15 bp, Homo sapiens
gaccacagcacagcc

SEQ ID NO: 3449200 - DNA, 16 bp, Homo sapiens
gaccacagcacagcca

SEQ ID NO: 3449201 - DNA, 22 bp, Homo sapiens
gaccaccaccccaacaaaccat

SEQ ID NO: 3449202 - DNA, 22 bp, Homo sapiens
gaccacgcccgtcctgcctgtg

SEQ ID NO: 3449203 - DNA, 14 bp, Homo sapiens
gaccacgctttcta

SEQ ID NO: 3449204 - DNA, 21 bp, Homo sapiens
gaccagacaccttgacagggc

SEQ ID NO: 3449205 - DNA, 23 bp, Homo sapiens
gaccagacaccttgacagggcac

SEQ ID NO: 3449206 - DNA, 18 bp, Homo sapiens
gaccagccgtgagcatgt

SEQ ID NO: 3449207 - DNA, 12 bp, Homo sapiens
gaccagctcagg

SEQ ID NO: 3449208 - DNA, 22 bp, Homo sapiens
gaccagctcaggacagatgcca

SEQ ID NO: 3449209 - DNA, 13 bp, Homo sapiens
gaccaggatccag

SEQ ID NO: 3449210 - DNA, 15 bp, Homo sapiens
gaccaggatccagcc

SEQ ID NO: 3449211 - DNA, 15 bp, Homo sapiens
gaccaggctgtgtcc

SEQ ID NO: 3449212 - DNA, 17 bp, Homo sapiens
gaccagtcaacctgggc

SEQ ID NO: 3449213 - DNA, 21 bp, Homo sapiens
gaccatgctcatctgctggtc

SEQ ID NO: 3449214 - DNA, 22 bp, Homo sapiens
gacccaagtagctgctaccttc

SEQ ID NO: 3449215 - DNA, 20 bp, Homo sapiens
gacccacgaaactgccctgg

SEQ ID NO: 3449216 - DNA, 11 bp, Homo sapiens
gacccactgct

SEQ ID NO: 3449217 - DNA, 15 bp, Homo sapiens
gacccagatctcatg

SEQ ID NO: 3449218 - DNA, 23 bp, Homo sapiens
gacccagccccttgagaaacctt

SEQ ID NO: 3449219 - DNA, 13 bp, Homo sapiens
gacccaggctggg

SEQ ID NO: 3449220 - DNA, 14 bp, Homo sapiens
gacccaggctgggc

SEQ ID NO: 3449221 - DNA, 16 bp, Homo sapiens
gacccagtgcccccac

SEQ ID NO: 3449222 - DNA, 20 bp, Homo sapiens
gacccagtgcccccactgac

SEQ ID NO: 3449223 - DNA, 23 bp, Homo sapiens
gacccatgagttggggtctggca

SEQ ID NO: 3449224 - DNA, 14 bp, Homo sapiens
gacccattgctgtt

SEQ ID NO: 3449225 - DNA, 17 bp, Homo sapiens
gaccccaaaggaacact

SEQ ID NO: 3449226 - DNA, 12 bp, Homo sapiens
gaccccagagga

SEQ ID NO: 3449227 - DNA, 17 bp, Homo sapiens
gaccccaggacctcttc

SEQ ID NO: 3449228 - DNA, 17 bp, Homo sapiens
gacccccagctccggcc

SEQ ID NO: 3449229 - DNA, 11 bp, Homo sapiens
gacccccgccc

SEQ ID NO: 3449230 - DNA, 16 bp, Homo sapiens
gacccccgccccctgc

SEQ ID NO: 3449231 - DNA, 18 bp, Homo sapiens
gacccctccatgtgggct

SEQ ID NO: 3449232 - DNA, 17 bp, Homo sapiens
gacccctggctctgggc

SEQ ID NO: 3449233 - DNA, 12 bp, Homo sapiens
gacccggctgcg

SEQ ID NO: 3449234 - DNA, 13 bp, Homo sapiens
gacccggctgcgt

SEQ ID NO: 3449235 - DNA, 16 bp, Homo sapiens
gaccctgaaggggcca

SEQ ID NO: 3449236 - DNA, 17 bp, Homo sapiens
gaccctgtatatagccc

SEQ ID NO: 3449237 - DNA, 23 bp, Homo sapiens
gaccctgtctcaaaaaaagaaaa

SEQ ID NO: 3449238 - DNA, 14 bp, Homo sapiens
gaccctgtgccctc

SEQ ID NO: 3449239 - DNA, 17 bp, Homo sapiens
gaccggacttttctgca

SEQ ID NO: 3449240 - DNA, 15 bp, Homo sapiens
gaccggcggctcgga

SEQ ID NO: 3449241 - DNA, 18 bp, Homo sapiens
gacctcaggtgagaagca

SEQ ID NO: 3449242 - DNA, 19 bp, Homo sapiens
gacctcaggtgatccaccc

SEQ ID NO: 3449243 - DNA, 21 bp, Homo sapiens
gacctcaggtgatccacccac

SEQ ID NO: 3449244 - DNA, 12 bp, Homo sapiens
gacctcctgcct

SEQ ID NO: 3449245 - DNA, 12 bp, Homo sapiens
gacctcttctgg

SEQ ID NO: 3449246 - DNA, 13 bp, Homo sapiens
gacctgaggctgt

SEQ ID NO: 3449247 - DNA, 15 bp, Homo sapiens
gacctgaggctgtgg

SEQ ID NO: 3449248 - DNA, 17 bp, Homo sapiens
gacctgagggacccttc

SEQ ID NO: 3449249 - DNA, 18 bp, Homo sapiens
gacctgatcctggaggcc

SEQ ID NO: 3449250 - DNA, 23 bp, Homo sapiens
gacctgatttctgagcatttaat

SEQ ID NO: 3449251 - DNA, 19 bp, Homo sapiens
gacctggtccacagggcac

SEQ ID NO: 3449252 - DNA, 23 bp, Homo sapiens
gacctgtgagcccagctgggtca

SEQ ID NO: 3449253 - DNA, 16 bp, Homo sapiens
gaccttaggccttcct

SEQ ID NO: 3449254 - DNA, 21 bp, Homo sapiens
gaccttcacagatgcctactt

SEQ ID NO: 3449255 - DNA, 18 bp, Homo sapiens
gaccttcagagccagccg

SEQ ID NO: 3449256 - DNA, 13 bp, Homo sapiens
gaccttcagctca

SEQ ID NO: 3449257 - DNA, 17 bp, Homo sapiens
gaccttcatttcatgta

SEQ ID NO: 3449258 - DNA, 16 bp, Homo sapiens
gaccttcgggctgtgc

SEQ ID NO: 3449259 - DNA, 16 bp, Homo sapiens
gaccttgttacttctg

SEQ ID NO: 3449260 - DNA, 17 bp, Homo sapiens
gacctttaactgagggc

SEQ ID NO: 3449261 - DNA, 18 bp, Homo sapiens
gacctttccaccacagcc

SEQ ID NO: 3449262 - DNA, 21 bp, Homo sapiens
gacctttccaccacagccagc

SEQ ID NO: 3449263 - DNA, 18 bp, Homo sapiens
gacctttgtacagcccag

SEQ ID NO: 3449264 - DNA, 18 bp, Homo sapiens
gaccttttgggggagggc

SEQ ID NO: 3449265 - DNA, 18 bp, Homo sapiens
gacgaggggtgtcttggg

SEQ ID NO: 3449266 - DNA, 15 bp, Homo sapiens
gacgcaggcccctct

SEQ ID NO: 3449267 - DNA, 19 bp, Homo sapiens
gacgcaggcccctctcctc

SEQ ID NO: 3449268 - DNA, 20 bp, Homo sapiens
gacgcaggcccctctcctcc

SEQ ID NO: 3449269 - DNA, 13 bp, Homo sapiens
gacgcctgaggaa

SEQ ID NO: 3449270 - DNA, 21 bp, Homo sapiens
gacgctgatccataaagacaa

SEQ ID NO: 3449271 - DNA, 13 bp, Homo sapiens
gacgcttgctctg

SEQ ID NO: 3449272 - DNA, 13 bp, Homo sapiens
gacgctttgtctg

SEQ ID NO: 3449273 - DNA, 22 bp, Homo sapiens
gacggcacggtcttccctcttc

SEQ ID NO: 3449274 - DNA, 12 bp, Homo sapiens
gacggctccact

SEQ ID NO: 3449275 - DNA, 12 bp, Homo sapiens
gacggctgggca

SEQ ID NO: 3449276 - DNA, 13 bp, Homo sapiens
gacggctgggcac

SEQ ID NO: 3449277 - DNA, 18 bp, Homo sapiens
gacggctgggcacacgcc

SEQ ID NO: 3449278 - DNA, 16 bp, Homo sapiens
gacggtgcccaagcca

SEQ ID NO: 3449279 - DNA, 23 bp, Homo sapiens
gacggtgttttgccatgttggcc

SEQ ID NO: 3449280 - DNA, 13 bp, Homo sapiens
gacgtgggctggg

SEQ ID NO: 3449281 - DNA, 20 bp, Homo sapiens
gacgtgttacccactgccat

SEQ ID NO: 3449282 - DNA, 12 bp, Homo sapiens
gactaaaagata

SEQ ID NO: 3449283 - DNA, 18 bp, Homo sapiens
gactaaaagatataagtg

SEQ ID NO: 3449284 - DNA, 21 bp, Homo sapiens
gactaaaagatataagtgctg

SEQ ID NO: 3449285 - DNA, 22 bp, Homo sapiens
gactaaaagatataagtgctgt

SEQ ID NO: 3449286 - DNA, 12 bp, Homo sapiens
gactaatttcaa

SEQ ID NO: 3449287 - DNA, 22 bp, Homo sapiens
gactaatttcaaaatgcttttt

SEQ ID NO: 3449288 - DNA, 18 bp, Homo sapiens
gactaattttacatgttt

SEQ ID NO: 3449289 - DNA, 15 bp, Homo sapiens
gactacaggcaccca

SEQ ID NO: 3449290 - DNA, 13 bp, Homo sapiens
gactacaggtgtg

SEQ ID NO: 3449291 - DNA, 19 bp, Homo sapiens
gactagagggacctctccc

SEQ ID NO: 3449292 - DNA, 19 bp, Homo sapiens
gactatatttgggcctgct

SEQ ID NO: 3449293 - DNA, 22 bp, Homo sapiens
gactatatttgggcctgctcca

SEQ ID NO: 3449294 - DNA, 18 bp, Homo sapiens
gactcaaagtttcagaga

SEQ ID NO: 3449295 - DNA, 22 bp, Homo sapiens
gactcaaatgctcagaccagct

SEQ ID NO: 3449296 - DNA, 19 bp, Homo sapiens
gactcacaacctgaaccta

SEQ ID NO: 3449297 - DNA, 16 bp, Homo sapiens
gactcagaagcctctg

SEQ ID NO: 3449298 - DNA, 19 bp, Homo sapiens
gactcagaagcctctgggt

SEQ ID NO: 3449299 - DNA, 12 bp, Homo sapiens
gactcagggctc

SEQ ID NO: 3449300 - DNA, 14 bp, Homo sapiens
gactcagggctcct

SEQ ID NO: 3449301 - DNA, 17 bp, Homo sapiens
gactcagggctcctggg

SEQ ID NO: 3449302 - DNA, 18 bp, Homo sapiens
gactcatgaggaggggcc

SEQ ID NO: 3449303 - DNA, 22 bp, Homo sapiens
gactcatgaggaggggcccccc

SEQ ID NO: 3449304 - DNA, 18 bp, Homo sapiens
gactcatggtgtgttaca

SEQ ID NO: 3449305 - DNA, 19 bp, Homo sapiens
gactcatggtgtgttacac

SEQ ID NO: 3449306 - DNA, 13 bp, Homo sapiens
gactcattctgaa

SEQ ID NO: 3449307 - DNA, 17 bp, Homo sapiens
gactcattctgaaggag

SEQ ID NO: 3449308 - DNA, 21 bp, Homo sapiens
gactccggctgtgctgggaga

SEQ ID NO: 3449309 - DNA, 16 bp, Homo sapiens
gactccgttggccact

SEQ ID NO: 3449310 - DNA, 22 bp, Homo sapiens
gactccttgagagaccaggcaa

SEQ ID NO: 3449311 - DNA, 17 bp, Homo sapiens
gactctaggtgcccttg

SEQ ID NO: 3449312 - DNA, 19 bp, Homo sapiens
gactctaggtgcccttgga

SEQ ID NO: 3449313 - DNA, 12 bp, Homo sapiens
gactctcacctg

SEQ ID NO: 3449314 - DNA, 16 bp, Homo sapiens
gactctcagtctctga

SEQ ID NO: 3449315 - DNA, 20 bp, Homo sapiens
gactctcagtctctgagcag

SEQ ID NO: 3449316 - DNA, 21 bp, Homo sapiens
gactctcgtgcatttcaactt

SEQ ID NO: 3449317 - DNA, 22 bp, Homo sapiens
gactctggaagattttcattga

SEQ ID NO: 3449318 - DNA, 14 bp, Homo sapiens
gactctgggtcctt

SEQ ID NO: 3449319 - DNA, 20 bp, Homo sapiens
gactctgggtccttcctgaa

SEQ ID NO: 3449320 - DNA, 14 bp, Homo sapiens
gactcttctctcaa

SEQ ID NO: 3449321 - DNA, 20 bp, Homo sapiens
gactctttagcaaaaaaaac

SEQ ID NO: 3449322 - DNA, 15 bp, Homo sapiens
gactgacctggtcca

SEQ ID NO: 3449323 - DNA, 19 bp, Homo sapiens
gactgacctggtccacagg

SEQ ID NO: 3449324 - DNA, 16 bp, Homo sapiens
gactgagcaccctctg

SEQ ID NO: 3449325 - DNA, 17 bp, Homo sapiens
gactgagcaccctctgg

SEQ ID NO: 3449326 - DNA, 13 bp, Homo sapiens
gactgaggcctga

SEQ ID NO: 3449327 - DNA, 14 bp, Homo sapiens
gactgaggcctgag

SEQ ID NO: 3449328 - DNA, 21 bp, Homo sapiens
gactgaggcctgagcgctcct

SEQ ID NO: 3449329 - DNA, 23 bp, Homo sapiens
gactgaggcctgagcgctcctgc

SEQ ID NO: 3449330 - DNA, 13 bp, Homo sapiens
gactgattttaat

SEQ ID NO: 3449331 - DNA, 21 bp, Homo sapiens
gactgcacagcgtcctgtcca

SEQ ID NO: 3449332 - DNA, 12 bp, Homo sapiens
gactgcagagca

SEQ ID NO: 3449333 - DNA, 13 bp, Homo sapiens
gactgcccggcag

SEQ ID NO: 3449334 - DNA, 21 bp, Homo sapiens
gactgctttggacctaaatgg

SEQ ID NO: 3449335 - DNA, 21 bp, Homo sapiens
gactggaagctaatttgcatt

SEQ ID NO: 3449336 - DNA, 15 bp, Homo sapiens
gactggccagggcca

SEQ ID NO: 3449337 - DNA, 17 bp, Homo sapiens
gactgggctctggctct

SEQ ID NO: 3449338 - DNA, 16 bp, Homo sapiens
gactgggctgagggag

SEQ ID NO: 3449339 - DNA, 23 bp, Homo sapiens
gactgggtctcgctttgttgccc

SEQ ID NO: 3449340 - DNA, 22 bp, Homo sapiens
gactgtagggagggcggcaggg

SEQ ID NO: 3449341 - DNA, 17 bp, Homo sapiens
gactgtctccacggcct

SEQ ID NO: 3449342 - DNA, 18 bp, Homo sapiens
gactgtctccatggccct

SEQ ID NO: 3449343 - DNA, 18 bp, Homo sapiens
gactgttcaagagcacac

SEQ ID NO: 3449344 - DNA, 19 bp, Homo sapiens
gactgttcaagagcacact

SEQ ID NO: 3449345 - DNA, 21 bp, Homo sapiens
gactgttggggtgggtataaa

SEQ ID NO: 3449346 - DNA, 18 bp, Homo sapiens
gactgttttctcttgaga

SEQ ID NO: 3449347 - DNA, 16 bp, Homo sapiens
gacttaactccttcca

SEQ ID NO: 3449348 - DNA, 16 bp, Homo sapiens
gacttaatagaaacat

SEQ ID NO: 3449349 - DNA, 14 bp, Homo sapiens
gacttaatgtgatt

SEQ ID NO: 3449350 - DNA, 15 bp, Homo sapiens
gacttaatgtgatta

SEQ ID NO: 3449351 - DNA, 13 bp, Homo sapiens
gacttcagtatgt

SEQ ID NO: 3449352 - DNA, 21 bp, Homo sapiens
gacttcatcaaacatgggttt

SEQ ID NO: 3449353 - DNA, 20 bp, Homo sapiens
gacttccccggagggctgcg

SEQ ID NO: 3449354 - DNA, 23 bp, Homo sapiens
gacttccccggagggctgcggcg

SEQ ID NO: 3449355 - DNA, 15 bp, Homo sapiens
gacttcccctgcctc

SEQ ID NO: 3449356 - DNA, 19 bp, Homo sapiens
gacttcctgactctcacct

SEQ ID NO: 3449357 - DNA, 22 bp, Homo sapiens
gacttcctgtccagctccaacc

SEQ ID NO: 3449358 - DNA, 17 bp, Homo sapiens
gacttgaactttcctgg

SEQ ID NO: 3449359 - DNA, 20 bp, Homo sapiens
gacttgccacccccagttcc

SEQ ID NO: 3449360 - DNA, 13 bp, Homo sapiens
gacttggaagctc

SEQ ID NO: 3449361 - DNA, 18 bp, Homo sapiens
gacttgttttatgctcag

SEQ ID NO: 3449362 - DNA, 18 bp, Homo sapiens
gacttgtttttgcacatg

SEQ ID NO: 3449363 - DNA, 12 bp, Homo sapiens
gactttaattta

SEQ ID NO: 3449364 - DNA, 17 bp, Homo sapiens
gactttactaaaagaga

SEQ ID NO: 3449365 - DNA, 17 bp, Homo sapiens
gactttaggctttcagc

SEQ ID NO: 3449366 - DNA, 17 bp, Homo sapiens
gactttagtctgcaaaa

SEQ ID NO: 3449367 - DNA, 14 bp, Homo sapiens
gactttcaggtact

SEQ ID NO: 3449368 - DNA, 21 bp, Homo sapiens
gacttttctgtccgagctttg

SEQ ID NO: 3449369 - DNA, 23 bp, Homo sapiens
gacttttctgtccgagctttgaa

SEQ ID NO: 3449370 - DNA, 13 bp, Homo sapiens
gactttttataaa

SEQ ID NO: 3449371 - DNA, 16 bp, Homo sapiens
gagaaaaaaaaaatag

SEQ ID NO: 3449372 - DNA, 21 bp, Homo sapiens
gagaaaaaagtcaccattctg

SEQ ID NO: 3449373 - DNA, 12 bp, Homo sapiens
gagaaaaagacc

SEQ ID NO: 3449374 - DNA, 15 bp, Homo sapiens
gagaaaacagaccta

SEQ ID NO: 3449375 - DNA, 17 bp, Homo sapiens
gagaaaatatatgtatt

SEQ ID NO: 3449376 - DNA, 18 bp, Homo sapiens
gagaaaatcatcaagaag

SEQ ID NO: 3449377 - DNA, 17 bp, Homo sapiens
gagaaacccaccagcct

SEQ ID NO: 3449378 - DNA, 17 bp, Homo sapiens
gagaaaccctaaaaaga

SEQ ID NO: 3449379 - DNA, 18 bp, Homo sapiens
gagaaacttaagcaaagg

SEQ ID NO: 3449380 - DNA, 18 bp, Homo sapiens
gagaaagagcacttaaga

SEQ ID NO: 3449381 - DNA, 15 bp, Homo sapiens
gagaaagggacaatg

SEQ ID NO: 3449382 - DNA, 23 bp, Homo sapiens
gagaaatctggcttctggccagg

SEQ ID NO: 3449383 - DNA, 13 bp, Homo sapiens
gagaaatgggact

SEQ ID NO: 3449384 - DNA, 17 bp, Homo sapiens
gagaacaaacagatcga

SEQ ID NO: 3449385 - DNA, 15 bp, Homo sapiens
gagaacattttactg

SEQ ID NO: 3449386 - DNA, 18 bp, Homo sapiens
gagaaccaaatctggaag

SEQ ID NO: 3449387 - DNA, 16 bp, Homo sapiens
gagaactttcattttt

SEQ ID NO: 3449388 - DNA, 17 bp, Homo sapiens
gagaactttcatttttt

SEQ ID NO: 3449389 - DNA, 18 bp, Homo sapiens
gagaagccacaggcctga

SEQ ID NO: 3449390 - DNA, 22 bp, Homo sapiens
gagaagccacaggcctgagatt

SEQ ID NO: 3449391 - DNA, 15 bp, Homo sapiens
gagaagcccgtgtga

SEQ ID NO: 3449392 - DNA, 13 bp, Homo sapiens
gagaagcggctgg

SEQ ID NO: 3449393 - DNA, 17 bp, Homo sapiens
gagaagcggctggcagc

SEQ ID NO: 3449394 - DNA, 19 bp, Homo sapiens
gagaagctcctctccccag

SEQ ID NO: 3449395 - DNA, 20 bp, Homo sapiens
gagaagggaatcctcctcca

SEQ ID NO: 3449396 - DNA, 15 bp, Homo sapiens
gagaaggtgcctgcc

SEQ ID NO: 3449397 - DNA, 19 bp, Homo sapiens
gagaagtctggtcagagcc

SEQ ID NO: 3449398 - DNA, 22 bp, Homo sapiens
gagaagtctggtcagagccaca

SEQ ID NO: 3449399 - DNA, 23 bp, Homo sapiens
gagaagtctggtcagagccacag

SEQ ID NO: 3449400 - DNA, 21 bp, Homo sapiens
gagaatacaagatattatgta

SEQ ID NO: 3449401 - DNA, 20 bp, Homo sapiens
gagaatcagatcatttcaaa

SEQ ID NO: 3449402 - DNA, 21 bp, Homo sapiens
gagaatctacccccagatcca

SEQ ID NO: 3449403 - DNA, 19 bp, Homo sapiens
gagaatctttattgagaaa

SEQ ID NO: 3449404 - DNA, 15 bp, Homo sapiens
gagaatgtgccatgt

SEQ ID NO: 3449405 - DNA, 16 bp, Homo sapiens
gagaattcttacatgt

SEQ ID NO: 3449406 - DNA, 18 bp, Homo sapiens
gagaattgcttgaaccca

SEQ ID NO: 3449407 - DNA, 14 bp, Homo sapiens
gagaattgggggct

SEQ ID NO: 3449408 - DNA, 20 bp, Homo sapiens
gagacaatgtctgcagccct

SEQ ID NO: 3449409 - DNA, 12 bp, Homo sapiens
gagacaggcaga

SEQ ID NO: 3449410 - DNA, 19 bp, Homo sapiens
gagacaggcagagctgctc

SEQ ID NO: 3449411 - DNA, 13 bp, Homo sapiens
gagaccagcctgg

SEQ ID NO: 3449412 - DNA, 16 bp, Homo sapiens
gagaccagggagcctt

SEQ ID NO: 3449413 - DNA, 18 bp, Homo sapiens
gagacccagccctcatcc

SEQ ID NO: 3449414 - DNA, 15 bp, Homo sapiens
gagacctcctgcctc

SEQ ID NO: 3449415 - DNA, 19 bp, Homo sapiens
gagacctggacacaggcct

SEQ ID NO: 3449416 - DNA, 14 bp, Homo sapiens
gagacggagtccca

SEQ ID NO: 3449417 - DNA, 16 bp, Homo sapiens
gagacggagtcccacc

SEQ ID NO: 3449418 - DNA, 22 bp, Homo sapiens
gagacggtgtcttgttctgtca

SEQ ID NO: 3449419 - DNA, 18 bp, Homo sapiens
gagacggtgttttgccat

SEQ ID NO: 3449420 - DNA, 15 bp, Homo sapiens
gagactactaagagg

SEQ ID NO: 3449421 - DNA, 16 bp, Homo sapiens
gagactcctaggcagg

SEQ ID NO: 3449422 - DNA, 16 bp, Homo sapiens
gagactcgagaacttt

SEQ ID NO: 3449423 - DNA, 15 bp, Homo sapiens
gagactgcccagcta

SEQ ID NO: 3449424 - DNA, 21 bp, Homo sapiens
gagactgggctgagggagcct

SEQ ID NO: 3449425 - DNA, 16 bp, Homo sapiens
gagagagcaaggaagc

SEQ ID NO: 3449426 - DNA, 15 bp, Homo sapiens
gagagcaacatttta

SEQ ID NO: 3449427 - DNA, 18 bp, Homo sapiens
gagagcatcggcctaggg

SEQ ID NO: 3449428 - DNA, 16 bp, Homo sapiens
gagagccaccaagagg

SEQ ID NO: 3449429 - DNA, 17 bp, Homo sapiens
gagagccgtggtccctg

SEQ ID NO: 3449430 - DNA, 17 bp, Homo sapiens
gagagcctggtgctgct

SEQ ID NO: 3449431 - DNA, 16 bp, Homo sapiens
gagagcgacacagacg

SEQ ID NO: 3449432 - DNA, 13 bp, Homo sapiens
gagagctggagcc

SEQ ID NO: 3449433 - DNA, 14 bp, Homo sapiens
gagagctggagcct

SEQ ID NO: 3449434 - DNA, 22 bp, Homo sapiens
gagaggaaataacagagagaat

SEQ ID NO: 3449435 - DNA, 20 bp, Homo sapiens
gagaggaaatattgctgggg

SEQ ID NO: 3449436 - DNA, 12 bp, Homo sapiens
gagaggaagggt

SEQ ID NO: 3449437 - DNA, 17 bp, Homo sapiens
gagaggagacggagggg

SEQ ID NO: 3449438 - DNA, 20 bp, Homo sapiens
gagaggcaatggctccttca

SEQ ID NO: 3449439 - DNA, 18 bp, Homo sapiens
gagaggccaaaggctggt

SEQ ID NO: 3449440 - DNA, 19 bp, Homo sapiens
gagagggaggcaagccctg

SEQ ID NO: 3449441 - DNA, 16 bp, Homo sapiens
gagagggcaggcatga

SEQ ID NO: 3449442 - DNA, 22 bp, Homo sapiens
gagagggcggtgggtatgcgag

SEQ ID NO: 3449443 - DNA, 11 bp, Homo sapiens
gagagggcttt

SEQ ID NO: 3449444 - DNA, 13 bp, Homo sapiens
gagaggggaacag

SEQ ID NO: 3449445 - DNA, 12 bp, Homo sapiens
gagaggggacgc

SEQ ID NO: 3449446 - DNA, 23 bp, Homo sapiens
gagagtcagctctctgccctgtg

SEQ ID NO: 3449447 - DNA, 15 bp, Homo sapiens
gagataatatgagaa

SEQ ID NO: 3449448 - DNA, 17 bp, Homo sapiens
gagatacagaattttat

SEQ ID NO: 3449449 - DNA, 19 bp, Homo sapiens
gagatagcctgtggccctg

SEQ ID NO: 3449450 - DNA, 21 bp, Homo sapiens
gagatagcctgtggccctgtc

SEQ ID NO: 3449451 - DNA, 14 bp, Homo sapiens
gagatcagcctggg

SEQ ID NO: 3449452 - DNA, 21 bp, Homo sapiens
gagatccaaaagaagccccca

SEQ ID NO: 3449453 - DNA, 14 bp, Homo sapiens
gagatcctcctgca

SEQ ID NO: 3449454 - DNA, 21 bp, Homo sapiens
gagatgaaatcttacagctgg

SEQ ID NO: 3449455 - DNA, 22 bp, Homo sapiens
gagatgatacatccaaagcaga

SEQ ID NO: 3449456 - DNA, 18 bp, Homo sapiens
gagatgcaccaccaagcc

SEQ ID NO: 3449457 - DNA, 15 bp, Homo sapiens
gagatggaagcttgt

SEQ ID NO: 3449458 - DNA, 18 bp, Homo sapiens
gagatggaagcttgttga

SEQ ID NO: 3449459 - DNA, 11 bp, Homo sapiens
gagatggagct

SEQ ID NO: 3449460 - DNA, 23 bp, Homo sapiens
gagatggatcaatcaaacccggc

SEQ ID NO: 3449461 - DNA, 19 bp, Homo sapiens
gagatggcagattcccact

SEQ ID NO: 3449462 - DNA, 12 bp, Homo sapiens
gagattcatttt

SEQ ID NO: 3449463 - DNA, 21 bp, Homo sapiens
gagattcattttctagataca

SEQ ID NO: 3449464 - DNA, 19 bp, Homo sapiens
gagatttcatctgctctcc

SEQ ID NO: 3449465 - DNA, 16 bp, Homo sapiens
gagcaaaggctgagaa

SEQ ID NO: 3449466 - DNA, 12 bp, Homo sapiens
gagcaagactct

SEQ ID NO: 3449467 - DNA, 12 bp, Homo sapiens
gagcaaggaagc

SEQ ID NO: 3449468 - DNA, 16 bp, Homo sapiens
gagcaaggaagcttca

SEQ ID NO: 3449469 - DNA, 20 bp, Homo sapiens
gagcaagggttccctcaaga

SEQ ID NO: 3449470 - DNA, 18 bp, Homo sapiens
gagcacacttggcccaag

SEQ ID NO: 3449471 - DNA, 19 bp, Homo sapiens
gagcacctccacatcctcc

SEQ ID NO: 3449472 - DNA, 14 bp, Homo sapiens
gagcacctttggaa

SEQ ID NO: 3449473 - DNA, 15 bp, Homo sapiens
gagcactaaggtgtg

SEQ ID NO: 3449474 - DNA, 14 bp, Homo sapiens
gagcactgggctcc

SEQ ID NO: 3449475 - DNA, 20 bp, Homo sapiens
gagcagagcccggagctccg

SEQ ID NO: 3449476 - DNA, 14 bp, Homo sapiens
gagcagaggtctcc

SEQ ID NO: 3449477 - DNA, 16 bp, Homo sapiens
gagcaggactccaggc

SEQ ID NO: 3449478 - DNA, 21 bp, Homo sapiens
gagcagggggacctaggctcc

SEQ ID NO: 3449479 - DNA, 14 bp, Homo sapiens
gagcagtgcaggca

SEQ ID NO: 3449480 - DNA, 16 bp, Homo sapiens
gagcagtgcaggcaca

SEQ ID NO: 3449481 - DNA, 17 bp, Homo sapiens
gagcatgggttcatcct

SEQ ID NO: 3449482 - DNA, 17 bp, Homo sapiens
gagcattttttatgata

SEQ ID NO: 3449483 - DNA, 14 bp, Homo sapiens
gagccaaattttat

SEQ ID NO: 3449484 - DNA, 19 bp, Homo sapiens
gagccacagggtctgcctc

SEQ ID NO: 3449485 - DNA, 13 bp, Homo sapiens
gagccacctgccc

SEQ ID NO: 3449486 - DNA, 15 bp, Homo sapiens
gagccactcctctga

SEQ ID NO: 3449487 - DNA, 13 bp, Homo sapiens
gagccactgcacc

SEQ ID NO: 3449488 - DNA, 18 bp, Homo sapiens
gagccactgcaccgggcc

SEQ ID NO: 3449489 - DNA, 20 bp, Homo sapiens
gagccactgcaccgggccac

SEQ ID NO: 3449490 - DNA, 19 bp, Homo sapiens
gagccagcccaagtagagg

SEQ ID NO: 3449491 - DNA, 13 bp, Homo sapiens
gagccagctccct

SEQ ID NO: 3449492 - DNA, 18 bp, Homo sapiens
gagccagtaaacagagga

SEQ ID NO: 3449493 - DNA, 12 bp, Homo sapiens
gagccatgtttc

SEQ ID NO: 3449494 - DNA, 15 bp, Homo sapiens
gagcccaccttggct

SEQ ID NO: 3449495 - DNA, 14 bp, Homo sapiens
gagcccagaggagg

SEQ ID NO: 3449496 - DNA, 15 bp, Homo sapiens
gagcccagccctccc

SEQ ID NO: 3449497 - DNA, 18 bp, Homo sapiens
gagcccagccctccccat

SEQ ID NO: 3449498 - DNA, 13 bp, Homo sapiens
gagcccagctggg

SEQ ID NO: 3449499 - DNA, 22 bp, Homo sapiens
gagcccagctgggtcaggcagg

SEQ ID NO: 3449500 - DNA, 12 bp, Homo sapiens
gagcccatggtg

SEQ ID NO: 3449501 - DNA, 17 bp, Homo sapiens
gagccccattcctggga

SEQ ID NO: 3449502 - DNA, 18 bp, Homo sapiens
gagcccctcggctctgga

SEQ ID NO: 3449503 - DNA, 20 bp, Homo sapiens
gagcccctgtctagagaggg

SEQ ID NO: 3449504 - DNA, 21 bp, Homo sapiens
gagcccctgtctagagaggga

SEQ ID NO: 3449505 - DNA, 22 bp, Homo sapiens
gagcccctgtctagagagggag

SEQ ID NO: 3449506 - DNA, 21 bp, Homo sapiens
gagccccttctgctcagctct

SEQ ID NO: 3449507 - DNA, 13 bp, Homo sapiens
gagccctggtggc

SEQ ID NO: 3449508 - DNA, 15 bp, Homo sapiens
gagccctggtggcag

SEQ ID NO: 3449509 - DNA, 22 bp, Homo sapiens
gagccgagatcacgccactgca

SEQ ID NO: 3449510 - DNA, 17 bp, Homo sapiens
gagccgggtctgcctct

SEQ ID NO: 3449511 - DNA, 22 bp, Homo sapiens
gagccgggtctgcctcttctgg

SEQ ID NO: 3449512 - DNA, 15 bp, Homo sapiens
gagcctcagcatcct

SEQ ID NO: 3449513 - DNA, 17 bp, Homo sapiens
gagcctcagcatcctgg

SEQ ID NO: 3449514 - DNA, 14 bp, Homo sapiens
gagcctcgctctgt

SEQ ID NO: 3449515 - DNA, 12 bp, Homo sapiens
gagcctgaggga

SEQ ID NO: 3449516 - DNA, 13 bp, Homo sapiens
gagcctgggaggt

SEQ ID NO: 3449517 - DNA, 13 bp, Homo sapiens
gagccttcagcct

SEQ ID NO: 3449518 - DNA, 17 bp, Homo sapiens
gagccttcagccttaat

SEQ ID NO: 3449519 - DNA, 20 bp, Homo sapiens
gagccttgggagccactgcc

SEQ ID NO: 3449520 - DNA, 22 bp, Homo sapiens
gagccttgggagccactgccac

SEQ ID NO: 3449521 - DNA, 13 bp, Homo sapiens
gagcctttccaaa

SEQ ID NO: 3449522 - DNA, 23 bp, Homo sapiens
gagcctttggttctggccagaat

SEQ ID NO: 3449523 - DNA, 13 bp, Homo sapiens
gagcgacacagac

SEQ ID NO: 3449524 - DNA, 21 bp, Homo sapiens
gagcgaggagatgctccttgg

SEQ ID NO: 3449525 - DNA, 19 bp, Homo sapiens
gagcgcctccatccaaggc

SEQ ID NO: 3449526 - DNA, 22 bp, Homo sapiens
gagcgcctgcccctcccagaac

SEQ ID NO: 3449527 - DNA, 22 bp, Homo sapiens
gagcgctcctgccgcagagctg

SEQ ID NO: 3449528 - DNA, 15 bp, Homo sapiens
gagcggaaagcagct

SEQ ID NO: 3449529 - DNA, 22 bp, Homo sapiens
gagctaatttactggacaaaga

SEQ ID NO: 3449530 - DNA, 20 bp, Homo sapiens
gagctagttggttgaatttt

SEQ ID NO: 3449531 - DNA, 13 bp, Homo sapiens
gagctattgctgt

SEQ ID NO: 3449532 - DNA, 19 bp, Homo sapiens
gagctccaactcagaaggg

SEQ ID NO: 3449533 - DNA, 21 bp, Homo sapiens
gagctcccaggtgcagccaga

SEQ ID NO: 3449534 - DNA, 22 bp, Homo sapiens
gagctcccaggtgcagccagag

SEQ ID NO: 3449535 - DNA, 14 bp, Homo sapiens
gagctctacccagg

SEQ ID NO: 3449536 - DNA, 15 bp, Homo sapiens
gagctctacccaggg

SEQ ID NO: 3449537 - DNA, 23 bp, Homo sapiens
gagctctacccagggcctgcagg

SEQ ID NO: 3449538 - DNA, 21 bp, Homo sapiens
gagctctcaaatccctctcca

SEQ ID NO: 3449539 - DNA, 23 bp, Homo sapiens
gagctctcaaatccctctccaac

SEQ ID NO: 3449540 - DNA, 20 bp, Homo sapiens
gagctctgtgggtctctgga

SEQ ID NO: 3449541 - DNA, 21 bp, Homo sapiens
gagctgaaagctggtggcaga

SEQ ID NO: 3449542 - DNA, 22 bp, Homo sapiens
gagctgacacaaacctgcctgg

SEQ ID NO: 3449543 - DNA, 16 bp, Homo sapiens
gagctgacacaggatg

SEQ ID NO: 3449544 - DNA, 16 bp, Homo sapiens
gagctgaggcagcagt

SEQ ID NO: 3449545 - DNA, 15 bp, Homo sapiens
gagctgagtggggga

SEQ ID NO: 3449546 - DNA, 16 bp, Homo sapiens
gagctgcctgttcagc

SEQ ID NO: 3449547 - DNA, 20 bp, Homo sapiens
gagctgcctgttcagctcca

SEQ ID NO: 3449548 - DNA, 14 bp, Homo sapiens
gagctggagcctgg

SEQ ID NO: 3449549 - DNA, 19 bp, Homo sapiens
gagctggccaaagagcctt

SEQ ID NO: 3449550 - DNA, 22 bp, Homo sapiens
gagctggccaaagagcctttcc

SEQ ID NO: 3449551 - DNA, 19 bp, Homo sapiens
gagctggccaggccactgg

SEQ ID NO: 3449552 - DNA, 13 bp, Homo sapiens
gagctggccccgc

SEQ ID NO: 3449553 - DNA, 14 bp, Homo sapiens
gagctggccccgcc

SEQ ID NO: 3449554 - DNA, 17 bp, Homo sapiens
gagctggccccgccgcc

SEQ ID NO: 3449555 - DNA, 12 bp, Homo sapiens
gagctggctctg

SEQ ID NO: 3449556 - DNA, 13 bp, Homo sapiens
gagctggctctga

SEQ ID NO: 3449557 - DNA, 22 bp, Homo sapiens
gagctggctctgagcgcctcca

SEQ ID NO: 3449558 - DNA, 19 bp, Homo sapiens
gagctgtcaccaaggaaac

SEQ ID NO: 3449559 - DNA, 18 bp, Homo sapiens
gagctgtgcaggtgggga

SEQ ID NO: 3449560 - DNA, 14 bp, Homo sapiens
gagcttctctgtga

SEQ ID NO: 3449561 - DNA, 15 bp, Homo sapiens
gagcttttggtgaga

SEQ ID NO: 3449562 - DNA, 22 bp, Homo sapiens
gaggaaaagtaaccatcactgg

SEQ ID NO: 3449563 - DNA, 22 bp, Homo sapiens
gaggaaactactgcctttagaa

SEQ ID NO: 3449564 - DNA, 14 bp, Homo sapiens
gaggaaaggccagc

SEQ ID NO: 3449565 - DNA, 19 bp, Homo sapiens
gaggaaataacagagagaa

SEQ ID NO: 3449566 - DNA, 19 bp, Homo sapiens
gaggaagaacggggctctt

SEQ ID NO: 3449567 - DNA, 19 bp, Homo sapiens
gaggaagccctaagacgtc

SEQ ID NO: 3449568 - DNA, 14 bp, Homo sapiens
gaggaagttcagat

SEQ ID NO: 3449569 - DNA, 17 bp, Homo sapiens
gaggaagttcagatctt

SEQ ID NO: 3449570 - DNA, 19 bp, Homo sapiens
gaggaatctgtgggtctgg

SEQ ID NO: 3449571 - DNA, 14 bp, Homo sapiens
gaggaatggacaga

SEQ ID NO: 3449572 - DNA, 14 bp, Homo sapiens
gaggacaggcggga

SEQ ID NO: 3449573 - DNA, 22 bp, Homo sapiens
gaggacagggaggtgaccccag

SEQ ID NO: 3449574 - DNA, 14 bp, Homo sapiens
gaggaccccttaat

SEQ ID NO: 3449575 - DNA, 21 bp, Homo sapiens
gaggactgtagggagggcggc

SEQ ID NO: 3449576 - DNA, 16 bp, Homo sapiens
gaggacttttctttgt

SEQ ID NO: 3449577 - DNA, 13 bp, Homo sapiens
gaggagagagcct

SEQ ID NO: 3449578 - DNA, 24 bp, Homo sapiens
gaggagagatagcctgtggccctg

SEQ ID NO: 3449579 - DNA, 16 bp, Homo sapiens
gaggagcaaaggctga

SEQ ID NO: 3449580 - DNA, 18 bp, Homo sapiens
gaggagccccatctgtct

SEQ ID NO: 3449581 - DNA, 18 bp, Homo sapiens
gaggagcccctggacatg

SEQ ID NO: 3449582 - DNA, 18 bp, Homo sapiens
gaggaggggccgctgcca

SEQ ID NO: 3449583 - DNA, 15 bp, Homo sapiens
gaggagtacaggtga

SEQ ID NO: 3449584 - DNA, 14 bp, Homo sapiens
gaggagtggaggtg

SEQ ID NO: 3449585 - DNA, 13 bp, Homo sapiens
gaggataactttt

SEQ ID NO: 3449586 - DNA, 14 bp, Homo sapiens
gaggatcagttttt

SEQ ID NO: 3449587 - DNA, 22 bp, Homo sapiens
gaggatgagctctacccagggc

SEQ ID NO: 3449588 - DNA, 15 bp, Homo sapiens
gaggatgtaaggcct

SEQ ID NO: 3449589 - DNA, 12 bp, Homo sapiens
gaggatgttctg

SEQ ID NO: 3449590 - DNA, 18 bp, Homo sapiens
gaggattgctgccagaga

SEQ ID NO: 3449591 - DNA, 20 bp, Homo sapiens
gaggattgctgccagagaag

SEQ ID NO: 3449592 - DNA, 12 bp, Homo sapiens
gaggcactgaag

SEQ ID NO: 3449593 - DNA, 22 bp, Homo sapiens
gaggcagacttccctgaatgta

SEQ ID NO: 3449594 - DNA, 20 bp, Homo sapiens
gaggcagaggttgcagtgag

SEQ ID NO: 3449595 - DNA, 13 bp, Homo sapiens
gaggcagcagtgt

SEQ ID NO: 3449596 - DNA, 13 bp, Homo sapiens
gaggcagccccat

SEQ ID NO: 3449597 - DNA, 20 bp, Homo sapiens
gaggcagccccattctgcct

SEQ ID NO: 3449598 - DNA, 21 bp, Homo sapiens
gaggcagccccattctgcctg

SEQ ID NO: 3449599 - DNA, 23 bp, Homo sapiens
gaggcagccccattctgcctgcc

SEQ ID NO: 3449600 - DNA, 9 bp, Homo sapiens
gaggcaggg

SEQ ID NO: 3449601 - DNA, 14 bp, Homo sapiens
gaggcagggaagtc

SEQ ID NO: 3449602 - DNA, 15 bp, Homo sapiens
gaggcagggtctcac

SEQ ID NO: 3449603 - DNA, 19 bp, Homo sapiens
gaggcagggtctcactctg

SEQ ID NO: 3449604 - DNA, 22 bp, Homo sapiens
gaggcagggtctcactctgtcg

SEQ ID NO: 3449605 - DNA, 14 bp, Homo sapiens
gaggcatcctctga

SEQ ID NO: 3449606 - DNA, 17 bp, Homo sapiens
gaggcatctggaaaggg

SEQ ID NO: 3449607 - DNA, 17 bp, Homo sapiens
gaggccaacactgtggg

SEQ ID NO: 3449608 - DNA, 20 bp, Homo sapiens
gaggccaagcagtgcctgcc

SEQ ID NO: 3449609 - DNA, 22 bp, Homo sapiens
gaggccaaggtgggaggattgc

SEQ ID NO: 3449610 - DNA, 21 bp, Homo sapiens
gaggccagaggcccccagccc

SEQ ID NO: 3449611 - DNA, 23 bp, Homo sapiens
gaggccagcctgcgggaagctga

SEQ ID NO: 3449612 - DNA, 11 bp, Homo sapiens
gaggccagcta

SEQ ID NO: 3449613 - DNA, 21 bp, Homo sapiens
gaggccagctatctgcctgac

SEQ ID NO: 3449614 - DNA, 19 bp, Homo sapiens
gaggccagggcagagtgag

SEQ ID NO: 3449615 - DNA, 16 bp, Homo sapiens
gaggccagtgagccac

SEQ ID NO: 3449616 - DNA, 15 bp, Homo sapiens
gaggcccaggctggg

SEQ ID NO: 3449617 - DNA, 14 bp, Homo sapiens
gaggcccccagccc

SEQ ID NO: 3449618 - DNA, 21 bp, Homo sapiens
gaggcccccagcccagggctc

SEQ ID NO: 3449619 - DNA, 22 bp, Homo sapiens
gaggcctcaggtgctgtccatg

SEQ ID NO: 3449620 - DNA, 18 bp, Homo sapiens
gaggcctgaagccagctg

SEQ ID NO: 3449621 - DNA, 20 bp, Homo sapiens
gaggcctgaagccagctgcc

SEQ ID NO: 3449622 - DNA, 22 bp, Homo sapiens
gaggcctgaagccagctgccct

SEQ ID NO: 3449623 - DNA, 19 bp, Homo sapiens
gaggcctgcctccagggct

SEQ ID NO: 3449624 - DNA, 16 bp, Homo sapiens
gaggcctgggccgctg

SEQ ID NO: 3449625 - DNA, 18 bp, Homo sapiens
gaggcctgggggacccct

SEQ ID NO: 3449626 - DNA, 16 bp, Homo sapiens
gaggccttctctgaag

SEQ ID NO: 3449627 - DNA, 23 bp, Homo sapiens
gaggctaaattactcaggaagaa

SEQ ID NO: 3449628 - DNA, 14 bp, Homo sapiens
gaggctccagaggg

SEQ ID NO: 3449629 - DNA, 17 bp, Homo sapiens
gaggctccagagggcac

SEQ ID NO: 3449630 - DNA, 16 bp, Homo sapiens
gaggctgaggcaagag

SEQ ID NO: 3449631 - DNA, 20 bp, Homo sapiens
gaggctgaggctggcacagg

SEQ ID NO: 3449632 - DNA, 15 bp, Homo sapiens
gaggctgcaggactt

SEQ ID NO: 3449633 - DNA, 14 bp, Homo sapiens
gaggctgcctccca

SEQ ID NO: 3449634 - DNA, 13 bp, Homo sapiens
gaggctggcacag

SEQ ID NO: 3449635 - DNA, 15 bp, Homo sapiens
gaggctgggaggagc

SEQ ID NO: 3449636 - DNA, 20 bp, Homo sapiens
gaggctgggggagagccgtg

SEQ ID NO: 3449637 - DNA, 22 bp, Homo sapiens
gaggcttagctttgctctgcca

SEQ ID NO: 3449638 - DNA, 14 bp, Homo sapiens
gaggctttggattt

SEQ ID NO: 3449639 - DNA, 20 bp, Homo sapiens
gaggctttggatttgacatt

SEQ ID NO: 3449640 - DNA, 19 bp, Homo sapiens
gagggaacggaaataaagg

SEQ ID NO: 3449641 - DNA, 18 bp, Homo sapiens
gagggacctctcccaggg

SEQ ID NO: 3449642 - DNA, 14 bp, Homo sapiens
gagggacgcctggg

SEQ ID NO: 3449643 - DNA, 23 bp, Homo sapiens
gagggagctccaactcagaaggg

SEQ ID NO: 3449644 - DNA, 17 bp, Homo sapiens
gagggaggcaagccctg

SEQ ID NO: 3449645 - DNA, 18 bp, Homo sapiens
gagggagtgacagaggca

SEQ ID NO: 3449646 - DNA, 19 bp, Homo sapiens
gagggatttctttgctgta

SEQ ID NO: 3449647 - DNA, 15 bp, Homo sapiens
gagggcacacactgt

SEQ ID NO: 3449648 - DNA, 23 bp, Homo sapiens
gagggcacattccttgcctgcac

SEQ ID NO: 3449649 - DNA, 22 bp, Homo sapiens
gagggcagcagaagggggtggt

SEQ ID NO: 3449650 - DNA, 15 bp, Homo sapiens
gagggcagcagggct

SEQ ID NO: 3449651 - DNA, 16 bp, Homo sapiens
gagggcagcagggcta

SEQ ID NO: 3449652 - DNA, 19 bp, Homo sapiens
gagggcagcagggctaccc

SEQ ID NO: 3449653 - DNA, 21 bp, Homo sapiens
gagggcctgctggaggcctca

SEQ ID NO: 3449654 - DNA, 16 bp, Homo sapiens
gagggcggagccggcc

SEQ ID NO: 3449655 - DNA, 23 bp, Homo sapiens
gagggcggcaggggcctggagat

SEQ ID NO: 3449656 - DNA, 23 bp, Homo sapiens
gagggctgcgacgcttgctctgt

SEQ ID NO: 3449657 - DNA, 13 bp, Homo sapiens
gagggctggctgg

SEQ ID NO: 3449658 - DNA, 18 bp, Homo sapiens
gagggctggctggcctca

SEQ ID NO: 3449659 - DNA, 17 bp, Homo sapiens
gaggggaaaaaaatgtt

SEQ ID NO: 3449660 - DNA, 12 bp, Homo sapiens
gaggggaacaga

SEQ ID NO: 3449661 - DNA, 16 bp, Homo sapiens
gaggggaaggggcggt

SEQ ID NO: 3449662 - DNA, 15 bp, Homo sapiens
gaggggacgcaggcc

SEQ ID NO: 3449663 - DNA, 22 bp, Homo sapiens
gaggggcctaggcctcagccag

SEQ ID NO: 3449664 - DNA, 19 bp, Homo sapiens
gaggggggatttccagcca

SEQ ID NO: 3449665 - DNA, 15 bp, Homo sapiens
gagggtgataaatct

SEQ ID NO: 3449666 - DNA, 18 bp, Homo sapiens
gagggtgtatctagctct

SEQ ID NO: 3449667 - DNA, 14 bp, Homo sapiens
gagggttgggctgg

SEQ ID NO: 3449668 - DNA, 15 bp, Homo sapiens
gaggtatgggctggg

SEQ ID NO: 3449669 - DNA, 18 bp, Homo sapiens
gaggtatgggctgggggc

SEQ ID NO: 3449670 - DNA, 11 bp, Homo sapiens
gaggtcactgc

SEQ ID NO: 3449671 - DNA, 13 bp, Homo sapiens
gaggtcagagcct

SEQ ID NO: 3449672 - DNA, 20 bp, Homo sapiens
gaggtcagagcctgcagtta

SEQ ID NO: 3449673 - DNA, 15 bp, Homo sapiens
gaggtcgaggcagga

SEQ ID NO: 3449674 - DNA, 22 bp, Homo sapiens
gaggtcggtaggttcagccaag

SEQ ID NO: 3449675 - DNA, 16 bp, Homo sapiens
gaggtctccaaactga

SEQ ID NO: 3449676 - DNA, 23 bp, Homo sapiens
gaggtgccttcttcagggcctgg

SEQ ID NO: 3449677 - DNA, 20 bp, Homo sapiens
gaggtggctgagcccctgtc

SEQ ID NO: 3449678 - DNA, 21 bp, Homo sapiens
gaggtgggccagtctgtggat

SEQ ID NO: 3449679 - DNA, 16 bp, Homo sapiens
gaggtgtggagccgag

SEQ ID NO: 3449680 - DNA, 19 bp, Homo sapiens
gaggttaaggctgaggaaa

SEQ ID NO: 3449681 - DNA, 16 bp, Homo sapiens
gaggtttcaaacctcc

SEQ ID NO: 3449682 - DNA, 19 bp, Homo sapiens
gaggttttaaaaaaatccc

SEQ ID NO: 3449683 - DNA, 13 bp, Homo sapiens
gagtactgtgggc

SEQ ID NO: 3449684 - DNA, 18 bp, Homo sapiens
gagtactgtgggcaattt

SEQ ID NO: 3449685 - DNA, 15 bp, Homo sapiens
gagtagaaaggcctt

SEQ ID NO: 3449686 - DNA, 17 bp, Homo sapiens
gagtagaaaggccttta

SEQ ID NO: 3449687 - DNA, 19 bp, Homo sapiens
gagtagctgggactacagg

SEQ ID NO: 3449688 - DNA, 20 bp, Homo sapiens
gagtagttgatgttgcattt

SEQ ID NO: 3449689 - DNA, 21 bp, Homo sapiens
gagtagttgatgttgcatttt

SEQ ID NO: 3449690 - DNA, 19 bp, Homo sapiens
gagtcaaaactacaaatca

SEQ ID NO: 3449691 - DNA, 19 bp, Homo sapiens
gagtcaaatggtaggcatt

SEQ ID NO: 3449692 - DNA, 14 bp, Homo sapiens
gagtcacattctgc

SEQ ID NO: 3449693 - DNA, 21 bp, Homo sapiens
gagtcacattctgcttaaagt

SEQ ID NO: 3449694 - DNA, 22 bp, Homo sapiens
gagtcacattctgcttaaagtt

SEQ ID NO: 3449695 - DNA, 15 bp, Homo sapiens
gagtcaccaagccca

SEQ ID NO: 3449696 - DNA, 17 bp, Homo sapiens
gagtcaccaagcccagt

SEQ ID NO: 3449697 - DNA, 16 bp, Homo sapiens
gagtcagccaggagct

SEQ ID NO: 3449698 - DNA, 15 bp, Homo sapiens
gagtcagctctctgc

SEQ ID NO: 3449699 - DNA, 20 bp, Homo sapiens
gagtcaggcccggcctattg

SEQ ID NO: 3449700 - DNA, 18 bp, Homo sapiens
gagtcagggacccctgcc

SEQ ID NO: 3449701 - DNA, 22 bp, Homo sapiens
gagtcagggacccctgcccttg

SEQ ID NO: 3449702 - DNA, 13 bp, Homo sapiens
gagtcatgtgcct

SEQ ID NO: 3449703 - DNA, 13 bp, Homo sapiens
gagtcatttgagt

SEQ ID NO: 3449704 - DNA, 18 bp, Homo sapiens
gagtcatttgagtctctt

SEQ ID NO: 3449705 - DNA, 22 bp, Homo sapiens
gagtccactttgtttcgtgggg

SEQ ID NO: 3449706 - DNA, 12 bp, Homo sapiens
gagtcccacctt

SEQ ID NO: 3449707 - DNA, 21 bp, Homo sapiens
gagtcccaccttggctgcagg

SEQ ID NO: 3449708 - DNA, 17 bp, Homo sapiens
gagtcctagagctacag

SEQ ID NO: 3449709 - DNA, 17 bp, Homo sapiens
gagtcgaggacagggag

SEQ ID NO: 3449710 - DNA, 18 bp, Homo sapiens
gagtcgtggggtgtgctg

SEQ ID NO: 3449711 - DNA, 18 bp, Homo sapiens
gagtctaatagtctttgc

SEQ ID NO: 3449712 - DNA, 16 bp, Homo sapiens
gagtctatgttcaaag

SEQ ID NO: 3449713 - DNA, 21 bp, Homo sapiens
gagtctatgttcaaagactgt

SEQ ID NO: 3449714 - DNA, 15 bp, Homo sapiens
gagtctgaagcagat

SEQ ID NO: 3449715 - DNA, 17 bp, Homo sapiens
gagtctggccctagact

SEQ ID NO: 3449716 - DNA, 18 bp, Homo sapiens
gagtctggccctagactc

SEQ ID NO: 3449717 - DNA, 20 bp, Homo sapiens
gagtgacacccaagagggct

SEQ ID NO: 3449718 - DNA, 15 bp, Homo sapiens
gagtgacagaggcag

SEQ ID NO: 3449719 - DNA, 23 bp, Homo sapiens
gagtgagacccagccctcatccc

SEQ ID NO: 3449720 - DNA, 14 bp, Homo sapiens
gagtgagactctgt

SEQ ID NO: 3449721 - DNA, 18 bp, Homo sapiens
gagtgagactctgtctca

SEQ ID NO: 3449722 - DNA, 24 bp, Homo sapiens
gagtgagcactaaggtgtgctctg

SEQ ID NO: 3449723 - DNA, 14 bp, Homo sapiens
gagtgcagtcctga

SEQ ID NO: 3449724 - DNA, 18 bp, Homo sapiens
gagtgcagtcctgatcag

SEQ ID NO: 3449725 - DNA, 14 bp, Homo sapiens
gagtgcctggccaa

SEQ ID NO: 3449726 - DNA, 16 bp, Homo sapiens
gagtgccttctgtggg

SEQ ID NO: 3449727 - DNA, 18 bp, Homo sapiens
gagtgccttttgcagaag

SEQ ID NO: 3449728 - DNA, 14 bp, Homo sapiens
gagtgcgtgctcag

SEQ ID NO: 3449729 - DNA, 15 bp, Homo sapiens
gagtgctaagtgtag

SEQ ID NO: 3449730 - DNA, 20 bp, Homo sapiens
gagtggaggtgggctgggcc

SEQ ID NO: 3449731 - DNA, 19 bp, Homo sapiens
gagtggaggttaaggctga

SEQ ID NO: 3449732 - DNA, 23 bp, Homo sapiens
gagtgtgagccacctaagatctc

SEQ ID NO: 3449733 - DNA, 13 bp, Homo sapiens
gagttaagacctg

SEQ ID NO: 3449734 - DNA, 17 bp, Homo sapiens
gagttaggaatgagaag

SEQ ID NO: 3449735 - DNA, 17 bp, Homo sapiens
gagttaggctattcaca

SEQ ID NO: 3449736 - DNA, 22 bp, Homo sapiens
gagttatctaagaatacagctt

SEQ ID NO: 3449737 - DNA, 14 bp, Homo sapiens
gagttattgagatt

SEQ ID NO: 3449738 - DNA, 21 bp, Homo sapiens
gagttccttgatctgtatata

SEQ ID NO: 3449739 - DNA, 12 bp, Homo sapiens
gagttctgctga

SEQ ID NO: 3449740 - DNA, 16 bp, Homo sapiens
gagttgattcagctct

SEQ ID NO: 3449741 - DNA, 17 bp, Homo sapiens
gagttgattcagctctg

SEQ ID NO: 3449742 - DNA, 16 bp, Homo sapiens
gagttgcattgattca

SEQ ID NO: 3449743 - DNA, 12 bp, Homo sapiens
gagttgtaaata

SEQ ID NO: 3449744 - DNA, 19 bp, Homo sapiens
gagttgtaaatatataaat

SEQ ID NO: 3449745 - DNA, 13 bp, Homo sapiens
gagtttaaagcaa

SEQ ID NO: 3449746 - DNA, 16 bp, Homo sapiens
gagtttaaattgtaat

SEQ ID NO: 3449747 - DNA, 17 bp, Homo sapiens
gagtttgtcgctcatgt

SEQ ID NO: 3449748 - DNA, 18 bp, Homo sapiens
gagttttccatggcagga

SEQ ID NO: 3449749 - DNA, 21 bp, Homo sapiens
gagttttccatggcaggaagg

SEQ ID NO: 3449750 - DNA, 16 bp, Homo sapiens
gagttttgtagcagtg

SEQ ID NO: 3449751 - DNA, 13 bp, Homo sapiens
gataaagatttct

SEQ ID NO: 3449752 - DNA, 14 bp, Homo sapiens
gataaagcacagct

SEQ ID NO: 3449753 - DNA, 16 bp, Homo sapiens
gataaatacaaggccc

SEQ ID NO: 3449754 - DNA, 17 bp, Homo sapiens
gataaattgccataata

SEQ ID NO: 3449755 - DNA, 24 bp, Homo sapiens
gataaattgccataatatgatgca

SEQ ID NO: 3449756 - DNA, 19 bp, Homo sapiens
gataactagatggtgctga

SEQ ID NO: 3449757 - DNA, 22 bp, Homo sapiens
gataagagtagaaactgcaggg

SEQ ID NO: 3449758 - DNA, 17 bp, Homo sapiens
gataaggaattatagac

SEQ ID NO: 3449759 - DNA, 17 bp, Homo sapiens
gataaggtaaaatgcca

SEQ ID NO: 3449760 - DNA, 21 bp, Homo sapiens
gataatgacactgtttcctga

SEQ ID NO: 3449761 - DNA, 17 bp, Homo sapiens
gataattacaatacaaa

SEQ ID NO: 3449762 - DNA, 15 bp, Homo sapiens
gataattcaacattt

SEQ ID NO: 3449763 - DNA, 13 bp, Homo sapiens
gatacacacacac

SEQ ID NO: 3449764 - DNA, 19 bp, Homo sapiens
gatacacccaaagtatcag

SEQ ID NO: 3449765 - DNA, 19 bp, Homo sapiens
gatacaggaaaagctgctg

SEQ ID NO: 3449766 - DNA, 15 bp, Homo sapiens
gataccagcgaggag

SEQ ID NO: 3449767 - DNA, 22 bp, Homo sapiens
gataccagcgaggaggctccag

SEQ ID NO: 3449768 - DNA, 16 bp, Homo sapiens
gataccatagagtcca

SEQ ID NO: 3449769 - DNA, 21 bp, Homo sapiens
gatacctaaaacataagatca

SEQ ID NO: 3449770 - DNA, 22 bp, Homo sapiens
gatacgctactataaagagaag

SEQ ID NO: 3449771 - DNA, 21 bp, Homo sapiens
gatactgcgactttctgcctg

SEQ ID NO: 3449772 - DNA, 22 bp, Homo sapiens
gatactgtaacactttacaatg

SEQ ID NO: 3449773 - DNA, 22 bp, Homo sapiens
gatacttaacaaatacattcaa

SEQ ID NO: 3449774 - DNA, 19 bp, Homo sapiens
gatagaaatgccaagcact

SEQ ID NO: 3449775 - DNA, 20 bp, Homo sapiens
gatagatgctggcccagggc

SEQ ID NO: 3449776 - DNA, 20 bp, Homo sapiens
gatagcaagtgaatttttct

SEQ ID NO: 3449777 - DNA, 20 bp, Homo sapiens
gatagcactttctacaatgt

SEQ ID NO: 3449778 - DNA, 16 bp, Homo sapiens
gatagcctgtggccct

SEQ ID NO: 3449779 - DNA, 17 bp, Homo sapiens
gatagcgggaaaaggag

SEQ ID NO: 3449780 - DNA, 16 bp, Homo sapiens
gatataagtgctgtat

SEQ ID NO: 3449781 - DNA, 19 bp, Homo sapiens
gatataagtgctgtataaa

SEQ ID NO: 3449782 - DNA, 14 bp, Homo sapiens
gatataatctttca

SEQ ID NO: 3449783 - DNA, 14 bp, Homo sapiens
gatatatacatagc

SEQ ID NO: 3449784 - DNA, 16 bp, Homo sapiens
gatatccattctttct

SEQ ID NO: 3449785 - DNA, 23 bp, Homo sapiens
gatatcgacttgtttttgcacat

SEQ ID NO: 3449786 - DNA, 14 bp, Homo sapiens
gatatcttcagttt

SEQ ID NO: 3449787 - DNA, 16 bp, Homo sapiens
gatatcttcagtttaa

SEQ ID NO: 3449788 - DNA, 20 bp, Homo sapiens
gatatgtatgttgtgaatta

SEQ ID NO: 3449789 - DNA, 21 bp, Homo sapiens
gatattatgtataaaatgtaa

SEQ ID NO: 3449790 - DNA, 15 bp, Homo sapiens
gatattccaaaataa

SEQ ID NO: 3449791 - DNA, 21 bp, Homo sapiens
gatattccaaaataaaaggac

SEQ ID NO: 3449792 - DNA, 21 bp, Homo sapiens
gatcaaccccttcgctcctgt

SEQ ID NO: 3449793 - DNA, 22 bp, Homo sapiens
gatcaaccccttcgctcctgtg

SEQ ID NO: 3449794 - DNA, 18 bp, Homo sapiens
gatcaaggagaggaggca

SEQ ID NO: 3449795 - DNA, 23 bp, Homo sapiens
gatcaaggccttattggaaagca

SEQ ID NO: 3449796 - DNA, 22 bp, Homo sapiens
gatcaagtcctttgtgaatatt

SEQ ID NO: 3449797 - DNA, 16 bp, Homo sapiens
gatcacaacgtgcatt

SEQ ID NO: 3449798 - DNA, 14 bp, Homo sapiens
gatcacagcctctg

SEQ ID NO: 3449799 - DNA, 16 bp, Homo sapiens
gatcacgccactgcac

SEQ ID NO: 3449800 - DNA, 12 bp, Homo sapiens
gatcacggctca

SEQ ID NO: 3449801 - DNA, 14 bp, Homo sapiens
gatcagaaatacag

SEQ ID NO: 3449802 - DNA, 11 bp, Homo sapiens
gatcaggtcat

SEQ ID NO: 3449803 - DNA, 16 bp, Homo sapiens
gatcatccactgtgcc

SEQ ID NO: 3449804 - DNA, 21 bp, Homo sapiens
gatcatccactgtgccatgtg

SEQ ID NO: 3449805 - DNA, 19 bp, Homo sapiens
gatcatcgccagaggtgct

SEQ ID NO: 3449806 - DNA, 23 bp, Homo sapiens
gatcatcgccagaggtgcttcac

SEQ ID NO: 3449807 - DNA, 15 bp, Homo sapiens
gatcatgtacttttt

SEQ ID NO: 3449808 - DNA, 16 bp, Homo sapiens
gatccaaaagaagccc

SEQ ID NO: 3449809 - DNA, 19 bp, Homo sapiens
gatccaaaagaagccccca

SEQ ID NO: 3449810 - DNA, 12 bp, Homo sapiens
gatccaagctgg

SEQ ID NO: 3449811 - DNA, 19 bp, Homo sapiens
gatccaagctggtcccact

SEQ ID NO: 3449812 - DNA, 18 bp, Homo sapiens
gatccacccacctcagcc

SEQ ID NO: 3449813 - DNA, 19 bp, Homo sapiens
gatccacccacctcagcct

SEQ ID NO: 3449814 - DNA, 21 bp, Homo sapiens
gatccacccacctcagcctcc

SEQ ID NO: 3449815 - DNA, 22 bp, Homo sapiens
gatccacccacctcagcctccc

SEQ ID NO: 3449816 - DNA, 19 bp, Homo sapiens
gatccacctgtctcagcct

SEQ ID NO: 3449817 - DNA, 12 bp, Homo sapiens
gatccagggaca

SEQ ID NO: 3449818 - DNA, 22 bp, Homo sapiens
gatccagggacagaggccccag

SEQ ID NO: 3449819 - DNA, 13 bp, Homo sapiens
gatccatccagct

SEQ ID NO: 3449820 - DNA, 18 bp, Homo sapiens
gatccatccagcttgcca

SEQ ID NO: 3449821 - DNA, 21 bp, Homo sapiens
gatcccaagtagaatctcagt

SEQ ID NO: 3449822 - DNA, 19 bp, Homo sapiens
gatcccaggcccctggagg

SEQ ID NO: 3449823 - DNA, 13 bp, Homo sapiens
gatccctcccccc

SEQ ID NO: 3449824 - DNA, 23 bp, Homo sapiens
gatccctcccccccatgcactgt

SEQ ID NO: 3449825 - DNA, 19 bp, Homo sapiens
gatccctgtctttcctaag

SEQ ID NO: 3449826 - DNA, 18 bp, Homo sapiens
gatcctaggcatttgctg

SEQ ID NO: 3449827 - DNA, 16 bp, Homo sapiens
gatcctcccacctcag

SEQ ID NO: 3449828 - DNA, 17 bp, Homo sapiens
gatcctcccacctcagc

SEQ ID NO: 3449829 - DNA, 18 bp, Homo sapiens
gatcctcccacctcagcc

SEQ ID NO: 3449830 - DNA, 19 bp, Homo sapiens
gatcctcccacctcagcct

SEQ ID NO: 3449831 - DNA, 17 bp, Homo sapiens
gatcctgcgggtggggc

SEQ ID NO: 3449832 - DNA, 17 bp, Homo sapiens
gatcgaaccgttttgaa

SEQ ID NO: 3449833 - DNA, 13 bp, Homo sapiens
gatctcactctgc

SEQ ID NO: 3449834 - DNA, 14 bp, Homo sapiens
gatctgagaatctt

SEQ ID NO: 3449835 - DNA, 16 bp, Homo sapiens
gatctgcaggggtctg

SEQ ID NO: 3449836 - DNA, 17 bp, Homo sapiens
gatctgcaggggtctgg

SEQ ID NO: 3449837 - DNA, 23 bp, Homo sapiens
gatctgcaggggtctgggagtca

SEQ ID NO: 3449838 - DNA, 12 bp, Homo sapiens
gatctggaaccc

SEQ ID NO: 3449839 - DNA, 14 bp, Homo sapiens
gatctggaacccag

SEQ ID NO: 3449840 - DNA, 16 bp, Homo sapiens
gatctggaacccagac

SEQ ID NO: 3449841 - DNA, 17 bp, Homo sapiens
gatctggaacctcagcc

SEQ ID NO: 3449842 - DNA, 20 bp, Homo sapiens
gatctggaacctcagcctgg

SEQ ID NO: 3449843 - DNA, 12 bp, Homo sapiens
gatctggcatgt

SEQ ID NO: 3449844 - DNA, 18 bp, Homo sapiens
gatctggggctctgggat

SEQ ID NO: 3449845 - DNA, 20 bp, Homo sapiens
gatctgggttcactgcaacc

SEQ ID NO: 3449846 - DNA, 20 bp, Homo sapiens
gatctgtatatacaataaca

SEQ ID NO: 3449847 - DNA, 15 bp, Homo sapiens
gatctgtcctcagcc

SEQ ID NO: 3449848 - DNA, 13 bp, Homo sapiens
gatctgttttgaa

SEQ ID NO: 3449849 - DNA, 18 bp, Homo sapiens
gatctgttttgaaggcaa

SEQ ID NO: 3449850 - DNA, 17 bp, Homo sapiens
gatctttgcagacaggc

SEQ ID NO: 3449851 - DNA, 11 bp, Homo sapiens
gatctttgtgg

SEQ ID NO: 3449852 - DNA, 19 bp, Homo sapiens
gatgaaatcttacagctgg

SEQ ID NO: 3449853 - DNA, 20 bp, Homo sapiens
gatgaaatcttacagctggg

SEQ ID NO: 3449854 - DNA, 21 bp, Homo sapiens
gatgaaatgaggtcagagcct

SEQ ID NO: 3449855 - DNA, 19 bp, Homo sapiens
gatgaagccgaccttagat

SEQ ID NO: 3449856 - DNA, 14 bp, Homo sapiens
gatgaatgtattta

SEQ ID NO: 3449857 - DNA, 22 bp, Homo sapiens
gatgaattgcgttggtctctgc

SEQ ID NO: 3449858 - DNA, 12 bp, Homo sapiens
gatgacagctct

SEQ ID NO: 3449859 - DNA, 21 bp, Homo sapiens
gatgacagctcttctaaggaa

SEQ ID NO: 3449860 - DNA, 12 bp, Homo sapiens
gatgacagtgct

SEQ ID NO: 3449861 - DNA, 21 bp, Homo sapiens
gatgactatgcagaggcctgg

SEQ ID NO: 3449862 - DNA, 12 bp, Homo sapiens
gatgactgcctt

SEQ ID NO: 3449863 - DNA, 13 bp, Homo sapiens
gatgagagttttg

SEQ ID NO: 3449864 - DNA, 12 bp, Homo sapiens
gatgagcagagc

SEQ ID NO: 3449865 - DNA, 16 bp, Homo sapiens
gatgagcatcccagga

SEQ ID NO: 3449866 - DNA, 16 bp, Homo sapiens
gatgagcatggagctg

SEQ ID NO: 3449867 - DNA, 17 bp, Homo sapiens
gatgagcatggagctgg

SEQ ID NO: 3449868 - DNA, 19 bp, Homo sapiens
gatgagctctacccagggc

SEQ ID NO: 3449869 - DNA, 14 bp, Homo sapiens
gatgatcctaggca

SEQ ID NO: 3449870 - DNA, 20 bp, Homo sapiens
gatgatctttgcagacaggc

SEQ ID NO: 3449871 - DNA, 21 bp, Homo sapiens
gatgatgaaatgaggtcagag

SEQ ID NO: 3449872 - DNA, 17 bp, Homo sapiens
gatgatgtgcctgggtg

SEQ ID NO: 3449873 - DNA, 15 bp, Homo sapiens
gatgattcaggtgca

SEQ ID NO: 3449874 - DNA, 22 bp, Homo sapiens
gatgatttcttgaaaagggtgt

SEQ ID NO: 3449875 - DNA, 14 bp, Homo sapiens
gatgcaaagaaaat

SEQ ID NO: 3449876 - DNA, 14 bp, Homo sapiens
gatgcaaagaggca

SEQ ID NO: 3449877 - DNA, 15 bp, Homo sapiens
gatgcaaagaggcaa

SEQ ID NO: 3449878 - DNA, 16 bp, Homo sapiens
gatgcaaagaggcaag

SEQ ID NO: 3449879 - DNA, 19 bp, Homo sapiens
gatgcaaatagcaaaacta

SEQ ID NO: 3449880 - DNA, 22 bp, Homo sapiens
gatgcacatgttggaggagaga

SEQ ID NO: 3449881 - DNA, 22 bp, Homo sapiens
gatgcagcgccgtgtcctctct

SEQ ID NO: 3449882 - DNA, 21 bp, Homo sapiens
gatgcaggatttgttctctgt

SEQ ID NO: 3449883 - DNA, 17 bp, Homo sapiens
gatgcatgtcttttaaa

SEQ ID NO: 3449884 - DNA, 20 bp, Homo sapiens
gatgcatgttttccagctcc

SEQ ID NO: 3449885 - DNA, 21 bp, Homo sapiens
gatgcattcttggttggctgg

SEQ ID NO: 3449886 - DNA, 15 bp, Homo sapiens
gatgccacacaagga

SEQ ID NO: 3449887 - DNA, 13 bp, Homo sapiens
gatgccccaggga

SEQ ID NO: 3449888 - DNA, 14 bp, Homo sapiens
gatgccccagggat

SEQ ID NO: 3449889 - DNA, 16 bp, Homo sapiens
gatgccccagggatgg

SEQ ID NO: 3449890 - DNA, 17 bp, Homo sapiens
gatgccccagggatggg

SEQ ID NO: 3449891 - DNA, 13 bp, Homo sapiens
gatgccctgccct

SEQ ID NO: 3449892 - DNA, 15 bp, Homo sapiens
gatgccctggaggtg

SEQ ID NO: 3449893 - DNA, 13 bp, Homo sapiens
gatgcctactttt

SEQ ID NO: 3449894 - DNA, 14 bp, Homo sapiens
gatgcctggtggca

SEQ ID NO: 3449895 - DNA, 16 bp, Homo sapiens
gatgcctggtggcagc

SEQ ID NO: 3449896 - DNA, 17 bp, Homo sapiens
gatgcctggtggcagct

SEQ ID NO: 3449897 - DNA, 14 bp, Homo sapiens
gatgccttgaattg

SEQ ID NO: 3449898 - DNA, 22 bp, Homo sapiens
gatgccttttttgtagtttttt

SEQ ID NO: 3449899 - DNA, 19 bp, Homo sapiens
gatgcgcagccccatctgt

SEQ ID NO: 3449900 - DNA, 18 bp, Homo sapiens
gatgctgccggcacagct

SEQ ID NO: 3449901 - DNA, 13 bp, Homo sapiens
gatgctggcccag

SEQ ID NO: 3449902 - DNA, 23 bp, Homo sapiens
gatgctggcccagggcccagagc

SEQ ID NO: 3449903 - DNA, 15 bp, Homo sapiens
gatgcttacatctgg

SEQ ID NO: 3449904 - DNA, 21 bp, Homo sapiens
gatgcttacatctggaatctg

SEQ ID NO: 3449905 - DNA, 22 bp, Homo sapiens
gatgcttagagggatttctttg

SEQ ID NO: 3449906 - DNA, 23 bp, Homo sapiens
gatgcttctcactgccatgccag

SEQ ID NO: 3449907 - DNA, 21 bp, Homo sapiens
gatgctttaagtgcacaacat

SEQ ID NO: 3449908 - DNA, 16 bp, Homo sapiens
gatgcttttgtctaat

SEQ ID NO: 3449909 - DNA, 14 bp, Homo sapiens
gatggatttaacag

SEQ ID NO: 3449910 - DNA, 15 bp, Homo sapiens
gatggcaacagatct

SEQ ID NO: 3449911 - DNA, 13 bp, Homo sapiens
gatggcaggatgg

SEQ ID NO: 3449912 - DNA, 18 bp, Homo sapiens
gatggcaggatggcctgg

SEQ ID NO: 3449913 - DNA, 13 bp, Homo sapiens
gatggccaggctg

SEQ ID NO: 3449914 - DNA, 18 bp, Homo sapiens
gatggccggagaggaccg

SEQ ID NO: 3449915 - DNA, 14 bp, Homo sapiens
gatggcctggccag

SEQ ID NO: 3449916 - DNA, 19 bp, Homo sapiens
gatgggaggtatgggctgg

SEQ ID NO: 3449917 - DNA, 20 bp, Homo sapiens
gatgggaggtatgggctggg

SEQ ID NO: 3449918 - DNA, 21 bp, Homo sapiens
gatgggcaacccccagcctgc

SEQ ID NO: 3449919 - DNA, 22 bp, Homo sapiens
gatgggcaacccccagcctgct

SEQ ID NO: 3449920 - DNA, 12 bp, Homo sapiens
gatggggagggg

SEQ ID NO: 3449921 - DNA, 17 bp, Homo sapiens
gatgggggaaagcacag

SEQ ID NO: 3449922 - DNA, 22 bp, Homo sapiens
gatggggtggggtggagaactc

SEQ ID NO: 3449923 - DNA, 16 bp, Homo sapiens
gatgggtgaaggctgg

SEQ ID NO: 3449924 - DNA, 15 bp, Homo sapiens
gatggtaagaaacaa

SEQ ID NO: 3449925 - DNA, 14 bp, Homo sapiens
gatggtgctgagaa

SEQ ID NO: 3449926 - DNA, 16 bp, Homo sapiens
gatggtgctgagaagc

SEQ ID NO: 3449927 - DNA, 17 bp, Homo sapiens
gatggtgctgagaagct

SEQ ID NO: 3449928 - DNA, 18 bp, Homo sapiens
gatggtggcacattcctt

SEQ ID NO: 3449929 - DNA, 17 bp, Homo sapiens
gatggtgggatgtggtt

SEQ ID NO: 3449930 - DNA, 13 bp, Homo sapiens
gatggtgggcttc

SEQ ID NO: 3449931 - DNA, 15 bp, Homo sapiens
gatggttgtgtatgg

SEQ ID NO: 3449932 - DNA, 22 bp, Homo sapiens
gatgtaaggccttagccatgat

SEQ ID NO: 3449933 - DNA, 13 bp, Homo sapiens
gatgtaatgtttt

SEQ ID NO: 3449934 - DNA, 19 bp, Homo sapiens
gatgtaccatgaaacaaag

SEQ ID NO: 3449935 - DNA, 17 bp, Homo sapiens
gatgtcctcaccacatg

SEQ ID NO: 3449936 - DNA, 19 bp, Homo sapiens
gatgtctgtttgctgatgg

SEQ ID NO: 3449937 - DNA, 20 bp, Homo sapiens
gatgtctgtttgctgatggt

SEQ ID NO: 3449938 - DNA, 13 bp, Homo sapiens
gatgtgaagccaa

SEQ ID NO: 3449939 - DNA, 17 bp, Homo sapiens
ctgaggcagcagtgtga

SEQ ID NO: 3449940 - DNA, 23 bp, Homo sapiens
ctgaggcagcagtgtgaggccag

SEQ ID NO: 3449941 - DNA, 15 bp, Homo sapiens
ctgaggcatccagca

SEQ ID NO: 3449942 - DNA, 20 bp, Homo sapiens
ctgaggcatccagcagtctc

SEQ ID NO: 3449943 - DNA, 14 bp, Homo sapiens
ctgaggccacactc

SEQ ID NO: 3449944 - DNA, 23 bp, Homo sapiens
ctgaggcctgggccgctgccacg

SEQ ID NO: 3449945 - DNA, 16 bp, Homo sapiens
ctgaggcggagcccag

SEQ ID NO: 3449946 - DNA, 17 bp, Homo sapiens
ctgaggctggcacagga

SEQ ID NO: 3449947 - DNA, 19 bp, Homo sapiens
ctgaggctggcacaggaca

SEQ ID NO: 3449948 - DNA, 20 bp, Homo sapiens
ctgaggctggcacaggacat

SEQ ID NO: 3449949 - DNA, 14 bp, Homo sapiens
ctgaggctgtggtc

SEQ ID NO: 3449950 - DNA, 14 bp, Homo sapiens
ctgaggctttggat

SEQ ID NO: 3449951 - DNA, 15 bp, Homo sapiens
ctgagggcctgctgg

SEQ ID NO: 3449952 - DNA, 12 bp, Homo sapiens
ctgagggctgat

SEQ ID NO: 3449953 - DNA, 15 bp, Homo sapiens
ctgagggtgcccttt

SEQ ID NO: 3449954 - DNA, 19 bp, Homo sapiens
ctgagggtgtttcttcctg

SEQ ID NO: 3449955 - DNA, 14 bp, Homo sapiens
ctgaggtcactgct

SEQ ID NO: 3449956 - DNA, 12 bp, Homo sapiens
ctgaggtgggag

SEQ ID NO: 3449957 - DNA, 22 bp, Homo sapiens
ctgagtagatgcgcagccccat

SEQ ID NO: 3449958 - DNA, 17 bp, Homo sapiens
ctgagtagctctcctga

SEQ ID NO: 3449959 - DNA, 18 bp, Homo sapiens
ctgagtctatgttcaaag

SEQ ID NO: 3449960 - DNA, 23 bp, Homo sapiens
ctgagtgccttctgtggggactc

SEQ ID NO: 3449961 - DNA, 13 bp, Homo sapiens
ctgagtggcaggg

SEQ ID NO: 3449962 - DNA, 16 bp, Homo sapiens
ctgagttttccatggc

SEQ ID NO: 3449963 - DNA, 18 bp, Homo sapiens
ctgagttttccatggcag

SEQ ID NO: 3449964 - DNA, 19 bp, Homo sapiens
ctgagttttccatggcagg

SEQ ID NO: 3449965 - DNA, 15 bp, Homo sapiens
ctgagttttgttttg

SEQ ID NO: 3449966 - DNA, 19 bp, Homo sapiens
ctgataaaaccatgtagaa

SEQ ID NO: 3449967 - DNA, 24 bp, Homo sapiens
ctgataactagatggtgctgagaa

SEQ ID NO: 3449968 - DNA, 12 bp, Homo sapiens
ctgatacctcaa

SEQ ID NO: 3449969 - DNA, 22 bp, Homo sapiens
ctgatatatgtgtttttcacat

SEQ ID NO: 3449970 - DNA, 22 bp, Homo sapiens
ctgatatttccctcccctgggg

SEQ ID NO: 3449971 - DNA, 12 bp, Homo sapiens
ctgatccctcta

SEQ ID NO: 3449972 - DNA, 17 bp, Homo sapiens
ctgatccctctgggggc

SEQ ID NO: 3449973 - DNA, 19 bp, Homo sapiens
ctgatcctggaggcccagt

SEQ ID NO: 3449974 - DNA, 21 bp, Homo sapiens
ctgatcctggaggcccagttc

SEQ ID NO: 3449975 - DNA, 22 bp, Homo sapiens
ctgatctttaactggaaggctg

SEQ ID NO: 3449976 - DNA, 23 bp, Homo sapiens
ctgatctttaactggaaggctgc

SEQ ID NO: 3449977 - DNA, 23 bp, Homo sapiens
ctgatgcaggatttgttctctgt

SEQ ID NO: 3449978 - DNA, 19 bp, Homo sapiens
ctgatgcttacatctggaa

SEQ ID NO: 3449979 - DNA, 16 bp, Homo sapiens
ctgatggcaggatggc

SEQ ID NO: 3449980 - DNA, 17 bp, Homo sapiens
ctgatggcaggatggcc

SEQ ID NO: 3449981 - DNA, 23 bp, Homo sapiens
ctgatgggcaacccccagcctgc

SEQ ID NO: 3449982 - DNA, 24 bp, Homo sapiens
ctgatgggcaacccccagcctgct

SEQ ID NO: 3449983 - DNA, 22 bp, Homo sapiens
ctgatgggcgtacgctggtgct

SEQ ID NO: 3449984 - DNA, 18 bp, Homo sapiens
ctgattaaatatttgaag

SEQ ID NO: 3449985 - DNA, 20 bp, Homo sapiens
ctgattaaatatttgaagag

SEQ ID NO: 3449986 - DNA, 14 bp, Homo sapiens
ctgattcaactaaa

SEQ ID NO: 3449987 - DNA, 20 bp, Homo sapiens
ctgattcccaagctctgctc

SEQ ID NO: 3449988 - DNA, 14 bp, Homo sapiens
ctgattctcagggt

SEQ ID NO: 3449989 - DNA, 23 bp, Homo sapiens
ctgcaaaaaatactttttctaat

SEQ ID NO: 3449990 - DNA, 17 bp, Homo sapiens
ctgcaaaaatatttata

SEQ ID NO: 3449991 - DNA, 20 bp, Homo sapiens
ctgcaaaaatatttataaaa

SEQ ID NO: 3449992 - DNA, 17 bp, Homo sapiens
ctgcaaaaggactctca

SEQ ID NO: 3449993 - DNA, 13 bp, Homo sapiens
ctgcaaaatctgt

SEQ ID NO: 3449994 - DNA, 12 bp, Homo sapiens
ctgcaaaatgag

SEQ ID NO: 3449995 - DNA, 15 bp, Homo sapiens
ctgcaaacgctgcct

SEQ ID NO: 3449996 - DNA, 22 bp, Homo sapiens
ctgcaaagatctgtcctcagcc

SEQ ID NO: 3449997 - DNA, 12 bp, Homo sapiens
ctgcaacaaaat

SEQ ID NO: 3449998 - DNA, 13 bp, Homo sapiens
ctgcaagaagtct

SEQ ID NO: 3449999 - DNA, 20 bp, Homo sapiens
ctgcaagaattgaagcagga

SEQ ID NO: 3450000 - DNA, 15 bp, Homo sapiens
ctgcaagagccaagt

SEQ ID NO: 3450001 - DNA, 22 bp, Homo sapiens
ctgcaaggtttaggctggtggc

SEQ ID NO: 3450002 - DNA, 20 bp, Homo sapiens
ctgcaagtccttttgtaaag

SEQ ID NO: 3450003 - DNA, 20 bp, Homo sapiens
ctgcaagtgctcagggaaat

SEQ ID NO: 3450004 - DNA, 21 bp, Homo sapiens
ctgcacaagccatgctggctc

SEQ ID NO: 3450005 - DNA, 15 bp, Homo sapiens
ctgcacaagctgcac

SEQ ID NO: 3450006 - DNA, 18 bp, Homo sapiens
ctgcacaagctgcaccct

SEQ ID NO: 3450007 - DNA, 14 bp, Homo sapiens
ctgcacagcttttc

SEQ ID NO: 3450008 - DNA, 15 bp, Homo sapiens
ctgcacagcttttcc

SEQ ID NO: 3450009 - DNA, 18 bp, Homo sapiens
ctgcacagcttttccaaa

SEQ ID NO: 3450010 - DNA, 22 bp, Homo sapiens
ctgcacatgactcgggggtggg

SEQ ID NO: 3450011 - DNA, 14 bp, Homo sapiens
ctgcacccccctgg

SEQ ID NO: 3450012 - DNA, 18 bp, Homo sapiens
ctgcaccgggccacagag

SEQ ID NO: 3450013 - DNA, 17 bp, Homo sapiens
ctgcaccgtactgtgga

SEQ ID NO: 3450014 - DNA, 16 bp, Homo sapiens
ctgcaccttgccaggg

SEQ ID NO: 3450015 - DNA, 19 bp, Homo sapiens
ctgcactccagcctgggtg

SEQ ID NO: 3450016 - DNA, 18 bp, Homo sapiens
ctgcactccctcctggag

SEQ ID NO: 3450017 - DNA, 20 bp, Homo sapiens
ctgcactccctcctggagct

SEQ ID NO: 3450018 - DNA, 16 bp, Homo sapiens
ctgcactgcagccaca

SEQ ID NO: 3450019 - DNA, 20 bp, Homo sapiens
ctgcagaaaccctgagcaga

SEQ ID NO: 3450020 - DNA, 13 bp, Homo sapiens
ctgcagaaggaaa

SEQ ID NO: 3450021 - DNA, 15 bp, Homo sapiens
ctgcagaaggaaaaa

SEQ ID NO: 3450022 - DNA, 21 bp, Homo sapiens
ctgcagaaggaaaaatgtgta

SEQ ID NO: 3450023 - DNA, 17 bp, Homo sapiens
ctgcagacttcccagct

SEQ ID NO: 3450024 - DNA, 18 bp, Homo sapiens
ctgcagacttcccagcta

SEQ ID NO: 3450025 - DNA, 16 bp, Homo sapiens
ctgcagagcacacagg

SEQ ID NO: 3450026 - DNA, 13 bp, Homo sapiens
ctgcagagcagat

SEQ ID NO: 3450027 - DNA, 16 bp, Homo sapiens
ctgcagagcagatggc

SEQ ID NO: 3450028 - DNA, 22 bp, Homo sapiens
ctgcagagcagatggcagatgc

SEQ ID NO: 3450029 - DNA, 20 bp, Homo sapiens
ctgcagaggccagaggcccc

SEQ ID NO: 3450030 - DNA, 18 bp, Homo sapiens
ctgcagatttgggctgga

SEQ ID NO: 3450031 - DNA, 20 bp, Homo sapiens
ctgcagatttgggctggaac

SEQ ID NO: 3450032 - DNA, 23 bp, Homo sapiens
ctgcagatttgggctggaacaga

SEQ ID NO: 3450033 - DNA, 15 bp, Homo sapiens
ctgcagccacagggg

SEQ ID NO: 3450034 - DNA, 19 bp, Homo sapiens
ctgcagcctcaacctcctg

SEQ ID NO: 3450035 - DNA, 23 bp, Homo sapiens
ctgcagcctcaacctcctgggct

SEQ ID NO: 3450036 - DNA, 19 bp, Homo sapiens
ctgcagctccctggcttct

SEQ ID NO: 3450037 - DNA, 23 bp, Homo sapiens
ctgcagctccctggcttctgtgg

SEQ ID NO: 3450038 - DNA, 15 bp, Homo sapiens
ctgcaggacctgcct

SEQ ID NO: 3450039 - DNA, 11 bp, Homo sapiens
ctgcaggactt

SEQ ID NO: 3450040 - DNA, 15 bp, Homo sapiens
ctgcaggacttgcca

SEQ ID NO: 3450041 - DNA, 12 bp, Homo sapiens
ctgcaggcagac

SEQ ID NO: 3450042 - DNA, 23 bp, Homo sapiens
ctgcaggccaggccagctgcctc

SEQ ID NO: 3450043 - DNA, 13 bp, Homo sapiens
ctgcaggccctgg

SEQ ID NO: 3450044 - DNA, 16 bp, Homo sapiens
ctgcaggccctggcct

SEQ ID NO: 3450045 - DNA, 17 bp, Homo sapiens
ctgcaggccctggcctc

SEQ ID NO: 3450046 - DNA, 14 bp, Homo sapiens
ctgcaggggtctgg

SEQ ID NO: 3450047 - DNA, 18 bp, Homo sapiens
ctgcaggtgagcagacag

SEQ ID NO: 3450048 - DNA, 14 bp, Homo sapiens
ctgcagtaaatctt

SEQ ID NO: 3450049 - DNA, 14 bp, Homo sapiens
ctgcagtgtgcccc

SEQ ID NO: 3450050 - DNA, 16 bp, Homo sapiens
ctgcataccaacctgg

SEQ ID NO: 3450051 - DNA, 22 bp, Homo sapiens
ctgcatccagagattcattttc

SEQ ID NO: 3450052 - DNA, 18 bp, Homo sapiens
ctgcatctaagcccatgg

SEQ ID NO: 3450053 - DNA, 19 bp, Homo sapiens
ctgcatctgaccagcagcg

SEQ ID NO: 3450054 - DNA, 14 bp, Homo sapiens
ctgcatctggggcc

SEQ ID NO: 3450055 - DNA, 16 bp, Homo sapiens
ctgcatgatgtttgcc

SEQ ID NO: 3450056 - DNA, 17 bp, Homo sapiens
ctgcatgccctctcagg

SEQ ID NO: 3450057 - DNA, 21 bp, Homo sapiens
ctgcatgccctctcaggccgg

SEQ ID NO: 3450058 - DNA, 12 bp, Homo sapiens
ctgcatgctgct

SEQ ID NO: 3450059 - DNA, 18 bp, Homo sapiens
ctgcatgctgctggacag

SEQ ID NO: 3450060 - DNA, 22 bp, Homo sapiens
ctgcatgctgctggacagtatc

SEQ ID NO: 3450061 - DNA, 21 bp, Homo sapiens
ctgcatgtaaacacgcctgca

SEQ ID NO: 3450062 - DNA, 17 bp, Homo sapiens
ctgcattgagaactgca

SEQ ID NO: 3450063 - DNA, 17 bp, Homo sapiens
ctgcatttagctgtatt

SEQ ID NO: 3450064 - DNA, 17 bp, Homo sapiens
ctgcatttcggtggcta

SEQ ID NO: 3450065 - DNA, 18 bp, Homo sapiens
ctgcatttcggtggctag

SEQ ID NO: 3450066 - DNA, 15 bp, Homo sapiens
ctgccaaaatgctct

SEQ ID NO: 3450067 - DNA, 17 bp, Homo sapiens
ctgccaacatactttaa

SEQ ID NO: 3450068 - DNA, 15 bp, Homo sapiens
ctgccaataaatcct

SEQ ID NO: 3450069 - DNA, 14 bp, Homo sapiens
ctgccacaccctcc

SEQ ID NO: 3450070 - DNA, 17 bp, Homo sapiens
ctgccacaccctcccca

SEQ ID NO: 3450071 - DNA, 23 bp, Homo sapiens
ctgccacagcctcccctgccagg

SEQ ID NO: 3450072 - DNA, 16 bp, Homo sapiens
ctgccaccaccctgtc

SEQ ID NO: 3450073 - DNA, 18 bp, Homo sapiens
ctgccaccaggccacctc

SEQ ID NO: 3450074 - DNA, 15 bp, Homo sapiens
ctgccacccacctcc

SEQ ID NO: 3450075 - DNA, 17 bp, Homo sapiens
ctgccacccacctccct

SEQ ID NO: 3450076 - DNA, 22 bp, Homo sapiens
ctgccacccacctccctgcctc

SEQ ID NO: 3450077 - DNA, 15 bp, Homo sapiens
ctgccaccctgggga

SEQ ID NO: 3450078 - DNA, 16 bp, Homo sapiens
ctgccactcactaggc

SEQ ID NO: 3450079 - DNA, 18 bp, Homo sapiens
ctgccactccagtcctgc

SEQ ID NO: 3450080 - DNA, 13 bp, Homo sapiens
ctgccaggccccc

SEQ ID NO: 3450081 - DNA, 19 bp, Homo sapiens
ctgccaggggttcttgagc

SEQ ID NO: 3450082 - DNA, 20 bp, Homo sapiens
ctgccataaaacattaagaa

SEQ ID NO: 3450083 - DNA, 23 bp, Homo sapiens
ctgccataaaacattaagaaaat

SEQ ID NO: 3450084 - DNA, 13 bp, Homo sapiens
ctgccatagccag

SEQ ID NO: 3450085 - DNA, 15 bp, Homo sapiens
ctgccatagccagga

SEQ ID NO: 3450086 - DNA, 18 bp, Homo sapiens
ctgccatagccaggagcg

SEQ ID NO: 3450087 - DNA, 22 bp, Homo sapiens
ctgccatattctgttggccagt

SEQ ID NO: 3450088 - DNA, 12 bp, Homo sapiens
ctgccatccagg

SEQ ID NO: 3450089 - DNA, 15 bp, Homo sapiens
ctgccatgcagggcc

SEQ ID NO: 3450090 - DNA, 15 bp, Homo sapiens
ctgccatgccagctt

SEQ ID NO: 3450091 - DNA, 22 bp, Homo sapiens
ctgccatggaactgtttccttc

SEQ ID NO: 3450092 - DNA, 19 bp, Homo sapiens
ctgccatgtactagtttta

SEQ ID NO: 3450093 - DNA, 22 bp, Homo sapiens
ctgccatgttgcccctttctct

SEQ ID NO: 3450094 - DNA, 16 bp, Homo sapiens
ctgccatttctgagat

SEQ ID NO: 3450095 - DNA, 12 bp, Homo sapiens
ctgcccacctgt

SEQ ID NO: 3450096 - DNA, 14 bp, Homo sapiens
ctgcccaggcactg

SEQ ID NO: 3450097 - DNA, 15 bp, Homo sapiens
ctgcccaggcactgc

SEQ ID NO: 3450098 - DNA, 14 bp, Homo sapiens
ctgcccaggcccct

SEQ ID NO: 3450099 - DNA, 16 bp, Homo sapiens
ctgcccaggcccctgc

SEQ ID NO: 3450100 - DNA, 23 bp, Homo sapiens
ctgcccagtcgaccccaaaggaa

SEQ ID NO: 3450101 - DNA, 15 bp, Homo sapiens
ctgccccaaacaaat

SEQ ID NO: 3450102 - DNA, 21 bp, Homo sapiens
ctgccccaaacaaatatgcaa

SEQ ID NO: 3450103 - DNA, 21 bp, Homo sapiens
ctgccccacatgtggccatgg

SEQ ID NO: 3450104 - DNA, 16 bp, Homo sapiens
ctgccccatcctccag

SEQ ID NO: 3450105 - DNA, 21 bp, Homo sapiens
ctgccccatcctccagcaggg

SEQ ID NO: 3450106 - DNA, 19 bp, Homo sapiens
ctgccccatctcccctcag

SEQ ID NO: 3450107 - DNA, 22 bp, Homo sapiens
ctgccccatctcccctcagctc

SEQ ID NO: 3450108 - DNA, 17 bp, Homo sapiens
ctgcccccaggactggg

SEQ ID NO: 3450109 - DNA, 19 bp, Homo sapiens
ctgccccccccccccatct

SEQ ID NO: 3450110 - DNA, 20 bp, Homo sapiens
ctgccccgcttccccacaga

SEQ ID NO: 3450111 - DNA, 23 bp, Homo sapiens
ctgccccgggtccccagctcccc

SEQ ID NO: 3450112 - DNA, 15 bp, Homo sapiens
ctgcccctcccagaa

SEQ ID NO: 3450113 - DNA, 18 bp, Homo sapiens
ctgcccgcagacctctgg

SEQ ID NO: 3450114 - DNA, 13 bp, Homo sapiens
ctgcccggcaggg

SEQ ID NO: 3450115 - DNA, 18 bp, Homo sapiens
ctgcccgtaaacacgcct

SEQ ID NO: 3450116 - DNA, 21 bp, Homo sapiens
ctgcccgtaaacacgcctgca

SEQ ID NO: 3450117 - DNA, 14 bp, Homo sapiens
ctgcccgtgtacat

SEQ ID NO: 3450118 - DNA, 15 bp, Homo sapiens
ctgcccgtgtacata

SEQ ID NO: 3450119 - DNA, 18 bp, Homo sapiens
ctgccctcacctcccttt

SEQ ID NO: 3450120 - DNA, 10 bp, Homo sapiens
ctgccctccc

SEQ ID NO: 3450121 - DNA, 14 bp, Homo sapiens
ctgccctcccctct

SEQ ID NO: 3450122 - DNA, 12 bp, Homo sapiens
ctgccctctaga

SEQ ID NO: 3450123 - DNA, 14 bp, Homo sapiens
ctgccctctagagc

SEQ ID NO: 3450124 - DNA, 18 bp, Homo sapiens
ctgcccttgtcccactca

SEQ ID NO: 3450125 - DNA, 18 bp, Homo sapiens
ctgcccttttttctgcct

SEQ ID NO: 3450126 - DNA, 20 bp, Homo sapiens
ctgcccttttttctgcctcc

SEQ ID NO: 3450127 - DNA, 16 bp, Homo sapiens
ctgccgagacagaccc

SEQ ID NO: 3450128 - DNA, 13 bp, Homo sapiens
ctgccgcagagct

SEQ ID NO: 3450129 - DNA, 13 bp, Homo sapiens
ctgccgctacctc

SEQ ID NO: 3450130 - DNA, 18 bp, Homo sapiens
ctgccgctacctccctcc

SEQ ID NO: 3450131 - DNA, 15 bp, Homo sapiens
ctgccggcacagctg

SEQ ID NO: 3450132 - DNA, 17 bp, Homo sapiens
ctgccggcacagctggg

SEQ ID NO: 3450133 - DNA, 20 bp, Homo sapiens
ctgccggcacagctgggata

SEQ ID NO: 3450134 - DNA, 18 bp, Homo sapiens
ctgccgggctgagggcct

SEQ ID NO: 3450135 - DNA, 19 bp, Homo sapiens
ctgccgggctgagggcctg

SEQ ID NO: 3450136 - DNA, 20 bp, Homo sapiens
ctgccgtggggccgccgcct

SEQ ID NO: 3450137 - DNA, 16 bp, Homo sapiens
ctgcctaggtccccca

SEQ ID NO: 3450138 - DNA, 12 bp, Homo sapiens
ctgcctcagcct

SEQ ID NO: 3450139 - DNA, 14 bp, Homo sapiens
ctgcctcagcctcc

SEQ ID NO: 3450140 - DNA, 14 bp, Homo sapiens
ctgcctcaggactg

SEQ ID NO: 3450141 - DNA, 12 bp, Homo sapiens
ctgcctcattta

SEQ ID NO: 3450142 - DNA, 16 bp, Homo sapiens
ctgcctccagggctgg

SEQ ID NO: 3450143 - DNA, 19 bp, Homo sapiens
ctgcctccagggctggact

SEQ ID NO: 3450144 - DNA, 23 bp, Homo sapiens
ctgcctccagggctggactgagg

SEQ ID NO: 3450145 - DNA, 23 bp, Homo sapiens
ctgcctccattatccattcccaa

SEQ ID NO: 3450146 - DNA, 11 bp, Homo sapiens
ctgcctcccaa

SEQ ID NO: 3450147 - DNA, 20 bp, Homo sapiens
ctgcctcccctctccttcct

SEQ ID NO: 3450148 - DNA, 14 bp, Homo sapiens
ctgcctcccttgac

SEQ ID NO: 3450149 - DNA, 12 bp, Homo sapiens
ctgcctccttta

SEQ ID NO: 3450150 - DNA, 21 bp, Homo sapiens
ctgcctctgacacacagctct

SEQ ID NO: 3450151 - DNA, 23 bp, Homo sapiens
ctgcctctgacacacagctctgt

SEQ ID NO: 3450152 - DNA, 15 bp, Homo sapiens
ctgcctcttctctac

SEQ ID NO: 3450153 - DNA, 17 bp, Homo sapiens
ctgcctcttctgggagg

SEQ ID NO: 3450154 - DNA, 18 bp, Homo sapiens
ctgcctgaagtcacacag

SEQ ID NO: 3450155 - DNA, 15 bp, Homo sapiens
ctgcctgacaggctg

SEQ ID NO: 3450156 - DNA, 23 bp, Homo sapiens
ctgcctgacatttggagtgttcc

SEQ ID NO: 3450157 - DNA, 16 bp, Homo sapiens
ctgcctgatggacctg

SEQ ID NO: 3450158 - DNA, 16 bp, Homo sapiens
ctgcctgcatctattc

SEQ ID NO: 3450159 - DNA, 12 bp, Homo sapiens
ctgcctgcccac

SEQ ID NO: 3450160 - DNA, 13 bp, Homo sapiens
ctgcctgcccagg

SEQ ID NO: 3450161 - DNA, 14 bp, Homo sapiens
ctgcctgcccaggc

SEQ ID NO: 3450162 - DNA, 18 bp, Homo sapiens
ctgcctggactagaggga

SEQ ID NO: 3450163 - DNA, 22 bp, Homo sapiens
ctgcctggagacttagggcacc

SEQ ID NO: 3450164 - DNA, 12 bp, Homo sapiens
ctgcctggcagg

SEQ ID NO: 3450165 - DNA, 12 bp, Homo sapiens
ctgcctgggttt

SEQ ID NO: 3450166 - DNA, 22 bp, Homo sapiens
ctgcctgtagcccactctgctc

SEQ ID NO: 3450167 - DNA, 23 bp, Homo sapiens
ctgcctgtagcccactctgctcg

SEQ ID NO: 3450168 - DNA, 20 bp, Homo sapiens
ctgcctgttcagctccagct

SEQ ID NO: 3450169 - DNA, 18 bp, Homo sapiens
ctgccttaccgagagcca

SEQ ID NO: 3450170 - DNA, 15 bp, Homo sapiens
ctgccttagcttcag

SEQ ID NO: 3450171 - DNA, 17 bp, Homo sapiens
ctgccttagcttcagga

SEQ ID NO: 3450172 - DNA, 16 bp, Homo sapiens
ctgccttcctcctggg

SEQ ID NO: 3450173 - DNA, 15 bp, Homo sapiens
ctgccttcgcttctt

SEQ ID NO: 3450174 - DNA, 13 bp, Homo sapiens
ctgccttgccttt

SEQ ID NO: 3450175 - DNA, 16 bp, Homo sapiens
ctgcctttagaaaata

SEQ ID NO: 3450176 - DNA, 15 bp, Homo sapiens
ctgcctttattgtgt

SEQ ID NO: 3450177 - DNA, 18 bp, Homo sapiens
ctgcctttattgtgtttg

SEQ ID NO: 3450178 - DNA, 19 bp, Homo sapiens
ctgcgcccagtccttccac

SEQ ID NO: 3450179 - DNA, 13 bp, Homo sapiens
ctgcgcctttcct

SEQ ID NO: 3450180 - DNA, 21 bp, Homo sapiens
ctgcgcctttccttttcgcct

SEQ ID NO: 3450181 - DNA, 20 bp, Homo sapiens
ctgcggcaggactgcagagc

SEQ ID NO: 3450182 - DNA, 19 bp, Homo sapiens
ctgcgggaagctgaccttt

SEQ ID NO: 3450183 - DNA, 21 bp, Homo sapiens
ctgcgggtggggcttggggct

SEQ ID NO: 3450184 - DNA, 23 bp, Homo sapiens
ctgcggtccacccaggagccccg

SEQ ID NO: 3450185 - DNA, 19 bp, Homo sapiens
ctgcgtcatgcttgtgtta

SEQ ID NO: 3450186 - DNA, 19 bp, Homo sapiens
ctgcgtgtcacctgtgctt

SEQ ID NO: 3450187 - DNA, 15 bp, Homo sapiens
ctgctactagctctt

SEQ ID NO: 3450188 - DNA, 17 bp, Homo sapiens
ctgctatcaaagaggtt

SEQ ID NO: 3450189 - DNA, 15 bp, Homo sapiens
ctgctatcattattc

SEQ ID NO: 3450190 - DNA, 18 bp, Homo sapiens
ctgctcactttaaacctg

SEQ ID NO: 3450191 - DNA, 18 bp, Homo sapiens
ctgctcagaacttgctgc

SEQ ID NO: 3450192 - DNA, 19 bp, Homo sapiens
ctgctcagaacttgctgct

SEQ ID NO: 3450193 - DNA, 22 bp, Homo sapiens
ctgctcagctctgggccattct

SEQ ID NO: 3450194 - DNA, 18 bp, Homo sapiens
ctgctcagctctggtcca

SEQ ID NO: 3450195 - DNA, 16 bp, Homo sapiens
ctgctcagcttctcct

SEQ ID NO: 3450196 - DNA, 14 bp, Homo sapiens
ctgctccaagtggt

SEQ ID NO: 3450197 - DNA, 13 bp, Homo sapiens
ctgctccagacct

SEQ ID NO: 3450198 - DNA, 15 bp, Homo sapiens
ctgctccagctgttc

SEQ ID NO: 3450199 - DNA, 21 bp, Homo sapiens
ctgctcccctctgcacggacc

SEQ ID NO: 3450200 - DNA, 14 bp, Homo sapiens
ctgctcctagaggg

SEQ ID NO: 3450201 - DNA, 19 bp, Homo sapiens
ctgctcctctccccagcaa

SEQ ID NO: 3450202 - DNA, 20 bp, Homo sapiens
ctgctcctctccccagcaag

SEQ ID NO: 3450203 - DNA, 13 bp, Homo sapiens
ctgctcctttccc

SEQ ID NO: 3450204 - DNA, 14 bp, Homo sapiens
ctgctcctttcccc

SEQ ID NO: 3450205 - DNA, 15 bp, Homo sapiens
ctgctcgccttagca

SEQ ID NO: 3450206 - DNA, 16 bp, Homo sapiens
ctgctcgccttagcac

SEQ ID NO: 3450207 - DNA, 15 bp, Homo sapiens
ctgctctcagcctcc

SEQ ID NO: 3450208 - DNA, 19 bp, Homo sapiens
ctgctctccgaccagacac

SEQ ID NO: 3450209 - DNA, 20 bp, Homo sapiens
ctgctctctttttctccagg

SEQ ID NO: 3450210 - DNA, 24 bp, Homo sapiens
ctgctctctttttctccagggtca

SEQ ID NO: 3450211 - DNA, 13 bp, Homo sapiens
ctgctctgagcca

SEQ ID NO: 3450212 - DNA, 20 bp, Homo sapiens
ctgctctgcgtgtcacctgt

SEQ ID NO: 3450213 - DNA, 22 bp, Homo sapiens
ctgctctgcgtgtcacctgtgc

SEQ ID NO: 3450214 - DNA, 16 bp, Homo sapiens
ctgctgaaggctcatt

SEQ ID NO: 3450215 - DNA, 21 bp, Homo sapiens
ctgctgacagacacaggcccg

SEQ ID NO: 3450216 - DNA, 11 bp, Homo sapiens
ctgctgacagt

SEQ ID NO: 3450217 - DNA, 19 bp, Homo sapiens
ctgctgagatacatacaga

SEQ ID NO: 3450218 - DNA, 21 bp, Homo sapiens
ctgctgcatgccctctcaggc

SEQ ID NO: 3450219 - DNA, 19 bp, Homo sapiens
ctgctgccccgcttcccca

SEQ ID NO: 3450220 - DNA, 11 bp, Homo sapiens
ctgctgcctgc

SEQ ID NO: 3450221 - DNA, 13 bp, Homo sapiens
ctgctgcctgcct

SEQ ID NO: 3450222 - DNA, 20 bp, Homo sapiens
ctgctgctcctccctctgac

SEQ ID NO: 3450223 - DNA, 23 bp, Homo sapiens
ctgctgctcctccctctgaccca

SEQ ID NO: 3450224 - DNA, 14 bp, Homo sapiens
ctgctgctgctcct

SEQ ID NO: 3450225 - DNA, 14 bp, Homo sapiens
ctgctgctgctgtg

SEQ ID NO: 3450226 - DNA, 14 bp, Homo sapiens
ctgctggaagccca

SEQ ID NO: 3450227 - DNA, 16 bp, Homo sapiens
ctgctggaagcccagc

SEQ ID NO: 3450228 - DNA, 20 bp, Homo sapiens
ctgctggacagtatcactgt

SEQ ID NO: 3450229 - DNA, 22 bp, Homo sapiens
ctgctggacagtatcactgtct

SEQ ID NO: 3450230 - DNA, 14 bp, Homo sapiens
ctgctggaggcctc

SEQ ID NO: 3450231 - DNA, 21 bp, Homo sapiens
ctgctggagtttcatgtacaa

SEQ ID NO: 3450232 - DNA, 17 bp, Homo sapiens
ctgctggtccgtgggac

SEQ ID NO: 3450233 - DNA, 23 bp, Homo sapiens
ctgctggttcagggttggcccct

SEQ ID NO: 3450234 - DNA, 20 bp, Homo sapiens
ctgctgtcacctctcccacg

SEQ ID NO: 3450235 - DNA, 15 bp, Homo sapiens
ctgctgtccagtgcc

SEQ ID NO: 3450236 - DNA, 18 bp, Homo sapiens
ctgctgtccagtgcctac

SEQ ID NO: 3450237 - DNA, 12 bp, Homo sapiens
ctgctgtctcta

SEQ ID NO: 3450238 - DNA, 15 bp, Homo sapiens
ctgctgtctctctgg

SEQ ID NO: 3450239 - DNA, 17 bp, Homo sapiens
ctgctgtgaaccctggg

SEQ ID NO: 3450240 - DNA, 23 bp, Homo sapiens
ctgctgtgaaccctggggcctga

SEQ ID NO: 3450241 - DNA, 14 bp, Homo sapiens
ctgcttcagcctcc

SEQ ID NO: 3450242 - DNA, 22 bp, Homo sapiens
ctgcttcatttttgtaataaca

SEQ ID NO: 3450243 - DNA, 13 bp, Homo sapiens
ctgcttcccaggt

SEQ ID NO: 3450244 - DNA, 13 bp, Homo sapiens
ctgcttcctcctg

SEQ ID NO: 3450245 - DNA, 15 bp, Homo sapiens
ctgcttcctcctgga

SEQ ID NO: 3450246 - DNA, 16 bp, Homo sapiens
ctgcttcctcctggaa

SEQ ID NO: 3450247 - DNA, 16 bp, Homo sapiens
ctgcttctctgacttc

SEQ ID NO: 3450248 - DNA, 17 bp, Homo sapiens
ctgcttctctgacttct

SEQ ID NO: 3450249 - DNA, 19 bp, Homo sapiens
ctgcttctctgacttctgc

SEQ ID NO: 3450250 - DNA, 20 bp, Homo sapiens
ctgcttctctgacttctgcc

SEQ ID NO: 3450251 - DNA, 12 bp, Homo sapiens
ctgcttgaggaa

SEQ ID NO: 3450252 - DNA, 14 bp, Homo sapiens
ctgcttgaggaaaa

SEQ ID NO: 3450253 - DNA, 21 bp, Homo sapiens
ctgcttgaggcaactcatctt

SEQ ID NO: 3450254 - DNA, 16 bp, Homo sapiens
ctgcttggagctgagc

SEQ ID NO: 3450255 - DNA, 14 bp, Homo sapiens
ctgctttctcccca

SEQ ID NO: 3450256 - DNA, 13 bp, Homo sapiens
ctgctttgcaaag

SEQ ID NO: 3450257 - DNA, 14 bp, Homo sapiens
ctgctttgcaaaga

SEQ ID NO: 3450258 - DNA, 19 bp, Homo sapiens
ctgcttttaactctagaat

SEQ ID NO: 3450259 - DNA, 22 bp, Homo sapiens
ctgcttttccttggggcaggca

SEQ ID NO: 3450260 - DNA, 23 bp, Homo sapiens
ctgcttttccttggggcaggcag

SEQ ID NO: 3450261 - DNA, 14 bp, Homo sapiens
ctgcttttggcctg

SEQ ID NO: 3450262 - DNA, 15 bp, Homo sapiens
ctgcttttggcctgg

SEQ ID NO: 3450263 - DNA, 15 bp, Homo sapiens
ctgcttttggtctgt

SEQ ID NO: 3450264 - DNA, 20 bp, Homo sapiens
ctgcttttgtctatgggact

SEQ ID NO: 3450265 - DNA, 21 bp, Homo sapiens
ctgcttttgtctatgggactc

SEQ ID NO: 3450266 - DNA, 23 bp, Homo sapiens
ctggaaaataatactgctgagat

SEQ ID NO: 3450267 - DNA, 22 bp, Homo sapiens
ctggaaatgttctttagatggt

SEQ ID NO: 3450268 - DNA, 16 bp, Homo sapiens
ctggaacaaattattt

SEQ ID NO: 3450269 - DNA, 17 bp, Homo sapiens
ctggaacaaattatttt

SEQ ID NO: 3450270 - DNA, 20 bp, Homo sapiens
ctggaacacaaagaccaaaa

SEQ ID NO: 3450271 - DNA, 21 bp, Homo sapiens
ctggaacactagacaagccag

SEQ ID NO: 3450272 - DNA, 16 bp, Homo sapiens
ctggaacctcagcctg

SEQ ID NO: 3450273 - DNA, 15 bp, Homo sapiens
ctggaacctgcaaaa

SEQ ID NO: 3450274 - DNA, 14 bp, Homo sapiens
ctggaagaaaaaaa

SEQ ID NO: 3450275 - DNA, 13 bp, Homo sapiens
ctggaagacagag

SEQ ID NO: 3450276 - DNA, 21 bp, Homo sapiens
ctggaagacagagacctcctg

SEQ ID NO: 3450277 - DNA, 15 bp, Homo sapiens
ctggaagagcccagt

SEQ ID NO: 3450278 - DNA, 14 bp, Homo sapiens
ctggaagattttca

SEQ ID NO: 3450279 - DNA, 18 bp, Homo sapiens
ctggaagcacagcttcat

SEQ ID NO: 3450280 - DNA, 21 bp, Homo sapiens
ctggaagcccagcccctactg

SEQ ID NO: 3450281 - DNA, 22 bp, Homo sapiens
ctggaaggctgctttctccttt

SEQ ID NO: 3450282 - DNA, 16 bp, Homo sapiens
ctggaagtccaatgtg

SEQ ID NO: 3450283 - DNA, 23 bp, Homo sapiens
ctggaatcaggaatattttccaa

SEQ ID NO: 3450284 - DNA, 13 bp, Homo sapiens
ctggaatctgagg

SEQ ID NO: 3450285 - DNA, 22 bp, Homo sapiens
ctggaatctgaggcatcctctg

SEQ ID NO: 3450286 - DNA, 19 bp, Homo sapiens
ctggaatctggagaccagg

SEQ ID NO: 3450287 - DNA, 24 bp, Homo sapiens
ctggaatctggagaccagggagcc

SEQ ID NO: 3450288 - DNA, 23 bp, Homo sapiens
ctggaattcctaacttttcaatg

SEQ ID NO: 3450289 - DNA, 14 bp, Homo sapiens
ctggacacaggcct

SEQ ID NO: 3450290 - DNA, 15 bp, Homo sapiens
ctggacacaggcctg

SEQ ID NO: 3450291 - DNA, 19 bp, Homo sapiens
ctggacagccccaccctgg

SEQ ID NO: 3450292 - DNA, 20 bp, Homo sapiens
ctggacagtatcactgtctt

SEQ ID NO: 3450293 - DNA, 16 bp, Homo sapiens
ctggacagtcagctct

SEQ ID NO: 3450294 - DNA, 19 bp, Homo sapiens
ctggacagtcagctcttca

SEQ ID NO: 3450295 - DNA, 13 bp, Homo sapiens
ctggacatgcctg

SEQ ID NO: 3450296 - DNA, 19 bp, Homo sapiens
ctggacatgcctgtcctga

SEQ ID NO: 3450297 - DNA, 14 bp, Homo sapiens
ctggaccctgttgc

SEQ ID NO: 3450298 - DNA, 15 bp, Homo sapiens
ctggaccctgttgct

SEQ ID NO: 3450299 - DNA, 16 bp, Homo sapiens
ctggaccctgttgcta

SEQ ID NO: 3450300 - DNA, 19 bp, Homo sapiens
ctggacctagggtggcctg

SEQ ID NO: 3450301 - DNA, 17 bp, Homo sapiens
ctggaccttgaactggg

SEQ ID NO: 3450302 - DNA, 19 bp, Homo sapiens
ctggactctcagtctctga

SEQ ID NO: 3450303 - DNA, 21 bp, Homo sapiens
ctggactctcagtctctgagc

SEQ ID NO: 3450304 - DNA, 17 bp, Homo sapiens
ctggacttggcccctgc

SEQ ID NO: 3450305 - DNA, 19 bp, Homo sapiens
ctggagactcctaggcagg

SEQ ID NO: 3450306 - DNA, 22 bp, Homo sapiens
ctggagaggccctctggagtgg

SEQ ID NO: 3450307 - DNA, 20 bp, Homo sapiens
ctggagatcctcctgcagac

SEQ ID NO: 3450308 - DNA, 23 bp, Homo sapiens
ctggagatcctcctgcagaccac

SEQ ID NO: 3450309 - DNA, 15 bp, Homo sapiens
ctggagatggaagct

SEQ ID NO: 3450310 - DNA, 16 bp, Homo sapiens
ctggagatggaagctt

SEQ ID NO: 3450311 - DNA, 19 bp, Homo sapiens
ctggagcactgggctcccg

SEQ ID NO: 3450312 - DNA, 19 bp, Homo sapiens
ctggagcttaattttctgt

SEQ ID NO: 3450313 - DNA, 14 bp, Homo sapiens
ctggaggcccaggc

SEQ ID NO: 3450314 - DNA, 13 bp, Homo sapiens
ctggaggcccagt

SEQ ID NO: 3450315 - DNA, 15 bp, Homo sapiens
ctggaggcccagttc

SEQ ID NO: 3450316 - DNA, 15 bp, Homo sapiens
ctggaggcctcaggt

SEQ ID NO: 3450317 - DNA, 19 bp, Homo sapiens
ctggaggcctcaggtgctg

SEQ ID NO: 3450318 - DNA, 16 bp, Homo sapiens
ctggaggctgcctccc

SEQ ID NO: 3450319 - DNA, 20 bp, Homo sapiens
ctggagggtgagaggaaggg

SEQ ID NO: 3450320 - DNA, 22 bp, Homo sapiens
ctggagtcatgtgcctctgtcc

SEQ ID NO: 3450321 - DNA, 15 bp, Homo sapiens
ctggagtgaggaaaa

SEQ ID NO: 3450322 - DNA, 24 bp, Homo sapiens
ctggagtggccactaagcagagga

SEQ ID NO: 3450323 - DNA, 22 bp, Homo sapiens
ctggagtttcatgtacaagatg

SEQ ID NO: 3450324 - DNA, 15 bp, Homo sapiens
ctggatctgttcctt

SEQ ID NO: 3450325 - DNA, 21 bp, Homo sapiens
ctggatgggcctttgagcctg

SEQ ID NO: 3450326 - DNA, 13 bp, Homo sapiens
ctggatgtctgaa

SEQ ID NO: 3450327 - DNA, 21 bp, Homo sapiens
ctggatgtctgaactttggga

SEQ ID NO: 3450328 - DNA, 13 bp, Homo sapiens
ctggattcccagg

SEQ ID NO: 3450329 - DNA, 20 bp, Homo sapiens
ctggcaaagcttttagaaat

SEQ ID NO: 3450330 - DNA, 15 bp, Homo sapiens
ctggcaacacagagg

SEQ ID NO: 3450331 - DNA, 18 bp, Homo sapiens
ctggcaaggacacagatg

SEQ ID NO: 3450332 - DNA, 18 bp, Homo sapiens
ctggcactggaccccagc

SEQ ID NO: 3450333 - DNA, 15 bp, Homo sapiens
ctggcagcagagtgt

SEQ ID NO: 3450334 - DNA, 22 bp, Homo sapiens
ctggcagcctcccatccagggc

SEQ ID NO: 3450335 - DNA, 12 bp, Homo sapiens
ctggcagctcag

SEQ ID NO: 3450336 - DNA, 13 bp, Homo sapiens
ctggcagctcagc

SEQ ID NO: 3450337 - DNA, 17 bp, Homo sapiens
ctggcagctcagcttcc

SEQ ID NO: 3450338 - DNA, 18 bp, Homo sapiens
ctggcagctctggacagc

SEQ ID NO: 3450339 - DNA, 19 bp, Homo sapiens
ctggcagtttaaaaaaatt

SEQ ID NO: 3450340 - DNA, 15 bp, Homo sapiens
ctggcagttttccat

SEQ ID NO: 3450341 - DNA, 18 bp, Homo sapiens
ctggcatgatccaagcaa

SEQ ID NO: 3450342 - DNA, 17 bp, Homo sapiens
ctggccaaatagcaaag

SEQ ID NO: 3450343 - DNA, 13 bp, Homo sapiens
ctggccaacatgg

SEQ ID NO: 3450344 - DNA, 14 bp, Homo sapiens
ctggccaagggcca

SEQ ID NO: 3450345 - DNA, 19 bp, Homo sapiens
ctggccaagggccagacag

SEQ ID NO: 3450346 - DNA, 20 bp, Homo sapiens
ctggccaagggccagacaga

SEQ ID NO: 3450347 - DNA, 23 bp, Homo sapiens
ctggccaagggccagacagacct

SEQ ID NO: 3450348 - DNA, 17 bp, Homo sapiens
ctggccagacacaggcc

SEQ ID NO: 3450349 - DNA, 19 bp, Homo sapiens
ctggccagacacaggccct

SEQ ID NO: 3450350 - DNA, 17 bp, Homo sapiens
ctggccagatgcaccag

SEQ ID NO: 3450351 - DNA, 19 bp, Homo sapiens
ctggccagatgcaccagcc

SEQ ID NO: 3450352 - DNA, 13 bp, Homo sapiens
ctggccagggcca

SEQ ID NO: 3450353 - DNA, 14 bp, Homo sapiens
ctggccagggccac

SEQ ID NO: 3450354 - DNA, 23 bp, Homo sapiens
ctggccagggccacgctccagct

SEQ ID NO: 3450355 - DNA, 15 bp, Homo sapiens
ctggccagggcctgg

SEQ ID NO: 3450356 - DNA, 17 bp, Homo sapiens
ctggccagtccaggctg

SEQ ID NO: 3450357 - DNA, 23 bp, Homo sapiens
ctggccagtccaggctgccgtgg

SEQ ID NO: 3450358 - DNA, 17 bp, Homo sapiens
ctggcccagccaaaccc

SEQ ID NO: 3450359 - DNA, 20 bp, Homo sapiens
ctggcccagccaaaccctgt

SEQ ID NO: 3450360 - DNA, 23 bp, Homo sapiens
ctggcccagccaaaccctgtctg

SEQ ID NO: 3450361 - DNA, 13 bp, Homo sapiens
ctggcccagggcc

SEQ ID NO: 3450362 - DNA, 14 bp, Homo sapiens
ctggcccagggccc

SEQ ID NO: 3450363 - DNA, 13 bp, Homo sapiens
ctggccccaggac

SEQ ID NO: 3450364 - DNA, 20 bp, Homo sapiens
ctggccccaggacctggctg

SEQ ID NO: 3450365 - DNA, 22 bp, Homo sapiens
ctggccccgccgcctggtactc

SEQ ID NO: 3450366 - DNA, 15 bp, Homo sapiens
ctggccccgcctgcc

SEQ ID NO: 3450367 - DNA, 18 bp, Homo sapiens
ctggccccgcctgcctgc

SEQ ID NO: 3450368 - DNA, 21 bp, Homo sapiens
ctggccccgcctgcctgccac

SEQ ID NO: 3450369 - DNA, 19 bp, Homo sapiens
ctggccctagactcggggt

SEQ ID NO: 3450370 - DNA, 16 bp, Homo sapiens
ctggccgagtccaagc

SEQ ID NO: 3450371 - DNA, 17 bp, Homo sapiens
ctggccgagtccaagct

SEQ ID NO: 3450372 - DNA, 15 bp, Homo sapiens
ctggccgcctccagg

SEQ ID NO: 3450373 - DNA, 19 bp, Homo sapiens
ctggccggctccagtttcc

SEQ ID NO: 3450374 - DNA, 15 bp, Homo sapiens
ctggccgtgggcctg

SEQ ID NO: 3450375 - DNA, 22 bp, Homo sapiens
ctggccgttgatgttggctggg

SEQ ID NO: 3450376 - DNA, 22 bp, Homo sapiens
ctggcctcaagtgattctcctg

SEQ ID NO: 3450377 - DNA, 22 bp, Homo sapiens
ctggcctcacccacccctgcac

SEQ ID NO: 3450378 - DNA, 17 bp, Homo sapiens
ctggcctcccacagact

SEQ ID NO: 3450379 - DNA, 19 bp, Homo sapiens
ctggcctcccacagactca

SEQ ID NO: 3450380 - DNA, 13 bp, Homo sapiens
ctggcctctgtgc

SEQ ID NO: 3450381 - DNA, 19 bp, Homo sapiens
ctggcctgagagtcagctc

SEQ ID NO: 3450382 - DNA, 19 bp, Homo sapiens
ctggccttgaaaccacctt

SEQ ID NO: 3450383 - DNA, 23 bp, Homo sapiens
ctggcgagagtctggccctagac

SEQ ID NO: 3450384 - DNA, 22 bp, Homo sapiens
ctggcgaggtgcggccaccacc

SEQ ID NO: 3450385 - DNA, 22 bp, Homo sapiens
ctggcgagtgaatgccagtgtg

SEQ ID NO: 3450386 - DNA, 19 bp, Homo sapiens
ctggctcattctgcacctt

SEQ ID NO: 3450387 - DNA, 20 bp, Homo sapiens
ctggctccagatgcagggca

SEQ ID NO: 3450388 - DNA, 12 bp, Homo sapiens
ctggctctgagc

SEQ ID NO: 3450389 - DNA, 18 bp, Homo sapiens
ctggctctgttcggcctt

SEQ ID NO: 3450390 - DNA, 23 bp, Homo sapiens
ctggctctgttcggcctttgggt

SEQ ID NO: 3450391 - DNA, 22 bp, Homo sapiens
ctggctctttggagatcaagga

SEQ ID NO: 3450392 - DNA, 13 bp, Homo sapiens
ctggctggagtga

SEQ ID NO: 3450393 - DNA, 19 bp, Homo sapiens
ctggctgggacgtggctca

SEQ ID NO: 3450394 - DNA, 21 bp, Homo sapiens
ctggctgggacgtggctcagc

SEQ ID NO: 3450395 - DNA, 16 bp, Homo sapiens
ctggctgttggctggg

SEQ ID NO: 3450396 - DNA, 13 bp, Homo sapiens
ctggcttctggcc

SEQ ID NO: 3450397 - DNA, 17 bp, Homo sapiens
ctggcttctggccagga

SEQ ID NO: 3450398 - DNA, 21 bp, Homo sapiens
ctggcttctgtggggcccctc

SEQ ID NO: 3450399 - DNA, 14 bp, Homo sapiens
ctggctttggcttc

SEQ ID NO: 3450400 - DNA, 11 bp, Homo sapiens
ctgggaaacag

SEQ ID NO: 3450401 - DNA, 13 bp, Homo sapiens
ctgggacacagtt

SEQ ID NO: 3450402 - DNA, 15 bp, Homo sapiens
ctgggacagcccagg

SEQ ID NO: 3450403 - DNA, 20 bp, Homo sapiens
ctgggacatcaggagactgg

SEQ ID NO: 3450404 - DNA, 14 bp, Homo sapiens
ctgggaccacgtga

SEQ ID NO: 3450405 - DNA, 15 bp, Homo sapiens
ctgggacgtggctca

SEQ ID NO: 3450406 - DNA, 17 bp, Homo sapiens
ctgggacgtggctcagc

SEQ ID NO: 3450407 - DNA, 15 bp, Homo sapiens
ctgggactacaggca

SEQ ID NO: 3450408 - DNA, 16 bp, Homo sapiens
ctgggactacaggcac

SEQ ID NO: 3450409 - DNA, 17 bp, Homo sapiens
ctgggactacaggcacc

SEQ ID NO: 3450410 - DNA, 13 bp, Homo sapiens
ctgggactcagcc

SEQ ID NO: 3450411 - DNA, 17 bp, Homo sapiens
ctgggagaaaatcatca

SEQ ID NO: 3450412 - DNA, 18 bp, Homo sapiens
ctgggagaaatctggctt

SEQ ID NO: 3450413 - DNA, 20 bp, Homo sapiens
ctgggagaaatctggcttct

SEQ ID NO: 3450414 - DNA, 20 bp, Homo sapiens
ctgggagctccactctgctt

SEQ ID NO: 3450415 - DNA, 23 bp, Homo sapiens
ctgggagctccactctgcttctc

SEQ ID NO: 3450416 - DNA, 19 bp, Homo sapiens
ctgggaggaatggacagac

SEQ ID NO: 3450417 - DNA, 22 bp, Homo sapiens
ctgggaggaatggacagacaga

SEQ ID NO: 3450418 - DNA, 13 bp, Homo sapiens
ctgggaggagccc

SEQ ID NO: 3450419 - DNA, 19 bp, Homo sapiens
ctgggagggcagcagggct

SEQ ID NO: 3450420 - DNA, 22 bp, Homo sapiens
ctgggagggcagcagggctacc

SEQ ID NO: 3450421 - DNA, 18 bp, Homo sapiens
ctgggaggtcaaggctgc

SEQ ID NO: 3450422 - DNA, 16 bp, Homo sapiens
ctgggagtagctagtt

SEQ ID NO: 3450423 - DNA, 14 bp, Homo sapiens
ctgggagtcacaca

SEQ ID NO: 3450424 - DNA, 16 bp, Homo sapiens
ctgggagtcacacagt

SEQ ID NO: 3450425 - DNA, 22 bp, Homo sapiens
ctgggatacacacggctccccc

SEQ ID NO: 3450426 - DNA, 22 bp, Homo sapiens
ctgggatcacaggtgtcagcca

SEQ ID NO: 3450427 - DNA, 21 bp, Homo sapiens
ctgggatggtgggcttcaggg

SEQ ID NO: 3450428 - DNA, 17 bp, Homo sapiens
ctgggattacaggtgtg

SEQ ID NO: 3450429 - DNA, 19 bp, Homo sapiens
ctgggattacaggtgtgca

SEQ ID NO: 3450430 - DNA, 15 bp, Homo sapiens
ctgggcaaggaggcc

SEQ ID NO: 3450431 - DNA, 20 bp, Homo sapiens
ctgggcaatgtgataaaacc

SEQ ID NO: 3450432 - DNA, 16 bp, Homo sapiens
ctgggcacacgcctcc

SEQ ID NO: 3450433 - DNA, 17 bp, Homo sapiens
ctgggcacttccctgct

SEQ ID NO: 3450434 - DNA, 21 bp, Homo sapiens
ctgggcagcacaaggccttgc

SEQ ID NO: 3450435 - DNA, 17 bp, Homo sapiens
ctgggcagcttgagagg

SEQ ID NO: 3450436 - DNA, 20 bp, Homo sapiens
ctgggcaggttggtgggggc

SEQ ID NO: 3450437 - DNA, 22 bp, Homo sapiens
ctgggccattctccacagcaac

SEQ ID NO: 3450438 - DNA, 13 bp, Homo sapiens
ctgggccctctct

SEQ ID NO: 3450439 - DNA, 15 bp, Homo sapiens
ctgggccctctcttc

SEQ ID NO: 3450440 - DNA, 11 bp, Homo sapiens
ctgggccctgg

SEQ ID NO: 3450441 - DNA, 15 bp, Homo sapiens
ctgggccgctgccac

SEQ ID NO: 3450442 - DNA, 15 bp, Homo sapiens
ctgggccgggcctgg

SEQ ID NO: 3450443 - DNA, 16 bp, Homo sapiens
ctgggccgggcctggg

SEQ ID NO: 3450444 - DNA, 20 bp, Homo sapiens
ctgggccgggcctggggctc

SEQ ID NO: 3450445 - DNA, 18 bp, Homo sapiens
ctgggccgtatctccggc

SEQ ID NO: 3450446 - DNA, 21 bp, Homo sapiens
ctgggccgtatctccggctcc

SEQ ID NO: 3450447 - DNA, 20 bp, Homo sapiens
ctgggcctcagtgtgcccat

SEQ ID NO: 3450448 - DNA, 20 bp, Homo sapiens
ctgggcctgaccaaacagcc

SEQ ID NO: 3450449 - DNA, 22 bp, Homo sapiens
ctgggcggcgggcggctgggtc

SEQ ID NO: 3450450 - DNA, 23 bp, Homo sapiens
ctgggcgtagtggctcacacctg

SEQ ID NO: 3450451 - DNA, 19 bp, Homo sapiens
ctgggctagaggctgagca

SEQ ID NO: 3450452 - DNA, 21 bp, Homo sapiens
ctgggctagaggctgagcacc

SEQ ID NO: 3450453 - DNA, 18 bp, Homo sapiens
ctgggctcccgggcccca

SEQ ID NO: 3450454 - DNA, 19 bp, Homo sapiens
ctgggctgaatgacagtga

SEQ ID NO: 3450455 - DNA, 13 bp, Homo sapiens
ctgggctgagaga

SEQ ID NO: 3450456 - DNA, 13 bp, Homo sapiens
ctgggctgaggga

SEQ ID NO: 3450457 - DNA, 19 bp, Homo sapiens
ctgggctgagggagcctgg

SEQ ID NO: 3450458 - DNA, 17 bp, Homo sapiens
ctgggctgcagagtctg

SEQ ID NO: 3450459 - DNA, 22 bp, Homo sapiens
ctgggctgggtggcccctgtct

SEQ ID NO: 3450460 - DNA, 19 bp, Homo sapiens
ctgggcttcagtggcagct

SEQ ID NO: 3450461 - DNA, 19 bp, Homo sapiens
ctgggcttggggcttccta

SEQ ID NO: 3450462 - DNA, 15 bp, Homo sapiens
ctggggaaaggggac

SEQ ID NO: 3450463 - DNA, 23 bp, Homo sapiens
ctggggaaaggggacaaggaagg

SEQ ID NO: 3450464 - DNA, 14 bp, Homo sapiens
ctggggagaaagta

SEQ ID NO: 3450465 - DNA, 20 bp, Homo sapiens
ctggggcctgactgctcaga

SEQ ID NO: 3450466 - DNA, 19 bp, Homo sapiens
ctggggctaggctggagcc

SEQ ID NO: 3450467 - DNA, 14 bp, Homo sapiens
ctggggctctggga

SEQ ID NO: 3450468 - DNA, 14 bp, Homo sapiens
ctggggctgctggc

SEQ ID NO: 3450469 - DNA, 15 bp, Homo sapiens
ctggggctgctggcc

SEQ ID NO: 3450470 - DNA, 14 bp, Homo sapiens
ctggggctggcttt

SEQ ID NO: 3450471 - DNA, 14 bp, Homo sapiens
ctgggggagagccg

SEQ ID NO: 3450472 - DNA, 17 bp, Homo sapiens
ctgggggcctcagtgcc

SEQ ID NO: 3450473 - DNA, 18 bp, Homo sapiens
ctgggggcctcagtgcca

SEQ ID NO: 3450474 - DNA, 14 bp, Homo sapiens
ctgggggctctggc

SEQ ID NO: 3450475 - DNA, 20 bp, Homo sapiens
ctgggggctctggccaaggg

SEQ ID NO: 3450476 - DNA, 23 bp, Homo sapiens
ctgggggctctggccaagggcca

SEQ ID NO: 3450477 - DNA, 15 bp, Homo sapiens
ctgggggtgggccag

SEQ ID NO: 3450478 - DNA, 16 bp, Homo sapiens
ctgggggtgggccagg

SEQ ID NO: 3450479 - DNA, 22 bp, Homo sapiens
ctggggtctggagttgatctgg

SEQ ID NO: 3450480 - DNA, 12 bp, Homo sapiens
ctggggtggcct

SEQ ID NO: 3450481 - DNA, 17 bp, Homo sapiens
ctggggtggcctgtgtg

SEQ ID NO: 3450482 - DNA, 19 bp, Homo sapiens
ctggggtgtgggaggcccg

SEQ ID NO: 3450483 - DNA, 15 bp, Homo sapiens
ctgggtacttcttga

SEQ ID NO: 3450484 - DNA, 17 bp, Homo sapiens
ctgggtacttcttgaag

SEQ ID NO: 3450485 - DNA, 20 bp, Homo sapiens
ctgggtacttcttgaaggtg

SEQ ID NO: 3450486 - DNA, 23 bp, Homo sapiens
ctgggtacttgtggacacagctc

SEQ ID NO: 3450487 - DNA, 22 bp, Homo sapiens
ctgggtgacagagcaagactct

SEQ ID NO: 3450488 - DNA, 23 bp, Homo sapiens
ctgggtgacagagcaagactctg

SEQ ID NO: 3450489 - DNA, 16 bp, Homo sapiens
ctgggtggagggagac

SEQ ID NO: 3450490 - DNA, 18 bp, Homo sapiens
ctgggtggcaccagcagc

SEQ ID NO: 3450491 - DNA, 23 bp, Homo sapiens
ctgggtggcaccagcagcctgga

SEQ ID NO: 3450492 - DNA, 14 bp, Homo sapiens
ctgggtggcactgc

SEQ ID NO: 3450493 - DNA, 19 bp, Homo sapiens
ctgggtggcccctgtctcg

SEQ ID NO: 3450494 - DNA, 15 bp, Homo sapiens
ctgggtggggcagtg

SEQ ID NO: 3450495 - DNA, 14 bp, Homo sapiens
ctgggtggtggcct

SEQ ID NO: 3450496 - DNA, 15 bp, Homo sapiens
ctgggttgcagacag

SEQ ID NO: 3450497 - DNA, 18 bp, Homo sapiens
ctgggtttaaggggagag

SEQ ID NO: 3450498 - DNA, 17 bp, Homo sapiens
ctgggtttgaagctgct

SEQ ID NO: 3450499 - DNA, 22 bp, Homo sapiens
ctgggttttgtattctctgagc

SEQ ID NO: 3450500 - DNA, 23 bp, Homo sapiens
ctggtaggaaagggcaagtcttt

SEQ ID NO: 3450501 - DNA, 15 bp, Homo sapiens
ctggtaggaccaagc

SEQ ID NO: 3450502 - DNA, 18 bp, Homo sapiens
ctggtaggaccaagcatc

SEQ ID NO: 3450503 - DNA, 14 bp, Homo sapiens
ctggtattcctgcc

SEQ ID NO: 3450504 - DNA, 17 bp, Homo sapiens
ctggtattcctgcctcc

SEQ ID NO: 3450505 - DNA, 15 bp, Homo sapiens
ctggtattctgttct

SEQ ID NO: 3450506 - DNA, 19 bp, Homo sapiens
ctggtattctgttctggag

SEQ ID NO: 3450507 - DNA, 23 bp, Homo sapiens
ctggtcaaacaaactctctgaac

SEQ ID NO: 3450508 - DNA, 19 bp, Homo sapiens
ctggtcaatcaacactacc

SEQ ID NO: 3450509 - DNA, 14 bp, Homo sapiens
ctggtcagagccac

SEQ ID NO: 3450510 - DNA, 15 bp, Homo sapiens
ctggtcagagccaca

SEQ ID NO: 3450511 - DNA, 16 bp, Homo sapiens
ctggtcagagccacag

SEQ ID NO: 3450512 - DNA, 22 bp, Homo sapiens
ctggtcagagccacagggtctg

SEQ ID NO: 3450513 - DNA, 13 bp, Homo sapiens
ctggtccacaggg

SEQ ID NO: 3450514 - DNA, 16 bp, Homo sapiens
ctggtccaggccctgt

SEQ ID NO: 3450515 - DNA, 13 bp, Homo sapiens
ctggtcccactca

SEQ ID NO: 3450516 - DNA, 20 bp, Homo sapiens
ctggtcccggggccagcact

SEQ ID NO: 3450517 - DNA, 23 bp, Homo sapiens
ctggtccctgttttcccacgagg

SEQ ID NO: 3450518 - DNA, 13 bp, Homo sapiens
ctggtcctaccca

SEQ ID NO: 3450519 - DNA, 22 bp, Homo sapiens
ctggtcctacccatccccgcag

SEQ ID NO: 3450520 - DNA, 21 bp, Homo sapiens
ctggtctcaaactcctgggct

SEQ ID NO: 3450521 - DNA, 23 bp, Homo sapiens
ctggtctcaaactcttgacctca

SEQ ID NO: 3450522 - DNA, 17 bp, Homo sapiens
ctggtctctaggctggg

SEQ ID NO: 3450523 - DNA, 12 bp, Homo sapiens
ctggtcttcctt

SEQ ID NO: 3450524 - DNA, 16 bp, Homo sapiens
ctggtgcactttgtaa

SEQ ID NO: 3450525 - DNA, 23 bp, Homo sapiens
ctggtgccctaacctctgagtca

SEQ ID NO: 3450526 - DNA, 19 bp, Homo sapiens
ctggtgctgcctctacctg

SEQ ID NO: 3450527 - DNA, 14 bp, Homo sapiens
ctggtgctgctgct

SEQ ID NO: 3450528 - DNA, 15 bp, Homo sapiens
ctggtggcacaggag

SEQ ID NO: 3450529 - DNA, 19 bp, Homo sapiens
ctggtggcagtgggagctg

SEQ ID NO: 3450530 - DNA, 23 bp, Homo sapiens
ctggtggcagtgggagctgcctg

SEQ ID NO: 3450531 - DNA, 11 bp, Homo sapiens
ctggtggccca

SEQ ID NO: 3450532 - DNA, 18 bp, Homo sapiens
ctggtgttttatttccta

SEQ ID NO: 3450533 - DNA, 15 bp, Homo sapiens
ctggttccagggtcc

SEQ ID NO: 3450534 - DNA, 18 bp, Homo sapiens
ctggttccagggtccctc

SEQ ID NO: 3450535 - DNA, 23 bp, Homo sapiens
ctggttccagggtccctctgtgt

SEQ ID NO: 3450536 - DNA, 21 bp, Homo sapiens
ctggtttgtcaaacaacatgt

SEQ ID NO: 3450537 - DNA, 17 bp, Homo sapiens
ctggtttgtggggcaca

SEQ ID NO: 3450538 - DNA, 23 bp, Homo sapiens
ctgtaaattgctggcagatgctt

SEQ ID NO: 3450539 - DNA, 16 bp, Homo sapiens
ctgtaacactttacaa

SEQ ID NO: 3450540 - DNA, 19 bp, Homo sapiens
ctgtaacctcttcagaggc

SEQ ID NO: 3450541 - DNA, 21 bp, Homo sapiens
ctgtaagaataatttatagta

SEQ ID NO: 3450542 - DNA, 20 bp, Homo sapiens
ctgtaatcatttgtttacat

SEQ ID NO: 3450543 - DNA, 20 bp, Homo sapiens
ctgtaatcccagcactttgg

SEQ ID NO: 3450544 - DNA, 20 bp, Homo sapiens
ctgtaatcgccctactattc

SEQ ID NO: 3450545 - DNA, 20 bp, Homo sapiens
ctgtaatgtgaatctatgct

SEQ ID NO: 3450546 - DNA, 13 bp, Homo sapiens
ctgtaattttata

SEQ ID NO: 3450547 - DNA, 15 bp, Homo sapiens
ctgtacaaatataag

SEQ ID NO: 3450548 - DNA, 19 bp, Homo sapiens
ctgtacaaatataagaata

SEQ ID NO: 3450549 - DNA, 11 bp, Homo sapiens
ctgtacaataa

SEQ ID NO: 3450550 - DNA, 14 bp, Homo sapiens
ctgtacatctattt

SEQ ID NO: 3450551 - DNA, 19 bp, Homo sapiens
ctgtacgtctgacaggcaa

SEQ ID NO: 3450552 - DNA, 16 bp, Homo sapiens
ctgtactattgcagac

SEQ ID NO: 3450553 - DNA, 22 bp, Homo sapiens
ctgtacttgaagtctaaaagca

SEQ ID NO: 3450554 - DNA, 19 bp, Homo sapiens
ctgtacttttcccatttgt

SEQ ID NO: 3450555 - DNA, 17 bp, Homo sapiens
ctgtagaaatggttgta

SEQ ID NO: 3450556 - DNA, 20 bp, Homo sapiens
ctgtagaaatggttgtatta

SEQ ID NO: 3450557 - DNA, 19 bp, Homo sapiens
ctgtagaatagcctgtggc

SEQ ID NO: 3450558 - DNA, 21 bp, Homo sapiens
ctgtagaatagcctgtggcct

SEQ ID NO: 3450559 - DNA, 19 bp, Homo sapiens
ctgtaggatctaaggctgt

SEQ ID NO: 3450560 - DNA, 21 bp, Homo sapiens
ctgtagggaattcttctgtta

SEQ ID NO: 3450561 - DNA, 13 bp, Homo sapiens
ctgtagttaggcc

SEQ ID NO: 3450562 - DNA, 16 bp, Homo sapiens
ctgtagttaggcctgg

SEQ ID NO: 3450563 - DNA, 20 bp, Homo sapiens
ctgtagttaggcctggctca

SEQ ID NO: 3450564 - DNA, 20 bp, Homo sapiens
ctgtagttgacaattctgca

SEQ ID NO: 3450565 - DNA, 23 bp, Homo sapiens
ctgtagttgacaattctgcatgt

SEQ ID NO: 3450566 - DNA, 17 bp, Homo sapiens
ctgtataaaatcagcca

SEQ ID NO: 3450567 - DNA, 13 bp, Homo sapiens
ctgtataagtaag

SEQ ID NO: 3450568 - DNA, 21 bp, Homo sapiens
ctgtataagtggaggcacttt

SEQ ID NO: 3450569 - DNA, 22 bp, Homo sapiens
ctgtataagtggaggcacttta

SEQ ID NO: 3450570 - DNA, 15 bp, Homo sapiens
ctgtataagttattt

SEQ ID NO: 3450571 - DNA, 14 bp, Homo sapiens
ctgtatagctcctt

SEQ ID NO: 3450572 - DNA, 15 bp, Homo sapiens
ctgtatagtactggc

SEQ ID NO: 3450573 - DNA, 14 bp, Homo sapiens
ctgtatatactttt

SEQ ID NO: 3450574 - DNA, 15 bp, Homo sapiens
ctgtatatacttttt

SEQ ID NO: 3450575 - DNA, 16 bp, Homo sapiens
ctgtatatagcccagc

SEQ ID NO: 3450576 - DNA, 19 bp, Homo sapiens
ctgtatcccatgagcctca

SEQ ID NO: 3450577 - DNA, 12 bp, Homo sapiens
ctgtatgattta

SEQ ID NO: 3450578 - DNA, 16 bp, Homo sapiens
ctgtatgctgatcatc

SEQ ID NO: 3450579 - DNA, 18 bp, Homo sapiens
ctgtatgtgctgtaattt

SEQ ID NO: 3450580 - DNA, 16 bp, Homo sapiens
ctgtattcagacagat

SEQ ID NO: 3450581 - DNA, 16 bp, Homo sapiens
ctgtattcatatattg

SEQ ID NO: 3450582 - DNA, 17 bp, Homo sapiens
ctgtattcatatattgc

SEQ ID NO: 3450583 - DNA, 20 bp, Homo sapiens
ctgtattttgtttttgtctt

SEQ ID NO: 3450584 - DNA, 19 bp, Homo sapiens
ctgtattttttgtttgtat

SEQ ID NO: 3450585 - DNA, 20 bp, Homo sapiens
ctgtattttttgtttgtatt

SEQ ID NO: 3450586 - DNA, 22 bp, Homo sapiens
ctgtattttttgtttgtattgt

SEQ ID NO: 3450587 - DNA, 14 bp, Homo sapiens
ctgtcaaacaaagc

SEQ ID NO: 3450588 - DNA, 18 bp, Homo sapiens
ctgtcaaacaaagccaga

SEQ ID NO: 3450589 - DNA, 19 bp, Homo sapiens
ctgtcaaacaaagccagaa

SEQ ID NO: 3450590 - DNA, 19 bp, Homo sapiens
ctgtcaagagtagttatat

SEQ ID NO: 3450591 - DNA, 22 bp, Homo sapiens
ctgtcaagagtagttatataat

SEQ ID NO: 3450592 - DNA, 21 bp, Homo sapiens
ctgtcaagtcccccagcagaa

SEQ ID NO: 3450593 - DNA, 22 bp, Homo sapiens
ctgtcaagtcccccagcagaac

SEQ ID NO: 3450594 - DNA, 16 bp, Homo sapiens
ctgtcaccaaggaaac

SEQ ID NO: 3450595 - DNA, 14 bp, Homo sapiens
ctgtcaccctgcag

SEQ ID NO: 3450596 - DNA, 18 bp, Homo sapiens
ctgtcaccctgcaggact

SEQ ID NO: 3450597 - DNA, 18 bp, Homo sapiens
ctgtcacttcttcacctc

SEQ ID NO: 3450598 - DNA, 23 bp, Homo sapiens
ctgtcacttcttcacctcttcca

SEQ ID NO: 3450599 - DNA, 17 bp, Homo sapiens
ctgtcagtcacagccac

SEQ ID NO: 3450600 - DNA, 15 bp, Homo sapiens
ctgtcatctgtgcac

SEQ ID NO: 3450601 - DNA, 21 bp, Homo sapiens
ctgtcatctgtgcactgccca

SEQ ID NO: 3450602 - DNA, 14 bp, Homo sapiens
ctgtcatgcttcat

SEQ ID NO: 3450603 - DNA, 14 bp, Homo sapiens
ctgtcatttgagca

SEQ ID NO: 3450604 - DNA, 17 bp, Homo sapiens
ctgtcatttgagcaggg

SEQ ID NO: 3450605 - DNA, 22 bp, Homo sapiens
ctgtcatttgagcagggctcag

SEQ ID NO: 3450606 - DNA, 23 bp, Homo sapiens
ctgtcatttgagcagggctcagc

SEQ ID NO: 3450607 - DNA, 15 bp, Homo sapiens
ctgtcattttgcact

SEQ ID NO: 3450608 - DNA, 17 bp, Homo sapiens
ctgtcattttgcactgt

SEQ ID NO: 3450609 - DNA, 17 bp, Homo sapiens
ctgtccagctccaacct

SEQ ID NO: 3450610 - DNA, 12 bp, Homo sapiens
ctgtccaggctc

SEQ ID NO: 3450611 - DNA, 12 bp, Homo sapiens
ctgtccagtgcc

SEQ ID NO: 3450612 - DNA, 21 bp, Homo sapiens
ctgtccatgtattcacacacc

SEQ ID NO: 3450613 - DNA, 22 bp, Homo sapiens
ctgtccatgtattcacacaccc

SEQ ID NO: 3450614 - DNA, 22 bp, Homo sapiens
ctgtcccaggttatctgggcat

SEQ ID NO: 3450615 - DNA, 22 bp, Homo sapiens
ctgtcccagtgccgagaaggaa

SEQ ID NO: 3450616 - DNA, 18 bp, Homo sapiens
ctgtcccatagtccctgc

SEQ ID NO: 3450617 - DNA, 15 bp, Homo sapiens
ctgtcccccaacact

SEQ ID NO: 3450618 - DNA, 14 bp, Homo sapiens
ctgtccccttctct

SEQ ID NO: 3450619 - DNA, 20 bp, Homo sapiens
ctgtccccttctctcatctc

SEQ ID NO: 3450620 - DNA, 21 bp, Homo sapiens
ctgtccccttctctcatctct

SEQ ID NO: 3450621 - DNA, 22 bp, Homo sapiens
ctgtccccttctctcatctctt

SEQ ID NO: 3450622 - DNA, 23 bp, Homo sapiens
ctgtccccttctctcatctctta

SEQ ID NO: 3450623 - DNA, 19 bp, Homo sapiens
ctgtccctagtaaaaatac

SEQ ID NO: 3450624 - DNA, 13 bp, Homo sapiens
ctgtccctcactg

SEQ ID NO: 3450625 - DNA, 21 bp, Homo sapiens
ctgtccctccgggacctggtg

SEQ ID NO: 3450626 - DNA, 14 bp, Homo sapiens
ctgtcccttgctgt

SEQ ID NO: 3450627 - DNA, 20 bp, Homo sapiens
ctgtccggaatgccacccac

SEQ ID NO: 3450628 - DNA, 23 bp, Homo sapiens
ctgtcctatgaatgctttgcatt

SEQ ID NO: 3450629 - DNA, 15 bp, Homo sapiens
ctgtcctcaggtggc

SEQ ID NO: 3450630 - DNA, 18 bp, Homo sapiens
ctgtcctcaggtggccat

SEQ ID NO: 3450631 - DNA, 15 bp, Homo sapiens
ctgtcctccaacacc

SEQ ID NO: 3450632 - DNA, 23 bp, Homo sapiens
ctgtcctccaacaccaagcacag

SEQ ID NO: 3450633 - DNA, 15 bp, Homo sapiens
ctgtcctccaagcca

SEQ ID NO: 3450634 - DNA, 17 bp, Homo sapiens
ctgtcctccaagccagc

SEQ ID NO: 3450635 - DNA, 14 bp, Homo sapiens
ctgtcctgaaagcg

SEQ ID NO: 3450636 - DNA, 13 bp, Homo sapiens
ctgtcctgggagt

SEQ ID NO: 3450637 - DNA, 13 bp, Homo sapiens
ctgtcctgggcct

SEQ ID NO: 3450638 - DNA, 14 bp, Homo sapiens
ctgtcctgggcctg

SEQ ID NO: 3450639 - DNA, 21 bp, Homo sapiens
ctgtcctttctagagcactgc

SEQ ID NO: 3450640 - DNA, 23 bp, Homo sapiens
ctgtcctttctagagcactgcca

SEQ ID NO: 3450641 - DNA, 14 bp, Homo sapiens
ctgtctagagaggg

SEQ ID NO: 3450642 - DNA, 17 bp, Homo sapiens
ctgtctagagagggagg

SEQ ID NO: 3450643 - DNA, 14 bp, Homo sapiens
ctgtctcagcctcc

SEQ ID NO: 3450644 - DNA, 12 bp, Homo sapiens
ctgtctcatcca

SEQ ID NO: 3450645 - DNA, 16 bp, Homo sapiens
ctgtctcatccatcat

SEQ ID NO: 3450646 - DNA, 17 bp, Homo sapiens
ctgtctcatccatcatc

SEQ ID NO: 3450647 - DNA, 20 bp, Homo sapiens
ctgtctcatccatcatcatg

SEQ ID NO: 3450648 - DNA, 21 bp, Homo sapiens
ctgtctcatccatcatcatgt

SEQ ID NO: 3450649 - DNA, 20 bp, Homo sapiens
ctgtctccatggccctgcaa

SEQ ID NO: 3450650 - DNA, 17 bp, Homo sapiens
ctgtctctagaagtgcc

SEQ ID NO: 3450651 - DNA, 21 bp, Homo sapiens
ctgtctctagaagtgccatct

SEQ ID NO: 3450652 - DNA, 12 bp, Homo sapiens
ctgtctctctgg

SEQ ID NO: 3450653 - DNA, 21 bp, Homo sapiens
ctgtctgaaccacgcgggggc

SEQ ID NO: 3450654 - DNA, 20 bp, Homo sapiens
ctgtctgacaacctcttggt

SEQ ID NO: 3450655 - DNA, 13 bp, Homo sapiens
ctgtctgcagcct

SEQ ID NO: 3450656 - DNA, 11 bp, Homo sapiens
ctgtctgcccc

SEQ ID NO: 3450657 - DNA, 13 bp, Homo sapiens
ctgtctgccccag

SEQ ID NO: 3450658 - DNA, 18 bp, Homo sapiens
ctgtctgccccagcccag

SEQ ID NO: 3450659 - DNA, 13 bp, Homo sapiens
ctgtctggtggcc

SEQ ID NO: 3450660 - DNA, 15 bp, Homo sapiens
ctgtctggtggcccc

SEQ ID NO: 3450661 - DNA, 23 bp, Homo sapiens
ctgtctggtttcaccgaggacat

SEQ ID NO: 3450662 - DNA, 14 bp, Homo sapiens
ctgtcttcctctgc

SEQ ID NO: 3450663 - DNA, 15 bp, Homo sapiens
ctgtcttctggactg

SEQ ID NO: 3450664 - DNA, 16 bp, Homo sapiens
ctgtcttgttcatttt

SEQ ID NO: 3450665 - DNA, 20 bp, Homo sapiens
ctgtctttactcctcacact

SEQ ID NO: 3450666 - DNA, 17 bp, Homo sapiens
ctgtctttcagcattca

SEQ ID NO: 3450667 - DNA, 12 bp, Homo sapiens
ctgtgaaatagt

SEQ ID NO: 3450668 - DNA, 19 bp, Homo sapiens
ctgtgaaccctggggcctg

SEQ ID NO: 3450669 - DNA, 16 bp, Homo sapiens
ctgtgaacgatttaga

SEQ ID NO: 3450670 - DNA, 14 bp, Homo sapiens
ctgtgaagatctca

SEQ ID NO: 3450671 - DNA, 14 bp, Homo sapiens
ctgtgaagtaagga

SEQ ID NO: 3450672 - DNA, 20 bp, Homo sapiens
ctgtgaatgccactgccttc

SEQ ID NO: 3450673 - DNA, 17 bp, Homo sapiens
ctgtgacagcctctgca

SEQ ID NO: 3450674 - DNA, 13 bp, Homo sapiens
ctgtgacccccag

SEQ ID NO: 3450675 - DNA, 17 bp, Homo sapiens
ctgtgacccccagctcc

SEQ ID NO: 3450676 - DNA, 19 bp, Homo sapiens
ctgtgactcttctctcaac

SEQ ID NO: 3450677 - DNA, 14 bp, Homo sapiens
ctgtgagcccagct

SEQ ID NO: 3450678 - DNA, 17 bp, Homo sapiens
ctgtgagcccagctggg

SEQ ID NO: 3450679 - DNA, 18 bp, Homo sapiens
ctgtgagtgaaagttgcc

SEQ ID NO: 3450680 - DNA, 22 bp, Homo sapiens
ctgtgagtgaaagttgccatta

SEQ ID NO: 3450681 - DNA, 17 bp, Homo sapiens
ctgtgagtttaaagcaa

SEQ ID NO: 3450682 - DNA, 16 bp, Homo sapiens
ctgtgattgtgcctac

SEQ ID NO: 3450683 - DNA, 16 bp, Homo sapiens
ctgtgcaaatccttga

SEQ ID NO: 3450684 - DNA, 20 bp, Homo sapiens
ctgtgcacatctgtgtcttg

SEQ ID NO: 3450685 - DNA, 21 bp, Homo sapiens
ctgtgcagccgctgagcgagg

SEQ ID NO: 3450686 - DNA, 15 bp, Homo sapiens
ctgtgcattctcctg

SEQ ID NO: 3450687 - DNA, 15 bp, Homo sapiens
ctgtgccatgtgcca

SEQ ID NO: 3450688 - DNA, 18 bp, Homo sapiens
ctgtgccatgtgccaggt

SEQ ID NO: 3450689 - DNA, 16 bp, Homo sapiens
ctgtgccctccttccc

SEQ ID NO: 3450690 - DNA, 16 bp, Homo sapiens
ctgtgctcaggactca

SEQ ID NO: 3450691 - DNA, 17 bp, Homo sapiens
ctgtgctcaggactcag

SEQ ID NO: 3450692 - DNA, 23 bp, Homo sapiens
ctgtgctcaggactcagaagcct

SEQ ID NO: 3450693 - DNA, 14 bp, Homo sapiens
ctgtgctccctggt

SEQ ID NO: 3450694 - DNA, 17 bp, Homo sapiens
ctgtgctctggacaggc

SEQ ID NO: 3450695 - DNA, 19 bp, Homo sapiens
ctgtgctctggacaggcat

SEQ ID NO: 3450696 - DNA, 20 bp, Homo sapiens
ctgtgcttcgggcccttccc

SEQ ID NO: 3450697 - DNA, 15 bp, Homo sapiens
ctgtgcttgaaggcc

SEQ ID NO: 3450698 - DNA, 22 bp, Homo sapiens
ctgtggaaaagaaacacgcact

SEQ ID NO: 3450699 - DNA, 15 bp, Homo sapiens
ctgtggatgagccct

SEQ ID NO: 3450700 - DNA, 17 bp, Homo sapiens
ctgtggatgagccctca

SEQ ID NO: 3450701 - DNA, 17 bp, Homo sapiens
ctgtggccccaccctgg

SEQ ID NO: 3450702 - DNA, 18 bp, Homo sapiens
ctgtggccccaccctggg

SEQ ID NO: 3450703 - DNA, 21 bp, Homo sapiens
ctgtggccccaccctgggccc

SEQ ID NO: 3450704 - DNA, 13 bp, Homo sapiens
ctgtggccctgtc

SEQ ID NO: 3450705 - DNA, 17 bp, Homo sapiens
ctgtggcgccgtctcca

SEQ ID NO: 3450706 - DNA, 15 bp, Homo sapiens
ctgtgggcaatttag

SEQ ID NO: 3450707 - DNA, 16 bp, Homo sapiens
ctgtgggcgggcccag

SEQ ID NO: 3450708 - DNA, 22 bp, Homo sapiens
ctgtggggactccggctgtgct

SEQ ID NO: 3450709 - DNA, 20 bp, Homo sapiens
ctgtggggcagctgagcagc

SEQ ID NO: 3450710 - DNA, 23 bp, Homo sapiens
ctgtggggtgtgcacatctctgc

SEQ ID NO: 3450711 - DNA, 13 bp, Homo sapiens
ctgtgggtgatgg

SEQ ID NO: 3450712 - DNA, 16 bp, Homo sapiens
ctgtgggtgatgggga

SEQ ID NO: 3450713 - DNA, 18 bp, Homo sapiens
ctgtgggtgatggggagg

SEQ ID NO: 3450714 - DNA, 19 bp, Homo sapiens
ctgtgggtgatggggaggg

SEQ ID NO: 3450715 - DNA, 15 bp, Homo sapiens
ctgtggtgtgtcccc

SEQ ID NO: 3450716 - DNA, 16 bp, Homo sapiens
ctgtgtatttgctttt

SEQ ID NO: 3450717 - DNA, 19 bp, Homo sapiens
ctgtgtcaatccagatggt

SEQ ID NO: 3450718 - DNA, 17 bp, Homo sapiens
ctgtgtcagcatagaag

SEQ ID NO: 3450719 - DNA, 22 bp, Homo sapiens
ctgtgtcaggtggggcagcttg

SEQ ID NO: 3450720 - DNA, 23 bp, Homo sapiens
ctgtgtcctgaaacgctcctttg

SEQ ID NO: 3450721 - DNA, 13 bp, Homo sapiens
ctgtgtctaaact

SEQ ID NO: 3450722 - DNA, 15 bp, Homo sapiens
ctgtgtctttttcgc

SEQ ID NO: 3450723 - DNA, 22 bp, Homo sapiens
ctgtgtgattgacagctttgct

SEQ ID NO: 3450724 - DNA, 23 bp, Homo sapiens
ctgtgtgattgacagctttgctg

SEQ ID NO: 3450725 - DNA, 19 bp, Homo sapiens
ctgtgtgctgactgaacat

SEQ ID NO: 3450726 - DNA, 15 bp, Homo sapiens
ctgtgtgtccaaaac

SEQ ID NO: 3450727 - DNA, 19 bp, Homo sapiens
ctgtgtgtccaaaactgcc

SEQ ID NO: 3450728 - DNA, 21 bp, Homo sapiens
ctgtgtgtccaaaactgcctc

SEQ ID NO: 3450729 - DNA, 20 bp, Homo sapiens
ctgtgtgtgcgcctacagga

SEQ ID NO: 3450730 - DNA, 12 bp, Homo sapiens
ctgtgtgtgtga

SEQ ID NO: 3450731 - DNA, 20 bp, Homo sapiens
ctgtgtgttgccacaggaca

SEQ ID NO: 3450732 - DNA, 17 bp, Homo sapiens
ctgtgttcaaaaatata

SEQ ID NO: 3450733 - DNA, 13 bp, Homo sapiens
ctgtgttgccaag

SEQ ID NO: 3450734 - DNA, 17 bp, Homo sapiens
ctgtgttgccaagctcc

SEQ ID NO: 3450735 - DNA, 21 bp, Homo sapiens
ctgtgttgccaagctccaagc

SEQ ID NO: 3450736 - DNA, 15 bp, Homo sapiens
ctgtgtttccatctc

SEQ ID NO: 3450737 - DNA, 16 bp, Homo sapiens
ctgtgtttggctttca

SEQ ID NO: 3450738 - DNA, 23 bp, Homo sapiens
ctgtgtttggctttcagggaggc

SEQ ID NO: 3450739 - DNA, 13 bp, Homo sapiens
ctgtgttttaata

SEQ ID NO: 3450740 - DNA, 20 bp, Homo sapiens
ctgttaacgtcatctcaggg

SEQ ID NO: 3450741 - DNA, 16 bp, Homo sapiens
ctgttaatagttcagg

SEQ ID NO: 3450742 - DNA, 22 bp, Homo sapiens
ctgttacccagggtggagtgca

SEQ ID NO: 3450743 - DNA, 15 bp, Homo sapiens
ctgttagggccttgg

SEQ ID NO: 3450744 - DNA, 12 bp, Homo sapiens
ctgttcaagagc

SEQ ID NO: 3450745 - DNA, 19 bp, Homo sapiens
ctgttcagctccagctcac

SEQ ID NO: 3450746 - DNA, 18 bp, Homo sapiens
ctgttcagctggttgagg

SEQ ID NO: 3450747 - DNA, 12 bp, Homo sapiens
ctgttcagtact

SEQ ID NO: 3450748 - DNA, 14 bp, Homo sapiens
ctgttcagtactct

SEQ ID NO: 3450749 - DNA, 17 bp, Homo sapiens
ctgttcccacctgctgg

SEQ ID NO: 3450750 - DNA, 15 bp, Homo sapiens
ctgttccccagagaa

SEQ ID NO: 3450751 - DNA, 17 bp, Homo sapiens
ctgttcccccttcacaa

SEQ ID NO: 3450752 - DNA, 23 bp, Homo sapiens
ctgttcccccttcacaaagccca

SEQ ID NO: 3450753 - DNA, 15 bp, Homo sapiens
ctgttctaacatgta

SEQ ID NO: 3450754 - DNA, 16 bp, Homo sapiens
ctgttctaacatgtaa

SEQ ID NO: 3450755 - DNA, 16 bp, Homo sapiens
ctgttctcattcctgt

SEQ ID NO: 3450756 - DNA, 20 bp, Homo sapiens
ctgttctcattcctgttctt

SEQ ID NO: 3450757 - DNA, 14 bp, Homo sapiens
ctgttctggaggaa

SEQ ID NO: 3450758 - DNA, 23 bp, Homo sapiens
ctgttctggaggaaagggaggag

SEQ ID NO: 3450759 - DNA, 15 bp, Homo sapiens
ctgttctgggactcc

SEQ ID NO: 3450760 - DNA, 23 bp, Homo sapiens
ctgttgaattttgttctctggga

SEQ ID NO: 3450761 - DNA, 15 bp, Homo sapiens
ctgttgacatattta

SEQ ID NO: 3450762 - DNA, 16 bp, Homo sapiens
ctgttgacatatttaa

SEQ ID NO: 3450763 - DNA, 18 bp, Homo sapiens
ctgttgacatatttaatg

SEQ ID NO: 3450764 - DNA, 22 bp, Homo sapiens
ctgttgactggctgtgtgacct

SEQ ID NO: 3450765 - DNA, 20 bp, Homo sapiens
ctgttgagctgttttccctg

SEQ ID NO: 3450766 - DNA, 16 bp, Homo sapiens
ctgttgcaagcccctc

SEQ ID NO: 3450767 - DNA, 22 bp, Homo sapiens
ctgttgcaagcccctctttctg

SEQ ID NO: 3450768 - DNA, 12 bp, Homo sapiens
ctgttgcccagg

SEQ ID NO: 3450769 - DNA, 13 bp, Homo sapiens
ctgttgcccaggc

SEQ ID NO: 3450770 - DNA, 14 bp, Homo sapiens
ctgttgcccaggct

SEQ ID NO: 3450771 - DNA, 15 bp, Homo sapiens
ctgttgcccaggctg

SEQ ID NO: 3450772 - DNA, 16 bp, Homo sapiens
ctgttgcccaggctgg

SEQ ID NO: 3450773 - DNA, 12 bp, Homo sapiens
ctgttgctaagc

SEQ ID NO: 3450774 - DNA, 15 bp, Homo sapiens
ctgttggcaggctgg

SEQ ID NO: 3450775 - DNA, 14 bp, Homo sapiens
ctgttggctggggg

SEQ ID NO: 3450776 - DNA, 17 bp, Homo sapiens
ctgttgggaacagcatg

SEQ ID NO: 3450777 - DNA, 11 bp, Homo sapiens
ctgttgtacaa

SEQ ID NO: 3450778 - DNA, 16 bp, Homo sapiens
ctgttgtacaatcatg

SEQ ID NO: 3450779 - DNA, 17 bp, Homo sapiens
ctgtttagcagcagcct

SEQ ID NO: 3450780 - DNA, 15 bp, Homo sapiens
ctgtttcccagcagt

SEQ ID NO: 3450781 - DNA, 20 bp, Homo sapiens
ctgtttcctgacattgtctc

SEQ ID NO: 3450782 - DNA, 12 bp, Homo sapiens
ctgtttcctgat

SEQ ID NO: 3450783 - DNA, 23 bp, Homo sapiens
ctgtttggaggagcaaaggctga

SEQ ID NO: 3450784 - DNA, 20 bp, Homo sapiens
ctgtttgtagccacaagcct

SEQ ID NO: 3450785 - DNA, 12 bp, Homo sapiens
ctgtttgttatg

SEQ ID NO: 3450786 - DNA, 21 bp, Homo sapiens
ctgttttctttatgtcttttg

SEQ ID NO: 3450787 - DNA, 19 bp, Homo sapiens
ctgttttgagttttgtagc

SEQ ID NO: 3450788 - DNA, 20 bp, Homo sapiens
ctgttttgagttttgtagca

SEQ ID NO: 3450789 - DNA, 17 bp, Homo sapiens
ctgttttgtttggcaag

SEQ ID NO: 3450790 - DNA, 13 bp, Homo sapiens
ctgtttttgttgt

SEQ ID NO: 3450791 - DNA, 15 bp, Homo sapiens
ctgtttttgtttctt

SEQ ID NO: 3450792 - DNA, 19 bp, Homo sapiens
ctgttttttggcttgctta

SEQ ID NO: 3450793 - DNA, 16 bp, Homo sapiens
cttaaaaagtggaaaa

SEQ ID NO: 3450794 - DNA, 17 bp, Homo sapiens
cttaaaaatatatttcc

SEQ ID NO: 3450795 - DNA, 24 bp, Homo sapiens
cttaaaatgttcacttttgacaaa

SEQ ID NO: 3450796 - DNA, 15 bp, Homo sapiens
cttaaacacccctca

SEQ ID NO: 3450797 - DNA, 13 bp, Homo sapiens
cttaacaaataca

SEQ ID NO: 3450798 - DNA, 17 bp, Homo sapiens
cttaagcaaaagaaaaa

SEQ ID NO: 3450799 - DNA, 13 bp, Homo sapiens
cttaagccctggc

SEQ ID NO: 3450800 - DNA, 16 bp, Homo sapiens
cttaagccctggcccc

SEQ ID NO: 3450801 - DNA, 20 bp, Homo sapiens
cttaagtcaccctagccctc

SEQ ID NO: 3450802 - DNA, 16 bp, Homo sapiens
cttaatactaccttga

SEQ ID NO: 3450803 - DNA, 18 bp, Homo sapiens
cttaatactaccttgaaa

SEQ ID NO: 3450804 - DNA, 20 bp, Homo sapiens
cttaatagaaacattgaaga

SEQ ID NO: 3450805 - DNA, 21 bp, Homo sapiens
cttaatataaattcactttca

SEQ ID NO: 3450806 - DNA, 21 bp, Homo sapiens
cttaatatgctgcaacaaaat

SEQ ID NO: 3450807 - DNA, 23 bp, Homo sapiens
cttaatatgctgcaacaaaatgt

SEQ ID NO: 3450808 - DNA, 18 bp, Homo sapiens
cttaatccagctgatgag

SEQ ID NO: 3450809 - DNA, 14 bp, Homo sapiens
cttaatcttgcttt

SEQ ID NO: 3450810 - DNA, 17 bp, Homo sapiens
cttaatcttgctttctt

SEQ ID NO: 3450811 - DNA, 18 bp, Homo sapiens
cttaatcttgctttcttt

SEQ ID NO: 3450812 - DNA, 16 bp, Homo sapiens
cttaatgaagagccag

SEQ ID NO: 3450813 - DNA, 12 bp, Homo sapiens
cttaatgaagtt

SEQ ID NO: 3450814 - DNA, 20 bp, Homo sapiens
cttaatgaagtttgaatgtt

SEQ ID NO: 3450815 - DNA, 21 bp, Homo sapiens
cttaattgctttcctgcctcc

SEQ ID NO: 3450816 - DNA, 15 bp, Homo sapiens
cttacaaaaacactt

SEQ ID NO: 3450817 - DNA, 21 bp, Homo sapiens
cttacacaaatctatttaatt

SEQ ID NO: 3450818 - DNA, 20 bp, Homo sapiens
cttacacccacagtggaaag

SEQ ID NO: 3450819 - DNA, 23 bp, Homo sapiens
cttacagctgggtggcactgcca

SEQ ID NO: 3450820 - DNA, 16 bp, Homo sapiens
cttacagtaggagccc

SEQ ID NO: 3450821 - DNA, 23 bp, Homo sapiens
cttacagtaggagcccagctctg

SEQ ID NO: 3450822 - DNA, 16 bp, Homo sapiens
cttacattctctaata

SEQ ID NO: 3450823 - DNA, 20 bp, Homo sapiens
cttacattgttcaattagaa

SEQ ID NO: 3450824 - DNA, 21 bp, Homo sapiens
cttacccggagaaggccgctg

SEQ ID NO: 3450825 - DNA, 23 bp, Homo sapiens
cttacccggagaaggccgctgcc

SEQ ID NO: 3450826 - DNA, 13 bp, Homo sapiens
cttacccttagaa

SEQ ID NO: 3450827 - DNA, 17 bp, Homo sapiens
cttaccgagagccaaac

SEQ ID NO: 3450828 - DNA, 18 bp, Homo sapiens
cttacctaccacatgcca

SEQ ID NO: 3450829 - DNA, 16 bp, Homo sapiens
cttacctttaccccat

SEQ ID NO: 3450830 - DNA, 23 bp, Homo sapiens
cttacgaatacttttgccctttg

SEQ ID NO: 3450831 - DNA, 14 bp, Homo sapiens
cttactctttccta

SEQ ID NO: 3450832 - DNA, 12 bp, Homo sapiens
cttactgaaggt

SEQ ID NO: 3450833 - DNA, 17 bp, Homo sapiens
cttactgtaagacatta

SEQ ID NO: 3450834 - DNA, 22 bp, Homo sapiens
cttactgtgcacctagagcttt

SEQ ID NO: 3450835 - DNA, 14 bp, Homo sapiens
cttacttcttgccc

SEQ ID NO: 3450836 - DNA, 14 bp, Homo sapiens
cttagaaatttatt

SEQ ID NO: 3450837 - DNA, 20 bp, Homo sapiens
cttagaagtcacacagtatt

SEQ ID NO: 3450838 - DNA, 12 bp, Homo sapiens
cttagaatccaa

SEQ ID NO: 3450839 - DNA, 16 bp, Homo sapiens
cttagaatccaaactt

SEQ ID NO: 3450840 - DNA, 22 bp, Homo sapiens
cttagagacagttgggtgagaa

SEQ ID NO: 3450841 - DNA, 19 bp, Homo sapiens
cttagagcagtttctgtcc

SEQ ID NO: 3450842 - DNA, 21 bp, Homo sapiens
cttagatctggcatgttagcc

SEQ ID NO: 3450843 - DNA, 20 bp, Homo sapiens
cttagatgttccagtaatct

SEQ ID NO: 3450844 - DNA, 21 bp, Homo sapiens
cttagcagggaaacagctaat

SEQ ID NO: 3450845 - DNA, 14 bp, Homo sapiens
cttagctcccctcc

SEQ ID NO: 3450846 - DNA, 11 bp, Homo sapiens
cttagcttcag

SEQ ID NO: 3450847 - DNA, 13 bp, Homo sapiens
cttagcttcagga

SEQ ID NO: 3450848 - DNA, 14 bp, Homo sapiens
cttagcttcaggaa

SEQ ID NO: 3450849 - DNA, 17 bp, Homo sapiens
cttaggaagagaaacca

SEQ ID NO: 3450850 - DNA, 22 bp, Homo sapiens
cttaggaagagaaaccagggag

SEQ ID NO: 3450851 - DNA, 15 bp, Homo sapiens
cttaggccttcctct

SEQ ID NO: 3450852 - DNA, 16 bp, Homo sapiens
cttagggtttggagct

SEQ ID NO: 3450853 - DNA, 17 bp, Homo sapiens
cttaggttggcaaaaag

SEQ ID NO: 3450854 - DNA, 21 bp, Homo sapiens
cttaggttggcaaaaaggcag

SEQ ID NO: 3450855 - DNA, 17 bp, Homo sapiens
cttagtttgtgtgttgt

SEQ ID NO: 3450856 - DNA, 19 bp, Homo sapiens
cttatacgcttttctttgt

SEQ ID NO: 3450857 - DNA, 16 bp, Homo sapiens
cttatactgtacaata

SEQ ID NO: 3450858 - DNA, 13 bp, Homo sapiens
cttatagaatatt

SEQ ID NO: 3450859 - DNA, 15 bp, Homo sapiens
cttatagaatattta

SEQ ID NO: 3450860 - DNA, 13 bp, Homo sapiens
cttataggtggcc

SEQ ID NO: 3450861 - DNA, 21 bp, Homo sapiens
cttatcacccccttgttgtaa

SEQ ID NO: 3450862 - DNA, 18 bp, Homo sapiens
cttatcactgacacaaaa

SEQ ID NO: 3450863 - DNA, 18 bp, Homo sapiens
cttatccttcctctcctt

SEQ ID NO: 3450864 - DNA, 16 bp, Homo sapiens
cttatctgtgctcagg

SEQ ID NO: 3450865 - DNA, 18 bp, Homo sapiens
cttatgaatgatttgcat

SEQ ID NO: 3450866 - DNA, 13 bp, Homo sapiens
cttatgagaaact

SEQ ID NO: 3450867 - DNA, 14 bp, Homo sapiens
cttatggaattgat

SEQ ID NO: 3450868 - DNA, 15 bp, Homo sapiens
cttatgtacaaaact

SEQ ID NO: 3450869 - DNA, 20 bp, Homo sapiens
cttatgtgtaggtgaacagt

SEQ ID NO: 3450870 - DNA, 21 bp, Homo sapiens
cttattaacaattaggcagac

SEQ ID NO: 3450871 - DNA, 13 bp, Homo sapiens
cttattacccaaa

SEQ ID NO: 3450872 - DNA, 14 bp, Homo sapiens
cttattacccaaac

SEQ ID NO: 3450873 - DNA, 13 bp, Homo sapiens
cttattgcccacg

SEQ ID NO: 3450874 - DNA, 13 bp, Homo sapiens
cttattgtacctc

SEQ ID NO: 3450875 - DNA, 14 bp, Homo sapiens
cttattgtacctct

SEQ ID NO: 3450876 - DNA, 15 bp, Homo sapiens
cttattgtacctctc

SEQ ID NO: 3450877 - DNA, 13 bp, Homo sapiens
cttcaaccctcag

SEQ ID NO: 3450878 - DNA, 16 bp, Homo sapiens
cttcaaccctcagcct

SEQ ID NO: 3450879 - DNA, 22 bp, Homo sapiens
cttcaactcctcgacatcactg

SEQ ID NO: 3450880 - DNA, 14 bp, Homo sapiens
cttcaaggcttcag

SEQ ID NO: 3450881 - DNA, 15 bp, Homo sapiens
cttcaaggcttcagt

SEQ ID NO: 3450882 - DNA, 19 bp, Homo sapiens
cttcaatagttcaaggaac

SEQ ID NO: 3450883 - DNA, 14 bp, Homo sapiens
cttcacaaagccca

SEQ ID NO: 3450884 - DNA, 13 bp, Homo sapiens
cttcacagatgcc

SEQ ID NO: 3450885 - DNA, 16 bp, Homo sapiens
cttcacagatgcctac

SEQ ID NO: 3450886 - DNA, 21 bp, Homo sapiens
cttcacatcctgtgtttctag

SEQ ID NO: 3450887 - DNA, 22 bp, Homo sapiens
cttcacattcccctggggaccc

SEQ ID NO: 3450888 - DNA, 17 bp, Homo sapiens
cttcaccatttggcaat

SEQ ID NO: 3450889 - DNA, 14 bp, Homo sapiens
cttcacctcttcca

SEQ ID NO: 3450890 - DNA, 15 bp, Homo sapiens
cttcacctcttccac

SEQ ID NO: 3450891 - DNA, 20 bp, Homo sapiens
cttcacctgattcaactaaa

SEQ ID NO: 3450892 - DNA, 21 bp, Homo sapiens
cttcacctgattcaactaaaa

SEQ ID NO: 3450893 - DNA, 16 bp, Homo sapiens
cttcactattcctagg

SEQ ID NO: 3450894 - DNA, 19 bp, Homo sapiens
cttcactcttcaaatgcct

SEQ ID NO: 3450895 - DNA, 15 bp, Homo sapiens
cttcactgtaaaata

SEQ ID NO: 3450896 - DNA, 17 bp, Homo sapiens
cttcactgtcctccaag

SEQ ID NO: 3450897 - DNA, 21 bp, Homo sapiens
cttcactgtcctccaagccag

SEQ ID NO: 3450898 - DNA, 23 bp, Homo sapiens
cttcagaggccctcgctgccagc

SEQ ID NO: 3450899 - DNA, 19 bp, Homo sapiens
cttcagccctcacccctgg

SEQ ID NO: 3450900 - DNA, 16 bp, Homo sapiens
cttcagcctagtggct

SEQ ID NO: 3450901 - DNA, 17 bp, Homo sapiens
cttcagctcacgcttca

SEQ ID NO: 3450902 - DNA, 23 bp, Homo sapiens
cttcaggaacacccccatgacat

SEQ ID NO: 3450903 - DNA, 16 bp, Homo sapiens
cttcagggcaggtggg

SEQ ID NO: 3450904 - DNA, 13 bp, Homo sapiens
cttcagggcctgg

SEQ ID NO: 3450905 - DNA, 10 bp, Homo sapiens
cttcaggtcc

SEQ ID NO: 3450906 - DNA, 20 bp, Homo sapiens
cttcagtaacccccactgga

SEQ ID NO: 3450907 - DNA, 22 bp, Homo sapiens
cttcagtaacccccactggact

SEQ ID NO: 3450908 - DNA, 14 bp, Homo sapiens
cttcagtaagccgt

SEQ ID NO: 3450909 - DNA, 15 bp, Homo sapiens
cttcagtaagccgtg

SEQ ID NO: 3450910 - DNA, 15 bp, Homo sapiens
cttcagtatgttgtc

SEQ ID NO: 3450911 - DNA, 22 bp, Homo sapiens
cttcagtatgttgtcaaagaga

SEQ ID NO: 3450912 - DNA, 17 bp, Homo sapiens
cttcagtggcagctgct

SEQ ID NO: 3450913 - DNA, 15 bp, Homo sapiens
cttcagtttaatgca

SEQ ID NO: 3450914 - DNA, 22 bp, Homo sapiens
cttcagtttaatgcaagagaac

SEQ ID NO: 3450915 - DNA, 14 bp, Homo sapiens
cttcagtttatttc

SEQ ID NO: 3450916 - DNA, 22 bp, Homo sapiens
cttcatatgaaaggtgccatgg

SEQ ID NO: 3450917 - DNA, 20 bp, Homo sapiens
cttcatattctaaaaccatt

SEQ ID NO: 3450918 - DNA, 13 bp, Homo sapiens
cttcatctcccac

SEQ ID NO: 3450919 - DNA, 19 bp, Homo sapiens
cttcatctcccacctagca

SEQ ID NO: 3450920 - DNA, 15 bp, Homo sapiens
cttcatctgcccaac

SEQ ID NO: 3450921 - DNA, 19 bp, Homo sapiens
cttcatcttcctgtgtcct

SEQ ID NO: 3450922 - DNA, 20 bp, Homo sapiens
cttcatcttcctgtgtcctg

SEQ ID NO: 3450923 - DNA, 15 bp, Homo sapiens
cttcatcttttaaag

SEQ ID NO: 3450924 - DNA, 15 bp, Homo sapiens
cttcatggaccaaga

SEQ ID NO: 3450925 - DNA, 16 bp, Homo sapiens
cttcatgtggcttccc

SEQ ID NO: 3450926 - DNA, 22 bp, Homo sapiens
cttcattctccttgttgttggt

SEQ ID NO: 3450927 - DNA, 20 bp, Homo sapiens
cttcattcttgaaagctgtg

SEQ ID NO: 3450928 - DNA, 14 bp, Homo sapiens
cttcattttcagag

SEQ ID NO: 3450929 - DNA, 17 bp, Homo sapiens
cttcattttcagagtga

SEQ ID NO: 3450930 - DNA, 17 bp, Homo sapiens
cttcatttttctttctt

SEQ ID NO: 3450931 - DNA, 18 bp, Homo sapiens
cttcatttttgtaataac

SEQ ID NO: 3450932 - DNA, 19 bp, Homo sapiens
cttcatttttgtaataaca

SEQ ID NO: 3450933 - DNA, 23 bp, Homo sapiens
cttcatttttgtaataacattta

SEQ ID NO: 3450934 - DNA, 16 bp, Homo sapiens
cttccaaatcccctaa

SEQ ID NO: 3450935 - DNA, 20 bp, Homo sapiens
cttccaaatcccctaagcag

SEQ ID NO: 3450936 - DNA, 17 bp, Homo sapiens
cttccacaaagaaaatt

SEQ ID NO: 3450937 - DNA, 18 bp, Homo sapiens
cttccactgagggcagtc

SEQ ID NO: 3450938 - DNA, 20 bp, Homo sapiens
cttccagggatttgcctcac

SEQ ID NO: 3450939 - DNA, 16 bp, Homo sapiens
cttccaggtgttactg

SEQ ID NO: 3450940 - DNA, 19 bp, Homo sapiens
cttccaggtgttactgtaa

SEQ ID NO: 3450941 - DNA, 22 bp, Homo sapiens
cttccaggtgttactgtaattc

SEQ ID NO: 3450942 - DNA, 22 bp, Homo sapiens
cttccatctttcctgatggcag

SEQ ID NO: 3450943 - DNA, 22 bp, Homo sapiens
cttccattgtttaaaaatacac

SEQ ID NO: 3450944 - DNA, 18 bp, Homo sapiens
cttcccaaacccagtctc

SEQ ID NO: 3450945 - DNA, 20 bp, Homo sapiens
cttcccaaacccagtctcct

SEQ ID NO: 3450946 - DNA, 21 bp, Homo sapiens
cttcccaaacccagtctcctc

SEQ ID NO: 3450947 - DNA, 15 bp, Homo sapiens
cttcccaatcttctt

SEQ ID NO: 3450948 - DNA, 19 bp, Homo sapiens
cttcccaatcttctttttc

SEQ ID NO: 3450949 - DNA, 16 bp, Homo sapiens
cttcccagctaggaag

SEQ ID NO: 3450950 - DNA, 18 bp, Homo sapiens
cttcccaggttcaagcga

SEQ ID NO: 3450951 - DNA, 14 bp, Homo sapiens
cttcccagtggctg

SEQ ID NO: 3450952 - DNA, 17 bp, Homo sapiens
cttcccagtggctgctg

SEQ ID NO: 3450953 - DNA, 20 bp, Homo sapiens
cttcccataccacccaatgc

SEQ ID NO: 3450954 - DNA, 15 bp, Homo sapiens
cttcccatgacccag

SEQ ID NO: 3450955 - DNA, 19 bp, Homo sapiens
cttcccatgacccaggctg

SEQ ID NO: 3450956 - DNA, 12 bp, Homo sapiens
cttccccacaga

SEQ ID NO: 3450957 - DNA, 13 bp, Homo sapiens
cttccccacagaa

SEQ ID NO: 3450958 - DNA, 16 bp, Homo sapiens
cttccccacagaactg

SEQ ID NO: 3450959 - DNA, 13 bp, Homo sapiens
cttcccctgcctc

SEQ ID NO: 3450960 - DNA, 18 bp, Homo sapiens
cttcccgggccagggctg

SEQ ID NO: 3450961 - DNA, 17 bp, Homo sapiens
cttccctacccagtccc

SEQ ID NO: 3450962 - DNA, 13 bp, Homo sapiens
cttccctgactca

SEQ ID NO: 3450963 - DNA, 14 bp, Homo sapiens
cttccctgactcat

SEQ ID NO: 3450964 - DNA, 14 bp, Homo sapiens
cttccctgctgcct

SEQ ID NO: 3450965 - DNA, 20 bp, Homo sapiens
cttcccttttaaacacattt

SEQ ID NO: 3450966 - DNA, 19 bp, Homo sapiens
cttccgatgacagtgctct

SEQ ID NO: 3450967 - DNA, 16 bp, Homo sapiens
cttcctaagcctgtgg

SEQ ID NO: 3450968 - DNA, 18 bp, Homo sapiens
cttcctaagcctgtggct

SEQ ID NO: 3450969 - DNA, 16 bp, Homo sapiens
cttcctaccctgcctc

SEQ ID NO: 3450970 - DNA, 17 bp, Homo sapiens
cttcctaccctgcctcc

SEQ ID NO: 3450971 - DNA, 22 bp, Homo sapiens
cttcctattccaagcttccata

SEQ ID NO: 3450972 - DNA, 13 bp, Homo sapiens
cttcctcctggaa

SEQ ID NO: 3450973 - DNA, 17 bp, Homo sapiens
cttcctctccttccttg

SEQ ID NO: 3450974 - DNA, 15 bp, Homo sapiens
cttcctctctccaga

SEQ ID NO: 3450975 - DNA, 16 bp, Homo sapiens
cttcctctctccagat

SEQ ID NO: 3450976 - DNA, 13 bp, Homo sapiens
cttcctctgcaag

SEQ ID NO: 3450977 - DNA, 17 bp, Homo sapiens
cttcctctgcaagtgct

SEQ ID NO: 3450978 - DNA, 18 bp, Homo sapiens
cttcctgaaactatattt

SEQ ID NO: 3450979 - DNA, 19 bp, Homo sapiens
cttcctgactctcacctgt

SEQ ID NO: 3450980 - DNA, 22 bp, Homo sapiens
cttcctggagactgcccagcta

SEQ ID NO: 3450981 - DNA, 16 bp, Homo sapiens
cttcctgtccagctcc

SEQ ID NO: 3450982 - DNA, 23 bp, Homo sapiens
cttcctgtgtgtccaaaactgcc

SEQ ID NO: 3450983 - DNA, 22 bp, Homo sapiens
cttccttgaagaactgcaggcc

SEQ ID NO: 3450984 - DNA, 12 bp, Homo sapiens
cttccttgcccc

SEQ ID NO: 3450985 - DNA, 21 bp, Homo sapiens
cttccttgttacccatgaaaa

SEQ ID NO: 3450986 - DNA, 21 bp, Homo sapiens
cttccttttaagtaaggtcca

SEQ ID NO: 3450987 - DNA, 13 bp, Homo sapiens
cttcgctcctgtg

SEQ ID NO: 3450988 - DNA, 14 bp, Homo sapiens
cttcgctcctgtgt

SEQ ID NO: 3450989 - DNA, 15 bp, Homo sapiens
cttcgctcctgtgtc

SEQ ID NO: 3450990 - DNA, 17 bp, Homo sapiens
cttcgctcctgtgtctt

SEQ ID NO: 3450991 - DNA, 13 bp, Homo sapiens
cttcgctgtcccc

SEQ ID NO: 3450992 - DNA, 18 bp, Homo sapiens
cttcgcttcttgcctctg

SEQ ID NO: 3450993 - DNA, 20 bp, Homo sapiens
cttcgcttcttgcctctgtg

SEQ ID NO: 3450994 - DNA, 12 bp, Homo sapiens
cttcgggaccag

SEQ ID NO: 3450995 - DNA, 21 bp, Homo sapiens
cttcgggaggtcgaggcagga

SEQ ID NO: 3450996 - DNA, 17 bp, Homo sapiens
cttcgggcccttcccac

SEQ ID NO: 3450997 - DNA, 22 bp, Homo sapiens
cttcggggtagaggctgggagg

SEQ ID NO: 3450998 - DNA, 14 bp, Homo sapiens
cttcgtctttccca

SEQ ID NO: 3450999 - DNA, 21 bp, Homo sapiens
cttcgtgcggaatcagcttct

SEQ ID NO: 3451000 - DNA, 13 bp, Homo sapiens
cttcgttcgcaga

SEQ ID NO: 3451001 - DNA, 17 bp, Homo sapiens
cttcgttcgcagagctt

SEQ ID NO: 3451002 - DNA, 15 bp, Homo sapiens
cttcgttctttttaa

SEQ ID NO: 3451003 - DNA, 18 bp, Homo sapiens
cttctaaacttccccatc

SEQ ID NO: 3451004 - DNA, 23 bp, Homo sapiens
cttctaaggaaatggagaagctc

SEQ ID NO: 3451005 - DNA, 13 bp, Homo sapiens
cttctagagctta

SEQ ID NO: 3451006 - DNA, 16 bp, Homo sapiens
cttctaggacgccacc

SEQ ID NO: 3451007 - DNA, 22 bp, Homo sapiens
cttctatgtaggaaaaaaatag

SEQ ID NO: 3451008 - DNA, 13 bp, Homo sapiens
cttctattttatt

SEQ ID NO: 3451009 - DNA, 20 bp, Homo sapiens
cttctcacatttatattttt

SEQ ID NO: 3451010 - DNA, 12 bp, Homo sapiens
cttctcaccagc

SEQ ID NO: 3451011 - DNA, 15 bp, Homo sapiens
cttctcaccagctgc

SEQ ID NO: 3451012 - DNA, 19 bp, Homo sapiens
cttctcaccagctgcaaag

SEQ ID NO: 3451013 - DNA, 18 bp, Homo sapiens
cttctcatttcacccctc

SEQ ID NO: 3451014 - DNA, 20 bp, Homo sapiens
cttctccaaaaatctgcctg

SEQ ID NO: 3451015 - DNA, 18 bp, Homo sapiens
cttctccaccctgctctc

SEQ ID NO: 3451016 - DNA, 14 bp, Homo sapiens
cttctccaggctgt

SEQ ID NO: 3451017 - DNA, 12 bp, Homo sapiens
cttctccccaga

SEQ ID NO: 3451018 - DNA, 16 bp, Homo sapiens
cttctccccagagttc

SEQ ID NO: 3451019 - DNA, 15 bp, Homo sapiens
cttctcctatgtgta

SEQ ID NO: 3451020 - DNA, 15 bp, Homo sapiens
cttctcctcttgtaa

SEQ ID NO: 3451021 - DNA, 23 bp, Homo sapiens
cttctcctcttgtaaataaagcc

SEQ ID NO: 3451022 - DNA, 16 bp, Homo sapiens
cttctcgcttttgcca

SEQ ID NO: 3451023 - DNA, 21 bp, Homo sapiens
cttctcggcttggatcctggg

SEQ ID NO: 3451024 - DNA, 12 bp, Homo sapiens
cttctctataaa

SEQ ID NO: 3451025 - DNA, 13 bp, Homo sapiens
cttctctataaaa

SEQ ID NO: 3451026 - DNA, 16 bp, Homo sapiens
cttctctcatctctta

SEQ ID NO: 3451027 - DNA, 22 bp, Homo sapiens
cttctctgacttctgcctggag

SEQ ID NO: 3451028 - DNA, 22 bp, Homo sapiens
cttctctgtgaacgatttagaa

SEQ ID NO: 3451029 - DNA, 17 bp, Homo sapiens
cttctgagcaaactatt

SEQ ID NO: 3451030 - DNA, 15 bp, Homo sapiens
cttctgccatattct

SEQ ID NO: 3451031 - DNA, 17 bp, Homo sapiens
cttctgccggccctggg

SEQ ID NO: 3451032 - DNA, 12 bp, Homo sapiens
cttctgcctgca

SEQ ID NO: 3451033 - DNA, 16 bp, Homo sapiens
cttctgcctggagact

SEQ ID NO: 3451034 - DNA, 13 bp, Homo sapiens
cttctgctactgg

SEQ ID NO: 3451035 - DNA, 15 bp, Homo sapiens
cttctgctcagctct

SEQ ID NO: 3451036 - DNA, 17 bp, Homo sapiens
cttctgcttcagcctcc

SEQ ID NO: 3451037 - DNA, 16 bp, Homo sapiens
cttctggaatttgttc

SEQ ID NO: 3451038 - DNA, 19 bp, Homo sapiens
cttctggcctcccacagac

SEQ ID NO: 3451039 - DNA, 15 bp, Homo sapiens
cttctgggtggggca

SEQ ID NO: 3451040 - DNA, 20 bp, Homo sapiens
cttctgtacgtctgacaggc

SEQ ID NO: 3451041 - DNA, 18 bp, Homo sapiens
cttctgtcctactctgtg

SEQ ID NO: 3451042 - DNA, 19 bp, Homo sapiens
cttctgtcctactctgtgt

SEQ ID NO: 3451043 - DNA, 14 bp, Homo sapiens
cttctgtctccagc

SEQ ID NO: 3451044 - DNA, 22 bp, Homo sapiens
cttctgtgtatctctttcacat

SEQ ID NO: 3451045 - DNA, 23 bp, Homo sapiens
cttcttaagatacaaatggtgga

SEQ ID NO: 3451046 - DNA, 20 bp, Homo sapiens
cttcttattacccaaaccca

SEQ ID NO: 3451047 - DNA, 13 bp, Homo sapiens
cttcttattttgg

SEQ ID NO: 3451048 - DNA, 18 bp, Homo sapiens
cttcttcacctcttccac

SEQ ID NO: 3451049 - DNA, 16 bp, Homo sapiens
cttcttcagggcctgg

SEQ ID NO: 3451050 - DNA, 14 bp, Homo sapiens
cttcttgccctggg

SEQ ID NO: 3451051 - DNA, 15 bp, Homo sapiens
cttcttgcctctgtg

SEQ ID NO: 3451052 - DNA, 17 bp, Homo sapiens
cttcttgcctctgtgct

SEQ ID NO: 3451053 - DNA, 17 bp, Homo sapiens
cttcttgtttccttgtt

SEQ ID NO: 3451054 - DNA, 21 bp, Homo sapiens
cttctttctttgggaatattt

SEQ ID NO: 3451055 - DNA, 15 bp, Homo sapiens
cttctttttattttc

SEQ ID NO: 3451056 - DNA, 23 bp, Homo sapiens
cttctttttattttcttttgtaa

SEQ ID NO: 3451057 - DNA, 16 bp, Homo sapiens
cttcttttttttcatt

SEQ ID NO: 3451058 - DNA, 21 bp, Homo sapiens
cttgaaattaagaaggcaaaa

SEQ ID NO: 3451059 - DNA, 18 bp, Homo sapiens
cttgaacctatgaagcaa

SEQ ID NO: 3451060 - DNA, 13 bp, Homo sapiens
cttgaactcctgg

SEQ ID NO: 3451061 - DNA, 14 bp, Homo sapiens
cttgaactcctggc

SEQ ID NO: 3451062 - DNA, 14 bp, Homo sapiens
cttgaactctgggc

SEQ ID NO: 3451063 - DNA, 18 bp, Homo sapiens
cttgaactctgggctcaa

SEQ ID NO: 3451064 - DNA, 18 bp, Homo sapiens
cttgaactgggtacttgt

SEQ ID NO: 3451065 - DNA, 18 bp, Homo sapiens
cttgaacttgcctctttt

SEQ ID NO: 3451066 - DNA, 17 bp, Homo sapiens
cttgaagaactgcaggc

SEQ ID NO: 3451067 - DNA, 22 bp, Homo sapiens
cttgaagaactgcaggccctgg

SEQ ID NO: 3451068 - DNA, 14 bp, Homo sapiens
cttgaagaatattc

SEQ ID NO: 3451069 - DNA, 16 bp, Homo sapiens
cttgaagagaaaaaag

SEQ ID NO: 3451070 - DNA, 21 bp, Homo sapiens
cttgaaggccctgctgagtca

SEQ ID NO: 3451071 - DNA, 13 bp, Homo sapiens
cttgaagggccag

SEQ ID NO: 3451072 - DNA, 22 bp, Homo sapiens
cttgaagttgttactaactaaa

SEQ ID NO: 3451073 - DNA, 14 bp, Homo sapiens
cttgaataataagc

SEQ ID NO: 3451074 - DNA, 16 bp, Homo sapiens
cttgaatagcttatgt

SEQ ID NO: 3451075 - DNA, 17 bp, Homo sapiens
cttgaattgtaactgtt

SEQ ID NO: 3451076 - DNA, 20 bp, Homo sapiens
cttgaattgtaactgttctt

SEQ ID NO: 3451077 - DNA, 21 bp, Homo sapiens
cttgaattgtaactgttcttg

SEQ ID NO: 3451078 - DNA, 23 bp, Homo sapiens
cttgaatttttttctgcacagct

SEQ ID NO: 3451079 - DNA, 14 bp, Homo sapiens
cttgacaacatctg

SEQ ID NO: 3451080 - DNA, 16 bp, Homo sapiens
cttgacaactggcagg

SEQ ID NO: 3451081 - DNA, 23 bp, Homo sapiens
cttgacacatagtttttcagtct

SEQ ID NO: 3451082 - DNA, 13 bp, Homo sapiens
cttgacagaaagc

SEQ ID NO: 3451083 - DNA, 20 bp, Homo sapiens
cttgacagaaagcagttctg

SEQ ID NO: 3451084 - DNA, 15 bp, Homo sapiens
cttgaccaagcagga

SEQ ID NO: 3451085 - DNA, 18 bp, Homo sapiens
cttgaccaagcaggaagc

SEQ ID NO: 3451086 - DNA, 13 bp, Homo sapiens
cttgaccctgagc

SEQ ID NO: 3451087 - DNA, 14 bp, Homo sapiens
cttgaccctgagct

SEQ ID NO: 3451088 - DNA, 19 bp, Homo sapiens
cttgacctgcattgtaaat

SEQ ID NO: 3451089 - DNA, 15 bp, Homo sapiens
cttgaccttgtagag

SEQ ID NO: 3451090 - DNA, 21 bp, Homo sapiens
cttgacctttgtacagcccag

SEQ ID NO: 3451091 - DNA, 19 bp, Homo sapiens
cttgactttgctcctcaca

SEQ ID NO: 3451092 - DNA, 14 bp, Homo sapiens
cttgagagaccagg

SEQ ID NO: 3451093 - DNA, 16 bp, Homo sapiens
cttgagagaccaggca

SEQ ID NO: 3451094 - DNA, 14 bp, Homo sapiens
cttgagagggtgga

SEQ ID NO: 3451095 - DNA, 12 bp, Homo sapiens
cttgagcctggg

SEQ ID NO: 3451096 - DNA, 15 bp, Homo sapiens
cttgagcctgggagg

SEQ ID NO: 3451097 - DNA, 16 bp, Homo sapiens
cttgagcctgggaggt

SEQ ID NO: 3451098 - DNA, 20 bp, Homo sapiens
cttgagggttgggctggtgt

SEQ ID NO: 3451099 - DNA, 12 bp, Homo sapiens
cttgagtttgtc

SEQ ID NO: 3451100 - DNA, 16 bp, Homo sapiens
cttgagtttgtcgctc

SEQ ID NO: 3451101 - DNA, 21 bp, Homo sapiens
cttgagtttgtcgctcatgtg

SEQ ID NO: 3451102 - DNA, 17 bp, Homo sapiens
cttgatagaaatgccaa

SEQ ID NO: 3451103 - DNA, 15 bp, Homo sapiens
cttgatctgtatata

SEQ ID NO: 3451104 - DNA, 20 bp, Homo sapiens
cttgatctgtatatacaata

SEQ ID NO: 3451105 - DNA, 15 bp, Homo sapiens
cttgatgactgcctt

SEQ ID NO: 3451106 - DNA, 22 bp, Homo sapiens
cttgatgactgccttgcctcct

SEQ ID NO: 3451107 - DNA, 18 bp, Homo sapiens
cttgatgggattctggac

SEQ ID NO: 3451108 - DNA, 15 bp, Homo sapiens
cttgatgtttagaaa

SEQ ID NO: 3451109 - DNA, 16 bp, Homo sapiens
cttgattatccatatt

SEQ ID NO: 3451110 - DNA, 22 bp, Homo sapiens
cttgattctgcagtaaatcttt

SEQ ID NO: 3451111 - DNA, 18 bp, Homo sapiens
cttgatttaaacacacag

SEQ ID NO: 3451112 - DNA, 23 bp, Homo sapiens
cttgcaaatacctcctccctaat

SEQ ID NO: 3451113 - DNA, 19 bp, Homo sapiens
cttgcaatataacattcta

SEQ ID NO: 3451114 - DNA, 14 bp, Homo sapiens
cttgcaatggcagc

SEQ ID NO: 3451115 - DNA, 16 bp, Homo sapiens
cttgcaatggcagcct

SEQ ID NO: 3451116 - DNA, 17 bp, Homo sapiens
cttgcaatggcagcctt

SEQ ID NO: 3451117 - DNA, 18 bp, Homo sapiens
cttgcaatggcagccttg

SEQ ID NO: 3451118 - DNA, 21 bp, Homo sapiens
cttgcagactctacagaggcc

SEQ ID NO: 3451119 - DNA, 12 bp, Homo sapiens
cttgcagcagga

SEQ ID NO: 3451120 - DNA, 13 bp, Homo sapiens
cttgcagcaggat

SEQ ID NO: 3451121 - DNA, 17 bp, Homo sapiens
cttgccaaatataaata

SEQ ID NO: 3451122 - DNA, 21 bp, Homo sapiens
cttgccagaaccaaattaact

SEQ ID NO: 3451123 - DNA, 14 bp, Homo sapiens
cttgccagatgctg

SEQ ID NO: 3451124 - DNA, 13 bp, Homo sapiens
cttgccagccaga

SEQ ID NO: 3451125 - DNA, 22 bp, Homo sapiens
cttgccagccagaagcctctgc

SEQ ID NO: 3451126 - DNA, 18 bp, Homo sapiens
cttgccatccattctgga

SEQ ID NO: 3451127 - DNA, 13 bp, Homo sapiens
cttgccctctctt

SEQ ID NO: 3451128 - DNA, 15 bp, Homo sapiens
cttgccctctctttt

SEQ ID NO: 3451129 - DNA, 15 bp, Homo sapiens
cttgcctcctcagta

SEQ ID NO: 3451130 - DNA, 17 bp, Homo sapiens
cttgcctctgtcccctt

SEQ ID NO: 3451131 - DNA, 14 bp, Homo sapiens
cttgcctctgtgct

SEQ ID NO: 3451132 - DNA, 12 bp, Homo sapiens
cttgcctcttcc

SEQ ID NO: 3451133 - DNA, 20 bp, Homo sapiens
cttgcctcttttacctgctg

SEQ ID NO: 3451134 - DNA, 15 bp, Homo sapiens
cttgccttcctaagc

SEQ ID NO: 3451135 - DNA, 21 bp, Homo sapiens
cttgccttcctaagcctgtgg

SEQ ID NO: 3451136 - DNA, 19 bp, Homo sapiens
cttgcctttcgaggcctga

SEQ ID NO: 3451137 - DNA, 23 bp, Homo sapiens
cttgctatattgcccaggctggt

SEQ ID NO: 3451138 - DNA, 23 bp, Homo sapiens
cttgctggagtcatgtgcctctg

SEQ ID NO: 3451139 - DNA, 13 bp, Homo sapiens
cttgctgtatgct

SEQ ID NO: 3451140 - DNA, 19 bp, Homo sapiens
cttgctgtatgctgatcat

SEQ ID NO: 3451141 - DNA, 20 bp, Homo sapiens
cttgctgttgacatatttaa

SEQ ID NO: 3451142 - DNA, 14 bp, Homo sapiens
cttgcttatgtgta

SEQ ID NO: 3451143 - DNA, 15 bp, Homo sapiens
cttgcttcttactga

SEQ ID NO: 3451144 - DNA, 11 bp, Homo sapiens
cttgctttctt

SEQ ID NO: 3451145 - DNA, 17 bp, Homo sapiens
cttgctttctttagaat

SEQ ID NO: 3451146 - DNA, 22 bp, Homo sapiens
cttggaaccgtaggacccaagc

SEQ ID NO: 3451147 - DNA, 16 bp, Homo sapiens
cttggacatcctcctc

SEQ ID NO: 3451148 - DNA, 17 bp, Homo sapiens
cttggacatcctcctcc

SEQ ID NO: 3451149 - DNA, 20 bp, Homo sapiens
cttggacatcctcctcccac

SEQ ID NO: 3451150 - DNA, 17 bp, Homo sapiens
cttggagctgagcaaat

SEQ ID NO: 3451151 - DNA, 12 bp, Homo sapiens
cttggaggacag

SEQ ID NO: 3451152 - DNA, 13 bp, Homo sapiens
cttggaggacagt

SEQ ID NO: 3451153 - DNA, 14 bp, Homo sapiens
cttggaggacagtg

SEQ ID NO: 3451154 - DNA, 15 bp, Homo sapiens
cttggaggccagcca

SEQ ID NO: 3451155 - DNA, 17 bp, Homo sapiens
cttggatcctgggctgg

SEQ ID NO: 3451156 - DNA, 14 bp, Homo sapiens
cttggattctctaa

SEQ ID NO: 3451157 - DNA, 23 bp, Homo sapiens
cttggcacatttaagagacagtc

SEQ ID NO: 3451158 - DNA, 20 bp, Homo sapiens
cttggcaccagacacccagg

SEQ ID NO: 3451159 - DNA, 21 bp, Homo sapiens
cttggcacccaagacctcagg

SEQ ID NO: 3451160 - DNA, 18 bp, Homo sapiens
cttggcagcacctgtctc

SEQ ID NO: 3451161 - DNA, 19 bp, Homo sapiens
cttggcagcacctgtctcc

SEQ ID NO: 3451162 - DNA, 13 bp, Homo sapiens
cttggcctgggcc

SEQ ID NO: 3451163 - DNA, 14 bp, Homo sapiens
cttggcctgggccg

SEQ ID NO: 3451164 - DNA, 14 bp, Homo sapiens
cttggccttctccc

SEQ ID NO: 3451165 - DNA, 17 bp, Homo sapiens
cttggccttctcccctc

SEQ ID NO: 3451166 - DNA, 21 bp, Homo sapiens
cttggccttctcccctcttct

SEQ ID NO: 3451167 - DNA, 17 bp, Homo sapiens
cttggctacacagggat

SEQ ID NO: 3451168 - DNA, 16 bp, Homo sapiens
cttggctcagacatgt

SEQ ID NO: 3451169 - DNA, 19 bp, Homo sapiens
cttggctcgaatctctgtg

SEQ ID NO: 3451170 - DNA, 20 bp, Homo sapiens
cttggctcgaatctctgtgc

SEQ ID NO: 3451171 - DNA, 14 bp, Homo sapiens
cttggctgcaggga

SEQ ID NO: 3451172 - DNA, 19 bp, Homo sapiens
cttggcttaatcattttca

SEQ ID NO: 3451173 - DNA, 22 bp, Homo sapiens
cttgggaaaggtggtgtttctg

SEQ ID NO: 3451174 - DNA, 14 bp, Homo sapiens
cttgggagccactg

SEQ ID NO: 3451175 - DNA, 19 bp, Homo sapiens
cttgggagccactgccact

SEQ ID NO: 3451176 - DNA, 20 bp, Homo sapiens
cttgggccaagccagctgcc

SEQ ID NO: 3451177 - DNA, 17 bp, Homo sapiens
cttgggccctttgagtg

SEQ ID NO: 3451178 - DNA, 19 bp, Homo sapiens
cttggggagttaagacctg

SEQ ID NO: 3451179 - DNA, 23 bp, Homo sapiens
cttggggggctgaggtgggagga

SEQ ID NO: 3451180 - DNA, 16 bp, Homo sapiens
cttgggggggtggccg

SEQ ID NO: 3451181 - DNA, 22 bp, Homo sapiens
cttgggggggtggccgctgagt

SEQ ID NO: 3451182 - DNA, 22 bp, Homo sapiens
cttggttcaataaagcactgag

SEQ ID NO: 3451183 - DNA, 23 bp, Homo sapiens
cttggttcaataaagcactgagc

SEQ ID NO: 3451184 - DNA, 19 bp, Homo sapiens
cttggttcccccactgatc

SEQ ID NO: 3451185 - DNA, 15 bp, Homo sapiens
cttggttggctggcc

SEQ ID NO: 3451186 - DNA, 12 bp, Homo sapiens
cttgtaaataaa

SEQ ID NO: 3451187 - DNA, 16 bp, Homo sapiens
cttgtaaatagctcag

SEQ ID NO: 3451188 - DNA, 17 bp, Homo sapiens
cttgtaaatagctcagg

SEQ ID NO: 3451189 - DNA, 19 bp, Homo sapiens
cttgtacctatggctgcct

SEQ ID NO: 3451190 - DNA, 17 bp, Homo sapiens
cttgtagcgactaaact

SEQ ID NO: 3451191 - DNA, 15 bp, Homo sapiens
cttgtatccaggcct

SEQ ID NO: 3451192 - DNA, 17 bp, Homo sapiens
cttgtatccaggcctgg

SEQ ID NO: 3451193 - DNA, 17 bp, Homo sapiens
cttgtattaaagacaga

SEQ ID NO: 3451194 - DNA, 22 bp, Homo sapiens
cttgtccagttcaaataagaaa

SEQ ID NO: 3451195 - DNA, 19 bp, Homo sapiens
cttgtcccagaggctgccc

SEQ ID NO: 3451196 - DNA, 20 bp, Homo sapiens
cttgtcccctcctcactccc

SEQ ID NO: 3451197 - DNA, 14 bp, Homo sapiens
cttgtctcaatgct

SEQ ID NO: 3451198 - DNA, 18 bp, Homo sapiens
cttgtggactaaaagata

SEQ ID NO: 3451199 - DNA, 16 bp, Homo sapiens
cttgttattgaagtgt

SEQ ID NO: 3451200 - DNA, 14 bp, Homo sapiens
cttgttccctctcc

SEQ ID NO: 3451201 - DNA, 12 bp, Homo sapiens
cttgttctgtca

SEQ ID NO: 3451202 - DNA, 12 bp, Homo sapiens
cttgttgctttg

SEQ ID NO: 3451203 - DNA, 13 bp, Homo sapiens
cttgttgctttgt

SEQ ID NO: 3451204 - DNA, 18 bp, Homo sapiens
cttgttgctttgttgcac

SEQ ID NO: 3451205 - DNA, 15 bp, Homo sapiens
cttgttgtgctttta

SEQ ID NO: 3451206 - DNA, 17 bp, Homo sapiens
cttgtttgcactgtgtg

SEQ ID NO: 3451207 - DNA, 13 bp, Homo sapiens
cttgttttccaaa

SEQ ID NO: 3451208 - DNA, 18 bp, Homo sapiens
cttgtttttccactactg

SEQ ID NO: 3451209 - DNA, 12 bp, Homo sapiens
cttgtttttgca

SEQ ID NO: 3451210 - DNA, 20 bp, Homo sapiens
ctttaaaagacaaatcaaag

SEQ ID NO: 3451211 - DNA, 13 bp, Homo sapiens
ctttaaaagagag

SEQ ID NO: 3451212 - DNA, 21 bp, Homo sapiens
ctttaaaagagagagagagaa

SEQ ID NO: 3451213 - DNA, 18 bp, Homo sapiens
ctttaaaatttttttaga

SEQ ID NO: 3451214 - DNA, 10 bp, Homo sapiens
ctttaaagaa

SEQ ID NO: 3451215 - DNA, 18 bp, Homo sapiens
ctttaaatatatattatt

SEQ ID NO: 3451216 - DNA, 20 bp, Homo sapiens
ctttaactccctttttacac

SEQ ID NO: 3451217 - DNA, 19 bp, Homo sapiens
ctttaagcctgcattctta

SEQ ID NO: 3451218 - DNA, 12 bp, Homo sapiens
ctttaatgcatc

SEQ ID NO: 3451219 - DNA, 13 bp, Homo sapiens
ctttaatgcatct

SEQ ID NO: 3451220 - DNA, 17 bp, Homo sapiens
ctttaatgtcacaggca

SEQ ID NO: 3451221 - DNA, 18 bp, Homo sapiens
ctttaatgtcacaggcag

SEQ ID NO: 3451222 - DNA, 15 bp, Homo sapiens
ctttaatttatgtaa

SEQ ID NO: 3451223 - DNA, 21 bp, Homo sapiens
ctttaatttttttaaccaaag

SEQ ID NO: 3451224 - DNA, 19 bp, Homo sapiens
ctttacaatgttcatccca

SEQ ID NO: 3451225 - DNA, 17 bp, Homo sapiens
ctttaccctctttgctg

SEQ ID NO: 3451226 - DNA, 19 bp, Homo sapiens
ctttactcctcacacttac

SEQ ID NO: 3451227 - DNA, 14 bp, Homo sapiens
ctttactgtttgtt

SEQ ID NO: 3451228 - DNA, 12 bp, Homo sapiens
ctttagaaaata

SEQ ID NO: 3451229 - DNA, 18 bp, Homo sapiens
ctttagaaaatataagta

SEQ ID NO: 3451230 - DNA, 18 bp, Homo sapiens
ctttagaatttttaccca

SEQ ID NO: 3451231 - DNA, 23 bp, Homo sapiens
ctttagatggtggcacattcctt

SEQ ID NO: 3451232 - DNA, 14 bp, Homo sapiens
ctttagccagaatc

SEQ ID NO: 3451233 - DNA, 14 bp, Homo sapiens
ctttagcgcccagt

SEQ ID NO: 3451234 - DNA, 15 bp, Homo sapiens
ctttagcgcccagtt

SEQ ID NO: 3451235 - DNA, 22 bp, Homo sapiens
ctttagcgctcaataggaccag

SEQ ID NO: 3451236 - DNA, 16 bp, Homo sapiens
ctttaggtctttgtaa

SEQ ID NO: 3451237 - DNA, 14 bp, Homo sapiens
ctttagtggcttca

SEQ ID NO: 3451238 - DNA, 22 bp, Homo sapiens
ctttatgaatgaaaaaacagtc

SEQ ID NO: 3451239 - DNA, 15 bp, Homo sapiens
ctttatgctgaaaca

SEQ ID NO: 3451240 - DNA, 15 bp, Homo sapiens
ctttattaatcacta

SEQ ID NO: 3451241 - DNA, 14 bp, Homo sapiens
ctttattaccccct

SEQ ID NO: 3451242 - DNA, 20 bp, Homo sapiens
ctttattaccccctccttca

SEQ ID NO: 3451243 - DNA, 18 bp, Homo sapiens
ctttattgaacttgaaat

SEQ ID NO: 3451244 - DNA, 13 bp, Homo sapiens
ctttattgagaaa

SEQ ID NO: 3451245 - DNA, 19 bp, Homo sapiens
ctttattgtgtttgtcatt

SEQ ID NO: 3451246 - DNA, 17 bp, Homo sapiens
ctttattttactagaaa

SEQ ID NO: 3451247 - DNA, 19 bp, Homo sapiens
ctttattttactagaaatg

SEQ ID NO: 3451248 - DNA, 21 bp, Homo sapiens
ctttattttctataatttaaa

SEQ ID NO: 3451249 - DNA, 20 bp, Homo sapiens
ctttcaagcagtcgtgcctg

SEQ ID NO: 3451250 - DNA, 23 bp, Homo sapiens
ctttcaagcagtcgtgcctgtgt

SEQ ID NO: 3451251 - DNA, 21 bp, Homo sapiens
ctttcaattccgtagccagct

SEQ ID NO: 3451252 - DNA, 24 bp, Homo sapiens
ctttcacattgtttgctgctattg

SEQ ID NO: 3451253 - DNA, 16 bp, Homo sapiens
ctttcaccaccccctc

SEQ ID NO: 3451254 - DNA, 21 bp, Homo sapiens
ctttcaccccagggcctgagc

SEQ ID NO: 3451255 - DNA, 19 bp, Homo sapiens
ctttcagacttgccatgtg

SEQ ID NO: 3451256 - DNA, 12 bp, Homo sapiens
ctttcaggtact

SEQ ID NO: 3451257 - DNA, 16 bp, Homo sapiens
ctttcatgctacagaa

SEQ ID NO: 3451258 - DNA, 17 bp, Homo sapiens
ctttcatgtaaactgtg

SEQ ID NO: 3451259 - DNA, 19 bp, Homo sapiens
ctttcatgtaaactgtgca

SEQ ID NO: 3451260 - DNA, 10 bp, Homo sapiens
ctttcatttt

SEQ ID NO: 3451261 - DNA, 15 bp, Homo sapiens
ctttcatttttgata

SEQ ID NO: 3451262 - DNA, 19 bp, Homo sapiens
ctttcatttttttccaggc

SEQ ID NO: 3451263 - DNA, 22 bp, Homo sapiens
ctttccaaaccttatctccaca

SEQ ID NO: 3451264 - DNA, 21 bp, Homo sapiens
ctttccaaaggccatggagag

SEQ ID NO: 3451265 - DNA, 18 bp, Homo sapiens
ctttccaaatgcccagct

SEQ ID NO: 3451266 - DNA, 22 bp, Homo sapiens
ctttcccaaaattagggagctc

SEQ ID NO: 3451267 - DNA, 18 bp, Homo sapiens
ctttcccactttcttcta

SEQ ID NO: 3451268 - DNA, 21 bp, Homo sapiens
ctttccgtcaacgttgtactg

SEQ ID NO: 3451269 - DNA, 20 bp, Homo sapiens
ctttcctaaggctgcaaggt

SEQ ID NO: 3451270 - DNA, 21 bp, Homo sapiens
ctttcctagatggcagtcact

SEQ ID NO: 3451271 - DNA, 16 bp, Homo sapiens
ctttcctccttccatg

SEQ ID NO: 3451272 - DNA, 14 bp, Homo sapiens
ctttcctcctttcc

SEQ ID NO: 3451273 - DNA, 17 bp, Homo sapiens
ctttcctctctatattt

SEQ ID NO: 3451274 - DNA, 15 bp, Homo sapiens
ctttccttggcttta

SEQ ID NO: 3451275 - DNA, 19 bp, Homo sapiens
ctttcctttaactcccttt

SEQ ID NO: 3451276 - DNA, 21 bp, Homo sapiens
ctttccttttcgcctttcctc

SEQ ID NO: 3451277 - DNA, 17 bp, Homo sapiens
ctttccttttttaaaaa

SEQ ID NO: 3451278 - DNA, 20 bp, Homo sapiens
ctttcgaggcctgaagccag

SEQ ID NO: 3451279 - DNA, 20 bp, Homo sapiens
ctttcggaatttttaaaata

SEQ ID NO: 3451280 - DNA, 22 bp, Homo sapiens
ctttcggaatttttaaaataaa

SEQ ID NO: 3451281 - DNA, 18 bp, Homo sapiens
ctttcgtccacagcttcc

SEQ ID NO: 3451282 - DNA, 18 bp, Homo sapiens
ctttctacaatgtgaact

SEQ ID NO: 3451283 - DNA, 16 bp, Homo sapiens
ctttctacccagcgag

SEQ ID NO: 3451284 - DNA, 14 bp, Homo sapiens
ctttctcccctgcc

SEQ ID NO: 3451285 - DNA, 22 bp, Homo sapiens
ctttctcccctgcccccaggac

SEQ ID NO: 3451286 - DNA, 24 bp, Homo sapiens
ctttctcccctgcccccaggactg

SEQ ID NO: 3451287 - DNA, 17 bp, Homo sapiens
ctttctcttttctaaaa

SEQ ID NO: 3451288 - DNA, 17 bp, Homo sapiens
ctttctgagtgccttct

SEQ ID NO: 3451289 - DNA, 19 bp, Homo sapiens
ctttctgagtgccttctgt

SEQ ID NO: 3451290 - DNA, 20 bp, Homo sapiens
ctttctgagtgccttctgtg

SEQ ID NO: 3451291 - DNA, 21 bp, Homo sapiens
ctttctgagtgccttctgtgg

SEQ ID NO: 3451292 - DNA, 21 bp, Homo sapiens
ctttctgataactagatggtg

SEQ ID NO: 3451293 - DNA, 22 bp, Homo sapiens
ctttctggtgttttatttccta

SEQ ID NO: 3451294 - DNA, 18 bp, Homo sapiens
ctttctgtatatactttt

SEQ ID NO: 3451295 - DNA, 18 bp, Homo sapiens
ctttctgtcccttctgtc

SEQ ID NO: 3451296 - DNA, 11 bp, Homo sapiens
ctttcttagaa

SEQ ID NO: 3451297 - DNA, 17 bp, Homo sapiens
ctttcttagaaatttat

SEQ ID NO: 3451298 - DNA, 22 bp, Homo sapiens
ctttcttatcctagcacatgct

SEQ ID NO: 3451299 - DNA, 18 bp, Homo sapiens
ctttctttgggaatattt

SEQ ID NO: 3451300 - DNA, 20 bp, Homo sapiens
ctttctttttgaatctctca

SEQ ID NO: 3451301 - DNA, 16 bp, Homo sapiens
ctttgaagtcatacca

SEQ ID NO: 3451302 - DNA, 17 bp, Homo sapiens
ctttgaataaagaatac

SEQ ID NO: 3451303 - DNA, 21 bp, Homo sapiens
ctttgaataaagaatacttga

SEQ ID NO: 3451304 - DNA, 13 bp, Homo sapiens
ctttgaatgttaa

SEQ ID NO: 3451305 - DNA, 17 bp, Homo sapiens
ctttgagataatacatt

SEQ ID NO: 3451306 - DNA, 12 bp, Homo sapiens
ctttgagcctga

SEQ ID NO: 3451307 - DNA, 12 bp, Homo sapiens
ctttgaggataa

SEQ ID NO: 3451308 - DNA, 21 bp, Homo sapiens
ctttgatgattaattcacctt

SEQ ID NO: 3451309 - DNA, 20 bp, Homo sapiens
ctttgattaaagactccagt

SEQ ID NO: 3451310 - DNA, 19 bp, Homo sapiens
ctttgattagttttcttgt

SEQ ID NO: 3451311 - DNA, 14 bp, Homo sapiens
ctttgattctcctt

SEQ ID NO: 3451312 - DNA, 18 bp, Homo sapiens
ctttgattctccttcagc

SEQ ID NO: 3451313 - DNA, 20 bp, Homo sapiens
ctttgattctccttcagccc

SEQ ID NO: 3451314 - DNA, 19 bp, Homo sapiens
ctttgcaaagtattgtaaa

SEQ ID NO: 3451315 - DNA, 21 bp, Homo sapiens
ctttgcaaagtattgtaaatt

SEQ ID NO: 3451316 - DNA, 14 bp, Homo sapiens
ctttgcagacaggc

SEQ ID NO: 3451317 - DNA, 19 bp, Homo sapiens
ctttgcatagcagctgcta

SEQ ID NO: 3451318 - DNA, 16 bp, Homo sapiens
ctttgcatttggaatt

SEQ ID NO: 3451319 - DNA, 14 bp, Homo sapiens
ctttgcattttgga

SEQ ID NO: 3451320 - DNA, 23 bp, Homo sapiens
ctttgctgtcccatagtccctgc

SEQ ID NO: 3451321 - DNA, 13 bp, Homo sapiens
ctttgctttctgc

SEQ ID NO: 3451322 - DNA, 14 bp, Homo sapiens
ctttgctttctgct

SEQ ID NO: 3451323 - DNA, 11 bp, Homo sapiens
ctttgctttgg

SEQ ID NO: 3451324 - DNA, 21 bp, Homo sapiens
ctttggaaaatgcattgtatc

SEQ ID NO: 3451325 - DNA, 23 bp, Homo sapiens
ctttggagatcaaggagaggagg

SEQ ID NO: 3451326 - DNA, 14 bp, Homo sapiens
ctttggaggcccct

SEQ ID NO: 3451327 - DNA, 15 bp, Homo sapiens
ctttggatttgacat

SEQ ID NO: 3451328 - DNA, 13 bp, Homo sapiens
ctttggcctgagt

SEQ ID NO: 3451329 - DNA, 19 bp, Homo sapiens
ctttggctattagagatca

SEQ ID NO: 3451330 - DNA, 14 bp, Homo sapiens
ctttgggaagcctt

SEQ ID NO: 3451331 - DNA, 18 bp, Homo sapiens
ctttgggaatatttgaat

SEQ ID NO: 3451332 - DNA, 20 bp, Homo sapiens
ctttgggaatatttgaatct

SEQ ID NO: 3451333 - DNA, 13 bp, Homo sapiens
ctttgggaatgtt

SEQ ID NO: 3451334 - DNA, 13 bp, Homo sapiens
ctttgggccagac

SEQ ID NO: 3451335 - DNA, 19 bp, Homo sapiens
ctttggtgagaacctgggt

SEQ ID NO: 3451336 - DNA, 17 bp, Homo sapiens
ctttggtggagataaag

SEQ ID NO: 3451337 - DNA, 15 bp, Homo sapiens
ctttggttcctgtga

SEQ ID NO: 3451338 - DNA, 17 bp, Homo sapiens
ctttggtttggcctcca

SEQ ID NO: 3451339 - DNA, 12 bp, Homo sapiens
ctttgtaaatag

SEQ ID NO: 3451340 - DNA, 15 bp, Homo sapiens
ctttgtacagcccag

SEQ ID NO: 3451341 - DNA, 17 bp, Homo sapiens
ctttgtacagcccagag

SEQ ID NO: 3451342 - DNA, 18 bp, Homo sapiens
ctttgtagcactcaggct

SEQ ID NO: 3451343 - DNA, 21 bp, Homo sapiens
ctttgtagcactcaggctctc

SEQ ID NO: 3451344 - DNA, 15 bp, Homo sapiens
ctttgtctaaaacaa

SEQ ID NO: 3451345 - DNA, 19 bp, Homo sapiens
ctttgtctaaaacaataaa

SEQ ID NO: 3451346 - DNA, 13 bp, Homo sapiens
ctttgtgaatatt

SEQ ID NO: 3451347 - DNA, 16 bp, Homo sapiens
ctttgtggccaaggag

SEQ ID NO: 3451348 - DNA, 21 bp, Homo sapiens
ctttgtggccaaggagctgct

SEQ ID NO: 3451349 - DNA, 22 bp, Homo sapiens
ctttgtggccaaggagctgcta

SEQ ID NO: 3451350 - DNA, 16 bp, Homo sapiens
ctttgttaaggtcctg

SEQ ID NO: 3451351 - DNA, 19 bp, Homo sapiens
ctttgttttgcacactttg

SEQ ID NO: 3451352 - DNA, 14 bp, Homo sapiens
ctttgtttttattt

SEQ ID NO: 3451353 - DNA, 18 bp, Homo sapiens
ctttgttttttgttggag

SEQ ID NO: 3451354 - DNA, 22 bp, Homo sapiens
cttttaacagagtctgaaccta

SEQ ID NO: 3451355 - DNA, 14 bp, Homo sapiens
cttttacatactgc

SEQ ID NO: 3451356 - DNA, 15 bp, Homo sapiens
cttttacgagtgcta

SEQ ID NO: 3451357 - DNA, 20 bp, Homo sapiens
cttttactgaagcctttctt

SEQ ID NO: 3451358 - DNA, 15 bp, Homo sapiens
cttttagaaatactg

SEQ ID NO: 3451359 - DNA, 19 bp, Homo sapiens
cttttagaaatactgcaag

SEQ ID NO: 3451360 - DNA, 18 bp, Homo sapiens
cttttattgacacagaaa

SEQ ID NO: 3451361 - DNA, 23 bp, Homo sapiens
cttttattttggaactatgaaga

SEQ ID NO: 3451362 - DNA, 17 bp, Homo sapiens
cttttcccatttgtaat

SEQ ID NO: 3451363 - DNA, 19 bp, Homo sapiens
cttttcccatttgtaattt

SEQ ID NO: 3451364 - DNA, 17 bp, Homo sapiens
cttttcccctttcctgt

SEQ ID NO: 3451365 - DNA, 18 bp, Homo sapiens
cttttcccctttcctgtc

SEQ ID NO: 3451366 - DNA, 20 bp, Homo sapiens
cttttcccctttcctgtccc

SEQ ID NO: 3451367 - DNA, 21 bp, Homo sapiens
cttttcccctttcctgtccca

SEQ ID NO: 3451368 - DNA, 12 bp, Homo sapiens
cttttcctgaag

SEQ ID NO: 3451369 - DNA, 19 bp, Homo sapiens
cttttcctgataaagcaca

SEQ ID NO: 3451370 - DNA, 22 bp, Homo sapiens
cttttcctgataaagcacagct

SEQ ID NO: 3451371 - DNA, 15 bp, Homo sapiens
cttttccttggcatt

SEQ ID NO: 3451372 - DNA, 18 bp, Homo sapiens
cttttctgtctctctctt

SEQ ID NO: 3451373 - DNA, 14 bp, Homo sapiens
cttttcttctatgt

SEQ ID NO: 3451374 - DNA, 14 bp, Homo sapiens
cttttctttaaaga

SEQ ID NO: 3451375 - DNA, 15 bp, Homo sapiens
cttttctttgttata

SEQ ID NO: 3451376 - DNA, 21 bp, Homo sapiens
cttttgaataaaaactttgct

SEQ ID NO: 3451377 - DNA, 14 bp, Homo sapiens
cttttgcagaagag

SEQ ID NO: 3451378 - DNA, 14 bp, Homo sapiens
cttttgctttattc

SEQ ID NO: 3451379 - DNA, 15 bp, Homo sapiens
cttttgggggagggc

SEQ ID NO: 3451380 - DNA, 19 bp, Homo sapiens
cttttggtgagaaggtgtt

SEQ ID NO: 3451381 - DNA, 19 bp, Homo sapiens
cttttgtaaagtgaagaat

SEQ ID NO: 3451382 - DNA, 16 bp, Homo sapiens
cttttgtatgtaaatg

SEQ ID NO: 3451383 - DNA, 23 bp, Homo sapiens
cttttgtatgtaaatgtgcattc

SEQ ID NO: 3451384 - DNA, 16 bp, Homo sapiens
cttttgtctaattaaa

SEQ ID NO: 3451385 - DNA, 18 bp, Homo sapiens
cttttgtctatgggactc

SEQ ID NO: 3451386 - DNA, 21 bp, Homo sapiens
cttttgtgaagaactatttta

SEQ ID NO: 3451387 - DNA, 12 bp, Homo sapiens
ctttttaaaaaa

SEQ ID NO: 3451388 - DNA, 14 bp, Homo sapiens
ctttttaataaaaa

SEQ ID NO: 3451389 - DNA, 15 bp, Homo sapiens
ctttttaataaaaag

SEQ ID NO: 3451390 - DNA, 13 bp, Homo sapiens
ctttttacacttt

SEQ ID NO: 3451391 - DNA, 15 bp, Homo sapiens
ctttttacactttat

SEQ ID NO: 3451392 - DNA, 16 bp, Homo sapiens
ctttttagtaatttct

SEQ ID NO: 3451393 - DNA, 17 bp, Homo sapiens
ctttttattgaatctat

SEQ ID NO: 3451394 - DNA, 14 bp, Homo sapiens
ctttttattgcctt

SEQ ID NO: 3451395 - DNA, 23 bp, Homo sapiens
ctttttattgccttctcaccagc

SEQ ID NO: 3451396 - DNA, 13 bp, Homo sapiens
ctttttatttcta

SEQ ID NO: 3451397 - DNA, 18 bp, Homo sapiens
ctttttcaggctcgccaa

SEQ ID NO: 3451398 - DNA, 23 bp, Homo sapiens
ctttttccaacttggctgcagga

SEQ ID NO: 3451399 - DNA, 22 bp, Homo sapiens
ctttttgaagtgtaggcagaca

SEQ ID NO: 3451400 - DNA, 23 bp, Homo sapiens
ctttttgaagtgtaggcagacac

SEQ ID NO: 3451401 - DNA, 17 bp, Homo sapiens
ctttttgtttgtttgtt

SEQ ID NO: 3451402 - DNA, 13 bp, Homo sapiens
cttttttctgcct

SEQ ID NO: 3451403 - DNA, 13 bp, Homo sapiens
cttttttgttttg

SEQ ID NO: 3451404 - DNA, 22 bp, Homo sapiens
cttttttgttttttcaaaatag

SEQ ID NO: 3451405 - DNA, 11 bp, Homo sapiens
ctttttttccc

SEQ ID NO: 3451406 - DNA, 14 bp, Homo sapiens
cttttttttcttta

SEQ ID NO: 3451407 - DNA, 15 bp, Homo sapiens
cttttttttgtatgt

SEQ ID NO: 3451408 - DNA, 18 bp, Homo sapiens
cttttttttttttttggt

SEQ ID NO: 3451409 - DNA, 19 bp, Homo sapiens
cttttttttttttttggta

SEQ ID NO: 3451410 - DNA, 21 bp, Homo sapiens
gaaaaaaaccacacaaagaca

SEQ ID NO: 3451411 - DNA, 17 bp, Homo sapiens
gaaaaactgagacaggc

SEQ ID NO: 3451412 - DNA, 12 bp, Homo sapiens
gaaaaacttgtg

SEQ ID NO: 3451413 - DNA, 16 bp, Homo sapiens
gaaaaatatgtaccaa

SEQ ID NO: 3451414 - DNA, 18 bp, Homo sapiens
gaaaaatatttattcatt

SEQ ID NO: 3451415 - DNA, 16 bp, Homo sapiens
gaaaaatgagcctggc

SEQ ID NO: 3451416 - DNA, 16 bp, Homo sapiens
gaaaaatggagcaaag

SEQ ID NO: 3451417 - DNA, 13 bp, Homo sapiens
gaaaaatgtgtaa

SEQ ID NO: 3451418 - DNA, 12 bp, Homo sapiens
gaaaacaaggaa

SEQ ID NO: 3451419 - DNA, 14 bp, Homo sapiens
gaaaacactgtgca

SEQ ID NO: 3451420 - DNA, 21 bp, Homo sapiens
gaaaacactgtgcacatctgt

SEQ ID NO: 3451421 - DNA, 13 bp, Homo sapiens
gaaaacagaccta

SEQ ID NO: 3451422 - DNA, 21 bp, Homo sapiens
gaaaacagacctaatgctcct

SEQ ID NO: 3451423 - DNA, 16 bp, Homo sapiens
gaaaacgaagctcatt

SEQ ID NO: 3451424 - DNA, 14 bp, Homo sapiens
gaaaacggagctga

SEQ ID NO: 3451425 - DNA, 23 bp, Homo sapiens
gaaaacttatgacctcttccttt

SEQ ID NO: 3451426 - DNA, 14 bp, Homo sapiens
gaaaagaaagaaga

SEQ ID NO: 3451427 - DNA, 23 bp, Homo sapiens
gaaaagatggagtttacaaagat

SEQ ID NO: 3451428 - DNA, 22 bp, Homo sapiens
gaaaagctagtgtacctcctct

SEQ ID NO: 3451429 - DNA, 17 bp, Homo sapiens
gaaaaggagaggaaact

SEQ ID NO: 3451430 - DNA, 20 bp, Homo sapiens
gaaaagtgcatatttatcca

SEQ ID NO: 3451431 - DNA, 19 bp, Homo sapiens
gaaaataacgataaaagac

SEQ ID NO: 3451432 - DNA, 17 bp, Homo sapiens
gaaaataggcaggaagc

SEQ ID NO: 3451433 - DNA, 18 bp, Homo sapiens
gaaaatataagtggtgct

SEQ ID NO: 3451434 - DNA, 20 bp, Homo sapiens
gaaaatatatgtatttttat

SEQ ID NO: 3451435 - DNA, 21 bp, Homo sapiens
gaaaatattttgtctaaaatg

SEQ ID NO: 3451436 - DNA, 14 bp, Homo sapiens
gaaaatcagcctgc

SEQ ID NO: 3451437 - DNA, 16 bp, Homo sapiens
gaaaatcagcctgctc

SEQ ID NO: 3451438 - DNA, 14 bp, Homo sapiens
gaaaatcatattgc

SEQ ID NO: 3451439 - DNA, 15 bp, Homo sapiens
gaaaatcatcaagaa

SEQ ID NO: 3451440 - DNA, 20 bp, Homo sapiens
gaaaatcatcaagaagggct

SEQ ID NO: 3451441 - DNA, 23 bp, Homo sapiens
gaaaatcatcaagaagggctgca

SEQ ID NO: 3451442 - DNA, 20 bp, Homo sapiens
gaaaatcttataatttaaaa

SEQ ID NO: 3451443 - DNA, 23 bp, Homo sapiens
gaaaatgatgtgtacccaaacgt

SEQ ID NO: 3451444 - DNA, 22 bp, Homo sapiens
gaaaatgcagcagggatgccct

SEQ ID NO: 3451445 - DNA, 16 bp, Homo sapiens
gaaaatgttatttaac

SEQ ID NO: 3451446 - DNA, 17 bp, Homo sapiens
gaaaatgttgagaatcc

SEQ ID NO: 3451447 - DNA, 17 bp, Homo sapiens
gaaaatttgttattttg

SEQ ID NO: 3451448 - DNA, 15 bp, Homo sapiens
gaaacaacagcttta

SEQ ID NO: 3451449 - DNA, 17 bp, Homo sapiens
gaaacaactctttgaga

SEQ ID NO: 3451450 - DNA, 14 bp, Homo sapiens
gaaacaacttggaa

SEQ ID NO: 3451451 - DNA, 19 bp, Homo sapiens
gaaacacactgaggcaggg

SEQ ID NO: 3451452 - DNA, 20 bp, Homo sapiens
gaaacacactgaggcaggga

SEQ ID NO: 3451453 - DNA, 23 bp, Homo sapiens
gaaacacactgaggcagggaagt

SEQ ID NO: 3451454 - DNA, 22 bp, Homo sapiens
gaaacagaaaaatatgtaccaa

SEQ ID NO: 3451455 - DNA, 22 bp, Homo sapiens
gaaacaggttgggatgggatag

SEQ ID NO: 3451456 - DNA, 20 bp, Homo sapiens
gaaacatcagttactctgaa

SEQ ID NO: 3451457 - DNA, 23 bp, Homo sapiens
gaaacatcagttactctgaaggg

SEQ ID NO: 3451458 - DNA, 15 bp, Homo sapiens
gaaaccacagctgct

SEQ ID NO: 3451459 - DNA, 15 bp, Homo sapiens
gaaacccaccagcct

SEQ ID NO: 3451460 - DNA, 23 bp, Homo sapiens
gaaacctcattgttctgtacaaa

SEQ ID NO: 3451461 - DNA, 16 bp, Homo sapiens
gaaacctgggattcag

SEQ ID NO: 3451462 - DNA, 17 bp, Homo sapiens
gaaaccttattgtacct

SEQ ID NO: 3451463 - DNA, 19 bp, Homo sapiens
gaaaccttattgtacctct

SEQ ID NO: 3451464 - DNA, 18 bp, Homo sapiens
gaaacgctacctctctgt

SEQ ID NO: 3451465 - DNA, 23 bp, Homo sapiens
gaaacgctacctctctgtccctt

SEQ ID NO: 3451466 - DNA, 20 bp, Homo sapiens
gaaactaattgactttagaa

SEQ ID NO: 3451467 - DNA, 20 bp, Homo sapiens
gaaactactgcctttagaaa

SEQ ID NO: 3451468 - DNA, 14 bp, Homo sapiens
gaaactcatctcat

SEQ ID NO: 3451469 - DNA, 15 bp, Homo sapiens
gaaactcatctcatt

SEQ ID NO: 3451470 - DNA, 20 bp, Homo sapiens
gaaactccaccttgcgggga

SEQ ID NO: 3451471 - DNA, 17 bp, Homo sapiens
gaaactttgctttgggt

SEQ ID NO: 3451472 - DNA, 22 bp, Homo sapiens
gaaagaaacccgacagagggaa

SEQ ID NO: 3451473 - DNA, 23 bp, Homo sapiens
gaaagaaagttgcacggctgctg

SEQ ID NO: 3451474 - DNA, 14 bp, Homo sapiens
gaaagacatctttc

SEQ ID NO: 3451475 - DNA, 15 bp, Homo sapiens
gaaagagaaggtggg

SEQ ID NO: 3451476 - DNA, 22 bp, Homo sapiens
gaaagagcacttaagagaatat

SEQ ID NO: 3451477 - DNA, 12 bp, Homo sapiens
gaaagcaacttt

SEQ ID NO: 3451478 - DNA, 14 bp, Homo sapiens
gaaagcatttgaat

SEQ ID NO: 3451479 - DNA, 15 bp, Homo sapiens
gaaagcatttgaatg

SEQ ID NO: 3451480 - DNA, 16 bp, Homo sapiens
gaaagcatttgaatgc

SEQ ID NO: 3451481 - DNA, 21 bp, Homo sapiens
gaaagccctgagctttctgct

SEQ ID NO: 3451482 - DNA, 15 bp, Homo sapiens
gaaagcggctgcctc

SEQ ID NO: 3451483 - DNA, 17 bp, Homo sapiens
gaaaggaaaagattcct

SEQ ID NO: 3451484 - DNA, 19 bp, Homo sapiens
gaaaggaaaagattcctgt

SEQ ID NO: 3451485 - DNA, 16 bp, Homo sapiens
gaaaggatgagcagag

SEQ ID NO: 3451486 - DNA, 17 bp, Homo sapiens
gaaaggatgagcagagc

SEQ ID NO: 3451487 - DNA, 12 bp, Homo sapiens
gaaaggccagct

SEQ ID NO: 3451488 - DNA, 14 bp, Homo sapiens
gaaaggccagctgg

SEQ ID NO: 3451489 - DNA, 16 bp, Homo sapiens
gaaagggacaatgata

SEQ ID NO: 3451490 - DNA, 19 bp, Homo sapiens
gaaagggacttggaagctc

SEQ ID NO: 3451491 - DNA, 18 bp, Homo sapiens
gaaaggggacaaggaagg

SEQ ID NO: 3451492 - DNA, 13 bp, Homo sapiens
gaaaggggagccc

SEQ ID NO: 3451493 - DNA, 16 bp, Homo sapiens
gaaaggggagcccact

SEQ ID NO: 3451494 - DNA, 22 bp, Homo sapiens
gaaaggggatggagtgagccca

SEQ ID NO: 3451495 - DNA, 18 bp, Homo sapiens
gaaaggtgccatggaaga

SEQ ID NO: 3451496 - DNA, 21 bp, Homo sapiens
gaaagtacttctccaccctgc

SEQ ID NO: 3451497 - DNA, 16 bp, Homo sapiens
gaaagtgaaagtccag

SEQ ID NO: 3451498 - DNA, 18 bp, Homo sapiens
gaaagttgcacggctgct

SEQ ID NO: 3451499 - DNA, 20 bp, Homo sapiens
gaaagttgcacggctgctga

SEQ ID NO: 3451500 - DNA, 13 bp, Homo sapiens
gaaagttgccatt

SEQ ID NO: 3451501 - DNA, 18 bp, Homo sapiens
gaaagttgtacatgaaat

SEQ ID NO: 3451502 - DNA, 18 bp, Homo sapiens
gaaataaaaggaagccaa

SEQ ID NO: 3451503 - DNA, 19 bp, Homo sapiens
gaaataaaaggaagccaaa

SEQ ID NO: 3451504 - DNA, 12 bp, Homo sapiens
gaaataaaatta

SEQ ID NO: 3451505 - DNA, 19 bp, Homo sapiens
gaaataaattctgattctt

SEQ ID NO: 3451506 - DNA, 18 bp, Homo sapiens
gaaataacagagagaatg

SEQ ID NO: 3451507 - DNA, 15 bp, Homo sapiens
gaaataatatgcatt

SEQ ID NO: 3451508 - DNA, 19 bp, Homo sapiens
gaaataatgtacatctggc

SEQ ID NO: 3451509 - DNA, 17 bp, Homo sapiens
gaaatacagattttgat

SEQ ID NO: 3451510 - DNA, 18 bp, Homo sapiens
gaaatagtacttacaaat

SEQ ID NO: 3451511 - DNA, 18 bp, Homo sapiens
gaaatagttcaaagccaa

SEQ ID NO: 3451512 - DNA, 12 bp, Homo sapiens
gaaatatcattt

SEQ ID NO: 3451513 - DNA, 14 bp, Homo sapiens
gaaatatcatttat

SEQ ID NO: 3451514 - DNA, 14 bp, Homo sapiens
gaaatattgctgta

SEQ ID NO: 3451515 - DNA, 14 bp, Homo sapiens
gaaatccaatcaga

SEQ ID NO: 3451516 - DNA, 20 bp, Homo sapiens
gaaatctgtcaagagtagtt

SEQ ID NO: 3451517 - DNA, 13 bp, Homo sapiens
gaaatgctgctgg

SEQ ID NO: 3451518 - DNA, 15 bp, Homo sapiens
gaaatgctgctggcc

SEQ ID NO: 3451519 - DNA, 14 bp, Homo sapiens
gaaatggccttccc

SEQ ID NO: 3451520 - DNA, 19 bp, Homo sapiens
gaaatgggacttaactcct

SEQ ID NO: 3451521 - DNA, 15 bp, Homo sapiens
gaaatggtggaactg

SEQ ID NO: 3451522 - DNA, 17 bp, Homo sapiens
gaaatggttgtattaga

SEQ ID NO: 3451523 - DNA, 12 bp, Homo sapiens
gaaatgttcttt

SEQ ID NO: 3451524 - DNA, 13 bp, Homo sapiens
gaaatgttcttta

SEQ ID NO: 3451525 - DNA, 17 bp, Homo sapiens
gaaattaagaaggcaaa

SEQ ID NO: 3451526 - DNA, 18 bp, Homo sapiens
gaaattaagaaggcaaaa

SEQ ID NO: 3451527 - DNA, 15 bp, Homo sapiens
gaaattctcctggag

SEQ ID NO: 3451528 - DNA, 16 bp, Homo sapiens
gaaattctgaatttgc

SEQ ID NO: 3451529 - DNA, 19 bp, Homo sapiens
gaaattctgaatttgcaaa

SEQ ID NO: 3451530 - DNA, 21 bp, Homo sapiens
gaaattctgaatttgcaaagt

SEQ ID NO: 3451531 - DNA, 18 bp, Homo sapiens
gaaattctttatacattc

SEQ ID NO: 3451532 - DNA, 16 bp, Homo sapiens
gaaattgtattacaaa

SEQ ID NO: 3451533 - DNA, 18 bp, Homo sapiens
gaaattgtattacaaatc

SEQ ID NO: 3451534 - DNA, 16 bp, Homo sapiens
gaaatttaaaagcaga

SEQ ID NO: 3451535 - DNA, 21 bp, Homo sapiens
gaaatttaattcatgtttctt

SEQ ID NO: 3451536 - DNA, 17 bp, Homo sapiens
gaaatttgataatgaca

SEQ ID NO: 3451537 - DNA, 18 bp, Homo sapiens
gaaatttggatcttcttt

SEQ ID NO: 3451538 - DNA, 13 bp, Homo sapiens
gaaattttgctat

SEQ ID NO: 3451539 - DNA, 14 bp, Homo sapiens
gaacaaagcagcca

SEQ ID NO: 3451540 - DNA, 15 bp, Homo sapiens
gaacaaagcagccac

SEQ ID NO: 3451541 - DNA, 16 bp, Homo sapiens
gaacaagcaaacccag

SEQ ID NO: 3451542 - DNA, 17 bp, Homo sapiens
gaacacaaactgtaaat

SEQ ID NO: 3451543 - DNA, 14 bp, Homo sapiens
gaacacggccacat

SEQ ID NO: 3451544 - DNA, 19 bp, Homo sapiens
gaacactagacaagccaga

SEQ ID NO: 3451545 - DNA, 16 bp, Homo sapiens
gaacagactggaagca

SEQ ID NO: 3451546 - DNA, 20 bp, Homo sapiens
gaacagactggaagcacagc

SEQ ID NO: 3451547 - DNA, 21 bp, Homo sapiens
gaacagatgtttcttttgtat

SEQ ID NO: 3451548 - DNA, 17 bp, Homo sapiens
gaacagattcacactgt

SEQ ID NO: 3451549 - DNA, 21 bp, Homo sapiens
gaacagggaaaataggcagga

SEQ ID NO: 3451550 - DNA, 22 bp, Homo sapiens
gaacagtcacgcctgaaacttt

SEQ ID NO: 3451551 - DNA, 18 bp, Homo sapiens
gaacagtgcttgccacag

SEQ ID NO: 3451552 - DNA, 22 bp, Homo sapiens
gaacatcatcaaggcactgcct

SEQ ID NO: 3451553 - DNA, 18 bp, Homo sapiens
gaacatccaaccttccca

SEQ ID NO: 3451554 - DNA, 21 bp, Homo sapiens
gaacatgatgggcctgaactc

SEQ ID NO: 3451555 - DNA, 18 bp, Homo sapiens
gaacatgcagtttgaaat

SEQ ID NO: 3451556 - DNA, 24 bp, Homo sapiens
gaacatgtcctaattcttctgtcc

SEQ ID NO: 3451557 - DNA, 10 bp, Homo sapiens
gaacattgta

SEQ ID NO: 3451558 - DNA, 16 bp, Homo sapiens
gaaccaaatctggaag

SEQ ID NO: 3451559 - DNA, 17 bp, Homo sapiens
gaaccaccacacccagc

SEQ ID NO: 3451560 - DNA, 22 bp, Homo sapiens
gaaccaccacacccagcccact

SEQ ID NO: 3451561 - DNA, 18 bp, Homo sapiens
gaaccagccggggcctta

SEQ ID NO: 3451562 - DNA, 23 bp, Homo sapiens
gaaccaggagaagggctggggcc

SEQ ID NO: 3451563 - DNA, 21 bp, Homo sapiens
gaaccatgtcagcaaaaagca

SEQ ID NO: 3451564 - DNA, 23 bp, Homo sapiens
gaaccatgtcagcaaaaagcaaa

SEQ ID NO: 3451565 - DNA, 18 bp, Homo sapiens
gaaccctcagccttgact

SEQ ID NO: 3451566 - DNA, 14 bp, Homo sapiens
gaaccctgccatgg

SEQ ID NO: 3451567 - DNA, 16 bp, Homo sapiens
gaaccctggggcctga

SEQ ID NO: 3451568 - DNA, 16 bp, Homo sapiens
gaacccttggcttgcc

SEQ ID NO: 3451569 - DNA, 17 bp, Homo sapiens
gaacccttggcttgccc

SEQ ID NO: 3451570 - DNA, 17 bp, Homo sapiens
gaaccgttttgaagcta

SEQ ID NO: 3451571 - DNA, 16 bp, Homo sapiens
gaacctcacgcacctc

SEQ ID NO: 3451572 - DNA, 22 bp, Homo sapiens
gaacctccccagcctgcgcctg

SEQ ID NO: 3451573 - DNA, 13 bp, Homo sapiens
gaacctcctctgt

SEQ ID NO: 3451574 - DNA, 22 bp, Homo sapiens
gaacctcgagtactgtgggcaa

SEQ ID NO: 3451575 - DNA, 16 bp, Homo sapiens
ctgaaacagctgcctt

SEQ ID NO: 3451576 - DNA, 17 bp, Homo sapiens
ctgaaacagctgcctta

SEQ ID NO: 3451577 - DNA, 22 bp, Homo sapiens
ctgaaacagctgccttagcttc

SEQ ID NO: 3451578 - DNA, 23 bp, Homo sapiens
ctgaaacagctgccttagcttca

SEQ ID NO: 3451579 - DNA, 16 bp, Homo sapiens
ctgaaaccctggacca

SEQ ID NO: 3451580 - DNA, 12 bp, Homo sapiens
ctgaaactatat

SEQ ID NO: 3451581 - DNA, 14 bp, Homo sapiens
ctgaaactttgagg

SEQ ID NO: 3451582 - DNA, 15 bp, Homo sapiens
ctgaaagccctgagc

SEQ ID NO: 3451583 - DNA, 23 bp, Homo sapiens
ctgaaagccctgagctttctgct

SEQ ID NO: 3451584 - DNA, 15 bp, Homo sapiens
ctgaaagcggctgcc

SEQ ID NO: 3451585 - DNA, 19 bp, Homo sapiens
ctgaaagcggctgcctcca

SEQ ID NO: 3451586 - DNA, 17 bp, Homo sapiens
ctgaaagtgacagagac

SEQ ID NO: 3451587 - DNA, 22 bp, Homo sapiens
ctgaaatatcccgggggtgggg

SEQ ID NO: 3451588 - DNA, 16 bp, Homo sapiens
ctgaaattctcctgga

SEQ ID NO: 3451589 - DNA, 21 bp, Homo sapiens
ctgaacaataggctgttccca

SEQ ID NO: 3451590 - DNA, 18 bp, Homo sapiens
ctgaacattagttgcact

SEQ ID NO: 3451591 - DNA, 16 bp, Homo sapiens
ctgaacccctccctcc

SEQ ID NO: 3451592 - DNA, 14 bp, Homo sapiens
ctgaactttgggaa

SEQ ID NO: 3451593 - DNA, 13 bp, Homo sapiens
ctgaagaaagtgt

SEQ ID NO: 3451594 - DNA, 18 bp, Homo sapiens
ctgaagaaatccaatcct

SEQ ID NO: 3451595 - DNA, 14 bp, Homo sapiens
ctgaagaaccagtc

SEQ ID NO: 3451596 - DNA, 21 bp, Homo sapiens
ctgaagactcattcttctgta

SEQ ID NO: 3451597 - DNA, 20 bp, Homo sapiens
ctgaagcaggttcccaagct

SEQ ID NO: 3451598 - DNA, 21 bp, Homo sapiens
ctgaagcaggttcccaagctc

SEQ ID NO: 3451599 - DNA, 14 bp, Homo sapiens
ctgaagccagctgc

SEQ ID NO: 3451600 - DNA, 19 bp, Homo sapiens
ctgaagcctttcttttgga

SEQ ID NO: 3451601 - DNA, 20 bp, Homo sapiens
ctgaagctgacgaacttcca

SEQ ID NO: 3451602 - DNA, 23 bp, Homo sapiens
ctgaaggggccatgatggcaaca

SEQ ID NO: 3451603 - DNA, 19 bp, Homo sapiens
ctgaaggtaaaattgaaag

SEQ ID NO: 3451604 - DNA, 17 bp, Homo sapiens
ctgaagtcacacagtga

SEQ ID NO: 3451605 - DNA, 22 bp, Homo sapiens
ctgaatattgacaagtgtcttt

SEQ ID NO: 3451606 - DNA, 23 bp, Homo sapiens
ctgaatattgacaagtgtctttt

SEQ ID NO: 3451607 - DNA, 18 bp, Homo sapiens
ctgaatcatgagcctgct

SEQ ID NO: 3451608 - DNA, 22 bp, Homo sapiens
ctgaatgaaccttctggcctcc

SEQ ID NO: 3451609 - DNA, 21 bp, Homo sapiens
ctgaatgccgcgatgggtcag

SEQ ID NO: 3451610 - DNA, 22 bp, Homo sapiens
ctgaatgccgcgatgggtcagg

SEQ ID NO: 3451611 - DNA, 13 bp, Homo sapiens
ctgaatttgcaaa

SEQ ID NO: 3451612 - DNA, 14 bp, Homo sapiens
ctgaatttgcaaag

SEQ ID NO: 3451613 - DNA, 19 bp, Homo sapiens
ctgaatttgcaaagtactg

SEQ ID NO: 3451614 - DNA, 20 bp, Homo sapiens
ctgaatttgcaaagtactgt

SEQ ID NO: 3451615 - DNA, 22 bp, Homo sapiens
ctgaatttgcaaagtactgtaa

SEQ ID NO: 3451616 - DNA, 13 bp, Homo sapiens
ctgacaaggccag

SEQ ID NO: 3451617 - DNA, 13 bp, Homo sapiens
ctgacacacagct

SEQ ID NO: 3451618 - DNA, 17 bp, Homo sapiens
ctgacacacagctctgt

SEQ ID NO: 3451619 - DNA, 19 bp, Homo sapiens
ctgacacacagctctgtcc

SEQ ID NO: 3451620 - DNA, 20 bp, Homo sapiens
ctgacacacagctctgtcct

SEQ ID NO: 3451621 - DNA, 21 bp, Homo sapiens
ctgacacacagctctgtcctg

SEQ ID NO: 3451622 - DNA, 18 bp, Homo sapiens
ctgacacaggatgaaggc

SEQ ID NO: 3451623 - DNA, 20 bp, Homo sapiens
ctgacactaccttatcaggc

SEQ ID NO: 3451624 - DNA, 12 bp, Homo sapiens
ctgacagacaca

SEQ ID NO: 3451625 - DNA, 18 bp, Homo sapiens
ctgacagacacaggcccg

SEQ ID NO: 3451626 - DNA, 12 bp, Homo sapiens
ctgacagcctcc

SEQ ID NO: 3451627 - DNA, 14 bp, Homo sapiens
ctgacagctgctcc

SEQ ID NO: 3451628 - DNA, 23 bp, Homo sapiens
ctgacagctgctcctagagggag

SEQ ID NO: 3451629 - DNA, 18 bp, Homo sapiens
ctgacaggcaatgctggc

SEQ ID NO: 3451630 - DNA, 19 bp, Homo sapiens
ctgacaggcaatgctggct

SEQ ID NO: 3451631 - DNA, 13 bp, Homo sapiens
ctgacaggctgtg

SEQ ID NO: 3451632 - DNA, 17 bp, Homo sapiens
ctgacaggctgtgactc

SEQ ID NO: 3451633 - DNA, 19 bp, Homo sapiens
ctgacaggctgtgactctt

SEQ ID NO: 3451634 - DNA, 21 bp, Homo sapiens
ctgacagtgtgggacaggctc

SEQ ID NO: 3451635 - DNA, 16 bp, Homo sapiens
ctgacatgattccttc

SEQ ID NO: 3451636 - DNA, 17 bp, Homo sapiens
ctgacattcacctgccc

SEQ ID NO: 3451637 - DNA, 23 bp, Homo sapiens
ctgacattcacctgccccaactc

SEQ ID NO: 3451638 - DNA, 17 bp, Homo sapiens
ctgacattgttggccaa

SEQ ID NO: 3451639 - DNA, 21 bp, Homo sapiens
ctgacattgttggccaaagcc

SEQ ID NO: 3451640 - DNA, 18 bp, Homo sapiens
ctgacatttggagtgttc

SEQ ID NO: 3451641 - DNA, 12 bp, Homo sapiens
ctgaccacagca

SEQ ID NO: 3451642 - DNA, 15 bp, Homo sapiens
ctgaccacagcacag

SEQ ID NO: 3451643 - DNA, 22 bp, Homo sapiens
ctgaccacgctttctagctgtt

SEQ ID NO: 3451644 - DNA, 13 bp, Homo sapiens
ctgaccagcagcg

SEQ ID NO: 3451645 - DNA, 11 bp, Homo sapiens
ctgacccactg

SEQ ID NO: 3451646 - DNA, 14 bp, Homo sapiens
ctgacccactgctt

SEQ ID NO: 3451647 - DNA, 21 bp, Homo sapiens
ctgacccagccccttgagaaa

SEQ ID NO: 3451648 - DNA, 10 bp, Homo sapiens
ctgacccagt

SEQ ID NO: 3451649 - DNA, 19 bp, Homo sapiens
ctgaccctggggctggctt

SEQ ID NO: 3451650 - DNA, 12 bp, Homo sapiens
ctgaccctgtat

SEQ ID NO: 3451651 - DNA, 15 bp, Homo sapiens
ctgaccctgtatata

SEQ ID NO: 3451652 - DNA, 18 bp, Homo sapiens
ctgaccgaaacagcgctg

SEQ ID NO: 3451653 - DNA, 13 bp, Homo sapiens
ctgacctccacag

SEQ ID NO: 3451654 - DNA, 15 bp, Homo sapiens
ctgacctccacagct

SEQ ID NO: 3451655 - DNA, 20 bp, Homo sapiens
ctgacctccctctaatttat

SEQ ID NO: 3451656 - DNA, 18 bp, Homo sapiens
ctgacctggtccacaggg

SEQ ID NO: 3451657 - DNA, 14 bp, Homo sapiens
ctgacctttaactg

SEQ ID NO: 3451658 - DNA, 21 bp, Homo sapiens
ctgacgaacttccatggccct

SEQ ID NO: 3451659 - DNA, 22 bp, Homo sapiens
ctgacgtagctgcaaaggacag

SEQ ID NO: 3451660 - DNA, 14 bp, Homo sapiens
ctgactcagggctc

SEQ ID NO: 3451661 - DNA, 15 bp, Homo sapiens
ctgactcagggctcc

SEQ ID NO: 3451662 - DNA, 21 bp, Homo sapiens
ctgactcagggctcctgggtt

SEQ ID NO: 3451663 - DNA, 16 bp, Homo sapiens
ctgactcggtttctcc

SEQ ID NO: 3451664 - DNA, 14 bp, Homo sapiens
ctgactctcacctg

SEQ ID NO: 3451665 - DNA, 22 bp, Homo sapiens
ctgactctcgtgcatttcaact

SEQ ID NO: 3451666 - DNA, 14 bp, Homo sapiens
ctgactgcccagca

SEQ ID NO: 3451667 - DNA, 22 bp, Homo sapiens
ctgactggatgtccagagctgg

SEQ ID NO: 3451668 - DNA, 16 bp, Homo sapiens
ctgactgttttctctt

SEQ ID NO: 3451669 - DNA, 18 bp, Homo sapiens
ctgactgttttctcttga

SEQ ID NO: 3451670 - DNA, 20 bp, Homo sapiens
ctgacttaagcaaaagaaaa

SEQ ID NO: 3451671 - DNA, 17 bp, Homo sapiens
ctgacttcatctcccac

SEQ ID NO: 3451672 - DNA, 19 bp, Homo sapiens
ctgacttctgcctggagac

SEQ ID NO: 3451673 - DNA, 19 bp, Homo sapiens
ctgacttggggaccttttg

SEQ ID NO: 3451674 - DNA, 12 bp, Homo sapiens
ctgagaaactct

SEQ ID NO: 3451675 - DNA, 16 bp, Homo sapiens
ctgagaaagccctgtc

SEQ ID NO: 3451676 - DNA, 11 bp, Homo sapiens
ctgagaacact

SEQ ID NO: 3451677 - DNA, 22 bp, Homo sapiens
ctgagaacactgtgaaaacatt

SEQ ID NO: 3451678 - DNA, 12 bp, Homo sapiens
ctgagagaaata

SEQ ID NO: 3451679 - DNA, 22 bp, Homo sapiens
ctgagagtcagctctctgccct

SEQ ID NO: 3451680 - DNA, 21 bp, Homo sapiens
ctgagattattccttcttcta

SEQ ID NO: 3451681 - DNA, 18 bp, Homo sapiens
ctgagatttcatctgctc

SEQ ID NO: 3451682 - DNA, 21 bp, Homo sapiens
ctgagatttcatctgctctcc

SEQ ID NO: 3451683 - DNA, 20 bp, Homo sapiens
ctgagcaactcttgattatc

SEQ ID NO: 3451684 - DNA, 13 bp, Homo sapiens
ctgagcacagatg

SEQ ID NO: 3451685 - DNA, 14 bp, Homo sapiens
ctgagcaccctctg

SEQ ID NO: 3451686 - DNA, 15 bp, Homo sapiens
ctgagcaccctctgg

SEQ ID NO: 3451687 - DNA, 17 bp, Homo sapiens
ctgagcaccgtgtcaag

SEQ ID NO: 3451688 - DNA, 17 bp, Homo sapiens
ctgagcagaaagaggcc

SEQ ID NO: 3451689 - DNA, 18 bp, Homo sapiens
ctgagcaggacctctgaa

SEQ ID NO: 3451690 - DNA, 13 bp, Homo sapiens
ctgagccacagtg

SEQ ID NO: 3451691 - DNA, 15 bp, Homo sapiens
ctgagccacctgccc

SEQ ID NO: 3451692 - DNA, 17 bp, Homo sapiens
ctgagccacctgccctt

SEQ ID NO: 3451693 - DNA, 12 bp, Homo sapiens
ctgagcccctgt

SEQ ID NO: 3451694 - DNA, 13 bp, Homo sapiens
ctgagcccctgtc

SEQ ID NO: 3451695 - DNA, 22 bp, Homo sapiens
ctgagcccctgtctagagaggg

SEQ ID NO: 3451696 - DNA, 23 bp, Homo sapiens
ctgagcccctgtctagagaggga

SEQ ID NO: 3451697 - DNA, 16 bp, Homo sapiens
ctgagcctagctacct

SEQ ID NO: 3451698 - DNA, 15 bp, Homo sapiens
ctgagcgccaggatg

SEQ ID NO: 3451699 - DNA, 15 bp, Homo sapiens
ctgagcgcctccatc

SEQ ID NO: 3451700 - DNA, 20 bp, Homo sapiens
ctgagctgcttcactaggga

SEQ ID NO: 3451701 - DNA, 22 bp, Homo sapiens
ctgagctgcttcactagggaat

SEQ ID NO: 3451702 - DNA, 11 bp, Homo sapiens
ctgagctgggg

SEQ ID NO: 3451703 - DNA, 15 bp, Homo sapiens
ctgagctgtgcaggt

SEQ ID NO: 3451704 - DNA, 15 bp, Homo sapiens
ctgagctttctgcta

SEQ ID NO: 3451705 - DNA, 17 bp, Homo sapiens
ctgaggaaaggccagct

SEQ ID NO: 3451706 - DNA, 18 bp, Homo sapiens
ctgaggaaaggccagctg

SEQ ID NO: 3451707 - DNA, 15 bp, Homo sapiens
ctgaggaagaacggg

SEQ ID NO: 3451708 - DNA, 23 bp, Homo sapiens
ctgaggacactaaccacgctgga

SEQ ID NO: 3451709 - DNA, 20 bp, Homo sapiens
ctgaggatgggtcagagcta

SEQ ID NO: 3451710 - DNA, 15 bp, Homo sapiens
ctgaggcagcagtgt

SEQ ID NO: 3451711 - DNA, 19 bp, Homo sapiens
ctctgccaacttcttcaga

SEQ ID NO: 3451712 - DNA, 15 bp, Homo sapiens
ctctgccccatcctc

SEQ ID NO: 3451713 - DNA, 21 bp, Homo sapiens
ctctgccccatcctccagcag

SEQ ID NO: 3451714 - DNA, 13 bp, Homo sapiens
ctctgccctgtgt

SEQ ID NO: 3451715 - DNA, 14 bp, Homo sapiens
ctctgccgctacct

SEQ ID NO: 3451716 - DNA, 14 bp, Homo sapiens
ctctgcctctgaca

SEQ ID NO: 3451717 - DNA, 20 bp, Homo sapiens
ctctgcctctgacacacagc

SEQ ID NO: 3451718 - DNA, 22 bp, Homo sapiens
ctctgcctgaagtcacacagtg

SEQ ID NO: 3451719 - DNA, 17 bp, Homo sapiens
ctctgcctgacaaggcc

SEQ ID NO: 3451720 - DNA, 12 bp, Homo sapiens
ctctgcctgcct

SEQ ID NO: 3451721 - DNA, 20 bp, Homo sapiens
ctctgccttcgaggtcagag

SEQ ID NO: 3451722 - DNA, 15 bp, Homo sapiens
ctctgccttgccttt

SEQ ID NO: 3451723 - DNA, 13 bp, Homo sapiens
ctctgctccccag

SEQ ID NO: 3451724 - DNA, 20 bp, Homo sapiens
ctctgctcctctccccagca

SEQ ID NO: 3451725 - DNA, 13 bp, Homo sapiens
ctctgctctgcgt

SEQ ID NO: 3451726 - DNA, 12 bp, Homo sapiens
ctctgctgaaga

SEQ ID NO: 3451727 - DNA, 13 bp, Homo sapiens
ctctgctgacaga

SEQ ID NO: 3451728 - DNA, 18 bp, Homo sapiens
ctctgctgacagacacag

SEQ ID NO: 3451729 - DNA, 22 bp, Homo sapiens
ctctgctgacagacacaggccc

SEQ ID NO: 3451730 - DNA, 13 bp, Homo sapiens
ctctgctgccgcc

SEQ ID NO: 3451731 - DNA, 21 bp, Homo sapiens
ctctgctgccgccccacccag

SEQ ID NO: 3451732 - DNA, 14 bp, Homo sapiens
ctctgctggcccag

SEQ ID NO: 3451733 - DNA, 12 bp, Homo sapiens
ctctgcttctct

SEQ ID NO: 3451734 - DNA, 17 bp, Homo sapiens
ctctgcttgagtcaggt

SEQ ID NO: 3451735 - DNA, 18 bp, Homo sapiens
ctctggacagccccaccc

SEQ ID NO: 3451736 - DNA, 15 bp, Homo sapiens
ctctggacaggcatg

SEQ ID NO: 3451737 - DNA, 16 bp, Homo sapiens
ctctggaggggagggg

SEQ ID NO: 3451738 - DNA, 12 bp, Homo sapiens
ctctggagtggc

SEQ ID NO: 3451739 - DNA, 22 bp, Homo sapiens
ctctggatctgttccttggcag

SEQ ID NO: 3451740 - DNA, 19 bp, Homo sapiens
ctctggatgcctgattgcc

SEQ ID NO: 3451741 - DNA, 17 bp, Homo sapiens
ctctggattaggtctct

SEQ ID NO: 3451742 - DNA, 22 bp, Homo sapiens
ctctggattggagatagggaaa

SEQ ID NO: 3451743 - DNA, 20 bp, Homo sapiens
ctctggccaagggccagaca

SEQ ID NO: 3451744 - DNA, 21 bp, Homo sapiens
ctctggccaagggccagacag

SEQ ID NO: 3451745 - DNA, 13 bp, Homo sapiens
ctctggccccagg

SEQ ID NO: 3451746 - DNA, 14 bp, Homo sapiens
ctctggctctgttc

SEQ ID NO: 3451747 - DNA, 12 bp, Homo sapiens
ctctgggagaaa

SEQ ID NO: 3451748 - DNA, 18 bp, Homo sapiens
ctctgggagaaaatcatc

SEQ ID NO: 3451749 - DNA, 20 bp, Homo sapiens
ctctgggagaaaatcatcaa

SEQ ID NO: 3451750 - DNA, 17 bp, Homo sapiens
ctctgggccacttggag

SEQ ID NO: 3451751 - DNA, 17 bp, Homo sapiens
ctctgggggctctggcc

SEQ ID NO: 3451752 - DNA, 20 bp, Homo sapiens
ctctgggggctctggccaag

SEQ ID NO: 3451753 - DNA, 18 bp, Homo sapiens
ctctggtcgctcctgccc

SEQ ID NO: 3451754 - DNA, 19 bp, Homo sapiens
ctctggtgataaggacatg

SEQ ID NO: 3451755 - DNA, 15 bp, Homo sapiens
ctctggttatctaat

SEQ ID NO: 3451756 - DNA, 19 bp, Homo sapiens
ctctgtaccccatgacctt

SEQ ID NO: 3451757 - DNA, 12 bp, Homo sapiens
ctctgtactttt

SEQ ID NO: 3451758 - DNA, 22 bp, Homo sapiens
ctctgtatcaggacccagagga

SEQ ID NO: 3451759 - DNA, 16 bp, Homo sapiens
ctctgtcagtcacagc

SEQ ID NO: 3451760 - DNA, 14 bp, Homo sapiens
ctctgtccaggcac

SEQ ID NO: 3451761 - DNA, 14 bp, Homo sapiens
ctctgtccccttct

SEQ ID NO: 3451762 - DNA, 15 bp, Homo sapiens
ctctgtccccttctc

SEQ ID NO: 3451763 - DNA, 17 bp, Homo sapiens
ctctgtccccttctctc

SEQ ID NO: 3451764 - DNA, 14 bp, Homo sapiens
ctctgtcctgggag

SEQ ID NO: 3451765 - DNA, 17 bp, Homo sapiens
ctctgtcgcccagtctg

SEQ ID NO: 3451766 - DNA, 19 bp, Homo sapiens
ctctgtcgcccagtctgga

SEQ ID NO: 3451767 - DNA, 19 bp, Homo sapiens
ctctgtctacttgctcagg

SEQ ID NO: 3451768 - DNA, 15 bp, Homo sapiens
ctctgtctcatccat

SEQ ID NO: 3451769 - DNA, 13 bp, Homo sapiens
ctctgtcttctgg

SEQ ID NO: 3451770 - DNA, 21 bp, Homo sapiens
ctctgtgaacgatttagaaag

SEQ ID NO: 3451771 - DNA, 19 bp, Homo sapiens
ctctgtgaccaatgtcttg

SEQ ID NO: 3451772 - DNA, 13 bp, Homo sapiens
ctctgtgagactc

SEQ ID NO: 3451773 - DNA, 17 bp, Homo sapiens
ctctgtgagactcgaga

SEQ ID NO: 3451774 - DNA, 13 bp, Homo sapiens
ctctgtgccttcg

SEQ ID NO: 3451775 - DNA, 13 bp, Homo sapiens
ctctgtgctgtgt

SEQ ID NO: 3451776 - DNA, 13 bp, Homo sapiens
ctctgtggggctg

SEQ ID NO: 3451777 - DNA, 16 bp, Homo sapiens
ctctgtgggtctctgg

SEQ ID NO: 3451778 - DNA, 18 bp, Homo sapiens
ctctgtgtatttgctttt

SEQ ID NO: 3451779 - DNA, 15 bp, Homo sapiens
ctctgtgtcaggtgg

SEQ ID NO: 3451780 - DNA, 19 bp, Homo sapiens
ctctgtgtcaggtggggca

SEQ ID NO: 3451781 - DNA, 17 bp, Homo sapiens
ctctgttcagtgtaaat

SEQ ID NO: 3451782 - DNA, 13 bp, Homo sapiens
ctctgttgactgg

SEQ ID NO: 3451783 - DNA, 14 bp, Homo sapiens
ctctgttgtaagaa

SEQ ID NO: 3451784 - DNA, 24 bp, Homo sapiens
ctcttaaaacccaagtgccttagc

SEQ ID NO: 3451785 - DNA, 13 bp, Homo sapiens
ctcttacatgtat

SEQ ID NO: 3451786 - DNA, 13 bp, Homo sapiens
ctcttagaaaaac

SEQ ID NO: 3451787 - DNA, 15 bp, Homo sapiens
ctcttagaaaaacca

SEQ ID NO: 3451788 - DNA, 23 bp, Homo sapiens
ctcttagaggaaggagataggga

SEQ ID NO: 3451789 - DNA, 21 bp, Homo sapiens
ctcttagcattttaattagat

SEQ ID NO: 3451790 - DNA, 15 bp, Homo sapiens
ctcttagctcccctc

SEQ ID NO: 3451791 - DNA, 19 bp, Homo sapiens
ctcttagctcccctccaac

SEQ ID NO: 3451792 - DNA, 16 bp, Homo sapiens
ctcttatagaatattt

SEQ ID NO: 3451793 - DNA, 21 bp, Homo sapiens
ctcttatagaatatttattac

SEQ ID NO: 3451794 - DNA, 13 bp, Homo sapiens
ctcttattgccca

SEQ ID NO: 3451795 - DNA, 19 bp, Homo sapiens
ctcttcaggttgtaaaaaa

SEQ ID NO: 3451796 - DNA, 17 bp, Homo sapiens
ctcttccactccttctc

SEQ ID NO: 3451797 - DNA, 13 bp, Homo sapiens
ctcttccccccaa

SEQ ID NO: 3451798 - DNA, 19 bp, Homo sapiens
ctcttcctaccctgcctcc

SEQ ID NO: 3451799 - DNA, 12 bp, Homo sapiens
ctcttctccagg

SEQ ID NO: 3451800 - DNA, 13 bp, Homo sapiens
ctcttctccaggc

SEQ ID NO: 3451801 - DNA, 14 bp, Homo sapiens
ctcttctctcaacc

SEQ ID NO: 3451802 - DNA, 21 bp, Homo sapiens
ctcttctctcaaccttggcct

SEQ ID NO: 3451803 - DNA, 22 bp, Homo sapiens
ctcttctctcaaccttggcctt

SEQ ID NO: 3451804 - DNA, 23 bp, Homo sapiens
ctcttctctcaaccttggccttc

SEQ ID NO: 3451805 - DNA, 22 bp, Homo sapiens
ctcttctggagatggaagcttg

SEQ ID NO: 3451806 - DNA, 14 bp, Homo sapiens
ctcttctggctcaa

SEQ ID NO: 3451807 - DNA, 22 bp, Homo sapiens
ctcttctgggagggcagcaggg

SEQ ID NO: 3451808 - DNA, 16 bp, Homo sapiens
ctcttcttattaccca

SEQ ID NO: 3451809 - DNA, 16 bp, Homo sapiens
ctcttcttcccagcac

SEQ ID NO: 3451810 - DNA, 12 bp, Homo sapiens
ctcttctttaga

SEQ ID NO: 3451811 - DNA, 17 bp, Homo sapiens
ctcttctttagaacagg

SEQ ID NO: 3451812 - DNA, 13 bp, Homo sapiens
ctcttgacctcag

SEQ ID NO: 3451813 - DNA, 15 bp, Homo sapiens
ctcttgacctcaggt

SEQ ID NO: 3451814 - DNA, 16 bp, Homo sapiens
ctcttgacctcaggtg

SEQ ID NO: 3451815 - DNA, 14 bp, Homo sapiens
ctcttgagcctggg

SEQ ID NO: 3451816 - DNA, 15 bp, Homo sapiens
ctcttgagcctggga

SEQ ID NO: 3451817 - DNA, 16 bp, Homo sapiens
ctcttgagcctgggag

SEQ ID NO: 3451818 - DNA, 16 bp, Homo sapiens
ctcttggcctgatcag

SEQ ID NO: 3451819 - DNA, 14 bp, Homo sapiens
ctcttggctccact

SEQ ID NO: 3451820 - DNA, 15 bp, Homo sapiens
ctcttgggccaagcc

SEQ ID NO: 3451821 - DNA, 21 bp, Homo sapiens
ctcttgggccaagccagctgc

SEQ ID NO: 3451822 - DNA, 19 bp, Homo sapiens
ctcttgggttcaagcgatt

SEQ ID NO: 3451823 - DNA, 17 bp, Homo sapiens
ctcttgtaaataaagcc

SEQ ID NO: 3451824 - DNA, 20 bp, Homo sapiens
ctcttgtaaataaagccctg

SEQ ID NO: 3451825 - DNA, 15 bp, Homo sapiens
ctcttgtattaaact

SEQ ID NO: 3451826 - DNA, 18 bp, Homo sapiens
ctctttaatgtcacaggc

SEQ ID NO: 3451827 - DNA, 23 bp, Homo sapiens
ctctttagaaataatggtcattc

SEQ ID NO: 3451828 - DNA, 21 bp, Homo sapiens
ctctttatgcttgcaaaaact

SEQ ID NO: 3451829 - DNA, 15 bp, Homo sapiens
ctctttattttacta

SEQ ID NO: 3451830 - DNA, 12 bp, Homo sapiens
ctctttcatcca

SEQ ID NO: 3451831 - DNA, 16 bp, Homo sapiens
ctctttcctccttcca

SEQ ID NO: 3451832 - DNA, 16 bp, Homo sapiens
ctctttcgtctactgc

SEQ ID NO: 3451833 - DNA, 17 bp, Homo sapiens
ctctttctgagtgcctt

SEQ ID NO: 3451834 - DNA, 23 bp, Homo sapiens
ctctttctgagtgccttctgtgg

SEQ ID NO: 3451835 - DNA, 19 bp, Homo sapiens
ctctttctgtcccttctgt

SEQ ID NO: 3451836 - DNA, 10 bp, Homo sapiens
ctctttgaga

SEQ ID NO: 3451837 - DNA, 22 bp, Homo sapiens
ctctttgagataatacattccg

SEQ ID NO: 3451838 - DNA, 18 bp, Homo sapiens
ctctttgctttgctttct

SEQ ID NO: 3451839 - DNA, 20 bp, Homo sapiens
ctctttgggaatgtttgtct

SEQ ID NO: 3451840 - DNA, 21 bp, Homo sapiens
ctctttggtggcatggaaggg

SEQ ID NO: 3451841 - DNA, 16 bp, Homo sapiens
ctcttttatatttgta

SEQ ID NO: 3451842 - DNA, 21 bp, Homo sapiens
ctcttttcccctttcctgtcc

SEQ ID NO: 3451843 - DNA, 12 bp, Homo sapiens
ctctttttccaa

SEQ ID NO: 3451844 - DNA, 21 bp, Homo sapiens
ctctttttccaacttggctgc

SEQ ID NO: 3451845 - DNA, 14 bp, Homo sapiens
ctgaaaacctctcc

SEQ ID NO: 3451846 - DNA, 10 bp, Homo sapiens
ctgaaaagaa

SEQ ID NO: 3451847 - DNA, 16 bp, Homo sapiens
ctgaaaagaaggaata

SEQ ID NO: 3451848 - DNA, 13 bp, Homo sapiens
ctgaaacagctgc

SEQ ID NO: 3451849 - DNA, 12 bp, Homo sapiens
ctccttcccaat

SEQ ID NO: 3451850 - DNA, 19 bp, Homo sapiens
ctccttccctgtgtctttt

SEQ ID NO: 3451851 - DNA, 13 bp, Homo sapiens
ctccttcctgtgt

SEQ ID NO: 3451852 - DNA, 14 bp, Homo sapiens
ctccttctgtccta

SEQ ID NO: 3451853 - DNA, 12 bp, Homo sapiens
ctccttctgttt

SEQ ID NO: 3451854 - DNA, 17 bp, Homo sapiens
ctccttgagagaccagg

SEQ ID NO: 3451855 - DNA, 13 bp, Homo sapiens
ctccttgggaggc

SEQ ID NO: 3451856 - DNA, 16 bp, Homo sapiens
ctccttgggaggcccc

SEQ ID NO: 3451857 - DNA, 19 bp, Homo sapiens
ctccttgggccctttgagt

SEQ ID NO: 3451858 - DNA, 18 bp, Homo sapiens
ctccttgtggcctgggcc

SEQ ID NO: 3451859 - DNA, 14 bp, Homo sapiens
ctccttgttcctag

SEQ ID NO: 3451860 - DNA, 17 bp, Homo sapiens
ctcctttaagagctctg

SEQ ID NO: 3451861 - DNA, 22 bp, Homo sapiens
ctcctttagcgcccagttgggt

SEQ ID NO: 3451862 - DNA, 19 bp, Homo sapiens
ctcctttcaccccagggcc

SEQ ID NO: 3451863 - DNA, 13 bp, Homo sapiens
ctcctttgtactt

SEQ ID NO: 3451864 - DNA, 14 bp, Homo sapiens
ctcctttgtacttt

SEQ ID NO: 3451865 - DNA, 16 bp, Homo sapiens
ctcctttgttcccggc

SEQ ID NO: 3451866 - DNA, 14 bp, Homo sapiens
ctcgaaacacagaa

SEQ ID NO: 3451867 - DNA, 18 bp, Homo sapiens
ctcgaatctctgtgcctt

SEQ ID NO: 3451868 - DNA, 17 bp, Homo sapiens
ctcgagcagtcctgcct

SEQ ID NO: 3451869 - DNA, 14 bp, Homo sapiens
ctcgaggtgccttc

SEQ ID NO: 3451870 - DNA, 13 bp, Homo sapiens
ctcgagtactgtg

SEQ ID NO: 3451871 - DNA, 20 bp, Homo sapiens
ctcgagtactgtgggcaatt

SEQ ID NO: 3451872 - DNA, 17 bp, Homo sapiens
ctcgagtcacattctgc

SEQ ID NO: 3451873 - DNA, 19 bp, Homo sapiens
ctcgagtcacattctgctt

SEQ ID NO: 3451874 - DNA, 13 bp, Homo sapiens
ctcgattttgtat

SEQ ID NO: 3451875 - DNA, 18 bp, Homo sapiens
ctcgattttgtatctgca

SEQ ID NO: 3451876 - DNA, 19 bp, Homo sapiens
ctcgattttgtatctgcag

SEQ ID NO: 3451877 - DNA, 19 bp, Homo sapiens
ctcgcataggacctttcca

SEQ ID NO: 3451878 - DNA, 15 bp, Homo sapiens
ctcgcatcttcccaa

SEQ ID NO: 3451879 - DNA, 12 bp, Homo sapiens
ctcgccaaggcc

SEQ ID NO: 3451880 - DNA, 13 bp, Homo sapiens
ctcgccaaggcct

SEQ ID NO: 3451881 - DNA, 16 bp, Homo sapiens
ctcgctctgttaccca

SEQ ID NO: 3451882 - DNA, 18 bp, Homo sapiens
ctcgctgcacaaatactc

SEQ ID NO: 3451883 - DNA, 13 bp, Homo sapiens
ctcgctgccagct

SEQ ID NO: 3451884 - DNA, 17 bp, Homo sapiens
ctcgctttgttgcccag

SEQ ID NO: 3451885 - DNA, 19 bp, Homo sapiens
ctcggaactgcatgctgct

SEQ ID NO: 3451886 - DNA, 21 bp, Homo sapiens
ctcggaactgcatgctgctgg

SEQ ID NO: 3451887 - DNA, 14 bp, Homo sapiens
ctcggacaagtgat

SEQ ID NO: 3451888 - DNA, 13 bp, Homo sapiens
ctcggaggaagcc

SEQ ID NO: 3451889 - DNA, 17 bp, Homo sapiens
ctcggagggattcccct

SEQ ID NO: 3451890 - DNA, 18 bp, Homo sapiens
ctcggcctcccaaagtgc

SEQ ID NO: 3451891 - DNA, 16 bp, Homo sapiens
ctcggctcagtgcaac

SEQ ID NO: 3451892 - DNA, 18 bp, Homo sapiens
ctcggctcagtgcaacct

SEQ ID NO: 3451893 - DNA, 23 bp, Homo sapiens
ctcggctcagtgcaacctctgct

SEQ ID NO: 3451894 - DNA, 19 bp, Homo sapiens
ctcggcttttctcagctgg

SEQ ID NO: 3451895 - DNA, 18 bp, Homo sapiens
ctcggtacccggggccca

SEQ ID NO: 3451896 - DNA, 21 bp, Homo sapiens
ctcggtacccggggcccaggg

SEQ ID NO: 3451897 - DNA, 22 bp, Homo sapiens
ctcggtacccggggcccagggc

SEQ ID NO: 3451898 - DNA, 16 bp, Homo sapiens
ctcggtgtggagaagc

SEQ ID NO: 3451899 - DNA, 19 bp, Homo sapiens
ctctaacctcgccctctcc

SEQ ID NO: 3451900 - DNA, 18 bp, Homo sapiens
ctctaataagaaaaccac

SEQ ID NO: 3451901 - DNA, 15 bp, Homo sapiens
ctctaatacattcca

SEQ ID NO: 3451902 - DNA, 22 bp, Homo sapiens
ctctacaccaattaatgtagct

SEQ ID NO: 3451903 - DNA, 20 bp, Homo sapiens
ctctacagagcttccctgac

SEQ ID NO: 3451904 - DNA, 14 bp, Homo sapiens
ctctacagaggcca

SEQ ID NO: 3451905 - DNA, 16 bp, Homo sapiens
ctctacagaggccatg

SEQ ID NO: 3451906 - DNA, 20 bp, Homo sapiens
ctctaccaagctatcctggc

SEQ ID NO: 3451907 - DNA, 21 bp, Homo sapiens
ctctaccagataactgaggag

SEQ ID NO: 3451908 - DNA, 14 bp, Homo sapiens
ctctacccagggcc

SEQ ID NO: 3451909 - DNA, 14 bp, Homo sapiens
ctctacccatctcc

SEQ ID NO: 3451910 - DNA, 13 bp, Homo sapiens
ctctaccccctca

SEQ ID NO: 3451911 - DNA, 12 bp, Homo sapiens
ctctacctgaca

SEQ ID NO: 3451912 - DNA, 15 bp, Homo sapiens
ctctactttgattct

SEQ ID NO: 3451913 - DNA, 18 bp, Homo sapiens
ctctagaaataggttaaa

SEQ ID NO: 3451914 - DNA, 22 bp, Homo sapiens
ctctagagccttcagccttaat

SEQ ID NO: 3451915 - DNA, 19 bp, Homo sapiens
ctctagatacctaaaacat

SEQ ID NO: 3451916 - DNA, 23 bp, Homo sapiens
ctctagctgggggtgggccaggc

SEQ ID NO: 3451917 - DNA, 21 bp, Homo sapiens
ctctaggaagacatttttccg

SEQ ID NO: 3451918 - DNA, 12 bp, Homo sapiens
ctctaggctggg

SEQ ID NO: 3451919 - DNA, 23 bp, Homo sapiens
ctctagggaaaaaccagcgtgtg

SEQ ID NO: 3451920 - DNA, 13 bp, Homo sapiens
ctctagttctttg

SEQ ID NO: 3451921 - DNA, 16 bp, Homo sapiens
ctctataaggcagcct

SEQ ID NO: 3451922 - DNA, 21 bp, Homo sapiens
ctctatcatttaataatatac

SEQ ID NO: 3451923 - DNA, 16 bp, Homo sapiens
ctctatttatgtttgc

SEQ ID NO: 3451924 - DNA, 17 bp, Homo sapiens
ctctatttctagagaca

SEQ ID NO: 3451925 - DNA, 18 bp, Homo sapiens
ctctatttcttcttcaca

SEQ ID NO: 3451926 - DNA, 20 bp, Homo sapiens
ctctcaaacggcaacattcc

SEQ ID NO: 3451927 - DNA, 18 bp, Homo sapiens
ctctcaaatccctctcca

SEQ ID NO: 3451928 - DNA, 16 bp, Homo sapiens
ctctcaaccttggcct

SEQ ID NO: 3451929 - DNA, 18 bp, Homo sapiens
ctctcaaccttggccttc

SEQ ID NO: 3451930 - DNA, 22 bp, Homo sapiens
ctctcaaccttggccttctccc

SEQ ID NO: 3451931 - DNA, 19 bp, Homo sapiens
ctctcactgtgttactgct

SEQ ID NO: 3451932 - DNA, 13 bp, Homo sapiens
ctctcagtctctg

SEQ ID NO: 3451933 - DNA, 18 bp, Homo sapiens
ctctcagtctctgagcag

SEQ ID NO: 3451934 - DNA, 13 bp, Homo sapiens
ctctcagtgtttt

SEQ ID NO: 3451935 - DNA, 19 bp, Homo sapiens
ctctcagttgcagccctgc

SEQ ID NO: 3451936 - DNA, 12 bp, Homo sapiens
ctctcagttttt

SEQ ID NO: 3451937 - DNA, 15 bp, Homo sapiens
ctctcatctgaggca

SEQ ID NO: 3451938 - DNA, 20 bp, Homo sapiens
ctctccagatgtttccagac

SEQ ID NO: 3451939 - DNA, 19 bp, Homo sapiens
ctctccattttagcccagt

SEQ ID NO: 3451940 - DNA, 11 bp, Homo sapiens
ctctcccaggg

SEQ ID NO: 3451941 - DNA, 18 bp, Homo sapiens
ctctcccattgtccctct

SEQ ID NO: 3451942 - DNA, 13 bp, Homo sapiens
ctctccccagcaa

SEQ ID NO: 3451943 - DNA, 15 bp, Homo sapiens
ctctccccagcccag

SEQ ID NO: 3451944 - DNA, 17 bp, Homo sapiens
ctctcccctgacctgtg

SEQ ID NO: 3451945 - DNA, 14 bp, Homo sapiens
ctctccctgaccct

SEQ ID NO: 3451946 - DNA, 23 bp, Homo sapiens
ctctcctcatctctaacagctca

SEQ ID NO: 3451947 - DNA, 20 bp, Homo sapiens
ctctcctcctgcccacctgt

SEQ ID NO: 3451948 - DNA, 14 bp, Homo sapiens
ctctccttccttgt

SEQ ID NO: 3451949 - DNA, 16 bp, Homo sapiens
ctctcgcatcttccca

SEQ ID NO: 3451950 - DNA, 17 bp, Homo sapiens
ctctcgcatcttcccaa

SEQ ID NO: 3451951 - DNA, 17 bp, Homo sapiens
ctctctcctcctgccca

SEQ ID NO: 3451952 - DNA, 16 bp, Homo sapiens
ctctctgaacccctcc

SEQ ID NO: 3451953 - DNA, 19 bp, Homo sapiens
ctctctgagtcctggccca

SEQ ID NO: 3451954 - DNA, 22 bp, Homo sapiens
ctctctgctctgcgtgtcacct

SEQ ID NO: 3451955 - DNA, 18 bp, Homo sapiens
ctctcttatagaatattt

SEQ ID NO: 3451956 - DNA, 17 bp, Homo sapiens
ctctcttgggccaagcc

SEQ ID NO: 3451957 - DNA, 19 bp, Homo sapiens
ctctcttgggccaagccag

SEQ ID NO: 3451958 - DNA, 20 bp, Homo sapiens
ctctcttgggccaagccagc

SEQ ID NO: 3451959 - DNA, 21 bp, Homo sapiens
ctctcttgggccaagccagct

SEQ ID NO: 3451960 - DNA, 11 bp, Homo sapiens
ctctgaaacag

SEQ ID NO: 3451961 - DNA, 15 bp, Homo sapiens
ctctgaaaccctgga

SEQ ID NO: 3451962 - DNA, 19 bp, Homo sapiens
ctctgaaagttgtacatga

SEQ ID NO: 3451963 - DNA, 17 bp, Homo sapiens
ctctgaaatatcccggg

SEQ ID NO: 3451964 - DNA, 23 bp, Homo sapiens
ctctgaagagtgggtttcacaag

SEQ ID NO: 3451965 - DNA, 19 bp, Homo sapiens
ctctgaagggcatcatgca

SEQ ID NO: 3451966 - DNA, 15 bp, Homo sapiens
ctctgacacacagct

SEQ ID NO: 3451967 - DNA, 20 bp, Homo sapiens
ctctgacttaagcaaaagaa

SEQ ID NO: 3451968 - DNA, 16 bp, Homo sapiens
ctctgacttctgcctg

SEQ ID NO: 3451969 - DNA, 18 bp, Homo sapiens
ctctgacttctgcctgga

SEQ ID NO: 3451970 - DNA, 19 bp, Homo sapiens
ctctgacttctgcctggag

SEQ ID NO: 3451971 - DNA, 21 bp, Homo sapiens
ctctgacttctgcctggagac

SEQ ID NO: 3451972 - DNA, 16 bp, Homo sapiens
ctctgagaccaaaatt

SEQ ID NO: 3451973 - DNA, 13 bp, Homo sapiens
ctctgagcagtga

SEQ ID NO: 3451974 - DNA, 16 bp, Homo sapiens
ctctgagccacagtgg

SEQ ID NO: 3451975 - DNA, 13 bp, Homo sapiens
ctctgagcgcctc

SEQ ID NO: 3451976 - DNA, 16 bp, Homo sapiens
ctctgagctgtgcagg

SEQ ID NO: 3451977 - DNA, 12 bp, Homo sapiens
ctctgaggacac

SEQ ID NO: 3451978 - DNA, 15 bp, Homo sapiens
ctctgagtcctggcc

SEQ ID NO: 3451979 - DNA, 16 bp, Homo sapiens
ctctgagtcctggccc

SEQ ID NO: 3451980 - DNA, 16 bp, Homo sapiens
ctctgatccctctggg

SEQ ID NO: 3451981 - DNA, 14 bp, Homo sapiens
ctctgcaagtgctc

SEQ ID NO: 3451982 - DNA, 10 bp, Homo sapiens
ctctgcacaa

SEQ ID NO: 3451983 - DNA, 21 bp, Homo sapiens
ctctgcacaagctgcaccctc

SEQ ID NO: 3451984 - DNA, 18 bp, Homo sapiens
ctctgcagacttcccagc

SEQ ID NO: 3451985 - DNA, 22 bp, Homo sapiens
ctctgcagacttcccagctagg

SEQ ID NO: 3451986 - DNA, 19 bp, Homo sapiens
ctctgcagggccgccaggg

SEQ ID NO: 3451987 - DNA, 18 bp, Homo sapiens
ctcaggtgatccacccac

SEQ ID NO: 3451988 - DNA, 20 bp, Homo sapiens
ctcaggtgatccacccacct

SEQ ID NO: 3451989 - DNA, 12 bp, Homo sapiens
ctcaggtggcca

SEQ ID NO: 3451990 - DNA, 16 bp, Homo sapiens
ctcaggtgtccctgca

SEQ ID NO: 3451991 - DNA, 19 bp, Homo sapiens
ctcagtactttggaggccc

SEQ ID NO: 3451992 - DNA, 20 bp, Homo sapiens
ctcagtactttggaggcccc

SEQ ID NO: 3451993 - DNA, 19 bp, Homo sapiens
ctcagtatgtgggggcttc

SEQ ID NO: 3451994 - DNA, 13 bp, Homo sapiens
ctcagtcataatc

SEQ ID NO: 3451995 - DNA, 17 bp, Homo sapiens
ctcagtccatagcagag

SEQ ID NO: 3451996 - DNA, 14 bp, Homo sapiens
ctcagtgcatttgt

SEQ ID NO: 3451997 - DNA, 16 bp, Homo sapiens
ctcagtgcatttgtgc

SEQ ID NO: 3451998 - DNA, 22 bp, Homo sapiens
ctcagtgcatttgtgctagaaa

SEQ ID NO: 3451999 - DNA, 23 bp, Homo sapiens
ctcagtgttttggactccatctc

SEQ ID NO: 3452000 - DNA, 23 bp, Homo sapiens
ctcagttattacatgtaatttga

SEQ ID NO: 3452001 - DNA, 20 bp, Homo sapiens
ctcagttgattttctggatt

SEQ ID NO: 3452002 - DNA, 15 bp, Homo sapiens
ctcagttgtgcagct

SEQ ID NO: 3452003 - DNA, 18 bp, Homo sapiens
ctcataagttggaccaga

SEQ ID NO: 3452004 - DNA, 20 bp, Homo sapiens
ctcataagttggaccagagg

SEQ ID NO: 3452005 - DNA, 21 bp, Homo sapiens
ctcataagttggaccagagga

SEQ ID NO: 3452006 - DNA, 20 bp, Homo sapiens
ctcataccatctgctgcccc

SEQ ID NO: 3452007 - DNA, 16 bp, Homo sapiens
ctcataggttgagcaa

SEQ ID NO: 3452008 - DNA, 12 bp, Homo sapiens
ctcatcactgtg

SEQ ID NO: 3452009 - DNA, 15 bp, Homo sapiens
ctcatcactgtggct

SEQ ID NO: 3452010 - DNA, 15 bp, Homo sapiens
ctcatcattctctgt

SEQ ID NO: 3452011 - DNA, 17 bp, Homo sapiens
ctcatcattctctgtct

SEQ ID NO: 3452012 - DNA, 16 bp, Homo sapiens
ctcatccagggctctg

SEQ ID NO: 3452013 - DNA, 19 bp, Homo sapiens
ctcatccatcatcatgtgt

SEQ ID NO: 3452014 - DNA, 21 bp, Homo sapiens
ctcatccctaatgctgcagat

SEQ ID NO: 3452015 - DNA, 13 bp, Homo sapiens
ctcatcctccagt

SEQ ID NO: 3452016 - DNA, 23 bp, Homo sapiens
ctcatcctccagtaccttgcttc

SEQ ID NO: 3452017 - DNA, 14 bp, Homo sapiens
ctcatcctgcaggc

SEQ ID NO: 3452018 - DNA, 22 bp, Homo sapiens
ctcatctctaacagctcaggat

SEQ ID NO: 3452019 - DNA, 23 bp, Homo sapiens
ctcatctctaacagctcaggatc

SEQ ID NO: 3452020 - DNA, 17 bp, Homo sapiens
ctcatctctgcctgaca

SEQ ID NO: 3452021 - DNA, 22 bp, Homo sapiens
ctcatctctgcctgacaaggcc

SEQ ID NO: 3452022 - DNA, 15 bp, Homo sapiens
ctcatctctgtccca

SEQ ID NO: 3452023 - DNA, 19 bp, Homo sapiens
ctcatctcttagctcccct

SEQ ID NO: 3452024 - DNA, 12 bp, Homo sapiens
ctcatctgctgg

SEQ ID NO: 3452025 - DNA, 20 bp, Homo sapiens
ctcatctgctggtccgtggg

SEQ ID NO: 3452026 - DNA, 12 bp, Homo sapiens
ctcatctgtgat

SEQ ID NO: 3452027 - DNA, 17 bp, Homo sapiens
ctcatcttcttcaccat

SEQ ID NO: 3452028 - DNA, 12 bp, Homo sapiens
ctcatctttctt

SEQ ID NO: 3452029 - DNA, 13 bp, Homo sapiens
ctcatgacagcca

SEQ ID NO: 3452030 - DNA, 23 bp, Homo sapiens
ctcatgaggaggggcccccctgc

SEQ ID NO: 3452031 - DNA, 13 bp, Homo sapiens
ctcatgtggctgg

SEQ ID NO: 3452032 - DNA, 16 bp, Homo sapiens
ctcatgttctgctttc

SEQ ID NO: 3452033 - DNA, 15 bp, Homo sapiens
ctcattaatgacact

SEQ ID NO: 3452034 - DNA, 19 bp, Homo sapiens
ctcattacccttttctggg

SEQ ID NO: 3452035 - DNA, 21 bp, Homo sapiens
ctcattagcattttgctaaat

SEQ ID NO: 3452036 - DNA, 19 bp, Homo sapiens
ctcattctgaaggagcccc

SEQ ID NO: 3452037 - DNA, 16 bp, Homo sapiens
ctcattctgcaccttg

SEQ ID NO: 3452038 - DNA, 19 bp, Homo sapiens
ctcattctgcaccttgcca

SEQ ID NO: 3452039 - DNA, 20 bp, Homo sapiens
ctcattctgcaccttgccag

SEQ ID NO: 3452040 - DNA, 16 bp, Homo sapiens
ctcattgctgagcctc

SEQ ID NO: 3452041 - DNA, 17 bp, Homo sapiens
ctcattggacccttcca

SEQ ID NO: 3452042 - DNA, 15 bp, Homo sapiens
ctcatttagtgccct

SEQ ID NO: 3452043 - DNA, 23 bp, Homo sapiens
ctcatttcacccctccctttctc

SEQ ID NO: 3452044 - DNA, 16 bp, Homo sapiens
ctcatttcaggagcag

SEQ ID NO: 3452045 - DNA, 18 bp, Homo sapiens
ctccaaaaatctgcctgg

SEQ ID NO: 3452046 - DNA, 20 bp, Homo sapiens
ctccaaaaatctgcctgggt

SEQ ID NO: 3452047 - DNA, 21 bp, Homo sapiens
ctccaaaaatctgcctgggtt

SEQ ID NO: 3452048 - DNA, 13 bp, Homo sapiens
ctccaaaccactt

SEQ ID NO: 3452049 - DNA, 22 bp, Homo sapiens
ctccaaaccactttttgcagct

SEQ ID NO: 3452050 - DNA, 13 bp, Homo sapiens
ctccaaagatgac

SEQ ID NO: 3452051 - DNA, 18 bp, Homo sapiens
ctccaaagatgacttccc

SEQ ID NO: 3452052 - DNA, 22 bp, Homo sapiens
ctccaacaccaagcacagcagc

SEQ ID NO: 3452053 - DNA, 23 bp, Homo sapiens
ctccaacaccaagcacagcagcc

SEQ ID NO: 3452054 - DNA, 14 bp, Homo sapiens
ctccaaccccccag

SEQ ID NO: 3452055 - DNA, 20 bp, Homo sapiens
ctccaaccccccagcactga

SEQ ID NO: 3452056 - DNA, 21 bp, Homo sapiens
ctccaaccccccagcactgag

SEQ ID NO: 3452057 - DNA, 13 bp, Homo sapiens
ctccaacctgcaa

SEQ ID NO: 3452058 - DNA, 15 bp, Homo sapiens
ctccaagccccatct

SEQ ID NO: 3452059 - DNA, 16 bp, Homo sapiens
ctccacagcaacccca

SEQ ID NO: 3452060 - DNA, 12 bp, Homo sapiens
ctccacagggcc

SEQ ID NO: 3452061 - DNA, 14 bp, Homo sapiens
ctccaccctggccg

SEQ ID NO: 3452062 - DNA, 15 bp, Homo sapiens
ctccaccctggccga

SEQ ID NO: 3452063 - DNA, 13 bp, Homo sapiens
ctccactctcccc

SEQ ID NO: 3452064 - DNA, 19 bp, Homo sapiens
ctccactctctaccagata

SEQ ID NO: 3452065 - DNA, 17 bp, Homo sapiens
ctccactctgcttctct

SEQ ID NO: 3452066 - DNA, 21 bp, Homo sapiens
ctccactctgcttctctgact

SEQ ID NO: 3452067 - DNA, 17 bp, Homo sapiens
ctccactgctctcagcc

SEQ ID NO: 3452068 - DNA, 18 bp, Homo sapiens
ctccactgctctcagcct

SEQ ID NO: 3452069 - DNA, 14 bp, Homo sapiens
ctccagaagatagc

SEQ ID NO: 3452070 - DNA, 12 bp, Homo sapiens
ctccagacctga

SEQ ID NO: 3452071 - DNA, 23 bp, Homo sapiens
ctccagacctgatcctggaggcc

SEQ ID NO: 3452072 - DNA, 18 bp, Homo sapiens
ctccagagatttgcttta

SEQ ID NO: 3452073 - DNA, 13 bp, Homo sapiens
ctccagagggcac

SEQ ID NO: 3452074 - DNA, 21 bp, Homo sapiens
ctccagatgcagggcagtcat

SEQ ID NO: 3452075 - DNA, 19 bp, Homo sapiens
ctccagatgtttccagact

SEQ ID NO: 3452076 - DNA, 22 bp, Homo sapiens
ctccagccccttctcagaatct

SEQ ID NO: 3452077 - DNA, 19 bp, Homo sapiens
ctccagcctgcctggcagg

SEQ ID NO: 3452078 - DNA, 12 bp, Homo sapiens
ctccagcctggg

SEQ ID NO: 3452079 - DNA, 14 bp, Homo sapiens
ctccagctcaccag

SEQ ID NO: 3452080 - DNA, 20 bp, Homo sapiens
ctccagctcaccagccccag

SEQ ID NO: 3452081 - DNA, 11 bp, Homo sapiens
ctccagctgcc

SEQ ID NO: 3452082 - DNA, 12 bp, Homo sapiens
ctccagcttccc

SEQ ID NO: 3452083 - DNA, 18 bp, Homo sapiens
ctccaggaaccacaccac

SEQ ID NO: 3452084 - DNA, 17 bp, Homo sapiens
ctccaggagcttcttgt

SEQ ID NO: 3452085 - DNA, 13 bp, Homo sapiens
ctccaggcaggct

SEQ ID NO: 3452086 - DNA, 12 bp, Homo sapiens
ctccaggcccaa

SEQ ID NO: 3452087 - DNA, 15 bp, Homo sapiens
ctccaggctccttta

SEQ ID NO: 3452088 - DNA, 20 bp, Homo sapiens
ctccaggctgtatcccatga

SEQ ID NO: 3452089 - DNA, 13 bp, Homo sapiens
ctccagggctgga

SEQ ID NO: 3452090 - DNA, 16 bp, Homo sapiens
ctccagggctggactg

SEQ ID NO: 3452091 - DNA, 21 bp, Homo sapiens
ctccagggctggactgaggcc

SEQ ID NO: 3452092 - DNA, 18 bp, Homo sapiens
ctccaggtaccttgacct

SEQ ID NO: 3452093 - DNA, 17 bp, Homo sapiens
ctccagtatgacagagg

SEQ ID NO: 3452094 - DNA, 18 bp, Homo sapiens
ctccagtatgacagagga

SEQ ID NO: 3452095 - DNA, 14 bp, Homo sapiens
ctccagtttcccca

SEQ ID NO: 3452096 - DNA, 16 bp, Homo sapiens
ctccataagtaagaaa

SEQ ID NO: 3452097 - DNA, 12 bp, Homo sapiens
ctccatccaagg

SEQ ID NO: 3452098 - DNA, 18 bp, Homo sapiens
ctccatccaaggccaggt

SEQ ID NO: 3452099 - DNA, 14 bp, Homo sapiens
ctccatcctcatct

SEQ ID NO: 3452100 - DNA, 19 bp, Homo sapiens
ctccattatccattcccaa

SEQ ID NO: 3452101 - DNA, 17 bp, Homo sapiens
ctccattcaatttcagg

SEQ ID NO: 3452102 - DNA, 12 bp, Homo sapiens
ctcccaaaagac

SEQ ID NO: 3452103 - DNA, 16 bp, Homo sapiens
ctcccaaagtgctggg

SEQ ID NO: 3452104 - DNA, 14 bp, Homo sapiens
ctcccaacagtggg

SEQ ID NO: 3452105 - DNA, 17 bp, Homo sapiens
ctcccaaccccagggcc

SEQ ID NO: 3452106 - DNA, 15 bp, Homo sapiens
ctcccaagctggctg

SEQ ID NO: 3452107 - DNA, 16 bp, Homo sapiens
ctcccaagctggctgg

SEQ ID NO: 3452108 - DNA, 17 bp, Homo sapiens
ctcccaagctggctggg

SEQ ID NO: 3452109 - DNA, 18 bp, Homo sapiens
ctcccaagctggctgggg

SEQ ID NO: 3452110 - DNA, 18 bp, Homo sapiens
ctcccaagggatggtgcc

SEQ ID NO: 3452111 - DNA, 22 bp, Homo sapiens
ctcccaagtagctgggattaca

SEQ ID NO: 3452112 - DNA, 22 bp, Homo sapiens
ctcccacccccatctctccctc

SEQ ID NO: 3452113 - DNA, 17 bp, Homo sapiens
ctcccacccggctgcag

SEQ ID NO: 3452114 - DNA, 12 bp, Homo sapiens
ctcccacctcag

SEQ ID NO: 3452115 - DNA, 23 bp, Homo sapiens
ctcccactggggtccagggagca

SEQ ID NO: 3452116 - DNA, 24 bp, Homo sapiens
ctcccagaacacactccatcagct

SEQ ID NO: 3452117 - DNA, 17 bp, Homo sapiens
ctcccagagctggtgga

SEQ ID NO: 3452118 - DNA, 12 bp, Homo sapiens
ctcccaggctct

SEQ ID NO: 3452119 - DNA, 18 bp, Homo sapiens
ctcccaggtgcagccaga

SEQ ID NO: 3452120 - DNA, 17 bp, Homo sapiens
ctcccataaccgctgat

SEQ ID NO: 3452121 - DNA, 14 bp, Homo sapiens
ctcccatccagggc

SEQ ID NO: 3452122 - DNA, 22 bp, Homo sapiens
ctcccatccagggcccccatct

SEQ ID NO: 3452123 - DNA, 17 bp, Homo sapiens
ctcccattcctgaagaa

SEQ ID NO: 3452124 - DNA, 19 bp, Homo sapiens
ctcccattgtccctctgcc

SEQ ID NO: 3452125 - DNA, 22 bp, Homo sapiens
ctccccaatgagacttgccttc

SEQ ID NO: 3452126 - DNA, 23 bp, Homo sapiens
ctccccaatgagacttgccttcc

SEQ ID NO: 3452127 - DNA, 16 bp, Homo sapiens
ctccccacgagggctg

SEQ ID NO: 3452128 - DNA, 18 bp, Homo sapiens
ctccccacgagggctggc

SEQ ID NO: 3452129 - DNA, 21 bp, Homo sapiens
ctccccagcaagtgagagctg

SEQ ID NO: 3452130 - DNA, 22 bp, Homo sapiens
ctccccagcaagtgagagctgg

SEQ ID NO: 3452131 - DNA, 23 bp, Homo sapiens
ctccccagcaagtgagagctggg

SEQ ID NO: 3452132 - DNA, 15 bp, Homo sapiens
ctccccagcccagag

SEQ ID NO: 3452133 - DNA, 16 bp, Homo sapiens
ctccccagcccagaga

SEQ ID NO: 3452134 - DNA, 17 bp, Homo sapiens
ctccccaggactcaccc

SEQ ID NO: 3452135 - DNA, 16 bp, Homo sapiens
ctccccaggtccagct

SEQ ID NO: 3452136 - DNA, 20 bp, Homo sapiens
ctccccaggtccagctctgg

SEQ ID NO: 3452137 - DNA, 16 bp, Homo sapiens
ctccccattagctttc

SEQ ID NO: 3452138 - DNA, 16 bp, Homo sapiens
ctccccattcacagag

SEQ ID NO: 3452139 - DNA, 17 bp, Homo sapiens
ctccccattcagacact

SEQ ID NO: 3452140 - DNA, 16 bp, Homo sapiens
ctcccccaggcctgag

SEQ ID NO: 3452141 - DNA, 19 bp, Homo sapiens
ctcccccaggcctgagctg

SEQ ID NO: 3452142 - DNA, 23 bp, Homo sapiens
ctcccccaggcctgagctgcttc

SEQ ID NO: 3452143 - DNA, 18 bp, Homo sapiens
ctcccccctcctctgaaa

SEQ ID NO: 3452144 - DNA, 23 bp, Homo sapiens
ctcccccctcctctgaaacagct

SEQ ID NO: 3452145 - DNA, 15 bp, Homo sapiens
ctcccctccaacctg

SEQ ID NO: 3452146 - DNA, 16 bp, Homo sapiens
ctcccctctccttcct

SEQ ID NO: 3452147 - DNA, 23 bp, Homo sapiens
ctcccctctgaaagttgtacatg

SEQ ID NO: 3452148 - DNA, 14 bp, Homo sapiens
ctcccctcttctga

SEQ ID NO: 3452149 - DNA, 17 bp, Homo sapiens
ctcccctcttctgagct

SEQ ID NO: 3452150 - DNA, 14 bp, Homo sapiens
ctcccctgccccca

SEQ ID NO: 3452151 - DNA, 20 bp, Homo sapiens
ctcccctgcccccaggactg

SEQ ID NO: 3452152 - DNA, 23 bp, Homo sapiens
ctccccttgatttaaacacacag

SEQ ID NO: 3452153 - DNA, 23 bp, Homo sapiens
ctcccgaatagctgggactacag

SEQ ID NO: 3452154 - DNA, 15 bp, Homo sapiens
ctcccgagtagctgg

SEQ ID NO: 3452155 - DNA, 18 bp, Homo sapiens
ctccctatactgcttgga

SEQ ID NO: 3452156 - DNA, 21 bp, Homo sapiens
ctccctatactgcttggagct

SEQ ID NO: 3452157 - DNA, 16 bp, Homo sapiens
ctccctccccgtctca

SEQ ID NO: 3452158 - DNA, 21 bp, Homo sapiens
ctccctcctggagctctgtgg

SEQ ID NO: 3452159 - DNA, 12 bp, Homo sapiens
ctccctgaccct

SEQ ID NO: 3452160 - DNA, 16 bp, Homo sapiens
ctccctgaccctgtat

SEQ ID NO: 3452161 - DNA, 17 bp, Homo sapiens
ctccctgaccctgtata

SEQ ID NO: 3452162 - DNA, 14 bp, Homo sapiens
ctccctgacttttc

SEQ ID NO: 3452163 - DNA, 20 bp, Homo sapiens
ctccctgcactccctcctgg

SEQ ID NO: 3452164 - DNA, 20 bp, Homo sapiens
ctccctgcatctgaccagca

SEQ ID NO: 3452165 - DNA, 15 bp, Homo sapiens
ctccctgcctccagg

SEQ ID NO: 3452166 - DNA, 16 bp, Homo sapiens
ctccctgcctccagga

SEQ ID NO: 3452167 - DNA, 20 bp, Homo sapiens
ctccctgcttaaaaatgtag

SEQ ID NO: 3452168 - DNA, 13 bp, Homo sapiens
ctccctggcttct

SEQ ID NO: 3452169 - DNA, 18 bp, Homo sapiens
ctccctggcttctgtggg

SEQ ID NO: 3452170 - DNA, 22 bp, Homo sapiens
ctcccttgcctttcgaggcctg

SEQ ID NO: 3452171 - DNA, 15 bp, Homo sapiens
ctccctttctcccct

SEQ ID NO: 3452172 - DNA, 14 bp, Homo sapiens
ctccctttttacac

SEQ ID NO: 3452173 - DNA, 16 bp, Homo sapiens
ctccctttttacactt

SEQ ID NO: 3452174 - DNA, 14 bp, Homo sapiens
ctccgagaggtggg

SEQ ID NO: 3452175 - DNA, 15 bp, Homo sapiens
ctccgagaggtgggc

SEQ ID NO: 3452176 - DNA, 18 bp, Homo sapiens
ctccgagaggtgggccag

SEQ ID NO: 3452177 - DNA, 22 bp, Homo sapiens
ctccgagaggtgggccagtctg

SEQ ID NO: 3452178 - DNA, 18 bp, Homo sapiens
ctccgagtgaactggtct

SEQ ID NO: 3452179 - DNA, 12 bp, Homo sapiens
ctccgcaggact

SEQ ID NO: 3452180 - DNA, 14 bp, Homo sapiens
ctccgccttcacat

SEQ ID NO: 3452181 - DNA, 13 bp, Homo sapiens
ctccgctgtggga

SEQ ID NO: 3452182 - DNA, 22 bp, Homo sapiens
ctccgctttctacccagcgagc

SEQ ID NO: 3452183 - DNA, 23 bp, Homo sapiens
ctccgctttctacccagcgagcc

SEQ ID NO: 3452184 - DNA, 16 bp, Homo sapiens
ctccggactggtgccc

SEQ ID NO: 3452185 - DNA, 15 bp, Homo sapiens
ctccggctcccagcc

SEQ ID NO: 3452186 - DNA, 17 bp, Homo sapiens
ctccggctcccagcctc

SEQ ID NO: 3452187 - DNA, 19 bp, Homo sapiens
ctccggctcccagcctcag

SEQ ID NO: 3452188 - DNA, 20 bp, Homo sapiens
ctccggctcccagcctcagc

SEQ ID NO: 3452189 - DNA, 14 bp, Homo sapiens
ctccggctgtgctg

SEQ ID NO: 3452190 - DNA, 21 bp, Homo sapiens
ctccggctgtgctgggagaaa

SEQ ID NO: 3452191 - DNA, 17 bp, Homo sapiens
ctccgtcccccaaacat

SEQ ID NO: 3452192 - DNA, 13 bp, Homo sapiens
ctccgtggcacat

SEQ ID NO: 3452193 - DNA, 21 bp, Homo sapiens
ctccgttagctcctgtggccc

SEQ ID NO: 3452194 - DNA, 22 bp, Homo sapiens
ctccgttagctcctgtggcccc

SEQ ID NO: 3452195 - DNA, 12 bp, Homo sapiens
ctccgttggcca

SEQ ID NO: 3452196 - DNA, 18 bp, Homo sapiens
ctcctactccagtatgac

SEQ ID NO: 3452197 - DNA, 17 bp, Homo sapiens
ctcctatatatttctat

SEQ ID NO: 3452198 - DNA, 18 bp, Homo sapiens
ctcctatatatttctatt

SEQ ID NO: 3452199 - DNA, 21 bp, Homo sapiens
ctcctcacaacatggtgtctg

SEQ ID NO: 3452200 - DNA, 17 bp, Homo sapiens
ctcctcactcaccttca

SEQ ID NO: 3452201 - DNA, 17 bp, Homo sapiens
ctcctcaggcacacagc

SEQ ID NO: 3452202 - DNA, 18 bp, Homo sapiens
ctcctcaggcacacagct

SEQ ID NO: 3452203 - DNA, 19 bp, Homo sapiens
ctcctcaggcacacagcta

SEQ ID NO: 3452204 - DNA, 20 bp, Homo sapiens
ctcctcatccagggctctga

SEQ ID NO: 3452205 - DNA, 17 bp, Homo sapiens
ctcctccactctccccc

SEQ ID NO: 3452206 - DNA, 15 bp, Homo sapiens
ctcctccagccgcca

SEQ ID NO: 3452207 - DNA, 22 bp, Homo sapiens
ctcctccagccgccatgctcct

SEQ ID NO: 3452208 - DNA, 21 bp, Homo sapiens
ctcctccagggtgattttatg

SEQ ID NO: 3452209 - DNA, 15 bp, Homo sapiens
ctcctccatgggaga

SEQ ID NO: 3452210 - DNA, 11 bp, Homo sapiens
ctcctcccata

SEQ ID NO: 3452211 - DNA, 22 bp, Homo sapiens
ctcctccctaatgctcaccttt

SEQ ID NO: 3452212 - DNA, 18 bp, Homo sapiens
ctcctccctgcatctgac

SEQ ID NO: 3452213 - DNA, 14 bp, Homo sapiens
ctcctccgtggcac

SEQ ID NO: 3452214 - DNA, 15 bp, Homo sapiens
ctcctccgtggcaca

SEQ ID NO: 3452215 - DNA, 20 bp, Homo sapiens
ctcctcgacatcactgttca

SEQ ID NO: 3452216 - DNA, 17 bp, Homo sapiens
ctcctcgcaagctgggt

SEQ ID NO: 3452217 - DNA, 13 bp, Homo sapiens
ctcctctcagtac

SEQ ID NO: 3452218 - DNA, 15 bp, Homo sapiens
ctcctctcagtgttt

SEQ ID NO: 3452219 - DNA, 21 bp, Homo sapiens
ctcctctccattttagcccag

SEQ ID NO: 3452220 - DNA, 20 bp, Homo sapiens
ctcctctccccagcccagag

SEQ ID NO: 3452221 - DNA, 16 bp, Homo sapiens
ctcctctgaaacagct

SEQ ID NO: 3452222 - DNA, 22 bp, Homo sapiens
ctcctctgaaacagctgcctta

SEQ ID NO: 3452223 - DNA, 17 bp, Homo sapiens
ctcctgcacttacttgc

SEQ ID NO: 3452224 - DNA, 20 bp, Homo sapiens
ctcctgcacttacttgctta

SEQ ID NO: 3452225 - DNA, 14 bp, Homo sapiens
ctcctgccaccagc

SEQ ID NO: 3452226 - DNA, 15 bp, Homo sapiens
ctcctgccaccagca

SEQ ID NO: 3452227 - DNA, 19 bp, Homo sapiens
ctcctgccaccagcatcca

SEQ ID NO: 3452228 - DNA, 14 bp, Homo sapiens
ctcctgcccacctg

SEQ ID NO: 3452229 - DNA, 17 bp, Homo sapiens
ctcctgcccacggagtc

SEQ ID NO: 3452230 - DNA, 20 bp, Homo sapiens
ctcctgcccgcagacctctg

SEQ ID NO: 3452231 - DNA, 23 bp, Homo sapiens
ctcctgcccgcagacctctggat

SEQ ID NO: 3452232 - DNA, 18 bp, Homo sapiens
ctcctgccgcagagctgg

SEQ ID NO: 3452233 - DNA, 16 bp, Homo sapiens
ctcctgcctcagcctc

SEQ ID NO: 3452234 - DNA, 16 bp, Homo sapiens
ctcctgccttcctcct

SEQ ID NO: 3452235 - DNA, 18 bp, Homo sapiens
ctcctgccttcctcctgg

SEQ ID NO: 3452236 - DNA, 19 bp, Homo sapiens
ctcctgccttcctcctggg

SEQ ID NO: 3452237 - DNA, 18 bp, Homo sapiens
ctcctgctactctgttcc

SEQ ID NO: 3452238 - DNA, 15 bp, Homo sapiens
ctcctggagttgcat

SEQ ID NO: 3452239 - DNA, 19 bp, Homo sapiens
ctcctggcctcaagtgatt

SEQ ID NO: 3452240 - DNA, 14 bp, Homo sapiens
ctcctgggccctct

SEQ ID NO: 3452241 - DNA, 13 bp, Homo sapiens
ctcctgggctcag

SEQ ID NO: 3452242 - DNA, 17 bp, Homo sapiens
ctcctgtactttttcca

SEQ ID NO: 3452243 - DNA, 12 bp, Homo sapiens
ctcctgtcctcc

SEQ ID NO: 3452244 - DNA, 18 bp, Homo sapiens
ctcctgtcctccctcacc

SEQ ID NO: 3452245 - DNA, 20 bp, Homo sapiens
ctcctgtggccccaccctgg

SEQ ID NO: 3452246 - DNA, 15 bp, Homo sapiens
ctcctgtgtcttgca

SEQ ID NO: 3452247 - DNA, 11 bp, Homo sapiens
ctcctgtgtgt

SEQ ID NO: 3452248 - DNA, 19 bp, Homo sapiens
ctcctgtgtgtgcgcctac

SEQ ID NO: 3452249 - DNA, 20 bp, Homo sapiens
ctcctgtgtgtgcgcctaca

SEQ ID NO: 3452250 - DNA, 17 bp, Homo sapiens
ctccttaacactgagct

SEQ ID NO: 3452251 - DNA, 19 bp, Homo sapiens
ctccttagacctgagggac

SEQ ID NO: 3452252 - DNA, 19 bp, Homo sapiens
ctccttcaccacccccacg

SEQ ID NO: 3452253 - DNA, 20 bp, Homo sapiens
ctccttcaccacccccacga

SEQ ID NO: 3452254 - DNA, 13 bp, Homo sapiens
ctccttcagacac

SEQ ID NO: 3452255 - DNA, 14 bp, Homo sapiens
ctccttcagacacc

SEQ ID NO: 3452256 - DNA, 19 bp, Homo sapiens
ctccttcagacaccctcaa

SEQ ID NO: 3452257 - DNA, 15 bp, Homo sapiens
ctccttcagccctca

SEQ ID NO: 3452258 - DNA, 17 bp, Homo sapiens
ctccttcagccctcacc

SEQ ID NO: 3452259 - DNA, 14 bp, Homo sapiens
ctccttccaacagg

SEQ ID NO: 3452260 - DNA, 17 bp, Homo sapiens
ctagaggaaaagaaaga

SEQ ID NO: 3452261 - DNA, 19 bp, Homo sapiens
ctagaggaaccaaccccca

SEQ ID NO: 3452262 - DNA, 18 bp, Homo sapiens
ctagaggctcatggccct

SEQ ID NO: 3452263 - DNA, 16 bp, Homo sapiens
ctagaggctgagcacc

SEQ ID NO: 3452264 - DNA, 18 bp, Homo sapiens
ctagagggacctctccca

SEQ ID NO: 3452265 - DNA, 22 bp, Homo sapiens
ctagaggggggatttccagcca

SEQ ID NO: 3452266 - DNA, 17 bp, Homo sapiens
ctagagtagagtggagg

SEQ ID NO: 3452267 - DNA, 15 bp, Homo sapiens
ctagatacaataaat

SEQ ID NO: 3452268 - DNA, 24 bp, Homo sapiens
ctagatacctaaaacataagatca

SEQ ID NO: 3452269 - DNA, 15 bp, Homo sapiens
ctagatggctcctct

SEQ ID NO: 3452270 - DNA, 18 bp, Homo sapiens
ctagatggctcctctcag

SEQ ID NO: 3452271 - DNA, 13 bp, Homo sapiens
ctagatggtgctg

SEQ ID NO: 3452272 - DNA, 14 bp, Homo sapiens
ctagatggtgctga

SEQ ID NO: 3452273 - DNA, 19 bp, Homo sapiens
ctagattttcacttatgaa

SEQ ID NO: 3452274 - DNA, 21 bp, Homo sapiens
ctagcaagctgccgaaccaaa

SEQ ID NO: 3452275 - DNA, 22 bp, Homo sapiens
ctagcaccattttaagtccctg

SEQ ID NO: 3452276 - DNA, 17 bp, Homo sapiens
ctagcactttgggaggc

SEQ ID NO: 3452277 - DNA, 12 bp, Homo sapiens
ctagcagcaccg

SEQ ID NO: 3452278 - DNA, 20 bp, Homo sapiens
ctagcagcaccgttctgtgc

SEQ ID NO: 3452279 - DNA, 12 bp, Homo sapiens
ctagcagctgca

SEQ ID NO: 3452280 - DNA, 20 bp, Homo sapiens
ctagcaggcacaggacacct

SEQ ID NO: 3452281 - DNA, 21 bp, Homo sapiens
ctagccctctccctctaggct

SEQ ID NO: 3452282 - DNA, 20 bp, Homo sapiens
ctagcctgatgagattttta

SEQ ID NO: 3452283 - DNA, 22 bp, Homo sapiens
ctagcggagttccagcaaacaa

SEQ ID NO: 3452284 - DNA, 15 bp, Homo sapiens
ctagctaaaccagaa

SEQ ID NO: 3452285 - DNA, 19 bp, Homo sapiens
ctagctctatgtttacaaa

SEQ ID NO: 3452286 - DNA, 12 bp, Homo sapiens
ctagctctttga

SEQ ID NO: 3452287 - DNA, 12 bp, Homo sapiens
ctagctgggggt

SEQ ID NO: 3452288 - DNA, 18 bp, Homo sapiens
ctagctgggggtgggcca

SEQ ID NO: 3452289 - DNA, 22 bp, Homo sapiens
ctaggacccctccatgtgggct

SEQ ID NO: 3452290 - DNA, 19 bp, Homo sapiens
ctaggcaaaattgtgaagc

SEQ ID NO: 3452291 - DNA, 22 bp, Homo sapiens
ctaggcaggacatgctgaagcc

SEQ ID NO: 3452292 - DNA, 21 bp, Homo sapiens
ctaggcatttgctgaatacag

SEQ ID NO: 3452293 - DNA, 15 bp, Homo sapiens
ctaggcccccacttg

SEQ ID NO: 3452294 - DNA, 22 bp, Homo sapiens
ctaggcccccacttgcctcttc

SEQ ID NO: 3452295 - DNA, 16 bp, Homo sapiens
ctaggcccctgccctg

SEQ ID NO: 3452296 - DNA, 17 bp, Homo sapiens
ctaggcctcctggccca

SEQ ID NO: 3452297 - DNA, 13 bp, Homo sapiens
ctaggcctggcca

SEQ ID NO: 3452298 - DNA, 15 bp, Homo sapiens
ctaggctctgccttc

SEQ ID NO: 3452299 - DNA, 13 bp, Homo sapiens
ctaggctgccccg

SEQ ID NO: 3452300 - DNA, 15 bp, Homo sapiens
ctaggctggagccca

SEQ ID NO: 3452301 - DNA, 19 bp, Homo sapiens
ctagggaaaaaccagcgtg

SEQ ID NO: 3452302 - DNA, 14 bp, Homo sapiens
ctagggaagataat

SEQ ID NO: 3452303 - DNA, 13 bp, Homo sapiens
ctagggatccctc

SEQ ID NO: 3452304 - DNA, 15 bp, Homo sapiens
ctagggccactgaag

SEQ ID NO: 3452305 - DNA, 14 bp, Homo sapiens
ctaggtcataaaga

SEQ ID NO: 3452306 - DNA, 18 bp, Homo sapiens
ctaggtgacagagtgaga

SEQ ID NO: 3452307 - DNA, 13 bp, Homo sapiens
ctaggtgcagctc

SEQ ID NO: 3452308 - DNA, 18 bp, Homo sapiens
ctaggtgcagctcctcag

SEQ ID NO: 3452309 - DNA, 19 bp, Homo sapiens
ctaggtgcagctcctcagc

SEQ ID NO: 3452310 - DNA, 22 bp, Homo sapiens
ctaggtgcccttggaggccagc

SEQ ID NO: 3452311 - DNA, 23 bp, Homo sapiens
ctaggtggcaaggctgtgctccc

SEQ ID NO: 3452312 - DNA, 17 bp, Homo sapiens
ctagtgaaggcttctct

SEQ ID NO: 3452313 - DNA, 21 bp, Homo sapiens
ctagtgctttccttttttaaa

SEQ ID NO: 3452314 - DNA, 15 bp, Homo sapiens
ctagtggggtttcct

SEQ ID NO: 3452315 - DNA, 18 bp, Homo sapiens
ctagtggggtttcctggc

SEQ ID NO: 3452316 - DNA, 22 bp, Homo sapiens
ctagtgtaacactgcaagaagt

SEQ ID NO: 3452317 - DNA, 21 bp, Homo sapiens
ctagtgtacctcctctcagtg

SEQ ID NO: 3452318 - DNA, 14 bp, Homo sapiens
ctagttctgtagaa

SEQ ID NO: 3452319 - DNA, 15 bp, Homo sapiens
ctagttggttgaatt

SEQ ID NO: 3452320 - DNA, 16 bp, Homo sapiens
ctagttggttgaattt

SEQ ID NO: 3452321 - DNA, 17 bp, Homo sapiens
ctagttggttgaatttt

SEQ ID NO: 3452322 - DNA, 20 bp, Homo sapiens
ctagttttagttttctctta

SEQ ID NO: 3452323 - DNA, 16 bp, Homo sapiens
ctagttttctttcctc

SEQ ID NO: 3452324 - DNA, 18 bp, Homo sapiens
ctagttttctttcctcct

SEQ ID NO: 3452325 - DNA, 15 bp, Homo sapiens
ctataaaaaatatgt

SEQ ID NO: 3452326 - DNA, 15 bp, Homo sapiens
ctataaaagctttct

SEQ ID NO: 3452327 - DNA, 23 bp, Homo sapiens
ctataaattcctctttgctttgc

SEQ ID NO: 3452328 - DNA, 23 bp, Homo sapiens
ctataagattccaaaaagcacat

SEQ ID NO: 3452329 - DNA, 12 bp, Homo sapiens
ctataatttaaa

SEQ ID NO: 3452330 - DNA, 15 bp, Homo sapiens
ctatacatatcttta

SEQ ID NO: 3452331 - DNA, 14 bp, Homo sapiens
ctatacctgtgcct

SEQ ID NO: 3452332 - DNA, 19 bp, Homo sapiens
ctatagcctaggtgacaga

SEQ ID NO: 3452333 - DNA, 20 bp, Homo sapiens
ctatagcctaggtgacagag

SEQ ID NO: 3452334 - DNA, 14 bp, Homo sapiens
ctatagcctggggt

SEQ ID NO: 3452335 - DNA, 15 bp, Homo sapiens
ctataggtccagaag

SEQ ID NO: 3452336 - DNA, 23 bp, Homo sapiens
ctatagtatttgattcaaaatat

SEQ ID NO: 3452337 - DNA, 22 bp, Homo sapiens
ctatatagtttattgacaataa

SEQ ID NO: 3452338 - DNA, 13 bp, Homo sapiens
ctatatatttcta

SEQ ID NO: 3452339 - DNA, 15 bp, Homo sapiens
ctatatgcagtctct

SEQ ID NO: 3452340 - DNA, 17 bp, Homo sapiens
ctatatgcagtctcttt

SEQ ID NO: 3452341 - DNA, 20 bp, Homo sapiens
ctatatgcagtctctttatt

SEQ ID NO: 3452342 - DNA, 14 bp, Homo sapiens
ctatattttgtcat

SEQ ID NO: 3452343 - DNA, 15 bp, Homo sapiens
ctatattttgtcata

SEQ ID NO: 3452344 - DNA, 16 bp, Homo sapiens
ctatattttgtcatat

SEQ ID NO: 3452345 - DNA, 16 bp, Homo sapiens
ctatcacctatttcca

SEQ ID NO: 3452346 - DNA, 22 bp, Homo sapiens
ctatcatggtgaaaagctccat

SEQ ID NO: 3452347 - DNA, 17 bp, Homo sapiens
ctatcatttaataatat

SEQ ID NO: 3452348 - DNA, 17 bp, Homo sapiens
ctatccgtgttgcaggt

SEQ ID NO: 3452349 - DNA, 15 bp, Homo sapiens
ctatcctgctgttct

SEQ ID NO: 3452350 - DNA, 17 bp, Homo sapiens
ctatctactctcctcat

SEQ ID NO: 3452351 - DNA, 11 bp, Homo sapiens
ctatctgtctg

SEQ ID NO: 3452352 - DNA, 16 bp, Homo sapiens
ctatgaagacttaaaa

SEQ ID NO: 3452353 - DNA, 15 bp, Homo sapiens
ctatgaatgctttgc

SEQ ID NO: 3452354 - DNA, 15 bp, Homo sapiens
ctatgataattacaa

SEQ ID NO: 3452355 - DNA, 17 bp, Homo sapiens
ctatgcagaggcctggg

SEQ ID NO: 3452356 - DNA, 20 bp, Homo sapiens
ctatgcatggtgccccagga

SEQ ID NO: 3452357 - DNA, 20 bp, Homo sapiens
ctatgctattgacaataaaa

SEQ ID NO: 3452358 - DNA, 17 bp, Homo sapiens
ctatgctttccaaacct

SEQ ID NO: 3452359 - DNA, 19 bp, Homo sapiens
ctatggacggtgctccagg

SEQ ID NO: 3452360 - DNA, 14 bp, Homo sapiens
ctatggcagtccag

SEQ ID NO: 3452361 - DNA, 19 bp, Homo sapiens
ctatggcagtccagccagc

SEQ ID NO: 3452362 - DNA, 20 bp, Homo sapiens
ctatggcagtccagccagct

SEQ ID NO: 3452363 - DNA, 19 bp, Homo sapiens
ctatggctgcctgcatcta

SEQ ID NO: 3452364 - DNA, 22 bp, Homo sapiens
ctatgggactcaatgcactgac

SEQ ID NO: 3452365 - DNA, 23 bp, Homo sapiens
ctatgggactcaatgcactgaca

SEQ ID NO: 3452366 - DNA, 13 bp, Homo sapiens
ctatgggcctgcc

SEQ ID NO: 3452367 - DNA, 23 bp, Homo sapiens
ctatgggcctgccgggctgaggg

SEQ ID NO: 3452368 - DNA, 22 bp, Homo sapiens
ctatgtaacatgtaggaagtag

SEQ ID NO: 3452369 - DNA, 18 bp, Homo sapiens
ctatgtagtggttttagg

SEQ ID NO: 3452370 - DNA, 21 bp, Homo sapiens
ctatgtctagagcctcttggg

SEQ ID NO: 3452371 - DNA, 11 bp, Homo sapiens
ctatgtgattt

SEQ ID NO: 3452372 - DNA, 20 bp, Homo sapiens
ctatgtgattttaactctgt

SEQ ID NO: 3452373 - DNA, 17 bp, Homo sapiens
ctatgtggctgtatctt

SEQ ID NO: 3452374 - DNA, 22 bp, Homo sapiens
ctatgtgtagggcgggaggatg

SEQ ID NO: 3452375 - DNA, 22 bp, Homo sapiens
ctatgttgatccatccagcttg

SEQ ID NO: 3452376 - DNA, 14 bp, Homo sapiens
ctatgttgcccagg

SEQ ID NO: 3452377 - DNA, 15 bp, Homo sapiens
ctatgttgcccaggc

SEQ ID NO: 3452378 - DNA, 17 bp, Homo sapiens
ctatgttgcccaggcag

SEQ ID NO: 3452379 - DNA, 13 bp, Homo sapiens
ctatgttgtaatt

SEQ ID NO: 3452380 - DNA, 20 bp, Homo sapiens
ctatgtttacaaatggacat

SEQ ID NO: 3452381 - DNA, 19 bp, Homo sapiens
ctattaaggatgtagcttt

SEQ ID NO: 3452382 - DNA, 21 bp, Homo sapiens
ctattaaggtgatatatttaa

SEQ ID NO: 3452383 - DNA, 16 bp, Homo sapiens
ctattagccacaaaat

SEQ ID NO: 3452384 - DNA, 15 bp, Homo sapiens
ctattccaaaaaggt

SEQ ID NO: 3452385 - DNA, 14 bp, Homo sapiens
ctattcctaggagg

SEQ ID NO: 3452386 - DNA, 12 bp, Homo sapiens
ctattgacaata

SEQ ID NO: 3452387 - DNA, 15 bp, Homo sapiens
ctattgacaataaaa

SEQ ID NO: 3452388 - DNA, 18 bp, Homo sapiens
ctattgacaataaaatat

SEQ ID NO: 3452389 - DNA, 16 bp, Homo sapiens
ctattgaccaccagtt

SEQ ID NO: 3452390 - DNA, 12 bp, Homo sapiens
ctattgcccagg

SEQ ID NO: 3452391 - DNA, 9 bp, Homo sapiens
ctatttaag

SEQ ID NO: 3452392 - DNA, 21 bp, Homo sapiens
ctatttaattaggaaaaaaac

SEQ ID NO: 3452393 - DNA, 19 bp, Homo sapiens
ctatttattgactctgggt

SEQ ID NO: 3452394 - DNA, 15 bp, Homo sapiens
ctatttatttactga

SEQ ID NO: 3452395 - DNA, 18 bp, Homo sapiens
ctatttatttactgagct

SEQ ID NO: 3452396 - DNA, 21 bp, Homo sapiens
ctatttcagtgttacctgtgt

SEQ ID NO: 3452397 - DNA, 18 bp, Homo sapiens
ctatttcttaaacacttg

SEQ ID NO: 3452398 - DNA, 16 bp, Homo sapiens
ctattttaatttgtat

SEQ ID NO: 3452399 - DNA, 20 bp, Homo sapiens
ctattttaatttgtattgaa

SEQ ID NO: 3452400 - DNA, 20 bp, Homo sapiens
ctatttttctctcctgtcct

SEQ ID NO: 3452401 - DNA, 20 bp, Homo sapiens
ctattttttacttgttttcg

SEQ ID NO: 3452402 - DNA, 21 bp, Homo sapiens
ctattttttacttgttttcgg

SEQ ID NO: 3452403 - DNA, 23 bp, Homo sapiens
ctattttttgacacttccattgt

SEQ ID NO: 3452404 - DNA, 19 bp, Homo sapiens
ctcaaaaaacattgttttg

SEQ ID NO: 3452405 - DNA, 16 bp, Homo sapiens
ctcaaacactgcaggc

SEQ ID NO: 3452406 - DNA, 13 bp, Homo sapiens
ctcaaagagggtg

SEQ ID NO: 3452407 - DNA, 17 bp, Homo sapiens
ctcaaagagggtgaggg

SEQ ID NO: 3452408 - DNA, 16 bp, Homo sapiens
ctcaaatgctcagacc

SEQ ID NO: 3452409 - DNA, 15 bp, Homo sapiens
ctcaaatggggccag

SEQ ID NO: 3452410 - DNA, 22 bp, Homo sapiens
ctcaaccccaccatatgaattg

SEQ ID NO: 3452411 - DNA, 13 bp, Homo sapiens
ctcaacctcctgg

SEQ ID NO: 3452412 - DNA, 13 bp, Homo sapiens
ctcaacctcttct

SEQ ID NO: 3452413 - DNA, 18 bp, Homo sapiens
ctcaacctcttctggctc

SEQ ID NO: 3452414 - DNA, 17 bp, Homo sapiens
ctcaaccttggccttct

SEQ ID NO: 3452415 - DNA, 18 bp, Homo sapiens
ctcaaccttggccttctc

SEQ ID NO: 3452416 - DNA, 19 bp, Homo sapiens
ctcaaccttggccttctcc

SEQ ID NO: 3452417 - DNA, 22 bp, Homo sapiens
ctcaaccttggccttctcccct

SEQ ID NO: 3452418 - DNA, 15 bp, Homo sapiens
ctcaactcctcccat

SEQ ID NO: 3452419 - DNA, 22 bp, Homo sapiens
ctcaagaaataaaaggaagcca

SEQ ID NO: 3452420 - DNA, 23 bp, Homo sapiens
ctcaagaaataaaaggaagccaa

SEQ ID NO: 3452421 - DNA, 17 bp, Homo sapiens
ctcaagatgacagctct

SEQ ID NO: 3452422 - DNA, 21 bp, Homo sapiens
ctcaagatgggggcagggctg

SEQ ID NO: 3452423 - DNA, 22 bp, Homo sapiens
ctcaagccaagcagccaagctc

SEQ ID NO: 3452424 - DNA, 17 bp, Homo sapiens
ctcaagcgattctcctg

SEQ ID NO: 3452425 - DNA, 23 bp, Homo sapiens
ctcaaggaataatgggcttagag

SEQ ID NO: 3452426 - DNA, 17 bp, Homo sapiens
ctcaaggcggtgcttga

SEQ ID NO: 3452427 - DNA, 18 bp, Homo sapiens
ctcaagtgattctcctgc

SEQ ID NO: 3452428 - DNA, 20 bp, Homo sapiens
ctcaatggaaacatcactgg

SEQ ID NO: 3452429 - DNA, 19 bp, Homo sapiens
ctcaattgtgctttgtatc

SEQ ID NO: 3452430 - DNA, 20 bp, Homo sapiens
ctcacaacctgaacctagga

SEQ ID NO: 3452431 - DNA, 21 bp, Homo sapiens
ctcacaatagccgatatcaga

SEQ ID NO: 3452432 - DNA, 23 bp, Homo sapiens
ctcacacggacactcaaaagctg

SEQ ID NO: 3452433 - DNA, 12 bp, Homo sapiens
ctcacactgaga

SEQ ID NO: 3452434 - DNA, 14 bp, Homo sapiens
ctcacactgagaat

SEQ ID NO: 3452435 - DNA, 20 bp, Homo sapiens
ctcacacttactgtaagaca

SEQ ID NO: 3452436 - DNA, 21 bp, Homo sapiens
ctcacacttactgtaagacat

SEQ ID NO: 3452437 - DNA, 22 bp, Homo sapiens
ctcacacttactgtaagacatt

SEQ ID NO: 3452438 - DNA, 17 bp, Homo sapiens
ctcaccagccccagtgc

SEQ ID NO: 3452439 - DNA, 11 bp, Homo sapiens
ctcaccagctg

SEQ ID NO: 3452440 - DNA, 13 bp, Homo sapiens
ctcaccagctgca

SEQ ID NO: 3452441 - DNA, 17 bp, Homo sapiens
ctcaccagctgcaaagt

SEQ ID NO: 3452442 - DNA, 20 bp, Homo sapiens
ctcaccagctgcaaagtgtt

SEQ ID NO: 3452443 - DNA, 19 bp, Homo sapiens
ctcacccataataaaggtt

SEQ ID NO: 3452444 - DNA, 22 bp, Homo sapiens
ctcaccccatcccacaccctgg

SEQ ID NO: 3452445 - DNA, 19 bp, Homo sapiens
ctcacccccttctccatcc

SEQ ID NO: 3452446 - DNA, 16 bp, Homo sapiens
ctcaccctcataccat

SEQ ID NO: 3452447 - DNA, 21 bp, Homo sapiens
ctcaccgtggctaagagtgtc

SEQ ID NO: 3452448 - DNA, 11 bp, Homo sapiens
ctcacctgggg

SEQ ID NO: 3452449 - DNA, 21 bp, Homo sapiens
ctcacctgtactattgcagac

SEQ ID NO: 3452450 - DNA, 19 bp, Homo sapiens
ctcaccttggcaccagaca

SEQ ID NO: 3452451 - DNA, 14 bp, Homo sapiens
ctcacctttgtttt

SEQ ID NO: 3452452 - DNA, 16 bp, Homo sapiens
ctcacgcacctcccat

SEQ ID NO: 3452453 - DNA, 23 bp, Homo sapiens
ctcacgcctgtaatcccagcact

SEQ ID NO: 3452454 - DNA, 23 bp, Homo sapiens
ctcacgcttacctcaaccatcct

SEQ ID NO: 3452455 - DNA, 15 bp, Homo sapiens
ctcactaatttttgt

SEQ ID NO: 3452456 - DNA, 23 bp, Homo sapiens
ctcactaatttttgtattatttt

SEQ ID NO: 3452457 - DNA, 17 bp, Homo sapiens
ctcactatgttgcccag

SEQ ID NO: 3452458 - DNA, 12 bp, Homo sapiens
ctcactgcagcc

SEQ ID NO: 3452459 - DNA, 13 bp, Homo sapiens
ctcactgcagcct

SEQ ID NO: 3452460 - DNA, 18 bp, Homo sapiens
ctcactgtgttactgctt

SEQ ID NO: 3452461 - DNA, 21 bp, Homo sapiens
ctcactgttgcccaggctggc

SEQ ID NO: 3452462 - DNA, 14 bp, Homo sapiens
ctcacttcaccctg

SEQ ID NO: 3452463 - DNA, 13 bp, Homo sapiens
ctcactttaaacc

SEQ ID NO: 3452464 - DNA, 14 bp, Homo sapiens
ctcagaacccttgg

SEQ ID NO: 3452465 - DNA, 21 bp, Homo sapiens
ctcagaacccttggcttgccc

SEQ ID NO: 3452466 - DNA, 17 bp, Homo sapiens
ctcagaagacactgatg

SEQ ID NO: 3452467 - DNA, 15 bp, Homo sapiens
ctcagaagcctctgg

SEQ ID NO: 3452468 - DNA, 17 bp, Homo sapiens
ctcagaagcctctgggt

SEQ ID NO: 3452469 - DNA, 22 bp, Homo sapiens
ctcagaagggagctagccagag

SEQ ID NO: 3452470 - DNA, 14 bp, Homo sapiens
ctcagaatccaaag

SEQ ID NO: 3452471 - DNA, 20 bp, Homo sapiens
ctcagaatctacccaaagga

SEQ ID NO: 3452472 - DNA, 19 bp, Homo sapiens
ctcagacatgttttccgtg

SEQ ID NO: 3452473 - DNA, 20 bp, Homo sapiens
ctcagacatgttttccgtga

SEQ ID NO: 3452474 - DNA, 13 bp, Homo sapiens
ctcagacattggc

SEQ ID NO: 3452475 - DNA, 16 bp, Homo sapiens
ctcagagacaggtggc

SEQ ID NO: 3452476 - DNA, 19 bp, Homo sapiens
ctcagagacaggtggccta

SEQ ID NO: 3452477 - DNA, 13 bp, Homo sapiens
ctcagagagggca

SEQ ID NO: 3452478 - DNA, 17 bp, Homo sapiens
ctcagaggcgcactgtg

SEQ ID NO: 3452479 - DNA, 18 bp, Homo sapiens
ctcagaggcgcactgtga

SEQ ID NO: 3452480 - DNA, 18 bp, Homo sapiens
ctcagagtatggagctca

SEQ ID NO: 3452481 - DNA, 17 bp, Homo sapiens
ctcagagtcggaacgga

SEQ ID NO: 3452482 - DNA, 22 bp, Homo sapiens
ctcagataaggtaaaatgccat

SEQ ID NO: 3452483 - DNA, 22 bp, Homo sapiens
ctcagatccagggacagaggcc

SEQ ID NO: 3452484 - DNA, 21 bp, Homo sapiens
ctcagatggaaccgcaggaag

SEQ ID NO: 3452485 - DNA, 22 bp, Homo sapiens
ctcagatggaaccgcaggaagc

SEQ ID NO: 3452486 - DNA, 23 bp, Homo sapiens
ctcagatggaaccgcaggaagct

SEQ ID NO: 3452487 - DNA, 20 bp, Homo sapiens
ctcagcacaaggccatctgg

SEQ ID NO: 3452488 - DNA, 15 bp, Homo sapiens
ctcagcatcctggca

SEQ ID NO: 3452489 - DNA, 22 bp, Homo sapiens
ctcagcatttgattaacatttg

SEQ ID NO: 3452490 - DNA, 12 bp, Homo sapiens
ctcagccagaga

SEQ ID NO: 3452491 - DNA, 14 bp, Homo sapiens
ctcagccagagaag

SEQ ID NO: 3452492 - DNA, 11 bp, Homo sapiens
ctcagccagca

SEQ ID NO: 3452493 - DNA, 13 bp, Homo sapiens
ctcagccctgacc

SEQ ID NO: 3452494 - DNA, 14 bp, Homo sapiens
ctcagccctgaccc

SEQ ID NO: 3452495 - DNA, 22 bp, Homo sapiens
ctcagcctactccgctcactga

SEQ ID NO: 3452496 - DNA, 14 bp, Homo sapiens
ctcagcctcccaaa

SEQ ID NO: 3452497 - DNA, 19 bp, Homo sapiens
ctcagcctcccgaatagct

SEQ ID NO: 3452498 - DNA, 21 bp, Homo sapiens
ctcagcctcccgaatagctgg

SEQ ID NO: 3452499 - DNA, 15 bp, Homo sapiens
ctcagcctggccaga

SEQ ID NO: 3452500 - DNA, 19 bp, Homo sapiens
ctcagcctggccagacaca

SEQ ID NO: 3452501 - DNA, 17 bp, Homo sapiens
ctcagccttcagacaga

SEQ ID NO: 3452502 - DNA, 17 bp, Homo sapiens
ctcagccttgccagaga

SEQ ID NO: 3452503 - DNA, 19 bp, Homo sapiens
ctcagccttgccagagatc

SEQ ID NO: 3452504 - DNA, 16 bp, Homo sapiens
ctcagcgcggccctcc

SEQ ID NO: 3452505 - DNA, 16 bp, Homo sapiens
ctcagcggggacagct

SEQ ID NO: 3452506 - DNA, 19 bp, Homo sapiens
ctcagcggggacagctcct

SEQ ID NO: 3452507 - DNA, 23 bp, Homo sapiens
ctcagcgtttttttgtttttaat

SEQ ID NO: 3452508 - DNA, 12 bp, Homo sapiens
ctcagctcccca

SEQ ID NO: 3452509 - DNA, 16 bp, Homo sapiens
ctcagctccccagagt

SEQ ID NO: 3452510 - DNA, 17 bp, Homo sapiens
ctcagctcggctcagct

SEQ ID NO: 3452511 - DNA, 18 bp, Homo sapiens
ctcagctcggctcagctc

SEQ ID NO: 3452512 - DNA, 20 bp, Homo sapiens
ctcagctcttggctccactg

SEQ ID NO: 3452513 - DNA, 14 bp, Homo sapiens
ctcagcttatctct

SEQ ID NO: 3452514 - DNA, 14 bp, Homo sapiens
ctcaggaagaacac

SEQ ID NO: 3452515 - DNA, 19 bp, Homo sapiens
ctcaggacagatgccacac

SEQ ID NO: 3452516 - DNA, 14 bp, Homo sapiens
ctcaggaccaggca

SEQ ID NO: 3452517 - DNA, 18 bp, Homo sapiens
ctcaggagtttgagacca

SEQ ID NO: 3452518 - DNA, 23 bp, Homo sapiens
ctcaggagtttgagaccaacctg

SEQ ID NO: 3452519 - DNA, 13 bp, Homo sapiens
ctcaggcacacag

SEQ ID NO: 3452520 - DNA, 16 bp, Homo sapiens
ctcaggcacacagcta

SEQ ID NO: 3452521 - DNA, 18 bp, Homo sapiens
ctcaggcacacagctact

SEQ ID NO: 3452522 - DNA, 16 bp, Homo sapiens
ctcaggccagagccaa

SEQ ID NO: 3452523 - DNA, 24 bp, Homo sapiens
ctcaggccggcagccccagcctgc

SEQ ID NO: 3452524 - DNA, 17 bp, Homo sapiens
ctcagggaaaagcagct

SEQ ID NO: 3452525 - DNA, 20 bp, Homo sapiens
ctcagggaaaagcagctctc

SEQ ID NO: 3452526 - DNA, 22 bp, Homo sapiens
ctcagggaaaagcagctctccc

SEQ ID NO: 3452527 - DNA, 19 bp, Homo sapiens
ctcagggaaatggccttcc

SEQ ID NO: 3452528 - DNA, 22 bp, Homo sapiens
ctcagggaaatggccttcccgc

SEQ ID NO: 3452529 - DNA, 15 bp, Homo sapiens
ctcagggctcctggg

SEQ ID NO: 3452530 - DNA, 20 bp, Homo sapiens
ctcaggtccctggggctagg

SEQ ID NO: 3452531 - DNA, 20 bp, Homo sapiens
ctcaggtgagaagcagagga

SEQ ID NO: 3452532 - DNA, 21 bp, Homo sapiens
cctcaaacactgcaggcatca

SEQ ID NO: 3452533 - DNA, 15 bp, Homo sapiens
cctcaacctcctggg

SEQ ID NO: 3452534 - DNA, 16 bp, Homo sapiens
cctcaacctcctgggc

SEQ ID NO: 3452535 - DNA, 12 bp, Homo sapiens
cctcaacctctt

SEQ ID NO: 3452536 - DNA, 20 bp, Homo sapiens
cctcaacctcttctggctca

SEQ ID NO: 3452537 - DNA, 16 bp, Homo sapiens
cctcaactcctcccat

SEQ ID NO: 3452538 - DNA, 13 bp, Homo sapiens
cctcaatccagct

SEQ ID NO: 3452539 - DNA, 20 bp, Homo sapiens
cctcacccctggttctcatc

SEQ ID NO: 3452540 - DNA, 23 bp, Homo sapiens
cctcacccctggttctcatcttt

SEQ ID NO: 3452541 - DNA, 16 bp, Homo sapiens
cctcaccttggcacca

SEQ ID NO: 3452542 - DNA, 14 bp, Homo sapiens
cctcacgcacctcc

SEQ ID NO: 3452543 - DNA, 14 bp, Homo sapiens
cctcactaattttt

SEQ ID NO: 3452544 - DNA, 20 bp, Homo sapiens
cctcactcccttcccataag

SEQ ID NO: 3452545 - DNA, 23 bp, Homo sapiens
cctcagaacaaagtgagacagtc

SEQ ID NO: 3452546 - DNA, 16 bp, Homo sapiens
cctcagaacccttggc

SEQ ID NO: 3452547 - DNA, 16 bp, Homo sapiens
cctcagcatcctggca

SEQ ID NO: 3452548 - DNA, 11 bp, Homo sapiens
cctcagccaga

SEQ ID NO: 3452549 - DNA, 15 bp, Homo sapiens
cctcagccagagaag

SEQ ID NO: 3452550 - DNA, 13 bp, Homo sapiens
cctcagccctgac

SEQ ID NO: 3452551 - DNA, 11 bp, Homo sapiens
cctcagcctcc

SEQ ID NO: 3452552 - DNA, 16 bp, Homo sapiens
cctcagcctggccaga

SEQ ID NO: 3452553 - DNA, 22 bp, Homo sapiens
cctcagcctggccagacacagg

SEQ ID NO: 3452554 - DNA, 17 bp, Homo sapiens
cctcagccttgccagag

SEQ ID NO: 3452555 - DNA, 17 bp, Homo sapiens
cctcagctcggctcagc

SEQ ID NO: 3452556 - DNA, 11 bp, Homo sapiens
cctcaggcagg

SEQ ID NO: 3452557 - DNA, 12 bp, Homo sapiens
cctcaggcaggt

SEQ ID NO: 3452558 - DNA, 16 bp, Homo sapiens
cctcaggtgagaagca

SEQ ID NO: 3452559 - DNA, 17 bp, Homo sapiens
cctcaggtgagaagcag

SEQ ID NO: 3452560 - DNA, 22 bp, Homo sapiens
cctcaggtgagaagcagaggaa

SEQ ID NO: 3452561 - DNA, 17 bp, Homo sapiens
cctcaggtgatccaccc

SEQ ID NO: 3452562 - DNA, 22 bp, Homo sapiens
cctcaggtgatccacccacctc

SEQ ID NO: 3452563 - DNA, 14 bp, Homo sapiens
cctcaggtgctgtc

SEQ ID NO: 3452564 - DNA, 16 bp, Homo sapiens
cctcaggtgctgtcca

SEQ ID NO: 3452565 - DNA, 12 bp, Homo sapiens
cctcaggtggcc

SEQ ID NO: 3452566 - DNA, 22 bp, Homo sapiens
cctcagtcccaaatccttccca

SEQ ID NO: 3452567 - DNA, 13 bp, Homo sapiens
cctcagtgtattt

SEQ ID NO: 3452568 - DNA, 14 bp, Homo sapiens
cctcagttgtgcag

SEQ ID NO: 3452569 - DNA, 16 bp, Homo sapiens
cctcagttgtgcagct

SEQ ID NO: 3452570 - DNA, 14 bp, Homo sapiens
cctcataccatctg

SEQ ID NO: 3452571 - DNA, 18 bp, Homo sapiens
cctcataccatctgctgc

SEQ ID NO: 3452572 - DNA, 20 bp, Homo sapiens
cctcatagtatggtggctgg

SEQ ID NO: 3452573 - DNA, 19 bp, Homo sapiens
cctcatctctctgcccaac

SEQ ID NO: 3452574 - DNA, 18 bp, Homo sapiens
cctcatcttcttcaccat

SEQ ID NO: 3452575 - DNA, 17 bp, Homo sapiens
cctcatgacagccagag

SEQ ID NO: 3452576 - DNA, 18 bp, Homo sapiens
cctcatgacagccagagc

SEQ ID NO: 3452577 - DNA, 17 bp, Homo sapiens
cctcatgtggctggaag

SEQ ID NO: 3452578 - DNA, 12 bp, Homo sapiens
cctcattctgaa

SEQ ID NO: 3452579 - DNA, 17 bp, Homo sapiens
cctcatttggggtagct

SEQ ID NO: 3452580 - DNA, 20 bp, Homo sapiens
cctcatttggggtagctaga

SEQ ID NO: 3452581 - DNA, 17 bp, Homo sapiens
cctccaaatgtccttaa

SEQ ID NO: 3452582 - DNA, 19 bp, Homo sapiens
cctccaacaccaagcacag

SEQ ID NO: 3452583 - DNA, 12 bp, Homo sapiens
cctccacagctt

SEQ ID NO: 3452584 - DNA, 15 bp, Homo sapiens
cctccacatcctcca

SEQ ID NO: 3452585 - DNA, 22 bp, Homo sapiens
cctccagaactcactggggcct

SEQ ID NO: 3452586 - DNA, 13 bp, Homo sapiens
cctccagcaggga

SEQ ID NO: 3452587 - DNA, 15 bp, Homo sapiens
cctccagctctttcc

SEQ ID NO: 3452588 - DNA, 22 bp, Homo sapiens
cctccagctctttcctccttcc

SEQ ID NO: 3452589 - DNA, 22 bp, Homo sapiens
cctccagggctggactgaggcc

SEQ ID NO: 3452590 - DNA, 23 bp, Homo sapiens
cctccagtccaaggaaaccacag

SEQ ID NO: 3452591 - DNA, 17 bp, Homo sapiens
cctccatcctcatctct

SEQ ID NO: 3452592 - DNA, 11 bp, Homo sapiens
cctccatggga

SEQ ID NO: 3452593 - DNA, 15 bp, Homo sapiens
cctccatgtgggcta

SEQ ID NO: 3452594 - DNA, 23 bp, Homo sapiens
cctccatgtgggctagttgggct

SEQ ID NO: 3452595 - DNA, 14 bp, Homo sapiens
cctcccaaaagact

SEQ ID NO: 3452596 - DNA, 19 bp, Homo sapiens
cctcccaatttcagactcc

SEQ ID NO: 3452597 - DNA, 15 bp, Homo sapiens
cctcccacactccca

SEQ ID NO: 3452598 - DNA, 15 bp, Homo sapiens
cctcccacctcagcc

SEQ ID NO: 3452599 - DNA, 17 bp, Homo sapiens
cctcccagaacacactc

SEQ ID NO: 3452600 - DNA, 15 bp, Homo sapiens
cctcccaggctctca

SEQ ID NO: 3452601 - DNA, 17 bp, Homo sapiens
cctcccagtacctcctg

SEQ ID NO: 3452602 - DNA, 21 bp, Homo sapiens
cctcccatagatactctcttc

SEQ ID NO: 3452603 - DNA, 12 bp, Homo sapiens
cctccccagcct

SEQ ID NO: 3452604 - DNA, 22 bp, Homo sapiens
cctccccattcacagagccttt

SEQ ID NO: 3452605 - DNA, 15 bp, Homo sapiens
cctcccccactgcca

SEQ ID NO: 3452606 - DNA, 12 bp, Homo sapiens
cctccccctgag

SEQ ID NO: 3452607 - DNA, 21 bp, Homo sapiens
cctcccctccggactggtgcc

SEQ ID NO: 3452608 - DNA, 14 bp, Homo sapiens
cctcccctgccatt

SEQ ID NO: 3452609 - DNA, 19 bp, Homo sapiens
cctcccgaatagctgggac

SEQ ID NO: 3452610 - DNA, 20 bp, Homo sapiens
cctcccgaatagctgggact

SEQ ID NO: 3452611 - DNA, 18 bp, Homo sapiens
cctcccgagtagctggga

SEQ ID NO: 3452612 - DNA, 21 bp, Homo sapiens
cctcccgagtagctgggacta

SEQ ID NO: 3452613 - DNA, 13 bp, Homo sapiens
cctccctctaatt

SEQ ID NO: 3452614 - DNA, 12 bp, Homo sapiens
cctccctctgac

SEQ ID NO: 3452615 - DNA, 14 bp, Homo sapiens
cctccctgcatctg

SEQ ID NO: 3452616 - DNA, 21 bp, Homo sapiens
cctccctgcatctgaccagca

SEQ ID NO: 3452617 - DNA, 14 bp, Homo sapiens
cctccctgcctcca

SEQ ID NO: 3452618 - DNA, 17 bp, Homo sapiens
cctcccttctgctactg

SEQ ID NO: 3452619 - DNA, 19 bp, Homo sapiens
cctccgacgctgcctctca

SEQ ID NO: 3452620 - DNA, 14 bp, Homo sapiens
cctccgaggccagt

SEQ ID NO: 3452621 - DNA, 14 bp, Homo sapiens
cctccgccctgcca

SEQ ID NO: 3452622 - DNA, 18 bp, Homo sapiens
cctccgccctgccactca

SEQ ID NO: 3452623 - DNA, 18 bp, Homo sapiens
cctccgccttcacattcc

SEQ ID NO: 3452624 - DNA, 13 bp, Homo sapiens
cctccggactggt

SEQ ID NO: 3452625 - DNA, 18 bp, Homo sapiens
cctccgggacctggtgct

SEQ ID NO: 3452626 - DNA, 15 bp, Homo sapiens
cctccgtccatatca

SEQ ID NO: 3452627 - DNA, 17 bp, Homo sapiens
cctcctcaggcacacag

SEQ ID NO: 3452628 - DNA, 12 bp, Homo sapiens
cctcctccagcc

SEQ ID NO: 3452629 - DNA, 14 bp, Homo sapiens
cctcctccctgcat

SEQ ID NO: 3452630 - DNA, 13 bp, Homo sapiens
cctcctctgaaac

SEQ ID NO: 3452631 - DNA, 18 bp, Homo sapiens
cctcctctgaaacagctg

SEQ ID NO: 3452632 - DNA, 19 bp, Homo sapiens
cctcctctgaaacagctgc

SEQ ID NO: 3452633 - DNA, 20 bp, Homo sapiens
cctcctgacccattgctgtt

SEQ ID NO: 3452634 - DNA, 17 bp, Homo sapiens
cctcctgcccacctgtc

SEQ ID NO: 3452635 - DNA, 12 bp, Homo sapiens
cctcctgcctcc

SEQ ID NO: 3452636 - DNA, 23 bp, Homo sapiens
cctcctggagctctgtgggtctc

SEQ ID NO: 3452637 - DNA, 15 bp, Homo sapiens
cctcctgtctctggc

SEQ ID NO: 3452638 - DNA, 14 bp, Homo sapiens
cctcctgttctgaa

SEQ ID NO: 3452639 - DNA, 17 bp, Homo sapiens
cctccttcaattccata

SEQ ID NO: 3452640 - DNA, 13 bp, Homo sapiens
cctccttcagaca

SEQ ID NO: 3452641 - DNA, 14 bp, Homo sapiens
cctccttcagacac

SEQ ID NO: 3452642 - DNA, 12 bp, Homo sapiens
cctccttcccaa

SEQ ID NO: 3452643 - DNA, 23 bp, Homo sapiens
cctcgaggtgccttcttcagggc

SEQ ID NO: 3452644 - DNA, 18 bp, Homo sapiens
cctcgccctctcctttgt

SEQ ID NO: 3452645 - DNA, 15 bp, Homo sapiens
cctcgctctgttacc

SEQ ID NO: 3452646 - DNA, 15 bp, Homo sapiens
cctcggctctggagg

SEQ ID NO: 3452647 - DNA, 18 bp, Homo sapiens
cctctacagagcttccct

SEQ ID NO: 3452648 - DNA, 20 bp, Homo sapiens
cctctacagagcttccctga

SEQ ID NO: 3452649 - DNA, 19 bp, Homo sapiens
cctctaggctctgccttcg

SEQ ID NO: 3452650 - DNA, 22 bp, Homo sapiens
cctctatcatggtgaaaagctc

SEQ ID NO: 3452651 - DNA, 19 bp, Homo sapiens
cctctatgaactatggacg

SEQ ID NO: 3452652 - DNA, 19 bp, Homo sapiens
cctctatttctagagacaa

SEQ ID NO: 3452653 - DNA, 23 bp, Homo sapiens
cctctcaggccggcagccccagc

SEQ ID NO: 3452654 - DNA, 15 bp, Homo sapiens
cctctcagtactttg

SEQ ID NO: 3452655 - DNA, 12 bp, Homo sapiens
cctctccccagc

SEQ ID NO: 3452656 - DNA, 20 bp, Homo sapiens
cctctccccagcccagagac

SEQ ID NO: 3452657 - DNA, 10 bp, Homo sapiens
cctctccctg

SEQ ID NO: 3452658 - DNA, 15 bp, Homo sapiens
cctctccctgaccct

SEQ ID NO: 3452659 - DNA, 22 bp, Homo sapiens
cctctccctgcactccctcctg

SEQ ID NO: 3452660 - DNA, 13 bp, Homo sapiens
cctctccttcctg

SEQ ID NO: 3452661 - DNA, 14 bp, Homo sapiens
cctctccttccttg

SEQ ID NO: 3452662 - DNA, 16 bp, Homo sapiens
cctctccttccttgtt

SEQ ID NO: 3452663 - DNA, 17 bp, Homo sapiens
cctctctgcagacttcc

SEQ ID NO: 3452664 - DNA, 21 bp, Homo sapiens
cctctctgcagacttcccagc

SEQ ID NO: 3452665 - DNA, 12 bp, Homo sapiens
cctctctgctct

SEQ ID NO: 3452666 - DNA, 12 bp, Homo sapiens
cctctctgtccc

SEQ ID NO: 3452667 - DNA, 13 bp, Homo sapiens
cctctctgtccct

SEQ ID NO: 3452668 - DNA, 19 bp, Homo sapiens
cctctctgtgtccctgctg

SEQ ID NO: 3452669 - DNA, 20 bp, Homo sapiens
cctctcttatagaatattta

SEQ ID NO: 3452670 - DNA, 12 bp, Homo sapiens
cgcagcctgagt

SEQ ID NO: 3452671 - DNA, 12 bp, Homo sapiens
cgcagctgaagt

SEQ ID NO: 3452672 - DNA, 12 bp, Homo sapiens
cgcaggaagctg

SEQ ID NO: 3452673 - DNA, 15 bp, Homo sapiens
cgcaggaagctgctc

SEQ ID NO: 3452674 - DNA, 18 bp, Homo sapiens
cgcaggagcacacccagc

SEQ ID NO: 3452675 - DNA, 10 bp, Homo sapiens
cgcaggcccc

SEQ ID NO: 3452676 - DNA, 17 bp, Homo sapiens
cgcaggcccctctcctc

SEQ ID NO: 3452677 - DNA, 19 bp, Homo sapiens
cgcaggcccctctcctccg

SEQ ID NO: 3452678 - DNA, 23 bp, Homo sapiens
cgcagtgtgcactaaggggcccg

SEQ ID NO: 3452679 - DNA, 19 bp, Homo sapiens
cgcatcttcccaacccctt

SEQ ID NO: 3452680 - DNA, 12 bp, Homo sapiens
cgcatttcctaa

SEQ ID NO: 3452681 - DNA, 13 bp, Homo sapiens
cgcatttcctaag

SEQ ID NO: 3452682 - DNA, 13 bp, Homo sapiens
cgccaaggcctag

SEQ ID NO: 3452683 - DNA, 13 bp, Homo sapiens
cgccaaggctggg

SEQ ID NO: 3452684 - DNA, 19 bp, Homo sapiens
cgccacccccccaccccag

SEQ ID NO: 3452685 - DNA, 21 bp, Homo sapiens
cgccacccccccaccccaggc

SEQ ID NO: 3452686 - DNA, 13 bp, Homo sapiens
cgccacccgcagc

SEQ ID NO: 3452687 - DNA, 17 bp, Homo sapiens
cgccagaggtgcttcac

SEQ ID NO: 3452688 - DNA, 23 bp, Homo sapiens
cgccaggggaaaatcagcctgct

SEQ ID NO: 3452689 - DNA, 15 bp, Homo sapiens
cgccatgctcctggc

SEQ ID NO: 3452690 - DNA, 23 bp, Homo sapiens
cgcccaggatcagattgcatgtg

SEQ ID NO: 3452691 - DNA, 16 bp, Homo sapiens
cgcccagtccttccac

SEQ ID NO: 3452692 - DNA, 19 bp, Homo sapiens
cgcccagtctggaatgcag

SEQ ID NO: 3452693 - DNA, 21 bp, Homo sapiens
cgcccagtctggaatgcagtg

SEQ ID NO: 3452694 - DNA, 13 bp, Homo sapiens
cgccccacccaga

SEQ ID NO: 3452695 - DNA, 14 bp, Homo sapiens
cgccccctgccctc

SEQ ID NO: 3452696 - DNA, 15 bp, Homo sapiens
cgccccctgccctcc

SEQ ID NO: 3452697 - DNA, 21 bp, Homo sapiens
cgcccctagccggttcctgtc

SEQ ID NO: 3452698 - DNA, 12 bp, Homo sapiens
cgccctgccact

SEQ ID NO: 3452699 - DNA, 19 bp, Homo sapiens
cgcccttacttcttgccct

SEQ ID NO: 3452700 - DNA, 14 bp, Homo sapiens
cgccctttcctcct

SEQ ID NO: 3452701 - DNA, 17 bp, Homo sapiens
cgccctttcctcctcag

SEQ ID NO: 3452702 - DNA, 19 bp, Homo sapiens
cgccctttcctcctcaggc

SEQ ID NO: 3452703 - DNA, 20 bp, Homo sapiens
cgccctttcctcctcaggca

SEQ ID NO: 3452704 - DNA, 19 bp, Homo sapiens
cgccgcaaaccacactgga

SEQ ID NO: 3452705 - DNA, 20 bp, Homo sapiens
cgccgcctggtactcaagcc

SEQ ID NO: 3452706 - DNA, 14 bp, Homo sapiens
cgccggaggccagc

SEQ ID NO: 3452707 - DNA, 23 bp, Homo sapiens
cgccggaggccagctatctgcct

SEQ ID NO: 3452708 - DNA, 15 bp, Homo sapiens
cgccgtctccagggg

SEQ ID NO: 3452709 - DNA, 16 bp, Homo sapiens
cgcctccatccaaggc

SEQ ID NO: 3452710 - DNA, 18 bp, Homo sapiens
cgcctccatccaaggcca

SEQ ID NO: 3452711 - DNA, 13 bp, Homo sapiens
cgcctcccactgg

SEQ ID NO: 3452712 - DNA, 14 bp, Homo sapiens
cgcctcccactggg

SEQ ID NO: 3452713 - DNA, 11 bp, Homo sapiens
cgcctgaaact

SEQ ID NO: 3452714 - DNA, 13 bp, Homo sapiens
cgcctgaaacttt

SEQ ID NO: 3452715 - DNA, 22 bp, Homo sapiens
cgcctgcaaacgctgcctgccg

SEQ ID NO: 3452716 - DNA, 16 bp, Homo sapiens
cgcctgcccctcccag

SEQ ID NO: 3452717 - DNA, 18 bp, Homo sapiens
cgcctgcctgccaccctg

SEQ ID NO: 3452718 - DNA, 14 bp, Homo sapiens
cgcctttcccaact

SEQ ID NO: 3452719 - DNA, 23 bp, Homo sapiens
cgcctttccttttcgcctttcct

SEQ ID NO: 3452720 - DNA, 19 bp, Homo sapiens
cgcgccaaataatgtctct

SEQ ID NO: 3452721 - DNA, 21 bp, Homo sapiens
cgcgccaaataatgtctctgt

SEQ ID NO: 3452722 - DNA, 23 bp, Homo sapiens
cgcgccaaataatgtctctgtga

SEQ ID NO: 3452723 - DNA, 13 bp, Homo sapiens
cgcgctctgctca

SEQ ID NO: 3452724 - DNA, 14 bp, Homo sapiens
cgcgctctgctcag

SEQ ID NO: 3452725 - DNA, 23 bp, Homo sapiens
cgcgggagccatgcgccccctcc

SEQ ID NO: 3452726 - DNA, 22 bp, Homo sapiens
cgcggtgccatgtctgcagtgt

SEQ ID NO: 3452727 - DNA, 16 bp, Homo sapiens
cgcgtgcacacaccag

SEQ ID NO: 3452728 - DNA, 17 bp, Homo sapiens
cgcgttgtaaaatatag

SEQ ID NO: 3452729 - DNA, 14 bp, Homo sapiens
cgctcactgaactc

SEQ ID NO: 3452730 - DNA, 13 bp, Homo sapiens
cgctcagcccagc

SEQ ID NO: 3452731 - DNA, 16 bp, Homo sapiens
cgctccagctgccccg

SEQ ID NO: 3452732 - DNA, 11 bp, Homo sapiens
cgctccaggta

SEQ ID NO: 3452733 - DNA, 18 bp, Homo sapiens
cgctcctgccgcagagct

SEQ ID NO: 3452734 - DNA, 20 bp, Homo sapiens
cgctcctttgtgtgtgtgtc

SEQ ID NO: 3452735 - DNA, 15 bp, Homo sapiens
cgctctgctcagtgg

SEQ ID NO: 3452736 - DNA, 13 bp, Homo sapiens
cgctgatatatgt

SEQ ID NO: 3452737 - DNA, 14 bp, Homo sapiens
cgctgattctcagg

SEQ ID NO: 3452738 - DNA, 20 bp, Homo sapiens
cgctgccacccacctccctg

SEQ ID NO: 3452739 - DNA, 15 bp, Homo sapiens
cgctgccccagcccc

SEQ ID NO: 3452740 - DNA, 21 bp, Homo sapiens
cgctgccccatctcccctcag

SEQ ID NO: 3452741 - DNA, 20 bp, Homo sapiens
cgctggactctcagtctctg

SEQ ID NO: 3452742 - DNA, 15 bp, Homo sapiens
cgctgggcacttccc

SEQ ID NO: 3452743 - DNA, 21 bp, Homo sapiens
cgctgggcacttccctgctgc

SEQ ID NO: 3452744 - DNA, 23 bp, Homo sapiens
cgctgggcacttccctgctgcct

SEQ ID NO: 3452745 - DNA, 13 bp, Homo sapiens
cgctggtgctgag

SEQ ID NO: 3452746 - DNA, 16 bp, Homo sapiens
cgcttcttgcctctgt

SEQ ID NO: 3452747 - DNA, 17 bp, Homo sapiens
cgcttcttgcctctgtg

SEQ ID NO: 3452748 - DNA, 18 bp, Homo sapiens
cgcttcttgcctctgtgc

SEQ ID NO: 3452749 - DNA, 16 bp, Homo sapiens
cgcttttccttggcat

SEQ ID NO: 3452750 - DNA, 23 bp, Homo sapiens
cgcttttgccattagccaaggat

SEQ ID NO: 3452751 - DNA, 17 bp, Homo sapiens
cggaactgtcctttcct

SEQ ID NO: 3452752 - DNA, 13 bp, Homo sapiens
cggaagagccttg

SEQ ID NO: 3452753 - DNA, 14 bp, Homo sapiens
cggacaccccctcg

SEQ ID NO: 3452754 - DNA, 16 bp, Homo sapiens
cggactggtgccctcc

SEQ ID NO: 3452755 - DNA, 20 bp, Homo sapiens
cggagacggagtcccacctt

SEQ ID NO: 3452756 - DNA, 11 bp, Homo sapiens
cggagaggaag

SEQ ID NO: 3452757 - DNA, 18 bp, Homo sapiens
cggagccactcctctgac

SEQ ID NO: 3452758 - DNA, 17 bp, Homo sapiens
cggagccggcacctaca

SEQ ID NO: 3452759 - DNA, 15 bp, Homo sapiens
cggagctccggcctg

SEQ ID NO: 3452760 - DNA, 20 bp, Homo sapiens
cggagctgcccctctctggg

SEQ ID NO: 3452761 - DNA, 13 bp, Homo sapiens
cggagctggcccc

SEQ ID NO: 3452762 - DNA, 19 bp, Homo sapiens
cggaggccagctatctgcc

SEQ ID NO: 3452763 - DNA, 21 bp, Homo sapiens
cggaggccagctatctgcctg

SEQ ID NO: 3452764 - DNA, 22 bp, Homo sapiens
cggaggccagctatctgcctga

SEQ ID NO: 3452765 - DNA, 12 bp, Homo sapiens
cggagggctgcg

SEQ ID NO: 3452766 - DNA, 11 bp, Homo sapiens
cggaggggagt

SEQ ID NO: 3452767 - DNA, 14 bp, Homo sapiens
cggaggggagtaga

SEQ ID NO: 3452768 - DNA, 16 bp, Homo sapiens
cggagtcccaccttgg

SEQ ID NO: 3452769 - DNA, 21 bp, Homo sapiens
cggagtcccaccttggctgca

SEQ ID NO: 3452770 - DNA, 24 bp, Homo sapiens
cggattccaaagagtagaattgca

SEQ ID NO: 3452771 - DNA, 13 bp, Homo sapiens
cggcacagctggg

SEQ ID NO: 3452772 - DNA, 16 bp, Homo sapiens
cggcacagctgggata

SEQ ID NO: 3452773 - DNA, 18 bp, Homo sapiens
cggcacctacatccccag

SEQ ID NO: 3452774 - DNA, 19 bp, Homo sapiens
cggcacctacatccccagg

SEQ ID NO: 3452775 - DNA, 21 bp, Homo sapiens
cggcacctacatccccaggtc

SEQ ID NO: 3452776 - DNA, 18 bp, Homo sapiens
cggcagccccagcctgct

SEQ ID NO: 3452777 - DNA, 22 bp, Homo sapiens
cggcagccccagcctgctagct

SEQ ID NO: 3452778 - DNA, 17 bp, Homo sapiens
cggcaggactgcagagc

SEQ ID NO: 3452779 - DNA, 18 bp, Homo sapiens
cggcaggactgcagagca

SEQ ID NO: 3452780 - DNA, 20 bp, Homo sapiens
cggcagggcgggcagagggc

SEQ ID NO: 3452781 - DNA, 15 bp, Homo sapiens
cggcattaaagccat

SEQ ID NO: 3452782 - DNA, 24 bp, Homo sapiens
cggccaggccagagggagtgacag

SEQ ID NO: 3452783 - DNA, 13 bp, Homo sapiens
cggcccctgctgg

SEQ ID NO: 3452784 - DNA, 18 bp, Homo sapiens
cggcccctgctggttcag

SEQ ID NO: 3452785 - DNA, 22 bp, Homo sapiens
cggccctcctaccctgcgccca

SEQ ID NO: 3452786 - DNA, 19 bp, Homo sapiens
cggccctgcagccagctca

SEQ ID NO: 3452787 - DNA, 12 bp, Homo sapiens
cggccctggggc

SEQ ID NO: 3452788 - DNA, 17 bp, Homo sapiens
cggcctattgcttgggt

SEQ ID NO: 3452789 - DNA, 21 bp, Homo sapiens
cggcctattgcttgggtctct

SEQ ID NO: 3452790 - DNA, 15 bp, Homo sapiens
cggcgtacaggctgg

SEQ ID NO: 3452791 - DNA, 16 bp, Homo sapiens
cggcgtacaggctggc

SEQ ID NO: 3452792 - DNA, 14 bp, Homo sapiens
cggctcactgcagc

SEQ ID NO: 3452793 - DNA, 21 bp, Homo sapiens
cggctcagtgcaacctctgct

SEQ ID NO: 3452794 - DNA, 13 bp, Homo sapiens
cggctccaggctc

SEQ ID NO: 3452795 - DNA, 13 bp, Homo sapiens
cggctcccagcct

SEQ ID NO: 3452796 - DNA, 22 bp, Homo sapiens
cggctcccccaggcctgagctg

SEQ ID NO: 3452797 - DNA, 20 bp, Homo sapiens
cggctcggaggaagccccca

SEQ ID NO: 3452798 - DNA, 23 bp, Homo sapiens
cggctggcagcccacccctcaac

SEQ ID NO: 3452799 - DNA, 18 bp, Homo sapiens
cggcttggatcctgggct

SEQ ID NO: 3452800 - DNA, 20 bp, Homo sapiens
cgggaaaaggagaggaaact

SEQ ID NO: 3452801 - DNA, 16 bp, Homo sapiens
cgggaacctccccagc

SEQ ID NO: 3452802 - DNA, 18 bp, Homo sapiens
cgggaacctccccagcct

SEQ ID NO: 3452803 - DNA, 21 bp, Homo sapiens
cgggaacctccccagcctgcg

SEQ ID NO: 3452804 - DNA, 15 bp, Homo sapiens
cgggaagctgacctt

SEQ ID NO: 3452805 - DNA, 18 bp, Homo sapiens
cgggacagtgctgcagct

SEQ ID NO: 3452806 - DNA, 16 bp, Homo sapiens
cgggactcaggcggga

SEQ ID NO: 3452807 - DNA, 19 bp, Homo sapiens
cgggagaggggacgcaggc

SEQ ID NO: 3452808 - DNA, 20 bp, Homo sapiens
cgggaggatgttctgggaca

SEQ ID NO: 3452809 - DNA, 18 bp, Homo sapiens
cgggaggtcgaggcagga

SEQ ID NO: 3452810 - DNA, 22 bp, Homo sapiens
cgggcactcagaagacactgat

SEQ ID NO: 3452811 - DNA, 15 bp, Homo sapiens
cgggcagagggctgg

SEQ ID NO: 3452812 - DNA, 19 bp, Homo sapiens
cgggcagagggctggaggc

SEQ ID NO: 3452813 - DNA, 23 bp, Homo sapiens
cgggcagagggctggaggcccag

SEQ ID NO: 3452814 - DNA, 13 bp, Homo sapiens
cgggccagggctg

SEQ ID NO: 3452815 - DNA, 14 bp, Homo sapiens
cgggcccagcactt

SEQ ID NO: 3452816 - DNA, 14 bp, Homo sapiens
cgggcctcagtgcc

SEQ ID NO: 3452817 - DNA, 20 bp, Homo sapiens
cgggcgcgatcccacacagg

SEQ ID NO: 3452818 - DNA, 15 bp, Homo sapiens
cgggctgagggcctg

SEQ ID NO: 3452819 - DNA, 16 bp, Homo sapiens
cgggctgagggcctgc

SEQ ID NO: 3452820 - DNA, 19 bp, Homo sapiens
cgggctgagggcctgctgg

SEQ ID NO: 3452821 - DNA, 23 bp, Homo sapiens
cggggacagctccttctgtccta

SEQ ID NO: 3452822 - DNA, 19 bp, Homo sapiens
cggggagaaataagaatta

SEQ ID NO: 3452823 - DNA, 21 bp, Homo sapiens
cggggcccagggcaagctccg

SEQ ID NO: 3452824 - DNA, 12 bp, Homo sapiens
cgggggcagctg

SEQ ID NO: 3452825 - DNA, 13 bp, Homo sapiens
cgggggcagctga

SEQ ID NO: 3452826 - DNA, 12 bp, Homo sapiens
cgggggggagga

SEQ ID NO: 3452827 - DNA, 17 bp, Homo sapiens
cgggggttaggggtgga

SEQ ID NO: 3452828 - DNA, 17 bp, Homo sapiens
cggggtagaggctggga

SEQ ID NO: 3452829 - DNA, 22 bp, Homo sapiens
cggtatccccccatcttgcttc

SEQ ID NO: 3452830 - DNA, 14 bp, Homo sapiens
cggtccacccagga

SEQ ID NO: 3452831 - DNA, 15 bp, Homo sapiens
cggtccacccaggag

SEQ ID NO: 3452832 - DNA, 21 bp, Homo sapiens
cggtcccagttttgttgcccc

SEQ ID NO: 3452833 - DNA, 20 bp, Homo sapiens
cggtgcccaagccagaggct

SEQ ID NO: 3452834 - DNA, 16 bp, Homo sapiens
cggtgctccaggcagg

SEQ ID NO: 3452835 - DNA, 17 bp, Homo sapiens
cggtgctgtcctcaggt

SEQ ID NO: 3452836 - DNA, 20 bp, Homo sapiens
cggtggctagtcaagctcct

SEQ ID NO: 3452837 - DNA, 22 bp, Homo sapiens
cggtggctagtcaagctcctcc

SEQ ID NO: 3452838 - DNA, 20 bp, Homo sapiens
cggtggctcacgcctgtaat

SEQ ID NO: 3452839 - DNA, 13 bp, Homo sapiens
cggtggctgggca

SEQ ID NO: 3452840 - DNA, 15 bp, Homo sapiens
cggtgggcacccacc

SEQ ID NO: 3452841 - DNA, 19 bp, Homo sapiens
cggtgggcacccaccctgg

SEQ ID NO: 3452842 - DNA, 13 bp, Homo sapiens
cggtgtggagaag

SEQ ID NO: 3452843 - DNA, 16 bp, Homo sapiens
cggttttactgcagct

SEQ ID NO: 3452844 - DNA, 22 bp, Homo sapiens
cgtagatattggacaaagaacc

SEQ ID NO: 3452845 - DNA, 23 bp, Homo sapiens
cgtagatattggacaaagaacct

SEQ ID NO: 3452846 - DNA, 19 bp, Homo sapiens
cgtagccagctgctcccca

SEQ ID NO: 3452847 - DNA, 16 bp, Homo sapiens
cgtagctgcaaaggac

SEQ ID NO: 3452848 - DNA, 15 bp, Homo sapiens
cgtataggcatgtaa

SEQ ID NO: 3452849 - DNA, 18 bp, Homo sapiens
cgtatatataagaaagac

SEQ ID NO: 3452850 - DNA, 18 bp, Homo sapiens
cgtatctccggctcccag

SEQ ID NO: 3452851 - DNA, 15 bp, Homo sapiens
cgtattagttgccaa

SEQ ID NO: 3452852 - DNA, 17 bp, Homo sapiens
cgtcaacgttgtactgt

SEQ ID NO: 3452853 - DNA, 20 bp, Homo sapiens
cgtcacgtgcgctgggcact

SEQ ID NO: 3452854 - DNA, 23 bp, Homo sapiens
cgtcagtagtttgagaccagcct

SEQ ID NO: 3452855 - DNA, 16 bp, Homo sapiens
cgtcatctcagggtcc

SEQ ID NO: 3452856 - DNA, 21 bp, Homo sapiens
cgtccaggttcaacccacagc

SEQ ID NO: 3452857 - DNA, 20 bp, Homo sapiens
cgtccatatcagaactgtgc

SEQ ID NO: 3452858 - DNA, 14 bp, Homo sapiens
cgtcccctgcccac

SEQ ID NO: 3452859 - DNA, 13 bp, Homo sapiens
cgtcctgcctgtg

SEQ ID NO: 3452860 - DNA, 16 bp, Homo sapiens
cgtcgccctcccaggc

SEQ ID NO: 3452861 - DNA, 14 bp, Homo sapiens
cgtctgacaggcaa

SEQ ID NO: 3452862 - DNA, 21 bp, Homo sapiens
cgtctgacaggcaatgctggc

SEQ ID NO: 3452863 - DNA, 15 bp, Homo sapiens
cgtctggaagtccaa

SEQ ID NO: 3452864 - DNA, 14 bp, Homo sapiens
cgtctttttgtttg

SEQ ID NO: 3452865 - DNA, 14 bp, Homo sapiens
cgtgacaacacttg

SEQ ID NO: 3452866 - DNA, 14 bp, Homo sapiens
cgtgagccactgca

SEQ ID NO: 3452867 - DNA, 15 bp, Homo sapiens
cgtgagccactgcac

SEQ ID NO: 3452868 - DNA, 22 bp, Homo sapiens
cgtgagccactgcaccgggcca

SEQ ID NO: 3452869 - DNA, 16 bp, Homo sapiens
cgtgagccccatcttc

SEQ ID NO: 3452870 - DNA, 14 bp, Homo sapiens
cgtgatcaaagcca

SEQ ID NO: 3452871 - DNA, 21 bp, Homo sapiens
cgtgatcaaagccacactctg

SEQ ID NO: 3452872 - DNA, 17 bp, Homo sapiens
cgtgcaaagccaaggca

SEQ ID NO: 3452873 - DNA, 14 bp, Homo sapiens
cgtgcacacaccag

SEQ ID NO: 3452874 - DNA, 13 bp, Homo sapiens
cgtgcacttccca

SEQ ID NO: 3452875 - DNA, 15 bp, Homo sapiens
cgtgcattgtgcttc

SEQ ID NO: 3452876 - DNA, 21 bp, Homo sapiens
cgtgcattgtgcttctttctt

SEQ ID NO: 3452877 - DNA, 15 bp, Homo sapiens
cgtggagctgcctga

SEQ ID NO: 3452878 - DNA, 16 bp, Homo sapiens
cgtggaggagcagtgc

SEQ ID NO: 3452879 - DNA, 10 bp, Homo sapiens
cgtggcacat

SEQ ID NO: 3452880 - DNA, 21 bp, Homo sapiens
cgtggcctcccaaagtgctgg

SEQ ID NO: 3452881 - DNA, 21 bp, Homo sapiens
cgtgggcatatctggggagcc

SEQ ID NO: 3452882 - DNA, 14 bp, Homo sapiens
cgtgggcattgtct

SEQ ID NO: 3452883 - DNA, 13 bp, Homo sapiens
cgtgggctccctg

SEQ ID NO: 3452884 - DNA, 17 bp, Homo sapiens
cgtgggctccctgactg

SEQ ID NO: 3452885 - DNA, 22 bp, Homo sapiens
cgtgggctgggcccacaaaggc

SEQ ID NO: 3452886 - DNA, 11 bp, Homo sapiens
cgtggggaggt

SEQ ID NO: 3452887 - DNA, 15 bp, Homo sapiens
cgtggggtgtgctgg

SEQ ID NO: 3452888 - DNA, 17 bp, Homo sapiens
cgtggggtgtgctggga

SEQ ID NO: 3452889 - DNA, 18 bp, Homo sapiens
cgtggggtgtgctgggag

SEQ ID NO: 3452890 - DNA, 16 bp, Homo sapiens
cgtggtatgtctgcca

SEQ ID NO: 3452891 - DNA, 14 bp, Homo sapiens
cgtgtcaagctgct

SEQ ID NO: 3452892 - DNA, 15 bp, Homo sapiens
cgtgtcaagctgctc

SEQ ID NO: 3452893 - DNA, 17 bp, Homo sapiens
cgtgtcaagctgctctg

SEQ ID NO: 3452894 - DNA, 15 bp, Homo sapiens
cgtgttacccactgc

SEQ ID NO: 3452895 - DNA, 14 bp, Homo sapiens
cgttagctcctgtg

SEQ ID NO: 3452896 - DNA, 17 bp, Homo sapiens
cgttagctcctgtggcc

SEQ ID NO: 3452897 - DNA, 14 bp, Homo sapiens
cgttaggcatttcc

SEQ ID NO: 3452898 - DNA, 20 bp, Homo sapiens
cgttaggcatttcctgctga

SEQ ID NO: 3452899 - DNA, 20 bp, Homo sapiens
cgttccatgatgctgggatt

SEQ ID NO: 3452900 - DNA, 14 bp, Homo sapiens
cgttctgctcatca

SEQ ID NO: 3452901 - DNA, 19 bp, Homo sapiens
cgttcttaggctgctggga

SEQ ID NO: 3452902 - DNA, 20 bp, Homo sapiens
cgttcttaggctgctgggat

SEQ ID NO: 3452903 - DNA, 18 bp, Homo sapiens
cgttgatgttggctggga

SEQ ID NO: 3452904 - DNA, 14 bp, Homo sapiens
cgtttactatgcct

SEQ ID NO: 3452905 - DNA, 20 bp, Homo sapiens
cgtttactatgcctgtgtct

SEQ ID NO: 3452906 - DNA, 15 bp, Homo sapiens
cgttttctgtttgga

SEQ ID NO: 3452907 - DNA, 16 bp, Homo sapiens
cgttttgttttgtgcc

SEQ ID NO: 3452908 - DNA, 18 bp, Homo sapiens
ctaaaaaaaaaaaagtat

SEQ ID NO: 3452909 - DNA, 20 bp, Homo sapiens
ctaaaaaaaaaaaagtatta

SEQ ID NO: 3452910 - DNA, 12 bp, Homo sapiens
ctaaaaagcaac

SEQ ID NO: 3452911 - DNA, 22 bp, Homo sapiens
ctaaaagacttccctaacactt

SEQ ID NO: 3452912 - DNA, 12 bp, Homo sapiens
ctaaaagcacac

SEQ ID NO: 3452913 - DNA, 20 bp, Homo sapiens
ctaaaagtgggcttgattct

SEQ ID NO: 3452914 - DNA, 17 bp, Homo sapiens
ctaaaagtttagaactt

SEQ ID NO: 3452915 - DNA, 20 bp, Homo sapiens
ctaaaagtttagaacttgca

SEQ ID NO: 3452916 - DNA, 17 bp, Homo sapiens
ctaaacacgtgacacaa

SEQ ID NO: 3452917 - DNA, 18 bp, Homo sapiens
ctaaacacgtgacacaaa

SEQ ID NO: 3452918 - DNA, 16 bp, Homo sapiens
ctaaaccaaggactga

SEQ ID NO: 3452919 - DNA, 15 bp, Homo sapiens
ctaaacccaatccaa

SEQ ID NO: 3452920 - DNA, 16 bp, Homo sapiens
ctaaacccaatccaaa

SEQ ID NO: 3452921 - DNA, 15 bp, Homo sapiens
ctaaacggattccaa

SEQ ID NO: 3452922 - DNA, 16 bp, Homo sapiens
ctaaacggattccaaa

SEQ ID NO: 3452923 - DNA, 17 bp, Homo sapiens
ctaaacggattccaaag

SEQ ID NO: 3452924 - DNA, 14 bp, Homo sapiens
ctaaactcatttat

SEQ ID NO: 3452925 - DNA, 15 bp, Homo sapiens
ctaaactcatttata

SEQ ID NO: 3452926 - DNA, 16 bp, Homo sapiens
ctaaactccttcctgg

SEQ ID NO: 3452927 - DNA, 23 bp, Homo sapiens
ctaaagaaaaatatcttggccta

SEQ ID NO: 3452928 - DNA, 18 bp, Homo sapiens
ctaaagagtttattttaa

SEQ ID NO: 3452929 - DNA, 21 bp, Homo sapiens
ctaaagatagagtcattgctg

SEQ ID NO: 3452930 - DNA, 11 bp, Homo sapiens
ctaaagccaaa

SEQ ID NO: 3452931 - DNA, 16 bp, Homo sapiens
ctaaagtgtttagctg

SEQ ID NO: 3452932 - DNA, 18 bp, Homo sapiens
ctaaagtgtttagctgtc

SEQ ID NO: 3452933 - DNA, 10 bp, Homo sapiens
ctaaagttat

SEQ ID NO: 3452934 - DNA, 13 bp, Homo sapiens
ctaaagttatatt

SEQ ID NO: 3452935 - DNA, 22 bp, Homo sapiens
ctaaagttatatttcagatgta

SEQ ID NO: 3452936 - DNA, 14 bp, Homo sapiens
ctaaagttgtagtg

SEQ ID NO: 3452937 - DNA, 21 bp, Homo sapiens
ctaaataaatgtaatagccaa

SEQ ID NO: 3452938 - DNA, 22 bp, Homo sapiens
ctaaataaatgtaatagccaaa

SEQ ID NO: 3452939 - DNA, 21 bp, Homo sapiens
ctaaataatcttactctagat

SEQ ID NO: 3452940 - DNA, 21 bp, Homo sapiens
ctaaatcaccagagaccaaac

SEQ ID NO: 3452941 - DNA, 22 bp, Homo sapiens
ctaaatgaaaatcgtgacaaca

SEQ ID NO: 3452942 - DNA, 16 bp, Homo sapiens
ctaaatggcctcatgt

SEQ ID NO: 3452943 - DNA, 17 bp, Homo sapiens
ctaaatggcctcatgtg

SEQ ID NO: 3452944 - DNA, 24 bp, Homo sapiens
ctaaatgttaactacatattgtct

SEQ ID NO: 3452945 - DNA, 16 bp, Homo sapiens
ctaacacacagctccc

SEQ ID NO: 3452946 - DNA, 13 bp, Homo sapiens
ctaacacagttga

SEQ ID NO: 3452947 - DNA, 15 bp, Homo sapiens
ctaacaccagacaga

SEQ ID NO: 3452948 - DNA, 17 bp, Homo sapiens
ctaacagctcaggatct

SEQ ID NO: 3452949 - DNA, 14 bp, Homo sapiens
ctaaccacgctgga

SEQ ID NO: 3452950 - DNA, 18 bp, Homo sapiens
ctaactccttaacaactg

SEQ ID NO: 3452951 - DNA, 14 bp, Homo sapiens
ctaactgtaaatca

SEQ ID NO: 3452952 - DNA, 18 bp, Homo sapiens
ctaactgtaaatcatgtt

SEQ ID NO: 3452953 - DNA, 13 bp, Homo sapiens
ctaacttcataga

SEQ ID NO: 3452954 - DNA, 19 bp, Homo sapiens
ctaacttttcaatgacatt

SEQ ID NO: 3452955 - DNA, 14 bp, Homo sapiens
ctaagaaaagattt

SEQ ID NO: 3452956 - DNA, 14 bp, Homo sapiens
ctaagaacccctct

SEQ ID NO: 3452957 - DNA, 14 bp, Homo sapiens
ctaagaacctggaa

SEQ ID NO: 3452958 - DNA, 15 bp, Homo sapiens
ctaagaacctggaac

SEQ ID NO: 3452959 - DNA, 16 bp, Homo sapiens
ctaagaacctggaact

SEQ ID NO: 3452960 - DNA, 16 bp, Homo sapiens
ctaagaatacagcttt

SEQ ID NO: 3452961 - DNA, 18 bp, Homo sapiens
ctaagaatgcattattga

SEQ ID NO: 3452962 - DNA, 17 bp, Homo sapiens
ctaagaattcaaactgg

SEQ ID NO: 3452963 - DNA, 22 bp, Homo sapiens
ctaagagaatgataggcttttg

SEQ ID NO: 3452964 - DNA, 12 bp, Homo sapiens
ctaagcaacaga

SEQ ID NO: 3452965 - DNA, 16 bp, Homo sapiens
ctaagcaacagaaata

SEQ ID NO: 3452966 - DNA, 12 bp, Homo sapiens
ctaagcagagga

SEQ ID NO: 3452967 - DNA, 19 bp, Homo sapiens
ctaagcagaggaggggccg

SEQ ID NO: 3452968 - DNA, 20 bp, Homo sapiens
ctaagcagaggaggggccgc

SEQ ID NO: 3452969 - DNA, 16 bp, Homo sapiens
ctaagcccatgggaca

SEQ ID NO: 3452970 - DNA, 16 bp, Homo sapiens
ctaagccccagcaagc

SEQ ID NO: 3452971 - DNA, 19 bp, Homo sapiens
ctaagccccagcaagcaat

SEQ ID NO: 3452972 - DNA, 20 bp, Homo sapiens
ctaagcctgaaggggcgtct

SEQ ID NO: 3452973 - DNA, 15 bp, Homo sapiens
ctaagcctgtggctg

SEQ ID NO: 3452974 - DNA, 19 bp, Homo sapiens
ctaagcttctagaggctca

SEQ ID NO: 3452975 - DNA, 20 bp, Homo sapiens
ctaaggaaatggagaagctc

SEQ ID NO: 3452976 - DNA, 20 bp, Homo sapiens
ctaaggcgtggagctgcctg

SEQ ID NO: 3452977 - DNA, 17 bp, Homo sapiens
ctaaggctgtttgcttc

SEQ ID NO: 3452978 - DNA, 13 bp, Homo sapiens
ctaaggggcccgg

SEQ ID NO: 3452979 - DNA, 22 bp, Homo sapiens
ctaaggggcccggccagccatg

SEQ ID NO: 3452980 - DNA, 15 bp, Homo sapiens
ctaaggtgctaaatc

SEQ ID NO: 3452981 - DNA, 15 bp, Homo sapiens
ctaaggtgtgctctg

SEQ ID NO: 3452982 - DNA, 14 bp, Homo sapiens
ctaagtctttccat

SEQ ID NO: 3452983 - DNA, 14 bp, Homo sapiens
ctaagtgtgaactg

SEQ ID NO: 3452984 - DNA, 14 bp, Homo sapiens
ctaataaaccagtt

SEQ ID NO: 3452985 - DNA, 23 bp, Homo sapiens
ctaatatgatagcgggaaaagga

SEQ ID NO: 3452986 - DNA, 18 bp, Homo sapiens
ctaatatgtaacaagcca

SEQ ID NO: 3452987 - DNA, 19 bp, Homo sapiens
ctaatccaggcagatccag

SEQ ID NO: 3452988 - DNA, 23 bp, Homo sapiens
ctaatccaggcagatccaggact

SEQ ID NO: 3452989 - DNA, 17 bp, Homo sapiens
ctaatgaggagagaaaa

SEQ ID NO: 3452990 - DNA, 21 bp, Homo sapiens
ctaatgaggagagaaaatata

SEQ ID NO: 3452991 - DNA, 19 bp, Homo sapiens
ctaatgctcacctttatca

SEQ ID NO: 3452992 - DNA, 18 bp, Homo sapiens
ctaatgctccttgttcct

SEQ ID NO: 3452993 - DNA, 19 bp, Homo sapiens
ctaatgggtatttaaacaa

SEQ ID NO: 3452994 - DNA, 21 bp, Homo sapiens
ctaattatactactttgttag

SEQ ID NO: 3452995 - DNA, 15 bp, Homo sapiens
ctaattccacacctt

SEQ ID NO: 3452996 - DNA, 17 bp, Homo sapiens
ctaattccacacctttt

SEQ ID NO: 3452997 - DNA, 12 bp, Homo sapiens
ctaattgacttt

SEQ ID NO: 3452998 - DNA, 20 bp, Homo sapiens
ctaattgactttagaaagct

SEQ ID NO: 3452999 - DNA, 22 bp, Homo sapiens
ctaatttcaaaatgctttttat

SEQ ID NO: 3453000 - DNA, 22 bp, Homo sapiens
ctaatttgcattaaattcacaa

SEQ ID NO: 3453001 - DNA, 21 bp, Homo sapiens
ctacaaacaaaatttctatta

SEQ ID NO: 3453002 - DNA, 15 bp, Homo sapiens
ctacaaccaatggaa

SEQ ID NO: 3453003 - DNA, 13 bp, Homo sapiens
ctacaattcctct

SEQ ID NO: 3453004 - DNA, 20 bp, Homo sapiens
ctacaattcctctgataata

SEQ ID NO: 3453005 - DNA, 17 bp, Homo sapiens
ctacaatttaaacacca

SEQ ID NO: 3453006 - DNA, 21 bp, Homo sapiens
ctacacagggatgtacaaggc

SEQ ID NO: 3453007 - DNA, 16 bp, Homo sapiens
ctacacccttttccag

SEQ ID NO: 3453008 - DNA, 20 bp, Homo sapiens
ctacaccttgcttttttact

SEQ ID NO: 3453009 - DNA, 17 bp, Homo sapiens
ctacagaggccatgggc

SEQ ID NO: 3453010 - DNA, 14 bp, Homo sapiens
ctacaggagtgagc

SEQ ID NO: 3453011 - DNA, 15 bp, Homo sapiens
ctacaggagtgagca

SEQ ID NO: 3453012 - DNA, 17 bp, Homo sapiens
ctacaggcacccaccat

SEQ ID NO: 3453013 - DNA, 17 bp, Homo sapiens
ctacaggtcaagaaata

SEQ ID NO: 3453014 - DNA, 15 bp, Homo sapiens
ctacagtcaggaaag

SEQ ID NO: 3453015 - DNA, 18 bp, Homo sapiens
ctacagtcaggaaaggaa

SEQ ID NO: 3453016 - DNA, 21 bp, Homo sapiens
ctacagttgaaaaacagctga

SEQ ID NO: 3453017 - DNA, 13 bp, Homo sapiens
ctacatccccagg

SEQ ID NO: 3453018 - DNA, 17 bp, Homo sapiens
ctacatccccaggtctc

SEQ ID NO: 3453019 - DNA, 17 bp, Homo sapiens
ctacatcccgggcctca

SEQ ID NO: 3453020 - DNA, 22 bp, Homo sapiens
ctacattataaatgtctcttta

SEQ ID NO: 3453021 - DNA, 16 bp, Homo sapiens
ctacattttctttttt

SEQ ID NO: 3453022 - DNA, 19 bp, Homo sapiens
ctacattttctttttttat

SEQ ID NO: 3453023 - DNA, 18 bp, Homo sapiens
ctaccacatgccaagcac

SEQ ID NO: 3453024 - DNA, 11 bp, Homo sapiens
ctaccacctcc

SEQ ID NO: 3453025 - DNA, 18 bp, Homo sapiens
ctaccagataactgagga

SEQ ID NO: 3453026 - DNA, 18 bp, Homo sapiens
ctaccatcccctgtagag

SEQ ID NO: 3453027 - DNA, 21 bp, Homo sapiens
ctaccattgctgttctacttt

SEQ ID NO: 3453028 - DNA, 12 bp, Homo sapiens
ctacccaaagga

SEQ ID NO: 3453029 - DNA, 17 bp, Homo sapiens
ctacccaccctcctttc

SEQ ID NO: 3453030 - DNA, 22 bp, Homo sapiens
ctacccaccctcctttcaccac

SEQ ID NO: 3453031 - DNA, 14 bp, Homo sapiens
ctacccagggcctg

SEQ ID NO: 3453032 - DNA, 15 bp, Homo sapiens
ctacccagggcctgc

SEQ ID NO: 3453033 - DNA, 13 bp, Homo sapiens
ctacccatccccg

SEQ ID NO: 3453034 - DNA, 15 bp, Homo sapiens
ctacccatccccgca

SEQ ID NO: 3453035 - DNA, 17 bp, Homo sapiens
ctaccctgagctgaggc

SEQ ID NO: 3453036 - DNA, 13 bp, Homo sapiens
ctaccctgcctcc

SEQ ID NO: 3453037 - DNA, 19 bp, Homo sapiens
ctaccctgtgctaagcacg

SEQ ID NO: 3453038 - DNA, 21 bp, Homo sapiens
ctaccgacccagggttcccgc

SEQ ID NO: 3453039 - DNA, 13 bp, Homo sapiens
ctacctctctgtc

SEQ ID NO: 3453040 - DNA, 20 bp, Homo sapiens
ctacctctctgtcccttgct

SEQ ID NO: 3453041 - DNA, 15 bp, Homo sapiens
ctaccttatcaggca

SEQ ID NO: 3453042 - DNA, 15 bp, Homo sapiens
ctaccttctctaccc

SEQ ID NO: 3453043 - DNA, 22 bp, Homo sapiens
ctaccttctctacccatctccc

SEQ ID NO: 3453044 - DNA, 14 bp, Homo sapiens
ctaccttctttggc

SEQ ID NO: 3453045 - DNA, 17 bp, Homo sapiens
ctaccttgcttttgctt

SEQ ID NO: 3453046 - DNA, 15 bp, Homo sapiens
ctactaaaagtttag

SEQ ID NO: 3453047 - DNA, 17 bp, Homo sapiens
ctactaataaaccagtt

SEQ ID NO: 3453048 - DNA, 14 bp, Homo sapiens
ctactataaagaga

SEQ ID NO: 3453049 - DNA, 15 bp, Homo sapiens
ctactataaagagaa

SEQ ID NO: 3453050 - DNA, 17 bp, Homo sapiens
ctactcagcatttgatt

SEQ ID NO: 3453051 - DNA, 21 bp, Homo sapiens
ctactccagtatgacagagga

SEQ ID NO: 3453052 - DNA, 16 bp, Homo sapiens
ctactccggagacagg

SEQ ID NO: 3453053 - DNA, 20 bp, Homo sapiens
ctactctccccacgagggct

SEQ ID NO: 3453054 - DNA, 22 bp, Homo sapiens
ctactctgttccttcacatcct

SEQ ID NO: 3453055 - DNA, 16 bp, Homo sapiens
ctactcttacatgtat

SEQ ID NO: 3453056 - DNA, 21 bp, Homo sapiens
ctactgcccaggcactgcaaa

SEQ ID NO: 3453057 - DNA, 15 bp, Homo sapiens
ctactgcctttagaa

SEQ ID NO: 3453058 - DNA, 16 bp, Homo sapiens
ctactgcctttagaaa

SEQ ID NO: 3453059 - DNA, 11 bp, Homo sapiens
ctactgctgtg

SEQ ID NO: 3453060 - DNA, 17 bp, Homo sapiens
ctactgtaattttatat

SEQ ID NO: 3453061 - DNA, 20 bp, Homo sapiens
ctactgtcctacccaccctc

SEQ ID NO: 3453062 - DNA, 19 bp, Homo sapiens
ctactgtgtgtgtgaatga

SEQ ID NO: 3453063 - DNA, 20 bp, Homo sapiens
ctacttacccaggtgggtcc

SEQ ID NO: 3453064 - DNA, 14 bp, Homo sapiens
ctacttgctcaggt

SEQ ID NO: 3453065 - DNA, 17 bp, Homo sapiens
ctacttggtttgtgttc

SEQ ID NO: 3453066 - DNA, 16 bp, Homo sapiens
ctagaaacttccaaat

SEQ ID NO: 3453067 - DNA, 18 bp, Homo sapiens
ctagaaatgggaatcatg

SEQ ID NO: 3453068 - DNA, 16 bp, Homo sapiens
ctagaaattgacacaa

SEQ ID NO: 3453069 - DNA, 20 bp, Homo sapiens
ctagaaattgacacaagtgg

SEQ ID NO: 3453070 - DNA, 18 bp, Homo sapiens
ctagaaattgcctatcct

SEQ ID NO: 3453071 - DNA, 22 bp, Homo sapiens
ctagaatttattcaattcctct

SEQ ID NO: 3453072 - DNA, 16 bp, Homo sapiens
ctagacaagccagaac

SEQ ID NO: 3453073 - DNA, 17 bp, Homo sapiens
ctagacaagccagaact

SEQ ID NO: 3453074 - DNA, 22 bp, Homo sapiens
ctagactcggggtgcttccttg

SEQ ID NO: 3453075 - DNA, 16 bp, Homo sapiens
ctagactttaggcttt

SEQ ID NO: 3453076 - DNA, 22 bp, Homo sapiens
ctagactttaggctttcagctt

SEQ ID NO: 3453077 - DNA, 23 bp, Homo sapiens
ctagagagggaggcaagccctgt

SEQ ID NO: 3453078 - DNA, 14 bp, Homo sapiens
ctagagcctcttgg

SEQ ID NO: 3453079 - DNA, 17 bp, Homo sapiens
ctagagccttcagcctt

SEQ ID NO: 3453080 - DNA, 13 bp, Homo sapiens
ctagagctttttt

SEQ ID NO: 3453081 - DNA, 13 bp, Homo sapiens
cccctccgcctcc

SEQ ID NO: 3453082 - DNA, 18 bp, Homo sapiens
cccctcctccactctccc

SEQ ID NO: 3453083 - DNA, 11 bp, Homo sapiens
cccctctctgg

SEQ ID NO: 3453084 - DNA, 12 bp, Homo sapiens
cccctctggtcg

SEQ ID NO: 3453085 - DNA, 15 bp, Homo sapiens
cccctcttctgagct

SEQ ID NO: 3453086 - DNA, 20 bp, Homo sapiens
cccctgaaagtgacagagac

SEQ ID NO: 3453087 - DNA, 14 bp, Homo sapiens
cccctgactcatca

SEQ ID NO: 3453088 - DNA, 12 bp, Homo sapiens
cccctgccacca

SEQ ID NO: 3453089 - DNA, 16 bp, Homo sapiens
cccctgcccccaggac

SEQ ID NO: 3453090 - DNA, 18 bp, Homo sapiens
cccctgcccccaggactg

SEQ ID NO: 3453091 - DNA, 19 bp, Homo sapiens
cccctgcccggctgcggaa

SEQ ID NO: 3453092 - DNA, 14 bp, Homo sapiens
cccctgccctgtgg

SEQ ID NO: 3453093 - DNA, 15 bp, Homo sapiens
cccctgccctgtggg

SEQ ID NO: 3453094 - DNA, 14 bp, Homo sapiens
cccctgctgctgtc

SEQ ID NO: 3453095 - DNA, 21 bp, Homo sapiens
cccctgctgctgtcacctctc

SEQ ID NO: 3453096 - DNA, 20 bp, Homo sapiens
cccctgctggttcagggttg

SEQ ID NO: 3453097 - DNA, 18 bp, Homo sapiens
cccctgctgtctctctgg

SEQ ID NO: 3453098 - DNA, 22 bp, Homo sapiens
cccctggaagagcccagtctgt

SEQ ID NO: 3453099 - DNA, 15 bp, Homo sapiens
cccctggacatgcct

SEQ ID NO: 3453100 - DNA, 12 bp, Homo sapiens
cccctggcctct

SEQ ID NO: 3453101 - DNA, 14 bp, Homo sapiens
cccctggcctctgt

SEQ ID NO: 3453102 - DNA, 12 bp, Homo sapiens
cccctggctctg

SEQ ID NO: 3453103 - DNA, 14 bp, Homo sapiens
cccctggctctggg

SEQ ID NO: 3453104 - DNA, 22 bp, Homo sapiens
cccctggctgggacgtggctca

SEQ ID NO: 3453105 - DNA, 15 bp, Homo sapiens
cccctggggacccac

SEQ ID NO: 3453106 - DNA, 14 bp, Homo sapiens
cccctgtactccag

SEQ ID NO: 3453107 - DNA, 20 bp, Homo sapiens
cccctgtgcagccgctgagc

SEQ ID NO: 3453108 - DNA, 21 bp, Homo sapiens
ccccttaatcttgctttcttt

SEQ ID NO: 3453109 - DNA, 19 bp, Homo sapiens
ccccttatgttgaggtgac

SEQ ID NO: 3453110 - DNA, 10 bp, Homo sapiens
ccccttccca

SEQ ID NO: 3453111 - DNA, 15 bp, Homo sapiens
ccccttcgctcctgt

SEQ ID NO: 3453112 - DNA, 16 bp, Homo sapiens
ccccttctctcatctc

SEQ ID NO: 3453113 - DNA, 20 bp, Homo sapiens
cccctttaccctctttgctg

SEQ ID NO: 3453114 - DNA, 13 bp, Homo sapiens
cccctttcctgtc

SEQ ID NO: 3453115 - DNA, 20 bp, Homo sapiens
cccctttgatgattaattca

SEQ ID NO: 3453116 - DNA, 18 bp, Homo sapiens
cccctttggtttggcctc

SEQ ID NO: 3453117 - DNA, 22 bp, Homo sapiens
cccgaatagctgggactacagg

SEQ ID NO: 3453118 - DNA, 15 bp, Homo sapiens
cccgacagagggaag

SEQ ID NO: 3453119 - DNA, 15 bp, Homo sapiens
cccgagccaccccag

SEQ ID NO: 3453120 - DNA, 19 bp, Homo sapiens
cccgaggccgcgtgcgtga

SEQ ID NO: 3453121 - DNA, 15 bp, Homo sapiens
cccgaggccttctct

SEQ ID NO: 3453122 - DNA, 12 bp, Homo sapiens
cccgcacacctg

SEQ ID NO: 3453123 - DNA, 16 bp, Homo sapiens
cccgcagacaccttgg

SEQ ID NO: 3453124 - DNA, 13 bp, Homo sapiens
cccgcagagcgcg

SEQ ID NO: 3453125 - DNA, 19 bp, Homo sapiens
cccgccggaggccagctat

SEQ ID NO: 3453126 - DNA, 20 bp, Homo sapiens
cccgccggaggccagctatc

SEQ ID NO: 3453127 - DNA, 21 bp, Homo sapiens
cccgccggaggccagctatct

SEQ ID NO: 3453128 - DNA, 13 bp, Homo sapiens
cccgcctgcctgc

SEQ ID NO: 3453129 - DNA, 16 bp, Homo sapiens
cccgcctgcctgccac

SEQ ID NO: 3453130 - DNA, 18 bp, Homo sapiens
cccgcgcccccaccccag

SEQ ID NO: 3453131 - DNA, 22 bp, Homo sapiens
cccgcggggctgtcggcgctgc

SEQ ID NO: 3453132 - DNA, 12 bp, Homo sapiens
cccgcttcccca

SEQ ID NO: 3453133 - DNA, 20 bp, Homo sapiens
cccggagaaggccgctgccc

SEQ ID NO: 3453134 - DNA, 21 bp, Homo sapiens
cccggagaaggccgctgcccc

SEQ ID NO: 3453135 - DNA, 14 bp, Homo sapiens
cccggagctccggc

SEQ ID NO: 3453136 - DNA, 17 bp, Homo sapiens
cccggagctgcccctct

SEQ ID NO: 3453137 - DNA, 14 bp, Homo sapiens
cccggcagggcggg

SEQ ID NO: 3453138 - DNA, 11 bp, Homo sapiens
cccggccagcc

SEQ ID NO: 3453139 - DNA, 17 bp, Homo sapiens
cccggctaatttttgta

SEQ ID NO: 3453140 - DNA, 11 bp, Homo sapiens
cccggctccag

SEQ ID NO: 3453141 - DNA, 14 bp, Homo sapiens
cccggctccaggct

SEQ ID NO: 3453142 - DNA, 22 bp, Homo sapiens
cccggctcgagcagtcctgcct

SEQ ID NO: 3453143 - DNA, 16 bp, Homo sapiens
cccggctctgtgggtg

SEQ ID NO: 3453144 - DNA, 21 bp, Homo sapiens
cccggctgcagaggccagagg

SEQ ID NO: 3453145 - DNA, 20 bp, Homo sapiens
cccgggaacctccccagcct

SEQ ID NO: 3453146 - DNA, 23 bp, Homo sapiens
cccgggaacctccccagcctgcg

SEQ ID NO: 3453147 - DNA, 15 bp, Homo sapiens
cccggggcccagggc

SEQ ID NO: 3453148 - DNA, 13 bp, Homo sapiens
cccgggggtgggg

SEQ ID NO: 3453149 - DNA, 14 bp, Homo sapiens
cccgggtccccagc

SEQ ID NO: 3453150 - DNA, 17 bp, Homo sapiens
cccgggtccccagctcc

SEQ ID NO: 3453151 - DNA, 13 bp, Homo sapiens
cccggtgctccct

SEQ ID NO: 3453152 - DNA, 14 bp, Homo sapiens
ccctaaaagcacac

SEQ ID NO: 3453153 - DNA, 20 bp, Homo sapiens
ccctaccacacatctgtgga

SEQ ID NO: 3453154 - DNA, 17 bp, Homo sapiens
ccctaccacctccccag

SEQ ID NO: 3453155 - DNA, 19 bp, Homo sapiens
ccctaccacctccccagcc

SEQ ID NO: 3453156 - DNA, 14 bp, Homo sapiens
ccctactgctgtga

SEQ ID NO: 3453157 - DNA, 22 bp, Homo sapiens
ccctacttcattttcagagtga

SEQ ID NO: 3453158 - DNA, 17 bp, Homo sapiens
ccctagaaacttccaaa

SEQ ID NO: 3453159 - DNA, 21 bp, Homo sapiens
ccctagttttctttcctcctt

SEQ ID NO: 3453160 - DNA, 14 bp, Homo sapiens
ccctatgggcctgc

SEQ ID NO: 3453161 - DNA, 19 bp, Homo sapiens
ccctattttttgacacttc

SEQ ID NO: 3453162 - DNA, 18 bp, Homo sapiens
ccctcaaaaaaagccttt

SEQ ID NO: 3453163 - DNA, 15 bp, Homo sapiens
ccctcaagaacatga

SEQ ID NO: 3453164 - DNA, 21 bp, Homo sapiens
ccctcaagaacatgatgggcc

SEQ ID NO: 3453165 - DNA, 17 bp, Homo sapiens
ccctcaccccctccttc

SEQ ID NO: 3453166 - DNA, 21 bp, Homo sapiens
ccctcacctacttacccaggt

SEQ ID NO: 3453167 - DNA, 23 bp, Homo sapiens
ccctcaccttggcaccagacacc

SEQ ID NO: 3453168 - DNA, 22 bp, Homo sapiens
ccctcactatatattattctcg

SEQ ID NO: 3453169 - DNA, 22 bp, Homo sapiens
ccctcagaacccttggcttgcc

SEQ ID NO: 3453170 - DNA, 23 bp, Homo sapiens
ccctcagaacccttggcttgccc

SEQ ID NO: 3453171 - DNA, 15 bp, Homo sapiens
ccctcagagtgcaag

SEQ ID NO: 3453172 - DNA, 15 bp, Homo sapiens
ccctcataccatctg

SEQ ID NO: 3453173 - DNA, 17 bp, Homo sapiens
ccctcataccatctgct

SEQ ID NO: 3453174 - DNA, 13 bp, Homo sapiens
ccctcatctgtcc

SEQ ID NO: 3453175 - DNA, 19 bp, Homo sapiens
ccctccagaacacggctca

SEQ ID NO: 3453176 - DNA, 17 bp, Homo sapiens
ccctccccattcacaga

SEQ ID NO: 3453177 - DNA, 18 bp, Homo sapiens
ccctccccattcacagag

SEQ ID NO: 3453178 - DNA, 21 bp, Homo sapiens
ccctccccattcacagagcct

SEQ ID NO: 3453179 - DNA, 13 bp, Homo sapiens
ccctccccctgag

SEQ ID NO: 3453180 - DNA, 16 bp, Homo sapiens
ccctccccgccctttt

SEQ ID NO: 3453181 - DNA, 16 bp, Homo sapiens
ccctccgccaggcgag

SEQ ID NO: 3453182 - DNA, 16 bp, Homo sapiens
ccctccgcctccagga

SEQ ID NO: 3453183 - DNA, 14 bp, Homo sapiens
ccctccgccttcac

SEQ ID NO: 3453184 - DNA, 18 bp, Homo sapiens
ccctccggactggtgccc

SEQ ID NO: 3453185 - DNA, 18 bp, Homo sapiens
ccctccgtggcatcacct

SEQ ID NO: 3453186 - DNA, 13 bp, Homo sapiens
ccctcctccactc

SEQ ID NO: 3453187 - DNA, 13 bp, Homo sapiens
ccctcctctccca

SEQ ID NO: 3453188 - DNA, 14 bp, Homo sapiens
ccctcctctcccat

SEQ ID NO: 3453189 - DNA, 19 bp, Homo sapiens
ccctcctggagctctgtgg

SEQ ID NO: 3453190 - DNA, 20 bp, Homo sapiens
ccctcctggagctctgtggg

SEQ ID NO: 3453191 - DNA, 21 bp, Homo sapiens
ccctcctggagctctgtgggt

SEQ ID NO: 3453192 - DNA, 21 bp, Homo sapiens
ccctcgcttggacggctgggc

SEQ ID NO: 3453193 - DNA, 19 bp, Homo sapiens
ccctctaacctcgccctct

SEQ ID NO: 3453194 - DNA, 15 bp, Homo sapiens
ccctctacagagctt

SEQ ID NO: 3453195 - DNA, 18 bp, Homo sapiens
ccctctacagagcttccc

SEQ ID NO: 3453196 - DNA, 15 bp, Homo sapiens
ccctctcatctcagg

SEQ ID NO: 3453197 - DNA, 12 bp, Homo sapiens
ccctctcctccg

SEQ ID NO: 3453198 - DNA, 11 bp, Homo sapiens
ccctctctgga

SEQ ID NO: 3453199 - DNA, 13 bp, Homo sapiens
ccctctctgggcc

SEQ ID NO: 3453200 - DNA, 19 bp, Homo sapiens
ccctctctgggcctcagag

SEQ ID NO: 3453201 - DNA, 20 bp, Homo sapiens
ccctctgaaagttgtacatg

SEQ ID NO: 3453202 - DNA, 19 bp, Homo sapiens
ccctctgctgaagacttgc

SEQ ID NO: 3453203 - DNA, 17 bp, Homo sapiens
ccctctgggggctctgg

SEQ ID NO: 3453204 - DNA, 14 bp, Homo sapiens
ccctcttctgagca

SEQ ID NO: 3453205 - DNA, 18 bp, Homo sapiens
ccctctttcgtctactgc

SEQ ID NO: 3453206 - DNA, 19 bp, Homo sapiens
ccctctttcgtctactgca

SEQ ID NO: 3453207 - DNA, 15 bp, Homo sapiens
ccctctttgctgcag

SEQ ID NO: 3453208 - DNA, 18 bp, Homo sapiens
ccctgaaagccctgagct

SEQ ID NO: 3453209 - DNA, 15 bp, Homo sapiens
ccctgaccctgtgga

SEQ ID NO: 3453210 - DNA, 19 bp, Homo sapiens
ccctgaccctgtggaagca

SEQ ID NO: 3453211 - DNA, 15 bp, Homo sapiens
ccctgactcattctg

SEQ ID NO: 3453212 - DNA, 18 bp, Homo sapiens
ccctgagaaacccaccag

SEQ ID NO: 3453213 - DNA, 13 bp, Homo sapiens
ccctgagctgagg

SEQ ID NO: 3453214 - DNA, 17 bp, Homo sapiens
ccctgagctgaggcagc

SEQ ID NO: 3453215 - DNA, 16 bp, Homo sapiens
ccctgagctttctgct

SEQ ID NO: 3453216 - DNA, 18 bp, Homo sapiens
ccctgcaaaaggactctc

SEQ ID NO: 3453217 - DNA, 20 bp, Homo sapiens
ccctgcaaaaggactctcag

SEQ ID NO: 3453218 - DNA, 12 bp, Homo sapiens
ccctgcacttgc

SEQ ID NO: 3453219 - DNA, 19 bp, Homo sapiens
ccctgcatctgaccagcag

SEQ ID NO: 3453220 - DNA, 14 bp, Homo sapiens
ccctgccaccctgg

SEQ ID NO: 3453221 - DNA, 17 bp, Homo sapiens
ccctgccacctcctgcc

SEQ ID NO: 3453222 - DNA, 13 bp, Homo sapiens
ccctgccactcac

SEQ ID NO: 3453223 - DNA, 18 bp, Homo sapiens
ccctgcccccaggactgg

SEQ ID NO: 3453224 - DNA, 17 bp, Homo sapiens
ccctgcccggctgcgga

SEQ ID NO: 3453225 - DNA, 16 bp, Homo sapiens
ccctgccctcacctcc

SEQ ID NO: 3453226 - DNA, 14 bp, Homo sapiens
ccctgccctcccct

SEQ ID NO: 3453227 - DNA, 17 bp, Homo sapiens
ccctgccctgccctcac

SEQ ID NO: 3453228 - DNA, 17 bp, Homo sapiens
ccctgcctcctactcca

SEQ ID NO: 3453229 - DNA, 15 bp, Homo sapiens
ccctgcgcctgtgat

SEQ ID NO: 3453230 - DNA, 12 bp, Homo sapiens
ccctgcggagcc

SEQ ID NO: 3453231 - DNA, 13 bp, Homo sapiens
ccctgctgctgcc

SEQ ID NO: 3453232 - DNA, 20 bp, Homo sapiens
ccctgctgctgccagggctt

SEQ ID NO: 3453233 - DNA, 17 bp, Homo sapiens
ccctgctgctgcctgcc

SEQ ID NO: 3453234 - DNA, 18 bp, Homo sapiens
ccctgctgctgcctgcct

SEQ ID NO: 3453235 - DNA, 13 bp, Homo sapiens
ccctgctggttca

SEQ ID NO: 3453236 - DNA, 17 bp, Homo sapiens
ccctggacatgcctgtc

SEQ ID NO: 3453237 - DNA, 16 bp, Homo sapiens
ccctggaccagtggtc

SEQ ID NO: 3453238 - DNA, 21 bp, Homo sapiens
ccctggagaggccctctggag

SEQ ID NO: 3453239 - DNA, 13 bp, Homo sapiens
ccctggccccagg

SEQ ID NO: 3453240 - DNA, 14 bp, Homo sapiens
ccctggccccagga

SEQ ID NO: 3453241 - DNA, 12 bp, Homo sapiens
ccctggccccct

SEQ ID NO: 3453242 - DNA, 20 bp, Homo sapiens
ccctggccgagtccaagctg

SEQ ID NO: 3453243 - DNA, 11 bp, Homo sapiens
ccctggcctcc

SEQ ID NO: 3453244 - DNA, 19 bp, Homo sapiens
ccctggcctcccctgccac

SEQ ID NO: 3453245 - DNA, 15 bp, Homo sapiens
ccctggcctctgtgc

SEQ ID NO: 3453246 - DNA, 18 bp, Homo sapiens
ccctggcctctgtgcctt

SEQ ID NO: 3453247 - DNA, 14 bp, Homo sapiens
ccctggctccttca

SEQ ID NO: 3453248 - DNA, 17 bp, Homo sapiens
ccctggctccttcacca

SEQ ID NO: 3453249 - DNA, 13 bp, Homo sapiens
ccctggcttctgt

SEQ ID NO: 3453250 - DNA, 15 bp, Homo sapiens
ccctggcttctgtgg

SEQ ID NO: 3453251 - DNA, 17 bp, Homo sapiens
ccctggcttctgtgggg

SEQ ID NO: 3453252 - DNA, 18 bp, Homo sapiens
ccctgggccctgggctgg

SEQ ID NO: 3453253 - DNA, 13 bp, Homo sapiens
ccctgggctggaa

SEQ ID NO: 3453254 - DNA, 14 bp, Homo sapiens
ccctgggctggaat

SEQ ID NO: 3453255 - DNA, 19 bp, Homo sapiens
ccctggggaaggagccagt

SEQ ID NO: 3453256 - DNA, 16 bp, Homo sapiens
ccctggggctggcttt

SEQ ID NO: 3453257 - DNA, 15 bp, Homo sapiens
ccctggtcctggcct

SEQ ID NO: 3453258 - DNA, 23 bp, Homo sapiens
ccctggtcctggcctccttcccc

SEQ ID NO: 3453259 - DNA, 13 bp, Homo sapiens
ccctggtggcagt

SEQ ID NO: 3453260 - DNA, 14 bp, Homo sapiens
ccctggtggcagtg

SEQ ID NO: 3453261 - DNA, 22 bp, Homo sapiens
ccctggtggcagtgggagctgc

SEQ ID NO: 3453262 - DNA, 16 bp, Homo sapiens
ccctggtgggccaaca

SEQ ID NO: 3453263 - DNA, 23 bp, Homo sapiens
ccctggttctgatgatgtgcctg

SEQ ID NO: 3453264 - DNA, 17 bp, Homo sapiens
ccctgtagttaggcctg

SEQ ID NO: 3453265 - DNA, 18 bp, Homo sapiens
ccctgtagttaggcctgg

SEQ ID NO: 3453266 - DNA, 22 bp, Homo sapiens
ccctgtagttgacaattctgca

SEQ ID NO: 3453267 - DNA, 14 bp, Homo sapiens
ccctgtcacctctt

SEQ ID NO: 3453268 - DNA, 15 bp, Homo sapiens
ccctgtcctgccatg

SEQ ID NO: 3453269 - DNA, 17 bp, Homo sapiens
ccctgtctagagaggga

SEQ ID NO: 3453270 - DNA, 23 bp, Homo sapiens
ccctgtctcaaaaaaagaaaaag

SEQ ID NO: 3453271 - DNA, 14 bp, Homo sapiens
ccctgtcttcctct

SEQ ID NO: 3453272 - DNA, 17 bp, Homo sapiens
ccctgtcttcctctgca

SEQ ID NO: 3453273 - DNA, 20 bp, Homo sapiens
ccctgtctttactcctcaca

SEQ ID NO: 3453274 - DNA, 14 bp, Homo sapiens
ccctgtctttccta

SEQ ID NO: 3453275 - DNA, 23 bp, Homo sapiens
ccctgtctttcctaagacctggg

SEQ ID NO: 3453276 - DNA, 22 bp, Homo sapiens
ccctgtgcagccgctgagcgag

SEQ ID NO: 3453277 - DNA, 16 bp, Homo sapiens
ccctgttccccagaga

SEQ ID NO: 3453278 - DNA, 17 bp, Homo sapiens
ccctgttctcctcccca

SEQ ID NO: 3453279 - DNA, 11 bp, Homo sapiens
ccctgttgcta

SEQ ID NO: 3453280 - DNA, 22 bp, Homo sapiens
ccctgttttcccacgaggaatc

SEQ ID NO: 3453281 - DNA, 16 bp, Homo sapiens
cccttacttcttgccc

SEQ ID NO: 3453282 - DNA, 14 bp, Homo sapiens
cccttagcagggaa

SEQ ID NO: 3453283 - DNA, 23 bp, Homo sapiens
cccttagcagggaaacagctaat

SEQ ID NO: 3453284 - DNA, 20 bp, Homo sapiens
cccttatctgtgctcaggac

SEQ ID NO: 3453285 - DNA, 18 bp, Homo sapiens
cccttcacaaagcccaag

SEQ ID NO: 3453286 - DNA, 19 bp, Homo sapiens
cccttcattgatttcctgt

SEQ ID NO: 3453287 - DNA, 11 bp, Homo sapiens
cccttcccaca

SEQ ID NO: 3453288 - DNA, 22 bp, Homo sapiens
cccttcctattccaagcttcca

SEQ ID NO: 3453289 - DNA, 14 bp, Homo sapiens
cccttcctctttgg

SEQ ID NO: 3453290 - DNA, 15 bp, Homo sapiens
cccttcctctttggt

SEQ ID NO: 3453291 - DNA, 13 bp, Homo sapiens
cccttcgctcctg

SEQ ID NO: 3453292 - DNA, 15 bp, Homo sapiens
cccttcgctcctgtg

SEQ ID NO: 3453293 - DNA, 16 bp, Homo sapiens
cccttcgctcctgtgt

SEQ ID NO: 3453294 - DNA, 23 bp, Homo sapiens
cccttctagggttattgcatttg

SEQ ID NO: 3453295 - DNA, 20 bp, Homo sapiens
cccttctcctcttgtaaata

SEQ ID NO: 3453296 - DNA, 15 bp, Homo sapiens
cccttctctcatctc

SEQ ID NO: 3453297 - DNA, 14 bp, Homo sapiens
cccttctgctcagc

SEQ ID NO: 3453298 - DNA, 22 bp, Homo sapiens
cccttctggtgccagatcctct

SEQ ID NO: 3453299 - DNA, 17 bp, Homo sapiens
cccttctgtccctcaca

SEQ ID NO: 3453300 - DNA, 17 bp, Homo sapiens
cccttgacaactggcag

SEQ ID NO: 3453301 - DNA, 21 bp, Homo sapiens
cccttgacaactggcaggcag

SEQ ID NO: 3453302 - DNA, 14 bp, Homo sapiens
cccttgagaaacct

SEQ ID NO: 3453303 - DNA, 22 bp, Homo sapiens
cccttgagaaaccttattgtac

SEQ ID NO: 3453304 - DNA, 22 bp, Homo sapiens
cccttgctggagtcatgtgcct

SEQ ID NO: 3453305 - DNA, 13 bp, Homo sapiens
cccttggaggcca

SEQ ID NO: 3453306 - DNA, 23 bp, Homo sapiens
cccttgtacctatggctgcctgc

SEQ ID NO: 3453307 - DNA, 13 bp, Homo sapiens
ccctttaccctct

SEQ ID NO: 3453308 - DNA, 17 bp, Homo sapiens
ccctttcctcctcaggc

SEQ ID NO: 3453309 - DNA, 12 bp, Homo sapiens
ccctttcctgtc

SEQ ID NO: 3453310 - DNA, 14 bp, Homo sapiens
ccctttctcccctg

SEQ ID NO: 3453311 - DNA, 12 bp, Homo sapiens
ccctttgagtgc

SEQ ID NO: 3453312 - DNA, 14 bp, Homo sapiens
ccctttgagtgcag

SEQ ID NO: 3453313 - DNA, 13 bp, Homo sapiens
ccctttgctgtcc

SEQ ID NO: 3453314 - DNA, 16 bp, Homo sapiens
ccctttggtttggcct

SEQ ID NO: 3453315 - DNA, 17 bp, Homo sapiens
ccctttggtttggcctc

SEQ ID NO: 3453316 - DNA, 20 bp, Homo sapiens
ccctttggtttggcctccat

SEQ ID NO: 3453317 - DNA, 23 bp, Homo sapiens
cccttttctgggtttgaagctgc

SEQ ID NO: 3453318 - DNA, 16 bp, Homo sapiens
ccctttttacacttta

SEQ ID NO: 3453319 - DNA, 14 bp, Homo sapiens
cccttttttctgcc

SEQ ID NO: 3453320 - DNA, 16 bp, Homo sapiens
ccgaacctcctctgtg

SEQ ID NO: 3453321 - DNA, 17 bp, Homo sapiens
ccgaatagctgggacta

SEQ ID NO: 3453322 - DNA, 20 bp, Homo sapiens
ccgaatgttgaggtggactc

SEQ ID NO: 3453323 - DNA, 16 bp, Homo sapiens
ccgaccttagatttag

SEQ ID NO: 3453324 - DNA, 14 bp, Homo sapiens
ccgactgctttgga

SEQ ID NO: 3453325 - DNA, 16 bp, Homo sapiens
ccgactgctttggacc

SEQ ID NO: 3453326 - DNA, 17 bp, Homo sapiens
ccgagaaggaagcctcc

SEQ ID NO: 3453327 - DNA, 13 bp, Homo sapiens
ccgagagccaaac

SEQ ID NO: 3453328 - DNA, 15 bp, Homo sapiens
ccgagattgcaccac

SEQ ID NO: 3453329 - DNA, 14 bp, Homo sapiens
ccgagccaccccag

SEQ ID NO: 3453330 - DNA, 23 bp, Homo sapiens
ccgagggaggggaagcttctgtc

SEQ ID NO: 3453331 - DNA, 19 bp, Homo sapiens
ccgaggtgagcggatcaca

SEQ ID NO: 3453332 - DNA, 16 bp, Homo sapiens
ccgagtagctgggact

SEQ ID NO: 3453333 - DNA, 17 bp, Homo sapiens
ccgagtagctgggacta

SEQ ID NO: 3453334 - DNA, 19 bp, Homo sapiens
ccgagtcattcgttctgtg

SEQ ID NO: 3453335 - DNA, 22 bp, Homo sapiens
ccgagttaaggtgggcccggcc

SEQ ID NO: 3453336 - DNA, 15 bp, Homo sapiens
ccgattgggagaaag

SEQ ID NO: 3453337 - DNA, 21 bp, Homo sapiens
ccgcaaaccacactggactcc

SEQ ID NO: 3453338 - DNA, 18 bp, Homo sapiens
ccgcacgcctctccctgc

SEQ ID NO: 3453339 - DNA, 15 bp, Homo sapiens
ccgcagacaccttgg

SEQ ID NO: 3453340 - DNA, 14 bp, Homo sapiens
ccgcagacctctgg

SEQ ID NO: 3453341 - DNA, 22 bp, Homo sapiens
ccgcagagcgcgcccctagccg

SEQ ID NO: 3453342 - DNA, 15 bp, Homo sapiens
ccgcagagctggccg

SEQ ID NO: 3453343 - DNA, 11 bp, Homo sapiens
ccgcagcaccc

SEQ ID NO: 3453344 - DNA, 13 bp, Homo sapiens
ccgcaggaagctg

SEQ ID NO: 3453345 - DNA, 15 bp, Homo sapiens
ccgcaggaagctgct

SEQ ID NO: 3453346 - DNA, 19 bp, Homo sapiens
ccgcaggaagctgctccgt

SEQ ID NO: 3453347 - DNA, 21 bp, Homo sapiens
ccgccaaaagctgctcaggga

SEQ ID NO: 3453348 - DNA, 16 bp, Homo sapiens
ccgccatgctcctggc

SEQ ID NO: 3453349 - DNA, 11 bp, Homo sapiens
ccgccccctgc

SEQ ID NO: 3453350 - DNA, 16 bp, Homo sapiens
ccgccccctgccctcc

SEQ ID NO: 3453351 - DNA, 13 bp, Homo sapiens
ccgccctgccact

SEQ ID NO: 3453352 - DNA, 17 bp, Homo sapiens
ccgccggaggccagcta

SEQ ID NO: 3453353 - DNA, 13 bp, Homo sapiens
ccgcctccaggag

SEQ ID NO: 3453354 - DNA, 15 bp, Homo sapiens
ccgcctgcctgccac

SEQ ID NO: 3453355 - DNA, 22 bp, Homo sapiens
ccgcctggtactcaagcccgcg

SEQ ID NO: 3453356 - DNA, 22 bp, Homo sapiens
ccgcgccaaataatgtctctgt

SEQ ID NO: 3453357 - DNA, 23 bp, Homo sapiens
ccgctccaggtaccttgaccttt

SEQ ID NO: 3453358 - DNA, 13 bp, Homo sapiens
ccgctgattctca

SEQ ID NO: 3453359 - DNA, 17 bp, Homo sapiens
ccgctgccacccacctc

SEQ ID NO: 3453360 - DNA, 19 bp, Homo sapiens
ccgctgcttccaggctggg

SEQ ID NO: 3453361 - DNA, 21 bp, Homo sapiens
ccgctgtggccgcacgcctct

SEQ ID NO: 3453362 - DNA, 14 bp, Homo sapiens
ccgcttccccacag

SEQ ID NO: 3453363 - DNA, 19 bp, Homo sapiens
ccgcttccccacagaactg

SEQ ID NO: 3453364 - DNA, 15 bp, Homo sapiens
ccgcttctgcctgca

SEQ ID NO: 3453365 - DNA, 23 bp, Homo sapiens
ccgcttgaaaagctagtgtacct

SEQ ID NO: 3453366 - DNA, 18 bp, Homo sapiens
ccgcttggagcagagggg

SEQ ID NO: 3453367 - DNA, 17 bp, Homo sapiens
ccggaccctctaacctc

SEQ ID NO: 3453368 - DNA, 19 bp, Homo sapiens
ccggagctgcccctctctg

SEQ ID NO: 3453369 - DNA, 21 bp, Homo sapiens
ccggagctgcccctctctggg

SEQ ID NO: 3453370 - DNA, 23 bp, Homo sapiens
ccggagctgcccctctctgggcc

SEQ ID NO: 3453371 - DNA, 12 bp, Homo sapiens
ccggaggccagc

SEQ ID NO: 3453372 - DNA, 15 bp, Homo sapiens
ccggaggccagctat

SEQ ID NO: 3453373 - DNA, 21 bp, Homo sapiens
ccggaggccagctatctgcct

SEQ ID NO: 3453374 - DNA, 22 bp, Homo sapiens
ccggaggccagctatctgcctg

SEQ ID NO: 3453375 - DNA, 13 bp, Homo sapiens
ccggagggctgcg

SEQ ID NO: 3453376 - DNA, 15 bp, Homo sapiens
ccggatcctgggtgg

SEQ ID NO: 3453377 - DNA, 14 bp, Homo sapiens
ccggcacagctggg

SEQ ID NO: 3453378 - DNA, 17 bp, Homo sapiens
ccggcagccccagcctg

SEQ ID NO: 3453379 - DNA, 20 bp, Homo sapiens
ccggcagccccagcctgcta

SEQ ID NO: 3453380 - DNA, 11 bp, Homo sapiens
ccggcagggcg

SEQ ID NO: 3453381 - DNA, 17 bp, Homo sapiens
ccggcagttctgggtgc

SEQ ID NO: 3453382 - DNA, 14 bp, Homo sapiens
ccggcccctgctgg

SEQ ID NO: 3453383 - DNA, 18 bp, Homo sapiens
ccggcccgcgccacagga

SEQ ID NO: 3453384 - DNA, 15 bp, Homo sapiens
ccggcgagccctgtg

SEQ ID NO: 3453385 - DNA, 14 bp, Homo sapiens
ccggctccaggctc

SEQ ID NO: 3453386 - DNA, 21 bp, Homo sapiens
ccggctccaggctcctttagc

SEQ ID NO: 3453387 - DNA, 15 bp, Homo sapiens
ccggctccagtttcc

SEQ ID NO: 3453388 - DNA, 15 bp, Homo sapiens
ccggctcccagcctc

SEQ ID NO: 3453389 - DNA, 15 bp, Homo sapiens
ccggctctgtgggtg

SEQ ID NO: 3453390 - DNA, 14 bp, Homo sapiens
ccggcttctcggct

SEQ ID NO: 3453391 - DNA, 18 bp, Homo sapiens
ccgggaacctccccagcc

SEQ ID NO: 3453392 - DNA, 17 bp, Homo sapiens
ccgggacctggtgctgc

SEQ ID NO: 3453393 - DNA, 15 bp, Homo sapiens
ccgggcactcagaag

SEQ ID NO: 3453394 - DNA, 11 bp, Homo sapiens
ccgggcagaaa

SEQ ID NO: 3453395 - DNA, 13 bp, Homo sapiens
ccgggccagggct

SEQ ID NO: 3453396 - DNA, 14 bp, Homo sapiens
ccgggccagggctg

SEQ ID NO: 3453397 - DNA, 14 bp, Homo sapiens
ccgggcctggggct

SEQ ID NO: 3453398 - DNA, 16 bp, Homo sapiens
ccgggctgagggcctg

SEQ ID NO: 3453399 - DNA, 15 bp, Homo sapiens
ccggggaaaggcaag

SEQ ID NO: 3453400 - DNA, 19 bp, Homo sapiens
ccggggccttatcgggctc

SEQ ID NO: 3453401 - DNA, 16 bp, Homo sapiens
ccggtgctccctctgt

SEQ ID NO: 3453402 - DNA, 14 bp, Homo sapiens
ccggtggctgggca

SEQ ID NO: 3453403 - DNA, 19 bp, Homo sapiens
ccggttcctgtccctgcgc

SEQ ID NO: 3453404 - DNA, 21 bp, Homo sapiens
ccgtaaacacgcctgcaaacg

SEQ ID NO: 3453405 - DNA, 16 bp, Homo sapiens
ccgtaggttattttca

SEQ ID NO: 3453406 - DNA, 21 bp, Homo sapiens
ccgtcaccacgactggccagg

SEQ ID NO: 3453407 - DNA, 20 bp, Homo sapiens
ccgtcacgtgcgctgggcac

SEQ ID NO: 3453408 - DNA, 23 bp, Homo sapiens
ccgtccatatcagaactgtgcca

SEQ ID NO: 3453409 - DNA, 15 bp, Homo sapiens
ccgtcccctgcccac

SEQ ID NO: 3453410 - DNA, 20 bp, Homo sapiens
ccgtctccaggggctgcttc

SEQ ID NO: 3453411 - DNA, 15 bp, Homo sapiens
ccgtgagcatgtttg

SEQ ID NO: 3453412 - DNA, 20 bp, Homo sapiens
ccgtgcttgtttgctcacct

SEQ ID NO: 3453413 - DNA, 23 bp, Homo sapiens
ccgtgcttgtttgctcacctggg

SEQ ID NO: 3453414 - DNA, 11 bp, Homo sapiens
ccgtggatgcg

SEQ ID NO: 3453415 - DNA, 15 bp, Homo sapiens
ccgtggcactgcata

SEQ ID NO: 3453416 - DNA, 14 bp, Homo sapiens
ccgtggtcctttgg

SEQ ID NO: 3453417 - DNA, 18 bp, Homo sapiens
ccgtgtcaagctgctctg

SEQ ID NO: 3453418 - DNA, 21 bp, Homo sapiens
ccgtgttgcaggttcatggat

SEQ ID NO: 3453419 - DNA, 18 bp, Homo sapiens
ccgttagctcctgtggcc

SEQ ID NO: 3453420 - DNA, 13 bp, Homo sapiens
ccgtttgaccaat

SEQ ID NO: 3453421 - DNA, 15 bp, Homo sapiens
ccgtttgaccaattt

SEQ ID NO: 3453422 - DNA, 22 bp, Homo sapiens
ccgtttgagaagaaaacatcta

SEQ ID NO: 3453423 - DNA, 12 bp, Homo sapiens
cctaaaaaagat

SEQ ID NO: 3453424 - DNA, 18 bp, Homo sapiens
cctaaaaaagatatatta

SEQ ID NO: 3453425 - DNA, 13 bp, Homo sapiens
cctaaacctcagt

SEQ ID NO: 3453426 - DNA, 20 bp, Homo sapiens
cctaaagaaaaatatcttgg

SEQ ID NO: 3453427 - DNA, 22 bp, Homo sapiens
cctaaagaaaaatatcttggcc

SEQ ID NO: 3453428 - DNA, 14 bp, Homo sapiens
cctaaatccaaaga

SEQ ID NO: 3453429 - DNA, 14 bp, Homo sapiens
cctaaatttattaa

SEQ ID NO: 3453430 - DNA, 14 bp, Homo sapiens
cctaacttttcaat

SEQ ID NO: 3453431 - DNA, 15 bp, Homo sapiens
cctaagacctggggt

SEQ ID NO: 3453432 - DNA, 22 bp, Homo sapiens
cctaaggcatgtgtgaaacata

SEQ ID NO: 3453433 - DNA, 21 bp, Homo sapiens
cctaagtagaccaaatcttgt

SEQ ID NO: 3453434 - DNA, 21 bp, Homo sapiens
cctaataaagttctgtactca

SEQ ID NO: 3453435 - DNA, 19 bp, Homo sapiens
cctaatccaggcagatcca

SEQ ID NO: 3453436 - DNA, 16 bp, Homo sapiens
cctaatgctccttgtt

SEQ ID NO: 3453437 - DNA, 15 bp, Homo sapiens
cctaattcttctgtc

SEQ ID NO: 3453438 - DNA, 17 bp, Homo sapiens
cctacagctttgatccc

SEQ ID NO: 3453439 - DNA, 22 bp, Homo sapiens
cctacagttgaaaaacagctga

SEQ ID NO: 3453440 - DNA, 20 bp, Homo sapiens
cctacatcccgggcctcagt

SEQ ID NO: 3453441 - DNA, 18 bp, Homo sapiens
cctacccaccctcctttc

SEQ ID NO: 3453442 - DNA, 21 bp, Homo sapiens
cctacccagtccccattttct

SEQ ID NO: 3453443 - DNA, 23 bp, Homo sapiens
cctaccctgcctcccttgacttt

SEQ ID NO: 3453444 - DNA, 15 bp, Homo sapiens
cctactaataaacca

SEQ ID NO: 3453445 - DNA, 18 bp, Homo sapiens
cctacttcattttcagag

SEQ ID NO: 3453446 - DNA, 23 bp, Homo sapiens
cctacttctttgctttgcccagc

SEQ ID NO: 3453447 - DNA, 20 bp, Homo sapiens
cctagactttaggctttcag

SEQ ID NO: 3453448 - DNA, 20 bp, Homo sapiens
cctagaggccctttgctgtc

SEQ ID NO: 3453449 - DNA, 16 bp, Homo sapiens
cctagagggaggggcc

SEQ ID NO: 3453450 - DNA, 18 bp, Homo sapiens
cctagagtagagtggagg

SEQ ID NO: 3453451 - DNA, 22 bp, Homo sapiens
cctagagtagagtggagggagg

SEQ ID NO: 3453452 - DNA, 23 bp, Homo sapiens
cctagatggcagtcactgaattc

SEQ ID NO: 3453453 - DNA, 18 bp, Homo sapiens
cctagcacatgcttcaat

SEQ ID NO: 3453454 - DNA, 17 bp, Homo sapiens
cctagcaggcacaggac

SEQ ID NO: 3453455 - DNA, 18 bp, Homo sapiens
cctagcaggcacaggaca

SEQ ID NO: 3453456 - DNA, 15 bp, Homo sapiens
cctagccctgggaca

SEQ ID NO: 3453457 - DNA, 22 bp, Homo sapiens
cctagccggttcctgtccctgc

SEQ ID NO: 3453458 - DNA, 23 bp, Homo sapiens
cctagccggttcctgtccctgcg

SEQ ID NO: 3453459 - DNA, 20 bp, Homo sapiens
cctaggagtgccccattctt

SEQ ID NO: 3453460 - DNA, 13 bp, Homo sapiens
cctaggcaggaca

SEQ ID NO: 3453461 - DNA, 18 bp, Homo sapiens
cctaggcagtgggaggca

SEQ ID NO: 3453462 - DNA, 23 bp, Homo sapiens
cctaggcatttgctgaatacaga

SEQ ID NO: 3453463 - DNA, 12 bp, Homo sapiens
cctagggccccc

SEQ ID NO: 3453464 - DNA, 20 bp, Homo sapiens
cctagggcccccacagttgc

SEQ ID NO: 3453465 - DNA, 17 bp, Homo sapiens
cctaggtcccccaagca

SEQ ID NO: 3453466 - DNA, 15 bp, Homo sapiens
cctaggtgacagagt

SEQ ID NO: 3453467 - DNA, 15 bp, Homo sapiens
cctaggtgcagctcc

SEQ ID NO: 3453468 - DNA, 16 bp, Homo sapiens
cctaggtgcagctcct

SEQ ID NO: 3453469 - DNA, 15 bp, Homo sapiens
cctagtggcttgtcc

SEQ ID NO: 3453470 - DNA, 19 bp, Homo sapiens
cctagttctgtagaaatgg

SEQ ID NO: 3453471 - DNA, 13 bp, Homo sapiens
cctatactgcttg

SEQ ID NO: 3453472 - DNA, 16 bp, Homo sapiens
cctatcacctatttcc

SEQ ID NO: 3453473 - DNA, 16 bp, Homo sapiens
cctatgaatgctttgc

SEQ ID NO: 3453474 - DNA, 21 bp, Homo sapiens
cctatgctattgacaataaaa

SEQ ID NO: 3453475 - DNA, 22 bp, Homo sapiens
cctatgctattgacaataaaat

SEQ ID NO: 3453476 - DNA, 22 bp, Homo sapiens
cctatggtataatggttgactg

SEQ ID NO: 3453477 - DNA, 20 bp, Homo sapiens
cctatgtgattttaactctg

SEQ ID NO: 3453478 - DNA, 23 bp, Homo sapiens
cctatgtgattttaactctgtct

SEQ ID NO: 3453479 - DNA, 11 bp, Homo sapiens
cctatgtgtaa

SEQ ID NO: 3453480 - DNA, 22 bp, Homo sapiens
cctatgttgatccatccagctt

SEQ ID NO: 3453481 - DNA, 17 bp, Homo sapiens
cctattagagaagagat

SEQ ID NO: 3453482 - DNA, 14 bp, Homo sapiens
cctattgcttgggt

SEQ ID NO: 3453483 - DNA, 17 bp, Homo sapiens
cctattgcttgggtctc

SEQ ID NO: 3453484 - DNA, 23 bp, Homo sapiens
cctattgcttgggtctctctcca

SEQ ID NO: 3453485 - DNA, 19 bp, Homo sapiens
cctatttcagtgttacctg

SEQ ID NO: 3453486 - DNA, 14 bp, Homo sapiens
cctatttgacttac

SEQ ID NO: 3453487 - DNA, 23 bp, Homo sapiens
cctattttttgacacttccattg

SEQ ID NO: 3453488 - DNA, 20 bp, Homo sapiens
cctcaaaaacgccctcaaga

SEQ ID NO: 3453489 - DNA, 21 bp, Homo sapiens
cctcaaaaacgccctcaagaa

SEQ ID NO: 3453490 - DNA, 22 bp, Homo sapiens
cctcaaaaacgccctcaagaac

SEQ ID NO: 3453491 - DNA, 15 bp, Homo sapiens
cctcaaaactggagt

SEQ ID NO: 3453492 - DNA, 15 bp, Homo sapiens
cctcaaacactgcag

SEQ ID NO: 3453493 - DNA, 20 bp, Homo sapiens
cctctgaaacagctgcctta

SEQ ID NO: 3453494 - DNA, 16 bp, Homo sapiens
cctctgaaaccctgga

SEQ ID NO: 3453495 - DNA, 16 bp, Homo sapiens
cctctgacacacagct

SEQ ID NO: 3453496 - DNA, 17 bp, Homo sapiens
cctctgacccagactcc

SEQ ID NO: 3453497 - DNA, 16 bp, Homo sapiens
cctctgacttggggac

SEQ ID NO: 3453498 - DNA, 11 bp, Homo sapiens
cctctgagacc

SEQ ID NO: 3453499 - DNA, 17 bp, Homo sapiens
cctctgcaagtgctcag

SEQ ID NO: 3453500 - DNA, 20 bp, Homo sapiens
cctctgcaagtgctcaggga

SEQ ID NO: 3453501 - DNA, 20 bp, Homo sapiens
cctctgcacaagctgcaccc

SEQ ID NO: 3453502 - DNA, 19 bp, Homo sapiens
cctctgccccatcctccag

SEQ ID NO: 3453503 - DNA, 22 bp, Homo sapiens
cctctgccgctgcttccaggct

SEQ ID NO: 3453504 - DNA, 23 bp, Homo sapiens
cctctgccgctgcttccaggctg

SEQ ID NO: 3453505 - DNA, 21 bp, Homo sapiens
cctctgcctctgacacacagc

SEQ ID NO: 3453506 - DNA, 11 bp, Homo sapiens
cctctgcctga

SEQ ID NO: 3453507 - DNA, 20 bp, Homo sapiens
cctctgcctgaagtcacaca

SEQ ID NO: 3453508 - DNA, 22 bp, Homo sapiens
cctctgcctgaagtcacacagt

SEQ ID NO: 3453509 - DNA, 14 bp, Homo sapiens
cctctgctccccag

SEQ ID NO: 3453510 - DNA, 14 bp, Homo sapiens
cctctggagtggcc

SEQ ID NO: 3453511 - DNA, 15 bp, Homo sapiens
cctctggagtggcca

SEQ ID NO: 3453512 - DNA, 21 bp, Homo sapiens
cctctggattaggtctctgtt

SEQ ID NO: 3453513 - DNA, 14 bp, Homo sapiens
cctctgggggctct

SEQ ID NO: 3453514 - DNA, 21 bp, Homo sapiens
cctctgggggctctggccaag

SEQ ID NO: 3453515 - DNA, 17 bp, Homo sapiens
cctctgggtcagtggtc

SEQ ID NO: 3453516 - DNA, 21 bp, Homo sapiens
cctctggtcgctcctgcccac

SEQ ID NO: 3453517 - DNA, 15 bp, Homo sapiens
cctctgtcagtcaca

SEQ ID NO: 3453518 - DNA, 16 bp, Homo sapiens
cctctgtcagtcacag

SEQ ID NO: 3453519 - DNA, 21 bp, Homo sapiens
cctctgtcagtcacagccacc

SEQ ID NO: 3453520 - DNA, 20 bp, Homo sapiens
cctctgtccaggcactgaga

SEQ ID NO: 3453521 - DNA, 17 bp, Homo sapiens
cctctgtccccttctct

SEQ ID NO: 3453522 - DNA, 18 bp, Homo sapiens
cctctgtccccttctctc

SEQ ID NO: 3453523 - DNA, 19 bp, Homo sapiens
cctctgtccccttctctca

SEQ ID NO: 3453524 - DNA, 15 bp, Homo sapiens
cctctgtcttctgga

SEQ ID NO: 3453525 - DNA, 18 bp, Homo sapiens
cctctgtgaccaatgtct

SEQ ID NO: 3453526 - DNA, 14 bp, Homo sapiens
cctctgtgccttct

SEQ ID NO: 3453527 - DNA, 21 bp, Homo sapiens
cctctgtgccttcttttgatt

SEQ ID NO: 3453528 - DNA, 15 bp, Homo sapiens
cctctgtgctgtgtg

SEQ ID NO: 3453529 - DNA, 14 bp, Homo sapiens
cctcttcagaggcc

SEQ ID NO: 3453530 - DNA, 19 bp, Homo sapiens
cctcttccgactctttctg

SEQ ID NO: 3453531 - DNA, 14 bp, Homo sapiens
cctcttcctaccct

SEQ ID NO: 3453532 - DNA, 15 bp, Homo sapiens
cctcttctggctcaa

SEQ ID NO: 3453533 - DNA, 18 bp, Homo sapiens
cctcttctgggagggcag

SEQ ID NO: 3453534 - DNA, 21 bp, Homo sapiens
cctcttctgggagggcagcag

SEQ ID NO: 3453535 - DNA, 22 bp, Homo sapiens
cctcttctttcagacttgccat

SEQ ID NO: 3453536 - DNA, 12 bp, Homo sapiens
cctcttgtaaat

SEQ ID NO: 3453537 - DNA, 17 bp, Homo sapiens
cctcttgtaaataaagc

SEQ ID NO: 3453538 - DNA, 17 bp, Homo sapiens
cctctttagagttagac

SEQ ID NO: 3453539 - DNA, 19 bp, Homo sapiens
cctctttagagttagactg

SEQ ID NO: 3453540 - DNA, 23 bp, Homo sapiens
cctctttcaagcagtcgtgcctg

SEQ ID NO: 3453541 - DNA, 15 bp, Homo sapiens
cctctttcatccact

SEQ ID NO: 3453542 - DNA, 14 bp, Homo sapiens
cctctttgctttgc

SEQ ID NO: 3453543 - DNA, 15 bp, Homo sapiens
cctctttgctttgct

SEQ ID NO: 3453544 - DNA, 15 bp, Homo sapiens
cctctttgtctaaaa

SEQ ID NO: 3453545 - DNA, 22 bp, Homo sapiens
cctctttgtctaaaacaataaa

SEQ ID NO: 3453546 - DNA, 16 bp, Homo sapiens
cctcttttacctgctg

SEQ ID NO: 3453547 - DNA, 17 bp, Homo sapiens
cctcttttacctgctgc

SEQ ID NO: 3453548 - DNA, 16 bp, Homo sapiens
cctctttttaaggaca

SEQ ID NO: 3453549 - DNA, 17 bp, Homo sapiens
cctctttttaaggacac

SEQ ID NO: 3453550 - DNA, 15 bp, Homo sapiens
cctgaaacaacttgg

SEQ ID NO: 3453551 - DNA, 19 bp, Homo sapiens
cctgaaacgctcctttgtg

SEQ ID NO: 3453552 - DNA, 20 bp, Homo sapiens
cctgaaacgctcctttgtgt

SEQ ID NO: 3453553 - DNA, 14 bp, Homo sapiens
cctgaaactttgag

SEQ ID NO: 3453554 - DNA, 14 bp, Homo sapiens
cctgaaagccctga

SEQ ID NO: 3453555 - DNA, 14 bp, Homo sapiens
cctgaaagcggctg

SEQ ID NO: 3453556 - DNA, 15 bp, Homo sapiens
cctgaaagcggctgc

SEQ ID NO: 3453557 - DNA, 19 bp, Homo sapiens
cctgaaagcggctgcctcc

SEQ ID NO: 3453558 - DNA, 13 bp, Homo sapiens
cctgaaagtgaca

SEQ ID NO: 3453559 - DNA, 12 bp, Homo sapiens
cctgaagagctt

SEQ ID NO: 3453560 - DNA, 14 bp, Homo sapiens
cctgaagatttcag

SEQ ID NO: 3453561 - DNA, 18 bp, Homo sapiens
cctgaagccagctgccct

SEQ ID NO: 3453562 - DNA, 23 bp, Homo sapiens
cctgaatgtattgaacttggaaa

SEQ ID NO: 3453563 - DNA, 12 bp, Homo sapiens
cctgacaaggcc

SEQ ID NO: 3453564 - DNA, 13 bp, Homo sapiens
cctgacaaggcca

SEQ ID NO: 3453565 - DNA, 22 bp, Homo sapiens
cctgacaaggccagcacccaaa

SEQ ID NO: 3453566 - DNA, 13 bp, Homo sapiens
cctgacactccct

SEQ ID NO: 3453567 - DNA, 15 bp, Homo sapiens
ccttttattgacaca

SEQ ID NO: 3453568 - DNA, 19 bp, Homo sapiens
ccttttcgcctttcctctc

SEQ ID NO: 3453569 - DNA, 23 bp, Homo sapiens
ccttttgaacgcccccccccacc

SEQ ID NO: 3453570 - DNA, 19 bp, Homo sapiens
ccttttgtagaatgaacca

SEQ ID NO: 3453571 - DNA, 15 bp, Homo sapiens
cctttttacacttta

SEQ ID NO: 3453572 - DNA, 13 bp, Homo sapiens
cctttttgaagtg

SEQ ID NO: 3453573 - DNA, 14 bp, Homo sapiens
ccttttttgtagtt

SEQ ID NO: 3453574 - DNA, 20 bp, Homo sapiens
cgaaaggatgaaagtgacca

SEQ ID NO: 3453575 - DNA, 18 bp, Homo sapiens
cgaaaggatgagcagagc

SEQ ID NO: 3453576 - DNA, 14 bp, Homo sapiens
cgaaaggccttcag

SEQ ID NO: 3453577 - DNA, 21 bp, Homo sapiens
cgaaaggccttcagacacatg

SEQ ID NO: 3453578 - DNA, 17 bp, Homo sapiens
cgaaattccaaggccca

SEQ ID NO: 3453579 - DNA, 15 bp, Homo sapiens
cgaacctcctctgtg

SEQ ID NO: 3453580 - DNA, 18 bp, Homo sapiens
cgaaccttggcctgggcc

SEQ ID NO: 3453581 - DNA, 14 bp, Homo sapiens
cgaactggctgcaa

SEQ ID NO: 3453582 - DNA, 24 bp, Homo sapiens
cgaagctcattcccaacgtgcaaa

SEQ ID NO: 3453583 - DNA, 14 bp, Homo sapiens
cgaatagctgggac

SEQ ID NO: 3453584 - DNA, 18 bp, Homo sapiens
cgaatcagctatttactg

SEQ ID NO: 3453585 - DNA, 14 bp, Homo sapiens
cgaattgagcacaa

SEQ ID NO: 3453586 - DNA, 22 bp, Homo sapiens
cgacagagggaagaaaagagct

SEQ ID NO: 3453587 - DNA, 13 bp, Homo sapiens
cgacatcactgtt

SEQ ID NO: 3453588 - DNA, 17 bp, Homo sapiens
cgacatcactgttcatg

SEQ ID NO: 3453589 - DNA, 23 bp, Homo sapiens
cgaccagacaccttgacagggca

SEQ ID NO: 3453590 - DNA, 14 bp, Homo sapiens
cgaccccaaaggaa

SEQ ID NO: 3453591 - DNA, 20 bp, Homo sapiens
cgaccccaaaggaacactga

SEQ ID NO: 3453592 - DNA, 15 bp, Homo sapiens
cgactaaactagatt

SEQ ID NO: 3453593 - DNA, 19 bp, Homo sapiens
cgactccgttggccactcc

SEQ ID NO: 3453594 - DNA, 14 bp, Homo sapiens
cgactggccagggc

SEQ ID NO: 3453595 - DNA, 11 bp, Homo sapiens
cgactgtctcc

SEQ ID NO: 3453596 - DNA, 19 bp, Homo sapiens
cgacttgtttttgcacatg

SEQ ID NO: 3453597 - DNA, 13 bp, Homo sapiens
cgactttctgcct

SEQ ID NO: 3453598 - DNA, 20 bp, Homo sapiens
cgagaaataaagtttgctta

SEQ ID NO: 3453599 - DNA, 13 bp, Homo sapiens
cgagaccagcctg

SEQ ID NO: 3453600 - DNA, 14 bp, Homo sapiens
cgagaccagcctgg

SEQ ID NO: 3453601 - DNA, 12 bp, Homo sapiens
cgagagccaaac

SEQ ID NO: 3453602 - DNA, 23 bp, Homo sapiens
cgagagctggccaaagagccttt

SEQ ID NO: 3453603 - DNA, 19 bp, Homo sapiens
cgagaggtgggccagtctg

SEQ ID NO: 3453604 - DNA, 20 bp, Homo sapiens
cgagatcacgccactgcact

SEQ ID NO: 3453605 - DNA, 15 bp, Homo sapiens
cgagcagtcctgcct

SEQ ID NO: 3453606 - DNA, 15 bp, Homo sapiens
cgagcccctcggctc

SEQ ID NO: 3453607 - DNA, 18 bp, Homo sapiens
cgagcccctcggctctgg

SEQ ID NO: 3453608 - DNA, 15 bp, Homo sapiens
cgagccctggtggca

SEQ ID NO: 3453609 - DNA, 16 bp, Homo sapiens
cgagccctggtggcag

SEQ ID NO: 3453610 - DNA, 18 bp, Homo sapiens
cgagccctggtggcagtg

SEQ ID NO: 3453611 - DNA, 19 bp, Homo sapiens
cgaggaggctccagagggc

SEQ ID NO: 3453612 - DNA, 11 bp, Homo sapiens
cgaggccagta

SEQ ID NO: 3453613 - DNA, 17 bp, Homo sapiens
cgaggcctaccccgcag

SEQ ID NO: 3453614 - DNA, 10 bp, Homo sapiens
cgaggcctga

SEQ ID NO: 3453615 - DNA, 11 bp, Homo sapiens
cgaggcctgaa

SEQ ID NO: 3453616 - DNA, 14 bp, Homo sapiens
cgagggctggctgg

SEQ ID NO: 3453617 - DNA, 15 bp, Homo sapiens
cgagggctggctggc

SEQ ID NO: 3453618 - DNA, 23 bp, Homo sapiens
cgagggctggctggcctcaccca

SEQ ID NO: 3453619 - DNA, 18 bp, Homo sapiens
cgaggggtgtcttgggca

SEQ ID NO: 3453620 - DNA, 19 bp, Homo sapiens
cgaggggtgtcttgggcag

SEQ ID NO: 3453621 - DNA, 21 bp, Homo sapiens
cgaggtgccttcttcagggcc

SEQ ID NO: 3453622 - DNA, 13 bp, Homo sapiens
cgagtactgtggg

SEQ ID NO: 3453623 - DNA, 14 bp, Homo sapiens
cgagtactgtgggc

SEQ ID NO: 3453624 - DNA, 16 bp, Homo sapiens
cgagtactgtgggcaa

SEQ ID NO: 3453625 - DNA, 14 bp, Homo sapiens
cgagtagctgggac

SEQ ID NO: 3453626 - DNA, 15 bp, Homo sapiens
cgagtagctgggact

SEQ ID NO: 3453627 - DNA, 14 bp, Homo sapiens
cgagtcacattctg

SEQ ID NO: 3453628 - DNA, 16 bp, Homo sapiens
cgagtgctaagtgtag

SEQ ID NO: 3453629 - DNA, 20 bp, Homo sapiens
cgatactgcgactttctgcc

SEQ ID NO: 3453630 - DNA, 15 bp, Homo sapiens
cgatccacctgtctc

SEQ ID NO: 3453631 - DNA, 22 bp, Homo sapiens
cgatccacctgtctcagcctcc

SEQ ID NO: 3453632 - DNA, 19 bp, Homo sapiens
cgatcgcggcggagctggc

SEQ ID NO: 3453633 - DNA, 17 bp, Homo sapiens
cgatctcttattttaca

SEQ ID NO: 3453634 - DNA, 17 bp, Homo sapiens
cgatgattcaggtgcag

SEQ ID NO: 3453635 - DNA, 16 bp, Homo sapiens
cgatgcagctctcttt

SEQ ID NO: 3453636 - DNA, 13 bp, Homo sapiens
cgatgtaaattat

SEQ ID NO: 3453637 - DNA, 12 bp, Homo sapiens
cgattctcctgc

SEQ ID NO: 3453638 - DNA, 18 bp, Homo sapiens
cgattctcctgcctcagc

SEQ ID NO: 3453639 - DNA, 22 bp, Homo sapiens
cgattggtatgatgctgccggc

SEQ ID NO: 3453640 - DNA, 13 bp, Homo sapiens
cgatttctgtaaa

SEQ ID NO: 3453641 - DNA, 18 bp, Homo sapiens
cgattttgtatctgcagg

SEQ ID NO: 3453642 - DNA, 22 bp, Homo sapiens
cgcaagagccatgtagaagctg

SEQ ID NO: 3453643 - DNA, 17 bp, Homo sapiens
cgcactgtgacccccag

SEQ ID NO: 3453644 - DNA, 17 bp, Homo sapiens
cgcagacaccttggaca

SEQ ID NO: 3453645 - DNA, 16 bp, Homo sapiens
cgcagcaccctgcaga

SEQ ID NO: 3453646 - DNA, 18 bp, Homo sapiens
cgcagccccatctgtgca

SEQ ID NO: 3453647 - DNA, 15 bp, Homo sapiens
cccagtcgaccccaa

SEQ ID NO: 3453648 - DNA, 20 bp, Homo sapiens
cccagtctcctctccatttt

SEQ ID NO: 3453649 - DNA, 19 bp, Homo sapiens
cccagtctggaatgcagtg

SEQ ID NO: 3453650 - DNA, 13 bp, Homo sapiens
cccagtgcccaca

SEQ ID NO: 3453651 - DNA, 15 bp, Homo sapiens
cccagtgcccacagg

SEQ ID NO: 3453652 - DNA, 18 bp, Homo sapiens
cccagtgccgagaaggaa

SEQ ID NO: 3453653 - DNA, 15 bp, Homo sapiens
cccagtggctgctgc

SEQ ID NO: 3453654 - DNA, 17 bp, Homo sapiens
cccagtggctgctgccc

SEQ ID NO: 3453655 - DNA, 14 bp, Homo sapiens
cccagttagctctc

SEQ ID NO: 3453656 - DNA, 20 bp, Homo sapiens
cccagttcgcctggagccct

SEQ ID NO: 3453657 - DNA, 21 bp, Homo sapiens
cccagttcgcctggagccctc

SEQ ID NO: 3453658 - DNA, 14 bp, Homo sapiens
cccagttgggtgga

SEQ ID NO: 3453659 - DNA, 21 bp, Homo sapiens
cccataataaaggttgtgaat

SEQ ID NO: 3453660 - DNA, 15 bp, Homo sapiens
cccatcccacaccct

SEQ ID NO: 3453661 - DNA, 16 bp, Homo sapiens
cccatccccgcagtgt

SEQ ID NO: 3453662 - DNA, 15 bp, Homo sapiens
cccatcctccagcag

SEQ ID NO: 3453663 - DNA, 11 bp, Homo sapiens
cccatctcagg

SEQ ID NO: 3453664 - DNA, 23 bp, Homo sapiens
cccatctcaggccagagccaagg

SEQ ID NO: 3453665 - DNA, 21 bp, Homo sapiens
cccatctcgctccctcccagg

SEQ ID NO: 3453666 - DNA, 23 bp, Homo sapiens
cccatctcgctccctcccaggac

SEQ ID NO: 3453667 - DNA, 19 bp, Homo sapiens
cccatctctacaaaaagca

SEQ ID NO: 3453668 - DNA, 21 bp, Homo sapiens
cccatctctccctcccctgcc

SEQ ID NO: 3453669 - DNA, 22 bp, Homo sapiens
cccatctgcacccccctgggct

SEQ ID NO: 3453670 - DNA, 17 bp, Homo sapiens
cccatcttcgggaccag

SEQ ID NO: 3453671 - DNA, 12 bp, Homo sapiens
cccatcttgctt

SEQ ID NO: 3453672 - DNA, 20 bp, Homo sapiens
cccatgaccttatccttcct

SEQ ID NO: 3453673 - DNA, 20 bp, Homo sapiens
cccatgcactgtgaaggacc

SEQ ID NO: 3453674 - DNA, 19 bp, Homo sapiens
cccatggagccagctccct

SEQ ID NO: 3453675 - DNA, 15 bp, Homo sapiens
cccatggctctattt

SEQ ID NO: 3453676 - DNA, 21 bp, Homo sapiens
cccattatattgttttctcct

SEQ ID NO: 3453677 - DNA, 14 bp, Homo sapiens
cccattcacagagc

SEQ ID NO: 3453678 - DNA, 16 bp, Homo sapiens
cccattcacagagcct

SEQ ID NO: 3453679 - DNA, 18 bp, Homo sapiens
cccattcacagagccttt

SEQ ID NO: 3453680 - DNA, 17 bp, Homo sapiens
cccattcagacacttca

SEQ ID NO: 3453681 - DNA, 13 bp, Homo sapiens
cccattcctgaag

SEQ ID NO: 3453682 - DNA, 20 bp, Homo sapiens
cccattcgcgctctgctcag

SEQ ID NO: 3453683 - DNA, 14 bp, Homo sapiens
cccattctgcctgc

SEQ ID NO: 3453684 - DNA, 21 bp, Homo sapiens
cccattcttttgtaatttaaa

SEQ ID NO: 3453685 - DNA, 12 bp, Homo sapiens
cccattgctgtt

SEQ ID NO: 3453686 - DNA, 19 bp, Homo sapiens
cccatttcgtgagccccat

SEQ ID NO: 3453687 - DNA, 20 bp, Homo sapiens
cccatttcgtgagccccatc

SEQ ID NO: 3453688 - DNA, 20 bp, Homo sapiens
cccatttctatttatttact

SEQ ID NO: 3453689 - DNA, 17 bp, Homo sapiens
cccatttttgagccaag

SEQ ID NO: 3453690 - DNA, 19 bp, Homo sapiens
ccccaaaggaacactgaca

SEQ ID NO: 3453691 - DNA, 18 bp, Homo sapiens
ccccaaagtaaaagaaac

SEQ ID NO: 3453692 - DNA, 19 bp, Homo sapiens
ccccaaatgctctctcttc

SEQ ID NO: 3453693 - DNA, 20 bp, Homo sapiens
ccccaagaggaagttcagat

SEQ ID NO: 3453694 - DNA, 15 bp, Homo sapiens
ccccaataattgcag

SEQ ID NO: 3453695 - DNA, 19 bp, Homo sapiens
ccccaatgagacttgcctt

SEQ ID NO: 3453696 - DNA, 13 bp, Homo sapiens
ccccacagttgct

SEQ ID NO: 3453697 - DNA, 23 bp, Homo sapiens
ccccacccctggaagagcccagt

SEQ ID NO: 3453698 - DNA, 15 bp, Homo sapiens
ccccaccctgggccc

SEQ ID NO: 3453699 - DNA, 20 bp, Homo sapiens
ccccaccctgggccctgggc

SEQ ID NO: 3453700 - DNA, 12 bp, Homo sapiens
ccccacctctcc

SEQ ID NO: 3453701 - DNA, 14 bp, Homo sapiens
ccccacgagggctg

SEQ ID NO: 3453702 - DNA, 15 bp, Homo sapiens
ccccacgagggctgg

SEQ ID NO: 3453703 - DNA, 17 bp, Homo sapiens
ccccacgagggctggct

SEQ ID NO: 3453704 - DNA, 21 bp, Homo sapiens
ccccacgagggctggctggcc

SEQ ID NO: 3453705 - DNA, 11 bp, Homo sapiens
ccccactctgc

SEQ ID NO: 3453706 - DNA, 15 bp, Homo sapiens
ccccactgacagcct

SEQ ID NO: 3453707 - DNA, 15 bp, Homo sapiens
ccccactgaccagaa

SEQ ID NO: 3453708 - DNA, 19 bp, Homo sapiens
ccccactggactgacctgg

SEQ ID NO: 3453709 - DNA, 14 bp, Homo sapiens
ccccacttgcctct

SEQ ID NO: 3453710 - DNA, 14 bp, Homo sapiens
ccccagaagcagag

SEQ ID NO: 3453711 - DNA, 20 bp, Homo sapiens
ccccagattgcaacaggctg

SEQ ID NO: 3453712 - DNA, 21 bp, Homo sapiens
ccccagcaagtgagagctggg

SEQ ID NO: 3453713 - DNA, 22 bp, Homo sapiens
ccccagcaagtggtcctagagg

SEQ ID NO: 3453714 - DNA, 12 bp, Homo sapiens
ccccagcactga

SEQ ID NO: 3453715 - DNA, 15 bp, Homo sapiens
ccccagcactgagga

SEQ ID NO: 3453716 - DNA, 18 bp, Homo sapiens
ccccagcattctcaggca

SEQ ID NO: 3453717 - DNA, 13 bp, Homo sapiens
ccccagcccagag

SEQ ID NO: 3453718 - DNA, 15 bp, Homo sapiens
ccccagcccagagac

SEQ ID NO: 3453719 - DNA, 15 bp, Homo sapiens
ccccagcccagggct

SEQ ID NO: 3453720 - DNA, 20 bp, Homo sapiens
ccccagcccagggctcctgc

SEQ ID NO: 3453721 - DNA, 23 bp, Homo sapiens
ccccagccccggtggctgggcag

SEQ ID NO: 3453722 - DNA, 13 bp, Homo sapiens
ccccagcctccct

SEQ ID NO: 3453723 - DNA, 12 bp, Homo sapiens
ccccagcctgct

SEQ ID NO: 3453724 - DNA, 13 bp, Homo sapiens
ccccagcctgcta

SEQ ID NO: 3453725 - DNA, 11 bp, Homo sapiens
ccccagctccc

SEQ ID NO: 3453726 - DNA, 19 bp, Homo sapiens
ccccagctccccaggactc

SEQ ID NO: 3453727 - DNA, 15 bp, Homo sapiens
ccccaggaccagctc

SEQ ID NO: 3453728 - DNA, 21 bp, Homo sapiens
ccccaggacctggctgccata

SEQ ID NO: 3453729 - DNA, 17 bp, Homo sapiens
ccccaggactcaccctc

SEQ ID NO: 3453730 - DNA, 14 bp, Homo sapiens
ccccaggactgggc

SEQ ID NO: 3453731 - DNA, 16 bp, Homo sapiens
ccccaggactgggcca

SEQ ID NO: 3453732 - DNA, 23 bp, Homo sapiens
ccccaggcctgagctgcttcact

SEQ ID NO: 3453733 - DNA, 16 bp, Homo sapiens
ccccagggcccccaca

SEQ ID NO: 3453734 - DNA, 20 bp, Homo sapiens
ccccagggcccccacaggcc

SEQ ID NO: 3453735 - DNA, 16 bp, Homo sapiens
ccccagtgcccacagg

SEQ ID NO: 3453736 - DNA, 21 bp, Homo sapiens
ccccagttcgcctggagccct

SEQ ID NO: 3453737 - DNA, 16 bp, Homo sapiens
ccccatcccacaccct

SEQ ID NO: 3453738 - DNA, 19 bp, Homo sapiens
ccccatctctccctcccct

SEQ ID NO: 3453739 - DNA, 16 bp, Homo sapiens
ccccatcttcacccag

SEQ ID NO: 3453740 - DNA, 19 bp, Homo sapiens
ccccatcttcgggaccagg

SEQ ID NO: 3453741 - DNA, 13 bp, Homo sapiens
ccccatgcactgt

SEQ ID NO: 3453742 - DNA, 23 bp, Homo sapiens
ccccatgcactgtgaaggaccct

SEQ ID NO: 3453743 - DNA, 17 bp, Homo sapiens
ccccattagctttcaat

SEQ ID NO: 3453744 - DNA, 15 bp, Homo sapiens
ccccattctgcctgc

SEQ ID NO: 3453745 - DNA, 13 bp, Homo sapiens
ccccatttctatt

SEQ ID NO: 3453746 - DNA, 17 bp, Homo sapiens
ccccatttctatttatt

SEQ ID NO: 3453747 - DNA, 14 bp, Homo sapiens
cccccaccccaggc

SEQ ID NO: 3453748 - DNA, 12 bp, Homo sapiens
cccccaccccct

SEQ ID NO: 3453749 - DNA, 22 bp, Homo sapiens
cccccacctctccctgaccctg

SEQ ID NO: 3453750 - DNA, 13 bp, Homo sapiens
cccccactgccac

SEQ ID NO: 3453751 - DNA, 22 bp, Homo sapiens
cccccacttgcctcttccttga

SEQ ID NO: 3453752 - DNA, 11 bp, Homo sapiens
cccccagcact

SEQ ID NO: 3453753 - DNA, 21 bp, Homo sapiens
cccccagctaagaacctggaa

SEQ ID NO: 3453754 - DNA, 12 bp, Homo sapiens
cccccaggactg

SEQ ID NO: 3453755 - DNA, 15 bp, Homo sapiens
cccccaggcctgagc

SEQ ID NO: 3453756 - DNA, 18 bp, Homo sapiens
cccccaggcctgagctgc

SEQ ID NO: 3453757 - DNA, 19 bp, Homo sapiens
cccccaggcctgagctgct

SEQ ID NO: 3453758 - DNA, 21 bp, Homo sapiens
cccccaggcctgagctgcttc

SEQ ID NO: 3453759 - DNA, 16 bp, Homo sapiens
cccccatcttcgggac

SEQ ID NO: 3453760 - DNA, 21 bp, Homo sapiens
cccccatcttcgggaccagga

SEQ ID NO: 3453761 - DNA, 18 bp, Homo sapiens
cccccatgcactgtgaag

SEQ ID NO: 3453762 - DNA, 12 bp, Homo sapiens
ccccccacccct

SEQ ID NO: 3453763 - DNA, 13 bp, Homo sapiens
cccccccttccac

SEQ ID NO: 3453764 - DNA, 12 bp, Homo sapiens
ccccccttccac

SEQ ID NO: 3453765 - DNA, 13 bp, Homo sapiens
ccccccttccact

SEQ ID NO: 3453766 - DNA, 13 bp, Homo sapiens
ccccctgccctcc

SEQ ID NO: 3453767 - DNA, 12 bp, Homo sapiens
ccccctgtgcag

SEQ ID NO: 3453768 - DNA, 21 bp, Homo sapiens
ccccctgtgcagccgctgagc

SEQ ID NO: 3453769 - DNA, 11 bp, Homo sapiens
ccccgaagagt

SEQ ID NO: 3453770 - DNA, 14 bp, Homo sapiens
ccccgacttcctga

SEQ ID NO: 3453771 - DNA, 12 bp, Homo sapiens
ccccgcttcccc

SEQ ID NO: 3453772 - DNA, 17 bp, Homo sapiens
ccccgcttccccacaga

SEQ ID NO: 3453773 - DNA, 19 bp, Homo sapiens
ccccgcttccccacagaac

SEQ ID NO: 3453774 - DNA, 15 bp, Homo sapiens
ccccggagggctgcg

SEQ ID NO: 3453775 - DNA, 22 bp, Homo sapiens
ccccgggtccccagctccccag

SEQ ID NO: 3453776 - DNA, 20 bp, Homo sapiens
ccccggtcacctagcaagct

SEQ ID NO: 3453777 - DNA, 14 bp, Homo sapiens
ccccgtttctggtg

SEQ ID NO: 3453778 - DNA, 17 bp, Homo sapiens
cccctagccggttcctg

SEQ ID NO: 3453779 - DNA, 19 bp, Homo sapiens
cccctagccggttcctgtc

SEQ ID NO: 3453780 - DNA, 11 bp, Homo sapiens
cccctcaaccc

SEQ ID NO: 3453781 - DNA, 14 bp, Homo sapiens
cccctcagctcggc

SEQ ID NO: 3453782 - DNA, 11 bp, Homo sapiens
cccctcccaga

SEQ ID NO: 3453783 - DNA, 12 bp, Homo sapiens
cccctcccagaa

SEQ ID NO: 3453784 - DNA, 19 bp, Homo sapiens
cccctccgccctgccactc

SEQ ID NO: 3453785 - DNA, 13 bp, Homo sapiens
ccataggcccagt

SEQ ID NO: 3453786 - DNA, 13 bp, Homo sapiens
ccatagtccctgc

SEQ ID NO: 3453787 - DNA, 13 bp, Homo sapiens
ccatatattggca

SEQ ID NO: 3453788 - DNA, 15 bp, Homo sapiens
ccatatcctggtgcc

SEQ ID NO: 3453789 - DNA, 18 bp, Homo sapiens
ccatatccttaccctcct

SEQ ID NO: 3453790 - DNA, 12 bp, Homo sapiens
ccatatgaattg

SEQ ID NO: 3453791 - DNA, 14 bp, Homo sapiens
ccatatgaattgta

SEQ ID NO: 3453792 - DNA, 18 bp, Homo sapiens
ccatattctgttggccag

SEQ ID NO: 3453793 - DNA, 19 bp, Homo sapiens
ccatattctgttggccagt

SEQ ID NO: 3453794 - DNA, 13 bp, Homo sapiens
ccatattgcacat

SEQ ID NO: 3453795 - DNA, 19 bp, Homo sapiens
ccatcaaaatgctttttat

SEQ ID NO: 3453796 - DNA, 13 bp, Homo sapiens
ccatcaccagaca

SEQ ID NO: 3453797 - DNA, 21 bp, Homo sapiens
ccatcagcttaggggctgctg

SEQ ID NO: 3453798 - DNA, 13 bp, Homo sapiens
ccatcatgtctgg

SEQ ID NO: 3453799 - DNA, 14 bp, Homo sapiens
ccatcatgtctggc

SEQ ID NO: 3453800 - DNA, 16 bp, Homo sapiens
ccatcatgtctggcta

SEQ ID NO: 3453801 - DNA, 22 bp, Homo sapiens
ccatcattttccatatcctggt

SEQ ID NO: 3453802 - DNA, 15 bp, Homo sapiens
ccatccaaggccagg

SEQ ID NO: 3453803 - DNA, 16 bp, Homo sapiens
ccatcccacaccctgg

SEQ ID NO: 3453804 - DNA, 22 bp, Homo sapiens
ccatcccctgtagagtgggagc

SEQ ID NO: 3453805 - DNA, 23 bp, Homo sapiens
ccatcctaatcatccaatgctca

SEQ ID NO: 3453806 - DNA, 15 bp, Homo sapiens
ccatccttccctttg

SEQ ID NO: 3453807 - DNA, 22 bp, Homo sapiens
ccatctatgtcccttgctgtga

SEQ ID NO: 3453808 - DNA, 15 bp, Homo sapiens
ccatctcccctcagc

SEQ ID NO: 3453809 - DNA, 17 bp, Homo sapiens
ccatctctccctcccct

SEQ ID NO: 3453810 - DNA, 23 bp, Homo sapiens
ccatctctccctcccctgccatt

SEQ ID NO: 3453811 - DNA, 12 bp, Homo sapiens
ccatctctggat

SEQ ID NO: 3453812 - DNA, 18 bp, Homo sapiens
ccatctctggatgcctga

SEQ ID NO: 3453813 - DNA, 22 bp, Homo sapiens
ccatctctggatgcctgattgc

SEQ ID NO: 3453814 - DNA, 15 bp, Homo sapiens
ccatctcttccttga

SEQ ID NO: 3453815 - DNA, 19 bp, Homo sapiens
ccatctgcacccccctggg

SEQ ID NO: 3453816 - DNA, 20 bp, Homo sapiens
ccatctgcacccccctgggc

SEQ ID NO: 3453817 - DNA, 12 bp, Homo sapiens
ccatctgggctc

SEQ ID NO: 3453818 - DNA, 22 bp, Homo sapiens
ccatctgggctcctaaccttcc

SEQ ID NO: 3453819 - DNA, 16 bp, Homo sapiens
ccatctggtcatttgg

SEQ ID NO: 3453820 - DNA, 22 bp, Homo sapiens
ccatctgtcttgccagccagaa

SEQ ID NO: 3453821 - DNA, 16 bp, Homo sapiens
ccatctgtgcacgcag

SEQ ID NO: 3453822 - DNA, 12 bp, Homo sapiens
ccatctgtgcat

SEQ ID NO: 3453823 - DNA, 16 bp, Homo sapiens
ccatcttcacccaggc

SEQ ID NO: 3453824 - DNA, 21 bp, Homo sapiens
ccatcttcacccaggcctatg

SEQ ID NO: 3453825 - DNA, 18 bp, Homo sapiens
ccatgaatgaacccctgg

SEQ ID NO: 3453826 - DNA, 15 bp, Homo sapiens
ccatgacccaggctg

SEQ ID NO: 3453827 - DNA, 17 bp, Homo sapiens
ccatgacccaggctggg

SEQ ID NO: 3453828 - DNA, 18 bp, Homo sapiens
ccatgacccaggctgggc

SEQ ID NO: 3453829 - DNA, 23 bp, Homo sapiens
ccatgagatgatacatccaaagc

SEQ ID NO: 3453830 - DNA, 14 bp, Homo sapiens
ccatgagcctcagc

SEQ ID NO: 3453831 - DNA, 22 bp, Homo sapiens
ccatgagttggggtctggcagc

SEQ ID NO: 3453832 - DNA, 14 bp, Homo sapiens
ccatgatctgcagg

SEQ ID NO: 3453833 - DNA, 17 bp, Homo sapiens
ccatgatctgcaggggt

SEQ ID NO: 3453834 - DNA, 14 bp, Homo sapiens
ccatgatggcaaca

SEQ ID NO: 3453835 - DNA, 16 bp, Homo sapiens
ccatgatggcaacaga

SEQ ID NO: 3453836 - DNA, 21 bp, Homo sapiens
ccatgatggcaacagatctgg

SEQ ID NO: 3453837 - DNA, 20 bp, Homo sapiens
ccatgcaccaggactggctg

SEQ ID NO: 3453838 - DNA, 14 bp, Homo sapiens
ccatgcctcagccc

SEQ ID NO: 3453839 - DNA, 16 bp, Homo sapiens
ccatgcgacactggga

SEQ ID NO: 3453840 - DNA, 21 bp, Homo sapiens
ccatgcgacactgggaggcca

SEQ ID NO: 3453841 - DNA, 15 bp, Homo sapiens
ccatgcgctcagggc

SEQ ID NO: 3453842 - DNA, 22 bp, Homo sapiens
ccatgcgctcagggccatgctg

SEQ ID NO: 3453843 - DNA, 18 bp, Homo sapiens
ccatgctcatctgctggt

SEQ ID NO: 3453844 - DNA, 18 bp, Homo sapiens
ccatgctcctggcccact

SEQ ID NO: 3453845 - DNA, 17 bp, Homo sapiens
ccatgctgaggcctggg

SEQ ID NO: 3453846 - DNA, 18 bp, Homo sapiens
ccatgctgaggcctgggc

SEQ ID NO: 3453847 - DNA, 19 bp, Homo sapiens
ccatgctgaggcctgggcc

SEQ ID NO: 3453848 - DNA, 17 bp, Homo sapiens
ccatggaactgtttcct

SEQ ID NO: 3453849 - DNA, 21 bp, Homo sapiens
ccatggaagaggctacagggc

SEQ ID NO: 3453850 - DNA, 16 bp, Homo sapiens
ccatggacaggctggc

SEQ ID NO: 3453851 - DNA, 15 bp, Homo sapiens
ccatggagagctgga

SEQ ID NO: 3453852 - DNA, 14 bp, Homo sapiens
ccatggagccagct

SEQ ID NO: 3453853 - DNA, 22 bp, Homo sapiens
ccatggagccagctccctctat

SEQ ID NO: 3453854 - DNA, 14 bp, Homo sapiens
ccatggcaggaagg

SEQ ID NO: 3453855 - DNA, 15 bp, Homo sapiens
ccatggccctcatta

SEQ ID NO: 3453856 - DNA, 19 bp, Homo sapiens
ccatggctctatttcttct

SEQ ID NO: 3453857 - DNA, 22 bp, Homo sapiens
ccatggctctatttcttcttca

SEQ ID NO: 3453858 - DNA, 16 bp, Homo sapiens
ccatgggcagagccca

SEQ ID NO: 3453859 - DNA, 14 bp, Homo sapiens
ccatgggcctcctg

SEQ ID NO: 3453860 - DNA, 15 bp, Homo sapiens
ccatgggcctcctgt

SEQ ID NO: 3453861 - DNA, 17 bp, Homo sapiens
ccatgggcctcctgtgt

SEQ ID NO: 3453862 - DNA, 12 bp, Homo sapiens
ccatggggaggg

SEQ ID NO: 3453863 - DNA, 13 bp, Homo sapiens
ccatggggctgcg

SEQ ID NO: 3453864 - DNA, 19 bp, Homo sapiens
ccatggtgtgatcgtctga

SEQ ID NO: 3453865 - DNA, 17 bp, Homo sapiens
ccatgtaaataatctgt

SEQ ID NO: 3453866 - DNA, 14 bp, Homo sapiens
ccatgtagaagctg

SEQ ID NO: 3453867 - DNA, 20 bp, Homo sapiens
ccatgtagccccctggcctc

SEQ ID NO: 3453868 - DNA, 22 bp, Homo sapiens
ccatgtataatttttttcttgt

SEQ ID NO: 3453869 - DNA, 23 bp, Homo sapiens
ccatgtatggaatcccactgtat

SEQ ID NO: 3453870 - DNA, 16 bp, Homo sapiens
ccatgtattcacacac

SEQ ID NO: 3453871 - DNA, 18 bp, Homo sapiens
ccatgtattcacacaccc

SEQ ID NO: 3453872 - DNA, 23 bp, Homo sapiens
ccatgtcaccggatcctgggtgg

SEQ ID NO: 3453873 - DNA, 18 bp, Homo sapiens
ccatgtcagcaaaaagca

SEQ ID NO: 3453874 - DNA, 16 bp, Homo sapiens
ccatgtcccctcccag

SEQ ID NO: 3453875 - DNA, 20 bp, Homo sapiens
ccatgtctgcagtgtgcccc

SEQ ID NO: 3453876 - DNA, 17 bp, Homo sapiens
ccatgtgactctggctt

SEQ ID NO: 3453877 - DNA, 13 bp, Homo sapiens
ccatgtgccaggt

SEQ ID NO: 3453878 - DNA, 17 bp, Homo sapiens
ccatgtggagacttcat

SEQ ID NO: 3453879 - DNA, 18 bp, Homo sapiens
ccatgtggtgatgatgtg

SEQ ID NO: 3453880 - DNA, 13 bp, Homo sapiens
ccatgttgcccct

SEQ ID NO: 3453881 - DNA, 13 bp, Homo sapiens
ccatgttggccag

SEQ ID NO: 3453882 - DNA, 19 bp, Homo sapiens
ccatgttggccaggctggt

SEQ ID NO: 3453883 - DNA, 21 bp, Homo sapiens
ccatgttggccaggctggtct

SEQ ID NO: 3453884 - DNA, 19 bp, Homo sapiens
ccattacaactagatcaag

SEQ ID NO: 3453885 - DNA, 17 bp, Homo sapiens
ccattagccagatttgt

SEQ ID NO: 3453886 - DNA, 17 bp, Homo sapiens
ccattatattgttttct

SEQ ID NO: 3453887 - DNA, 16 bp, Homo sapiens
ccattcacagagcctt

SEQ ID NO: 3453888 - DNA, 19 bp, Homo sapiens
ccattcagaatatcatctt

SEQ ID NO: 3453889 - DNA, 18 bp, Homo sapiens
ccattcccaagatgcctg

SEQ ID NO: 3453890 - DNA, 21 bp, Homo sapiens
ccattcccaagatgcctgatc

SEQ ID NO: 3453891 - DNA, 18 bp, Homo sapiens
ccattcccttcggccaaa

SEQ ID NO: 3453892 - DNA, 16 bp, Homo sapiens
ccattcctgaagaacc

SEQ ID NO: 3453893 - DNA, 18 bp, Homo sapiens
ccattcgcgctctgctca

SEQ ID NO: 3453894 - DNA, 14 bp, Homo sapiens
ccattctacacaga

SEQ ID NO: 3453895 - DNA, 13 bp, Homo sapiens
ccattctgactcg

SEQ ID NO: 3453896 - DNA, 13 bp, Homo sapiens
ccattctgcattt

SEQ ID NO: 3453897 - DNA, 18 bp, Homo sapiens
ccattctgcatttagctg

SEQ ID NO: 3453898 - DNA, 19 bp, Homo sapiens
ccattctgcctgcccaggc

SEQ ID NO: 3453899 - DNA, 21 bp, Homo sapiens
ccattctgcctgcccaggccc

SEQ ID NO: 3453900 - DNA, 17 bp, Homo sapiens
ccattctttctgataac

SEQ ID NO: 3453901 - DNA, 22 bp, Homo sapiens
ccattcttttgtaatttaaatg

SEQ ID NO: 3453902 - DNA, 13 bp, Homo sapiens
ccattgcacccag

SEQ ID NO: 3453903 - DNA, 19 bp, Homo sapiens
ccattgctgttctactttt

SEQ ID NO: 3453904 - DNA, 15 bp, Homo sapiens
ccattggatctcatt

SEQ ID NO: 3453905 - DNA, 15 bp, Homo sapiens
ccattgtccctctgc

SEQ ID NO: 3453906 - DNA, 22 bp, Homo sapiens
ccattgtccctctgccccatcc

SEQ ID NO: 3453907 - DNA, 22 bp, Homo sapiens
ccatttccatgtcccctcccag

SEQ ID NO: 3453908 - DNA, 12 bp, Homo sapiens
ccatttctattt

SEQ ID NO: 3453909 - DNA, 14 bp, Homo sapiens
ccatttctatttat

SEQ ID NO: 3453910 - DNA, 21 bp, Homo sapiens
ccatttgcgttccatgatgct

SEQ ID NO: 3453911 - DNA, 13 bp, Homo sapiens
ccatttgtaattt

SEQ ID NO: 3453912 - DNA, 18 bp, Homo sapiens
ccatttgtctctactttt

SEQ ID NO: 3453913 - DNA, 16 bp, Homo sapiens
ccattttacatttcta

SEQ ID NO: 3453914 - DNA, 20 bp, Homo sapiens
ccattttggggtacccactg

SEQ ID NO: 3453915 - DNA, 22 bp, Homo sapiens
ccattttggggtacccactgct

SEQ ID NO: 3453916 - DNA, 15 bp, Homo sapiens
ccattttttttttct

SEQ ID NO: 3453917 - DNA, 23 bp, Homo sapiens
ccattttttttttctttttgggg

SEQ ID NO: 3453918 - DNA, 22 bp, Homo sapiens
cccaaaattagggagctcttga

SEQ ID NO: 3453919 - DNA, 23 bp, Homo sapiens
cccaaacccagtctcctctccat

SEQ ID NO: 3453920 - DNA, 18 bp, Homo sapiens
cccaaaggaacactgaca

SEQ ID NO: 3453921 - DNA, 13 bp, Homo sapiens
cccaaagtgctgg

SEQ ID NO: 3453922 - DNA, 15 bp, Homo sapiens
cccaaagtgctggga

SEQ ID NO: 3453923 - DNA, 16 bp, Homo sapiens
cccaaagtgctgggat

SEQ ID NO: 3453924 - DNA, 15 bp, Homo sapiens
cccaaatccgaacct

SEQ ID NO: 3453925 - DNA, 14 bp, Homo sapiens
cccaaatgctctct

SEQ ID NO: 3453926 - DNA, 16 bp, Homo sapiens
cccaaatttgattgat

SEQ ID NO: 3453927 - DNA, 19 bp, Homo sapiens
cccaaatttgattgatttg

SEQ ID NO: 3453928 - DNA, 13 bp, Homo sapiens
cccaacaagcaag

SEQ ID NO: 3453929 - DNA, 18 bp, Homo sapiens
cccaacacgcaggagcac

SEQ ID NO: 3453930 - DNA, 16 bp, Homo sapiens
cccaacggccctgcag

SEQ ID NO: 3453931 - DNA, 20 bp, Homo sapiens
cccaacggccctgcagccag

SEQ ID NO: 3453932 - DNA, 16 bp, Homo sapiens
cccaactctagctggg

SEQ ID NO: 3453933 - DNA, 13 bp, Homo sapiens
cccaagagggctg

SEQ ID NO: 3453934 - DNA, 22 bp, Homo sapiens
cccaagcatgggggaccccttc

SEQ ID NO: 3453935 - DNA, 23 bp, Homo sapiens
cccaagcatgggggaccccttcc

SEQ ID NO: 3453936 - DNA, 15 bp, Homo sapiens
cccaagctctgctcc

SEQ ID NO: 3453937 - DNA, 17 bp, Homo sapiens
cccaagctctgctcctc

SEQ ID NO: 3453938 - DNA, 14 bp, Homo sapiens
cccaagcttagaac

SEQ ID NO: 3453939 - DNA, 13 bp, Homo sapiens
cccaagggatctg

SEQ ID NO: 3453940 - DNA, 19 bp, Homo sapiens
cccaaggttggagcccagg

SEQ ID NO: 3453941 - DNA, 16 bp, Homo sapiens
cccaagtagaggggcc

SEQ ID NO: 3453942 - DNA, 22 bp, Homo sapiens
cccaagtagctgctaccttctt

SEQ ID NO: 3453943 - DNA, 23 bp, Homo sapiens
cccaatcccagctacctcaacca

SEQ ID NO: 3453944 - DNA, 18 bp, Homo sapiens
cccaatgagacttgcctt

SEQ ID NO: 3453945 - DNA, 19 bp, Homo sapiens
cccaatgagacttgccttc

SEQ ID NO: 3453946 - DNA, 13 bp, Homo sapiens
cccacaagtggtg

SEQ ID NO: 3453947 - DNA, 16 bp, Homo sapiens
cccacaagtggtggta

SEQ ID NO: 3453948 - DNA, 20 bp, Homo sapiens
cccacaagtggtggtaaccc

SEQ ID NO: 3453949 - DNA, 23 bp, Homo sapiens
cccacactcccaaggttggagcc

SEQ ID NO: 3453950 - DNA, 15 bp, Homo sapiens
cccacagaactgctt

SEQ ID NO: 3453951 - DNA, 19 bp, Homo sapiens
cccacaggacatttctcta

SEQ ID NO: 3453952 - DNA, 15 bp, Homo sapiens
cccacagttgctcta

SEQ ID NO: 3453953 - DNA, 12 bp, Homo sapiens
cccacccctgca

SEQ ID NO: 3453954 - DNA, 15 bp, Homo sapiens
cccacccctgcacag

SEQ ID NO: 3453955 - DNA, 18 bp, Homo sapiens
cccaccctgaaagccctg

SEQ ID NO: 3453956 - DNA, 14 bp, Homo sapiens
cccaccctgctgct

SEQ ID NO: 3453957 - DNA, 15 bp, Homo sapiens
cccaccgtgggcagg

SEQ ID NO: 3453958 - DNA, 19 bp, Homo sapiens
cccaccgtgggcagggagc

SEQ ID NO: 3453959 - DNA, 17 bp, Homo sapiens
cccacctcagcctcccg

SEQ ID NO: 3453960 - DNA, 22 bp, Homo sapiens
cccacctgtcaaacaaagccag

SEQ ID NO: 3453961 - DNA, 12 bp, Homo sapiens
cccaccttggct

SEQ ID NO: 3453962 - DNA, 17 bp, Homo sapiens
cccacgaaactgccctg

SEQ ID NO: 3453963 - DNA, 20 bp, Homo sapiens
cccacgactgcccggcaggg

SEQ ID NO: 3453964 - DNA, 14 bp, Homo sapiens
cccacgagggctgg

SEQ ID NO: 3453965 - DNA, 20 bp, Homo sapiens
cccacgctggagtgcagtga

SEQ ID NO: 3453966 - DNA, 20 bp, Homo sapiens
cccacggagtcgtggggtgt

SEQ ID NO: 3453967 - DNA, 19 bp, Homo sapiens
cccactcaagccaagcagc

SEQ ID NO: 3453968 - DNA, 12 bp, Homo sapiens
cccactgctctg

SEQ ID NO: 3453969 - DNA, 22 bp, Homo sapiens
cccactgcttttggtctgtgtg

SEQ ID NO: 3453970 - DNA, 23 bp, Homo sapiens
cccactgcttttggtctgtgtga

SEQ ID NO: 3453971 - DNA, 21 bp, Homo sapiens
cccactggggaaataacagct

SEQ ID NO: 3453972 - DNA, 22 bp, Homo sapiens
cccactgtcctgggcctgcaga

SEQ ID NO: 3453973 - DNA, 16 bp, Homo sapiens
cccagaaaacctccag

SEQ ID NO: 3453974 - DNA, 17 bp, Homo sapiens
cccagaaaacctccagt

SEQ ID NO: 3453975 - DNA, 16 bp, Homo sapiens
cccagaccggcttctc

SEQ ID NO: 3453976 - DNA, 19 bp, Homo sapiens
cccagactgtctccacggc

SEQ ID NO: 3453977 - DNA, 21 bp, Homo sapiens
cccagagacatacttgaaggg

SEQ ID NO: 3453978 - DNA, 15 bp, Homo sapiens
cccagaggagggcag

SEQ ID NO: 3453979 - DNA, 16 bp, Homo sapiens
cccagaggctgcccca

SEQ ID NO: 3453980 - DNA, 16 bp, Homo sapiens
cccagattcccctgtg

SEQ ID NO: 3453981 - DNA, 21 bp, Homo sapiens
cccagattggctcacactgag

SEQ ID NO: 3453982 - DNA, 22 bp, Homo sapiens
cccagattggctcacactgaga

SEQ ID NO: 3453983 - DNA, 18 bp, Homo sapiens
cccagattttgctgtata

SEQ ID NO: 3453984 - DNA, 18 bp, Homo sapiens
cccagcaagtgagagctg

SEQ ID NO: 3453985 - DNA, 20 bp, Homo sapiens
cccagcaagtgagagctggg

SEQ ID NO: 3453986 - DNA, 21 bp, Homo sapiens
cccagcaagtgagagctgggt

SEQ ID NO: 3453987 - DNA, 19 bp, Homo sapiens
cccagcacagcttgacctg

SEQ ID NO: 3453988 - DNA, 19 bp, Homo sapiens
cccagcattccagcccctc

SEQ ID NO: 3453989 - DNA, 20 bp, Homo sapiens
cccagcattccagcccctct

SEQ ID NO: 3453990 - DNA, 22 bp, Homo sapiens
cccagcattccagcccctctgg

SEQ ID NO: 3453991 - DNA, 15 bp, Homo sapiens
cccagcattctcagg

SEQ ID NO: 3453992 - DNA, 22 bp, Homo sapiens
cccagccagatggactccagcc

SEQ ID NO: 3453993 - DNA, 19 bp, Homo sapiens
cccagcccacttctgccat

SEQ ID NO: 3453994 - DNA, 11 bp, Homo sapiens
cccagcccaga

SEQ ID NO: 3453995 - DNA, 12 bp, Homo sapiens
cccagcccagag

SEQ ID NO: 3453996 - DNA, 15 bp, Homo sapiens
cccagcccagagaca

SEQ ID NO: 3453997 - DNA, 20 bp, Homo sapiens
cccagcccagattcccctgt

SEQ ID NO: 3453998 - DNA, 18 bp, Homo sapiens
cccagcccagggctcctg

SEQ ID NO: 3453999 - DNA, 22 bp, Homo sapiens
cccagccccggtggctgggcag

SEQ ID NO: 3454000 - DNA, 18 bp, Homo sapiens
cccagcccctactgctgt

SEQ ID NO: 3454001 - DNA, 19 bp, Homo sapiens
cccagcccctactgctgtg

SEQ ID NO: 3454002 - DNA, 13 bp, Homo sapiens
cccagcctcagcg

SEQ ID NO: 3454003 - DNA, 16 bp, Homo sapiens
cccagcctccctgaag

SEQ ID NO: 3454004 - DNA, 17 bp, Homo sapiens
cccagcctccctgaagc

SEQ ID NO: 3454005 - DNA, 11 bp, Homo sapiens
cccagcctgcg

SEQ ID NO: 3454006 - DNA, 18 bp, Homo sapiens
cccagcctgcgcctgctg

SEQ ID NO: 3454007 - DNA, 19 bp, Homo sapiens
cccagcctgcgcctgctgc

SEQ ID NO: 3454008 - DNA, 15 bp, Homo sapiens
cccagcctgctagct

SEQ ID NO: 3454009 - DNA, 21 bp, Homo sapiens
cccagcctgctagctagctca

SEQ ID NO: 3454010 - DNA, 15 bp, Homo sapiens
cccagcgagccctgg

SEQ ID NO: 3454011 - DNA, 17 bp, Homo sapiens
cccagctaagaacctgg

SEQ ID NO: 3454012 - DNA, 20 bp, Homo sapiens
cccagctaagaacctggaac

SEQ ID NO: 3454013 - DNA, 22 bp, Homo sapiens
cccagctacctcaaccaatgcc

SEQ ID NO: 3454014 - DNA, 16 bp, Homo sapiens
cccagctactctgatc

SEQ ID NO: 3454015 - DNA, 12 bp, Homo sapiens
cccagctcccca

SEQ ID NO: 3454016 - DNA, 16 bp, Homo sapiens
cccagctccccaggac

SEQ ID NO: 3454017 - DNA, 22 bp, Homo sapiens
cccagctctgaaaccagtgtta

SEQ ID NO: 3454018 - DNA, 22 bp, Homo sapiens
cccagctgtgcttatggtacca

SEQ ID NO: 3454019 - DNA, 12 bp, Homo sapiens
cccaggaagccg

SEQ ID NO: 3454020 - DNA, 13 bp, Homo sapiens
cccaggaccctga

SEQ ID NO: 3454021 - DNA, 23 bp, Homo sapiens
cccaggaccctgaaggggccatg

SEQ ID NO: 3454022 - DNA, 23 bp, Homo sapiens
cccaggactctgaccccagcatt

SEQ ID NO: 3454023 - DNA, 13 bp, Homo sapiens
cccaggactgggc

SEQ ID NO: 3454024 - DNA, 15 bp, Homo sapiens
cccaggactgggcca

SEQ ID NO: 3454025 - DNA, 23 bp, Homo sapiens
cccaggatcagattgcatgtgac

SEQ ID NO: 3454026 - DNA, 14 bp, Homo sapiens
cccaggatttgact

SEQ ID NO: 3454027 - DNA, 13 bp, Homo sapiens
cccaggcaggtct

SEQ ID NO: 3454028 - DNA, 17 bp, Homo sapiens
cccaggccccaggaagc

SEQ ID NO: 3454029 - DNA, 11 bp, Homo sapiens
cccaggcccct

SEQ ID NO: 3454030 - DNA, 18 bp, Homo sapiens
cccaggcccctgccaccc

SEQ ID NO: 3454031 - DNA, 16 bp, Homo sapiens
cccaggcccctggagg

SEQ ID NO: 3454032 - DNA, 18 bp, Homo sapiens
cccaggcccctggaggct

SEQ ID NO: 3454033 - DNA, 21 bp, Homo sapiens
cccaggcctatgttgatccat

SEQ ID NO: 3454034 - DNA, 19 bp, Homo sapiens
cccaggctggaatgcagtg

SEQ ID NO: 3454035 - DNA, 13 bp, Homo sapiens
cccaggctgggaa

SEQ ID NO: 3454036 - DNA, 21 bp, Homo sapiens
cccaggctgggaactcatctg

SEQ ID NO: 3454037 - DNA, 19 bp, Homo sapiens
cccaggctgggcaaggagg

SEQ ID NO: 3454038 - DNA, 16 bp, Homo sapiens
cccaggctggtcttga

SEQ ID NO: 3454039 - DNA, 22 bp, Homo sapiens
cccaggcttgtcactagcagct

SEQ ID NO: 3454040 - DNA, 18 bp, Homo sapiens
cccagggacacctgggag

SEQ ID NO: 3454041 - DNA, 19 bp, Homo sapiens
cccagggacacctgggaga

SEQ ID NO: 3454042 - DNA, 20 bp, Homo sapiens
cccagggagactccgctgtg

SEQ ID NO: 3454043 - DNA, 11 bp, Homo sapiens
cccagggatgg

SEQ ID NO: 3454044 - DNA, 17 bp, Homo sapiens
cccagggcatcttgctg

SEQ ID NO: 3454045 - DNA, 14 bp, Homo sapiens
cccagggcccagag

SEQ ID NO: 3454046 - DNA, 22 bp, Homo sapiens
cccagggcccagagcccagctc

SEQ ID NO: 3454047 - DNA, 13 bp, Homo sapiens
cccagggcctgag

SEQ ID NO: 3454048 - DNA, 15 bp, Homo sapiens
cccagggcctgagcc

SEQ ID NO: 3454049 - DNA, 14 bp, Homo sapiens
cccagggcctgcag

SEQ ID NO: 3454050 - DNA, 14 bp, Homo sapiens
cccagggttcccgc

SEQ ID NO: 3454051 - DNA, 18 bp, Homo sapiens
cccaggtccagctctgga

SEQ ID NO: 3454052 - DNA, 22 bp, Homo sapiens
cccaggtctctccactgctctc

SEQ ID NO: 3454053 - DNA, 13 bp, Homo sapiens
cccaggtttctgg

SEQ ID NO: 3454054 - DNA, 19 bp, Homo sapiens
cccaggtttctggtctcta

SEQ ID NO: 3454055 - DNA, 16 bp, Homo sapiens
cccagtaaaattgcca

SEQ ID NO: 3454056 - DNA, 18 bp, Homo sapiens
cccagtaaaattgccata

SEQ ID NO: 3454057 - DNA, 16 bp, Homo sapiens
ccaccaggaacctctt

SEQ ID NO: 3454058 - DNA, 14 bp, Homo sapiens
ccaccaggatcagc

SEQ ID NO: 3454059 - DNA, 21 bp, Homo sapiens
ccaccaggccacctccccagc

SEQ ID NO: 3454060 - DNA, 16 bp, Homo sapiens
ccaccaggtgcctttc

SEQ ID NO: 3454061 - DNA, 18 bp, Homo sapiens
ccaccatcatgtctggct

SEQ ID NO: 3454062 - DNA, 19 bp, Homo sapiens
ccaccatcatgtctggcta

SEQ ID NO: 3454063 - DNA, 15 bp, Homo sapiens
ccacccaatgctgat

SEQ ID NO: 3454064 - DNA, 14 bp, Homo sapiens
ccacccacctcagc

SEQ ID NO: 3454065 - DNA, 15 bp, Homo sapiens
ccacccacctcagcc

SEQ ID NO: 3454066 - DNA, 12 bp, Homo sapiens
ccacccaggagc

SEQ ID NO: 3454067 - DNA, 21 bp, Homo sapiens
ccacccaggagccccgaggcc

SEQ ID NO: 3454068 - DNA, 19 bp, Homo sapiens
ccacccccccaccccaggc

SEQ ID NO: 3454069 - DNA, 22 bp, Homo sapiens
ccacccctggaagagcccagtc

SEQ ID NO: 3454070 - DNA, 20 bp, Homo sapiens
ccacccctgggggctctcat

SEQ ID NO: 3454071 - DNA, 11 bp, Homo sapiens
ccaccctgctc

SEQ ID NO: 3454072 - DNA, 13 bp, Homo sapiens
ccaccctgctgct

SEQ ID NO: 3454073 - DNA, 20 bp, Homo sapiens
ccaccctggccgagtccaag

SEQ ID NO: 3454074 - DNA, 12 bp, Homo sapiens
ccaccctgggcc

SEQ ID NO: 3454075 - DNA, 16 bp, Homo sapiens
ccaccctgggccctgg

SEQ ID NO: 3454076 - DNA, 15 bp, Homo sapiens
ccaccctgtcttcct

SEQ ID NO: 3454077 - DNA, 16 bp, Homo sapiens
ccaccctgtcttcctc

SEQ ID NO: 3454078 - DNA, 14 bp, Homo sapiens
ccacccttcccctc

SEQ ID NO: 3454079 - DNA, 18 bp, Homo sapiens
ccaccgaagccgcctgtg

SEQ ID NO: 3454080 - DNA, 13 bp, Homo sapiens
ccaccgcccagag

SEQ ID NO: 3454081 - DNA, 17 bp, Homo sapiens
ccaccgcccagagaccc

SEQ ID NO: 3454082 - DNA, 18 bp, Homo sapiens
ccacctccctgcctccag

SEQ ID NO: 3454083 - DNA, 14 bp, Homo sapiens
ccaccttggctgca

SEQ ID NO: 3454084 - DNA, 19 bp, Homo sapiens
ccaccttggctgcagggag

SEQ ID NO: 3454085 - DNA, 17 bp, Homo sapiens
ccacgaaactgccctgg

SEQ ID NO: 3454086 - DNA, 23 bp, Homo sapiens
ccacgaatttctgtgccctcctg

SEQ ID NO: 3454087 - DNA, 15 bp, Homo sapiens
ccacgactgtctcca

SEQ ID NO: 3454088 - DNA, 14 bp, Homo sapiens
ccacgagggctggc

SEQ ID NO: 3454089 - DNA, 22 bp, Homo sapiens
ccacgagggctggctggcctca

SEQ ID NO: 3454090 - DNA, 22 bp, Homo sapiens
ccacgattggtatgatgctgcc

SEQ ID NO: 3454091 - DNA, 19 bp, Homo sapiens
ccacgcccgtcctgcctgt

SEQ ID NO: 3454092 - DNA, 22 bp, Homo sapiens
ccacgcccgtcctgcctgtggc

SEQ ID NO: 3454093 - DNA, 23 bp, Homo sapiens
ccacgcccgtcctgcctgtggcg

SEQ ID NO: 3454094 - DNA, 18 bp, Homo sapiens
ccacgctggagtgcagtg

SEQ ID NO: 3454095 - DNA, 14 bp, Homo sapiens
ccacgctgggtatt

SEQ ID NO: 3454096 - DNA, 22 bp, Homo sapiens
ccacggagcagttcagagtgga

SEQ ID NO: 3454097 - DNA, 12 bp, Homo sapiens
ccacggagccac

SEQ ID NO: 3454098 - DNA, 13 bp, Homo sapiens
ccacggccaggcc

SEQ ID NO: 3454099 - DNA, 20 bp, Homo sapiens
ccacgtattccccttcccac

SEQ ID NO: 3454100 - DNA, 16 bp, Homo sapiens
ccacgtgtgtgtgtga

SEQ ID NO: 3454101 - DNA, 19 bp, Homo sapiens
ccactaagcagaggagggg

SEQ ID NO: 3454102 - DNA, 22 bp, Homo sapiens
ccactaagcagaggaggggccg

SEQ ID NO: 3454103 - DNA, 14 bp, Homo sapiens
ccactagtgcaaat

SEQ ID NO: 3454104 - DNA, 16 bp, Homo sapiens
ccactagtgcaaatca

SEQ ID NO: 3454105 - DNA, 17 bp, Homo sapiens
ccactagtgcaaatcat

SEQ ID NO: 3454106 - DNA, 16 bp, Homo sapiens
ccactcaagccaagca

SEQ ID NO: 3454107 - DNA, 18 bp, Homo sapiens
ccactcagtccatagcag

SEQ ID NO: 3454108 - DNA, 18 bp, Homo sapiens
ccactccagtcctgccac

SEQ ID NO: 3454109 - DNA, 21 bp, Homo sapiens
ccactccagtcctgccaccac

SEQ ID NO: 3454110 - DNA, 13 bp, Homo sapiens
ccactcccaggca

SEQ ID NO: 3454111 - DNA, 14 bp, Homo sapiens
ccactcccaggcag

SEQ ID NO: 3454112 - DNA, 15 bp, Homo sapiens
ccactcccaggcagc

SEQ ID NO: 3454113 - DNA, 20 bp, Homo sapiens
ccactccgagaggtgggcca

SEQ ID NO: 3454114 - DNA, 20 bp, Homo sapiens
ccactcctctgactcagggc

SEQ ID NO: 3454115 - DNA, 13 bp, Homo sapiens
ccactctgcttct

SEQ ID NO: 3454116 - DNA, 19 bp, Homo sapiens
ccactctgcttctctgact

SEQ ID NO: 3454117 - DNA, 16 bp, Homo sapiens
ccactgatttagccat

SEQ ID NO: 3454118 - DNA, 19 bp, Homo sapiens
ccactgcaccgggccacag

SEQ ID NO: 3454119 - DNA, 20 bp, Homo sapiens
ccactgcactccagcctggg

SEQ ID NO: 3454120 - DNA, 17 bp, Homo sapiens
ccactgccactccagtc

SEQ ID NO: 3454121 - DNA, 16 bp, Homo sapiens
ccactgccataaaaca

SEQ ID NO: 3454122 - DNA, 11 bp, Homo sapiens
ccactgccatg

SEQ ID NO: 3454123 - DNA, 14 bp, Homo sapiens
ccactgccttcgct

SEQ ID NO: 3454124 - DNA, 23 bp, Homo sapiens
ccactgccttcgcttcttgcctc

SEQ ID NO: 3454125 - DNA, 14 bp, Homo sapiens
ccactgctctcagc

SEQ ID NO: 3454126 - DNA, 12 bp, Homo sapiens
ccactgctctgg

SEQ ID NO: 3454127 - DNA, 13 bp, Homo sapiens
ccactgctctggt

SEQ ID NO: 3454128 - DNA, 15 bp, Homo sapiens
ccactgctctggtta

SEQ ID NO: 3454129 - DNA, 18 bp, Homo sapiens
ccactgggaccaaccctg

SEQ ID NO: 3454130 - DNA, 23 bp, Homo sapiens
ccactgggaccaaccctggggaa

SEQ ID NO: 3454131 - DNA, 18 bp, Homo sapiens
ccactgggccctgagcca

SEQ ID NO: 3454132 - DNA, 12 bp, Homo sapiens
ccactggggaaa

SEQ ID NO: 3454133 - DNA, 22 bp, Homo sapiens
ccactggggaaataacagctgt

SEQ ID NO: 3454134 - DNA, 19 bp, Homo sapiens
ccactggggtccagggagc

SEQ ID NO: 3454135 - DNA, 19 bp, Homo sapiens
ccactgtcctgggcctgca

SEQ ID NO: 3454136 - DNA, 13 bp, Homo sapiens
ccacttcagctga

SEQ ID NO: 3454137 - DNA, 23 bp, Homo sapiens
ccacttcattcttgaaagctgtg

SEQ ID NO: 3454138 - DNA, 10 bp, Homo sapiens
ccacttctgg

SEQ ID NO: 3454139 - DNA, 19 bp, Homo sapiens
ccacttcttgttccccact

SEQ ID NO: 3454140 - DNA, 13 bp, Homo sapiens
ccacttgcctctt

SEQ ID NO: 3454141 - DNA, 16 bp, Homo sapiens
ccacttgcctcttcct

SEQ ID NO: 3454142 - DNA, 17 bp, Homo sapiens
ccacttgcctcttcctt

SEQ ID NO: 3454143 - DNA, 22 bp, Homo sapiens
ccacttgcctcttccttgaaga

SEQ ID NO: 3454144 - DNA, 15 bp, Homo sapiens
ccacttgtttgcact

SEQ ID NO: 3454145 - DNA, 20 bp, Homo sapiens
ccactttcttctaccagacc

SEQ ID NO: 3454146 - DNA, 16 bp, Homo sapiens
ccactttttgcagctt

SEQ ID NO: 3454147 - DNA, 12 bp, Homo sapiens
ccagaaaggtga

SEQ ID NO: 3454148 - DNA, 22 bp, Homo sapiens
ccagaacacactccatcagctt

SEQ ID NO: 3454149 - DNA, 19 bp, Homo sapiens
ccagaactcactggggcct

SEQ ID NO: 3454150 - DNA, 20 bp, Homo sapiens
ccagaacttgaccctgagct

SEQ ID NO: 3454151 - DNA, 22 bp, Homo sapiens
ccagaagatagcttcaccccaa

SEQ ID NO: 3454152 - DNA, 15 bp, Homo sapiens
ccagaagcctctgcc

SEQ ID NO: 3454153 - DNA, 23 bp, Homo sapiens
ccagaagtttgagatcagcctgg

SEQ ID NO: 3454154 - DNA, 21 bp, Homo sapiens
ccagaattcattccccagctc

SEQ ID NO: 3454155 - DNA, 14 bp, Homo sapiens
ccagacacaggccc

SEQ ID NO: 3454156 - DNA, 14 bp, Homo sapiens
ccagacacccagga

SEQ ID NO: 3454157 - DNA, 20 bp, Homo sapiens
ccagacatgccacaaggact

SEQ ID NO: 3454158 - DNA, 12 bp, Homo sapiens
ccagaccctgaa

SEQ ID NO: 3454159 - DNA, 15 bp, Homo sapiens
ccagacctgatcctg

SEQ ID NO: 3454160 - DNA, 16 bp, Homo sapiens
ccagacctgatcctgg

SEQ ID NO: 3454161 - DNA, 17 bp, Homo sapiens
ccagacctgatcctgga

SEQ ID NO: 3454162 - DNA, 21 bp, Homo sapiens
ccagacctgttagcagacagg

SEQ ID NO: 3454163 - DNA, 19 bp, Homo sapiens
ccagactgtctccacggcc

SEQ ID NO: 3454164 - DNA, 19 bp, Homo sapiens
ccagagaaaggggagccca

SEQ ID NO: 3454165 - DNA, 20 bp, Homo sapiens
ccagagaagtctggtcagag

SEQ ID NO: 3454166 - DNA, 17 bp, Homo sapiens
ccagagacatacttgaa

SEQ ID NO: 3454167 - DNA, 20 bp, Homo sapiens
ccagagacatacttgaaggg

SEQ ID NO: 3454168 - DNA, 22 bp, Homo sapiens
ccagagacatacttgaagggcc

SEQ ID NO: 3454169 - DNA, 17 bp, Homo sapiens
ccagagagagcaaggaa

SEQ ID NO: 3454170 - DNA, 23 bp, Homo sapiens
ccagagagggtggtgacctctgc

SEQ ID NO: 3454171 - DNA, 15 bp, Homo sapiens
ccagagccaaatttt

SEQ ID NO: 3454172 - DNA, 23 bp, Homo sapiens
ccagagccaggggggtgaggagc

SEQ ID NO: 3454173 - DNA, 16 bp, Homo sapiens
ccagagcccagctcca

SEQ ID NO: 3454174 - DNA, 18 bp, Homo sapiens
ccagagcccagctccaag

SEQ ID NO: 3454175 - DNA, 19 bp, Homo sapiens
ccagagcctgtctttcagc

SEQ ID NO: 3454176 - DNA, 23 bp, Homo sapiens
ccagagcctgtctttcagcattc

SEQ ID NO: 3454177 - DNA, 23 bp, Homo sapiens
ccagagctgaagagttgccccgt

SEQ ID NO: 3454178 - DNA, 16 bp, Homo sapiens
ccagagctggccaggc

SEQ ID NO: 3454179 - DNA, 15 bp, Homo sapiens
ccagaggaagcccct

SEQ ID NO: 3454180 - DNA, 14 bp, Homo sapiens
ccagaggcccccag

SEQ ID NO: 3454181 - DNA, 18 bp, Homo sapiens
ccagaggcccccagccca

SEQ ID NO: 3454182 - DNA, 19 bp, Homo sapiens
ccagaggcccccagcccag

SEQ ID NO: 3454183 - DNA, 22 bp, Homo sapiens
ccagaggcccccagcccagggc

SEQ ID NO: 3454184 - DNA, 15 bp, Homo sapiens
ccagaggctgcccca

SEQ ID NO: 3454185 - DNA, 21 bp, Homo sapiens
ccagagggagtgacagaggca

SEQ ID NO: 3454186 - DNA, 23 bp, Homo sapiens
ccagagggagtgacagaggcagc

SEQ ID NO: 3454187 - DNA, 18 bp, Homo sapiens
ccagagttccccatgcag

SEQ ID NO: 3454188 - DNA, 19 bp, Homo sapiens
ccagagttccccatgcaga

SEQ ID NO: 3454189 - DNA, 21 bp, Homo sapiens
ccagagttccccatgcagaca

SEQ ID NO: 3454190 - DNA, 21 bp, Homo sapiens
ccagatacacccaaagtatca

SEQ ID NO: 3454191 - DNA, 14 bp, Homo sapiens
ccagatccagcctg

SEQ ID NO: 3454192 - DNA, 19 bp, Homo sapiens
ccagatcttgcctccagag

SEQ ID NO: 3454193 - DNA, 17 bp, Homo sapiens
ccagatggactccagcc

SEQ ID NO: 3454194 - DNA, 16 bp, Homo sapiens
ccagatgggggaaagc

SEQ ID NO: 3454195 - DNA, 14 bp, Homo sapiens
ccagatggtgggat

SEQ ID NO: 3454196 - DNA, 15 bp, Homo sapiens
ccagatggttgtgta

SEQ ID NO: 3454197 - DNA, 18 bp, Homo sapiens
ccagatggttgtgtatgg

SEQ ID NO: 3454198 - DNA, 15 bp, Homo sapiens
ccagattcccctgtg

SEQ ID NO: 3454199 - DNA, 16 bp, Homo sapiens
ccagattcccctgtgt

SEQ ID NO: 3454200 - DNA, 12 bp, Homo sapiens
ccagattcttca

SEQ ID NO: 3454201 - DNA, 14 bp, Homo sapiens
ccagattcttcagc

SEQ ID NO: 3454202 - DNA, 20 bp, Homo sapiens
ccagattgcaacaggctggg

SEQ ID NO: 3454203 - DNA, 20 bp, Homo sapiens
ccagattggctcacactgag

SEQ ID NO: 3454204 - DNA, 15 bp, Homo sapiens
ccagatttgtctttt

SEQ ID NO: 3454205 - DNA, 18 bp, Homo sapiens
ccagattttgctgtatat

SEQ ID NO: 3454206 - DNA, 15 bp, Homo sapiens
ccagcaaacaaaatg

SEQ ID NO: 3454207 - DNA, 20 bp, Homo sapiens
ccagcaagtgagagctgggt

SEQ ID NO: 3454208 - DNA, 16 bp, Homo sapiens
ccagcacacagggcag

SEQ ID NO: 3454209 - DNA, 13 bp, Homo sapiens
ccagcacagcttg

SEQ ID NO: 3454210 - DNA, 15 bp, Homo sapiens
ccagcacccaaaggg

SEQ ID NO: 3454211 - DNA, 22 bp, Homo sapiens
ccagcaccggccccatttaccc

SEQ ID NO: 3454212 - DNA, 21 bp, Homo sapiens
ccagcacggtgactctgtcca

SEQ ID NO: 3454213 - DNA, 15 bp, Homo sapiens
ccagcactgcttgag

SEQ ID NO: 3454214 - DNA, 18 bp, Homo sapiens
ccagcactgcttgaggaa

SEQ ID NO: 3454215 - DNA, 22 bp, Homo sapiens
ccagcactgcttgaggaaaaca

SEQ ID NO: 3454216 - DNA, 16 bp, Homo sapiens
ccagcacttgtccagc

SEQ ID NO: 3454217 - DNA, 17 bp, Homo sapiens
ccagcagaaccagcctc

SEQ ID NO: 3454218 - DNA, 23 bp, Homo sapiens
ccagcagcagcccaagcttccct

SEQ ID NO: 3454219 - DNA, 12 bp, Homo sapiens
ccagcagcctgg

SEQ ID NO: 3454220 - DNA, 13 bp, Homo sapiens
ccagcagcctgga

SEQ ID NO: 3454221 - DNA, 15 bp, Homo sapiens
ccagcagcctggacc

SEQ ID NO: 3454222 - DNA, 12 bp, Homo sapiens
ccagcagcgcct

SEQ ID NO: 3454223 - DNA, 24 bp, Homo sapiens
ccagcagcggaaccgcccaggatc

SEQ ID NO: 3454224 - DNA, 18 bp, Homo sapiens
ccagcaggtgctgacttc

SEQ ID NO: 3454225 - DNA, 14 bp, Homo sapiens
ccagcagtcacttc

SEQ ID NO: 3454226 - DNA, 17 bp, Homo sapiens
ccagcagtctctgcctt

SEQ ID NO: 3454227 - DNA, 21 bp, Homo sapiens
ccagcagtctctgccttgcct

SEQ ID NO: 3454228 - DNA, 18 bp, Homo sapiens
ccagcatccacactgccg

SEQ ID NO: 3454229 - DNA, 18 bp, Homo sapiens
ccagcatcccttgaccag

SEQ ID NO: 3454230 - DNA, 20 bp, Homo sapiens
ccagccaaacgggagctttt

SEQ ID NO: 3454231 - DNA, 15 bp, Homo sapiens
ccagccaaagcctcc

SEQ ID NO: 3454232 - DNA, 14 bp, Homo sapiens
ccagccagcagcag

SEQ ID NO: 3454233 - DNA, 22 bp, Homo sapiens
ccagccagcagcagcccaagct

SEQ ID NO: 3454234 - DNA, 17 bp, Homo sapiens
ccagccaggccccaggc

SEQ ID NO: 3454235 - DNA, 14 bp, Homo sapiens
ccagccagggctgc

SEQ ID NO: 3454236 - DNA, 14 bp, Homo sapiens
ccagccatgtctgc

SEQ ID NO: 3454237 - DNA, 16 bp, Homo sapiens
ccagccatgtctgcat

SEQ ID NO: 3454238 - DNA, 20 bp, Homo sapiens
ccagcccaagtagaggggcc

SEQ ID NO: 3454239 - DNA, 12 bp, Homo sapiens
ccagcccagaga

SEQ ID NO: 3454240 - DNA, 23 bp, Homo sapiens
ccagcccagattcccctgtgtca

SEQ ID NO: 3454241 - DNA, 15 bp, Homo sapiens
ccagccccagtgccc

SEQ ID NO: 3454242 - DNA, 17 bp, Homo sapiens
ccagccccagtgcccac

SEQ ID NO: 3454243 - DNA, 15 bp, Homo sapiens
ccagcccctactgct

SEQ ID NO: 3454244 - DNA, 14 bp, Homo sapiens
ccagcccctctggt

SEQ ID NO: 3454245 - DNA, 14 bp, Homo sapiens
ccagccctcatccc

SEQ ID NO: 3454246 - DNA, 20 bp, Homo sapiens
ccagccctccccatggagcc

SEQ ID NO: 3454247 - DNA, 14 bp, Homo sapiens
ccagccgccatgct

SEQ ID NO: 3454248 - DNA, 19 bp, Homo sapiens
ccagccgccatgctcctgg

SEQ ID NO: 3454249 - DNA, 13 bp, Homo sapiens
ccagccggggcct

SEQ ID NO: 3454250 - DNA, 21 bp, Homo sapiens
ccagcctaagaagctctggcc

SEQ ID NO: 3454251 - DNA, 15 bp, Homo sapiens
ccagcctccctgaag

SEQ ID NO: 3454252 - DNA, 18 bp, Homo sapiens
ccagcctgaacagaagct

SEQ ID NO: 3454253 - DNA, 19 bp, Homo sapiens
ccagcctgaacagaagctc

SEQ ID NO: 3454254 - DNA, 15 bp, Homo sapiens
ccagcctgcgcctgc

SEQ ID NO: 3454255 - DNA, 21 bp, Homo sapiens
ccagcctgcgcctgctgcatg

SEQ ID NO: 3454256 - DNA, 23 bp, Homo sapiens
ccagcctgcgggaagctgacctt

SEQ ID NO: 3454257 - DNA, 10 bp, Homo sapiens
ccagcctgct

SEQ ID NO: 3454258 - DNA, 13 bp, Homo sapiens
ccagcctgggtga

SEQ ID NO: 3454259 - DNA, 20 bp, Homo sapiens
ccagcctttgatcaggtggg

SEQ ID NO: 3454260 - DNA, 14 bp, Homo sapiens
ccagcgagccctgg

SEQ ID NO: 3454261 - DNA, 21 bp, Homo sapiens
ccagcgtatatataagaaaga

SEQ ID NO: 3454262 - DNA, 17 bp, Homo sapiens
ccagctacacctttctc

SEQ ID NO: 3454263 - DNA, 18 bp, Homo sapiens
ccagctacacctttctcc

SEQ ID NO: 3454264 - DNA, 20 bp, Homo sapiens
ccagctacacctttctcctt

SEQ ID NO: 3454265 - DNA, 17 bp, Homo sapiens
ccagctactcgggaggc

SEQ ID NO: 3454266 - DNA, 15 bp, Homo sapiens
ccagctactctgatc

SEQ ID NO: 3454267 - DNA, 14 bp, Homo sapiens
ccagctatacctgt

SEQ ID NO: 3454268 - DNA, 19 bp, Homo sapiens
ccagctatacctgtgcctc

SEQ ID NO: 3454269 - DNA, 12 bp, Homo sapiens
ccagctatctgc

SEQ ID NO: 3454270 - DNA, 13 bp, Homo sapiens
ccagctatctgcc

SEQ ID NO: 3454271 - DNA, 15 bp, Homo sapiens
ccagctatctgcctg

SEQ ID NO: 3454272 - DNA, 16 bp, Homo sapiens
ccagctatctgcctga

SEQ ID NO: 3454273 - DNA, 19 bp, Homo sapiens
ccagctatctgcctgacag

SEQ ID NO: 3454274 - DNA, 22 bp, Homo sapiens
ccagctatctgcctgacaggct

SEQ ID NO: 3454275 - DNA, 15 bp, Homo sapiens
ccagctcaccagccc

SEQ ID NO: 3454276 - DNA, 14 bp, Homo sapiens
ccagctccaacctg

SEQ ID NO: 3454277 - DNA, 13 bp, Homo sapiens
ccagctccccagg

SEQ ID NO: 3454278 - DNA, 15 bp, Homo sapiens
ccagctccccaggac

SEQ ID NO: 3454279 - DNA, 16 bp, Homo sapiens
ccagctccccaggact

SEQ ID NO: 3454280 - DNA, 19 bp, Homo sapiens
ccagctccggcctgtcctc

SEQ ID NO: 3454281 - DNA, 12 bp, Homo sapiens
ccagctcctcat

SEQ ID NO: 3454282 - DNA, 23 bp, Homo sapiens
ccagctcctcatccagggctctg

SEQ ID NO: 3454283 - DNA, 21 bp, Homo sapiens
ccagctcctgggcagcttgag

SEQ ID NO: 3454284 - DNA, 18 bp, Homo sapiens
ccagctctgtatcaggac

SEQ ID NO: 3454285 - DNA, 21 bp, Homo sapiens
ccagctctgtatcaggaccca

SEQ ID NO: 3454286 - DNA, 17 bp, Homo sapiens
ccagctctttcctcctt

SEQ ID NO: 3454287 - DNA, 15 bp, Homo sapiens
ccagctgagcgccag

SEQ ID NO: 3454288 - DNA, 17 bp, Homo sapiens
ccagctgagcgccagga

SEQ ID NO: 3454289 - DNA, 14 bp, Homo sapiens
ccagctgcaaagtg

SEQ ID NO: 3454290 - DNA, 18 bp, Homo sapiens
ccagctgcactgatgctg

SEQ ID NO: 3454291 - DNA, 21 bp, Homo sapiens
ccagctgccctatgggcctgc

SEQ ID NO: 3454292 - DNA, 12 bp, Homo sapiens
ccagctgcctag

SEQ ID NO: 3454293 - DNA, 10 bp, Homo sapiens
ccagctgcta

SEQ ID NO: 3454294 - DNA, 14 bp, Homo sapiens
ccagctgctcccca

SEQ ID NO: 3454295 - DNA, 14 bp, Homo sapiens
ccagctggcagcag

SEQ ID NO: 3454296 - DNA, 15 bp, Homo sapiens
ccagctggcagcaga

SEQ ID NO: 3454297 - DNA, 20 bp, Homo sapiens
ccagctggcagcagagtgtg

SEQ ID NO: 3454298 - DNA, 20 bp, Homo sapiens
ccagctgggctagaggctga

SEQ ID NO: 3454299 - DNA, 23 bp, Homo sapiens
ccagctgggctagaggctgagca

SEQ ID NO: 3454300 - DNA, 18 bp, Homo sapiens
ccagctgggtcaggcagg

SEQ ID NO: 3454301 - DNA, 21 bp, Homo sapiens
ccagctggtgagtgatgcggc

SEQ ID NO: 3454302 - DNA, 18 bp, Homo sapiens
ccagctgtgctctggaca

SEQ ID NO: 3454303 - DNA, 16 bp, Homo sapiens
ccagctgttcagctgg

SEQ ID NO: 3454304 - DNA, 17 bp, Homo sapiens
ccagctgttcagctggt

SEQ ID NO: 3454305 - DNA, 16 bp, Homo sapiens
ccagcttatctcaggg

SEQ ID NO: 3454306 - DNA, 19 bp, Homo sapiens
ccagcttcatgtggcttcc

SEQ ID NO: 3454307 - DNA, 22 bp, Homo sapiens
ccagcttgccagatgctgcaga

SEQ ID NO: 3454308 - DNA, 19 bp, Homo sapiens
ccagcttggacatcagtgt

SEQ ID NO: 3454309 - DNA, 16 bp, Homo sapiens
ccagcttgttatttat

SEQ ID NO: 3454310 - DNA, 15 bp, Homo sapiens
ccaggaaaagcacaa

SEQ ID NO: 3454311 - DNA, 16 bp, Homo sapiens
ccaggaatttcccagg

SEQ ID NO: 3454312 - DNA, 18 bp, Homo sapiens
ccaggaatttcccaggac

SEQ ID NO: 3454313 - DNA, 20 bp, Homo sapiens
ccaggaatttcccaggaccc

SEQ ID NO: 3454314 - DNA, 22 bp, Homo sapiens
ccaggaatttcccaggaccctg

SEQ ID NO: 3454315 - DNA, 14 bp, Homo sapiens
ccaggaccagctca

SEQ ID NO: 3454316 - DNA, 16 bp, Homo sapiens
ccaggaccctgaaggg

SEQ ID NO: 3454317 - DNA, 18 bp, Homo sapiens
ccaggacctcttctggag

SEQ ID NO: 3454318 - DNA, 15 bp, Homo sapiens
ccaggacctggctgc

SEQ ID NO: 3454319 - DNA, 17 bp, Homo sapiens
ccaggacctggctgcca

SEQ ID NO: 3454320 - DNA, 11 bp, Homo sapiens
ccaggactctg

SEQ ID NO: 3454321 - DNA, 18 bp, Homo sapiens
ccaggactctgaccccag

SEQ ID NO: 3454322 - DNA, 22 bp, Homo sapiens
ccaggactctgaccccagcatt

SEQ ID NO: 3454323 - DNA, 14 bp, Homo sapiens
ccaggactgggcca

SEQ ID NO: 3454324 - DNA, 21 bp, Homo sapiens
ccaggacttatttaaactctg

SEQ ID NO: 3454325 - DNA, 20 bp, Homo sapiens
ccaggagaaggccaattcct

SEQ ID NO: 3454326 - DNA, 15 bp, Homo sapiens
ccaggagccccgagg

SEQ ID NO: 3454327 - DNA, 21 bp, Homo sapiens
ccaggagcttcttgtttcctt

SEQ ID NO: 3454328 - DNA, 19 bp, Homo sapiens
ccaggaggagttagccaaa

SEQ ID NO: 3454329 - DNA, 21 bp, Homo sapiens
ccaggaggtttttttgtcaac

SEQ ID NO: 3454330 - DNA, 16 bp, Homo sapiens
ccaggatagagactgg

SEQ ID NO: 3454331 - DNA, 21 bp, Homo sapiens
ccaggatcagattgcatgtga

SEQ ID NO: 3454332 - DNA, 17 bp, Homo sapiens
ccaggatttgcacagaa

SEQ ID NO: 3454333 - DNA, 15 bp, Homo sapiens
ccaggcagatccagg

SEQ ID NO: 3454334 - DNA, 18 bp, Homo sapiens
ccaggcagatccaggact

SEQ ID NO: 3454335 - DNA, 19 bp, Homo sapiens
ccaggcagatccaggacta

SEQ ID NO: 3454336 - DNA, 18 bp, Homo sapiens
ccaggcaggctaaggcgt

SEQ ID NO: 3454337 - DNA, 19 bp, Homo sapiens
ccaggcagggccaaccctt

SEQ ID NO: 3454338 - DNA, 23 bp, Homo sapiens
ccaggcagggccaacccttctcc

SEQ ID NO: 3454339 - DNA, 13 bp, Homo sapiens
ccaggcatggtgg

SEQ ID NO: 3454340 - DNA, 20 bp, Homo sapiens
ccaggcatttagccctcaca

SEQ ID NO: 3454341 - DNA, 13 bp, Homo sapiens
ccaggccacctcc

SEQ ID NO: 3454342 - DNA, 16 bp, Homo sapiens
ccaggccacctcccca

SEQ ID NO: 3454343 - DNA, 14 bp, Homo sapiens
ccaggccagaggga

SEQ ID NO: 3454344 - DNA, 21 bp, Homo sapiens
ccaggccagagggagtgacag

SEQ ID NO: 3454345 - DNA, 15 bp, Homo sapiens
ccaggccagctgcct

SEQ ID NO: 3454346 - DNA, 15 bp, Homo sapiens
ccaggcccaaggctc

SEQ ID NO: 3454347 - DNA, 13 bp, Homo sapiens
ccaggcccctgcc

SEQ ID NO: 3454348 - DNA, 21 bp, Homo sapiens
ccaggcccctgccaccctggg

SEQ ID NO: 3454349 - DNA, 23 bp, Homo sapiens
ccaggcccctgccaccctgggga

SEQ ID NO: 3454350 - DNA, 15 bp, Homo sapiens
ccaggcccctggagg

SEQ ID NO: 3454351 - DNA, 15 bp, Homo sapiens
ccaggccctgccaga

SEQ ID NO: 3454352 - DNA, 19 bp, Homo sapiens
ccaggccctgccagagcag

SEQ ID NO: 3454353 - DNA, 17 bp, Homo sapiens
ccaggccctgtggcagg

SEQ ID NO: 3454354 - DNA, 13 bp, Homo sapiens
ccaggcctgagct

SEQ ID NO: 3454355 - DNA, 16 bp, Homo sapiens
ccaggcctgagctgct

SEQ ID NO: 3454356 - DNA, 18 bp, Homo sapiens
ccaggcctgagctgcttc

SEQ ID NO: 3454357 - DNA, 18 bp, Homo sapiens
ccaggccttatctccaag

SEQ ID NO: 3454358 - DNA, 18 bp, Homo sapiens
ccaggcgcaggggctcac

SEQ ID NO: 3454359 - DNA, 20 bp, Homo sapiens
ccaggctgaagcaggttccc

SEQ ID NO: 3454360 - DNA, 23 bp, Homo sapiens
ccaggctgaccacagcacagcca

SEQ ID NO: 3454361 - DNA, 18 bp, Homo sapiens
ccaggctgccgtggggcc

SEQ ID NO: 3454362 - DNA, 16 bp, Homo sapiens
ccaggctggcgtgcag

SEQ ID NO: 3454363 - DNA, 19 bp, Homo sapiens
ccaggctggcgtgcagtgg

SEQ ID NO: 3454364 - DNA, 11 bp, Homo sapiens
ccaggctggga

SEQ ID NO: 3454365 - DNA, 23 bp, Homo sapiens
ccaggctgtgtttggctttcagg

SEQ ID NO: 3454366 - DNA, 17 bp, Homo sapiens
ccagggaagctgtccct

SEQ ID NO: 3454367 - DNA, 18 bp, Homo sapiens
ccagggacagaggcccca

SEQ ID NO: 3454368 - DNA, 22 bp, Homo sapiens
ccagggacagaggccccagcct

SEQ ID NO: 3454369 - DNA, 14 bp, Homo sapiens
ccagggagaagctc

SEQ ID NO: 3454370 - DNA, 23 bp, Homo sapiens
ccagggagacctggacacaggcc

SEQ ID NO: 3454371 - DNA, 22 bp, Homo sapiens
ccagggagcctttggttctggc

SEQ ID NO: 3454372 - DNA, 18 bp, Homo sapiens
ccagggagcggaaagcag

SEQ ID NO: 3454373 - DNA, 19 bp, Homo sapiens
ccagggagcggaaagcagc

SEQ ID NO: 3454374 - DNA, 20 bp, Homo sapiens
ccagggagcggaaagcagct

SEQ ID NO: 3454375 - DNA, 23 bp, Homo sapiens
ccagggagcggaaagcagctcaa

SEQ ID NO: 3454376 - DNA, 19 bp, Homo sapiens
ccagggaggtggaaggacc

SEQ ID NO: 3454377 - DNA, 17 bp, Homo sapiens
ccagggatttgcctcac

SEQ ID NO: 3454378 - DNA, 20 bp, Homo sapiens
ccagggcaagctccgcagga

SEQ ID NO: 3454379 - DNA, 22 bp, Homo sapiens
ccagggcaagctccgcaggact

SEQ ID NO: 3454380 - DNA, 23 bp, Homo sapiens
ccagggcaagggttaaggcctga

SEQ ID NO: 3454381 - DNA, 19 bp, Homo sapiens
ccagggccacgctccagct

SEQ ID NO: 3454382 - DNA, 18 bp, Homo sapiens
ccagggcccagagcccag

SEQ ID NO: 3454383 - DNA, 19 bp, Homo sapiens
ccagggcccagagcccagc

SEQ ID NO: 3454384 - DNA, 22 bp, Homo sapiens
ccagggcccagagcccagctcc

SEQ ID NO: 3454385 - DNA, 15 bp, Homo sapiens
ccagggcccccacag

SEQ ID NO: 3454386 - DNA, 16 bp, Homo sapiens
ccagggcctgagcctg

SEQ ID NO: 3454387 - DNA, 16 bp, Homo sapiens
ccagggcctggaagac

SEQ ID NO: 3454388 - DNA, 17 bp, Homo sapiens
ccagggcctggaagaca

SEQ ID NO: 3454389 - DNA, 19 bp, Homo sapiens
ccagggcctggaagacaga

SEQ ID NO: 3454390 - DNA, 16 bp, Homo sapiens
ccagggctctgaccag

SEQ ID NO: 3454391 - DNA, 13 bp, Homo sapiens
ccagggctggact

SEQ ID NO: 3454392 - DNA, 17 bp, Homo sapiens
ccagggctggactgagg

SEQ ID NO: 3454393 - DNA, 19 bp, Homo sapiens
ccagggctggactgaggcc

SEQ ID NO: 3454394 - DNA, 16 bp, Homo sapiens
ccaggggatgggaggt

SEQ ID NO: 3454395 - DNA, 14 bp, Homo sapiens
ccaggggcgaggcc

SEQ ID NO: 3454396 - DNA, 22 bp, Homo sapiens
ccaggggctgcttcctcctgga

SEQ ID NO: 3454397 - DNA, 17 bp, Homo sapiens
ccagggtcagaaacagg

SEQ ID NO: 3454398 - DNA, 16 bp, Homo sapiens
ccagggtccctctgtg

SEQ ID NO: 3454399 - DNA, 17 bp, Homo sapiens
ccagggtccctctgtgt

SEQ ID NO: 3454400 - DNA, 14 bp, Homo sapiens
ccaggtccagctct

SEQ ID NO: 3454401 - DNA, 18 bp, Homo sapiens
ccaggtctctccactgct

SEQ ID NO: 3454402 - DNA, 15 bp, Homo sapiens
ccaggtgcagccaga

SEQ ID NO: 3454403 - DNA, 16 bp, Homo sapiens
ccaggtgcagccagag

SEQ ID NO: 3454404 - DNA, 16 bp, Homo sapiens
ccaggtgcctttcaaa

SEQ ID NO: 3454405 - DNA, 22 bp, Homo sapiens
ccaggtgctacacccttttcca

SEQ ID NO: 3454406 - DNA, 22 bp, Homo sapiens
ccaggtgggtcccggctctgtg

SEQ ID NO: 3454407 - DNA, 17 bp, Homo sapiens
ccaggtgttactgtaat

SEQ ID NO: 3454408 - DNA, 21 bp, Homo sapiens
ccaggtgttactgtaattcct

SEQ ID NO: 3454409 - DNA, 16 bp, Homo sapiens
ccaggttatctgggca

SEQ ID NO: 3454410 - DNA, 16 bp, Homo sapiens
ccaggtttctatgtgt

SEQ ID NO: 3454411 - DNA, 17 bp, Homo sapiens
ccaggtttctggtctct

SEQ ID NO: 3454412 - DNA, 13 bp, Homo sapiens
ccagtaaaattgc

SEQ ID NO: 3454413 - DNA, 15 bp, Homo sapiens
ccagtaaaattgcca

SEQ ID NO: 3454414 - DNA, 17 bp, Homo sapiens
ccagtaaaattgccata

SEQ ID NO: 3454415 - DNA, 23 bp, Homo sapiens
ccagtaaaattgccatattgcac

SEQ ID NO: 3454416 - DNA, 12 bp, Homo sapiens
ccagtaaacaga

SEQ ID NO: 3454417 - DNA, 20 bp, Homo sapiens
ccagtacctcctgtctctgg

SEQ ID NO: 3454418 - DNA, 13 bp, Homo sapiens
ccagtatgacaga

SEQ ID NO: 3454419 - DNA, 16 bp, Homo sapiens
ccagtatgacagagga

SEQ ID NO: 3454420 - DNA, 17 bp, Homo sapiens
ccagtcaaatctgggct

SEQ ID NO: 3454421 - DNA, 14 bp, Homo sapiens
ccagtcaacctggg

SEQ ID NO: 3454422 - DNA, 14 bp, Homo sapiens
ccagtccaaggaaa

SEQ ID NO: 3454423 - DNA, 13 bp, Homo sapiens
ccagtccaggctg

SEQ ID NO: 3454424 - DNA, 14 bp, Homo sapiens
ccagtccaggctgc

SEQ ID NO: 3454425 - DNA, 15 bp, Homo sapiens
ccagtccaggctgcc

SEQ ID NO: 3454426 - DNA, 19 bp, Homo sapiens
ccagtccccagaagcagag

SEQ ID NO: 3454427 - DNA, 12 bp, Homo sapiens
ccagtcctgcca

SEQ ID NO: 3454428 - DNA, 14 bp, Homo sapiens
ccagtcctgccacc

SEQ ID NO: 3454429 - DNA, 21 bp, Homo sapiens
ccagtcctgccaccaccctgt

SEQ ID NO: 3454430 - DNA, 12 bp, Homo sapiens
ccagtcctgcta

SEQ ID NO: 3454431 - DNA, 17 bp, Homo sapiens
ccagtccttccacctcg

SEQ ID NO: 3454432 - DNA, 14 bp, Homo sapiens
ccagtcgaccccaa

SEQ ID NO: 3454433 - DNA, 19 bp, Homo sapiens
ccagtctccaccaggaacc

SEQ ID NO: 3454434 - DNA, 21 bp, Homo sapiens
ccagtctccaccaggaacctc

SEQ ID NO: 3454435 - DNA, 23 bp, Homo sapiens
ccagtctccaccaggaacctctt

SEQ ID NO: 3454436 - DNA, 20 bp, Homo sapiens
ccagtctggaatgcagtggt

SEQ ID NO: 3454437 - DNA, 16 bp, Homo sapiens
ccagtctgtggatcag

SEQ ID NO: 3454438 - DNA, 21 bp, Homo sapiens
ccagtctgtggatcagagatg

SEQ ID NO: 3454439 - DNA, 20 bp, Homo sapiens
ccagtgaatttttgcaataa

SEQ ID NO: 3454440 - DNA, 22 bp, Homo sapiens
ccagtgaatttttgcaataatg

SEQ ID NO: 3454441 - DNA, 14 bp, Homo sapiens
ccagtgagatgcat

SEQ ID NO: 3454442 - DNA, 14 bp, Homo sapiens
ccagtgcccccact

SEQ ID NO: 3454443 - DNA, 18 bp, Homo sapiens
ccagtgcccccactgacc

SEQ ID NO: 3454444 - DNA, 18 bp, Homo sapiens
ccagtggctgctgcccag

SEQ ID NO: 3454445 - DNA, 17 bp, Homo sapiens
ccagtggtctcacatgg

SEQ ID NO: 3454446 - DNA, 21 bp, Homo sapiens
ccagtgtactaggtcaatcag

SEQ ID NO: 3454447 - DNA, 14 bp, Homo sapiens
ccagtgtgacaagg

SEQ ID NO: 3454448 - DNA, 19 bp, Homo sapiens
ccagtgtgctgatgggcgt

SEQ ID NO: 3454449 - DNA, 17 bp, Homo sapiens
ccagttaaaaaaaattt

SEQ ID NO: 3454450 - DNA, 13 bp, Homo sapiens
ccagttcaccctg

SEQ ID NO: 3454451 - DNA, 19 bp, Homo sapiens
ccagttcctatgacacagt

SEQ ID NO: 3454452 - DNA, 20 bp, Homo sapiens
ccagttcgcctggagccctc

SEQ ID NO: 3454453 - DNA, 17 bp, Homo sapiens
ccagttgggtggatgcc

SEQ ID NO: 3454454 - DNA, 19 bp, Homo sapiens
ccagttgggtggatgcctg

SEQ ID NO: 3454455 - DNA, 23 bp, Homo sapiens
ccagttgggtggatgcctggtgg

SEQ ID NO: 3454456 - DNA, 22 bp, Homo sapiens
ccagtttccccatggggctgcg

SEQ ID NO: 3454457 - DNA, 12 bp, Homo sapiens
ccataaaacatt

SEQ ID NO: 3454458 - DNA, 20 bp, Homo sapiens
ccataaaacattaagaaaat

SEQ ID NO: 3454459 - DNA, 19 bp, Homo sapiens
ccataaagacaatcactgc

SEQ ID NO: 3454460 - DNA, 22 bp, Homo sapiens
ccataaccgctgattctcaggg

SEQ ID NO: 3454461 - DNA, 18 bp, Homo sapiens
ccataatatgatgcaaac

SEQ ID NO: 3454462 - DNA, 23 bp, Homo sapiens
ccataatgctaatttaaagagac

SEQ ID NO: 3454463 - DNA, 20 bp, Homo sapiens
ccatactctgtccccccagc

SEQ ID NO: 3454464 - DNA, 18 bp, Homo sapiens
ccatagcaagattgctta

SEQ ID NO: 3454465 - DNA, 14 bp, Homo sapiens
ccatagctgctgcc

SEQ ID NO: 3454466 - DNA, 22 bp, Homo sapiens
cattggctttatcctctttaga

SEQ ID NO: 3454467 - DNA, 16 bp, Homo sapiens
cattgtatcgatgtta

SEQ ID NO: 3454468 - DNA, 17 bp, Homo sapiens
cattgtatcgatgttat

SEQ ID NO: 3454469 - DNA, 22 bp, Homo sapiens
cattgtatcgatgttatgtaaa

SEQ ID NO: 3454470 - DNA, 19 bp, Homo sapiens
cattgtccaatcctatgtt

SEQ ID NO: 3454471 - DNA, 15 bp, Homo sapiens
cattgtccctctgcc

SEQ ID NO: 3454472 - DNA, 13 bp, Homo sapiens
cattgtcctgtga

SEQ ID NO: 3454473 - DNA, 22 bp, Homo sapiens
cattgtctcttcatgtctattc

SEQ ID NO: 3454474 - DNA, 22 bp, Homo sapiens
cattgtgatgtatattcctttg

SEQ ID NO: 3454475 - DNA, 15 bp, Homo sapiens
cattgttcaaaagga

SEQ ID NO: 3454476 - DNA, 17 bp, Homo sapiens
cattgttcaaaaggaac

SEQ ID NO: 3454477 - DNA, 16 bp, Homo sapiens
cattgttcaattagaa

SEQ ID NO: 3454478 - DNA, 18 bp, Homo sapiens
cattgttcaattagaata

SEQ ID NO: 3454479 - DNA, 18 bp, Homo sapiens
cattgttcacctttgtag

SEQ ID NO: 3454480 - DNA, 13 bp, Homo sapiens
cattgttgagcta

SEQ ID NO: 3454481 - DNA, 20 bp, Homo sapiens
cattgttgagctattgctgt

SEQ ID NO: 3454482 - DNA, 17 bp, Homo sapiens
cattgtttaaaaataca

SEQ ID NO: 3454483 - DNA, 19 bp, Homo sapiens
cattgtttaaaaatacaca

SEQ ID NO: 3454484 - DNA, 20 bp, Homo sapiens
cattgtttaaaaatacacat

SEQ ID NO: 3454485 - DNA, 12 bp, Homo sapiens
cattgtttctgt

SEQ ID NO: 3454486 - DNA, 15 bp, Homo sapiens
catttaaaaaaaatc

SEQ ID NO: 3454487 - DNA, 18 bp, Homo sapiens
catttaaatacagtcttc

SEQ ID NO: 3454488 - DNA, 20 bp, Homo sapiens
catttaaatacagtcttcca

SEQ ID NO: 3454489 - DNA, 12 bp, Homo sapiens
catttaataata

SEQ ID NO: 3454490 - DNA, 14 bp, Homo sapiens
catttaataatata

SEQ ID NO: 3454491 - DNA, 21 bp, Homo sapiens
catttactttgtgttcacctt

SEQ ID NO: 3454492 - DNA, 20 bp, Homo sapiens
catttagagaggaaaagtaa

SEQ ID NO: 3454493 - DNA, 22 bp, Homo sapiens
catttagctaaacggattccaa

SEQ ID NO: 3454494 - DNA, 22 bp, Homo sapiens
catttagctgtattcatatatt

SEQ ID NO: 3454495 - DNA, 23 bp, Homo sapiens
catttagctgtattcatatattg

SEQ ID NO: 3454496 - DNA, 23 bp, Homo sapiens
catttagtttgattattcagtgt

SEQ ID NO: 3454497 - DNA, 17 bp, Homo sapiens
catttatacaaattaga

SEQ ID NO: 3454498 - DNA, 18 bp, Homo sapiens
catttatacaaattagaa

SEQ ID NO: 3454499 - DNA, 19 bp, Homo sapiens
catttatagatcatttcta

SEQ ID NO: 3454500 - DNA, 16 bp, Homo sapiens
catttattctgctcac

SEQ ID NO: 3454501 - DNA, 16 bp, Homo sapiens
catttcaattcctggc

SEQ ID NO: 3454502 - DNA, 19 bp, Homo sapiens
catttcaattcctggccct

SEQ ID NO: 3454503 - DNA, 20 bp, Homo sapiens
catttcacaaaacagccttt

SEQ ID NO: 3454504 - DNA, 13 bp, Homo sapiens
catttcacccctc

SEQ ID NO: 3454505 - DNA, 22 bp, Homo sapiens
catttcacccctccctttctcc

SEQ ID NO: 3454506 - DNA, 16 bp, Homo sapiens
catttcaggagcagcc

SEQ ID NO: 3454507 - DNA, 22 bp, Homo sapiens
catttcaggagcagcctcagaa

SEQ ID NO: 3454508 - DNA, 16 bp, Homo sapiens
catttcatgtatagtt

SEQ ID NO: 3454509 - DNA, 11 bp, Homo sapiens
catttcctgct

SEQ ID NO: 3454510 - DNA, 21 bp, Homo sapiens
catttcgtgagccccatcttc

SEQ ID NO: 3454511 - DNA, 13 bp, Homo sapiens
catttctaattaa

SEQ ID NO: 3454512 - DNA, 14 bp, Homo sapiens
catttctaggcaaa

SEQ ID NO: 3454513 - DNA, 21 bp, Homo sapiens
catttctaggcaaaattgtga

SEQ ID NO: 3454514 - DNA, 18 bp, Homo sapiens
catttctatttatttact

SEQ ID NO: 3454515 - DNA, 23 bp, Homo sapiens
catttctatttatttactgagct

SEQ ID NO: 3454516 - DNA, 22 bp, Homo sapiens
catttctatttcataatgaaaa

SEQ ID NO: 3454517 - DNA, 23 bp, Homo sapiens
catttctatttcataatgaaaaa

SEQ ID NO: 3454518 - DNA, 13 bp, Homo sapiens
catttctgtattt

SEQ ID NO: 3454519 - DNA, 18 bp, Homo sapiens
catttctgtattttttgt

SEQ ID NO: 3454520 - DNA, 14 bp, Homo sapiens
catttgaatgcatt

SEQ ID NO: 3454521 - DNA, 18 bp, Homo sapiens
catttgaatgcattttgt

SEQ ID NO: 3454522 - DNA, 18 bp, Homo sapiens
catttgagcagggctcag

SEQ ID NO: 3454523 - DNA, 17 bp, Homo sapiens
catttgatgcatgtctt

SEQ ID NO: 3454524 - DNA, 14 bp, Homo sapiens
catttgcagggtcc

SEQ ID NO: 3454525 - DNA, 20 bp, Homo sapiens
catttgcagggtcctcttct

SEQ ID NO: 3454526 - DNA, 15 bp, Homo sapiens
catttggaatacttt

SEQ ID NO: 3454527 - DNA, 23 bp, Homo sapiens
catttggaatttttgcttgactt

SEQ ID NO: 3454528 - DNA, 22 bp, Homo sapiens
catttggggtagctagaggaac

SEQ ID NO: 3454529 - DNA, 16 bp, Homo sapiens
catttggttcattaat

SEQ ID NO: 3454530 - DNA, 20 bp, Homo sapiens
catttggttcattaattcta

SEQ ID NO: 3454531 - DNA, 12 bp, Homo sapiens
catttgtaattt

SEQ ID NO: 3454532 - DNA, 18 bp, Homo sapiens
catttgtggcagtccctt

SEQ ID NO: 3454533 - DNA, 20 bp, Homo sapiens
catttgtttacatttgatgc

SEQ ID NO: 3454534 - DNA, 22 bp, Homo sapiens
cattttaatttattaattgctt

SEQ ID NO: 3454535 - DNA, 23 bp, Homo sapiens
cattttaatttattaattgcttt

SEQ ID NO: 3454536 - DNA, 20 bp, Homo sapiens
cattttacccacacacagat

SEQ ID NO: 3454537 - DNA, 22 bp, Homo sapiens
cattttactgttgtacaatcat

SEQ ID NO: 3454538 - DNA, 19 bp, Homo sapiens
cattttattttttcttgca

SEQ ID NO: 3454539 - DNA, 16 bp, Homo sapiens
cattttcaccccaccc

SEQ ID NO: 3454540 - DNA, 17 bp, Homo sapiens
cattttcaccccaccct

SEQ ID NO: 3454541 - DNA, 15 bp, Homo sapiens
cattttgagaacaaa

SEQ ID NO: 3454542 - DNA, 23 bp, Homo sapiens
catttttaaagtagaagagggtt

SEQ ID NO: 3454543 - DNA, 14 bp, Homo sapiens
catttttaaatgtg

SEQ ID NO: 3454544 - DNA, 12 bp, Homo sapiens
catttttatcta

SEQ ID NO: 3454545 - DNA, 14 bp, Homo sapiens
catttttcaaagca

SEQ ID NO: 3454546 - DNA, 17 bp, Homo sapiens
catttttcaaagcaatt

SEQ ID NO: 3454547 - DNA, 14 bp, Homo sapiens
catttttgagccaa

SEQ ID NO: 3454548 - DNA, 12 bp, Homo sapiens
cattttttatga

SEQ ID NO: 3454549 - DNA, 15 bp, Homo sapiens
catttttttattcag

SEQ ID NO: 3454550 - DNA, 18 bp, Homo sapiens
catttttttattcagcag

SEQ ID NO: 3454551 - DNA, 17 bp, Homo sapiens
catttttttccaggctg

SEQ ID NO: 3454552 - DNA, 13 bp, Homo sapiens
ccaaaaagcacat

SEQ ID NO: 3454553 - DNA, 14 bp, Homo sapiens
ccaaaaagcacata

SEQ ID NO: 3454554 - DNA, 16 bp, Homo sapiens
ccaaaaatctgcctgg

SEQ ID NO: 3454555 - DNA, 22 bp, Homo sapiens
ccaaaacctcatgacagccaga

SEQ ID NO: 3454556 - DNA, 14 bp, Homo sapiens
ccaaaagctgctca

SEQ ID NO: 3454557 - DNA, 18 bp, Homo sapiens
ccaaaagtggcctctttg

SEQ ID NO: 3454558 - DNA, 21 bp, Homo sapiens
ccaaaagtggcctctttgtct

SEQ ID NO: 3454559 - DNA, 13 bp, Homo sapiens
ccaaaataaaagg

SEQ ID NO: 3454560 - DNA, 16 bp, Homo sapiens
ccaaaatactccaaag

SEQ ID NO: 3454561 - DNA, 17 bp, Homo sapiens
ccaaaatactccaaaga

SEQ ID NO: 3454562 - DNA, 18 bp, Homo sapiens
ccaaaatactccaaagat

SEQ ID NO: 3454563 - DNA, 21 bp, Homo sapiens
ccaaaatactccaaagatgac

SEQ ID NO: 3454564 - DNA, 16 bp, Homo sapiens
ccaaaatttattttat

SEQ ID NO: 3454565 - DNA, 15 bp, Homo sapiens
ccaaacagacaggtg

SEQ ID NO: 3454566 - DNA, 14 bp, Homo sapiens
ccaaaccacttttt

SEQ ID NO: 3454567 - DNA, 17 bp, Homo sapiens
ccaaacccagtctcctc

SEQ ID NO: 3454568 - DNA, 14 bp, Homo sapiens
ccaaacctctgttc

SEQ ID NO: 3454569 - DNA, 20 bp, Homo sapiens
ccaaacctctgttcagtgta

SEQ ID NO: 3454570 - DNA, 21 bp, Homo sapiens
ccaaacctctgttcagtgtaa

SEQ ID NO: 3454571 - DNA, 18 bp, Homo sapiens
ccaaactgtctctgcctc

SEQ ID NO: 3454572 - DNA, 18 bp, Homo sapiens
ccaaacttggatttttga

SEQ ID NO: 3454573 - DNA, 21 bp, Homo sapiens
ccaaagaataagtgtctttct

SEQ ID NO: 3454574 - DNA, 9 bp, Homo sapiens
ccaaagagt

SEQ ID NO: 3454575 - DNA, 15 bp, Homo sapiens
ccaaagagtgatagt

SEQ ID NO: 3454576 - DNA, 16 bp, Homo sapiens
ccaaagcagggtctgg

SEQ ID NO: 3454577 - DNA, 19 bp, Homo sapiens
ccaaagccaaagctaggcc

SEQ ID NO: 3454578 - DNA, 20 bp, Homo sapiens
ccaaagccaataacacacag

SEQ ID NO: 3454579 - DNA, 21 bp, Homo sapiens
ccaaagccaataacacacagc

SEQ ID NO: 3454580 - DNA, 22 bp, Homo sapiens
ccaaagcctcctccagccgcca

SEQ ID NO: 3454581 - DNA, 17 bp, Homo sapiens
ccaaaggaacactgaca

SEQ ID NO: 3454582 - DNA, 21 bp, Homo sapiens
ccaaaggccatggagagctgg

SEQ ID NO: 3454583 - DNA, 12 bp, Homo sapiens
ccaaaggctggt

SEQ ID NO: 3454584 - DNA, 15 bp, Homo sapiens
ccaaaggctggtggc

SEQ ID NO: 3454585 - DNA, 20 bp, Homo sapiens
ccaaaggtgaaggaatatat

SEQ ID NO: 3454586 - DNA, 14 bp, Homo sapiens
ccaaagtaaaagaa

SEQ ID NO: 3454587 - DNA, 14 bp, Homo sapiens
ccaaagtgctggga

SEQ ID NO: 3454588 - DNA, 16 bp, Homo sapiens
ccaaagttcaacttgg

SEQ ID NO: 3454589 - DNA, 17 bp, Homo sapiens
ccaaataatgtctctgt

SEQ ID NO: 3454590 - DNA, 17 bp, Homo sapiens
ccaaatccgaacctcct

SEQ ID NO: 3454591 - DNA, 22 bp, Homo sapiens
ccaaatccgaacctcctctgtg

SEQ ID NO: 3454592 - DNA, 24 bp, Homo sapiens
ccaaatccgaacctcctctgtgaa

SEQ ID NO: 3454593 - DNA, 21 bp, Homo sapiens
ccaaatccttagatctggcat

SEQ ID NO: 3454594 - DNA, 13 bp, Homo sapiens
ccaaatccttccc

SEQ ID NO: 3454595 - DNA, 15 bp, Homo sapiens
ccaaatttgattgat

SEQ ID NO: 3454596 - DNA, 12 bp, Homo sapiens
ccaacaaaccat

SEQ ID NO: 3454597 - DNA, 13 bp, Homo sapiens
ccaacaaaccatc

SEQ ID NO: 3454598 - DNA, 16 bp, Homo sapiens
ccaacaaaccatccag

SEQ ID NO: 3454599 - DNA, 19 bp, Homo sapiens
ccaacaaagaacactaact

SEQ ID NO: 3454600 - DNA, 13 bp, Homo sapiens
ccaacaccaagca

SEQ ID NO: 3454601 - DNA, 22 bp, Homo sapiens
ccaacaccaagcacagcagcct

SEQ ID NO: 3454602 - DNA, 16 bp, Homo sapiens
ccaacacgcacctgcc

SEQ ID NO: 3454603 - DNA, 21 bp, Homo sapiens
ccaacacgcacctgcctcagg

SEQ ID NO: 3454604 - DNA, 13 bp, Homo sapiens
ccaacactgagca

SEQ ID NO: 3454605 - DNA, 20 bp, Homo sapiens
ccaacactgtgggtgtgtga

SEQ ID NO: 3454606 - DNA, 13 bp, Homo sapiens
ccaacatataaaa

SEQ ID NO: 3454607 - DNA, 12 bp, Homo sapiens
ccaaccccaggg

SEQ ID NO: 3454608 - DNA, 23 bp, Homo sapiens
ccaaccccagggcccccacaggc

SEQ ID NO: 3454609 - DNA, 14 bp, Homo sapiens
ccaaccccccagca

SEQ ID NO: 3454610 - DNA, 17 bp, Homo sapiens
ccaaccccccagcactg

SEQ ID NO: 3454611 - DNA, 18 bp, Homo sapiens
ccaaccccccagcactga

SEQ ID NO: 3454612 - DNA, 19 bp, Homo sapiens
ccaaccccccagcactgag

SEQ ID NO: 3454613 - DNA, 16 bp, Homo sapiens
ccaaccctggggaagg

SEQ ID NO: 3454614 - DNA, 20 bp, Homo sapiens
ccaaccctggggaaggagcc

SEQ ID NO: 3454615 - DNA, 14 bp, Homo sapiens
ccaacctattttga

SEQ ID NO: 3454616 - DNA, 19 bp, Homo sapiens
ccaacctgcaaagatctgt

SEQ ID NO: 3454617 - DNA, 12 bp, Homo sapiens
ccaaccttccca

SEQ ID NO: 3454618 - DNA, 21 bp, Homo sapiens
ccaacggagagcgcctgcccc

SEQ ID NO: 3454619 - DNA, 20 bp, Homo sapiens
ccaacggccctgcagccagc

SEQ ID NO: 3454620 - DNA, 21 bp, Homo sapiens
ccaacggccctgcagccagct

SEQ ID NO: 3454621 - DNA, 13 bp, Homo sapiens
ccaacgtttggaa

SEQ ID NO: 3454622 - DNA, 20 bp, Homo sapiens
ccaacgtttggaagatcctg

SEQ ID NO: 3454623 - DNA, 21 bp, Homo sapiens
ccaacgtttggaagatcctgt

SEQ ID NO: 3454624 - DNA, 16 bp, Homo sapiens
ccaactatttattgac

SEQ ID NO: 3454625 - DNA, 14 bp, Homo sapiens
ccaactctagctgg

SEQ ID NO: 3454626 - DNA, 19 bp, Homo sapiens
ccaacttcttcagagctga

SEQ ID NO: 3454627 - DNA, 20 bp, Homo sapiens
ccaagaatagcatctgtaca

SEQ ID NO: 3454628 - DNA, 12 bp, Homo sapiens
ccaagagaccag

SEQ ID NO: 3454629 - DNA, 16 bp, Homo sapiens
ccaagagtctgatgat

SEQ ID NO: 3454630 - DNA, 14 bp, Homo sapiens
ccaagatgcctgat

SEQ ID NO: 3454631 - DNA, 12 bp, Homo sapiens
ccaagcacagca

SEQ ID NO: 3454632 - DNA, 15 bp, Homo sapiens
ccaagcacagcagcc

SEQ ID NO: 3454633 - DNA, 22 bp, Homo sapiens
ccaagcactgtgctcagggcta

SEQ ID NO: 3454634 - DNA, 12 bp, Homo sapiens
ccaagcagccaa

SEQ ID NO: 3454635 - DNA, 16 bp, Homo sapiens
ccaagcagccaagctc

SEQ ID NO: 3454636 - DNA, 18 bp, Homo sapiens
ccaagcaggaaatgaaaa

SEQ ID NO: 3454637 - DNA, 12 bp, Homo sapiens
ccaagcaggaag

SEQ ID NO: 3454638 - DNA, 22 bp, Homo sapiens
ccaagcatcttgggggggtggc

SEQ ID NO: 3454639 - DNA, 20 bp, Homo sapiens
ccaagccaagggaacctgtg

SEQ ID NO: 3454640 - DNA, 23 bp, Homo sapiens
ccaagccaagggaacctgtgtcc

SEQ ID NO: 3454641 - DNA, 19 bp, Homo sapiens
ccaagccagaggctgggtt

SEQ ID NO: 3454642 - DNA, 12 bp, Homo sapiens
ccaagccagctg

SEQ ID NO: 3454643 - DNA, 16 bp, Homo sapiens
ccaagccagctgccta

SEQ ID NO: 3454644 - DNA, 19 bp, Homo sapiens
ccaagctcaggaccaggca

SEQ ID NO: 3454645 - DNA, 22 bp, Homo sapiens
ccaagctccttgggaggcccca

SEQ ID NO: 3454646 - DNA, 12 bp, Homo sapiens
ccaagctctgct

SEQ ID NO: 3454647 - DNA, 14 bp, Homo sapiens
ccaagctctgctcc

SEQ ID NO: 3454648 - DNA, 23 bp, Homo sapiens
ccaagctgcctcccctctccttc

SEQ ID NO: 3454649 - DNA, 17 bp, Homo sapiens
ccaagctggctggggtg

SEQ ID NO: 3454650 - DNA, 12 bp, Homo sapiens
ccaagctggtcc

SEQ ID NO: 3454651 - DNA, 22 bp, Homo sapiens
ccaagcttccatagctgctgcc

SEQ ID NO: 3454652 - DNA, 13 bp, Homo sapiens
ccaagcttccctc

SEQ ID NO: 3454653 - DNA, 19 bp, Homo sapiens
ccaagctttcaaacatgtt

SEQ ID NO: 3454654 - DNA, 18 bp, Homo sapiens
ccaaggaaaccacagctg

SEQ ID NO: 3454655 - DNA, 22 bp, Homo sapiens
ccaaggaaaccacagctgctgg

SEQ ID NO: 3454656 - DNA, 23 bp, Homo sapiens
ccaaggaaaccacagctgctgga

SEQ ID NO: 3454657 - DNA, 12 bp, Homo sapiens
ccaaggagctgc

SEQ ID NO: 3454658 - DNA, 13 bp, Homo sapiens
ccaaggagctgct

SEQ ID NO: 3454659 - DNA, 12 bp, Homo sapiens
ccaaggaggatt

SEQ ID NO: 3454660 - DNA, 14 bp, Homo sapiens
ccaaggctggggga

SEQ ID NO: 3454661 - DNA, 24 bp, Homo sapiens
ccaagggagttaggctattcacaa

SEQ ID NO: 3454662 - DNA, 13 bp, Homo sapiens
ccaagggatctgg

SEQ ID NO: 3454663 - DNA, 19 bp, Homo sapiens
ccaaggggaatcagaactc

SEQ ID NO: 3454664 - DNA, 18 bp, Homo sapiens
ccaaggtgggaggattgc

SEQ ID NO: 3454665 - DNA, 19 bp, Homo sapiens
ccaaggttttataaggctg

SEQ ID NO: 3454666 - DNA, 23 bp, Homo sapiens
ccaagtaaaaatttcttctgggc

SEQ ID NO: 3454667 - DNA, 16 bp, Homo sapiens
ccaagtaagaggctgg

SEQ ID NO: 3454668 - DNA, 15 bp, Homo sapiens
ccaagtagcctctcc

SEQ ID NO: 3454669 - DNA, 14 bp, Homo sapiens
ccaataacacacag

SEQ ID NO: 3454670 - DNA, 16 bp, Homo sapiens
ccaataacacacagct

SEQ ID NO: 3454671 - DNA, 20 bp, Homo sapiens
ccaatattttctttaatgct

SEQ ID NO: 3454672 - DNA, 22 bp, Homo sapiens
ccaatcaataaaaaacaaatat

SEQ ID NO: 3454673 - DNA, 14 bp, Homo sapiens
ccaatcctatgttt

SEQ ID NO: 3454674 - DNA, 20 bp, Homo sapiens
ccaatcttctttttcaggct

SEQ ID NO: 3454675 - DNA, 22 bp, Homo sapiens
ccaatcttctttttcaggctcg

SEQ ID NO: 3454676 - DNA, 16 bp, Homo sapiens
ccaatgagacttgcct

SEQ ID NO: 3454677 - DNA, 17 bp, Homo sapiens
ccaatgagacttgcctt

SEQ ID NO: 3454678 - DNA, 15 bp, Homo sapiens
ccaatgcaagacgcc

SEQ ID NO: 3454679 - DNA, 17 bp, Homo sapiens
ccaatgctgatgtcctc

SEQ ID NO: 3454680 - DNA, 20 bp, Homo sapiens
ccaatggaatgtgatgttca

SEQ ID NO: 3454681 - DNA, 17 bp, Homo sapiens
ccaatgtaggagctgcc

SEQ ID NO: 3454682 - DNA, 20 bp, Homo sapiens
ccaatgtaggagctgccttg

SEQ ID NO: 3454683 - DNA, 21 bp, Homo sapiens
ccaatgtattgataagagggc

SEQ ID NO: 3454684 - DNA, 12 bp, Homo sapiens
ccaatgtcttga

SEQ ID NO: 3454685 - DNA, 15 bp, Homo sapiens
ccaattatgttaaac

SEQ ID NO: 3454686 - DNA, 14 bp, Homo sapiens
ccaattcagacagg

SEQ ID NO: 3454687 - DNA, 16 bp, Homo sapiens
ccaattcagacaggca

SEQ ID NO: 3454688 - DNA, 18 bp, Homo sapiens
ccaatttgcaccagtttt

SEQ ID NO: 3454689 - DNA, 21 bp, Homo sapiens
ccaattttaatttagtaaatg

SEQ ID NO: 3454690 - DNA, 23 bp, Homo sapiens
ccacaaaataaccaatcctggac

SEQ ID NO: 3454691 - DNA, 17 bp, Homo sapiens
ccacaactattttcaga

SEQ ID NO: 3454692 - DNA, 20 bp, Homo sapiens
ccacaagtgccgcaaattgt

SEQ ID NO: 3454693 - DNA, 21 bp, Homo sapiens
ccacaagtgccgcaaattgta

SEQ ID NO: 3454694 - DNA, 15 bp, Homo sapiens
ccacaagtggtggta

SEQ ID NO: 3454695 - DNA, 22 bp, Homo sapiens
ccacaagtggtggtaaccctgg

SEQ ID NO: 3454696 - DNA, 16 bp, Homo sapiens
ccacaatgcagttctg

SEQ ID NO: 3454697 - DNA, 14 bp, Homo sapiens
ccacacaggctggc

SEQ ID NO: 3454698 - DNA, 22 bp, Homo sapiens
ccacacccaattccactctgat

SEQ ID NO: 3454699 - DNA, 13 bp, Homo sapiens
ccacacccagccc

SEQ ID NO: 3454700 - DNA, 15 bp, Homo sapiens
ccacacccagcccac

SEQ ID NO: 3454701 - DNA, 20 bp, Homo sapiens
ccacacccagcccacttctg

SEQ ID NO: 3454702 - DNA, 21 bp, Homo sapiens
ccacacccagcccacttctgc

SEQ ID NO: 3454703 - DNA, 22 bp, Homo sapiens
ccacacccagcccacttctgcc

SEQ ID NO: 3454704 - DNA, 13 bp, Homo sapiens
ccacaccctcccc

SEQ ID NO: 3454705 - DNA, 23 bp, Homo sapiens
ccacactcccaaggttggagccc

SEQ ID NO: 3454706 - DNA, 14 bp, Homo sapiens
ccacagagcgggga

SEQ ID NO: 3454707 - DNA, 20 bp, Homo sapiens
ccacagcaaccccaggctga

SEQ ID NO: 3454708 - DNA, 14 bp, Homo sapiens
ccacagcacagcca

SEQ ID NO: 3454709 - DNA, 22 bp, Homo sapiens
ccacagccagcacctggcatcg

SEQ ID NO: 3454710 - DNA, 17 bp, Homo sapiens
ccacagcttcccctctc

SEQ ID NO: 3454711 - DNA, 17 bp, Homo sapiens
ccacaggacacagtcag

SEQ ID NO: 3454712 - DNA, 16 bp, Homo sapiens
ccacaggacatttctc

SEQ ID NO: 3454713 - DNA, 16 bp, Homo sapiens
ccacaggccgccctgc

SEQ ID NO: 3454714 - DNA, 22 bp, Homo sapiens
ccacaggcctgagatttcatct

SEQ ID NO: 3454715 - DNA, 11 bp, Homo sapiens
ccacagggcac

SEQ ID NO: 3454716 - DNA, 19 bp, Homo sapiens
ccacagggcacctgccacc

SEQ ID NO: 3454717 - DNA, 19 bp, Homo sapiens
ccacagggcttgttttcca

SEQ ID NO: 3454718 - DNA, 16 bp, Homo sapiens
ccacagggtctgcctc

SEQ ID NO: 3454719 - DNA, 17 bp, Homo sapiens
ccacaggtgtgagccac

SEQ ID NO: 3454720 - DNA, 15 bp, Homo sapiens
ccacagtagtcttga

SEQ ID NO: 3454721 - DNA, 17 bp, Homo sapiens
ccacagtagtcttgatg

SEQ ID NO: 3454722 - DNA, 14 bp, Homo sapiens
ccacatcaaagagg

SEQ ID NO: 3454723 - DNA, 20 bp, Homo sapiens
ccacatcccgggacgcagca

SEQ ID NO: 3454724 - DNA, 15 bp, Homo sapiens
ccacatctaagcctg

SEQ ID NO: 3454725 - DNA, 18 bp, Homo sapiens
ccacatcttgctctgctg

SEQ ID NO: 3454726 - DNA, 19 bp, Homo sapiens
ccacatcttgctctgctga

SEQ ID NO: 3454727 - DNA, 14 bp, Homo sapiens
ccacatgaaaccta

SEQ ID NO: 3454728 - DNA, 16 bp, Homo sapiens
ccacatgggaggctca

SEQ ID NO: 3454729 - DNA, 21 bp, Homo sapiens
ccaccaagagggacgcctggg

SEQ ID NO: 3454730 - DNA, 17 bp, Homo sapiens
ccaccacacccagccca

SEQ ID NO: 3454731 - DNA, 15 bp, Homo sapiens
ccaccacacctggct

SEQ ID NO: 3454732 - DNA, 18 bp, Homo sapiens
ccaccaccctgtcttcct

SEQ ID NO: 3454733 - DNA, 19 bp, Homo sapiens
ccaccaccctgtcttcctc

SEQ ID NO: 3454734 - DNA, 22 bp, Homo sapiens
ccaccaccctgtcttcctctgc

SEQ ID NO: 3454735 - DNA, 14 bp, Homo sapiens
ccaccactataaaa

SEQ ID NO: 3454736 - DNA, 12 bp, Homo sapiens
ccaccagcctaa

SEQ ID NO: 3454737 - DNA, 19 bp, Homo sapiens
ccaccagcctaagaagctc

SEQ ID NO: 3454738 - DNA, 14 bp, Homo sapiens
ccaccaggaacctc

SEQ ID NO: 3454739 - DNA, 14 bp, Homo sapiens
catggagctggccg

SEQ ID NO: 3454740 - DNA, 22 bp, Homo sapiens
catggatttctctgctcacaga

SEQ ID NO: 3454741 - DNA, 22 bp, Homo sapiens
catggccctcccagtacctcct

SEQ ID NO: 3454742 - DNA, 21 bp, Homo sapiens
catggctctatttcttcttca

SEQ ID NO: 3454743 - DNA, 16 bp, Homo sapiens
catggctgcacagttg

SEQ ID NO: 3454744 - DNA, 17 bp, Homo sapiens
catggcttttctctttg

SEQ ID NO: 3454745 - DNA, 14 bp, Homo sapiens
catgggaaggggag

SEQ ID NO: 3454746 - DNA, 17 bp, Homo sapiens
catgggaaggggaggac

SEQ ID NO: 3454747 - DNA, 13 bp, Homo sapiens
catgggagccggg

SEQ ID NO: 3454748 - DNA, 14 bp, Homo sapiens
catgggaggctcac

SEQ ID NO: 3454749 - DNA, 18 bp, Homo sapiens
catgggcctcctgtgtgt

SEQ ID NO: 3454750 - DNA, 19 bp, Homo sapiens
catgggggaccccttccca

SEQ ID NO: 3454751 - DNA, 20 bp, Homo sapiens
catgggggaccccttcccac

SEQ ID NO: 3454752 - DNA, 17 bp, Homo sapiens
catggtcacacactgat

SEQ ID NO: 3454753 - DNA, 15 bp, Homo sapiens
catggtgagcctagc

SEQ ID NO: 3454754 - DNA, 19 bp, Homo sapiens
catggtgagcctagccctg

SEQ ID NO: 3454755 - DNA, 16 bp, Homo sapiens
catggtgccccaggac

SEQ ID NO: 3454756 - DNA, 22 bp, Homo sapiens
catggtggacccagcgggcagg

SEQ ID NO: 3454757 - DNA, 22 bp, Homo sapiens
catggtgggtccatgggcagag

SEQ ID NO: 3454758 - DNA, 22 bp, Homo sapiens
catgtaaacacgcctgcaaacg

SEQ ID NO: 3454759 - DNA, 15 bp, Homo sapiens
catgtaaactgtgca

SEQ ID NO: 3454760 - DNA, 17 bp, Homo sapiens
catgtaaataatctgtg

SEQ ID NO: 3454761 - DNA, 22 bp, Homo sapiens
catgtaaataatctgtgagtga

SEQ ID NO: 3454762 - DNA, 21 bp, Homo sapiens
catgtaactatttcttcagag

SEQ ID NO: 3454763 - DNA, 18 bp, Homo sapiens
catgtaatcccagctact

SEQ ID NO: 3454764 - DNA, 14 bp, Homo sapiens
catgtacagacaga

SEQ ID NO: 3454765 - DNA, 13 bp, Homo sapiens
catgtagaagctg

SEQ ID NO: 3454766 - DNA, 18 bp, Homo sapiens
catgtagccccctggcct

SEQ ID NO: 3454767 - DNA, 18 bp, Homo sapiens
catgtaggaagtaggaag

SEQ ID NO: 3454768 - DNA, 19 bp, Homo sapiens
catgtataatttttttctt

SEQ ID NO: 3454769 - DNA, 15 bp, Homo sapiens
catgtatcataatta

SEQ ID NO: 3454770 - DNA, 20 bp, Homo sapiens
catgtcagcaaaaagcaaaa

SEQ ID NO: 3454771 - DNA, 17 bp, Homo sapiens
catgtccacgtgtgtgt

SEQ ID NO: 3454772 - DNA, 19 bp, Homo sapiens
catgtcctaattcttctgt

SEQ ID NO: 3454773 - DNA, 21 bp, Homo sapiens
catgtcctttgcgcctgtgac

SEQ ID NO: 3454774 - DNA, 15 bp, Homo sapiens
catgtcttaatgaag

SEQ ID NO: 3454775 - DNA, 17 bp, Homo sapiens
catgtcttaatgaagtt

SEQ ID NO: 3454776 - DNA, 20 bp, Homo sapiens
catgtcttaatgaagtttga

SEQ ID NO: 3454777 - DNA, 13 bp, Homo sapiens
catgtgactctga

SEQ ID NO: 3454778 - DNA, 17 bp, Homo sapiens
catgtgactctgaagct

SEQ ID NO: 3454779 - DNA, 20 bp, Homo sapiens
catgtgactctggcttggcc

SEQ ID NO: 3454780 - DNA, 14 bp, Homo sapiens
catgtgcacatgca

SEQ ID NO: 3454781 - DNA, 24 bp, Homo sapiens
catgtgccagggcaatgatgaatg

SEQ ID NO: 3454782 - DNA, 18 bp, Homo sapiens
catgtgcctctgtcctta

SEQ ID NO: 3454783 - DNA, 21 bp, Homo sapiens
catgtggccatggcctctgca

SEQ ID NO: 3454784 - DNA, 13 bp, Homo sapiens
catgtggctggaa

SEQ ID NO: 3454785 - DNA, 23 bp, Homo sapiens
catgtggtgatgatgtgtatata

SEQ ID NO: 3454786 - DNA, 12 bp, Homo sapiens
catgtgtgtcca

SEQ ID NO: 3454787 - DNA, 22 bp, Homo sapiens
catgtgtgtccacgactgtctc

SEQ ID NO: 3454788 - DNA, 23 bp, Homo sapiens
catgtgtgtccacgactgtctcc

SEQ ID NO: 3454789 - DNA, 23 bp, Homo sapiens
catgtgtgtgtgtgtgtgtgtct

SEQ ID NO: 3454790 - DNA, 16 bp, Homo sapiens
catgtgttaagtattt

SEQ ID NO: 3454791 - DNA, 18 bp, Homo sapiens
catgtgttttataaaatc

SEQ ID NO: 3454792 - DNA, 16 bp, Homo sapiens
catgttagcccttcct

SEQ ID NO: 3454793 - DNA, 19 bp, Homo sapiens
catgttctggtggtttgat

SEQ ID NO: 3454794 - DNA, 22 bp, Homo sapiens
catgttctggtggtttgattgt

SEQ ID NO: 3454795 - DNA, 17 bp, Homo sapiens
catgttgcccctttctc

SEQ ID NO: 3454796 - DNA, 18 bp, Homo sapiens
catgttgctgtttccagt

SEQ ID NO: 3454797 - DNA, 12 bp, Homo sapiens
catgttggccag

SEQ ID NO: 3454798 - DNA, 14 bp, Homo sapiens
catgttggccaggc

SEQ ID NO: 3454799 - DNA, 19 bp, Homo sapiens
catgttggccaggctggtc

SEQ ID NO: 3454800 - DNA, 19 bp, Homo sapiens
catgttggtttattttcac

SEQ ID NO: 3454801 - DNA, 12 bp, Homo sapiens
catgtttataaa

SEQ ID NO: 3454802 - DNA, 21 bp, Homo sapiens
catgtttcctctagttctttg

SEQ ID NO: 3454803 - DNA, 12 bp, Homo sapiens
catgttttaaca

SEQ ID NO: 3454804 - DNA, 14 bp, Homo sapiens
catgttttaacaaa

SEQ ID NO: 3454805 - DNA, 16 bp, Homo sapiens
catgttttaacaaaaa

SEQ ID NO: 3454806 - DNA, 17 bp, Homo sapiens
catgttttcaactgcca

SEQ ID NO: 3454807 - DNA, 14 bp, Homo sapiens
catgttttccgtga

SEQ ID NO: 3454808 - DNA, 11 bp, Homo sapiens
catgttttggt

SEQ ID NO: 3454809 - DNA, 12 bp, Homo sapiens
cattaaagccat

SEQ ID NO: 3454810 - DNA, 13 bp, Homo sapiens
cattaaattcaca

SEQ ID NO: 3454811 - DNA, 11 bp, Homo sapiens
cattaagaaaa

SEQ ID NO: 3454812 - DNA, 12 bp, Homo sapiens
cattaagaaaat

SEQ ID NO: 3454813 - DNA, 17 bp, Homo sapiens
cattaatatttgctgac

SEQ ID NO: 3454814 - DNA, 17 bp, Homo sapiens
cattactataagaactt

SEQ ID NO: 3454815 - DNA, 12 bp, Homo sapiens
cattagagcagg

SEQ ID NO: 3454816 - DNA, 20 bp, Homo sapiens
cattagatagtcatgctgct

SEQ ID NO: 3454817 - DNA, 19 bp, Homo sapiens
cattagccagatttgtctt

SEQ ID NO: 3454818 - DNA, 9 bp, Homo sapiens
cattagcct

SEQ ID NO: 3454819 - DNA, 17 bp, Homo sapiens
cattagggggaactcta

SEQ ID NO: 3454820 - DNA, 21 bp, Homo sapiens
cattagttgcactaactgctg

SEQ ID NO: 3454821 - DNA, 13 bp, Homo sapiens
cattattctatgt

SEQ ID NO: 3454822 - DNA, 15 bp, Homo sapiens
cattcacctgcccca

SEQ ID NO: 3454823 - DNA, 19 bp, Homo sapiens
cattcagaatatcatcttt

SEQ ID NO: 3454824 - DNA, 19 bp, Homo sapiens
cattcagtgattactgtca

SEQ ID NO: 3454825 - DNA, 22 bp, Homo sapiens
cattcagtgcagcatatacaat

SEQ ID NO: 3454826 - DNA, 15 bp, Homo sapiens
cattccagcccctct

SEQ ID NO: 3454827 - DNA, 22 bp, Homo sapiens
cattccagcccctctggtcgct

SEQ ID NO: 3454828 - DNA, 13 bp, Homo sapiens
cattcccaagatg

SEQ ID NO: 3454829 - DNA, 16 bp, Homo sapiens
cattcccaagatgcct

SEQ ID NO: 3454830 - DNA, 20 bp, Homo sapiens
cattcccaagatgcctgatc

SEQ ID NO: 3454831 - DNA, 21 bp, Homo sapiens
cattcccaagatgcctgatca

SEQ ID NO: 3454832 - DNA, 21 bp, Homo sapiens
cattccgaggggctcagttct

SEQ ID NO: 3454833 - DNA, 16 bp, Homo sapiens
cattcctgaagaacca

SEQ ID NO: 3454834 - DNA, 21 bp, Homo sapiens
cattcctgaagaaccagtccc

SEQ ID NO: 3454835 - DNA, 13 bp, Homo sapiens
cattcctgttctt

SEQ ID NO: 3454836 - DNA, 11 bp, Homo sapiens
cattccttctc

SEQ ID NO: 3454837 - DNA, 14 bp, Homo sapiens
cattcctttgggta

SEQ ID NO: 3454838 - DNA, 14 bp, Homo sapiens
cattcgttctgtgg

SEQ ID NO: 3454839 - DNA, 19 bp, Homo sapiens
cattctacacagagcagga

SEQ ID NO: 3454840 - DNA, 21 bp, Homo sapiens
cattctattgactttcttaaa

SEQ ID NO: 3454841 - DNA, 13 bp, Homo sapiens
cattctcaggcac

SEQ ID NO: 3454842 - DNA, 15 bp, Homo sapiens
cattctcaggcacca

SEQ ID NO: 3454843 - DNA, 18 bp, Homo sapiens
cattctccacagcaaccc

SEQ ID NO: 3454844 - DNA, 16 bp, Homo sapiens
cattctcgcttccctg

SEQ ID NO: 3454845 - DNA, 13 bp, Homo sapiens
cattctctgaaga

SEQ ID NO: 3454846 - DNA, 19 bp, Homo sapiens
cattctctgtctcatccat

SEQ ID NO: 3454847 - DNA, 16 bp, Homo sapiens
cattctgactcggttt

SEQ ID NO: 3454848 - DNA, 17 bp, Homo sapiens
cattctgcaagtatact

SEQ ID NO: 3454849 - DNA, 12 bp, Homo sapiens
cattctgcattt

SEQ ID NO: 3454850 - DNA, 13 bp, Homo sapiens
cattctgcattta

SEQ ID NO: 3454851 - DNA, 22 bp, Homo sapiens
cattctgcatttagctgtattc

SEQ ID NO: 3454852 - DNA, 12 bp, Homo sapiens
cattctgcctgc

SEQ ID NO: 3454853 - DNA, 13 bp, Homo sapiens
cattctgcctgcc

SEQ ID NO: 3454854 - DNA, 19 bp, Homo sapiens
cattcttggcttaatcatt

SEQ ID NO: 3454855 - DNA, 20 bp, Homo sapiens
cattcttggcttaatcattt

SEQ ID NO: 3454856 - DNA, 17 bp, Homo sapiens
cattcttggttggctgg

SEQ ID NO: 3454857 - DNA, 21 bp, Homo sapiens
cattcttggttggctggcctt

SEQ ID NO: 3454858 - DNA, 12 bp, Homo sapiens
cattcttttgta

SEQ ID NO: 3454859 - DNA, 22 bp, Homo sapiens
cattgaccgcgactaatttcaa

SEQ ID NO: 3454860 - DNA, 15 bp, Homo sapiens
cattgaggataaatt

SEQ ID NO: 3454861 - DNA, 19 bp, Homo sapiens
cattgatggggaaggaggc

SEQ ID NO: 3454862 - DNA, 14 bp, Homo sapiens
cattgcacccagcc

SEQ ID NO: 3454863 - DNA, 12 bp, Homo sapiens
cattgcagttta

SEQ ID NO: 3454864 - DNA, 15 bp, Homo sapiens
cattgccaagggctt

SEQ ID NO: 3454865 - DNA, 14 bp, Homo sapiens
cattgcccagtctt

SEQ ID NO: 3454866 - DNA, 17 bp, Homo sapiens
cattgcccagtctttca

SEQ ID NO: 3454867 - DNA, 18 bp, Homo sapiens
cattgcccagtctttcat

SEQ ID NO: 3454868 - DNA, 12 bp, Homo sapiens
cattgcctgtga

SEQ ID NO: 3454869 - DNA, 15 bp, Homo sapiens
cattgcggacagcca

SEQ ID NO: 3454870 - DNA, 15 bp, Homo sapiens
cattgctcccctgat

SEQ ID NO: 3454871 - DNA, 17 bp, Homo sapiens
cattgctgagcctctgc

SEQ ID NO: 3454872 - DNA, 21 bp, Homo sapiens
cattgctgagcctctgctccc

SEQ ID NO: 3454873 - DNA, 16 bp, Homo sapiens
cattgctggactctga

SEQ ID NO: 3454874 - DNA, 13 bp, Homo sapiens
cattgctgtagga

SEQ ID NO: 3454875 - DNA, 16 bp, Homo sapiens
cattgctgtctgcagc

SEQ ID NO: 3454876 - DNA, 16 bp, Homo sapiens
cattggacccttccat

SEQ ID NO: 3454877 - DNA, 13 bp, Homo sapiens
catctcagggtcc

SEQ ID NO: 3454878 - DNA, 19 bp, Homo sapiens
catctcagggtccagaccc

SEQ ID NO: 3454879 - DNA, 21 bp, Homo sapiens
catctcagggtccagaccctg

SEQ ID NO: 3454880 - DNA, 22 bp, Homo sapiens
catctcatgcccctggctggga

SEQ ID NO: 3454881 - DNA, 18 bp, Homo sapiens
catctcccagataatgtg

SEQ ID NO: 3454882 - DNA, 16 bp, Homo sapiens
catctcccctcagctc

SEQ ID NO: 3454883 - DNA, 14 bp, Homo sapiens
catctcgctccctc

SEQ ID NO: 3454884 - DNA, 16 bp, Homo sapiens
catctctaacagctca

SEQ ID NO: 3454885 - DNA, 18 bp, Homo sapiens
catctctaacagctcagg

SEQ ID NO: 3454886 - DNA, 16 bp, Homo sapiens
catctctcatcctcca

SEQ ID NO: 3454887 - DNA, 17 bp, Homo sapiens
catctctcatcctccag

SEQ ID NO: 3454888 - DNA, 12 bp, Homo sapiens
catctctccctc

SEQ ID NO: 3454889 - DNA, 18 bp, Homo sapiens
catctctctgcccaaccc

SEQ ID NO: 3454890 - DNA, 19 bp, Homo sapiens
catctctgcctgacaaggc

SEQ ID NO: 3454891 - DNA, 20 bp, Homo sapiens
catctctgcctgacaaggcc

SEQ ID NO: 3454892 - DNA, 21 bp, Homo sapiens
catctctgcctgacaaggcca

SEQ ID NO: 3454893 - DNA, 12 bp, Homo sapiens
catctctgcttg

SEQ ID NO: 3454894 - DNA, 16 bp, Homo sapiens
catctctggatgcctg

SEQ ID NO: 3454895 - DNA, 18 bp, Homo sapiens
catctctgtactttgctt

SEQ ID NO: 3454896 - DNA, 19 bp, Homo sapiens
catctcttagctcccctcc

SEQ ID NO: 3454897 - DNA, 21 bp, Homo sapiens
catctcttcctccgaggccag

SEQ ID NO: 3454898 - DNA, 12 bp, Homo sapiens
catctctttaga

SEQ ID NO: 3454899 - DNA, 22 bp, Homo sapiens
catctgaaggggcaaattcttt

SEQ ID NO: 3454900 - DNA, 19 bp, Homo sapiens
catctgaccagcagcgcct

SEQ ID NO: 3454901 - DNA, 18 bp, Homo sapiens
catctgaggcatccagca

SEQ ID NO: 3454902 - DNA, 17 bp, Homo sapiens
catctgcccaactgtgt

SEQ ID NO: 3454903 - DNA, 19 bp, Homo sapiens
catctgcccaactgtgtag

SEQ ID NO: 3454904 - DNA, 20 bp, Homo sapiens
catctgccgtgcctggatcc

SEQ ID NO: 3454905 - DNA, 16 bp, Homo sapiens
catctgctctccttcc

SEQ ID NO: 3454906 - DNA, 13 bp, Homo sapiens
catctgctgcccc

SEQ ID NO: 3454907 - DNA, 21 bp, Homo sapiens
catctggaatctggagaccag

SEQ ID NO: 3454908 - DNA, 13 bp, Homo sapiens
catctgggctcct

SEQ ID NO: 3454909 - DNA, 20 bp, Homo sapiens
catctgtccctccgggacct

SEQ ID NO: 3454910 - DNA, 22 bp, Homo sapiens
catctgtcttgccagccagaag

SEQ ID NO: 3454911 - DNA, 15 bp, Homo sapiens
catctgtgattccct

SEQ ID NO: 3454912 - DNA, 15 bp, Homo sapiens
catctgtgcacgcag

SEQ ID NO: 3454913 - DNA, 17 bp, Homo sapiens
catctgtgcactgccca

SEQ ID NO: 3454914 - DNA, 18 bp, Homo sapiens
catctgtgcactgcccat

SEQ ID NO: 3454915 - DNA, 16 bp, Homo sapiens
catctgttagggcctt

SEQ ID NO: 3454916 - DNA, 21 bp, Homo sapiens
catctgtttgtagccacaagc

SEQ ID NO: 3454917 - DNA, 15 bp, Homo sapiens
catcttaagagatgc

SEQ ID NO: 3454918 - DNA, 13 bp, Homo sapiens
catcttcacccag

SEQ ID NO: 3454919 - DNA, 17 bp, Homo sapiens
catcttcacccaggcct

SEQ ID NO: 3454920 - DNA, 13 bp, Homo sapiens
catcttcctgtgt

SEQ ID NO: 3454921 - DNA, 14 bp, Homo sapiens
catcttcctgtgtc

SEQ ID NO: 3454922 - DNA, 21 bp, Homo sapiens
catcttctaaacccaatccaa

SEQ ID NO: 3454923 - DNA, 22 bp, Homo sapiens
catcttgaatactctgccctct

SEQ ID NO: 3454924 - DNA, 16 bp, Homo sapiens
catcttgaccaagcag

SEQ ID NO: 3454925 - DNA, 22 bp, Homo sapiens
catcttgaccaagcaggaagct

SEQ ID NO: 3454926 - DNA, 23 bp, Homo sapiens
catcttgaccaagcaggaagctc

SEQ ID NO: 3454927 - DNA, 13 bp, Homo sapiens
catcttgctctgc

SEQ ID NO: 3454928 - DNA, 14 bp, Homo sapiens
catcttgctggcta

SEQ ID NO: 3454929 - DNA, 13 bp, Homo sapiens
catcttgcttccc

SEQ ID NO: 3454930 - DNA, 19 bp, Homo sapiens
catctttcctgatggcagg

SEQ ID NO: 3454931 - DNA, 21 bp, Homo sapiens
catctttcttctattttattc

SEQ ID NO: 3454932 - DNA, 23 bp, Homo sapiens
catctttcttctattttattccc

SEQ ID NO: 3454933 - DNA, 13 bp, Homo sapiens
catcttttaaaga

SEQ ID NO: 3454934 - DNA, 13 bp, Homo sapiens
catcttttacatt

SEQ ID NO: 3454935 - DNA, 15 bp, Homo sapiens
catcttttattttgg

SEQ ID NO: 3454936 - DNA, 16 bp, Homo sapiens
catcttttcttgcctc

SEQ ID NO: 3454937 - DNA, 14 bp, Homo sapiens
catgaaactccacc

SEQ ID NO: 3454938 - DNA, 18 bp, Homo sapiens
catgaagtttccttggct

SEQ ID NO: 3454939 - DNA, 23 bp, Homo sapiens
catgaagtttccttggctggtgc

SEQ ID NO: 3454940 - DNA, 23 bp, Homo sapiens
catgaatttattgcacattgttc

SEQ ID NO: 3454941 - DNA, 21 bp, Homo sapiens
catgaatttttttcatcttct

SEQ ID NO: 3454942 - DNA, 13 bp, Homo sapiens
catgacagccaga

SEQ ID NO: 3454943 - DNA, 18 bp, Homo sapiens
catgacagcctgcagcag

SEQ ID NO: 3454944 - DNA, 13 bp, Homo sapiens
catgacccaggct

SEQ ID NO: 3454945 - DNA, 20 bp, Homo sapiens
catgaccttatccttcctct

SEQ ID NO: 3454946 - DNA, 17 bp, Homo sapiens
catgactcgggggtggg

SEQ ID NO: 3454947 - DNA, 18 bp, Homo sapiens
catgagaaatacaaaaat

SEQ ID NO: 3454948 - DNA, 16 bp, Homo sapiens
catgagaacaaacaga

SEQ ID NO: 3454949 - DNA, 22 bp, Homo sapiens
catgagaagttgatatagaaca

SEQ ID NO: 3454950 - DNA, 22 bp, Homo sapiens
catgagaatgctagcaggctgt

SEQ ID NO: 3454951 - DNA, 22 bp, Homo sapiens
catgagatgatacatccaaagc

SEQ ID NO: 3454952 - DNA, 15 bp, Homo sapiens
catgagcctcagcat

SEQ ID NO: 3454953 - DNA, 22 bp, Homo sapiens
catgagcctcagcatcctggca

SEQ ID NO: 3454954 - DNA, 14 bp, Homo sapiens
catgagcctgctgg

SEQ ID NO: 3454955 - DNA, 16 bp, Homo sapiens
catgagcctgctggaa

SEQ ID NO: 3454956 - DNA, 18 bp, Homo sapiens
catgagcctgctggaagc

SEQ ID NO: 3454957 - DNA, 20 bp, Homo sapiens
catgagcctgctggaagccc

SEQ ID NO: 3454958 - DNA, 13 bp, Homo sapiens
catgaggggagag

SEQ ID NO: 3454959 - DNA, 15 bp, Homo sapiens
catgagttctgctga

SEQ ID NO: 3454960 - DNA, 21 bp, Homo sapiens
catgagttggggtctggcagc

SEQ ID NO: 3454961 - DNA, 23 bp, Homo sapiens
catgagttggggtctggcagcct

SEQ ID NO: 3454962 - DNA, 16 bp, Homo sapiens
catgatgcctctgtct

SEQ ID NO: 3454963 - DNA, 20 bp, Homo sapiens
catgatgcctctgtcttctg

SEQ ID NO: 3454964 - DNA, 23 bp, Homo sapiens
catgatgcctctgtcttctggac

SEQ ID NO: 3454965 - DNA, 15 bp, Homo sapiens
catgatgctgggatt

SEQ ID NO: 3454966 - DNA, 16 bp, Homo sapiens
catgatgctgggattt

SEQ ID NO: 3454967 - DNA, 15 bp, Homo sapiens
catgatggcaacaga

SEQ ID NO: 3454968 - DNA, 20 bp, Homo sapiens
catgatggcaacagatctgg

SEQ ID NO: 3454969 - DNA, 13 bp, Homo sapiens
catgatgtactaa

SEQ ID NO: 3454970 - DNA, 20 bp, Homo sapiens
catgatgtagtgcctctttc

SEQ ID NO: 3454971 - DNA, 15 bp, Homo sapiens
catgatgtttgccca

SEQ ID NO: 3454972 - DNA, 12 bp, Homo sapiens
catgatttcctt

SEQ ID NO: 3454973 - DNA, 14 bp, Homo sapiens
catgatttccttga

SEQ ID NO: 3454974 - DNA, 16 bp, Homo sapiens
catgatttccttgaat

SEQ ID NO: 3454975 - DNA, 14 bp, Homo sapiens
catgcaaatgctgt

SEQ ID NO: 3454976 - DNA, 22 bp, Homo sapiens
catgcaaatgctgtattcttct

SEQ ID NO: 3454977 - DNA, 18 bp, Homo sapiens
catgcaccaggactggct

SEQ ID NO: 3454978 - DNA, 15 bp, Homo sapiens
catgcactcagctct

SEQ ID NO: 3454979 - DNA, 13 bp, Homo sapiens
catgcactgtgaa

SEQ ID NO: 3454980 - DNA, 22 bp, Homo sapiens
catgcagtttgaaattctgaat

SEQ ID NO: 3454981 - DNA, 18 bp, Homo sapiens
catgccaagcactgtgct

SEQ ID NO: 3454982 - DNA, 21 bp, Homo sapiens
catgccacaaggacttcctgt

SEQ ID NO: 3454983 - DNA, 15 bp, Homo sapiens
catgccctctcaggc

SEQ ID NO: 3454984 - DNA, 18 bp, Homo sapiens
catgcctcactaattttt

SEQ ID NO: 3454985 - DNA, 11 bp, Homo sapiens
catgcctcagc

SEQ ID NO: 3454986 - DNA, 20 bp, Homo sapiens
catgcctgccccaaacaaat

SEQ ID NO: 3454987 - DNA, 14 bp, Homo sapiens
catgcctggcttcg

SEQ ID NO: 3454988 - DNA, 21 bp, Homo sapiens
catgcgccccctccgccctgc

SEQ ID NO: 3454989 - DNA, 14 bp, Homo sapiens
catgcgctcagggc

SEQ ID NO: 3454990 - DNA, 14 bp, Homo sapiens
catgcggtagccag

SEQ ID NO: 3454991 - DNA, 17 bp, Homo sapiens
catgcggtagccagcac

SEQ ID NO: 3454992 - DNA, 21 bp, Homo sapiens
catgcggtagccagcacacag

SEQ ID NO: 3454993 - DNA, 16 bp, Homo sapiens
catgctatgttctgtc

SEQ ID NO: 3454994 - DNA, 17 bp, Homo sapiens
catgctcatctgctggt

SEQ ID NO: 3454995 - DNA, 18 bp, Homo sapiens
catgctcatctgctggtc

SEQ ID NO: 3454996 - DNA, 17 bp, Homo sapiens
catgctcctggcccact

SEQ ID NO: 3454997 - DNA, 17 bp, Homo sapiens
catgctgaggcctgggc

SEQ ID NO: 3454998 - DNA, 19 bp, Homo sapiens
catgctgaggcctgggccg

SEQ ID NO: 3454999 - DNA, 15 bp, Homo sapiens
catgctgctagatct

SEQ ID NO: 3455000 - DNA, 22 bp, Homo sapiens
catgctggaaaataatactgct

SEQ ID NO: 3455001 - DNA, 23 bp, Homo sapiens
catgctggaaaataatactgctg

SEQ ID NO: 3455002 - DNA, 22 bp, Homo sapiens
catgctggaacctgcaaaaaat

SEQ ID NO: 3455003 - DNA, 19 bp, Homo sapiens
catgctgtgattgtgccta

SEQ ID NO: 3455004 - DNA, 14 bp, Homo sapiens
catgcttcatcatt

SEQ ID NO: 3455005 - DNA, 16 bp, Homo sapiens
catggaaaaacttcct

SEQ ID NO: 3455006 - DNA, 20 bp, Homo sapiens
catggaagaggctacagggc

SEQ ID NO: 3455007 - DNA, 21 bp, Homo sapiens
catggaaggggcttctggacc

SEQ ID NO: 3455008 - DNA, 14 bp, Homo sapiens
catggacaggctgg

SEQ ID NO: 3455009 - DNA, 15 bp, Homo sapiens
catggacaggctggc

SEQ ID NO: 3455010 - DNA, 17 bp, Homo sapiens
catggagagctggagcc

SEQ ID NO: 3455011 - DNA, 17 bp, Homo sapiens
catggagccagctccct

SEQ ID NO: 3455012 - DNA, 12 bp, Homo sapiens
catggagctggc

SEQ ID NO: 3455013 - DNA, 20 bp, Homo sapiens
cataatgctaatttaaagag

SEQ ID NO: 3455014 - DNA, 23 bp, Homo sapiens
cataattcactctgagtgtttta

SEQ ID NO: 3455015 - DNA, 15 bp, Homo sapiens
cataatttgtacata

SEQ ID NO: 3455016 - DNA, 18 bp, Homo sapiens
catacaccagcattcctt

SEQ ID NO: 3455017 - DNA, 23 bp, Homo sapiens
catacaccccctcttctgagcac

SEQ ID NO: 3455018 - DNA, 23 bp, Homo sapiens
catacagaattactgtaactgat

SEQ ID NO: 3455019 - DNA, 14 bp, Homo sapiens
cataccaatgaaaa

SEQ ID NO: 3455020 - DNA, 16 bp, Homo sapiens
cataccatctgctgcc

SEQ ID NO: 3455021 - DNA, 19 bp, Homo sapiens
cataccatctgctgccccg

SEQ ID NO: 3455022 - DNA, 20 bp, Homo sapiens
catacttgaagggccagagc

SEQ ID NO: 3455023 - DNA, 21 bp, Homo sapiens
catacttgaagggccagagcc

SEQ ID NO: 3455024 - DNA, 14 bp, Homo sapiens
catactttgtaaat

SEQ ID NO: 3455025 - DNA, 23 bp, Homo sapiens
catagcagagaatgaaagggccc

SEQ ID NO: 3455026 - DNA, 18 bp, Homo sapiens
catagcagattttaattt

SEQ ID NO: 3455027 - DNA, 15 bp, Homo sapiens
catagcatgacattt

SEQ ID NO: 3455028 - DNA, 15 bp, Homo sapiens
catagcccagtagac

SEQ ID NO: 3455029 - DNA, 19 bp, Homo sapiens
catagcccatgttaagtcc

SEQ ID NO: 3455030 - DNA, 16 bp, Homo sapiens
cataggacctttccac

SEQ ID NO: 3455031 - DNA, 13 bp, Homo sapiens
cataggcccagtg

SEQ ID NO: 3455032 - DNA, 23 bp, Homo sapiens
catagtaacttcttatggaattg

SEQ ID NO: 3455033 - DNA, 16 bp, Homo sapiens
catagtaccatttata

SEQ ID NO: 3455034 - DNA, 17 bp, Homo sapiens
catagtagtttttacag

SEQ ID NO: 3455035 - DNA, 18 bp, Homo sapiens
catagtattcatgactat

SEQ ID NO: 3455036 - DNA, 12 bp, Homo sapiens
catagtccctgc

SEQ ID NO: 3455037 - DNA, 13 bp, Homo sapiens
catagtccctgcc

SEQ ID NO: 3455038 - DNA, 19 bp, Homo sapiens
catagtgcattgtttctgt

SEQ ID NO: 3455039 - DNA, 22 bp, Homo sapiens
catagttggggtcatagatgtt

SEQ ID NO: 3455040 - DNA, 14 bp, Homo sapiens
catataaaataatg

SEQ ID NO: 3455041 - DNA, 15 bp, Homo sapiens
catataaaataatgc

SEQ ID NO: 3455042 - DNA, 21 bp, Homo sapiens
catataaaataatgcaaagaa

SEQ ID NO: 3455043 - DNA, 22 bp, Homo sapiens
catataaaataatgcaaagaat

SEQ ID NO: 3455044 - DNA, 21 bp, Homo sapiens
catataagttgagaaggtgcc

SEQ ID NO: 3455045 - DNA, 22 bp, Homo sapiens
catatactttaatgttttaact

SEQ ID NO: 3455046 - DNA, 17 bp, Homo sapiens
catatatatactattaa

SEQ ID NO: 3455047 - DNA, 22 bp, Homo sapiens
catatatatgttttaagaggca

SEQ ID NO: 3455048 - DNA, 21 bp, Homo sapiens
catatattggcactgctaaaa

SEQ ID NO: 3455049 - DNA, 18 bp, Homo sapiens
catatctgcctttattgt

SEQ ID NO: 3455050 - DNA, 14 bp, Homo sapiens
catatctttattaa

SEQ ID NO: 3455051 - DNA, 15 bp, Homo sapiens
catatctttattaat

SEQ ID NO: 3455052 - DNA, 16 bp, Homo sapiens
catatctttattaatc

SEQ ID NO: 3455053 - DNA, 20 bp, Homo sapiens
catatgaaaggtgccatgga

SEQ ID NO: 3455054 - DNA, 16 bp, Homo sapiens
catatgaattgtacag

SEQ ID NO: 3455055 - DNA, 17 bp, Homo sapiens
catatgaattgtacaga

SEQ ID NO: 3455056 - DNA, 14 bp, Homo sapiens
catatgtaaaataa

SEQ ID NO: 3455057 - DNA, 14 bp, Homo sapiens
catatgtacagaag

SEQ ID NO: 3455058 - DNA, 18 bp, Homo sapiens
catatgttaagcagctaa

SEQ ID NO: 3455059 - DNA, 19 bp, Homo sapiens
catatgttgaatacttttt

SEQ ID NO: 3455060 - DNA, 15 bp, Homo sapiens
catattctaaaacca

SEQ ID NO: 3455061 - DNA, 22 bp, Homo sapiens
catattgcacatgtcttaatga

SEQ ID NO: 3455062 - DNA, 20 bp, Homo sapiens
catatttaatgttttaaatg

SEQ ID NO: 3455063 - DNA, 22 bp, Homo sapiens
catatttaatgttttaaatgta

SEQ ID NO: 3455064 - DNA, 12 bp, Homo sapiens
catatttatcca

SEQ ID NO: 3455065 - DNA, 17 bp, Homo sapiens
catcaaatggaagacac

SEQ ID NO: 3455066 - DNA, 16 bp, Homo sapiens
catcaagaagggctgc

SEQ ID NO: 3455067 - DNA, 22 bp, Homo sapiens
catcaagaagggctgcatgatg

SEQ ID NO: 3455068 - DNA, 18 bp, Homo sapiens
catcaaggcactgcctga

SEQ ID NO: 3455069 - DNA, 11 bp, Homo sapiens
catcacacaca

SEQ ID NO: 3455070 - DNA, 15 bp, Homo sapiens
catcacacctgccct

SEQ ID NO: 3455071 - DNA, 12 bp, Homo sapiens
catcacagaatg

SEQ ID NO: 3455072 - DNA, 17 bp, Homo sapiens
catcacagctaacaatt

SEQ ID NO: 3455073 - DNA, 19 bp, Homo sapiens
catcaccttaggcagggaa

SEQ ID NO: 3455074 - DNA, 20 bp, Homo sapiens
catcaccttaggcagggaag

SEQ ID NO: 3455075 - DNA, 23 bp, Homo sapiens
catcaccttaggcagggaagtgt

SEQ ID NO: 3455076 - DNA, 17 bp, Homo sapiens
catcactgagttttcca

SEQ ID NO: 3455077 - DNA, 22 bp, Homo sapiens
catcactggggtcacttgggaa

SEQ ID NO: 3455078 - DNA, 16 bp, Homo sapiens
catcagcaccccagtg

SEQ ID NO: 3455079 - DNA, 22 bp, Homo sapiens
catcaggagaaaaagcctccag

SEQ ID NO: 3455080 - DNA, 14 bp, Homo sapiens
catcaggagactgg

SEQ ID NO: 3455081 - DNA, 16 bp, Homo sapiens
catcagtgctccctca

SEQ ID NO: 3455082 - DNA, 14 bp, Homo sapiens
catcagtggagcca

SEQ ID NO: 3455083 - DNA, 16 bp, Homo sapiens
catcagtgtttgttgg

SEQ ID NO: 3455084 - DNA, 18 bp, Homo sapiens
catcagtgtttgttggat

SEQ ID NO: 3455085 - DNA, 22 bp, Homo sapiens
catcagttactctgaagggcat

SEQ ID NO: 3455086 - DNA, 20 bp, Homo sapiens
catcagttagagctgacaca

SEQ ID NO: 3455087 - DNA, 21 bp, Homo sapiens
catcatcaaggcactgcctga

SEQ ID NO: 3455088 - DNA, 14 bp, Homo sapiens
catcatgagttctg

SEQ ID NO: 3455089 - DNA, 16 bp, Homo sapiens
catcatgagttctgct

SEQ ID NO: 3455090 - DNA, 21 bp, Homo sapiens
catcatgctggaacctgcaaa

SEQ ID NO: 3455091 - DNA, 13 bp, Homo sapiens
catcatgtctggc

SEQ ID NO: 3455092 - DNA, 15 bp, Homo sapiens
catcatgtctggcta

SEQ ID NO: 3455093 - DNA, 17 bp, Homo sapiens
catcattccttgagaaa

SEQ ID NO: 3455094 - DNA, 17 bp, Homo sapiens
catcattctctgtctca

SEQ ID NO: 3455095 - DNA, 21 bp, Homo sapiens
catcattctctgtctcatcca

SEQ ID NO: 3455096 - DNA, 20 bp, Homo sapiens
catcattttccatatcctgg

SEQ ID NO: 3455097 - DNA, 18 bp, Homo sapiens
catccaaagcagacagct

SEQ ID NO: 3455098 - DNA, 21 bp, Homo sapiens
catccaaagcagacagctcca

SEQ ID NO: 3455099 - DNA, 14 bp, Homo sapiens
catccaaccttccc

SEQ ID NO: 3455100 - DNA, 23 bp, Homo sapiens
catccaatgctcaagaaacaact

SEQ ID NO: 3455101 - DNA, 20 bp, Homo sapiens
catccagaactgctaccttc

SEQ ID NO: 3455102 - DNA, 17 bp, Homo sapiens
catccagcagtctctgc

SEQ ID NO: 3455103 - DNA, 19 bp, Homo sapiens
catccagcagtctctgcct

SEQ ID NO: 3455104 - DNA, 15 bp, Homo sapiens
catccaggttcagct

SEQ ID NO: 3455105 - DNA, 17 bp, Homo sapiens
catccaggttcagcttg

SEQ ID NO: 3455106 - DNA, 23 bp, Homo sapiens
catccagtctcccaacttgtatt

SEQ ID NO: 3455107 - DNA, 19 bp, Homo sapiens
catccagtgacaaaccatc

SEQ ID NO: 3455108 - DNA, 19 bp, Homo sapiens
catccatcagcaccccagt

SEQ ID NO: 3455109 - DNA, 18 bp, Homo sapiens
catcccatgatgtagtgc

SEQ ID NO: 3455110 - DNA, 20 bp, Homo sapiens
catcccatgatgtagtgcct

SEQ ID NO: 3455111 - DNA, 21 bp, Homo sapiens
catccccaggtctctccactg

SEQ ID NO: 3455112 - DNA, 19 bp, Homo sapiens
catccccttgaactcttca

SEQ ID NO: 3455113 - DNA, 16 bp, Homo sapiens
catcccgggcctcagt

SEQ ID NO: 3455114 - DNA, 17 bp, Homo sapiens
catcccgggcctcagtg

SEQ ID NO: 3455115 - DNA, 15 bp, Homo sapiens
catccctgccagctc

SEQ ID NO: 3455116 - DNA, 20 bp, Homo sapiens
catcccttgaccaggcctgg

SEQ ID NO: 3455117 - DNA, 23 bp, Homo sapiens
catcccttgaccaggcctgggcc

SEQ ID NO: 3455118 - DNA, 13 bp, Homo sapiens
catccgcaggtgc

SEQ ID NO: 3455119 - DNA, 20 bp, Homo sapiens
catccgtgctatgacatgga

SEQ ID NO: 3455120 - DNA, 16 bp, Homo sapiens
catcctcaaacactgc

SEQ ID NO: 3455121 - DNA, 18 bp, Homo sapiens
catcctccacgttctgct

SEQ ID NO: 3455122 - DNA, 13 bp, Homo sapiens
catcctcctccca

SEQ ID NO: 3455123 - DNA, 11 bp, Homo sapiens
catcctctgac

SEQ ID NO: 3455124 - DNA, 13 bp, Homo sapiens
catcctctgactc

SEQ ID NO: 3455125 - DNA, 17 bp, Homo sapiens
catcctctgactccact

SEQ ID NO: 3455126 - DNA, 22 bp, Homo sapiens
catcctggcacccggcccctgc

SEQ ID NO: 3455127 - DNA, 19 bp, Homo sapiens
catcctgtgcctccatcag

SEQ ID NO: 3455128 - DNA, 15 bp, Homo sapiens
catcctgtgtttcta

SEQ ID NO: 3455129 - DNA, 20 bp, Homo sapiens
catccttatccttcatcttt

SEQ ID NO: 3455130 - DNA, 19 bp, Homo sapiens
catcctttacgtgtttaaa

SEQ ID NO: 3455131 - DNA, 21 bp, Homo sapiens
catcctttagggttctgcctc

SEQ ID NO: 3455132 - DNA, 22 bp, Homo sapiens
catcctttagggttctgcctct

SEQ ID NO: 3455133 - DNA, 16 bp, Homo sapiens
catcgcaccattctga

SEQ ID NO: 3455134 - DNA, 20 bp, Homo sapiens
catcgccagaggtgcttcac

SEQ ID NO: 3455135 - DNA, 19 bp, Homo sapiens
catcgctcccaaaggaaag

SEQ ID NO: 3455136 - DNA, 21 bp, Homo sapiens
catcggacaagacccccagca

SEQ ID NO: 3455137 - DNA, 14 bp, Homo sapiens
catcggcctagggc

SEQ ID NO: 3455138 - DNA, 16 bp, Homo sapiens
catctaagcctgaagg

SEQ ID NO: 3455139 - DNA, 14 bp, Homo sapiens
catctacttcaggc

SEQ ID NO: 3455140 - DNA, 14 bp, Homo sapiens
catctagcaaatgt

SEQ ID NO: 3455141 - DNA, 21 bp, Homo sapiens
catctattctttgtaccatct

SEQ ID NO: 3455142 - DNA, 22 bp, Homo sapiens
catctattctttgtaccatctg

SEQ ID NO: 3455143 - DNA, 14 bp, Homo sapiens
catctcaaccatcc

SEQ ID NO: 3455144 - DNA, 22 bp, Homo sapiens
catctcaaggaataatgggctt

SEQ ID NO: 3455145 - DNA, 21 bp, Homo sapiens
catctcaatggaaacatcact

SEQ ID NO: 3455146 - DNA, 19 bp, Homo sapiens
catctcactggatgcaaag

SEQ ID NO: 3455147 - DNA, 17 bp, Homo sapiens
catctcaggccagagcc

SEQ ID NO: 3455148 - DNA, 23 bp, Homo sapiens
caggaatgtgtggcctgcacagt

SEQ ID NO: 3455149 - DNA, 20 bp, Homo sapiens
caggaatttcccaggaccct

SEQ ID NO: 3455150 - DNA, 21 bp, Homo sapiens
caggaatttcccaggaccctg

SEQ ID NO: 3455151 - DNA, 18 bp, Homo sapiens
caggacatgcggtagcca

SEQ ID NO: 3455152 - DNA, 14 bp, Homo sapiens
caggacatttctct

SEQ ID NO: 3455153 - DNA, 10 bp, Homo sapiens
caggaccagc

SEQ ID NO: 3455154 - DNA, 19 bp, Homo sapiens
caggaccagctcaggacag

SEQ ID NO: 3455155 - DNA, 18 bp, Homo sapiens
caggaccaggcaatgtga

SEQ ID NO: 3455156 - DNA, 21 bp, Homo sapiens
caggaccagtcaacctgggca

SEQ ID NO: 3455157 - DNA, 14 bp, Homo sapiens
caggacccagagga

SEQ ID NO: 3455158 - DNA, 15 bp, Homo sapiens
caggacccagaggaa

SEQ ID NO: 3455159 - DNA, 13 bp, Homo sapiens
caggaccctgaag

SEQ ID NO: 3455160 - DNA, 14 bp, Homo sapiens
caggaccctgaagg

SEQ ID NO: 3455161 - DNA, 15 bp, Homo sapiens
caggaccctgaaggg

SEQ ID NO: 3455162 - DNA, 16 bp, Homo sapiens
caggaccctgaagggg

SEQ ID NO: 3455163 - DNA, 19 bp, Homo sapiens
caggacctccaagccactg

SEQ ID NO: 3455164 - DNA, 20 bp, Homo sapiens
caggaccttcgggctgtgcc

SEQ ID NO: 3455165 - DNA, 16 bp, Homo sapiens
caggacgtgggctggg

SEQ ID NO: 3455166 - DNA, 15 bp, Homo sapiens
caggactcaccctca

SEQ ID NO: 3455167 - DNA, 16 bp, Homo sapiens
caggactcagaagcct

SEQ ID NO: 3455168 - DNA, 19 bp, Homo sapiens
caggactcagaagcctctg

SEQ ID NO: 3455169 - DNA, 14 bp, Homo sapiens
caggactcagctcc

SEQ ID NO: 3455170 - DNA, 19 bp, Homo sapiens
caggactcagctccccaga

SEQ ID NO: 3455171 - DNA, 21 bp, Homo sapiens
caggactccaggcccaaggct

SEQ ID NO: 3455172 - DNA, 16 bp, Homo sapiens
caggactgcagagcag

SEQ ID NO: 3455173 - DNA, 17 bp, Homo sapiens
caggactgcagagcaga

SEQ ID NO: 3455174 - DNA, 13 bp, Homo sapiens
caggactgggcca

SEQ ID NO: 3455175 - DNA, 15 bp, Homo sapiens
caggacttccccgga

SEQ ID NO: 3455176 - DNA, 16 bp, Homo sapiens
caggagaagagaggaa

SEQ ID NO: 3455177 - DNA, 15 bp, Homo sapiens
caggagcacacccag

SEQ ID NO: 3455178 - DNA, 16 bp, Homo sapiens
caggagcacacccagc

SEQ ID NO: 3455179 - DNA, 15 bp, Homo sapiens
caggagcagcctcag

SEQ ID NO: 3455180 - DNA, 19 bp, Homo sapiens
caggagcctaccccctgaa

SEQ ID NO: 3455181 - DNA, 13 bp, Homo sapiens
caggagcgcatct

SEQ ID NO: 3455182 - DNA, 15 bp, Homo sapiens
caggagcgcatctca

SEQ ID NO: 3455183 - DNA, 19 bp, Homo sapiens
caggagcttgcaagaagca

SEQ ID NO: 3455184 - DNA, 19 bp, Homo sapiens
caggaggagttagccaaac

SEQ ID NO: 3455185 - DNA, 20 bp, Homo sapiens
caggaggcagaggttgcagt

SEQ ID NO: 3455186 - DNA, 18 bp, Homo sapiens
caggaggccaggccggcg

SEQ ID NO: 3455187 - DNA, 22 bp, Homo sapiens
caggaggccctggtcctggcct

SEQ ID NO: 3455188 - DNA, 16 bp, Homo sapiens
caggaggggaaacatc

SEQ ID NO: 3455189 - DNA, 22 bp, Homo sapiens
caggagtctctggtagcctgca

SEQ ID NO: 3455190 - DNA, 23 bp, Homo sapiens
caggagtttgagaccaacctggg

SEQ ID NO: 3455191 - DNA, 21 bp, Homo sapiens
caggagtttgagaccagcctg

SEQ ID NO: 3455192 - DNA, 14 bp, Homo sapiens
caggatagagactg

SEQ ID NO: 3455193 - DNA, 13 bp, Homo sapiens
caggatattccaa

SEQ ID NO: 3455194 - DNA, 21 bp, Homo sapiens
caggatattccaaaataaaag

SEQ ID NO: 3455195 - DNA, 13 bp, Homo sapiens
caggatcagtctg

SEQ ID NO: 3455196 - DNA, 23 bp, Homo sapiens
caggatcgcaagagccatgtaga

SEQ ID NO: 3455197 - DNA, 15 bp, Homo sapiens
caggatgtgtttgct

SEQ ID NO: 3455198 - DNA, 18 bp, Homo sapiens
caggatgtgtttgctttc

SEQ ID NO: 3455199 - DNA, 15 bp, Homo sapiens
caggatttgcacaga

SEQ ID NO: 3455200 - DNA, 16 bp, Homo sapiens
caggcaaagcaagtga

SEQ ID NO: 3455201 - DNA, 21 bp, Homo sapiens
caggcaagcacctcctgcctc

SEQ ID NO: 3455202 - DNA, 20 bp, Homo sapiens
caggcacacagctactctcc

SEQ ID NO: 3455203 - DNA, 23 bp, Homo sapiens
caggcacacagctactctcccca

SEQ ID NO: 3455204 - DNA, 13 bp, Homo sapiens
caggcacaggaca

SEQ ID NO: 3455205 - DNA, 22 bp, Homo sapiens
caggcactgagataccagcgag

SEQ ID NO: 3455206 - DNA, 11 bp, Homo sapiens
caggcagacac

SEQ ID NO: 3455207 - DNA, 14 bp, Homo sapiens
caggcagacacgga

SEQ ID NO: 3455208 - DNA, 17 bp, Homo sapiens
caggcagatccaggact

SEQ ID NO: 3455209 - DNA, 19 bp, Homo sapiens
caggcagctttttctctcc

SEQ ID NO: 3455210 - DNA, 23 bp, Homo sapiens
caggcaggctaaggcgtggagct

SEQ ID NO: 3455211 - DNA, 23 bp, Homo sapiens
caggcagggctgactctaggtgc

SEQ ID NO: 3455212 - DNA, 15 bp, Homo sapiens
caggcagggtgcagt

SEQ ID NO: 3455213 - DNA, 20 bp, Homo sapiens
caggcagtgatgctggatgc

SEQ ID NO: 3455214 - DNA, 22 bp, Homo sapiens
caggcagtgatgctggatgctc

SEQ ID NO: 3455215 - DNA, 20 bp, Homo sapiens
caggcagtttcagagatgga

SEQ ID NO: 3455216 - DNA, 14 bp, Homo sapiens
caggcatcacagct

SEQ ID NO: 3455217 - DNA, 15 bp, Homo sapiens
caggcatgttctctg

SEQ ID NO: 3455218 - DNA, 19 bp, Homo sapiens
caggcatgttctctgagga

SEQ ID NO: 3455219 - DNA, 19 bp, Homo sapiens
caggcattgccaagggctt

SEQ ID NO: 3455220 - DNA, 17 bp, Homo sapiens
caggcatttagccctca

SEQ ID NO: 3455221 - DNA, 15 bp, Homo sapiens
caggccacctcccca

SEQ ID NO: 3455222 - DNA, 16 bp, Homo sapiens
caggccacctccccag

SEQ ID NO: 3455223 - DNA, 13 bp, Homo sapiens
caggccagaggga

SEQ ID NO: 3455224 - DNA, 21 bp, Homo sapiens
caggccagagggagtgacaga

SEQ ID NO: 3455225 - DNA, 17 bp, Homo sapiens
caggcccaaggctcccg

SEQ ID NO: 3455226 - DNA, 16 bp, Homo sapiens
caggccccccgcagca

SEQ ID NO: 3455227 - DNA, 15 bp, Homo sapiens
caggcccctctcctc

SEQ ID NO: 3455228 - DNA, 20 bp, Homo sapiens
caggcccctgccaccctggg

SEQ ID NO: 3455229 - DNA, 23 bp, Homo sapiens
caggcccctggaggctgcctccc

SEQ ID NO: 3455230 - DNA, 15 bp, Homo sapiens
caggcccggctccag

SEQ ID NO: 3455231 - DNA, 17 bp, Homo sapiens
caggcccggctccaggc

SEQ ID NO: 3455232 - DNA, 19 bp, Homo sapiens
caggcccggctccaggctc

SEQ ID NO: 3455233 - DNA, 20 bp, Homo sapiens
caggcccggctccaggctcc

SEQ ID NO: 3455234 - DNA, 22 bp, Homo sapiens
caggcccggctccaggctcctt

SEQ ID NO: 3455235 - DNA, 17 bp, Homo sapiens
caggccctgccagagca

SEQ ID NO: 3455236 - DNA, 18 bp, Homo sapiens
caggccctgccagagcag

SEQ ID NO: 3455237 - DNA, 19 bp, Homo sapiens
caggccctgccagagcagg

SEQ ID NO: 3455238 - DNA, 17 bp, Homo sapiens
caggccggcagccccag

SEQ ID NO: 3455239 - DNA, 20 bp, Homo sapiens
caggccggcagccccagcct

SEQ ID NO: 3455240 - DNA, 21 bp, Homo sapiens
caggccggcagccccagcctg

SEQ ID NO: 3455241 - DNA, 22 bp, Homo sapiens
caggccggcagccccagcctgc

SEQ ID NO: 3455242 - DNA, 20 bp, Homo sapiens
caggccggcgagccctgtgg

SEQ ID NO: 3455243 - DNA, 22 bp, Homo sapiens
caggcctatgttgatccatcca

SEQ ID NO: 3455244 - DNA, 16 bp, Homo sapiens
caggcctgagatttca

SEQ ID NO: 3455245 - DNA, 15 bp, Homo sapiens
caggcctgagctgct

SEQ ID NO: 3455246 - DNA, 18 bp, Homo sapiens
caggcctgagctgcttca

SEQ ID NO: 3455247 - DNA, 16 bp, Homo sapiens
caggcgatccacctgt

SEQ ID NO: 3455248 - DNA, 20 bp, Homo sapiens
caggcgatccacctgtctca

SEQ ID NO: 3455249 - DNA, 13 bp, Homo sapiens
caggcgttcagct

SEQ ID NO: 3455250 - DNA, 22 bp, Homo sapiens
caggctcccagggacacctggg

SEQ ID NO: 3455251 - DNA, 19 bp, Homo sapiens
caggctcctttagcgccca

SEQ ID NO: 3455252 - DNA, 14 bp, Homo sapiens
caggctcgccaagg

SEQ ID NO: 3455253 - DNA, 13 bp, Homo sapiens
caggctctccatt

SEQ ID NO: 3455254 - DNA, 15 bp, Homo sapiens
caggctggagtacag

SEQ ID NO: 3455255 - DNA, 12 bp, Homo sapiens
caggctggccag

SEQ ID NO: 3455256 - DNA, 16 bp, Homo sapiens
caggctggccagtcca

SEQ ID NO: 3455257 - DNA, 19 bp, Homo sapiens
caggctggccagtccaggc

SEQ ID NO: 3455258 - DNA, 15 bp, Homo sapiens
caggctggcgtgcag

SEQ ID NO: 3455259 - DNA, 19 bp, Homo sapiens
caggctggcgtgcagtggt

SEQ ID NO: 3455260 - DNA, 16 bp, Homo sapiens
caggctggctccagat

SEQ ID NO: 3455261 - DNA, 20 bp, Homo sapiens
caggctggctccagatgcag

SEQ ID NO: 3455262 - DNA, 14 bp, Homo sapiens
caggctgggcttca

SEQ ID NO: 3455263 - DNA, 20 bp, Homo sapiens
caggctgggcttcagtggca

SEQ ID NO: 3455264 - DNA, 21 bp, Homo sapiens
caggctgggcttcagtggcag

SEQ ID NO: 3455265 - DNA, 23 bp, Homo sapiens
caggctgggcttcagtggcagct

SEQ ID NO: 3455266 - DNA, 21 bp, Homo sapiens
caggctgtatcccatgagcct

SEQ ID NO: 3455267 - DNA, 17 bp, Homo sapiens
caggctgtgactcttct

SEQ ID NO: 3455268 - DNA, 18 bp, Homo sapiens
caggcttgtcactagcag

SEQ ID NO: 3455269 - DNA, 21 bp, Homo sapiens
caggcttgtcactagcagctg

SEQ ID NO: 3455270 - DNA, 20 bp, Homo sapiens
cagggaaaattatttgcata

SEQ ID NO: 3455271 - DNA, 18 bp, Homo sapiens
cagggaaatggccttccc

SEQ ID NO: 3455272 - DNA, 14 bp, Homo sapiens
cagggaagtcccca

SEQ ID NO: 3455273 - DNA, 17 bp, Homo sapiens
cagggaagtccccaggc

SEQ ID NO: 3455274 - DNA, 16 bp, Homo sapiens
cagggacagaggcccc

SEQ ID NO: 3455275 - DNA, 19 bp, Homo sapiens
cagggacagaggccccagc

SEQ ID NO: 3455276 - DNA, 21 bp, Homo sapiens
cagggacagaggccccagcct

SEQ ID NO: 3455277 - DNA, 16 bp, Homo sapiens
cagggacccctgccct

SEQ ID NO: 3455278 - DNA, 14 bp, Homo sapiens
cagggacttgaagt

SEQ ID NO: 3455279 - DNA, 15 bp, Homo sapiens
cagggacttgaagtt

SEQ ID NO: 3455280 - DNA, 19 bp, Homo sapiens
cagggacttgaagttgtta

SEQ ID NO: 3455281 - DNA, 13 bp, Homo sapiens
cagggagaagctc

SEQ ID NO: 3455282 - DNA, 12 bp, Homo sapiens
cagggagacaag

SEQ ID NO: 3455283 - DNA, 21 bp, Homo sapiens
cagggagacctggacacaggc

SEQ ID NO: 3455284 - DNA, 13 bp, Homo sapiens
cagggagcggaaa

SEQ ID NO: 3455285 - DNA, 16 bp, Homo sapiens
cagggagcggaaagca

SEQ ID NO: 3455286 - DNA, 17 bp, Homo sapiens
cagggagcggaaagcag

SEQ ID NO: 3455287 - DNA, 19 bp, Homo sapiens
cagggagcggccggccagc

SEQ ID NO: 3455288 - DNA, 16 bp, Homo sapiens
cagggagggcttctgc

SEQ ID NO: 3455289 - DNA, 12 bp, Homo sapiens
cagggatgagca

SEQ ID NO: 3455290 - DNA, 19 bp, Homo sapiens
cagggatttgcctcacctt

SEQ ID NO: 3455291 - DNA, 13 bp, Homo sapiens
cagggcaagctcc

SEQ ID NO: 3455292 - DNA, 15 bp, Homo sapiens
cagggcaagctccgc

SEQ ID NO: 3455293 - DNA, 21 bp, Homo sapiens
cagggcaagctccgcaggact

SEQ ID NO: 3455294 - DNA, 21 bp, Homo sapiens
cagggcacaccgggcactcag

SEQ ID NO: 3455295 - DNA, 19 bp, Homo sapiens
cagggcagagtgagaccca

SEQ ID NO: 3455296 - DNA, 22 bp, Homo sapiens
cagggccaaacgctgagccacc

SEQ ID NO: 3455297 - DNA, 17 bp, Homo sapiens
cagggccacgctccagc

SEQ ID NO: 3455298 - DNA, 16 bp, Homo sapiens
cagggccatgctgagg

SEQ ID NO: 3455299 - DNA, 23 bp, Homo sapiens
cagggccatgctgaggcctgggc

SEQ ID NO: 3455300 - DNA, 13 bp, Homo sapiens
cagggcccagagc

SEQ ID NO: 3455301 - DNA, 15 bp, Homo sapiens
cagggcccagagccc

SEQ ID NO: 3455302 - DNA, 16 bp, Homo sapiens
cagggcccagagccca

SEQ ID NO: 3455303 - DNA, 18 bp, Homo sapiens
cagggcccagagcccagc

SEQ ID NO: 3455304 - DNA, 21 bp, Homo sapiens
cagggcccagagcccagctcc

SEQ ID NO: 3455305 - DNA, 17 bp, Homo sapiens
cagggcccccacaggcc

SEQ ID NO: 3455306 - DNA, 21 bp, Homo sapiens
cagggcctgagcctggccagc

SEQ ID NO: 3455307 - DNA, 19 bp, Homo sapiens
cagggcctggaagacagag

SEQ ID NO: 3455308 - DNA, 13 bp, Homo sapiens
cagggcctggttg

SEQ ID NO: 3455309 - DNA, 18 bp, Homo sapiens
cagggcctggttgaagaa

SEQ ID NO: 3455310 - DNA, 19 bp, Homo sapiens
cagggcgggcagagggctg

SEQ ID NO: 3455311 - DNA, 23 bp, Homo sapiens
cagggctaccctgagctgaggca

SEQ ID NO: 3455312 - DNA, 23 bp, Homo sapiens
cagggctcagcggggacagctcc

SEQ ID NO: 3455313 - DNA, 11 bp, Homo sapiens
cagggctcctg

SEQ ID NO: 3455314 - DNA, 15 bp, Homo sapiens
cagggctctgaccag

SEQ ID NO: 3455315 - DNA, 18 bp, Homo sapiens
cagggctgctagacggag

SEQ ID NO: 3455316 - DNA, 14 bp, Homo sapiens
cagggctggactga

SEQ ID NO: 3455317 - DNA, 15 bp, Homo sapiens
cagggctggactgag

SEQ ID NO: 3455318 - DNA, 19 bp, Homo sapiens
caggggaaaatcagcctgc

SEQ ID NO: 3455319 - DNA, 16 bp, Homo sapiens
caggggacaggagtcc

SEQ ID NO: 3455320 - DNA, 16 bp, Homo sapiens
caggggctgcttcctc

SEQ ID NO: 3455321 - DNA, 18 bp, Homo sapiens
caggggctgcttcctcct

SEQ ID NO: 3455322 - DNA, 18 bp, Homo sapiens
cagggggacctaggctcc

SEQ ID NO: 3455323 - DNA, 20 bp, Homo sapiens
cagggggacctaggctcctc

SEQ ID NO: 3455324 - DNA, 15 bp, Homo sapiens
caggggggtgaggag

SEQ ID NO: 3455325 - DNA, 13 bp, Homo sapiens
caggggtctggga

SEQ ID NO: 3455326 - DNA, 22 bp, Homo sapiens
caggggtggctgcctcatttag

SEQ ID NO: 3455327 - DNA, 21 bp, Homo sapiens
cagggtattccagagtgggga

SEQ ID NO: 3455328 - DNA, 18 bp, Homo sapiens
cagggtcagaaacaggac

SEQ ID NO: 3455329 - DNA, 13 bp, Homo sapiens
cagggtccctctg

SEQ ID NO: 3455330 - DNA, 15 bp, Homo sapiens
cagggtccctctgtg

SEQ ID NO: 3455331 - DNA, 23 bp, Homo sapiens
cagggtctcactatgttgcccag

SEQ ID NO: 3455332 - DNA, 23 bp, Homo sapiens
cagggtctcactctgtcgcccag

SEQ ID NO: 3455333 - DNA, 17 bp, Homo sapiens
cagggtctctgctgccg

SEQ ID NO: 3455334 - DNA, 18 bp, Homo sapiens
cagggtctctgctgccgc

SEQ ID NO: 3455335 - DNA, 14 bp, Homo sapiens
cagggtctgcctcc

SEQ ID NO: 3455336 - DNA, 13 bp, Homo sapiens
cagggtgtgtgct

SEQ ID NO: 3455337 - DNA, 19 bp, Homo sapiens
cagggttgaccccagagga

SEQ ID NO: 3455338 - DNA, 16 bp, Homo sapiens
cagggttggcccctgc

SEQ ID NO: 3455339 - DNA, 21 bp, Homo sapiens
cagggttggcccctgcccggc

SEQ ID NO: 3455340 - DNA, 21 bp, Homo sapiens
cagggtttggctgtgtctaaa

SEQ ID NO: 3455341 - DNA, 22 bp, Homo sapiens
cagggtttggctgtgtctaaac

SEQ ID NO: 3455342 - DNA, 16 bp, Homo sapiens
caggtaacaggcagat

SEQ ID NO: 3455343 - DNA, 15 bp, Homo sapiens
caggtagcctgctgg

SEQ ID NO: 3455344 - DNA, 21 bp, Homo sapiens
caggtagctgcccctggctct

SEQ ID NO: 3455345 - DNA, 16 bp, Homo sapiens
caggtccaggctgtgt

SEQ ID NO: 3455346 - DNA, 17 bp, Homo sapiens
caggtctctccactgct

SEQ ID NO: 3455347 - DNA, 23 bp, Homo sapiens
caggtctctccactgctctcagc

SEQ ID NO: 3455348 - DNA, 18 bp, Homo sapiens
caggtcttgaactcctgg

SEQ ID NO: 3455349 - DNA, 20 bp, Homo sapiens
caggtcttgaactcctggcc

SEQ ID NO: 3455350 - DNA, 23 bp, Homo sapiens
caggtcttgaactcctggcctca

SEQ ID NO: 3455351 - DNA, 13 bp, Homo sapiens
caggtctttccta

SEQ ID NO: 3455352 - DNA, 16 bp, Homo sapiens
caggtgaaacccagtc

SEQ ID NO: 3455353 - DNA, 13 bp, Homo sapiens
caggtgagaagca

SEQ ID NO: 3455354 - DNA, 14 bp, Homo sapiens
caggtgagcagaca

SEQ ID NO: 3455355 - DNA, 15 bp, Homo sapiens
caggtgagcccatgg

SEQ ID NO: 3455356 - DNA, 23 bp, Homo sapiens
caggtgagtcctagagctacagg

SEQ ID NO: 3455357 - DNA, 17 bp, Homo sapiens
caggtgatccacccacc

SEQ ID NO: 3455358 - DNA, 15 bp, Homo sapiens
caggtgcagaggaag

SEQ ID NO: 3455359 - DNA, 15 bp, Homo sapiens
caggtgcagccagag

SEQ ID NO: 3455360 - DNA, 14 bp, Homo sapiens
caggtgcctttcaa

SEQ ID NO: 3455361 - DNA, 15 bp, Homo sapiens
caggtgcctttcaaa

SEQ ID NO: 3455362 - DNA, 17 bp, Homo sapiens
caggtgcctttcaaatt

SEQ ID NO: 3455363 - DNA, 14 bp, Homo sapiens
caggtgcgaaagga

SEQ ID NO: 3455364 - DNA, 20 bp, Homo sapiens
caggtgctgacttcatctcc

SEQ ID NO: 3455365 - DNA, 14 bp, Homo sapiens
caggtgctgccatc

SEQ ID NO: 3455366 - DNA, 21 bp, Homo sapiens
caggtgctggagcactgggct

SEQ ID NO: 3455367 - DNA, 22 bp, Homo sapiens
caggtgctggagcactgggctc

SEQ ID NO: 3455368 - DNA, 14 bp, Homo sapiens
caggtgctggtccc

SEQ ID NO: 3455369 - DNA, 18 bp, Homo sapiens
caggtggatcacctgacg

SEQ ID NO: 3455370 - DNA, 19 bp, Homo sapiens
caggtgggcttcccagtgg

SEQ ID NO: 3455371 - DNA, 19 bp, Homo sapiens
caggtggggagactgggct

SEQ ID NO: 3455372 - DNA, 23 bp, Homo sapiens
caggtggggagactgggctgagg

SEQ ID NO: 3455373 - DNA, 14 bp, Homo sapiens
caggtggggcagct

SEQ ID NO: 3455374 - DNA, 15 bp, Homo sapiens
caggtggggcagctt

SEQ ID NO: 3455375 - DNA, 17 bp, Homo sapiens
caggtgggggttgctgt

SEQ ID NO: 3455376 - DNA, 22 bp, Homo sapiens
caggtgggtcccggctctgtgg

SEQ ID NO: 3455377 - DNA, 16 bp, Homo sapiens
caggtgtgaaccacca

SEQ ID NO: 3455378 - DNA, 22 bp, Homo sapiens
caggtgtgaaccaccacaccca

SEQ ID NO: 3455379 - DNA, 23 bp, Homo sapiens
caggtgtgaaccaccacacccag

SEQ ID NO: 3455380 - DNA, 19 bp, Homo sapiens
caggtgtgccgacagaagg

SEQ ID NO: 3455381 - DNA, 17 bp, Homo sapiens
caggttcaacccacagc

SEQ ID NO: 3455382 - DNA, 13 bp, Homo sapiens
caggttcatggat

SEQ ID NO: 3455383 - DNA, 24 bp, Homo sapiens
caggttctccgttagctcctgtgg

SEQ ID NO: 3455384 - DNA, 15 bp, Homo sapiens
caggttctgcctgct

SEQ ID NO: 3455385 - DNA, 16 bp, Homo sapiens
caggtttaagctgtta

SEQ ID NO: 3455386 - DNA, 15 bp, Homo sapiens
caggttttgtaaaga

SEQ ID NO: 3455387 - DNA, 23 bp, Homo sapiens
caggttttgttttttttcagcca

SEQ ID NO: 3455388 - DNA, 23 bp, Homo sapiens
cagtaccttcaaactagggccaa

SEQ ID NO: 3455389 - DNA, 20 bp, Homo sapiens
cagtactattttaatttgta

SEQ ID NO: 3455390 - DNA, 20 bp, Homo sapiens
cagtactttggaggccccta

SEQ ID NO: 3455391 - DNA, 21 bp, Homo sapiens
cagtacttttttaaatatttt

SEQ ID NO: 3455392 - DNA, 12 bp, Homo sapiens
cagtagacaagc

SEQ ID NO: 3455393 - DNA, 15 bp, Homo sapiens
cagtaggagcccagc

SEQ ID NO: 3455394 - DNA, 21 bp, Homo sapiens
cagtaggagcccagctctgaa

SEQ ID NO: 3455395 - DNA, 16 bp, Homo sapiens
cagtagtttgagacca

SEQ ID NO: 3455396 - DNA, 20 bp, Homo sapiens
cagtagtttgagaccagcct

SEQ ID NO: 3455397 - DNA, 14 bp, Homo sapiens
cagtataaacaaag

SEQ ID NO: 3455398 - DNA, 19 bp, Homo sapiens
cagtatcaaggctgacttg

SEQ ID NO: 3455399 - DNA, 14 bp, Homo sapiens
cagtatcactgtct

SEQ ID NO: 3455400 - DNA, 22 bp, Homo sapiens
cagtatcactgtctttcctaga

SEQ ID NO: 3455401 - DNA, 15 bp, Homo sapiens
cagtatcatattatt

SEQ ID NO: 3455402 - DNA, 13 bp, Homo sapiens
cagtatcatgccc

SEQ ID NO: 3455403 - DNA, 17 bp, Homo sapiens
cagtatcatgccctgtg

SEQ ID NO: 3455404 - DNA, 19 bp, Homo sapiens
cagtatcatgccctgtgca

SEQ ID NO: 3455405 - DNA, 20 bp, Homo sapiens
cagtatcatgccctgtgcaa

SEQ ID NO: 3455406 - DNA, 15 bp, Homo sapiens
cagtatgacagagga

SEQ ID NO: 3455407 - DNA, 17 bp, Homo sapiens
cagtatgcttgctctaa

SEQ ID NO: 3455408 - DNA, 18 bp, Homo sapiens
cagtatggtacatttttc

SEQ ID NO: 3455409 - DNA, 19 bp, Homo sapiens
cagtatgtgggggcttcat

SEQ ID NO: 3455410 - DNA, 18 bp, Homo sapiens
cagtattttgtgtcctcc

SEQ ID NO: 3455411 - DNA, 20 bp, Homo sapiens
cagtatttttgctgcttctg

SEQ ID NO: 3455412 - DNA, 17 bp, Homo sapiens
cagtcaaatctgggctc

SEQ ID NO: 3455413 - DNA, 15 bp, Homo sapiens
cagtcaacaagcctg

SEQ ID NO: 3455414 - DNA, 20 bp, Homo sapiens
cagtcaacagttcaaagaag

SEQ ID NO: 3455415 - DNA, 14 bp, Homo sapiens
cagtcaagaagaaa

SEQ ID NO: 3455416 - DNA, 12 bp, Homo sapiens
cagtcacagcca

SEQ ID NO: 3455417 - DNA, 12 bp, Homo sapiens
cagtcaccccag

SEQ ID NO: 3455418 - DNA, 17 bp, Homo sapiens
cagtcaccccaggactc

SEQ ID NO: 3455419 - DNA, 23 bp, Homo sapiens
cagtcacttcggccagagctgaa

SEQ ID NO: 3455420 - DNA, 23 bp, Homo sapiens
cagtcagatttccagtctccacc

SEQ ID NO: 3455421 - DNA, 19 bp, Homo sapiens
cagtcagtgctggagaaat

SEQ ID NO: 3455422 - DNA, 21 bp, Homo sapiens
cagtcatcttgaccaagcagg

SEQ ID NO: 3455423 - DNA, 24 bp, Homo sapiens
cagtcatcttgaccaagcaggaag

SEQ ID NO: 3455424 - DNA, 22 bp, Homo sapiens
cagtcattcagcagcaaatttt

SEQ ID NO: 3455425 - DNA, 23 bp, Homo sapiens
cagtccaaggaaaccacagctgc

SEQ ID NO: 3455426 - DNA, 14 bp, Homo sapiens
cagtccagccagct

SEQ ID NO: 3455427 - DNA, 15 bp, Homo sapiens
cagtccagccagctc

SEQ ID NO: 3455428 - DNA, 15 bp, Homo sapiens
cagtccagcctggag

SEQ ID NO: 3455429 - DNA, 16 bp, Homo sapiens
cagtccagcctggaga

SEQ ID NO: 3455430 - DNA, 18 bp, Homo sapiens
cagtccaggctgccgtgg

SEQ ID NO: 3455431 - DNA, 22 bp, Homo sapiens
cagtccccattttctggtaagg

SEQ ID NO: 3455432 - DNA, 20 bp, Homo sapiens
cagtccccccaccctcattc

SEQ ID NO: 3455433 - DNA, 18 bp, Homo sapiens
cagtccgcctggccggct

SEQ ID NO: 3455434 - DNA, 18 bp, Homo sapiens
cagtcctgccaccaccct

SEQ ID NO: 3455435 - DNA, 22 bp, Homo sapiens
cagtcctgccaccaccctgtct

SEQ ID NO: 3455436 - DNA, 23 bp, Homo sapiens
cagtcctggagcaatcacagatg

SEQ ID NO: 3455437 - DNA, 15 bp, Homo sapiens
cagtccttaaaaatc

SEQ ID NO: 3455438 - DNA, 16 bp, Homo sapiens
cagtcgatagagctgt

SEQ ID NO: 3455439 - DNA, 17 bp, Homo sapiens
cagtctccaccaggaac

SEQ ID NO: 3455440 - DNA, 14 bp, Homo sapiens
cagtctcctctcca

SEQ ID NO: 3455441 - DNA, 12 bp, Homo sapiens
cagtctctgagc

SEQ ID NO: 3455442 - DNA, 13 bp, Homo sapiens
cagtctctgcctt

SEQ ID NO: 3455443 - DNA, 18 bp, Homo sapiens
cagtctctttattttact

SEQ ID NO: 3455444 - DNA, 20 bp, Homo sapiens
cagtctctttattttactag

SEQ ID NO: 3455445 - DNA, 22 bp, Homo sapiens
cagtctgatgagaactctgagc

SEQ ID NO: 3455446 - DNA, 20 bp, Homo sapiens
cagtctgattcccaagctct

SEQ ID NO: 3455447 - DNA, 15 bp, Homo sapiens
cagtctggaatgcag

SEQ ID NO: 3455448 - DNA, 18 bp, Homo sapiens
cagtctggaatgcagtgg

SEQ ID NO: 3455449 - DNA, 15 bp, Homo sapiens
cagtctgtggatcag

SEQ ID NO: 3455450 - DNA, 16 bp, Homo sapiens
cagtcttccacaaaga

SEQ ID NO: 3455451 - DNA, 17 bp, Homo sapiens
cagtcttccacaaagaa

SEQ ID NO: 3455452 - DNA, 18 bp, Homo sapiens
cagtcttccacaaagaaa

SEQ ID NO: 3455453 - DNA, 21 bp, Homo sapiens
cagtcttccacaaagaaaatt

SEQ ID NO: 3455454 - DNA, 15 bp, Homo sapiens
cagtcttccatttgc

SEQ ID NO: 3455455 - DNA, 18 bp, Homo sapiens
cagtcttccatttgcaag

SEQ ID NO: 3455456 - DNA, 18 bp, Homo sapiens
cagtctttcatgtgtgcc

SEQ ID NO: 3455457 - DNA, 13 bp, Homo sapiens
cagtgaagacaga

SEQ ID NO: 3455458 - DNA, 15 bp, Homo sapiens
cagtgaagacagaag

SEQ ID NO: 3455459 - DNA, 16 bp, Homo sapiens
cagtgaagacagaagt

SEQ ID NO: 3455460 - DNA, 20 bp, Homo sapiens
cagtgaatgattcagtgtta

SEQ ID NO: 3455461 - DNA, 16 bp, Homo sapiens
cagtgaatttttgcaa

SEQ ID NO: 3455462 - DNA, 18 bp, Homo sapiens
cagtgaatttttgcaata

SEQ ID NO: 3455463 - DNA, 17 bp, Homo sapiens
cagtgacacgtctcgcc

SEQ ID NO: 3455464 - DNA, 16 bp, Homo sapiens
cagtgacctgaggaag

SEQ ID NO: 3455465 - DNA, 13 bp, Homo sapiens
cagtgagccactc

SEQ ID NO: 3455466 - DNA, 21 bp, Homo sapiens
cagtgagggagggctgtcatc

SEQ ID NO: 3455467 - DNA, 23 bp, Homo sapiens
cagtgagtcgaggacagggaggt

SEQ ID NO: 3455468 - DNA, 22 bp, Homo sapiens
cagtgcagcatatacaataatg

SEQ ID NO: 3455469 - DNA, 15 bp, Homo sapiens
cagtgcccacaggat

SEQ ID NO: 3455470 - DNA, 21 bp, Homo sapiens
cagtgcccacaggatcagtct

SEQ ID NO: 3455471 - DNA, 12 bp, Homo sapiens
cagtgcccccac

SEQ ID NO: 3455472 - DNA, 15 bp, Homo sapiens
cagtgcccccactga

SEQ ID NO: 3455473 - DNA, 17 bp, Homo sapiens
cagtgcccccactgacc

SEQ ID NO: 3455474 - DNA, 20 bp, Homo sapiens
cagtgcccccactgaccaga

SEQ ID NO: 3455475 - DNA, 15 bp, Homo sapiens
cagtgccgagaagga

SEQ ID NO: 3455476 - DNA, 12 bp, Homo sapiens
cagtgcctgcct

SEQ ID NO: 3455477 - DNA, 15 bp, Homo sapiens
cagtgctcgctgttg

SEQ ID NO: 3455478 - DNA, 22 bp, Homo sapiens
cagtgctcgctgttgctgaata

SEQ ID NO: 3455479 - DNA, 19 bp, Homo sapiens
cagtgctgtgctgtgctat

SEQ ID NO: 3455480 - DNA, 12 bp, Homo sapiens
cagtgctgtgtg

SEQ ID NO: 3455481 - DNA, 17 bp, Homo sapiens
cagtgcttgccacagag

SEQ ID NO: 3455482 - DNA, 22 bp, Homo sapiens
cagtggactcagaaagccaaca

SEQ ID NO: 3455483 - DNA, 14 bp, Homo sapiens
cagtggcagctgct

SEQ ID NO: 3455484 - DNA, 15 bp, Homo sapiens
cagtggcagctgctt

SEQ ID NO: 3455485 - DNA, 17 bp, Homo sapiens
cagtgggaactggaggg

SEQ ID NO: 3455486 - DNA, 18 bp, Homo sapiens
cagtgggagctgcctgtt

SEQ ID NO: 3455487 - DNA, 19 bp, Homo sapiens
cagtggggctctctgagtc

SEQ ID NO: 3455488 - DNA, 20 bp, Homo sapiens
cagtggggctctctgagtcc

SEQ ID NO: 3455489 - DNA, 20 bp, Homo sapiens
cagtggggtttcgcagcctg

SEQ ID NO: 3455490 - DNA, 15 bp, Homo sapiens
cagtgggtaaaatta

SEQ ID NO: 3455491 - DNA, 13 bp, Homo sapiens
cagtggtctcaca

SEQ ID NO: 3455492 - DNA, 19 bp, Homo sapiens
cagtggtgcgatctgggtt

SEQ ID NO: 3455493 - DNA, 14 bp, Homo sapiens
cagtggttatttag

SEQ ID NO: 3455494 - DNA, 19 bp, Homo sapiens
cagtgtaaatagttactcc

SEQ ID NO: 3455495 - DNA, 22 bp, Homo sapiens
cagtgtccaaagcagggtctgg

SEQ ID NO: 3455496 - DNA, 16 bp, Homo sapiens
cagtgtctgtgtgtgt

SEQ ID NO: 3455497 - DNA, 17 bp, Homo sapiens
cagtgtgaggccagggc

SEQ ID NO: 3455498 - DNA, 14 bp, Homo sapiens
cagtgtgctgatgg

SEQ ID NO: 3455499 - DNA, 12 bp, Homo sapiens
cagtgtgggaca

SEQ ID NO: 3455500 - DNA, 16 bp, Homo sapiens
cagtgtgggacaggct

SEQ ID NO: 3455501 - DNA, 18 bp, Homo sapiens
cagtgtgggacaggctct

SEQ ID NO: 3455502 - DNA, 22 bp, Homo sapiens
cagtgtgggacaggctcttctt

SEQ ID NO: 3455503 - DNA, 14 bp, Homo sapiens
cagtgttacctgtg

SEQ ID NO: 3455504 - DNA, 19 bp, Homo sapiens
cagtgttacctgtgtgctt

SEQ ID NO: 3455505 - DNA, 19 bp, Homo sapiens
cagtgttagggaagggcct

SEQ ID NO: 3455506 - DNA, 18 bp, Homo sapiens
cagtgttttctttgagga

SEQ ID NO: 3455507 - DNA, 20 bp, Homo sapiens
cagtgttttggactccatct

SEQ ID NO: 3455508 - DNA, 13 bp, Homo sapiens
cagttactctgaa

SEQ ID NO: 3455509 - DNA, 16 bp, Homo sapiens
cagttactctgaaggg

SEQ ID NO: 3455510 - DNA, 14 bp, Homo sapiens
cagttatcaaaaag

SEQ ID NO: 3455511 - DNA, 20 bp, Homo sapiens
cagttattggtggaatcttt

SEQ ID NO: 3455512 - DNA, 23 bp, Homo sapiens
cagttcagaatcacttctgagaa

SEQ ID NO: 3455513 - DNA, 21 bp, Homo sapiens
cagttcatccgcactgtaaat

SEQ ID NO: 3455514 - DNA, 21 bp, Homo sapiens
cagttcctatgacacagttat

SEQ ID NO: 3455515 - DNA, 18 bp, Homo sapiens
cagttcgcctggagccct

SEQ ID NO: 3455516 - DNA, 12 bp, Homo sapiens
cagttctgatgc

SEQ ID NO: 3455517 - DNA, 18 bp, Homo sapiens
cagttctgtcatatgtta

SEQ ID NO: 3455518 - DNA, 17 bp, Homo sapiens
cagttctttgggccaga

SEQ ID NO: 3455519 - DNA, 21 bp, Homo sapiens
cagttctttgggccagacatg

SEQ ID NO: 3455520 - DNA, 19 bp, Homo sapiens
cagttgaagggaggggctg

SEQ ID NO: 3455521 - DNA, 22 bp, Homo sapiens
cagttgaccctattttttgaca

SEQ ID NO: 3455522 - DNA, 17 bp, Homo sapiens
cagttggccagagagcc

SEQ ID NO: 3455523 - DNA, 17 bp, Homo sapiens
cagttgggtgagaacaa

SEQ ID NO: 3455524 - DNA, 19 bp, Homo sapiens
cagttgggtggatgcctgg

SEQ ID NO: 3455525 - DNA, 20 bp, Homo sapiens
cagtttaagagcagaacaga

SEQ ID NO: 3455526 - DNA, 20 bp, Homo sapiens
cagtttatttccactatttt

SEQ ID NO: 3455527 - DNA, 22 bp, Homo sapiens
cagtttatttccactattttca

SEQ ID NO: 3455528 - DNA, 18 bp, Homo sapiens
cagtttatttttaaagat

SEQ ID NO: 3455529 - DNA, 14 bp, Homo sapiens
cagtttcagagatg

SEQ ID NO: 3455530 - DNA, 17 bp, Homo sapiens
cagtttcagagatggac

SEQ ID NO: 3455531 - DNA, 15 bp, Homo sapiens
cagtttctgtcctgc

SEQ ID NO: 3455532 - DNA, 13 bp, Homo sapiens
cagtttgaaattc

SEQ ID NO: 3455533 - DNA, 22 bp, Homo sapiens
cagtttgaaattctgaatttgc

SEQ ID NO: 3455534 - DNA, 24 bp, Homo sapiens
cagtttgaatgcagtctgtccagg

SEQ ID NO: 3455535 - DNA, 17 bp, Homo sapiens
cagttttatccataatg

SEQ ID NO: 3455536 - DNA, 23 bp, Homo sapiens
cagttttcaagtcaaattaataa

SEQ ID NO: 3455537 - DNA, 13 bp, Homo sapiens
cagttttccattg

SEQ ID NO: 3455538 - DNA, 12 bp, Homo sapiens
cataaaacaggt

SEQ ID NO: 3455539 - DNA, 16 bp, Homo sapiens
cataaaacattaagaa

SEQ ID NO: 3455540 - DNA, 23 bp, Homo sapiens
cataaaacattaagaaaatcata

SEQ ID NO: 3455541 - DNA, 14 bp, Homo sapiens
cataaacttttgca

SEQ ID NO: 3455542 - DNA, 22 bp, Homo sapiens
cataaagaggcgttgctttcac

SEQ ID NO: 3455543 - DNA, 17 bp, Homo sapiens
cataacaattcctctac

SEQ ID NO: 3455544 - DNA, 21 bp, Homo sapiens
cataacggatcagaaatacag

SEQ ID NO: 3455545 - DNA, 13 bp, Homo sapiens
cataacttcctgt

SEQ ID NO: 3455546 - DNA, 14 bp, Homo sapiens
cataacttcctgta

SEQ ID NO: 3455547 - DNA, 23 bp, Homo sapiens
cataacttcctgtacttgaagtc

SEQ ID NO: 3455548 - DNA, 21 bp, Homo sapiens
cataaggccagtatgatttat

SEQ ID NO: 3455549 - DNA, 11 bp, Homo sapiens
cataaggtttt

SEQ ID NO: 3455550 - DNA, 18 bp, Homo sapiens
cataagtacctcagcatt

SEQ ID NO: 3455551 - DNA, 23 bp, Homo sapiens
cataagttggaccagaggaagcc

SEQ ID NO: 3455552 - DNA, 23 bp, Homo sapiens
cataataaacgatgttgtgatgt

SEQ ID NO: 3455553 - DNA, 14 bp, Homo sapiens
cataataaaggttg

SEQ ID NO: 3455554 - DNA, 16 bp, Homo sapiens
cataataaaggttgtg

SEQ ID NO: 3455555 - DNA, 20 bp, Homo sapiens
cataataaaggttgtgaatg

SEQ ID NO: 3455556 - DNA, 15 bp, Homo sapiens
cagagaccaggctgt

SEQ ID NO: 3455557 - DNA, 14 bp, Homo sapiens
cagagacccagatc

SEQ ID NO: 3455558 - DNA, 19 bp, Homo sapiens
cagagacccagatctcatg

SEQ ID NO: 3455559 - DNA, 16 bp, Homo sapiens
cagagacctcctgcct

SEQ ID NO: 3455560 - DNA, 19 bp, Homo sapiens
cagagagaatgagagcgac

SEQ ID NO: 3455561 - DNA, 18 bp, Homo sapiens
cagagagagcaaggaagc

SEQ ID NO: 3455562 - DNA, 18 bp, Homo sapiens
cagagaggactgtaggga

SEQ ID NO: 3455563 - DNA, 20 bp, Homo sapiens
cagagagggtggtgacctct

SEQ ID NO: 3455564 - DNA, 22 bp, Homo sapiens
cagagagggtggtgacctctgc

SEQ ID NO: 3455565 - DNA, 22 bp, Homo sapiens
cagagatagtggggagacttct

SEQ ID NO: 3455566 - DNA, 20 bp, Homo sapiens
cagagatccaaaagaagccc

SEQ ID NO: 3455567 - DNA, 20 bp, Homo sapiens
cagagatgcaccaccaagcc

SEQ ID NO: 3455568 - DNA, 15 bp, Homo sapiens
cagagatggacagag

SEQ ID NO: 3455569 - DNA, 20 bp, Homo sapiens
cagagcaagactctgtctca

SEQ ID NO: 3455570 - DNA, 15 bp, Homo sapiens
cagagcacacaggta

SEQ ID NO: 3455571 - DNA, 18 bp, Homo sapiens
cagagcacccagatcaga

SEQ ID NO: 3455572 - DNA, 20 bp, Homo sapiens
cagagccaaggggcttcagg

SEQ ID NO: 3455573 - DNA, 24 bp, Homo sapiens
cagagccacagggtctgcctccag

SEQ ID NO: 3455574 - DNA, 23 bp, Homo sapiens
cagagccaggggggtgaggagct

SEQ ID NO: 3455575 - DNA, 15 bp, Homo sapiens
cagagcccggagctc

SEQ ID NO: 3455576 - DNA, 14 bp, Homo sapiens
cagagcctgcagtt

SEQ ID NO: 3455577 - DNA, 17 bp, Homo sapiens
cagagcctgtctttcag

SEQ ID NO: 3455578 - DNA, 18 bp, Homo sapiens
cagagctaaactccttcc

SEQ ID NO: 3455579 - DNA, 14 bp, Homo sapiens
cagagctgacacag

SEQ ID NO: 3455580 - DNA, 15 bp, Homo sapiens
cagagctgacacagg

SEQ ID NO: 3455581 - DNA, 14 bp, Homo sapiens
cagagctggccagg

SEQ ID NO: 3455582 - DNA, 18 bp, Homo sapiens
cagagctggctctgagcg

SEQ ID NO: 3455583 - DNA, 18 bp, Homo sapiens
cagagcttccctgactca

SEQ ID NO: 3455584 - DNA, 15 bp, Homo sapiens
cagagcttttcagat

SEQ ID NO: 3455585 - DNA, 15 bp, Homo sapiens
cagaggaagcccctt

SEQ ID NO: 3455586 - DNA, 16 bp, Homo sapiens
cagaggaaggggccag

SEQ ID NO: 3455587 - DNA, 21 bp, Homo sapiens
cagaggaaggggccagaggct

SEQ ID NO: 3455588 - DNA, 21 bp, Homo sapiens
cagaggactgtgatgccctgc

SEQ ID NO: 3455589 - DNA, 21 bp, Homo sapiens
cagaggagagatagcctgtgg

SEQ ID NO: 3455590 - DNA, 21 bp, Homo sapiens
cagaggaggatgtaaggcctt

SEQ ID NO: 3455591 - DNA, 14 bp, Homo sapiens
cagaggagggcagc

SEQ ID NO: 3455592 - DNA, 22 bp, Homo sapiens
cagaggagggcagcagaagggg

SEQ ID NO: 3455593 - DNA, 17 bp, Homo sapiens
cagaggagtacaggtga

SEQ ID NO: 3455594 - DNA, 21 bp, Homo sapiens
cagaggatgagctctacccag

SEQ ID NO: 3455595 - DNA, 23 bp, Homo sapiens
cagaggatgagctctacccaggg

SEQ ID NO: 3455596 - DNA, 11 bp, Homo sapiens
cagaggcagcc

SEQ ID NO: 3455597 - DNA, 12 bp, Homo sapiens
cagaggcagccc

SEQ ID NO: 3455598 - DNA, 15 bp, Homo sapiens
cagaggcagccccat

SEQ ID NO: 3455599 - DNA, 18 bp, Homo sapiens
cagaggcagccccattct

SEQ ID NO: 3455600 - DNA, 20 bp, Homo sapiens
cagaggcagccccattctgc

SEQ ID NO: 3455601 - DNA, 22 bp, Homo sapiens
cagaggcagccccattctgcct

SEQ ID NO: 3455602 - DNA, 20 bp, Homo sapiens
cagaggccatgggcctcctg

SEQ ID NO: 3455603 - DNA, 16 bp, Homo sapiens
cagaggccccagcctc

SEQ ID NO: 3455604 - DNA, 17 bp, Homo sapiens
cagaggccccagcctcc

SEQ ID NO: 3455605 - DNA, 21 bp, Homo sapiens
cagaggcctcttttcctgaag

SEQ ID NO: 3455606 - DNA, 17 bp, Homo sapiens
cagaggcgcactgtgac

SEQ ID NO: 3455607 - DNA, 12 bp, Homo sapiens
cagaggctgggt

SEQ ID NO: 3455608 - DNA, 19 bp, Homo sapiens
cagagggagtgacagaggc

SEQ ID NO: 3455609 - DNA, 20 bp, Homo sapiens
cagagggagtgacagaggca

SEQ ID NO: 3455610 - DNA, 11 bp, Homo sapiens
cagagggctgg

SEQ ID NO: 3455611 - DNA, 12 bp, Homo sapiens
cagagggctgga

SEQ ID NO: 3455612 - DNA, 13 bp, Homo sapiens
cagagggctggag

SEQ ID NO: 3455613 - DNA, 19 bp, Homo sapiens
cagagggctggaggcccag

SEQ ID NO: 3455614 - DNA, 20 bp, Homo sapiens
cagagggctggaggcccagg

SEQ ID NO: 3455615 - DNA, 21 bp, Homo sapiens
cagaggtgcttcaccctgagt

SEQ ID NO: 3455616 - DNA, 21 bp, Homo sapiens
cagagtcacacgggggcagct

SEQ ID NO: 3455617 - DNA, 17 bp, Homo sapiens
cagagtctcactgttgc

SEQ ID NO: 3455618 - DNA, 21 bp, Homo sapiens
cagagtctcactgttgcccag

SEQ ID NO: 3455619 - DNA, 23 bp, Homo sapiens
cagagtctcactgttgcccaggc

SEQ ID NO: 3455620 - DNA, 17 bp, Homo sapiens
cagagtgagacccagcc

SEQ ID NO: 3455621 - DNA, 19 bp, Homo sapiens
cagagtgagactctgtctc

SEQ ID NO: 3455622 - DNA, 20 bp, Homo sapiens
cagagtgagactctgtctca

SEQ ID NO: 3455623 - DNA, 18 bp, Homo sapiens
cagagtgcaagcccctgc

SEQ ID NO: 3455624 - DNA, 23 bp, Homo sapiens
cagagtgcaagcccctgctccag

SEQ ID NO: 3455625 - DNA, 24 bp, Homo sapiens
cagagttccccatgcagacatgag

SEQ ID NO: 3455626 - DNA, 12 bp, Homo sapiens
cagagttgtaaa

SEQ ID NO: 3455627 - DNA, 20 bp, Homo sapiens
cagagttgtaaatatataaa

SEQ ID NO: 3455628 - DNA, 13 bp, Homo sapiens
cagataactgagg

SEQ ID NO: 3455629 - DNA, 20 bp, Homo sapiens
cagataaggtaaaatgccat

SEQ ID NO: 3455630 - DNA, 13 bp, Homo sapiens
cagataatgtgaa

SEQ ID NO: 3455631 - DNA, 20 bp, Homo sapiens
cagatacaggaaaagctgct

SEQ ID NO: 3455632 - DNA, 19 bp, Homo sapiens
cagatatattaagtgactg

SEQ ID NO: 3455633 - DNA, 18 bp, Homo sapiens
cagatatcttcagtttaa

SEQ ID NO: 3455634 - DNA, 22 bp, Homo sapiens
cagatcagactctccttcaggg

SEQ ID NO: 3455635 - DNA, 12 bp, Homo sapiens
cagatccagcct

SEQ ID NO: 3455636 - DNA, 13 bp, Homo sapiens
cagatccagcctg

SEQ ID NO: 3455637 - DNA, 14 bp, Homo sapiens
cagatccagggaca

SEQ ID NO: 3455638 - DNA, 23 bp, Homo sapiens
cagatccagggacagaggcccca

SEQ ID NO: 3455639 - DNA, 18 bp, Homo sapiens
cagatcccaggcccctgg

SEQ ID NO: 3455640 - DNA, 23 bp, Homo sapiens
cagatctgacatgattccttcct

SEQ ID NO: 3455641 - DNA, 19 bp, Homo sapiens
cagatctggaacctcagcc

SEQ ID NO: 3455642 - DNA, 21 bp, Homo sapiens
cagatctggaacctcagcctg

SEQ ID NO: 3455643 - DNA, 22 bp, Homo sapiens
cagatctggaacctcagcctgg

SEQ ID NO: 3455644 - DNA, 14 bp, Homo sapiens
cagatcttgcctcc

SEQ ID NO: 3455645 - DNA, 19 bp, Homo sapiens
cagatcttgcctccagaga

SEQ ID NO: 3455646 - DNA, 18 bp, Homo sapiens
cagatcttggactcatga

SEQ ID NO: 3455647 - DNA, 15 bp, Homo sapiens
cagatgaatgtattt

SEQ ID NO: 3455648 - DNA, 14 bp, Homo sapiens
cagatgcaatgact

SEQ ID NO: 3455649 - DNA, 17 bp, Homo sapiens
cagatgcacatgttgga

SEQ ID NO: 3455650 - DNA, 16 bp, Homo sapiens
cagatgcagctcaaga

SEQ ID NO: 3455651 - DNA, 17 bp, Homo sapiens
cagatgcagggcagtca

SEQ ID NO: 3455652 - DNA, 16 bp, Homo sapiens
cagatgcctacttttg

SEQ ID NO: 3455653 - DNA, 17 bp, Homo sapiens
cagatgcctacttttgg

SEQ ID NO: 3455654 - DNA, 20 bp, Homo sapiens
cagatgcctacttttggcct

SEQ ID NO: 3455655 - DNA, 21 bp, Homo sapiens
cagatggaaccgcaggaagct

SEQ ID NO: 3455656 - DNA, 18 bp, Homo sapiens
cagatggcagatgcacat

SEQ ID NO: 3455657 - DNA, 14 bp, Homo sapiens
cagatgggggaaag

SEQ ID NO: 3455658 - DNA, 12 bp, Homo sapiens
cagatggttgtg

SEQ ID NO: 3455659 - DNA, 20 bp, Homo sapiens
cagatggttgtgtatgggta

SEQ ID NO: 3455660 - DNA, 12 bp, Homo sapiens
cagatgtaatgt

SEQ ID NO: 3455661 - DNA, 14 bp, Homo sapiens
cagatgtaatgttt

SEQ ID NO: 3455662 - DNA, 22 bp, Homo sapiens
cagatgtaatgttttctttgca

SEQ ID NO: 3455663 - DNA, 15 bp, Homo sapiens
cagatgtggggctga

SEQ ID NO: 3455664 - DNA, 21 bp, Homo sapiens
cagatgtggggctgagctggg

SEQ ID NO: 3455665 - DNA, 15 bp, Homo sapiens
cagatgtttccagac

SEQ ID NO: 3455666 - DNA, 16 bp, Homo sapiens
cagatgtttccagact

SEQ ID NO: 3455667 - DNA, 19 bp, Homo sapiens
cagatgtttcttttgtatg

SEQ ID NO: 3455668 - DNA, 20 bp, Homo sapiens
cagattgcaacaggctgggc

SEQ ID NO: 3455669 - DNA, 13 bp, Homo sapiens
cagattgcatgtg

SEQ ID NO: 3455670 - DNA, 15 bp, Homo sapiens
cagattgcatgtgac

SEQ ID NO: 3455671 - DNA, 16 bp, Homo sapiens
cagattgcatgtgact

SEQ ID NO: 3455672 - DNA, 18 bp, Homo sapiens
cagattgcatgtgactct

SEQ ID NO: 3455673 - DNA, 21 bp, Homo sapiens
cagattgcatgtgactctgaa

SEQ ID NO: 3455674 - DNA, 23 bp, Homo sapiens
cagattgcatgtgactctgaagc

SEQ ID NO: 3455675 - DNA, 18 bp, Homo sapiens
cagattggctcacactga

SEQ ID NO: 3455676 - DNA, 20 bp, Homo sapiens
cagattggctcacactgaga

SEQ ID NO: 3455677 - DNA, 18 bp, Homo sapiens
cagattgtggaatgttgg

SEQ ID NO: 3455678 - DNA, 13 bp, Homo sapiens
cagatttaataca

SEQ ID NO: 3455679 - DNA, 12 bp, Homo sapiens
cagatttgcatt

SEQ ID NO: 3455680 - DNA, 24 bp, Homo sapiens
cagatttgtctttttgttgtaaaa

SEQ ID NO: 3455681 - DNA, 15 bp, Homo sapiens
cagattttaattttg

SEQ ID NO: 3455682 - DNA, 13 bp, Homo sapiens
cagcaaaaagcaa

SEQ ID NO: 3455683 - DNA, 11 bp, Homo sapiens
cagcaaaccat

SEQ ID NO: 3455684 - DNA, 24 bp, Homo sapiens
cagcaaaccatttttaaagtagaa

SEQ ID NO: 3455685 - DNA, 22 bp, Homo sapiens
cagcaacaggaatctcagagac

SEQ ID NO: 3455686 - DNA, 23 bp, Homo sapiens
cagcaacaggaatctcagagaca

SEQ ID NO: 3455687 - DNA, 17 bp, Homo sapiens
cagcaacattttcttga

SEQ ID NO: 3455688 - DNA, 23 bp, Homo sapiens
cagcaacattttcttgaattttt

SEQ ID NO: 3455689 - DNA, 14 bp, Homo sapiens
cagcaagtgagagc

SEQ ID NO: 3455690 - DNA, 21 bp, Homo sapiens
cagcaagtgagagctgggtgt

SEQ ID NO: 3455691 - DNA, 12 bp, Homo sapiens
cagcacaaaatg

SEQ ID NO: 3455692 - DNA, 22 bp, Homo sapiens
cagcacaaggccttgcctggcc

SEQ ID NO: 3455693 - DNA, 15 bp, Homo sapiens
cagcacacagggcag

SEQ ID NO: 3455694 - DNA, 18 bp, Homo sapiens
cagcacacagggcagtga

SEQ ID NO: 3455695 - DNA, 16 bp, Homo sapiens
cagcacagagaccccc

SEQ ID NO: 3455696 - DNA, 13 bp, Homo sapiens
cagcacagccaac

SEQ ID NO: 3455697 - DNA, 13 bp, Homo sapiens
cagcacagcttga

SEQ ID NO: 3455698 - DNA, 15 bp, Homo sapiens
cagcacagcttgacc

SEQ ID NO: 3455699 - DNA, 17 bp, Homo sapiens
cagcacagcttgacctg

SEQ ID NO: 3455700 - DNA, 21 bp, Homo sapiens
cagcacatccatcagcacccc

SEQ ID NO: 3455701 - DNA, 17 bp, Homo sapiens
cagcacccaaagggtta

SEQ ID NO: 3455702 - DNA, 16 bp, Homo sapiens
cagcaccctgcagagc

SEQ ID NO: 3455703 - DNA, 22 bp, Homo sapiens
cagcaccctgcagagcacacag

SEQ ID NO: 3455704 - DNA, 18 bp, Homo sapiens
cagcaccgttctgtgcac

SEQ ID NO: 3455705 - DNA, 12 bp, Homo sapiens
cagcacctggca

SEQ ID NO: 3455706 - DNA, 12 bp, Homo sapiens
cagcactgagga

SEQ ID NO: 3455707 - DNA, 15 bp, Homo sapiens
cagcactgaggaaga

SEQ ID NO: 3455708 - DNA, 18 bp, Homo sapiens
cagcactgcttgaggaaa

SEQ ID NO: 3455709 - DNA, 23 bp, Homo sapiens
cagcacttgggggttcaggcccg

SEQ ID NO: 3455710 - DNA, 15 bp, Homo sapiens
cagcacttgtccagc

SEQ ID NO: 3455711 - DNA, 19 bp, Homo sapiens
cagcacttgtccagctgag

SEQ ID NO: 3455712 - DNA, 18 bp, Homo sapiens
cagcagaaccagcctcaa

SEQ ID NO: 3455713 - DNA, 11 bp, Homo sapiens
cagcagactga

SEQ ID NO: 3455714 - DNA, 18 bp, Homo sapiens
cagcagactgatcaggac

SEQ ID NO: 3455715 - DNA, 20 bp, Homo sapiens
cagcagcccaagcttccctc

SEQ ID NO: 3455716 - DNA, 12 bp, Homo sapiens
cagcagcctgga

SEQ ID NO: 3455717 - DNA, 15 bp, Homo sapiens
cagcagcctggaccc

SEQ ID NO: 3455718 - DNA, 22 bp, Homo sapiens
cagcagcctggaccctgtggat

SEQ ID NO: 3455719 - DNA, 20 bp, Homo sapiens
cagcagcctggggctggcct

SEQ ID NO: 3455720 - DNA, 17 bp, Homo sapiens
cagcagcctttaatgca

SEQ ID NO: 3455721 - DNA, 17 bp, Homo sapiens
cagcagcgcctttccca

SEQ ID NO: 3455722 - DNA, 18 bp, Homo sapiens
cagcaggaggccaggccg

SEQ ID NO: 3455723 - DNA, 24 bp, Homo sapiens
cagcagggaaaatgcagcagggat

SEQ ID NO: 3455724 - DNA, 20 bp, Homo sapiens
cagcagggagggcttctgcc

SEQ ID NO: 3455725 - DNA, 16 bp, Homo sapiens
cagcagggatgccctg

SEQ ID NO: 3455726 - DNA, 21 bp, Homo sapiens
cagcagggatgccctggaggt

SEQ ID NO: 3455727 - DNA, 17 bp, Homo sapiens
cagcagtgtgaggccag

SEQ ID NO: 3455728 - DNA, 20 bp, Homo sapiens
cagcagttttcaagtcaaat

SEQ ID NO: 3455729 - DNA, 20 bp, Homo sapiens
cagcatccccttgaactctt

SEQ ID NO: 3455730 - DNA, 23 bp, Homo sapiens
cagcatccgcaggtgctggtccc

SEQ ID NO: 3455731 - DNA, 20 bp, Homo sapiens
cagcatcctggcacccggcc

SEQ ID NO: 3455732 - DNA, 21 bp, Homo sapiens
cagcatcggacaagaccccca

SEQ ID NO: 3455733 - DNA, 21 bp, Homo sapiens
cagcatcttaccttcatatgc

SEQ ID NO: 3455734 - DNA, 21 bp, Homo sapiens
cagcattagatagtcatgctg

SEQ ID NO: 3455735 - DNA, 21 bp, Homo sapiens
cagcattccagcccctctggt

SEQ ID NO: 3455736 - DNA, 19 bp, Homo sapiens
cagcattctcaggcaccag

SEQ ID NO: 3455737 - DNA, 20 bp, Homo sapiens
cagcatttccacaccaagca

SEQ ID NO: 3455738 - DNA, 23 bp, Homo sapiens
cagcatttccacaccaagcagca

SEQ ID NO: 3455739 - DNA, 14 bp, Homo sapiens
cagcatttgatctg

SEQ ID NO: 3455740 - DNA, 16 bp, Homo sapiens
cagcatttgatctgtt

SEQ ID NO: 3455741 - DNA, 20 bp, Homo sapiens
cagcatttgattaacatttg

SEQ ID NO: 3455742 - DNA, 20 bp, Homo sapiens
cagccaaacgggagcttttg

SEQ ID NO: 3455743 - DNA, 15 bp, Homo sapiens
cagccaaagcctcct

SEQ ID NO: 3455744 - DNA, 16 bp, Homo sapiens
cagccaaagcctcctc

SEQ ID NO: 3455745 - DNA, 15 bp, Homo sapiens
cagccaaaggctggc

SEQ ID NO: 3455746 - DNA, 19 bp, Homo sapiens
cagccaacacgcacctgcc

SEQ ID NO: 3455747 - DNA, 18 bp, Homo sapiens
cagccaactagcccctgg

SEQ ID NO: 3455748 - DNA, 18 bp, Homo sapiens
cagccaattatgttaaac

SEQ ID NO: 3455749 - DNA, 21 bp, Homo sapiens
cagccaccgaagccgcctgtg

SEQ ID NO: 3455750 - DNA, 18 bp, Homo sapiens
cagccacgaggtgcaaca

SEQ ID NO: 3455751 - DNA, 14 bp, Homo sapiens
cagccacggccagg

SEQ ID NO: 3455752 - DNA, 19 bp, Homo sapiens
cagccacggccaggccaga

SEQ ID NO: 3455753 - DNA, 15 bp, Homo sapiens
cagccactaagaacc

SEQ ID NO: 3455754 - DNA, 12 bp, Homo sapiens
cagccagcacct

SEQ ID NO: 3455755 - DNA, 13 bp, Homo sapiens
cagccagcacctg

SEQ ID NO: 3455756 - DNA, 14 bp, Homo sapiens
cagccagcacctgg

SEQ ID NO: 3455757 - DNA, 16 bp, Homo sapiens
cagccagcacctggca

SEQ ID NO: 3455758 - DNA, 15 bp, Homo sapiens
cagccagctcctggg

SEQ ID NO: 3455759 - DNA, 17 bp, Homo sapiens
cagccagctcctgggca

SEQ ID NO: 3455760 - DNA, 15 bp, Homo sapiens
cagccaggccctgcc

SEQ ID NO: 3455761 - DNA, 21 bp, Homo sapiens
cagccagtgacctgaggaagc

SEQ ID NO: 3455762 - DNA, 22 bp, Homo sapiens
cagccagtgacctgaggaagcg

SEQ ID NO: 3455763 - DNA, 17 bp, Homo sapiens
cagccatcaaaatgctt

SEQ ID NO: 3455764 - DNA, 20 bp, Homo sapiens
cagccattacccagctaaat

SEQ ID NO: 3455765 - DNA, 21 bp, Homo sapiens
cagccattgcacccagcccag

SEQ ID NO: 3455766 - DNA, 15 bp, Homo sapiens
cagcccaagtagagg

SEQ ID NO: 3455767 - DNA, 18 bp, Homo sapiens
cagcccacttctgccata

SEQ ID NO: 3455768 - DNA, 12 bp, Homo sapiens
cagcccagagac

SEQ ID NO: 3455769 - DNA, 21 bp, Homo sapiens
cagcccagagacatacttgaa

SEQ ID NO: 3455770 - DNA, 19 bp, Homo sapiens
cagcccagattcccctgtg

SEQ ID NO: 3455771 - DNA, 18 bp, Homo sapiens
cagcccagggctcctgca

SEQ ID NO: 3455772 - DNA, 18 bp, Homo sapiens
cagccccagtgcccacag

SEQ ID NO: 3455773 - DNA, 13 bp, Homo sapiens
cagccccattctg

SEQ ID NO: 3455774 - DNA, 17 bp, Homo sapiens
cagccccattctgcctg

SEQ ID NO: 3455775 - DNA, 18 bp, Homo sapiens
cagccccattctgcctgc

SEQ ID NO: 3455776 - DNA, 22 bp, Homo sapiens
cagccccattctgcctgcccag

SEQ ID NO: 3455777 - DNA, 17 bp, Homo sapiens
cagcccccacatcctgt

SEQ ID NO: 3455778 - DNA, 17 bp, Homo sapiens
cagccccgacttcctga

SEQ ID NO: 3455779 - DNA, 18 bp, Homo sapiens
cagccccggtggctgggc

SEQ ID NO: 3455780 - DNA, 19 bp, Homo sapiens
cagccccggtggctgggca

SEQ ID NO: 3455781 - DNA, 20 bp, Homo sapiens
cagccccggtggctgggcag

SEQ ID NO: 3455782 - DNA, 20 bp, Homo sapiens
cagcccctactgctgtgaac

SEQ ID NO: 3455783 - DNA, 13 bp, Homo sapiens
cagcccctctggt

SEQ ID NO: 3455784 - DNA, 14 bp, Homo sapiens
cagcccctctggtc

SEQ ID NO: 3455785 - DNA, 16 bp, Homo sapiens
cagcccctctggtcgc

SEQ ID NO: 3455786 - DNA, 18 bp, Homo sapiens
cagcccctctggtcgctc

SEQ ID NO: 3455787 - DNA, 20 bp, Homo sapiens
cagcccctgatcctgtgaag

SEQ ID NO: 3455788 - DNA, 21 bp, Homo sapiens
cagcccctgatcctgtgaagt

SEQ ID NO: 3455789 - DNA, 18 bp, Homo sapiens
cagcccctgctgtgtggg

SEQ ID NO: 3455790 - DNA, 19 bp, Homo sapiens
cagcccctgctgtgtgggt

SEQ ID NO: 3455791 - DNA, 20 bp, Homo sapiens
cagccccttctcagaatcta

SEQ ID NO: 3455792 - DNA, 22 bp, Homo sapiens
cagccccttctcagaatctacc

SEQ ID NO: 3455793 - DNA, 16 bp, Homo sapiens
cagcccgcacacctgc

SEQ ID NO: 3455794 - DNA, 17 bp, Homo sapiens
cagcccgtgcaccctgg

SEQ ID NO: 3455795 - DNA, 13 bp, Homo sapiens
cagccctcacccc

SEQ ID NO: 3455796 - DNA, 13 bp, Homo sapiens
cagccctgaccct

SEQ ID NO: 3455797 - DNA, 21 bp, Homo sapiens
cagccgtgtaaccatggaccc

SEQ ID NO: 3455798 - DNA, 23 bp, Homo sapiens
cagcctcaaaaacgccctcaaga

SEQ ID NO: 3455799 - DNA, 18 bp, Homo sapiens
cagcctcaacctcctggg

SEQ ID NO: 3455800 - DNA, 20 bp, Homo sapiens
cagcctcaacctcctgggct

SEQ ID NO: 3455801 - DNA, 14 bp, Homo sapiens
cagcctcccacccc

SEQ ID NO: 3455802 - DNA, 16 bp, Homo sapiens
cagcctcccatccagg

SEQ ID NO: 3455803 - DNA, 23 bp, Homo sapiens
cagcctcccatccagggccccca

SEQ ID NO: 3455804 - DNA, 16 bp, Homo sapiens
cagcctcccctgccag

SEQ ID NO: 3455805 - DNA, 20 bp, Homo sapiens
cagcctcccctgccagggca

SEQ ID NO: 3455806 - DNA, 16 bp, Homo sapiens
cagcctccctgaagcc

SEQ ID NO: 3455807 - DNA, 17 bp, Homo sapiens
cagcctccctgaagcct

SEQ ID NO: 3455808 - DNA, 23 bp, Homo sapiens
cagcctctccccaggtccagctc

SEQ ID NO: 3455809 - DNA, 18 bp, Homo sapiens
cagcctcttggccccaga

SEQ ID NO: 3455810 - DNA, 17 bp, Homo sapiens
cagcctctttctgtccc

SEQ ID NO: 3455811 - DNA, 16 bp, Homo sapiens
cagcctgcgcctgctg

SEQ ID NO: 3455812 - DNA, 22 bp, Homo sapiens
cagcctgcgcctgctgcatgcc

SEQ ID NO: 3455813 - DNA, 19 bp, Homo sapiens
cagcctgcgggaagctgac

SEQ ID NO: 3455814 - DNA, 22 bp, Homo sapiens
cagcctgcgggaagctgacctt

SEQ ID NO: 3455815 - DNA, 12 bp, Homo sapiens
cagcctgctcca

SEQ ID NO: 3455816 - DNA, 20 bp, Homo sapiens
cagcctgctccagctgttca

SEQ ID NO: 3455817 - DNA, 15 bp, Homo sapiens
cagcctggaccctgt

SEQ ID NO: 3455818 - DNA, 19 bp, Homo sapiens
cagcctggaccctgtggat

SEQ ID NO: 3455819 - DNA, 14 bp, Homo sapiens
cagcctggccagac

SEQ ID NO: 3455820 - DNA, 17 bp, Homo sapiens
cagcctggccagacaca

SEQ ID NO: 3455821 - DNA, 20 bp, Homo sapiens
cagcctggccagacacaggc

SEQ ID NO: 3455822 - DNA, 16 bp, Homo sapiens
cagcctgggcaatgtg

SEQ ID NO: 3455823 - DNA, 18 bp, Homo sapiens
cagcctggggctggcctc

SEQ ID NO: 3455824 - DNA, 19 bp, Homo sapiens
cagcctggggtctggagtt

SEQ ID NO: 3455825 - DNA, 22 bp, Homo sapiens
cagcctttgatcaggtggggag

SEQ ID NO: 3455826 - DNA, 17 bp, Homo sapiens
cagcctttgcctccccg

SEQ ID NO: 3455827 - DNA, 16 bp, Homo sapiens
cagcgacagcctgggc

SEQ ID NO: 3455828 - DNA, 17 bp, Homo sapiens
cagcgactccgttggcc

SEQ ID NO: 3455829 - DNA, 16 bp, Homo sapiens
cagcgagccctggtgg

SEQ ID NO: 3455830 - DNA, 17 bp, Homo sapiens
cagcgagccctggtggc

SEQ ID NO: 3455831 - DNA, 12 bp, Homo sapiens
cagcgccaggct

SEQ ID NO: 3455832 - DNA, 21 bp, Homo sapiens
cagcgccaggctgaccacagc

SEQ ID NO: 3455833 - DNA, 22 bp, Homo sapiens
cagcgccaggctgaccacagca

SEQ ID NO: 3455834 - DNA, 18 bp, Homo sapiens
cagcggggacagctcctt

SEQ ID NO: 3455835 - DNA, 21 bp, Homo sapiens
cagcgggggaggcccgcagag

SEQ ID NO: 3455836 - DNA, 21 bp, Homo sapiens
cagcgtatatataagaaagac

SEQ ID NO: 3455837 - DNA, 16 bp, Homo sapiens
cagcgtcctcctctgt

SEQ ID NO: 3455838 - DNA, 18 bp, Homo sapiens
cagctaaattttctgaaa

SEQ ID NO: 3455839 - DNA, 15 bp, Homo sapiens
cagctaacacacagc

SEQ ID NO: 3455840 - DNA, 16 bp, Homo sapiens
cagctaacacacagct

SEQ ID NO: 3455841 - DNA, 17 bp, Homo sapiens
cagctaacacacagctc

SEQ ID NO: 3455842 - DNA, 18 bp, Homo sapiens
cagctaagaacctggaac

SEQ ID NO: 3455843 - DNA, 22 bp, Homo sapiens
cagctaaggaggggaaaaaaat

SEQ ID NO: 3455844 - DNA, 19 bp, Homo sapiens
cagctaatacccagagcac

SEQ ID NO: 3455845 - DNA, 22 bp, Homo sapiens
cagctaattcaggtcattttgt

SEQ ID NO: 3455846 - DNA, 20 bp, Homo sapiens
cagctactcgggaggctgag

SEQ ID NO: 3455847 - DNA, 15 bp, Homo sapiens
cagctactctcccca

SEQ ID NO: 3455848 - DNA, 23 bp, Homo sapiens
cagctactctccccacgagggct

SEQ ID NO: 3455849 - DNA, 14 bp, Homo sapiens
cagctactctgatc

SEQ ID NO: 3455850 - DNA, 21 bp, Homo sapiens
cagctactctgatccctctgg

SEQ ID NO: 3455851 - DNA, 15 bp, Homo sapiens
cagctacttgggagg

SEQ ID NO: 3455852 - DNA, 20 bp, Homo sapiens
cagctaggaagagcaggact

SEQ ID NO: 3455853 - DNA, 21 bp, Homo sapiens
cagctatacctgtgcctcggc

SEQ ID NO: 3455854 - DNA, 23 bp, Homo sapiens
cagctatacctgtgcctcggctt

SEQ ID NO: 3455855 - DNA, 14 bp, Homo sapiens
cagctatctgcctg

SEQ ID NO: 3455856 - DNA, 15 bp, Homo sapiens
cagctatctgcctga

SEQ ID NO: 3455857 - DNA, 17 bp, Homo sapiens
cagctatctgcctgaca

SEQ ID NO: 3455858 - DNA, 20 bp, Homo sapiens
cagctatctgcctgacaggc

SEQ ID NO: 3455859 - DNA, 21 bp, Homo sapiens
cagctatgttatattgaaaaa

SEQ ID NO: 3455860 - DNA, 15 bp, Homo sapiens
cagctcaaaggcaca

SEQ ID NO: 3455861 - DNA, 15 bp, Homo sapiens
cagctcaagagatcc

SEQ ID NO: 3455862 - DNA, 19 bp, Homo sapiens
cagctcaaggaaaggcctg

SEQ ID NO: 3455863 - DNA, 13 bp, Homo sapiens
cagctcaccagcc

SEQ ID NO: 3455864 - DNA, 22 bp, Homo sapiens
cagctcaccagccccagtgccc

SEQ ID NO: 3455865 - DNA, 17 bp, Homo sapiens
cagctcacgcttcacag

SEQ ID NO: 3455866 - DNA, 19 bp, Homo sapiens
cagctcacgcttcacagtg

SEQ ID NO: 3455867 - DNA, 12 bp, Homo sapiens
cagctcaggaca

SEQ ID NO: 3455868 - DNA, 19 bp, Homo sapiens
cagctcaggacagatgcca

SEQ ID NO: 3455869 - DNA, 11 bp, Homo sapiens
cagctcaggat

SEQ ID NO: 3455870 - DNA, 13 bp, Homo sapiens
cagctcaggatct

SEQ ID NO: 3455871 - DNA, 15 bp, Homo sapiens
cagctcatctctgtc

SEQ ID NO: 3455872 - DNA, 14 bp, Homo sapiens
cagctccaacctgc

SEQ ID NO: 3455873 - DNA, 16 bp, Homo sapiens
cagctccagctcacca

SEQ ID NO: 3455874 - DNA, 17 bp, Homo sapiens
cagctccagctcaccag

SEQ ID NO: 3455875 - DNA, 22 bp, Homo sapiens
cagctccagctcaccagcccca

SEQ ID NO: 3455876 - DNA, 11 bp, Homo sapiens
cagctccccag

SEQ ID NO: 3455877 - DNA, 24 bp, Homo sapiens
cagctccccagagtcctctatgaa

SEQ ID NO: 3455878 - DNA, 12 bp, Homo sapiens
cagctccccagg

SEQ ID NO: 3455879 - DNA, 17 bp, Homo sapiens
cagctccccaggactca

SEQ ID NO: 3455880 - DNA, 16 bp, Homo sapiens
cagctccctggcttct

SEQ ID NO: 3455881 - DNA, 13 bp, Homo sapiens
cagctcctcagcg

SEQ ID NO: 3455882 - DNA, 17 bp, Homo sapiens
cagctcctcagcggctc

SEQ ID NO: 3455883 - DNA, 18 bp, Homo sapiens
cagctcctcagcggctcc

SEQ ID NO: 3455884 - DNA, 13 bp, Homo sapiens
cagctccttcctg

SEQ ID NO: 3455885 - DNA, 17 bp, Homo sapiens
cagctctctgccctgtg

SEQ ID NO: 3455886 - DNA, 19 bp, Homo sapiens
cagctctctgccctgtgta

SEQ ID NO: 3455887 - DNA, 18 bp, Homo sapiens
cagctctggacagcccca

SEQ ID NO: 3455888 - DNA, 12 bp, Homo sapiens
cagctctgtcct

SEQ ID NO: 3455889 - DNA, 17 bp, Homo sapiens
cagctctgtcctgggag

SEQ ID NO: 3455890 - DNA, 13 bp, Homo sapiens
cagctcttcatct

SEQ ID NO: 3455891 - DNA, 14 bp, Homo sapiens
cagctcttcatctg

SEQ ID NO: 3455892 - DNA, 15 bp, Homo sapiens
cagctcttctaagga

SEQ ID NO: 3455893 - DNA, 13 bp, Homo sapiens
cagctcttctcca

SEQ ID NO: 3455894 - DNA, 16 bp, Homo sapiens
cagctcttctccaggc

SEQ ID NO: 3455895 - DNA, 18 bp, Homo sapiens
cagctcttctccaggctg

SEQ ID NO: 3455896 - DNA, 23 bp, Homo sapiens
cagctcttctccaggctgtatcc

SEQ ID NO: 3455897 - DNA, 22 bp, Homo sapiens
cagctcttctgccggccctggg

SEQ ID NO: 3455898 - DNA, 17 bp, Homo sapiens
cagctcttggctccact

SEQ ID NO: 3455899 - DNA, 17 bp, Homo sapiens
cagctctttcctccttc

SEQ ID NO: 3455900 - DNA, 22 bp, Homo sapiens
cagctctttcctccttccatgg

SEQ ID NO: 3455901 - DNA, 21 bp, Homo sapiens
cagctgaaatatgctggctgg

SEQ ID NO: 3455902 - DNA, 21 bp, Homo sapiens
cagctgaggctgggggagagc

SEQ ID NO: 3455903 - DNA, 23 bp, Homo sapiens
cagctgaggctgggggagagccg

SEQ ID NO: 3455904 - DNA, 17 bp, Homo sapiens
cagctgccccggcccct

SEQ ID NO: 3455905 - DNA, 19 bp, Homo sapiens
cagctgccctatgggcctg

SEQ ID NO: 3455906 - DNA, 20 bp, Homo sapiens
cagctgccctatgggcctgc

SEQ ID NO: 3455907 - DNA, 15 bp, Homo sapiens
cagctgccttagctt

SEQ ID NO: 3455908 - DNA, 16 bp, Homo sapiens
cagctgccttagcttc

SEQ ID NO: 3455909 - DNA, 23 bp, Homo sapiens
cagctgcggtccacccaggagcc

SEQ ID NO: 3455910 - DNA, 19 bp, Homo sapiens
cagctgctcctagagggag

SEQ ID NO: 3455911 - DNA, 19 bp, Homo sapiens
cagctgctggagactccta

SEQ ID NO: 3455912 - DNA, 22 bp, Homo sapiens
cagctgcttttgtctatgggac

SEQ ID NO: 3455913 - DNA, 23 bp, Homo sapiens
cagctgcttttgtctatgggact

SEQ ID NO: 3455914 - DNA, 23 bp, Homo sapiens
cagctggatgagaatttgagtgc

SEQ ID NO: 3455915 - DNA, 15 bp, Homo sapiens
cagctggcagcagag

SEQ ID NO: 3455916 - DNA, 17 bp, Homo sapiens
cagctgggctagaggct

SEQ ID NO: 3455917 - DNA, 20 bp, Homo sapiens
cagctgggctagaggctgag

SEQ ID NO: 3455918 - DNA, 18 bp, Homo sapiens
cagctgggtcaggcaggg

SEQ ID NO: 3455919 - DNA, 20 bp, Homo sapiens
cagctgggtcaggcagggtg

SEQ ID NO: 3455920 - DNA, 19 bp, Homo sapiens
cagctgggtggcactgcca

SEQ ID NO: 3455921 - DNA, 11 bp, Homo sapiens
cagctgtgctt

SEQ ID NO: 3455922 - DNA, 15 bp, Homo sapiens
cagctgttcagctgg

SEQ ID NO: 3455923 - DNA, 15 bp, Homo sapiens
cagcttatctctttt

SEQ ID NO: 3455924 - DNA, 18 bp, Homo sapiens
cagcttatctcttttata

SEQ ID NO: 3455925 - DNA, 19 bp, Homo sapiens
cagcttatctcttttatat

SEQ ID NO: 3455926 - DNA, 19 bp, Homo sapiens
cagcttattggcttaaaat

SEQ ID NO: 3455927 - DNA, 18 bp, Homo sapiens
cagcttcatttcctgtgt

SEQ ID NO: 3455928 - DNA, 22 bp, Homo sapiens
cagcttgacctgaggctgtggt

SEQ ID NO: 3455929 - DNA, 14 bp, Homo sapiens
cagcttgagggttg

SEQ ID NO: 3455930 - DNA, 20 bp, Homo sapiens
cagcttgagggttgggctgg

SEQ ID NO: 3455931 - DNA, 21 bp, Homo sapiens
cagcttgagggttgggctggt

SEQ ID NO: 3455932 - DNA, 21 bp, Homo sapiens
cagcttgccagatgctgcaga

SEQ ID NO: 3455933 - DNA, 20 bp, Homo sapiens
cagcttgctgtcacttcttc

SEQ ID NO: 3455934 - DNA, 21 bp, Homo sapiens
cagcttgctgtcacttcttca

SEQ ID NO: 3455935 - DNA, 20 bp, Homo sapiens
cagcttggacatcagtgttt

SEQ ID NO: 3455936 - DNA, 18 bp, Homo sapiens
cagcttgtaaatagctca

SEQ ID NO: 3455937 - DNA, 20 bp, Homo sapiens
cagcttgtaaatagctcagg

SEQ ID NO: 3455938 - DNA, 17 bp, Homo sapiens
cagcttgttatttataa

SEQ ID NO: 3455939 - DNA, 16 bp, Homo sapiens
cagctttactttaaaa

SEQ ID NO: 3455940 - DNA, 16 bp, Homo sapiens
cagctttgatccctga

SEQ ID NO: 3455941 - DNA, 12 bp, Homo sapiens
cagctttgtttg

SEQ ID NO: 3455942 - DNA, 13 bp, Homo sapiens
cagcttttccaaa

SEQ ID NO: 3455943 - DNA, 13 bp, Homo sapiens
caggaaaagcaca

SEQ ID NO: 3455944 - DNA, 15 bp, Homo sapiens
caggaaaagctgctg

SEQ ID NO: 3455945 - DNA, 16 bp, Homo sapiens
caggaaaagctgctga

SEQ ID NO: 3455946 - DNA, 20 bp, Homo sapiens
caggaaacccagtcgccctt

SEQ ID NO: 3455947 - DNA, 19 bp, Homo sapiens
caggaaaggaatcatttct

SEQ ID NO: 3455948 - DNA, 13 bp, Homo sapiens
caggaaatgaaaa

SEQ ID NO: 3455949 - DNA, 22 bp, Homo sapiens
caggaacaacatttacaactca

SEQ ID NO: 3455950 - DNA, 18 bp, Homo sapiens
caggaacctcgagtactg

SEQ ID NO: 3455951 - DNA, 23 bp, Homo sapiens
caggaagccgccagtacttgtca

SEQ ID NO: 3455952 - DNA, 15 bp, Homo sapiens
caggaagctgctccg

SEQ ID NO: 3455953 - DNA, 17 bp, Homo sapiens
caggaagctgctccgtg

SEQ ID NO: 3455954 - DNA, 13 bp, Homo sapiens
caggaaggcttgt

SEQ ID NO: 3455955 - DNA, 22 bp, Homo sapiens
caggaaggcttgttgtgctttt

SEQ ID NO: 3455956 - DNA, 17 bp, Homo sapiens
caggaatatatgtgtgc

SEQ ID NO: 3455957 - DNA, 16 bp, Homo sapiens
caggaatctcagagac

SEQ ID NO: 3455958 - DNA, 24 bp, Homo sapiens
caggaatctcagagacaggtggcc

SEQ ID NO: 3455959 - DNA, 12 bp, Homo sapiens
caggaatgaaaa

SEQ ID NO: 3455960 - DNA, 13 bp, Homo sapiens
caggaatgaaaac

SEQ ID NO: 3455961 - DNA, 21 bp, Homo sapiens
caggaatgtgtggcctgcaca

SEQ ID NO: 3455962 - DNA, 12 bp, Homo sapiens
cacttgcaacct

SEQ ID NO: 3455963 - DNA, 13 bp, Homo sapiens
cacttgcagactc

SEQ ID NO: 3455964 - DNA, 22 bp, Homo sapiens
cacttgccgcgtcgccctccca

SEQ ID NO: 3455965 - DNA, 12 bp, Homo sapiens
cacttgcctctt

SEQ ID NO: 3455966 - DNA, 13 bp, Homo sapiens
cacttgcctcttc

SEQ ID NO: 3455967 - DNA, 19 bp, Homo sapiens
cacttggtaattgtactaa

SEQ ID NO: 3455968 - DNA, 20 bp, Homo sapiens
cacttggtcctacctattat

SEQ ID NO: 3455969 - DNA, 23 bp, Homo sapiens
cacttgtccagctgagcgccagg

SEQ ID NO: 3455970 - DNA, 18 bp, Homo sapiens
cacttgtgccaacactca

SEQ ID NO: 3455971 - DNA, 22 bp, Homo sapiens
cacttgtgccaacactcaagaa

SEQ ID NO: 3455972 - DNA, 18 bp, Homo sapiens
cacttgtgttatgaagca

SEQ ID NO: 3455973 - DNA, 16 bp, Homo sapiens
cacttgtttgcactgt

SEQ ID NO: 3455974 - DNA, 17 bp, Homo sapiens
cactttagggctgtaaa

SEQ ID NO: 3455975 - DNA, 22 bp, Homo sapiens
cactttataagtcattgtatgt

SEQ ID NO: 3455976 - DNA, 23 bp, Homo sapiens
cactttattgccttttaattttt

SEQ ID NO: 3455977 - DNA, 12 bp, Homo sapiens
cactttgggagg

SEQ ID NO: 3455978 - DNA, 16 bp, Homo sapiens
cactttgggaggccaa

SEQ ID NO: 3455979 - DNA, 12 bp, Homo sapiens
cactttgtaaat

SEQ ID NO: 3455980 - DNA, 13 bp, Homo sapiens
cactttgtaaatt

SEQ ID NO: 3455981 - DNA, 12 bp, Homo sapiens
cacttttcacct

SEQ ID NO: 3455982 - DNA, 17 bp, Homo sapiens
cacttttgacaaaggca

SEQ ID NO: 3455983 - DNA, 15 bp, Homo sapiens
cactttttgcagctt

SEQ ID NO: 3455984 - DNA, 18 bp, Homo sapiens
cactttttgcagctttct

SEQ ID NO: 3455985 - DNA, 13 bp, Homo sapiens
cagaaaaatggag

SEQ ID NO: 3455986 - DNA, 22 bp, Homo sapiens
cagaaacatcagttactctgaa

SEQ ID NO: 3455987 - DNA, 23 bp, Homo sapiens
cagaaacatcagttactctgaag

SEQ ID NO: 3455988 - DNA, 16 bp, Homo sapiens
cagaaaccctgagcag

SEQ ID NO: 3455989 - DNA, 14 bp, Homo sapiens
cagaaagagacaca

SEQ ID NO: 3455990 - DNA, 13 bp, Homo sapiens
cagaaagccaaca

SEQ ID NO: 3455991 - DNA, 22 bp, Homo sapiens
cagaaaggtgattccaggagga

SEQ ID NO: 3455992 - DNA, 20 bp, Homo sapiens
cagaaatacagattttgata

SEQ ID NO: 3455993 - DNA, 23 bp, Homo sapiens
cagaaatacagattttgatagca

SEQ ID NO: 3455994 - DNA, 21 bp, Homo sapiens
cagaaatacagtcttccacaa

SEQ ID NO: 3455995 - DNA, 15 bp, Homo sapiens
cagaaatttaaaagc

SEQ ID NO: 3455996 - DNA, 23 bp, Homo sapiens
cagaaatttaattcatgtttctt

SEQ ID NO: 3455997 - DNA, 19 bp, Homo sapiens
cagaacacggctcacgctt

SEQ ID NO: 3455998 - DNA, 14 bp, Homo sapiens
cagaacccttggct

SEQ ID NO: 3455999 - DNA, 19 bp, Homo sapiens
cagaacccttggcttgccc

SEQ ID NO: 3456000 - DNA, 18 bp, Homo sapiens
cagaactaaactcattta

SEQ ID NO: 3456001 - DNA, 14 bp, Homo sapiens
cagaactctttcaa

SEQ ID NO: 3456002 - DNA, 15 bp, Homo sapiens
cagaactctttcaaa

SEQ ID NO: 3456003 - DNA, 19 bp, Homo sapiens
cagaactgcttactagccc

SEQ ID NO: 3456004 - DNA, 16 bp, Homo sapiens
cagaactgtgccacaa

SEQ ID NO: 3456005 - DNA, 21 bp, Homo sapiens
cagaacttgaccctgagctga

SEQ ID NO: 3456006 - DNA, 14 bp, Homo sapiens
cagaacttgctgct

SEQ ID NO: 3456007 - DNA, 20 bp, Homo sapiens
cagaacttgctgctgtcttg

SEQ ID NO: 3456008 - DNA, 21 bp, Homo sapiens
cagaagacactgatgggcaac

SEQ ID NO: 3456009 - DNA, 16 bp, Homo sapiens
cagaagacccctgact

SEQ ID NO: 3456010 - DNA, 17 bp, Homo sapiens
cagaagattaagacaga

SEQ ID NO: 3456011 - DNA, 18 bp, Homo sapiens
cagaagattaagacagag

SEQ ID NO: 3456012 - DNA, 23 bp, Homo sapiens
cagaagattaagacagagaaaca

SEQ ID NO: 3456013 - DNA, 20 bp, Homo sapiens
cagaagcactgggatcacag

SEQ ID NO: 3456014 - DNA, 22 bp, Homo sapiens
cagaagctcttactctttccta

SEQ ID NO: 3456015 - DNA, 16 bp, Homo sapiens
cagaagctgagcacca

SEQ ID NO: 3456016 - DNA, 21 bp, Homo sapiens
cagaagctgagcaccagggga

SEQ ID NO: 3456017 - DNA, 12 bp, Homo sapiens
cagaagcttcca

SEQ ID NO: 3456018 - DNA, 19 bp, Homo sapiens
cagaaggaaaaatgtgtaa

SEQ ID NO: 3456019 - DNA, 17 bp, Homo sapiens
cagaaggagacaggcag

SEQ ID NO: 3456020 - DNA, 18 bp, Homo sapiens
cagaaggcaaacccatca

SEQ ID NO: 3456021 - DNA, 20 bp, Homo sapiens
cagaagggagctagccagag

SEQ ID NO: 3456022 - DNA, 21 bp, Homo sapiens
cagaagggagctagccagagg

SEQ ID NO: 3456023 - DNA, 14 bp, Homo sapiens
cagaagggggtggt

SEQ ID NO: 3456024 - DNA, 15 bp, Homo sapiens
cagaagtaagcctca

SEQ ID NO: 3456025 - DNA, 16 bp, Homo sapiens
cagaagtttgcactat

SEQ ID NO: 3456026 - DNA, 22 bp, Homo sapiens
cagaatactgttaaaggaaaaa

SEQ ID NO: 3456027 - DNA, 22 bp, Homo sapiens
cagaatagccacatttggaata

SEQ ID NO: 3456028 - DNA, 13 bp, Homo sapiens
cagaatatttcta

SEQ ID NO: 3456029 - DNA, 19 bp, Homo sapiens
cagaatatttctattgaat

SEQ ID NO: 3456030 - DNA, 13 bp, Homo sapiens
cagaatccaaaga

SEQ ID NO: 3456031 - DNA, 14 bp, Homo sapiens
cagaatccaaagat

SEQ ID NO: 3456032 - DNA, 18 bp, Homo sapiens
cagaatccaaagatcaca

SEQ ID NO: 3456033 - DNA, 18 bp, Homo sapiens
cagaatctcattactgct

SEQ ID NO: 3456034 - DNA, 21 bp, Homo sapiens
cagaatctcattactgcttca

SEQ ID NO: 3456035 - DNA, 13 bp, Homo sapiens
cagaatctttgtt

SEQ ID NO: 3456036 - DNA, 15 bp, Homo sapiens
cagaatctttgttaa

SEQ ID NO: 3456037 - DNA, 16 bp, Homo sapiens
cagaatctttgttaag

SEQ ID NO: 3456038 - DNA, 12 bp, Homo sapiens
cagaatgaatct

SEQ ID NO: 3456039 - DNA, 17 bp, Homo sapiens
cagaatgctgtacatct

SEQ ID NO: 3456040 - DNA, 21 bp, Homo sapiens
cagaatgctgtacatctattt

SEQ ID NO: 3456041 - DNA, 21 bp, Homo sapiens
cagaatgtgataaggaaatca

SEQ ID NO: 3456042 - DNA, 23 bp, Homo sapiens
cagaattggatacatacaccagc

SEQ ID NO: 3456043 - DNA, 19 bp, Homo sapiens
cagaatttgggttctgcct

SEQ ID NO: 3456044 - DNA, 17 bp, Homo sapiens
cagacaatatgtgagtg

SEQ ID NO: 3456045 - DNA, 14 bp, Homo sapiens
cagacacacacaca

SEQ ID NO: 3456046 - DNA, 21 bp, Homo sapiens
cagacacaggcccggctccag

SEQ ID NO: 3456047 - DNA, 22 bp, Homo sapiens
cagacacaggcccggctccagg

SEQ ID NO: 3456048 - DNA, 14 bp, Homo sapiens
cagacacaggccct

SEQ ID NO: 3456049 - DNA, 18 bp, Homo sapiens
cagacacagggacttgaa

SEQ ID NO: 3456050 - DNA, 20 bp, Homo sapiens
cagacacagggacttgaagt

SEQ ID NO: 3456051 - DNA, 17 bp, Homo sapiens
cagacacatgctatgtt

SEQ ID NO: 3456052 - DNA, 14 bp, Homo sapiens
cagacaccctcaac

SEQ ID NO: 3456053 - DNA, 20 bp, Homo sapiens
cagacaccttgacagggcac

SEQ ID NO: 3456054 - DNA, 22 bp, Homo sapiens
cagacacttcatggaccaagaa

SEQ ID NO: 3456055 - DNA, 16 bp, Homo sapiens
cagacagaaagagaca

SEQ ID NO: 3456056 - DNA, 18 bp, Homo sapiens
cagacagaaagagacaca

SEQ ID NO: 3456057 - DNA, 19 bp, Homo sapiens
cagacagaaagagacacac

SEQ ID NO: 3456058 - DNA, 19 bp, Homo sapiens
cagacagaggatgagctct

SEQ ID NO: 3456059 - DNA, 11 bp, Homo sapiens
cagacagatga

SEQ ID NO: 3456060 - DNA, 17 bp, Homo sapiens
cagacagatgaggcttt

SEQ ID NO: 3456061 - DNA, 20 bp, Homo sapiens
cagacaggccccgtgaggca

SEQ ID NO: 3456062 - DNA, 22 bp, Homo sapiens
cagacatagaagagccaagagt

SEQ ID NO: 3456063 - DNA, 18 bp, Homo sapiens
cagacatgccacaaggac

SEQ ID NO: 3456064 - DNA, 18 bp, Homo sapiens
cagacatgttttccgtga

SEQ ID NO: 3456065 - DNA, 14 bp, Homo sapiens
cagaccacaaaact

SEQ ID NO: 3456066 - DNA, 22 bp, Homo sapiens
cagaccacgcccgtcctgcctg

SEQ ID NO: 3456067 - DNA, 16 bp, Homo sapiens
cagacccggctgcgtg

SEQ ID NO: 3456068 - DNA, 17 bp, Homo sapiens
cagacctaatgctcctt

SEQ ID NO: 3456069 - DNA, 18 bp, Homo sapiens
cagacctaatgctccttg

SEQ ID NO: 3456070 - DNA, 13 bp, Homo sapiens
cagacctgatcct

SEQ ID NO: 3456071 - DNA, 17 bp, Homo sapiens
cagacctgatcctggag

SEQ ID NO: 3456072 - DNA, 21 bp, Homo sapiens
cagacctgtcaccctgcagga

SEQ ID NO: 3456073 - DNA, 20 bp, Homo sapiens
cagacctgttagcagacagg

SEQ ID NO: 3456074 - DNA, 14 bp, Homo sapiens
cagaccttcacaga

SEQ ID NO: 3456075 - DNA, 23 bp, Homo sapiens
cagaccttcacagatgcctactt

SEQ ID NO: 3456076 - DNA, 16 bp, Homo sapiens
cagacgcctgaggaac

SEQ ID NO: 3456077 - DNA, 14 bp, Homo sapiens
cagactcccattcc

SEQ ID NO: 3456078 - DNA, 19 bp, Homo sapiens
cagactcccattcctgaag

SEQ ID NO: 3456079 - DNA, 23 bp, Homo sapiens
cagactctacagaggccatgggc

SEQ ID NO: 3456080 - DNA, 18 bp, Homo sapiens
cagactctttatgcttgc

SEQ ID NO: 3456081 - DNA, 17 bp, Homo sapiens
cagactgatcaggacct

SEQ ID NO: 3456082 - DNA, 16 bp, Homo sapiens
cagactggaagcacag

SEQ ID NO: 3456083 - DNA, 17 bp, Homo sapiens
cagactggaagcacagc

SEQ ID NO: 3456084 - DNA, 11 bp, Homo sapiens
cagactgtctc

SEQ ID NO: 3456085 - DNA, 20 bp, Homo sapiens
cagacttgccatgtgactct

SEQ ID NO: 3456086 - DNA, 22 bp, Homo sapiens
cagactttggaaaatgcattgt

SEQ ID NO: 3456087 - DNA, 15 bp, Homo sapiens
cagagaaagaggaag

SEQ ID NO: 3456088 - DNA, 19 bp, Homo sapiens
cagagaaaggggagcccac

SEQ ID NO: 3456089 - DNA, 11 bp, Homo sapiens
cagagaacttt

SEQ ID NO: 3456090 - DNA, 20 bp, Homo sapiens
cagagaactttattttggat

SEQ ID NO: 3456091 - DNA, 12 bp, Homo sapiens
cagagaaggcta

SEQ ID NO: 3456092 - DNA, 16 bp, Homo sapiens
cagagaatatgtctgc

SEQ ID NO: 3456093 - DNA, 21 bp, Homo sapiens
cagagaatgaaagggcccaga

SEQ ID NO: 3456094 - DNA, 21 bp, Homo sapiens
cagagacaggtggcctagcag

SEQ ID NO: 3456095 - DNA, 15 bp, Homo sapiens
cagagacatacttga

SEQ ID NO: 3456096 - DNA, 17 bp, Homo sapiens
cagagacatacttgaag

SEQ ID NO: 3456097 - DNA, 23 bp, Homo sapiens
cagagacatacttgaagggccag

SEQ ID NO: 3456098 - DNA, 22 bp, Homo sapiens
caccagccccagtgcccacagg

SEQ ID NO: 3456099 - DNA, 11 bp, Homo sapiens
caccagctgca

SEQ ID NO: 3456100 - DNA, 13 bp, Homo sapiens
caccagctgcaaa

SEQ ID NO: 3456101 - DNA, 17 bp, Homo sapiens
caccaggaacctcttca

SEQ ID NO: 3456102 - DNA, 20 bp, Homo sapiens
caccaggcttgcctgcaggc

SEQ ID NO: 3456103 - DNA, 19 bp, Homo sapiens
caccagggttgaccccaga

SEQ ID NO: 3456104 - DNA, 13 bp, Homo sapiens
caccatagcctac

SEQ ID NO: 3456105 - DNA, 16 bp, Homo sapiens
caccatccctttttga

SEQ ID NO: 3456106 - DNA, 15 bp, Homo sapiens
caccatgtattttgt

SEQ ID NO: 3456107 - DNA, 13 bp, Homo sapiens
caccattctgact

SEQ ID NO: 3456108 - DNA, 14 bp, Homo sapiens
caccattctgactc

SEQ ID NO: 3456109 - DNA, 21 bp, Homo sapiens
cacccaagtgccaagacacag

SEQ ID NO: 3456110 - DNA, 20 bp, Homo sapiens
cacccaccatcatgtctggc

SEQ ID NO: 3456111 - DNA, 16 bp, Homo sapiens
cacccacccctgcaca

SEQ ID NO: 3456112 - DNA, 13 bp, Homo sapiens
cacccaccctggg

SEQ ID NO: 3456113 - DNA, 16 bp, Homo sapiens
cacccacctcagcctc

SEQ ID NO: 3456114 - DNA, 13 bp, Homo sapiens
cacccacctccct

SEQ ID NO: 3456115 - DNA, 21 bp, Homo sapiens
cacccacctccctgcctccag

SEQ ID NO: 3456116 - DNA, 15 bp, Homo sapiens
cacccactcagctcc

SEQ ID NO: 3456117 - DNA, 21 bp, Homo sapiens
cacccagatgggggaaagcac

SEQ ID NO: 3456118 - DNA, 17 bp, Homo sapiens
cacccagcccacttctg

SEQ ID NO: 3456119 - DNA, 12 bp, Homo sapiens
cacccagcccag

SEQ ID NO: 3456120 - DNA, 13 bp, Homo sapiens
cacccagcccaga

SEQ ID NO: 3456121 - DNA, 16 bp, Homo sapiens
cacccagcccagattg

SEQ ID NO: 3456122 - DNA, 16 bp, Homo sapiens
cacccaggagccccga

SEQ ID NO: 3456123 - DNA, 14 bp, Homo sapiens
caccccacccttcc

SEQ ID NO: 3456124 - DNA, 19 bp, Homo sapiens
caccccaggccctgccaga

SEQ ID NO: 3456125 - DNA, 15 bp, Homo sapiens
caccccatcccacac

SEQ ID NO: 3456126 - DNA, 18 bp, Homo sapiens
cacccccccaccccaggc

SEQ ID NO: 3456127 - DNA, 15 bp, Homo sapiens
cacccctccctttct

SEQ ID NO: 3456128 - DNA, 13 bp, Homo sapiens
cacccctgcacag

SEQ ID NO: 3456129 - DNA, 20 bp, Homo sapiens
cacccctggaagagcccagt

SEQ ID NO: 3456130 - DNA, 17 bp, Homo sapiens
cacccctggttctcatc

SEQ ID NO: 3456131 - DNA, 12 bp, Homo sapiens
cacccggcccct

SEQ ID NO: 3456132 - DNA, 22 bp, Homo sapiens
caccctcataccatctgctgcc

SEQ ID NO: 3456133 - DNA, 13 bp, Homo sapiens
caccctctgtacc

SEQ ID NO: 3456134 - DNA, 17 bp, Homo sapiens
caccctgaaagccctga

SEQ ID NO: 3456135 - DNA, 20 bp, Homo sapiens
caccctgcagagcacacagg

SEQ ID NO: 3456136 - DNA, 15 bp, Homo sapiens
caccctgcaggactt

SEQ ID NO: 3456137 - DNA, 21 bp, Homo sapiens
caccctggaggatttcatctc

SEQ ID NO: 3456138 - DNA, 17 bp, Homo sapiens
caccctgggccctgggc

SEQ ID NO: 3456139 - DNA, 16 bp, Homo sapiens
caccctggtgggccaa

SEQ ID NO: 3456140 - DNA, 14 bp, Homo sapiens
caccctgtcttcct

SEQ ID NO: 3456141 - DNA, 15 bp, Homo sapiens
caccctgtcttcctc

SEQ ID NO: 3456142 - DNA, 18 bp, Homo sapiens
caccctgtcttcctctgc

SEQ ID NO: 3456143 - DNA, 19 bp, Homo sapiens
caccctgtcttcctctgca

SEQ ID NO: 3456144 - DNA, 21 bp, Homo sapiens
caccctgtcttcctctgcaag

SEQ ID NO: 3456145 - DNA, 13 bp, Homo sapiens
cacccttcccctc

SEQ ID NO: 3456146 - DNA, 22 bp, Homo sapiens
cacccttcccctccttctccct

SEQ ID NO: 3456147 - DNA, 15 bp, Homo sapiens
cacccttttccagct

SEQ ID NO: 3456148 - DNA, 21 bp, Homo sapiens
cacccttttccagctggatga

SEQ ID NO: 3456149 - DNA, 15 bp, Homo sapiens
caccggatcctgggt

SEQ ID NO: 3456150 - DNA, 22 bp, Homo sapiens
caccggccccatttacccaact

SEQ ID NO: 3456151 - DNA, 15 bp, Homo sapiens
caccgggccacagag

SEQ ID NO: 3456152 - DNA, 20 bp, Homo sapiens
caccggggacaggccgcagc

SEQ ID NO: 3456153 - DNA, 15 bp, Homo sapiens
caccgtggctaagag

SEQ ID NO: 3456154 - DNA, 13 bp, Homo sapiens
caccgtgggctcc

SEQ ID NO: 3456155 - DNA, 23 bp, Homo sapiens
caccgtgtcaagctgctctgagc

SEQ ID NO: 3456156 - DNA, 14 bp, Homo sapiens
caccgttctgtgca

SEQ ID NO: 3456157 - DNA, 16 bp, Homo sapiens
cacctacatccccagg

SEQ ID NO: 3456158 - DNA, 14 bp, Homo sapiens
cacctagcagcacc

SEQ ID NO: 3456159 - DNA, 19 bp, Homo sapiens
cacctcagagtatggagct

SEQ ID NO: 3456160 - DNA, 14 bp, Homo sapiens
cacctccagcctga

SEQ ID NO: 3456161 - DNA, 14 bp, Homo sapiens
cacctccccagcat

SEQ ID NO: 3456162 - DNA, 16 bp, Homo sapiens
cacctccccagcattc

SEQ ID NO: 3456163 - DNA, 20 bp, Homo sapiens
cacctccctatactgcttgg

SEQ ID NO: 3456164 - DNA, 13 bp, Homo sapiens
cacctccctgcct

SEQ ID NO: 3456165 - DNA, 14 bp, Homo sapiens
cacctcctgcctcg

SEQ ID NO: 3456166 - DNA, 19 bp, Homo sapiens
cacctctccctgaccctgt

SEQ ID NO: 3456167 - DNA, 11 bp, Homo sapiens
cacctcttcca

SEQ ID NO: 3456168 - DNA, 14 bp, Homo sapiens
cacctgaagactca

SEQ ID NO: 3456169 - DNA, 15 bp, Homo sapiens
cacctgaagactcat

SEQ ID NO: 3456170 - DNA, 16 bp, Homo sapiens
cacctgcatctggggc

SEQ ID NO: 3456171 - DNA, 17 bp, Homo sapiens
cacctgcatctggggcc

SEQ ID NO: 3456172 - DNA, 15 bp, Homo sapiens
cacctgccaccctgg

SEQ ID NO: 3456173 - DNA, 13 bp, Homo sapiens
cacctgcctcagg

SEQ ID NO: 3456174 - DNA, 14 bp, Homo sapiens
cacctgcctcagga

SEQ ID NO: 3456175 - DNA, 23 bp, Homo sapiens
cacctggcatcgcaccattctga

SEQ ID NO: 3456176 - DNA, 18 bp, Homo sapiens
cacctggccgcctccagg

SEQ ID NO: 3456177 - DNA, 20 bp, Homo sapiens
cacctggccgcctccaggag

SEQ ID NO: 3456178 - DNA, 21 bp, Homo sapiens
cacctggccgcctccaggagc

SEQ ID NO: 3456179 - DNA, 23 bp, Homo sapiens
cacctggccgcctccaggagcct

SEQ ID NO: 3456180 - DNA, 16 bp, Homo sapiens
cacctgggagaaatct

SEQ ID NO: 3456181 - DNA, 17 bp, Homo sapiens
cacctgggagaaatctg

SEQ ID NO: 3456182 - DNA, 15 bp, Homo sapiens
cacctggggctgctg

SEQ ID NO: 3456183 - DNA, 13 bp, Homo sapiens
cacctgtaatccc

SEQ ID NO: 3456184 - DNA, 16 bp, Homo sapiens
cacctgtaatcccagc

SEQ ID NO: 3456185 - DNA, 20 bp, Homo sapiens
cacctgtcaaacaaagccag

SEQ ID NO: 3456186 - DNA, 17 bp, Homo sapiens
cacctgtctcagcctcc

SEQ ID NO: 3456187 - DNA, 19 bp, Homo sapiens
cacctgtttttaagctgtt

SEQ ID NO: 3456188 - DNA, 23 bp, Homo sapiens
caccttcagtaacccccactgga

SEQ ID NO: 3456189 - DNA, 21 bp, Homo sapiens
caccttcgtttactatgcctg

SEQ ID NO: 3456190 - DNA, 16 bp, Homo sapiens
caccttgacagggcac

SEQ ID NO: 3456191 - DNA, 17 bp, Homo sapiens
caccttgccagggaggt

SEQ ID NO: 3456192 - DNA, 19 bp, Homo sapiens
caccttgcttttttactta

SEQ ID NO: 3456193 - DNA, 16 bp, Homo sapiens
caccttggacatcctc

SEQ ID NO: 3456194 - DNA, 21 bp, Homo sapiens
caccttggacatcctcctccc

SEQ ID NO: 3456195 - DNA, 17 bp, Homo sapiens
caccttggcaccagaca

SEQ ID NO: 3456196 - DNA, 16 bp, Homo sapiens
cacctttctcctttgt

SEQ ID NO: 3456197 - DNA, 14 bp, Homo sapiens
cacctttgtagcac

SEQ ID NO: 3456198 - DNA, 20 bp, Homo sapiens
caccttttgggaatgtttta

SEQ ID NO: 3456199 - DNA, 23 bp, Homo sapiens
cacgacctaggcagtaggccggt

SEQ ID NO: 3456200 - DNA, 22 bp, Homo sapiens
cacgaggaatctgtgggtctgg

SEQ ID NO: 3456201 - DNA, 16 bp, Homo sapiens
cacgcacctgcctcag

SEQ ID NO: 3456202 - DNA, 13 bp, Homo sapiens
cacgcacctgggt

SEQ ID NO: 3456203 - DNA, 19 bp, Homo sapiens
cacgcaggagcacacccag

SEQ ID NO: 3456204 - DNA, 20 bp, Homo sapiens
cacgcaggagcacacccagc

SEQ ID NO: 3456205 - DNA, 15 bp, Homo sapiens
cacgcccgtcctgcc

SEQ ID NO: 3456206 - DNA, 21 bp, Homo sapiens
cacgcccgtcctgcctgtggc

SEQ ID NO: 3456207 - DNA, 18 bp, Homo sapiens
cacgcctcccactggggt

SEQ ID NO: 3456208 - DNA, 21 bp, Homo sapiens
cacgcctgtaatcccagcact

SEQ ID NO: 3456209 - DNA, 22 bp, Homo sapiens
cacgcctgtaatcccagcactt

SEQ ID NO: 3456210 - DNA, 15 bp, Homo sapiens
cacgcgggggccttg

SEQ ID NO: 3456211 - DNA, 14 bp, Homo sapiens
cacgcgtatttaca

SEQ ID NO: 3456212 - DNA, 15 bp, Homo sapiens
cacgcgtgcacacac

SEQ ID NO: 3456213 - DNA, 16 bp, Homo sapiens
cacgcgtgcacacacc

SEQ ID NO: 3456214 - DNA, 13 bp, Homo sapiens
cacgctccagctg

SEQ ID NO: 3456215 - DNA, 19 bp, Homo sapiens
cacgctccagctgccccgg

SEQ ID NO: 3456216 - DNA, 16 bp, Homo sapiens
cacgctggagtgcagt

SEQ ID NO: 3456217 - DNA, 17 bp, Homo sapiens
cacgctggagtgcagtg

SEQ ID NO: 3456218 - DNA, 21 bp, Homo sapiens
cacgctggagtgcagtgagcc

SEQ ID NO: 3456219 - DNA, 18 bp, Homo sapiens
cacgctgggtattaccat

SEQ ID NO: 3456220 - DNA, 20 bp, Homo sapiens
cacgctgggtattaccatgt

SEQ ID NO: 3456221 - DNA, 14 bp, Homo sapiens
cacggaagttttca

SEQ ID NO: 3456222 - DNA, 15 bp, Homo sapiens
cacggaagttttcaa

SEQ ID NO: 3456223 - DNA, 16 bp, Homo sapiens
cacggagccactcctc

SEQ ID NO: 3456224 - DNA, 18 bp, Homo sapiens
cacggagccactcctctg

SEQ ID NO: 3456225 - DNA, 23 bp, Homo sapiens
cacggagtcgtggggtgtgctgg

SEQ ID NO: 3456226 - DNA, 18 bp, Homo sapiens
cacggatctgagaatctt

SEQ ID NO: 3456227 - DNA, 23 bp, Homo sapiens
cacggcaggacaacgaggaagcc

SEQ ID NO: 3456228 - DNA, 17 bp, Homo sapiens
cacggccaggccagagg

SEQ ID NO: 3456229 - DNA, 14 bp, Homo sapiens
cacggctcactgca

SEQ ID NO: 3456230 - DNA, 15 bp, Homo sapiens
cacggctcactgcag

SEQ ID NO: 3456231 - DNA, 19 bp, Homo sapiens
cacggctcactgcagcctc

SEQ ID NO: 3456232 - DNA, 20 bp, Homo sapiens
cacggctcactgcagcctca

SEQ ID NO: 3456233 - DNA, 14 bp, Homo sapiens
cacggctcccccag

SEQ ID NO: 3456234 - DNA, 22 bp, Homo sapiens
cacgggggcagctgatacaaat

SEQ ID NO: 3456235 - DNA, 15 bp, Homo sapiens
cacgtattccccttc

SEQ ID NO: 3456236 - DNA, 17 bp, Homo sapiens
cacgtgcctgtgggcct

SEQ ID NO: 3456237 - DNA, 21 bp, Homo sapiens
cacgtgcgctgggcacttccc

SEQ ID NO: 3456238 - DNA, 18 bp, Homo sapiens
cacgtggaggagcagtgc

SEQ ID NO: 3456239 - DNA, 23 bp, Homo sapiens
cacgtggttggggccctgccctg

SEQ ID NO: 3456240 - DNA, 16 bp, Homo sapiens
cactaaagactgggtt

SEQ ID NO: 3456241 - DNA, 12 bp, Homo sapiens
cactaaagcagt

SEQ ID NO: 3456242 - DNA, 16 bp, Homo sapiens
cactaaccacgctgga

SEQ ID NO: 3456243 - DNA, 13 bp, Homo sapiens
cactaactgctgg

SEQ ID NO: 3456244 - DNA, 17 bp, Homo sapiens
cactaagcagaggaggg

SEQ ID NO: 3456245 - DNA, 13 bp, Homo sapiens
cactaaggggccc

SEQ ID NO: 3456246 - DNA, 18 bp, Homo sapiens
cactaaggtgtgctctga

SEQ ID NO: 3456247 - DNA, 15 bp, Homo sapiens
cactaatttttgtat

SEQ ID NO: 3456248 - DNA, 15 bp, Homo sapiens
cactacattcattta

SEQ ID NO: 3456249 - DNA, 23 bp, Homo sapiens
cactaccagcgtatatataagaa

SEQ ID NO: 3456250 - DNA, 14 bp, Homo sapiens
cactaccttatcag

SEQ ID NO: 3456251 - DNA, 23 bp, Homo sapiens
cactacggaatagttggctagga

SEQ ID NO: 3456252 - DNA, 15 bp, Homo sapiens
cactactcttacatg

SEQ ID NO: 3456253 - DNA, 17 bp, Homo sapiens
cactagacaagccagaa

SEQ ID NO: 3456254 - DNA, 12 bp, Homo sapiens
cactagcagctg

SEQ ID NO: 3456255 - DNA, 20 bp, Homo sapiens
cactaggcccccacttgcct

SEQ ID NO: 3456256 - DNA, 12 bp, Homo sapiens
cactagggaatc

SEQ ID NO: 3456257 - DNA, 20 bp, Homo sapiens
cactagggaatcctgcggca

SEQ ID NO: 3456258 - DNA, 15 bp, Homo sapiens
cactagtgcaaatca

SEQ ID NO: 3456259 - DNA, 14 bp, Homo sapiens
cactatagcctagg

SEQ ID NO: 3456260 - DNA, 16 bp, Homo sapiens
cactatgttgcccagg

SEQ ID NO: 3456261 - DNA, 20 bp, Homo sapiens
cactatgttgcccaggcagg

SEQ ID NO: 3456262 - DNA, 21 bp, Homo sapiens
cactatgttgcccaggcaggt

SEQ ID NO: 3456263 - DNA, 16 bp, Homo sapiens
cactattttcaaagaa

SEQ ID NO: 3456264 - DNA, 20 bp, Homo sapiens
cactcaaaagctgggcaggt

SEQ ID NO: 3456265 - DNA, 21 bp, Homo sapiens
cactcaaagagggtgagggcc

SEQ ID NO: 3456266 - DNA, 22 bp, Homo sapiens
cactcaaagagggtgagggcct

SEQ ID NO: 3456267 - DNA, 15 bp, Homo sapiens
cactcaagccaagca

SEQ ID NO: 3456268 - DNA, 16 bp, Homo sapiens
cactcaagccaagcag

SEQ ID NO: 3456269 - DNA, 16 bp, Homo sapiens
cactcactaggccccc

SEQ ID NO: 3456270 - DNA, 12 bp, Homo sapiens
cactcagaagac

SEQ ID NO: 3456271 - DNA, 22 bp, Homo sapiens
cactcagaagacactgatgggc

SEQ ID NO: 3456272 - DNA, 13 bp, Homo sapiens
cactcagcacaag

SEQ ID NO: 3456273 - DNA, 22 bp, Homo sapiens
cactcagctcttggctccactg

SEQ ID NO: 3456274 - DNA, 16 bp, Homo sapiens
cactcatcccctcact

SEQ ID NO: 3456275 - DNA, 21 bp, Homo sapiens
cactcattgctgagcctctgc

SEQ ID NO: 3456276 - DNA, 23 bp, Homo sapiens
cactcattgctgagcctctgctc

SEQ ID NO: 3456277 - DNA, 18 bp, Homo sapiens
cactccagtcctgccacc

SEQ ID NO: 3456278 - DNA, 20 bp, Homo sapiens
cactccagtcctgccaccac

SEQ ID NO: 3456279 - DNA, 20 bp, Homo sapiens
cactcccaaggttggagccc

SEQ ID NO: 3456280 - DNA, 22 bp, Homo sapiens
cactcccacctgcatctggggc

SEQ ID NO: 3456281 - DNA, 13 bp, Homo sapiens
cactcccaggcag

SEQ ID NO: 3456282 - DNA, 16 bp, Homo sapiens
cactcccttgggctcc

SEQ ID NO: 3456283 - DNA, 20 bp, Homo sapiens
cactcctctgactcagggct

SEQ ID NO: 3456284 - DNA, 23 bp, Homo sapiens
cactcctctgactcagggctcct

SEQ ID NO: 3456285 - DNA, 14 bp, Homo sapiens
cactcggtcccagt

SEQ ID NO: 3456286 - DNA, 13 bp, Homo sapiens
cactctgcctgcc

SEQ ID NO: 3456287 - DNA, 12 bp, Homo sapiens
cactctgcttct

SEQ ID NO: 3456288 - DNA, 13 bp, Homo sapiens
cactctgcttctc

SEQ ID NO: 3456289 - DNA, 15 bp, Homo sapiens
cactctgcttctctg

SEQ ID NO: 3456290 - DNA, 16 bp, Homo sapiens
cactctgcttctctga

SEQ ID NO: 3456291 - DNA, 16 bp, Homo sapiens
cactctgtcgcccagt

SEQ ID NO: 3456292 - DNA, 20 bp, Homo sapiens
cactcttattgcccacgctg

SEQ ID NO: 3456293 - DNA, 22 bp, Homo sapiens
cactcttattgcccacgctgga

SEQ ID NO: 3456294 - DNA, 23 bp, Homo sapiens
cactcttttgctttattccagaa

SEQ ID NO: 3456295 - DNA, 17 bp, Homo sapiens
cactgaactccttcccc

SEQ ID NO: 3456296 - DNA, 19 bp, Homo sapiens
cactgaagggaatcacatc

SEQ ID NO: 3456297 - DNA, 23 bp, Homo sapiens
cactgacactggtattcctgcct

SEQ ID NO: 3456298 - DNA, 14 bp, Homo sapiens
cactgacagcctcc

SEQ ID NO: 3456299 - DNA, 16 bp, Homo sapiens
cactgacagcctccca

SEQ ID NO: 3456300 - DNA, 17 bp, Homo sapiens
cactgacagcctcccac

SEQ ID NO: 3456301 - DNA, 23 bp, Homo sapiens
cactgacattgttggccaaagcc

SEQ ID NO: 3456302 - DNA, 14 bp, Homo sapiens
cactgaccagaact

SEQ ID NO: 3456303 - DNA, 15 bp, Homo sapiens
cactgaggaagaacg

SEQ ID NO: 3456304 - DNA, 13 bp, Homo sapiens
cactgaggcaggg

SEQ ID NO: 3456305 - DNA, 14 bp, Homo sapiens
cactgaggcaggga

SEQ ID NO: 3456306 - DNA, 17 bp, Homo sapiens
cactgaggcagggaagt

SEQ ID NO: 3456307 - DNA, 19 bp, Homo sapiens
cactgaggcagggaagtcc

SEQ ID NO: 3456308 - DNA, 17 bp, Homo sapiens
cactgatgctgcccctc

SEQ ID NO: 3456309 - DNA, 18 bp, Homo sapiens
cactgatgggcaaccccc

SEQ ID NO: 3456310 - DNA, 15 bp, Homo sapiens
cactgatttagccat

SEQ ID NO: 3456311 - DNA, 13 bp, Homo sapiens
cactgcaacctcc

SEQ ID NO: 3456312 - DNA, 18 bp, Homo sapiens
cactgcaagaagtcttga

SEQ ID NO: 3456313 - DNA, 12 bp, Homo sapiens
cactgcaagtcc

SEQ ID NO: 3456314 - DNA, 22 bp, Homo sapiens
cactgcaagtccttttgtaaag

SEQ ID NO: 3456315 - DNA, 16 bp, Homo sapiens
cactgcaccgggccac

SEQ ID NO: 3456316 - DNA, 19 bp, Homo sapiens
cactgcaccgggccacaga

SEQ ID NO: 3456317 - DNA, 18 bp, Homo sapiens
cactgcactatagcctag

SEQ ID NO: 3456318 - DNA, 14 bp, Homo sapiens
cactgcagcctcaa

SEQ ID NO: 3456319 - DNA, 22 bp, Homo sapiens
cactgcagcctcaacctcctgg

SEQ ID NO: 3456320 - DNA, 20 bp, Homo sapiens
cactgcaggtgagaaccccg

SEQ ID NO: 3456321 - DNA, 14 bp, Homo sapiens
cactgccaacccct

SEQ ID NO: 3456322 - DNA, 15 bp, Homo sapiens
cactgccacaccctc

SEQ ID NO: 3456323 - DNA, 19 bp, Homo sapiens
cactgccacaccctcccca

SEQ ID NO: 3456324 - DNA, 20 bp, Homo sapiens
cactgccacaccctccccat

SEQ ID NO: 3456325 - DNA, 17 bp, Homo sapiens
cactgccactccagtcc

SEQ ID NO: 3456326 - DNA, 18 bp, Homo sapiens
cactgccactccagtcct

SEQ ID NO: 3456327 - DNA, 21 bp, Homo sapiens
cactgccactccagtcctgcc

SEQ ID NO: 3456328 - DNA, 16 bp, Homo sapiens
cactgccataaaacat

SEQ ID NO: 3456329 - DNA, 18 bp, Homo sapiens
cactgcccatggacaggc

SEQ ID NO: 3456330 - DNA, 16 bp, Homo sapiens
cactgctctcagcctc

SEQ ID NO: 3456331 - DNA, 17 bp, Homo sapiens
cactgctctcagcctcc

SEQ ID NO: 3456332 - DNA, 15 bp, Homo sapiens
cactgcttgaggaaa

SEQ ID NO: 3456333 - DNA, 17 bp, Homo sapiens
cactgcttttggcctgg

SEQ ID NO: 3456334 - DNA, 18 bp, Homo sapiens
cactgcttttggcctgga

SEQ ID NO: 3456335 - DNA, 15 bp, Homo sapiens
cactggaccccagca

SEQ ID NO: 3456336 - DNA, 15 bp, Homo sapiens
cactggactccggcc

SEQ ID NO: 3456337 - DNA, 13 bp, Homo sapiens
cactgggaaacag

SEQ ID NO: 3456338 - DNA, 14 bp, Homo sapiens
cactgggtggtggc

SEQ ID NO: 3456339 - DNA, 17 bp, Homo sapiens
cactgggtggtggcctg

SEQ ID NO: 3456340 - DNA, 17 bp, Homo sapiens
cactggtattcctgcct

SEQ ID NO: 3456341 - DNA, 20 bp, Homo sapiens
cactggttgcacttatgatt

SEQ ID NO: 3456342 - DNA, 19 bp, Homo sapiens
cactggtttctcagaatcc

SEQ ID NO: 3456343 - DNA, 18 bp, Homo sapiens
cactgtaaattgctggca

SEQ ID NO: 3456344 - DNA, 15 bp, Homo sapiens
cactgtatgatttat

SEQ ID NO: 3456345 - DNA, 16 bp, Homo sapiens
cactgtcatgcttcat

SEQ ID NO: 3456346 - DNA, 14 bp, Homo sapiens
cactgtcctccaag

SEQ ID NO: 3456347 - DNA, 17 bp, Homo sapiens
cactgtcctccaagcca

SEQ ID NO: 3456348 - DNA, 15 bp, Homo sapiens
cactgtgacccccag

SEQ ID NO: 3456349 - DNA, 20 bp, Homo sapiens
cactgtgacccccagctccg

SEQ ID NO: 3456350 - DNA, 22 bp, Homo sapiens
cactgtgagctcccaggtgcag

SEQ ID NO: 3456351 - DNA, 18 bp, Homo sapiens
cactgtgccatgtgccag

SEQ ID NO: 3456352 - DNA, 21 bp, Homo sapiens
cactgtgggaaggccagctgc

SEQ ID NO: 3456353 - DNA, 12 bp, Homo sapiens
cactgtgggtgt

SEQ ID NO: 3456354 - DNA, 15 bp, Homo sapiens
cactgttctgggact

SEQ ID NO: 3456355 - DNA, 13 bp, Homo sapiens
cactgttgaattt

SEQ ID NO: 3456356 - DNA, 14 bp, Homo sapiens
cactgttgcccagg

SEQ ID NO: 3456357 - DNA, 17 bp, Homo sapiens
cacttaagagaatattt

SEQ ID NO: 3456358 - DNA, 20 bp, Homo sapiens
cacttaagagaatattttaa

SEQ ID NO: 3456359 - DNA, 23 bp, Homo sapiens
cacttaattgctttcctgcctcc

SEQ ID NO: 3456360 - DNA, 21 bp, Homo sapiens
cacttactggtaggaccaagc

SEQ ID NO: 3456361 - DNA, 21 bp, Homo sapiens
cacttatgaatgatttgcata

SEQ ID NO: 3456362 - DNA, 12 bp, Homo sapiens
cacttatgattt

SEQ ID NO: 3456363 - DNA, 18 bp, Homo sapiens
cacttcatggaccaagaa

SEQ ID NO: 3456364 - DNA, 13 bp, Homo sapiens
cacttccatggga

SEQ ID NO: 3456365 - DNA, 14 bp, Homo sapiens
cacttccattgttt

SEQ ID NO: 3456366 - DNA, 16 bp, Homo sapiens
cacttccattgtttaa

SEQ ID NO: 3456367 - DNA, 16 bp, Homo sapiens
cacttccctgctgcct

SEQ ID NO: 3456368 - DNA, 19 bp, Homo sapiens
cacttcgttcgcagagctt

SEQ ID NO: 3456369 - DNA, 19 bp, Homo sapiens
cacttctgggtggggcagt

SEQ ID NO: 3456370 - DNA, 19 bp, Homo sapiens
cacttctggtcaatcaaca

SEQ ID NO: 3456371 - DNA, 22 bp, Homo sapiens
cacttgaggtcaggagttccta

SEQ ID NO: 3456372 - DNA, 21 bp, Homo sapiens
caagaaataaaaggaagccaa

SEQ ID NO: 3456373 - DNA, 14 bp, Homo sapiens
caagaagggctgca

SEQ ID NO: 3456374 - DNA, 16 bp, Homo sapiens
caagaagggctgcatg

SEQ ID NO: 3456375 - DNA, 19 bp, Homo sapiens
caagaagtcaaagtaaaac

SEQ ID NO: 3456376 - DNA, 18 bp, Homo sapiens
caagaatagcatctgtac

SEQ ID NO: 3456377 - DNA, 22 bp, Homo sapiens
caagaattgaagcaggactaaa

SEQ ID NO: 3456378 - DNA, 15 bp, Homo sapiens
caagacctcagggca

SEQ ID NO: 3456379 - DNA, 21 bp, Homo sapiens
caagacttcagtatgttgtca

SEQ ID NO: 3456380 - DNA, 16 bp, Homo sapiens
caagagaatgctgtca

SEQ ID NO: 3456381 - DNA, 19 bp, Homo sapiens
caagaggaagttcagatct

SEQ ID NO: 3456382 - DNA, 22 bp, Homo sapiens
caagagggaatagtatagacaa

SEQ ID NO: 3456383 - DNA, 17 bp, Homo sapiens
caagagggacgcctggg

SEQ ID NO: 3456384 - DNA, 17 bp, Homo sapiens
caagagggtctgaggaa

SEQ ID NO: 3456385 - DNA, 23 bp, Homo sapiens
caagatacaggaaaaatgaaaat

SEQ ID NO: 3456386 - DNA, 17 bp, Homo sapiens
caagatattatgtataa

SEQ ID NO: 3456387 - DNA, 16 bp, Homo sapiens
caagatgacagctctt

SEQ ID NO: 3456388 - DNA, 19 bp, Homo sapiens
caagatgacagctcttcta

SEQ ID NO: 3456389 - DNA, 19 bp, Homo sapiens
caagatgggggcagggctg

SEQ ID NO: 3456390 - DNA, 14 bp, Homo sapiens
caagattaaatgta

SEQ ID NO: 3456391 - DNA, 21 bp, Homo sapiens
caagattgcttaaaatagcaa

SEQ ID NO: 3456392 - DNA, 17 bp, Homo sapiens
caagcaaacccagacgg

SEQ ID NO: 3456393 - DNA, 13 bp, Homo sapiens
caagcaagactga

SEQ ID NO: 3456394 - DNA, 18 bp, Homo sapiens
caagcacaaagctcaaga

SEQ ID NO: 3456395 - DNA, 17 bp, Homo sapiens
caagcacagcagcctgg

SEQ ID NO: 3456396 - DNA, 13 bp, Homo sapiens
caagcacctcctg

SEQ ID NO: 3456397 - DNA, 14 bp, Homo sapiens
caagcacctcctgc

SEQ ID NO: 3456398 - DNA, 17 bp, Homo sapiens
caagcacctcctgcctc

SEQ ID NO: 3456399 - DNA, 14 bp, Homo sapiens
caagcacttctttt

SEQ ID NO: 3456400 - DNA, 12 bp, Homo sapiens
caagcagccaag

SEQ ID NO: 3456401 - DNA, 23 bp, Homo sapiens
caagcaggaaatgaaaatgtctt

SEQ ID NO: 3456402 - DNA, 13 bp, Homo sapiens
caagcaggaagct

SEQ ID NO: 3456403 - DNA, 14 bp, Homo sapiens
caagcaggaagctc

SEQ ID NO: 3456404 - DNA, 16 bp, Homo sapiens
caagcaggaagctcag

SEQ ID NO: 3456405 - DNA, 17 bp, Homo sapiens
caagcaggacagtgctt

SEQ ID NO: 3456406 - DNA, 20 bp, Homo sapiens
caagcagtcgtgcctgtgtc

SEQ ID NO: 3456407 - DNA, 16 bp, Homo sapiens
caagcagtgcctgcct

SEQ ID NO: 3456408 - DNA, 20 bp, Homo sapiens
caagcatgggggaccccttc

SEQ ID NO: 3456409 - DNA, 22 bp, Homo sapiens
caagcatgggggaccccttccc

SEQ ID NO: 3456410 - DNA, 13 bp, Homo sapiens
caagccaagcagc

SEQ ID NO: 3456411 - DNA, 21 bp, Homo sapiens
caagccaagcagccaagctcc

SEQ ID NO: 3456412 - DNA, 18 bp, Homo sapiens
caagccaagggaacctgt

SEQ ID NO: 3456413 - DNA, 13 bp, Homo sapiens
caagccagccaac

SEQ ID NO: 3456414 - DNA, 14 bp, Homo sapiens
caagccagctgcct

SEQ ID NO: 3456415 - DNA, 15 bp, Homo sapiens
caagccagctgccta

SEQ ID NO: 3456416 - DNA, 18 bp, Homo sapiens
caagcccccccttccact

SEQ ID NO: 3456417 - DNA, 17 bp, Homo sapiens
caagcctcatattttct

SEQ ID NO: 3456418 - DNA, 19 bp, Homo sapiens
caagcctcgaggtgccttc

SEQ ID NO: 3456419 - DNA, 21 bp, Homo sapiens
caagcctgtgcaaaaaaatta

SEQ ID NO: 3456420 - DNA, 18 bp, Homo sapiens
caagcgattctcctgcct

SEQ ID NO: 3456421 - DNA, 19 bp, Homo sapiens
caagcgattcttctgcttc

SEQ ID NO: 3456422 - DNA, 16 bp, Homo sapiens
caagctcaggaccagg

SEQ ID NO: 3456423 - DNA, 15 bp, Homo sapiens
caagctcatctattt

SEQ ID NO: 3456424 - DNA, 17 bp, Homo sapiens
caagctcatctatttgg

SEQ ID NO: 3456425 - DNA, 19 bp, Homo sapiens
caagctcatctatttggaa

SEQ ID NO: 3456426 - DNA, 14 bp, Homo sapiens
caagctccaagccc

SEQ ID NO: 3456427 - DNA, 13 bp, Homo sapiens
caagctcccaagg

SEQ ID NO: 3456428 - DNA, 22 bp, Homo sapiens
caagctcccaagggatggtgcc

SEQ ID NO: 3456429 - DNA, 14 bp, Homo sapiens
caagctccgcagga

SEQ ID NO: 3456430 - DNA, 15 bp, Homo sapiens
caagctccgcaggac

SEQ ID NO: 3456431 - DNA, 15 bp, Homo sapiens
caagctcctcctccc

SEQ ID NO: 3456432 - DNA, 17 bp, Homo sapiens
caagctcctcctccctg

SEQ ID NO: 3456433 - DNA, 22 bp, Homo sapiens
caagctccttgggaggccccac

SEQ ID NO: 3456434 - DNA, 13 bp, Homo sapiens
caagctctgctcc

SEQ ID NO: 3456435 - DNA, 13 bp, Homo sapiens
caagctgcaccct

SEQ ID NO: 3456436 - DNA, 16 bp, Homo sapiens
caagctgctctgagcc

SEQ ID NO: 3456437 - DNA, 18 bp, Homo sapiens
caagctgctctgagccac

SEQ ID NO: 3456438 - DNA, 22 bp, Homo sapiens
caagctggctggggtggcctgt

SEQ ID NO: 3456439 - DNA, 23 bp, Homo sapiens
caagctggctggggtggcctgtg

SEQ ID NO: 3456440 - DNA, 19 bp, Homo sapiens
caagctggtcccactcagt

SEQ ID NO: 3456441 - DNA, 19 bp, Homo sapiens
caagctggtggcctctgca

SEQ ID NO: 3456442 - DNA, 22 bp, Homo sapiens
caagcttcaaccctcagccttg

SEQ ID NO: 3456443 - DNA, 23 bp, Homo sapiens
caagcttcaaccctcagccttga

SEQ ID NO: 3456444 - DNA, 22 bp, Homo sapiens
caaggaaaccacagctgctgga

SEQ ID NO: 3456445 - DNA, 15 bp, Homo sapiens
caaggaaaggcaaat

SEQ ID NO: 3456446 - DNA, 19 bp, Homo sapiens
caaggaaaggggagaaggg

SEQ ID NO: 3456447 - DNA, 12 bp, Homo sapiens
caaggaagtcaa

SEQ ID NO: 3456448 - DNA, 20 bp, Homo sapiens
caaggactgagcaccctctg

SEQ ID NO: 3456449 - DNA, 13 bp, Homo sapiens
caaggagctgcta

SEQ ID NO: 3456450 - DNA, 12 bp, Homo sapiens
caaggagggaga

SEQ ID NO: 3456451 - DNA, 20 bp, Homo sapiens
caaggagggtgagtgcaagg

SEQ ID NO: 3456452 - DNA, 23 bp, Homo sapiens
caaggagggtgtaatggagcatc

SEQ ID NO: 3456453 - DNA, 15 bp, Homo sapiens
caaggatagatgctg

SEQ ID NO: 3456454 - DNA, 23 bp, Homo sapiens
caaggatagatgctggcccaggg

SEQ ID NO: 3456455 - DNA, 19 bp, Homo sapiens
caaggattgctactgtcct

SEQ ID NO: 3456456 - DNA, 20 bp, Homo sapiens
caaggattgctactgtccta

SEQ ID NO: 3456457 - DNA, 12 bp, Homo sapiens
caaggcactgcc

SEQ ID NO: 3456458 - DNA, 15 bp, Homo sapiens
caaggcactgcctga

SEQ ID NO: 3456459 - DNA, 18 bp, Homo sapiens
caaggcactgcctgatgg

SEQ ID NO: 3456460 - DNA, 16 bp, Homo sapiens
caaggcagcgacccca

SEQ ID NO: 3456461 - DNA, 18 bp, Homo sapiens
caaggcagcgaccccagg

SEQ ID NO: 3456462 - DNA, 21 bp, Homo sapiens
caaggcagcgaccccaggacc

SEQ ID NO: 3456463 - DNA, 18 bp, Homo sapiens
caaggccagcacccaaag

SEQ ID NO: 3456464 - DNA, 19 bp, Homo sapiens
caaggccagcacccaaagg

SEQ ID NO: 3456465 - DNA, 15 bp, Homo sapiens
caaggccatccttcc

SEQ ID NO: 3456466 - DNA, 23 bp, Homo sapiens
caaggccatccttccctgtctgc

SEQ ID NO: 3456467 - DNA, 14 bp, Homo sapiens
caaggccatctggg

SEQ ID NO: 3456468 - DNA, 14 bp, Homo sapiens
caaggcctaggacc

SEQ ID NO: 3456469 - DNA, 13 bp, Homo sapiens
caaggccttcagt

SEQ ID NO: 3456470 - DNA, 16 bp, Homo sapiens
caaggcggtgcttgat

SEQ ID NO: 3456471 - DNA, 19 bp, Homo sapiens
caaggctgatgcaggattt

SEQ ID NO: 3456472 - DNA, 12 bp, Homo sapiens
caaggctgcagt

SEQ ID NO: 3456473 - DNA, 22 bp, Homo sapiens
caaggctgcagtgagccgagat

SEQ ID NO: 3456474 - DNA, 16 bp, Homo sapiens
caaggctgcttagaat

SEQ ID NO: 3456475 - DNA, 18 bp, Homo sapiens
caaggctgtgctccctgg

SEQ ID NO: 3456476 - DNA, 16 bp, Homo sapiens
caagggaaaagtctct

SEQ ID NO: 3456477 - DNA, 15 bp, Homo sapiens
caagggaacctgtgt

SEQ ID NO: 3456478 - DNA, 21 bp, Homo sapiens
caagggacaggagaagagagg

SEQ ID NO: 3456479 - DNA, 17 bp, Homo sapiens
caagggatctggtccta

SEQ ID NO: 3456480 - DNA, 21 bp, Homo sapiens
caagggatctggtcctaccca

SEQ ID NO: 3456481 - DNA, 21 bp, Homo sapiens
caagggccagacagaccttca

SEQ ID NO: 3456482 - DNA, 16 bp, Homo sapiens
caagggttaaggcctg

SEQ ID NO: 3456483 - DNA, 21 bp, Homo sapiens
caaggtcctctgtcagtcaca

SEQ ID NO: 3456484 - DNA, 13 bp, Homo sapiens
caaggtctttaaa

SEQ ID NO: 3456485 - DNA, 18 bp, Homo sapiens
caaggtgaaatgaagcaa

SEQ ID NO: 3456486 - DNA, 23 bp, Homo sapiens
caaggtgggaggattgcttgagc

SEQ ID NO: 3456487 - DNA, 18 bp, Homo sapiens
caaggttcaacttattaa

SEQ ID NO: 3456488 - DNA, 13 bp, Homo sapiens
caaggttggagcc

SEQ ID NO: 3456489 - DNA, 17 bp, Homo sapiens
caaggttggagcccagg

SEQ ID NO: 3456490 - DNA, 21 bp, Homo sapiens
caaggttggagcccagggcat

SEQ ID NO: 3456491 - DNA, 19 bp, Homo sapiens
caaggttttataaggctga

SEQ ID NO: 3456492 - DNA, 15 bp, Homo sapiens
caagtaagaggctgg

SEQ ID NO: 3456493 - DNA, 14 bp, Homo sapiens
caagtagctgctac

SEQ ID NO: 3456494 - DNA, 14 bp, Homo sapiens
caagtcaaattaat

SEQ ID NO: 3456495 - DNA, 17 bp, Homo sapiens
caagtcaagtgaaaaag

SEQ ID NO: 3456496 - DNA, 17 bp, Homo sapiens
caagtcatgtgcatttc

SEQ ID NO: 3456497 - DNA, 13 bp, Homo sapiens
caagtcccccagc

SEQ ID NO: 3456498 - DNA, 21 bp, Homo sapiens
caagtcctcttttctgagagg

SEQ ID NO: 3456499 - DNA, 14 bp, Homo sapiens
caagtcctttgtga

SEQ ID NO: 3456500 - DNA, 15 bp, Homo sapiens
caagtccttttgtaa

SEQ ID NO: 3456501 - DNA, 18 bp, Homo sapiens
caagtccttttgtaaagt

SEQ ID NO: 3456502 - DNA, 22 bp, Homo sapiens
caagtctctgctggcccagcca

SEQ ID NO: 3456503 - DNA, 23 bp, Homo sapiens
caagtctctgctggcccagccaa

SEQ ID NO: 3456504 - DNA, 18 bp, Homo sapiens
caagtcttctcccgtcca

SEQ ID NO: 3456505 - DNA, 19 bp, Homo sapiens
caagtgaaaaaggaggaag

SEQ ID NO: 3456506 - DNA, 23 bp, Homo sapiens
caagtgaaaaaggaggaagagaa

SEQ ID NO: 3456507 - DNA, 12 bp, Homo sapiens
caagtgaaggtt

SEQ ID NO: 3456508 - DNA, 15 bp, Homo sapiens
caagtgagaccctgt

SEQ ID NO: 3456509 - DNA, 19 bp, Homo sapiens
caagtgagaccctgtctca

SEQ ID NO: 3456510 - DNA, 17 bp, Homo sapiens
caagtgagagctgggtg

SEQ ID NO: 3456511 - DNA, 20 bp, Homo sapiens
caagtgatcgccaccccccc

SEQ ID NO: 3456512 - DNA, 16 bp, Homo sapiens
caagtgattctcctgc

SEQ ID NO: 3456513 - DNA, 18 bp, Homo sapiens
caagtgattctcctgcct

SEQ ID NO: 3456514 - DNA, 22 bp, Homo sapiens
caagtgattctcctgcctcagc

SEQ ID NO: 3456515 - DNA, 19 bp, Homo sapiens
caagtgattgggacagagg

SEQ ID NO: 3456516 - DNA, 20 bp, Homo sapiens
caagtgcacggggcacagcg

SEQ ID NO: 3456517 - DNA, 12 bp, Homo sapiens
caagtggacctt

SEQ ID NO: 3456518 - DNA, 21 bp, Homo sapiens
caagtggaccttaggccttcc

SEQ ID NO: 3456519 - DNA, 23 bp, Homo sapiens
caagtggaccttaggccttcctc

SEQ ID NO: 3456520 - DNA, 15 bp, Homo sapiens
caagtggactcaggg

SEQ ID NO: 3456521 - DNA, 16 bp, Homo sapiens
caagtggactcagggc

SEQ ID NO: 3456522 - DNA, 18 bp, Homo sapiens
caagtggcagagcttgga

SEQ ID NO: 3456523 - DNA, 23 bp, Homo sapiens
caagtggcagagcttggactgga

SEQ ID NO: 3456524 - DNA, 18 bp, Homo sapiens
caagtggtggtaaccctg

SEQ ID NO: 3456525 - DNA, 19 bp, Homo sapiens
caagtggtggtaaccctgg

SEQ ID NO: 3456526 - DNA, 20 bp, Homo sapiens
caagtggtggtaaccctggt

SEQ ID NO: 3456527 - DNA, 12 bp, Homo sapiens
caagtgtctttt

SEQ ID NO: 3456528 - DNA, 22 bp, Homo sapiens
caagtgtggtagagtgtgcctg

SEQ ID NO: 3456529 - DNA, 17 bp, Homo sapiens
caagttttcttccatga

SEQ ID NO: 3456530 - DNA, 17 bp, Homo sapiens
caataaaaaacaaatat

SEQ ID NO: 3456531 - DNA, 14 bp, Homo sapiens
caataaaatattat

SEQ ID NO: 3456532 - DNA, 22 bp, Homo sapiens
caataaaattttttttcatgtt

SEQ ID NO: 3456533 - DNA, 15 bp, Homo sapiens
caataaagcactgag

SEQ ID NO: 3456534 - DNA, 17 bp, Homo sapiens
caataaatctgacccag

SEQ ID NO: 3456535 - DNA, 20 bp, Homo sapiens
caataaatctgacccagtgc

SEQ ID NO: 3456536 - DNA, 15 bp, Homo sapiens
caataaattgctaat

SEQ ID NO: 3456537 - DNA, 15 bp, Homo sapiens
caataacacacagct

SEQ ID NO: 3456538 - DNA, 17 bp, Homo sapiens
caataatgtaatttagt

SEQ ID NO: 3456539 - DNA, 16 bp, Homo sapiens
caataattgcagaact

SEQ ID NO: 3456540 - DNA, 19 bp, Homo sapiens
caatacaaaggttccattc

SEQ ID NO: 3456541 - DNA, 19 bp, Homo sapiens
caatacagtacaggcagca

SEQ ID NO: 3456542 - DNA, 23 bp, Homo sapiens
caatagaaggatgtacatttcca

SEQ ID NO: 3456543 - DNA, 12 bp, Homo sapiens
caatagctgccc

SEQ ID NO: 3456544 - DNA, 18 bp, Homo sapiens
caatagctgcccatttcg

SEQ ID NO: 3456545 - DNA, 15 bp, Homo sapiens
caatagtaactcttt

SEQ ID NO: 3456546 - DNA, 20 bp, Homo sapiens
caatagtgcaactgttttga

SEQ ID NO: 3456547 - DNA, 21 bp, Homo sapiens
caatataatgtttttaatatt

SEQ ID NO: 3456548 - DNA, 20 bp, Homo sapiens
caatatagaaaaataaaaat

SEQ ID NO: 3456549 - DNA, 22 bp, Homo sapiens
caatatagaaaaataaaaatct

SEQ ID NO: 3456550 - DNA, 12 bp, Homo sapiens
caatatagcaag

SEQ ID NO: 3456551 - DNA, 19 bp, Homo sapiens
caatatgtgccaatcaata

SEQ ID NO: 3456552 - DNA, 22 bp, Homo sapiens
caatattataatttttttcaat

SEQ ID NO: 3456553 - DNA, 17 bp, Homo sapiens
caatattcgctgtgtca

SEQ ID NO: 3456554 - DNA, 14 bp, Homo sapiens
caatattgaatttt

SEQ ID NO: 3456555 - DNA, 17 bp, Homo sapiens
caatattgactttgtct

SEQ ID NO: 3456556 - DNA, 20 bp, Homo sapiens
caatattggtgtactgtaat

SEQ ID NO: 3456557 - DNA, 14 bp, Homo sapiens
caatattgtttcta

SEQ ID NO: 3456558 - DNA, 13 bp, Homo sapiens
caatatttattat

SEQ ID NO: 3456559 - DNA, 19 bp, Homo sapiens
caatatttattattttcac

SEQ ID NO: 3456560 - DNA, 18 bp, Homo sapiens
caatcaagtctgtttact

SEQ ID NO: 3456561 - DNA, 21 bp, Homo sapiens
caatcaataaaaaacaaatat

SEQ ID NO: 3456562 - DNA, 21 bp, Homo sapiens
caatcagagaccaggccctgg

SEQ ID NO: 3456563 - DNA, 15 bp, Homo sapiens
caatcagctccttcc

SEQ ID NO: 3456564 - DNA, 16 bp, Homo sapiens
caatcagctccttcct

SEQ ID NO: 3456565 - DNA, 17 bp, Homo sapiens
caatcccagctacctca

SEQ ID NO: 3456566 - DNA, 17 bp, Homo sapiens
caatcctaggtagggtt

SEQ ID NO: 3456567 - DNA, 11 bp, Homo sapiens
caatcctggac

SEQ ID NO: 3456568 - DNA, 17 bp, Homo sapiens
caatctggaagaaaaaa

SEQ ID NO: 3456569 - DNA, 22 bp, Homo sapiens
caatgaaatatgtgaagcccag

SEQ ID NO: 3456570 - DNA, 21 bp, Homo sapiens
caatgatgaatgagaatctac

SEQ ID NO: 3456571 - DNA, 20 bp, Homo sapiens
caatgctgatgtcctcacca

SEQ ID NO: 3456572 - DNA, 14 bp, Homo sapiens
caatgctgatttgg

SEQ ID NO: 3456573 - DNA, 22 bp, Homo sapiens
caatgctggctgttggctgggg

SEQ ID NO: 3456574 - DNA, 23 bp, Homo sapiens
caatgtagtcagaattagctgct

SEQ ID NO: 3456575 - DNA, 21 bp, Homo sapiens
caatgtcatatactgccatgt

SEQ ID NO: 3456576 - DNA, 16 bp, Homo sapiens
caatgtctgagtgaac

SEQ ID NO: 3456577 - DNA, 22 bp, Homo sapiens
caatgtctgcagccctgagaaa

SEQ ID NO: 3456578 - DNA, 23 bp, Homo sapiens
caatgtcttgatgcatgcactgt

SEQ ID NO: 3456579 - DNA, 18 bp, Homo sapiens
caatgtgaactttattaa

SEQ ID NO: 3456580 - DNA, 15 bp, Homo sapiens
caatgtgataaaacc

SEQ ID NO: 3456581 - DNA, 21 bp, Homo sapiens
caatgtggcctaaaaatgcaa

SEQ ID NO: 3456582 - DNA, 15 bp, Homo sapiens
caatgttcatcccat

SEQ ID NO: 3456583 - DNA, 14 bp, Homo sapiens
caatgttctctctt

SEQ ID NO: 3456584 - DNA, 18 bp, Homo sapiens
caatgttggttactaaat

SEQ ID NO: 3456585 - DNA, 21 bp, Homo sapiens
caattataagaggatatgaac

SEQ ID NO: 3456586 - DNA, 14 bp, Homo sapiens
caattcagacaggc

SEQ ID NO: 3456587 - DNA, 23 bp, Homo sapiens
caattcagacaggcaaataaaag

SEQ ID NO: 3456588 - DNA, 13 bp, Homo sapiens
caattccactctg

SEQ ID NO: 3456589 - DNA, 22 bp, Homo sapiens
caattccactctgatagaatta

SEQ ID NO: 3456590 - DNA, 21 bp, Homo sapiens
caattccgtagccagctgctc

SEQ ID NO: 3456591 - DNA, 13 bp, Homo sapiens
caattcctctggg

SEQ ID NO: 3456592 - DNA, 23 bp, Homo sapiens
caattctcatttgtcacacactt

SEQ ID NO: 3456593 - DNA, 14 bp, Homo sapiens
caattctgttttta

SEQ ID NO: 3456594 - DNA, 23 bp, Homo sapiens
caattctgtttttaatgctattt

SEQ ID NO: 3456595 - DNA, 22 bp, Homo sapiens
caattgaaggatcatctgaagg

SEQ ID NO: 3456596 - DNA, 21 bp, Homo sapiens
caattggattggaatgcagag

SEQ ID NO: 3456597 - DNA, 18 bp, Homo sapiens
caattgtgagccaccacg

SEQ ID NO: 3456598 - DNA, 15 bp, Homo sapiens
caatttacaaagtgt

SEQ ID NO: 3456599 - DNA, 16 bp, Homo sapiens
caatttgcaccagttt

SEQ ID NO: 3456600 - DNA, 21 bp, Homo sapiens
caattttaatttagtaaatgt

SEQ ID NO: 3456601 - DNA, 23 bp, Homo sapiens
caattttaatttagtaaatgtta

SEQ ID NO: 3456602 - DNA, 13 bp, Homo sapiens
cacaaaacagcct

SEQ ID NO: 3456603 - DNA, 22 bp, Homo sapiens
cacaaaataaccaatcctggac

SEQ ID NO: 3456604 - DNA, 19 bp, Homo sapiens
cacaaagaaaattcctata

SEQ ID NO: 3456605 - DNA, 18 bp, Homo sapiens
cacaaagaccaaaatgaa

SEQ ID NO: 3456606 - DNA, 19 bp, Homo sapiens
cacaaagaccaaaatgaaa

SEQ ID NO: 3456607 - DNA, 22 bp, Homo sapiens
cacaaagatgggtgaaggctgg

SEQ ID NO: 3456608 - DNA, 11 bp, Homo sapiens
cacaaagccca

SEQ ID NO: 3456609 - DNA, 12 bp, Homo sapiens
cacaaagcccaa

SEQ ID NO: 3456610 - DNA, 19 bp, Homo sapiens
cacaaagctcaagatgaca

SEQ ID NO: 3456611 - DNA, 14 bp, Homo sapiens
cacaacgtgcattg

SEQ ID NO: 3456612 - DNA, 17 bp, Homo sapiens
cacaacgtgcattgtgc

SEQ ID NO: 3456613 - DNA, 19 bp, Homo sapiens
cacaacgtgcattgtgctt

SEQ ID NO: 3456614 - DNA, 20 bp, Homo sapiens
cacaacttgtttttggtttt

SEQ ID NO: 3456615 - DNA, 19 bp, Homo sapiens
cacaagatgccccagggat

SEQ ID NO: 3456616 - DNA, 14 bp, Homo sapiens
cacaagcacaaagc

SEQ ID NO: 3456617 - DNA, 23 bp, Homo sapiens
cacaaggactgccgccttctcgc

SEQ ID NO: 3456618 - DNA, 14 bp, Homo sapiens
cacaaggacttcct

SEQ ID NO: 3456619 - DNA, 16 bp, Homo sapiens
cacaagtgaaaaacat

SEQ ID NO: 3456620 - DNA, 21 bp, Homo sapiens
cacaagtgccgcaaattgtac

SEQ ID NO: 3456621 - DNA, 21 bp, Homo sapiens
cacaatattcaatcaaaattt

SEQ ID NO: 3456622 - DNA, 20 bp, Homo sapiens
cacaatgcataatgtcttta

SEQ ID NO: 3456623 - DNA, 21 bp, Homo sapiens
cacaattccatttccagttca

SEQ ID NO: 3456624 - DNA, 19 bp, Homo sapiens
cacacacaaaagggaaccc

SEQ ID NO: 3456625 - DNA, 16 bp, Homo sapiens
cacacacacagccagg

SEQ ID NO: 3456626 - DNA, 15 bp, Homo sapiens
cacacaccagagccc

SEQ ID NO: 3456627 - DNA, 11 bp, Homo sapiens
cacacacctgt

SEQ ID NO: 3456628 - DNA, 17 bp, Homo sapiens
cacacagatacacacac

SEQ ID NO: 3456629 - DNA, 18 bp, Homo sapiens
cacacagctactctcccc

SEQ ID NO: 3456630 - DNA, 15 bp, Homo sapiens
cacacagctctgtcc

SEQ ID NO: 3456631 - DNA, 20 bp, Homo sapiens
cacacagctctgtcctggga

SEQ ID NO: 3456632 - DNA, 23 bp, Homo sapiens
cacacagtattacttctgctaca

SEQ ID NO: 3456633 - DNA, 21 bp, Homo sapiens
cacacagtgagtcgaggacag

SEQ ID NO: 3456634 - DNA, 23 bp, Homo sapiens
cacacagtgagtcgaggacaggg

SEQ ID NO: 3456635 - DNA, 15 bp, Homo sapiens
cacacatacacacac

SEQ ID NO: 3456636 - DNA, 21 bp, Homo sapiens
cacacatataaacatcacaca

SEQ ID NO: 3456637 - DNA, 22 bp, Homo sapiens
cacaccagagcccaccttggct

SEQ ID NO: 3456638 - DNA, 14 bp, Homo sapiens
cacaccaggataga

SEQ ID NO: 3456639 - DNA, 13 bp, Homo sapiens
cacacccagccca

SEQ ID NO: 3456640 - DNA, 23 bp, Homo sapiens
cacaccctccccattcagacact

SEQ ID NO: 3456641 - DNA, 22 bp, Homo sapiens
cacacctgtaatcccagcactt

SEQ ID NO: 3456642 - DNA, 22 bp, Homo sapiens
cacacggacactcaaaagctgg

SEQ ID NO: 3456643 - DNA, 23 bp, Homo sapiens
cacacggctcccccaggcctgag

SEQ ID NO: 3456644 - DNA, 19 bp, Homo sapiens
cacacggtttgaagcctgg

SEQ ID NO: 3456645 - DNA, 14 bp, Homo sapiens
cacactcatcccct

SEQ ID NO: 3456646 - DNA, 21 bp, Homo sapiens
cacactcccaaggttggagcc

SEQ ID NO: 3456647 - DNA, 23 bp, Homo sapiens
cacactcccaaggttggagccca

SEQ ID NO: 3456648 - DNA, 14 bp, Homo sapiens
cacactgaggcagg

SEQ ID NO: 3456649 - DNA, 16 bp, Homo sapiens
cacactgaggcaggga

SEQ ID NO: 3456650 - DNA, 18 bp, Homo sapiens
cacactgaggcagggaag

SEQ ID NO: 3456651 - DNA, 22 bp, Homo sapiens
cacactgggtggtggcctggtc

SEQ ID NO: 3456652 - DNA, 18 bp, Homo sapiens
cacactgtcatgcttcat

SEQ ID NO: 3456653 - DNA, 20 bp, Homo sapiens
cacactgtcatgcttcatca

SEQ ID NO: 3456654 - DNA, 17 bp, Homo sapiens
cacactttttaagaaat

SEQ ID NO: 3456655 - DNA, 14 bp, Homo sapiens
cacagaaatgctgc

SEQ ID NO: 3456656 - DNA, 19 bp, Homo sapiens
cacagaaatgctgctggcc

SEQ ID NO: 3456657 - DNA, 21 bp, Homo sapiens
cacagaaatgctgctggccaa

SEQ ID NO: 3456658 - DNA, 14 bp, Homo sapiens
cacagaagtcctgt

SEQ ID NO: 3456659 - DNA, 22 bp, Homo sapiens
cacagaagtcctgtatgtctgt

SEQ ID NO: 3456660 - DNA, 20 bp, Homo sapiens
cacagacattctgccaggcc

SEQ ID NO: 3456661 - DNA, 22 bp, Homo sapiens
cacagacgttaggcatttcctg

SEQ ID NO: 3456662 - DNA, 18 bp, Homo sapiens
cacagactcaaatgctca

SEQ ID NO: 3456663 - DNA, 19 bp, Homo sapiens
cacagagaaagtacttctc

SEQ ID NO: 3456664 - DNA, 20 bp, Homo sapiens
cacagagaaagtacttctcc

SEQ ID NO: 3456665 - DNA, 14 bp, Homo sapiens
cacagagcaggact

SEQ ID NO: 3456666 - DNA, 21 bp, Homo sapiens
cacagagcaggactgcacagc

SEQ ID NO: 3456667 - DNA, 16 bp, Homo sapiens
cacagatacacacaca

SEQ ID NO: 3456668 - DNA, 18 bp, Homo sapiens
cacagatagacctttttt

SEQ ID NO: 3456669 - DNA, 18 bp, Homo sapiens
cacagatcgcatttccta

SEQ ID NO: 3456670 - DNA, 19 bp, Homo sapiens
cacagatcgcatttcctaa

SEQ ID NO: 3456671 - DNA, 20 bp, Homo sapiens
cacagatgagttatctaaga

SEQ ID NO: 3456672 - DNA, 13 bp, Homo sapiens
cacagatttgcat

SEQ ID NO: 3456673 - DNA, 20 bp, Homo sapiens
cacagcaacattttcttgaa

SEQ ID NO: 3456674 - DNA, 18 bp, Homo sapiens
cacagcaaccccaggctg

SEQ ID NO: 3456675 - DNA, 14 bp, Homo sapiens
cacagcagcctggg

SEQ ID NO: 3456676 - DNA, 15 bp, Homo sapiens
cacagccagcacctg

SEQ ID NO: 3456677 - DNA, 21 bp, Homo sapiens
cacagccgattcacctgagca

SEQ ID NO: 3456678 - DNA, 20 bp, Homo sapiens
cacagcctcccctgccaggg

SEQ ID NO: 3456679 - DNA, 21 bp, Homo sapiens
cacagcggaggtgtggagccg

SEQ ID NO: 3456680 - DNA, 21 bp, Homo sapiens
cacagctaacaattgtgaagt

SEQ ID NO: 3456681 - DNA, 18 bp, Homo sapiens
cacagctctgtcctggga

SEQ ID NO: 3456682 - DNA, 17 bp, Homo sapiens
cacagctcttctccagg

SEQ ID NO: 3456683 - DNA, 21 bp, Homo sapiens
cacagctcttctccaggctgt

SEQ ID NO: 3456684 - DNA, 18 bp, Homo sapiens
cacagcttgacctgaggc

SEQ ID NO: 3456685 - DNA, 21 bp, Homo sapiens
cacagcttgacctgaggctgt

SEQ ID NO: 3456686 - DNA, 22 bp, Homo sapiens
cacagcttgacctgaggctgtg

SEQ ID NO: 3456687 - DNA, 14 bp, Homo sapiens
cacagcttttccaa

SEQ ID NO: 3456688 - DNA, 23 bp, Homo sapiens
cacaggacacctggccgcctcca

SEQ ID NO: 3456689 - DNA, 22 bp, Homo sapiens
cacaggacatgcggtagccagc

SEQ ID NO: 3456690 - DNA, 17 bp, Homo sapiens
cacaggacatttctcta

SEQ ID NO: 3456691 - DNA, 20 bp, Homo sapiens
cacaggagtgtcctcttccc

SEQ ID NO: 3456692 - DNA, 22 bp, Homo sapiens
cacaggagtgtcctcttccctc

SEQ ID NO: 3456693 - DNA, 16 bp, Homo sapiens
cacaggatcagtctga

SEQ ID NO: 3456694 - DNA, 19 bp, Homo sapiens
cacaggcaggtccagggtt

SEQ ID NO: 3456695 - DNA, 13 bp, Homo sapiens
cacaggcctgaga

SEQ ID NO: 3456696 - DNA, 14 bp, Homo sapiens
cacaggcctgagat

SEQ ID NO: 3456697 - DNA, 23 bp, Homo sapiens
cacaggcctgagatttcatctgc

SEQ ID NO: 3456698 - DNA, 22 bp, Homo sapiens
cacagggactgaaaacctctcc

SEQ ID NO: 3456699 - DNA, 17 bp, Homo sapiens
cacagggacttgaagtt

SEQ ID NO: 3456700 - DNA, 21 bp, Homo sapiens
cacagggacttgaagttgtta

SEQ ID NO: 3456701 - DNA, 20 bp, Homo sapiens
cacagggcttgttttccaaa

SEQ ID NO: 3456702 - DNA, 14 bp, Homo sapiens
cacagggtctgcct

SEQ ID NO: 3456703 - DNA, 15 bp, Homo sapiens
cacagggtctgcctc

SEQ ID NO: 3456704 - DNA, 20 bp, Homo sapiens
cacagggtctgcctccagcc

SEQ ID NO: 3456705 - DNA, 16 bp, Homo sapiens
cacaggtacagcaaca

SEQ ID NO: 3456706 - DNA, 19 bp, Homo sapiens
cacaggtacagcaacagga

SEQ ID NO: 3456707 - DNA, 14 bp, Homo sapiens
cacaggtctttcct

SEQ ID NO: 3456708 - DNA, 20 bp, Homo sapiens
cacaggtctttcctaaggct

SEQ ID NO: 3456709 - DNA, 16 bp, Homo sapiens
cacaggtgtcagccat

SEQ ID NO: 3456710 - DNA, 14 bp, Homo sapiens
cacaggtgtgagcc

SEQ ID NO: 3456711 - DNA, 13 bp, Homo sapiens
cacagtagtcttg

SEQ ID NO: 3456712 - DNA, 16 bp, Homo sapiens
cacagtattacttctg

SEQ ID NO: 3456713 - DNA, 19 bp, Homo sapiens
cacagtattacttctgcta

SEQ ID NO: 3456714 - DNA, 19 bp, Homo sapiens
cacagtgagtcgaggacag

SEQ ID NO: 3456715 - DNA, 21 bp, Homo sapiens
cacagtgagtcgaggacaggg

SEQ ID NO: 3456716 - DNA, 22 bp, Homo sapiens
cacagtgagtcgaggacaggga

SEQ ID NO: 3456717 - DNA, 14 bp, Homo sapiens
cacagtgttgccca

SEQ ID NO: 3456718 - DNA, 20 bp, Homo sapiens
cacagttctttgggccagac

SEQ ID NO: 3456719 - DNA, 18 bp, Homo sapiens
cacagttgaagggagggg

SEQ ID NO: 3456720 - DNA, 19 bp, Homo sapiens
cacagttgaccctattttt

SEQ ID NO: 3456721 - DNA, 14 bp, Homo sapiens
cacatatctgtcat

SEQ ID NO: 3456722 - DNA, 22 bp, Homo sapiens
cacatcctccacgttctgctca

SEQ ID NO: 3456723 - DNA, 17 bp, Homo sapiens
cacatctaacctcatct

SEQ ID NO: 3456724 - DNA, 13 bp, Homo sapiens
cacatctaagcct

SEQ ID NO: 3456725 - DNA, 17 bp, Homo sapiens
cacatctaagcctgaag

SEQ ID NO: 3456726 - DNA, 22 bp, Homo sapiens
cacatctaagcctgaaggggcg

SEQ ID NO: 3456727 - DNA, 12 bp, Homo sapiens
cacatcttccct

SEQ ID NO: 3456728 - DNA, 13 bp, Homo sapiens
cacatcttgctct

SEQ ID NO: 3456729 - DNA, 16 bp, Homo sapiens
cacatcttgctctgct

SEQ ID NO: 3456730 - DNA, 17 bp, Homo sapiens
cacatcttgctctgctg

SEQ ID NO: 3456731 - DNA, 19 bp, Homo sapiens
cacatcttgctctgctgac

SEQ ID NO: 3456732 - DNA, 23 bp, Homo sapiens
cacatcttgctctgctgacagac

SEQ ID NO: 3456733 - DNA, 17 bp, Homo sapiens
cacatgagaatgctagc

SEQ ID NO: 3456734 - DNA, 15 bp, Homo sapiens
cacatgctatgttct

SEQ ID NO: 3456735 - DNA, 19 bp, Homo sapiens
cacatgctatgttctgtct

SEQ ID NO: 3456736 - DNA, 20 bp, Homo sapiens
cacatgctcaggctactata

SEQ ID NO: 3456737 - DNA, 20 bp, Homo sapiens
cacatggaaaaaaaaaaaac

SEQ ID NO: 3456738 - DNA, 20 bp, Homo sapiens
cacatggtgctacgcctgca

SEQ ID NO: 3456739 - DNA, 22 bp, Homo sapiens
cacatggtgctacgcctgcatg

SEQ ID NO: 3456740 - DNA, 14 bp, Homo sapiens
cacatgtcttaatg

SEQ ID NO: 3456741 - DNA, 16 bp, Homo sapiens
cacatgtcttaatgaa

SEQ ID NO: 3456742 - DNA, 17 bp, Homo sapiens
cacatgtcttaatgaag

SEQ ID NO: 3456743 - DNA, 15 bp, Homo sapiens
cacatgtgcacatgc

SEQ ID NO: 3456744 - DNA, 22 bp, Homo sapiens
cacatgttggaggagagagcct

SEQ ID NO: 3456745 - DNA, 12 bp, Homo sapiens
cacatgtttcct

SEQ ID NO: 3456746 - DNA, 14 bp, Homo sapiens
cacatgtttcctct

SEQ ID NO: 3456747 - DNA, 19 bp, Homo sapiens
cacattccttgcctgcaca

SEQ ID NO: 3456748 - DNA, 20 bp, Homo sapiens
cacattcctttgggtatgtt

SEQ ID NO: 3456749 - DNA, 11 bp, Homo sapiens
cacattctgct

SEQ ID NO: 3456750 - DNA, 13 bp, Homo sapiens
cacattcttggct

SEQ ID NO: 3456751 - DNA, 22 bp, Homo sapiens
cacattcttggcttaatcattt

SEQ ID NO: 3456752 - DNA, 16 bp, Homo sapiens
cacatttaagagacag

SEQ ID NO: 3456753 - DNA, 17 bp, Homo sapiens
cacatttattctgctca

SEQ ID NO: 3456754 - DNA, 17 bp, Homo sapiens
cacatttggaatacttt

SEQ ID NO: 3456755 - DNA, 16 bp, Homo sapiens
caccaacttacaaaaa

SEQ ID NO: 3456756 - DNA, 22 bp, Homo sapiens
caccaagacttgttttatgctc

SEQ ID NO: 3456757 - DNA, 15 bp, Homo sapiens
caccaagcacagcag

SEQ ID NO: 3456758 - DNA, 17 bp, Homo sapiens
caccaagcacagcagcc

SEQ ID NO: 3456759 - DNA, 14 bp, Homo sapiens
caccaagccaaggg

SEQ ID NO: 3456760 - DNA, 12 bp, Homo sapiens
caccaaggaaac

SEQ ID NO: 3456761 - DNA, 16 bp, Homo sapiens
caccaagggacaggag

SEQ ID NO: 3456762 - DNA, 18 bp, Homo sapiens
caccaagggacaggagaa

SEQ ID NO: 3456763 - DNA, 20 bp, Homo sapiens
caccaagggacaggagaaga

SEQ ID NO: 3456764 - DNA, 17 bp, Homo sapiens
caccacacccagcccac

SEQ ID NO: 3456765 - DNA, 19 bp, Homo sapiens
caccacacccagcccactt

SEQ ID NO: 3456766 - DNA, 17 bp, Homo sapiens
caccacagccagcacct

SEQ ID NO: 3456767 - DNA, 14 bp, Homo sapiens
caccacccccacga

SEQ ID NO: 3456768 - DNA, 16 bp, Homo sapiens
caccaccctgtcttcc

SEQ ID NO: 3456769 - DNA, 13 bp, Homo sapiens
caccacctcagag

SEQ ID NO: 3456770 - DNA, 14 bp, Homo sapiens
caccacctcagagt

SEQ ID NO: 3456771 - DNA, 14 bp, Homo sapiens
caccactataaaat

SEQ ID NO: 3456772 - DNA, 16 bp, Homo sapiens
caccagacacccagga

SEQ ID NO: 3456773 - DNA, 22 bp, Homo sapiens
caccagagcccaccttggctca

SEQ ID NO: 3456774 - DNA, 14 bp, Homo sapiens
caccagcagcctgg

SEQ ID NO: 3456775 - DNA, 15 bp, Homo sapiens
caccagcagcctgga

SEQ ID NO: 3456776 - DNA, 12 bp, Homo sapiens
caccagccagcg

SEQ ID NO: 3456777 - DNA, 18 bp, Homo sapiens
caccagccccagtgccca

SEQ ID NO: 3456778 - DNA, 21 bp, Homo sapiens
caccagccccagtgcccacag

SEQ ID NO: 3456779 - DNA, 13 bp, Homo sapiens
aaaatctgttggt

SEQ ID NO: 3456780 - DNA, 19 bp, Homo sapiens
aaaatctttctttcttaga

SEQ ID NO: 3456781 - DNA, 20 bp, Homo sapiens
aaaatctttctttcttagaa

SEQ ID NO: 3456782 - DNA, 16 bp, Homo sapiens
aaaatgaattggttgg

SEQ ID NO: 3456783 - DNA, 19 bp, Homo sapiens
aaaatgagagctgtaactg

SEQ ID NO: 3456784 - DNA, 15 bp, Homo sapiens
aaaatgaggaatgta

SEQ ID NO: 3456785 - DNA, 14 bp, Homo sapiens
aaaatgcaaatcct

SEQ ID NO: 3456786 - DNA, 22 bp, Homo sapiens
aaaatgcaaatcctatgtgatt

SEQ ID NO: 3456787 - DNA, 18 bp, Homo sapiens
aaaatgcagcagggatgc

SEQ ID NO: 3456788 - DNA, 19 bp, Homo sapiens
aaaatgcctcagtgtattt

SEQ ID NO: 3456789 - DNA, 20 bp, Homo sapiens
aaaatgcctcagtgtatttg

SEQ ID NO: 3456790 - DNA, 13 bp, Homo sapiens
aaaatgcttttta

SEQ ID NO: 3456791 - DNA, 14 bp, Homo sapiens
aaaatgtaaagcca

SEQ ID NO: 3456792 - DNA, 16 bp, Homo sapiens
aaaatgtagaatattc

SEQ ID NO: 3456793 - DNA, 14 bp, Homo sapiens
aaaatgtatatgca

SEQ ID NO: 3456794 - DNA, 15 bp, Homo sapiens
aaaatgtcttcaagg

SEQ ID NO: 3456795 - DNA, 18 bp, Homo sapiens
aaaatgtcttgtgttacc

SEQ ID NO: 3456796 - DNA, 11 bp, Homo sapiens
aaaatgtgtaa

SEQ ID NO: 3456797 - DNA, 17 bp, Homo sapiens
aaaatgtgtaattttgt

SEQ ID NO: 3456798 - DNA, 13 bp, Homo sapiens
aaaatgttgaaaa

SEQ ID NO: 3456799 - DNA, 14 bp, Homo sapiens
aaaatgttgagaat

SEQ ID NO: 3456800 - DNA, 14 bp, Homo sapiens
aaaatgttttctgg

SEQ ID NO: 3456801 - DNA, 15 bp, Homo sapiens
aaaatgttttttcat

SEQ ID NO: 3456802 - DNA, 21 bp, Homo sapiens
aaaatgttttttcatgtgttt

SEQ ID NO: 3456803 - DNA, 11 bp, Homo sapiens
aaaattaaagc

SEQ ID NO: 3456804 - DNA, 15 bp, Homo sapiens
aaaattagccaagtg

SEQ ID NO: 3456805 - DNA, 20 bp, Homo sapiens
aaaattagggagctcttgac

SEQ ID NO: 3456806 - DNA, 17 bp, Homo sapiens
aaaattcaattgtaaat

SEQ ID NO: 3456807 - DNA, 14 bp, Homo sapiens
aaaattcacataat

SEQ ID NO: 3456808 - DNA, 13 bp, Homo sapiens
aaaattcagtgga

SEQ ID NO: 3456809 - DNA, 21 bp, Homo sapiens
aaaattctgaattttggggat

SEQ ID NO: 3456810 - DNA, 12 bp, Homo sapiens
aaaattgccata

SEQ ID NO: 3456811 - DNA, 21 bp, Homo sapiens
aaaattgccatattgcacatg

SEQ ID NO: 3456812 - DNA, 16 bp, Homo sapiens
aaaattggttggagaa

SEQ ID NO: 3456813 - DNA, 17 bp, Homo sapiens
aaaattggttggagaat

SEQ ID NO: 3456814 - DNA, 15 bp, Homo sapiens
aaaattgtgaagcta

SEQ ID NO: 3456815 - DNA, 18 bp, Homo sapiens
aaaatttattttataaga

SEQ ID NO: 3456816 - DNA, 14 bp, Homo sapiens
aaaatttttttaga

SEQ ID NO: 3456817 - DNA, 16 bp, Homo sapiens
aaaatttttttagaaa

SEQ ID NO: 3456818 - DNA, 15 bp, Homo sapiens
aaaattttttttcat

SEQ ID NO: 3456819 - DNA, 14 bp, Homo sapiens
aaacaaaaaatgtg

SEQ ID NO: 3456820 - DNA, 18 bp, Homo sapiens
aaacaaaaaatgtgctgt

SEQ ID NO: 3456821 - DNA, 18 bp, Homo sapiens
aaacaaaaacaaaaccag

SEQ ID NO: 3456822 - DNA, 12 bp, Homo sapiens
aaacaaaaagaa

SEQ ID NO: 3456823 - DNA, 17 bp, Homo sapiens
aaacaaaaagaacaaaa

SEQ ID NO: 3456824 - DNA, 18 bp, Homo sapiens
aaacaaaatggcttcagt

SEQ ID NO: 3456825 - DNA, 14 bp, Homo sapiens
aaacaaaatttcta

SEQ ID NO: 3456826 - DNA, 12 bp, Homo sapiens
aaacaaaatttg

SEQ ID NO: 3456827 - DNA, 13 bp, Homo sapiens
aaacaaaatttga

SEQ ID NO: 3456828 - DNA, 23 bp, Homo sapiens
aaacaagccaagaaagatgtata

SEQ ID NO: 3456829 - DNA, 16 bp, Homo sapiens
aaacaataaatgtgca

SEQ ID NO: 3456830 - DNA, 22 bp, Homo sapiens
aaacaatagtaattctcaggcc

SEQ ID NO: 3456831 - DNA, 14 bp, Homo sapiens
aaacaatattgttt

SEQ ID NO: 3456832 - DNA, 16 bp, Homo sapiens
aaacaatgaatgtctt

SEQ ID NO: 3456833 - DNA, 14 bp, Homo sapiens
aaacaattttttgt

SEQ ID NO: 3456834 - DNA, 15 bp, Homo sapiens
aaacaattttttgtt

SEQ ID NO: 3456835 - DNA, 19 bp, Homo sapiens
aaacaccaacatgttggga

SEQ ID NO: 3456836 - DNA, 21 bp, Homo sapiens
aaacacttcgttcgcagagct

SEQ ID NO: 3456837 - DNA, 20 bp, Homo sapiens
aaacagactcgattcatatt

SEQ ID NO: 3456838 - DNA, 19 bp, Homo sapiens
aaacagatatcttcagttt

SEQ ID NO: 3456839 - DNA, 18 bp, Homo sapiens
aaacagatgtgaatattc

SEQ ID NO: 3456840 - DNA, 12 bp, Homo sapiens
aaacagctgcct

SEQ ID NO: 3456841 - DNA, 18 bp, Homo sapiens
aaacagctgccttagctt

SEQ ID NO: 3456842 - DNA, 20 bp, Homo sapiens
aaacatcagttactctgaag

SEQ ID NO: 3456843 - DNA, 15 bp, Homo sapiens
aaacatctattctct

SEQ ID NO: 3456844 - DNA, 21 bp, Homo sapiens
aaacatgaccctaaatcttga

SEQ ID NO: 3456845 - DNA, 12 bp, Homo sapiens
aaacatgtatgt

SEQ ID NO: 3456846 - DNA, 13 bp, Homo sapiens
aaacattaagaaa

SEQ ID NO: 3456847 - DNA, 14 bp, Homo sapiens
aaacattaagaaaa

SEQ ID NO: 3456848 - DNA, 16 bp, Homo sapiens
aaacattaagaaaatc

SEQ ID NO: 3456849 - DNA, 20 bp, Homo sapiens
aaacattaagaaaatcatat

SEQ ID NO: 3456850 - DNA, 19 bp, Homo sapiens
aaacattgcctttgaatgt

SEQ ID NO: 3456851 - DNA, 14 bp, Homo sapiens
aaaccaaaatgata

SEQ ID NO: 3456852 - DNA, 17 bp, Homo sapiens
aaaccaaagctttattt

SEQ ID NO: 3456853 - DNA, 12 bp, Homo sapiens
aaaccacacaaa

SEQ ID NO: 3456854 - DNA, 12 bp, Homo sapiens
aaaccacagcag

SEQ ID NO: 3456855 - DNA, 10 bp, Homo sapiens
aaaccacttt

SEQ ID NO: 3456856 - DNA, 15 bp, Homo sapiens
aaaccatgcctggta

SEQ ID NO: 3456857 - DNA, 23 bp, Homo sapiens
aaacccaccagcctaagaagctc

SEQ ID NO: 3456858 - DNA, 12 bp, Homo sapiens
aaaccctatatg

SEQ ID NO: 3456859 - DNA, 16 bp, Homo sapiens
aaaccgccaaggctgg

SEQ ID NO: 3456860 - DNA, 15 bp, Homo sapiens
aaacctaaaaaagat

SEQ ID NO: 3456861 - DNA, 17 bp, Homo sapiens
aaacctaaaaaagatat

SEQ ID NO: 3456862 - DNA, 17 bp, Homo sapiens
aaacctcattgttctgt

SEQ ID NO: 3456863 - DNA, 11 bp, Homo sapiens
aaacctctcct

SEQ ID NO: 3456864 - DNA, 11 bp, Homo sapiens
aaacctctgtt

SEQ ID NO: 3456865 - DNA, 16 bp, Homo sapiens
aaacctctgttcagtg

SEQ ID NO: 3456866 - DNA, 15 bp, Homo sapiens
aaacctggatgtcac

SEQ ID NO: 3456867 - DNA, 19 bp, Homo sapiens
aaacctgttgaagattatt

SEQ ID NO: 3456868 - DNA, 13 bp, Homo sapiens
aaaccttagtttc

SEQ ID NO: 3456869 - DNA, 17 bp, Homo sapiens
aaaccttattgtacctc

SEQ ID NO: 3456870 - DNA, 18 bp, Homo sapiens
aaaccttattgtacctct

SEQ ID NO: 3456871 - DNA, 14 bp, Homo sapiens
aaaccttctgcctt

SEQ ID NO: 3456872 - DNA, 12 bp, Homo sapiens
aaacgctacctc

SEQ ID NO: 3456873 - DNA, 14 bp, Homo sapiens
aaacgctcctttgt

SEQ ID NO: 3456874 - DNA, 15 bp, Homo sapiens
aaactaaggtgctaa

SEQ ID NO: 3456875 - DNA, 18 bp, Homo sapiens
aaactagggccaagccca

SEQ ID NO: 3456876 - DNA, 18 bp, Homo sapiens
aaactatattttgtcata

SEQ ID NO: 3456877 - DNA, 22 bp, Homo sapiens
aaactattaaggatgtagcttt

SEQ ID NO: 3456878 - DNA, 14 bp, Homo sapiens
aaactcatctcatt

SEQ ID NO: 3456879 - DNA, 15 bp, Homo sapiens
aaactcatttataaa

SEQ ID NO: 3456880 - DNA, 23 bp, Homo sapiens
aaactctctttgggaatgtttgt

SEQ ID NO: 3456881 - DNA, 12 bp, Homo sapiens
aaactcttaaaa

SEQ ID NO: 3456882 - DNA, 16 bp, Homo sapiens
aaactcttcagttaat

SEQ ID NO: 3456883 - DNA, 19 bp, Homo sapiens
aaactcttcagttaattct

SEQ ID NO: 3456884 - DNA, 15 bp, Homo sapiens
aaactgagacaggca

SEQ ID NO: 3456885 - DNA, 17 bp, Homo sapiens
aaactgagacaggcagt

SEQ ID NO: 3456886 - DNA, 23 bp, Homo sapiens
aaactgcataagtgaaaatctta

SEQ ID NO: 3456887 - DNA, 13 bp, Homo sapiens
aaactggctttgg

SEQ ID NO: 3456888 - DNA, 14 bp, Homo sapiens
aaactggctttggc

SEQ ID NO: 3456889 - DNA, 16 bp, Homo sapiens
aaactggtattttatc

SEQ ID NO: 3456890 - DNA, 22 bp, Homo sapiens
aaactggtattttatctttgat

SEQ ID NO: 3456891 - DNA, 12 bp, Homo sapiens
aaactgtaaact

SEQ ID NO: 3456892 - DNA, 20 bp, Homo sapiens
aaactgtctttaaaagagag

SEQ ID NO: 3456893 - DNA, 17 bp, Homo sapiens
aaactgtgcttctctat

SEQ ID NO: 3456894 - DNA, 20 bp, Homo sapiens
aaactgttcccacctgctgg

SEQ ID NO: 3456895 - DNA, 15 bp, Homo sapiens
aaactgtttttacta

SEQ ID NO: 3456896 - DNA, 15 bp, Homo sapiens
aaacttcgctgtccc

SEQ ID NO: 3456897 - DNA, 18 bp, Homo sapiens
aaacttggattctctaac

SEQ ID NO: 3456898 - DNA, 13 bp, Homo sapiens
aaactttaatata

SEQ ID NO: 3456899 - DNA, 12 bp, Homo sapiens
aaactttccttt

SEQ ID NO: 3456900 - DNA, 22 bp, Homo sapiens
aaactttgaggataacttttta

SEQ ID NO: 3456901 - DNA, 22 bp, Homo sapiens
aaactttgctttgggtttgtgg

SEQ ID NO: 3456902 - DNA, 23 bp, Homo sapiens
aaagaaacccgacagagggaaga

SEQ ID NO: 3456903 - DNA, 12 bp, Homo sapiens
aaagaacataaa

SEQ ID NO: 3456904 - DNA, 12 bp, Homo sapiens
aaagaacttacc

SEQ ID NO: 3456905 - DNA, 20 bp, Homo sapiens
aaagaagactgtgtttttgc

SEQ ID NO: 3456906 - DNA, 14 bp, Homo sapiens
aaagaagatctgta

SEQ ID NO: 3456907 - DNA, 15 bp, Homo sapiens
aaagaagatctgtaa

SEQ ID NO: 3456908 - DNA, 21 bp, Homo sapiens
aaagaataagtgtctttctgg

SEQ ID NO: 3456909 - DNA, 14 bp, Homo sapiens
aaagaatacttgaa

SEQ ID NO: 3456910 - DNA, 17 bp, Homo sapiens
aaagaatacttgaactt

SEQ ID NO: 3456911 - DNA, 13 bp, Homo sapiens
aaagaatgttact

SEQ ID NO: 3456912 - DNA, 19 bp, Homo sapiens
aaagacaaattctgtttct

SEQ ID NO: 3456913 - DNA, 13 bp, Homo sapiens
aaagacaagactt

SEQ ID NO: 3456914 - DNA, 23 bp, Homo sapiens
aagaataaaatgttgaaaagtca

SEQ ID NO: 3456915 - DNA, 14 bp, Homo sapiens
aagaatacttgaac

SEQ ID NO: 3456916 - DNA, 21 bp, Homo sapiens
aagaatccttttgtagaatga

SEQ ID NO: 3456917 - DNA, 13 bp, Homo sapiens
aagaatggaaaag

SEQ ID NO: 3456918 - DNA, 13 bp, Homo sapiens
aagaatttgtttt

SEQ ID NO: 3456919 - DNA, 17 bp, Homo sapiens
aagacaaatcaaagcag

SEQ ID NO: 3456920 - DNA, 16 bp, Homo sapiens
aagacagaagtttgca

SEQ ID NO: 3456921 - DNA, 17 bp, Homo sapiens
aagacagagaaacagac

SEQ ID NO: 3456922 - DNA, 22 bp, Homo sapiens
aagacagcttctcatcctgcag

SEQ ID NO: 3456923 - DNA, 15 bp, Homo sapiens
aagacatgatttcct

SEQ ID NO: 3456924 - DNA, 14 bp, Homo sapiens
aagaccaaaatgaa

SEQ ID NO: 3456925 - DNA, 23 bp, Homo sapiens
aagaccagagatagtggggagac

SEQ ID NO: 3456926 - DNA, 13 bp, Homo sapiens
aagacccccagca

SEQ ID NO: 3456927 - DNA, 12 bp, Homo sapiens
aagacctggcaa

SEQ ID NO: 3456928 - DNA, 21 bp, Homo sapiens
aagacggcacggtcttccctc

SEQ ID NO: 3456929 - DNA, 15 bp, Homo sapiens
aagacgtatgtaaca

SEQ ID NO: 3456930 - DNA, 18 bp, Homo sapiens
aagacgtcccttttttct

SEQ ID NO: 3456931 - DNA, 16 bp, Homo sapiens
aagacgtgtttgtgtt

SEQ ID NO: 3456932 - DNA, 17 bp, Homo sapiens
aagactcattcttctgt

SEQ ID NO: 3456933 - DNA, 19 bp, Homo sapiens
aagactccagtactatttt

SEQ ID NO: 3456934 - DNA, 20 bp, Homo sapiens
aagactggaagctaatttgc

SEQ ID NO: 3456935 - DNA, 21 bp, Homo sapiens
aagactggaaggtggggacag

SEQ ID NO: 3456936 - DNA, 21 bp, Homo sapiens
aagacttcagtatgttgtcaa

SEQ ID NO: 3456937 - DNA, 20 bp, Homo sapiens
aagacttgcatttaaatgtg

SEQ ID NO: 3456938 - DNA, 13 bp, Homo sapiens
aagagaaaaaata

SEQ ID NO: 3456939 - DNA, 17 bp, Homo sapiens
aagagaacattttactg

SEQ ID NO: 3456940 - DNA, 21 bp, Homo sapiens
aagagaacattttactgttgt

SEQ ID NO: 3456941 - DNA, 24 bp, Homo sapiens
aagagaacattttactgttgtaca

SEQ ID NO: 3456942 - DNA, 13 bp, Homo sapiens
aagagaatatttt

SEQ ID NO: 3456943 - DNA, 22 bp, Homo sapiens
aagagaatattttaagtattgc

SEQ ID NO: 3456944 - DNA, 14 bp, Homo sapiens
aagagacagtcacc

SEQ ID NO: 3456945 - DNA, 20 bp, Homo sapiens
aagagacagtcaccccagga

SEQ ID NO: 3456946 - DNA, 21 bp, Homo sapiens
aagagacagtcaccccaggac

SEQ ID NO: 3456947 - DNA, 13 bp, Homo sapiens
aagagagaaacaa

SEQ ID NO: 3456948 - DNA, 19 bp, Homo sapiens
aagagagagagagaaaaaa

SEQ ID NO: 3456949 - DNA, 20 bp, Homo sapiens
aagagagagagagaaaaaaa

SEQ ID NO: 3456950 - DNA, 14 bp, Homo sapiens
aagagatatgggaa

SEQ ID NO: 3456951 - DNA, 15 bp, Homo sapiens
aagagattcctgagc

SEQ ID NO: 3456952 - DNA, 19 bp, Homo sapiens
aagagattgtggtttcatt

SEQ ID NO: 3456953 - DNA, 13 bp, Homo sapiens
aagagcacacttg

SEQ ID NO: 3456954 - DNA, 21 bp, Homo sapiens
aagagcacttaagagaatatt

SEQ ID NO: 3456955 - DNA, 16 bp, Homo sapiens
aagagccaagttccaa

SEQ ID NO: 3456956 - DNA, 14 bp, Homo sapiens
aagagcctttccaa

SEQ ID NO: 3456957 - DNA, 15 bp, Homo sapiens
aagagcctttccaaa

SEQ ID NO: 3456958 - DNA, 17 bp, Homo sapiens
aagagcttataaaattt

SEQ ID NO: 3456959 - DNA, 14 bp, Homo sapiens
aagaggcagggtct

SEQ ID NO: 3456960 - DNA, 22 bp, Homo sapiens
aagaggcgttgctttcactctc

SEQ ID NO: 3456961 - DNA, 15 bp, Homo sapiens
aagaggctacagggc

SEQ ID NO: 3456962 - DNA, 17 bp, Homo sapiens
aagagggacgcctgggg

SEQ ID NO: 3456963 - DNA, 16 bp, Homo sapiens
aagagggcacacactg

SEQ ID NO: 3456964 - DNA, 22 bp, Homo sapiens
aagagggtctgaggaatccaga

SEQ ID NO: 3456965 - DNA, 21 bp, Homo sapiens
aagagggtgagggccttctta

SEQ ID NO: 3456966 - DNA, 20 bp, Homo sapiens
aagagtagaaactgcaggga

SEQ ID NO: 3456967 - DNA, 22 bp, Homo sapiens
aagagtagttgatgttgcattt

SEQ ID NO: 3456968 - DNA, 15 bp, Homo sapiens
aagagtcctctgaat

SEQ ID NO: 3456969 - DNA, 18 bp, Homo sapiens
aagagtgactctccaggg

SEQ ID NO: 3456970 - DNA, 21 bp, Homo sapiens
aagagttgccccgtctctgtt

SEQ ID NO: 3456971 - DNA, 13 bp, Homo sapiens
aagataagatttc

SEQ ID NO: 3456972 - DNA, 15 bp, Homo sapiens
aagatacaaatggtg

SEQ ID NO: 3456973 - DNA, 22 bp, Homo sapiens
aagatacagaactctttcaaaa

SEQ ID NO: 3456974 - DNA, 21 bp, Homo sapiens
aagatataagtgctgtataaa

SEQ ID NO: 3456975 - DNA, 22 bp, Homo sapiens
aagatattatgtataaaatgta

SEQ ID NO: 3456976 - DNA, 11 bp, Homo sapiens
aagatcctgtg

SEQ ID NO: 3456977 - DNA, 14 bp, Homo sapiens
aagatcctgtgagg

SEQ ID NO: 3456978 - DNA, 20 bp, Homo sapiens
aagatctgtcctcagccttg

SEQ ID NO: 3456979 - DNA, 21 bp, Homo sapiens
aagatctgttttgaaggcaaa

SEQ ID NO: 3456980 - DNA, 23 bp, Homo sapiens
aagatgaaggagaggcaacatcc

SEQ ID NO: 3456981 - DNA, 14 bp, Homo sapiens
aagatgacagctct

SEQ ID NO: 3456982 - DNA, 17 bp, Homo sapiens
aagatgagagaactgga

SEQ ID NO: 3456983 - DNA, 22 bp, Homo sapiens
aagatgccccagggatgggagg

SEQ ID NO: 3456984 - DNA, 15 bp, Homo sapiens
aagatgcctgatcag

SEQ ID NO: 3456985 - DNA, 17 bp, Homo sapiens
aagatgcttctcactgc

SEQ ID NO: 3456986 - DNA, 19 bp, Homo sapiens
aagatgcttctcactgcca

SEQ ID NO: 3456987 - DNA, 23 bp, Homo sapiens
aagatgggggcagggctgtgctt

SEQ ID NO: 3456988 - DNA, 21 bp, Homo sapiens
aagatggggtctgtaaaatct

SEQ ID NO: 3456989 - DNA, 23 bp, Homo sapiens
aagattaatctaccttgcagtgt

SEQ ID NO: 3456990 - DNA, 12 bp, Homo sapiens
aagattccaaaa

SEQ ID NO: 3456991 - DNA, 14 bp, Homo sapiens
aagattcctgtcct

SEQ ID NO: 3456992 - DNA, 16 bp, Homo sapiens
aagattctttcccaat

SEQ ID NO: 3456993 - DNA, 22 bp, Homo sapiens
aagattgttggtgaattttcaa

SEQ ID NO: 3456994 - DNA, 17 bp, Homo sapiens
aagatttctaaataaaa

SEQ ID NO: 3456995 - DNA, 18 bp, Homo sapiens
aagattttaatcaagttg

SEQ ID NO: 3456996 - DNA, 13 bp, Homo sapiens
aagattttcattg

SEQ ID NO: 3456997 - DNA, 19 bp, Homo sapiens
aagattttcattgaggata

SEQ ID NO: 3456998 - DNA, 14 bp, Homo sapiens
aagcaaaagaaaaa

SEQ ID NO: 3456999 - DNA, 15 bp, Homo sapiens
aagcaaaagaaaaag

SEQ ID NO: 3457000 - DNA, 13 bp, Homo sapiens
aagcaaaatatta

SEQ ID NO: 3457001 - DNA, 20 bp, Homo sapiens
aagcaacagcctttgaatgt

SEQ ID NO: 3457002 - DNA, 16 bp, Homo sapiens
aagcaacttgatggaa

SEQ ID NO: 3457003 - DNA, 13 bp, Homo sapiens
aagcaagactgag

SEQ ID NO: 3457004 - DNA, 19 bp, Homo sapiens
aagcaatatgcatttaaat

SEQ ID NO: 3457005 - DNA, 15 bp, Homo sapiens
aagcaatcctaggta

SEQ ID NO: 3457006 - DNA, 22 bp, Homo sapiens
aagcaatcctctcacctcagcc

SEQ ID NO: 3457007 - DNA, 14 bp, Homo sapiens
aagcaccaagctca

SEQ ID NO: 3457008 - DNA, 15 bp, Homo sapiens
aagcacctcctgcct

SEQ ID NO: 3457009 - DNA, 17 bp, Homo sapiens
aagcacctcctgcctcg

SEQ ID NO: 3457010 - DNA, 12 bp, Homo sapiens
aagcactgtgct

SEQ ID NO: 3457011 - DNA, 12 bp, Homo sapiens
aagcagacagct

SEQ ID NO: 3457012 - DNA, 14 bp, Homo sapiens
aagcagacagctcc

SEQ ID NO: 3457013 - DNA, 14 bp, Homo sapiens
aagcagagcatttt

SEQ ID NO: 3457014 - DNA, 22 bp, Homo sapiens
aagcagagcattttttatgata

SEQ ID NO: 3457015 - DNA, 15 bp, Homo sapiens
aagcagaggaggggc

SEQ ID NO: 3457016 - DNA, 16 bp, Homo sapiens
aagcagatgcaaagag

SEQ ID NO: 3457017 - DNA, 14 bp, Homo sapiens
aagcagccaagctc

SEQ ID NO: 3457018 - DNA, 16 bp, Homo sapiens
aagcagccaagctcct

SEQ ID NO: 3457019 - DNA, 22 bp, Homo sapiens
aagcagcctctccccaggtcca

SEQ ID NO: 3457020 - DNA, 22 bp, Homo sapiens
aagcagcggtcagcagacaagg

SEQ ID NO: 3457021 - DNA, 13 bp, Homo sapiens
aagcagctctccc

SEQ ID NO: 3457022 - DNA, 17 bp, Homo sapiens
aagcagctctcccctca

SEQ ID NO: 3457023 - DNA, 18 bp, Homo sapiens
aagcaggggagtatgcaa

SEQ ID NO: 3457024 - DNA, 17 bp, Homo sapiens
aagcagggtctgggcag

SEQ ID NO: 3457025 - DNA, 18 bp, Homo sapiens
aagcaggttcccaagctc

SEQ ID NO: 3457026 - DNA, 13 bp, Homo sapiens
aagcagtaactga

SEQ ID NO: 3457027 - DNA, 22 bp, Homo sapiens
aagcataaaaacattttaaaaa

SEQ ID NO: 3457028 - DNA, 17 bp, Homo sapiens
aagcatactttgtaaat

SEQ ID NO: 3457029 - DNA, 23 bp, Homo sapiens
aagcatcctttagggttctgcct

SEQ ID NO: 3457030 - DNA, 19 bp, Homo sapiens
aagcatgtaacttatatta

SEQ ID NO: 3457031 - DNA, 13 bp, Homo sapiens
aagcattcacaac

SEQ ID NO: 3457032 - DNA, 16 bp, Homo sapiens
aagcatttactttgtg

SEQ ID NO: 3457033 - DNA, 12 bp, Homo sapiens
aagcatttataa

SEQ ID NO: 3457034 - DNA, 12 bp, Homo sapiens
aagcatttgaat

SEQ ID NO: 3457035 - DNA, 17 bp, Homo sapiens
aagcatttgaatgcatt

SEQ ID NO: 3457036 - DNA, 21 bp, Homo sapiens
aagcatttgaatgcattttgt

SEQ ID NO: 3457037 - DNA, 18 bp, Homo sapiens
aagccaaagctaggcctg

SEQ ID NO: 3457038 - DNA, 20 bp, Homo sapiens
aagccaaagctaggcctggc

SEQ ID NO: 3457039 - DNA, 22 bp, Homo sapiens
aagccaaagctaggcctggcca

SEQ ID NO: 3457040 - DNA, 14 bp, Homo sapiens
aagccaagcagcca

SEQ ID NO: 3457041 - DNA, 16 bp, Homo sapiens
aagccaagcagccaag

SEQ ID NO: 3457042 - DNA, 18 bp, Homo sapiens
aagccaataacacacagc

SEQ ID NO: 3457043 - DNA, 20 bp, Homo sapiens
aagccaataacacacagcta

SEQ ID NO: 3457044 - DNA, 23 bp, Homo sapiens
aagccacaggcctgagatttcat

SEQ ID NO: 3457045 - DNA, 18 bp, Homo sapiens
aagccacttaaaatgttc

SEQ ID NO: 3457046 - DNA, 18 bp, Homo sapiens
aatgtagcagcttcttag

SEQ ID NO: 3457047 - DNA, 16 bp, Homo sapiens
aatgtaggcttagttt

SEQ ID NO: 3457048 - DNA, 19 bp, Homo sapiens
aatgtaggcttagtttgtg

SEQ ID NO: 3457049 - DNA, 22 bp, Homo sapiens
aatgtaggcttagtttgtgtgt

SEQ ID NO: 3457050 - DNA, 14 bp, Homo sapiens
aatgtatatgcact

SEQ ID NO: 3457051 - DNA, 16 bp, Homo sapiens
aatgtatcttattcac

SEQ ID NO: 3457052 - DNA, 16 bp, Homo sapiens
aatgtattataacttt

SEQ ID NO: 3457053 - DNA, 18 bp, Homo sapiens
aatgtcatatactgccat

SEQ ID NO: 3457054 - DNA, 15 bp, Homo sapiens
aatgtcttcaaggct

SEQ ID NO: 3457055 - DNA, 18 bp, Homo sapiens
aatgtcttcaaggcttca

SEQ ID NO: 3457056 - DNA, 19 bp, Homo sapiens
aatgtcttcaaggcttcag

SEQ ID NO: 3457057 - DNA, 22 bp, Homo sapiens
aatgtcttgctgttgacatatt

SEQ ID NO: 3457058 - DNA, 22 bp, Homo sapiens
aatgtgaaaatggtccaggaga

SEQ ID NO: 3457059 - DNA, 20 bp, Homo sapiens
aatgtgaactttattaaata

SEQ ID NO: 3457060 - DNA, 12 bp, Homo sapiens
aatgtgagcaca

SEQ ID NO: 3457061 - DNA, 16 bp, Homo sapiens
aatgtgatgaatactg

SEQ ID NO: 3457062 - DNA, 14 bp, Homo sapiens
aatgtgccatgtat

SEQ ID NO: 3457063 - DNA, 15 bp, Homo sapiens
aatgttaaataaatt

SEQ ID NO: 3457064 - DNA, 20 bp, Homo sapiens
aatgttaaataaattgtata

SEQ ID NO: 3457065 - DNA, 17 bp, Homo sapiens
aatgttaactacatatt

SEQ ID NO: 3457066 - DNA, 21 bp, Homo sapiens
aatgttaattttttggtacaa

SEQ ID NO: 3457067 - DNA, 22 bp, Homo sapiens
aatgttaattttttggtacaaa

SEQ ID NO: 3457068 - DNA, 15 bp, Homo sapiens
aatgttacattgttt

SEQ ID NO: 3457069 - DNA, 17 bp, Homo sapiens
aatgttatatcatatgt

SEQ ID NO: 3457070 - DNA, 19 bp, Homo sapiens
aatgttatcttatactgta

SEQ ID NO: 3457071 - DNA, 21 bp, Homo sapiens
aatgttatcttatactgtaca

SEQ ID NO: 3457072 - DNA, 14 bp, Homo sapiens
aatgttatttaaca

SEQ ID NO: 3457073 - DNA, 19 bp, Homo sapiens
aatgttcacatagtgaaat

SEQ ID NO: 3457074 - DNA, 21 bp, Homo sapiens
aatgttctgtgatacagaact

SEQ ID NO: 3457075 - DNA, 13 bp, Homo sapiens
aatgttgaaaagt

SEQ ID NO: 3457076 - DNA, 16 bp, Homo sapiens
aatgtttgcctctgcc

SEQ ID NO: 3457077 - DNA, 18 bp, Homo sapiens
aatgtttgcctctgcctc

SEQ ID NO: 3457078 - DNA, 18 bp, Homo sapiens
aatgtttgtctcatccca

SEQ ID NO: 3457079 - DNA, 19 bp, Homo sapiens
aatgtttgttaaaaataaa

SEQ ID NO: 3457080 - DNA, 19 bp, Homo sapiens
aatgttttaaatgtacaga

SEQ ID NO: 3457081 - DNA, 13 bp, Homo sapiens
aatgttttctttg

SEQ ID NO: 3457082 - DNA, 19 bp, Homo sapiens
aatgttttttcatgtgttt

SEQ ID NO: 3457083 - DNA, 21 bp, Homo sapiens
aattaaaatggatgccttgaa

SEQ ID NO: 3457084 - DNA, 17 bp, Homo sapiens
aattaacttacttccaa

SEQ ID NO: 3457085 - DNA, 13 bp, Homo sapiens
aattaagaaggca

SEQ ID NO: 3457086 - DNA, 14 bp, Homo sapiens
aattacaattttat

SEQ ID NO: 3457087 - DNA, 19 bp, Homo sapiens
aattacttatccctgccca

SEQ ID NO: 3457088 - DNA, 18 bp, Homo sapiens
aattagacatcttcagat

SEQ ID NO: 3457089 - DNA, 17 bp, Homo sapiens
aattagatgcatgttga

SEQ ID NO: 3457090 - DNA, 15 bp, Homo sapiens
aattagccaagtgtg

SEQ ID NO: 3457091 - DNA, 21 bp, Homo sapiens
aattagtgctaagtgtgaact

SEQ ID NO: 3457092 - DNA, 14 bp, Homo sapiens
aattataaattgag

SEQ ID NO: 3457093 - DNA, 14 bp, Homo sapiens
aattatactacttt

SEQ ID NO: 3457094 - DNA, 13 bp, Homo sapiens
aattatatttgtg

SEQ ID NO: 3457095 - DNA, 19 bp, Homo sapiens
aattatgttaaactagcat

SEQ ID NO: 3457096 - DNA, 21 bp, Homo sapiens
aattatttgactttaatttat

SEQ ID NO: 3457097 - DNA, 17 bp, Homo sapiens
aattatttttacagttc

SEQ ID NO: 3457098 - DNA, 14 bp, Homo sapiens
aattcacaaacttt

SEQ ID NO: 3457099 - DNA, 14 bp, Homo sapiens
aattcacataataa

SEQ ID NO: 3457100 - DNA, 23 bp, Homo sapiens
aattcactctgagtgttttatga

SEQ ID NO: 3457101 - DNA, 20 bp, Homo sapiens
aattccacaccttttattga

SEQ ID NO: 3457102 - DNA, 19 bp, Homo sapiens
aattccttcgaaaggcctt

SEQ ID NO: 3457103 - DNA, 15 bp, Homo sapiens
aattcggtgtgcacc

SEQ ID NO: 3457104 - DNA, 15 bp, Homo sapiens
aattctacattgtca

SEQ ID NO: 3457105 - DNA, 21 bp, Homo sapiens
aattctcatttgtcacacact

SEQ ID NO: 3457106 - DNA, 15 bp, Homo sapiens
aattctcctgccttt

SEQ ID NO: 3457107 - DNA, 18 bp, Homo sapiens
aattctcctgcctttgcc

SEQ ID NO: 3457108 - DNA, 13 bp, Homo sapiens
aattctgcatgta

SEQ ID NO: 3457109 - DNA, 15 bp, Homo sapiens
aattctgcatgtact

SEQ ID NO: 3457110 - DNA, 16 bp, Homo sapiens
aattctgcatgtacta

SEQ ID NO: 3457111 - DNA, 20 bp, Homo sapiens
aattctgtcttgttcatttt

SEQ ID NO: 3457112 - DNA, 14 bp, Homo sapiens
aattctgtttttct

SEQ ID NO: 3457113 - DNA, 18 bp, Homo sapiens
aattctgtttttctaggc

SEQ ID NO: 3457114 - DNA, 18 bp, Homo sapiens
aattcttggttgaggaaa

SEQ ID NO: 3457115 - DNA, 19 bp, Homo sapiens
aattcttggttgaggaaac

SEQ ID NO: 3457116 - DNA, 20 bp, Homo sapiens
aattcttggttgaggaaaca

SEQ ID NO: 3457117 - DNA, 14 bp, Homo sapiens
aattcttttgaatt

SEQ ID NO: 3457118 - DNA, 18 bp, Homo sapiens
aattctttttttattatt

SEQ ID NO: 3457119 - DNA, 20 bp, Homo sapiens
aattctttttttattattat

SEQ ID NO: 3457120 - DNA, 21 bp, Homo sapiens
aattgaaaggcattctctgaa

SEQ ID NO: 3457121 - DNA, 21 bp, Homo sapiens
aattgacataggcaataataa

SEQ ID NO: 3457122 - DNA, 17 bp, Homo sapiens
aattgaggggattaata

SEQ ID NO: 3457123 - DNA, 20 bp, Homo sapiens
aattgatttgcattgaacac

SEQ ID NO: 3457124 - DNA, 18 bp, Homo sapiens
aattgcaaatcttgaaat

SEQ ID NO: 3457125 - DNA, 22 bp, Homo sapiens
aattgcacagaagtcctgtatg

SEQ ID NO: 3457126 - DNA, 18 bp, Homo sapiens
aattgcgttggtctctgc

SEQ ID NO: 3457127 - DNA, 22 bp, Homo sapiens
aattgcgttggtctctgcattt

SEQ ID NO: 3457128 - DNA, 15 bp, Homo sapiens
aattgctaatgttgc

SEQ ID NO: 3457129 - DNA, 21 bp, Homo sapiens
aattggcagccctatttcagt

SEQ ID NO: 3457130 - DNA, 18 bp, Homo sapiens
aattgggtcatagaaatt

SEQ ID NO: 3457131 - DNA, 21 bp, Homo sapiens
aattggttggagaatttaggt

SEQ ID NO: 3457132 - DNA, 14 bp, Homo sapiens
aattgtaactgttc

SEQ ID NO: 3457133 - DNA, 16 bp, Homo sapiens
aattgtaactgttctt

SEQ ID NO: 3457134 - DNA, 22 bp, Homo sapiens
aattgtaccttttttgtttttt

SEQ ID NO: 3457135 - DNA, 16 bp, Homo sapiens
aattgtattttagtaa

SEQ ID NO: 3457136 - DNA, 18 bp, Homo sapiens
aattgtcccttaaacaaa

SEQ ID NO: 3457137 - DNA, 22 bp, Homo sapiens
aatttaaaagcagagcattttt

SEQ ID NO: 3457138 - DNA, 23 bp, Homo sapiens
aatttaattcatgtttcttaaat

SEQ ID NO: 3457139 - DNA, 13 bp, Homo sapiens
aatttacaaagtg

SEQ ID NO: 3457140 - DNA, 21 bp, Homo sapiens
aatttacaaagtgtgtattaa

SEQ ID NO: 3457141 - DNA, 19 bp, Homo sapiens
aatttacaggttcttaggc

SEQ ID NO: 3457142 - DNA, 16 bp, Homo sapiens
aatttagattgtaaac

SEQ ID NO: 3457143 - DNA, 18 bp, Homo sapiens
aatttagtctaacacagt

SEQ ID NO: 3457144 - DNA, 18 bp, Homo sapiens
aatttatagtaatgagtt

SEQ ID NO: 3457145 - DNA, 14 bp, Homo sapiens
aatttatatgaaaa

SEQ ID NO: 3457146 - DNA, 18 bp, Homo sapiens
aatttatcttgtctctgg

SEQ ID NO: 3457147 - DNA, 20 bp, Homo sapiens
aatttatcttgtctctgggc

SEQ ID NO: 3457148 - DNA, 17 bp, Homo sapiens
aatttattaattgcttt

SEQ ID NO: 3457149 - DNA, 19 bp, Homo sapiens
aatttattgcacattgttc

SEQ ID NO: 3457150 - DNA, 20 bp, Homo sapiens
aatttattgcacattgttca

SEQ ID NO: 3457151 - DNA, 19 bp, Homo sapiens
aatttatttcctagttctg

SEQ ID NO: 3457152 - DNA, 18 bp, Homo sapiens
aatttattttataagaaa

SEQ ID NO: 3457153 - DNA, 21 bp, Homo sapiens
aatttattttataagaaaaac

SEQ ID NO: 3457154 - DNA, 16 bp, Homo sapiens
aatttcaaaatgcttt

SEQ ID NO: 3457155 - DNA, 13 bp, Homo sapiens
aatttcagactcc

SEQ ID NO: 3457156 - DNA, 22 bp, Homo sapiens
aatttcccaggaccctgaaggg

SEQ ID NO: 3457157 - DNA, 15 bp, Homo sapiens
aatttctactttgaa

SEQ ID NO: 3457158 - DNA, 19 bp, Homo sapiens
aatttctgtgccctcctga

SEQ ID NO: 3457159 - DNA, 23 bp, Homo sapiens
aatttcttctcctggagttgcat

SEQ ID NO: 3457160 - DNA, 17 bp, Homo sapiens
aatttgactaattttac

SEQ ID NO: 3457161 - DNA, 15 bp, Homo sapiens
aatttgattgatttg

SEQ ID NO: 3457162 - DNA, 16 bp, Homo sapiens
aatttgattgatttga

SEQ ID NO: 3457163 - DNA, 20 bp, Homo sapiens
aatttgattgatttgaagaa

SEQ ID NO: 3457164 - DNA, 10 bp, Homo sapiens
aatttgcaaa

SEQ ID NO: 3457165 - DNA, 12 bp, Homo sapiens
aatttgcaaagt

SEQ ID NO: 3457166 - DNA, 13 bp, Homo sapiens
aatttgcaaagta

SEQ ID NO: 3457167 - DNA, 15 bp, Homo sapiens
aatttgcattaaatt

SEQ ID NO: 3457168 - DNA, 21 bp, Homo sapiens
aatttgcattaaattcacaaa

SEQ ID NO: 3457169 - DNA, 23 bp, Homo sapiens
aatttgcattaaattcacaaact

SEQ ID NO: 3457170 - DNA, 20 bp, Homo sapiens
aattttacatgtttataaat

SEQ ID NO: 3457171 - DNA, 19 bp, Homo sapiens
aattttagtagagacaggg

SEQ ID NO: 3457172 - DNA, 12 bp, Homo sapiens
aattttattcct

SEQ ID NO: 3457173 - DNA, 19 bp, Homo sapiens
aattttcctaataaagttc

SEQ ID NO: 3457174 - DNA, 20 bp, Homo sapiens
aattttctgtggatcatttc

SEQ ID NO: 3457175 - DNA, 20 bp, Homo sapiens
aattttgatataatctttca

SEQ ID NO: 3457176 - DNA, 13 bp, Homo sapiens
aattttgtaatga

SEQ ID NO: 3457177 - DNA, 19 bp, Homo sapiens
aattttgttctagttttca

SEQ ID NO: 3457178 - DNA, 14 bp, Homo sapiens
acatatgaggggga

SEQ ID NO: 3457179 - DNA, 14 bp, Homo sapiens
acatatttaactgg

SEQ ID NO: 3457180 - DNA, 13 bp, Homo sapiens
acatatttaatgt

SEQ ID NO: 3457181 - DNA, 19 bp, Homo sapiens
acatcactctcaccttcca

SEQ ID NO: 3457182 - DNA, 21 bp, Homo sapiens
acatcaggagactgggctctg

SEQ ID NO: 3457183 - DNA, 18 bp, Homo sapiens
acatcagttactctgaag

SEQ ID NO: 3457184 - DNA, 20 bp, Homo sapiens
acatcagttactctgaaggg

SEQ ID NO: 3457185 - DNA, 21 bp, Homo sapiens
acatcattactataagaactt

SEQ ID NO: 3457186 - DNA, 18 bp, Homo sapiens
acatccaaagcagacagc

SEQ ID NO: 3457187 - DNA, 20 bp, Homo sapiens
acatccaatattttctttaa

SEQ ID NO: 3457188 - DNA, 18 bp, Homo sapiens
acatcccgggacgcagca

SEQ ID NO: 3457189 - DNA, 15 bp, Homo sapiens
acatccctgccagct

SEQ ID NO: 3457190 - DNA, 16 bp, Homo sapiens
acatcctgtgtttcta

SEQ ID NO: 3457191 - DNA, 18 bp, Homo sapiens
acatctattttggattgt

SEQ ID NO: 3457192 - DNA, 15 bp, Homo sapiens
acatctctgcttgag

SEQ ID NO: 3457193 - DNA, 23 bp, Homo sapiens
acatctggaatctgaggcatcct

SEQ ID NO: 3457194 - DNA, 14 bp, Homo sapiens
acatcttgctctgc

SEQ ID NO: 3457195 - DNA, 16 bp, Homo sapiens
acatcttgctctgctg

SEQ ID NO: 3457196 - DNA, 22 bp, Homo sapiens
acatcttgctctgctgacagac

SEQ ID NO: 3457197 - DNA, 18 bp, Homo sapiens
acatctttctcttttcta

SEQ ID NO: 3457198 - DNA, 16 bp, Homo sapiens
acatcttttaagacaa

SEQ ID NO: 3457199 - DNA, 20 bp, Homo sapiens
acatgaaacctacacactgt

SEQ ID NO: 3457200 - DNA, 18 bp, Homo sapiens
acatgaagattctttccc

SEQ ID NO: 3457201 - DNA, 21 bp, Homo sapiens
acatgaccctaaatcttgact

SEQ ID NO: 3457202 - DNA, 16 bp, Homo sapiens
acatgaggggacattt

SEQ ID NO: 3457203 - DNA, 23 bp, Homo sapiens
acatgatgcttttactgaacttt

SEQ ID NO: 3457204 - DNA, 13 bp, Homo sapiens
acatgattccttc

SEQ ID NO: 3457205 - DNA, 17 bp, Homo sapiens
acatgatttccttgaat

SEQ ID NO: 3457206 - DNA, 21 bp, Homo sapiens
acatgatttccttgaatgtgg

SEQ ID NO: 3457207 - DNA, 17 bp, Homo sapiens
acatgcagtttgaaatt

SEQ ID NO: 3457208 - DNA, 22 bp, Homo sapiens
acatgcagtttgaaattctgaa

SEQ ID NO: 3457209 - DNA, 18 bp, Homo sapiens
acatgccaagcactgtgc

SEQ ID NO: 3457210 - DNA, 11 bp, Homo sapiens
acatgcctgtc

SEQ ID NO: 3457211 - DNA, 12 bp, Homo sapiens
acatgcctgtcc

SEQ ID NO: 3457212 - DNA, 13 bp, Homo sapiens
acatgcctgtcct

SEQ ID NO: 3457213 - DNA, 15 bp, Homo sapiens
acatgcctgtcctga

SEQ ID NO: 3457214 - DNA, 23 bp, Homo sapiens
acatgcctgtcctgaaagcggct

SEQ ID NO: 3457215 - DNA, 17 bp, Homo sapiens
acatgcggagaacaaat

SEQ ID NO: 3457216 - DNA, 22 bp, Homo sapiens
acatgcggtagccagcacacag

SEQ ID NO: 3457217 - DNA, 14 bp, Homo sapiens
acatgctgaagcca

SEQ ID NO: 3457218 - DNA, 17 bp, Homo sapiens
acatgctgaagccaaag

SEQ ID NO: 3457219 - DNA, 15 bp, Homo sapiens
acatgcttcaatagt

SEQ ID NO: 3457220 - DNA, 20 bp, Homo sapiens
acatggtgagcctagccctg

SEQ ID NO: 3457221 - DNA, 23 bp, Homo sapiens
acatggtgtctggattcccagga

SEQ ID NO: 3457222 - DNA, 20 bp, Homo sapiens
acatgtaactatttcttcag

SEQ ID NO: 3457223 - DNA, 13 bp, Homo sapiens
acatgtaatttga

SEQ ID NO: 3457224 - DNA, 16 bp, Homo sapiens
acatgtcttaatgaag

SEQ ID NO: 3457225 - DNA, 18 bp, Homo sapiens
acatgtcttaatgaagtt

SEQ ID NO: 3457226 - DNA, 20 bp, Homo sapiens
acatgtcttaatgaagtttg

SEQ ID NO: 3457227 - DNA, 18 bp, Homo sapiens
acatgtgcacatgcacgt

SEQ ID NO: 3457228 - DNA, 22 bp, Homo sapiens
acatgtgccagggcaatgatga

SEQ ID NO: 3457229 - DNA, 19 bp, Homo sapiens
acatgtggctcctcccagc

SEQ ID NO: 3457230 - DNA, 11 bp, Homo sapiens
acatgtttcct

SEQ ID NO: 3457231 - DNA, 16 bp, Homo sapiens
acatgtttcctctagt

SEQ ID NO: 3457232 - DNA, 13 bp, Homo sapiens
acattaagaaaat

SEQ ID NO: 3457233 - DNA, 15 bp, Homo sapiens
acattagaagacaat

SEQ ID NO: 3457234 - DNA, 20 bp, Homo sapiens
acattagaagacaattgaca

SEQ ID NO: 3457235 - DNA, 13 bp, Homo sapiens
acattagttgcac

SEQ ID NO: 3457236 - DNA, 20 bp, Homo sapiens
acattcacctgccccaactc

SEQ ID NO: 3457237 - DNA, 13 bp, Homo sapiens
acattcaggagct

SEQ ID NO: 3457238 - DNA, 15 bp, Homo sapiens
acattcatgcctggc

SEQ ID NO: 3457239 - DNA, 16 bp, Homo sapiens
acattcatgcctggct

SEQ ID NO: 3457240 - DNA, 15 bp, Homo sapiens
acattccaactcgta

SEQ ID NO: 3457241 - DNA, 17 bp, Homo sapiens
acattcccctggggacc

SEQ ID NO: 3457242 - DNA, 22 bp, Homo sapiens
acattcccctggggacccacgt

SEQ ID NO: 3457243 - DNA, 19 bp, Homo sapiens
acattctctaataagaaaa

SEQ ID NO: 3457244 - DNA, 11 bp, Homo sapiens
acattcttgta

SEQ ID NO: 3457245 - DNA, 14 bp, Homo sapiens
acattgccaaaaag

SEQ ID NO: 3457246 - DNA, 21 bp, Homo sapiens
acattgcggacagccacggcc

SEQ ID NO: 3457247 - DNA, 22 bp, Homo sapiens
acattgcggacagccacggcca

SEQ ID NO: 3457248 - DNA, 15 bp, Homo sapiens
acattgcgtttgacc

SEQ ID NO: 3457249 - DNA, 19 bp, Homo sapiens
acattgggaaggggacccc

SEQ ID NO: 3457250 - DNA, 19 bp, Homo sapiens
acattgtctcctatatatt

SEQ ID NO: 3457251 - DNA, 22 bp, Homo sapiens
acattgtctcctatatatttct

SEQ ID NO: 3457252 - DNA, 16 bp, Homo sapiens
acattgttcaattaga

SEQ ID NO: 3457253 - DNA, 13 bp, Homo sapiens
acattgttcacct

SEQ ID NO: 3457254 - DNA, 14 bp, Homo sapiens
acattgttgagcta

SEQ ID NO: 3457255 - DNA, 17 bp, Homo sapiens
acattgttgagctattg

SEQ ID NO: 3457256 - DNA, 14 bp, Homo sapiens
acatttcaagttta

SEQ ID NO: 3457257 - DNA, 16 bp, Homo sapiens
acatttggaatacttt

SEQ ID NO: 3457258 - DNA, 15 bp, Homo sapiens
acatttggagtgttc

SEQ ID NO: 3457259 - DNA, 23 bp, Homo sapiens
acattttaaaaacatagaaaaat

SEQ ID NO: 3457260 - DNA, 15 bp, Homo sapiens
acattttagttactg

SEQ ID NO: 3457261 - DNA, 17 bp, Homo sapiens
acattttagttactgaa

SEQ ID NO: 3457262 - DNA, 16 bp, Homo sapiens
acattttcttgaattt

SEQ ID NO: 3457263 - DNA, 14 bp, Homo sapiens
acattttctttttt

SEQ ID NO: 3457264 - DNA, 12 bp, Homo sapiens
acattttgagaa

SEQ ID NO: 3457265 - DNA, 19 bp, Homo sapiens
acattttgagaacaaagat

SEQ ID NO: 3457266 - DNA, 17 bp, Homo sapiens
acattttggtgagaaat

SEQ ID NO: 3457267 - DNA, 18 bp, Homo sapiens
acattttggtgagaaatg

SEQ ID NO: 3457268 - DNA, 22 bp, Homo sapiens
acatttttcaactttgaataaa

SEQ ID NO: 3457269 - DNA, 19 bp, Homo sapiens
acatttttccgtttgcttt

SEQ ID NO: 3457270 - DNA, 21 bp, Homo sapiens
accaaaaaagctgtattttga

SEQ ID NO: 3457271 - DNA, 17 bp, Homo sapiens
accaaaagaatttgcac

SEQ ID NO: 3457272 - DNA, 15 bp, Homo sapiens
accaaaatactccaa

SEQ ID NO: 3457273 - DNA, 21 bp, Homo sapiens
accaaagtcctttttttccat

SEQ ID NO: 3457274 - DNA, 17 bp, Homo sapiens
accaaatcttgttattg

SEQ ID NO: 3457275 - DNA, 23 bp, Homo sapiens
accaacaaggaaactttccttta

SEQ ID NO: 3457276 - DNA, 19 bp, Homo sapiens
accaaccctggggaaggag

SEQ ID NO: 3457277 - DNA, 23 bp, Homo sapiens
accaactgaaggctaaaaagcaa

SEQ ID NO: 3457278 - DNA, 20 bp, Homo sapiens
accaacttgtatccaggcct

SEQ ID NO: 3457279 - DNA, 16 bp, Homo sapiens
accaagaagatgtctt

SEQ ID NO: 3457280 - DNA, 16 bp, Homo sapiens
accaagcacagcagcc

SEQ ID NO: 3457281 - DNA, 13 bp, Homo sapiens
accaagcaggaag

SEQ ID NO: 3457282 - DNA, 16 bp, Homo sapiens
accaagcaggaagctc

SEQ ID NO: 3457283 - DNA, 12 bp, Homo sapiens
accaagcccagt

SEQ ID NO: 3457284 - DNA, 15 bp, Homo sapiens
accaagctatcctgg

SEQ ID NO: 3457285 - DNA, 22 bp, Homo sapiens
accaatcctactaataaaccag

SEQ ID NO: 3457286 - DNA, 14 bp, Homo sapiens
accaatgcactgag

SEQ ID NO: 3457287 - DNA, 22 bp, Homo sapiens
accaatgcactgagtgaaggaa

SEQ ID NO: 3457288 - DNA, 21 bp, Homo sapiens
accaatgccaaaaaaagacag

SEQ ID NO: 3457289 - DNA, 13 bp, Homo sapiens
accaatgtcttga

SEQ ID NO: 3457290 - DNA, 14 bp, Homo sapiens
accaattaatgtag

SEQ ID NO: 3457291 - DNA, 17 bp, Homo sapiens
accaatttgcaccagtt

SEQ ID NO: 3457292 - DNA, 20 bp, Homo sapiens
accaatttgcaccagtttta

SEQ ID NO: 3457293 - DNA, 11 bp, Homo sapiens
accacacaaag

SEQ ID NO: 3457294 - DNA, 15 bp, Homo sapiens
accacacccagccca

SEQ ID NO: 3457295 - DNA, 16 bp, Homo sapiens
accacacccagcccac

SEQ ID NO: 3457296 - DNA, 14 bp, Homo sapiens
accacacctggcta

SEQ ID NO: 3457297 - DNA, 13 bp, Homo sapiens
accacactggact

SEQ ID NO: 3457298 - DNA, 16 bp, Homo sapiens
accacactggactccg

SEQ ID NO: 3457299 - DNA, 16 bp, Homo sapiens
accacagcacagccaa

SEQ ID NO: 3457300 - DNA, 12 bp, Homo sapiens
accacagcagga

SEQ ID NO: 3457301 - DNA, 14 bp, Homo sapiens
accacagcaggatc

SEQ ID NO: 3457302 - DNA, 12 bp, Homo sapiens
accacagctgct

SEQ ID NO: 3457303 - DNA, 13 bp, Homo sapiens
accacagctgctg

SEQ ID NO: 3457304 - DNA, 16 bp, Homo sapiens
accacagctgctggag

SEQ ID NO: 3457305 - DNA, 16 bp, Homo sapiens
accacatctaagcctg

SEQ ID NO: 3457306 - DNA, 20 bp, Homo sapiens
accacatctaagcctgaagg

SEQ ID NO: 3457307 - DNA, 14 bp, Homo sapiens
accacatcttgctc

SEQ ID NO: 3457308 - DNA, 17 bp, Homo sapiens
accacatcttgctctgc

SEQ ID NO: 3457309 - DNA, 18 bp, Homo sapiens
accacatcttgctctgct

SEQ ID NO: 3457310 - DNA, 24 bp, Homo sapiens
accacatcttgctctgctgacaga

SEQ ID NO: 3457311 - DNA, 16 bp, Homo sapiens
acccctggctccttca

SEQ ID NO: 3457312 - DNA, 15 bp, Homo sapiens
acccctggctctggg

SEQ ID NO: 3457313 - DNA, 18 bp, Homo sapiens
accccttaatcttgcttt

SEQ ID NO: 3457314 - DNA, 12 bp, Homo sapiens
accccttcccac

SEQ ID NO: 3457315 - DNA, 22 bp, Homo sapiens
acccggcccctgctggttcagg

SEQ ID NO: 3457316 - DNA, 21 bp, Homo sapiens
acccggcggtcccctccgcca

SEQ ID NO: 3457317 - DNA, 14 bp, Homo sapiens
acccggctgcagag

SEQ ID NO: 3457318 - DNA, 22 bp, Homo sapiens
acccggggcccagggcaagctc

SEQ ID NO: 3457319 - DNA, 16 bp, Homo sapiens
accctaaatcttgact

SEQ ID NO: 3457320 - DNA, 14 bp, Homo sapiens
accctattgctgct

SEQ ID NO: 3457321 - DNA, 11 bp, Homo sapiens
accctcagcct

SEQ ID NO: 3457322 - DNA, 12 bp, Homo sapiens
accctcagcctt

SEQ ID NO: 3457323 - DNA, 18 bp, Homo sapiens
accctcataccatctgct

SEQ ID NO: 3457324 - DNA, 19 bp, Homo sapiens
accctcataccatctgctg

SEQ ID NO: 3457325 - DNA, 23 bp, Homo sapiens
accctcataccatctgctgcccc

SEQ ID NO: 3457326 - DNA, 14 bp, Homo sapiens
accctccccattca

SEQ ID NO: 3457327 - DNA, 23 bp, Homo sapiens
accctctaacctcgccctctcct

SEQ ID NO: 3457328 - DNA, 15 bp, Homo sapiens
accctctgctgaaga

SEQ ID NO: 3457329 - DNA, 17 bp, Homo sapiens
accctctgctgaagact

SEQ ID NO: 3457330 - DNA, 22 bp, Homo sapiens
accctctgtaccccatgacctt

SEQ ID NO: 3457331 - DNA, 14 bp, Homo sapiens
accctcttagaaaa

SEQ ID NO: 3457332 - DNA, 16 bp, Homo sapiens
accctctttgctgcag

SEQ ID NO: 3457333 - DNA, 18 bp, Homo sapiens
accctgaaagccctgagc

SEQ ID NO: 3457334 - DNA, 20 bp, Homo sapiens
accctgatttaggagaagcc

SEQ ID NO: 3457335 - DNA, 14 bp, Homo sapiens
accctgcagagcac

SEQ ID NO: 3457336 - DNA, 19 bp, Homo sapiens
accctgcagagcacacagg

SEQ ID NO: 3457337 - DNA, 18 bp, Homo sapiens
accctgcaggacttgcca

SEQ ID NO: 3457338 - DNA, 17 bp, Homo sapiens
accctgccccttgccat

SEQ ID NO: 3457339 - DNA, 23 bp, Homo sapiens
accctgcctcccttgactttgct

SEQ ID NO: 3457340 - DNA, 14 bp, Homo sapiens
accctgctgctgct

SEQ ID NO: 3457341 - DNA, 17 bp, Homo sapiens
accctggaccagtggtc

SEQ ID NO: 3457342 - DNA, 12 bp, Homo sapiens
accctgggacct

SEQ ID NO: 3457343 - DNA, 23 bp, Homo sapiens
accctgggacctaggggcgccgc

SEQ ID NO: 3457344 - DNA, 14 bp, Homo sapiens
accctgggccctgg

SEQ ID NO: 3457345 - DNA, 21 bp, Homo sapiens
accctggggctggcttttctg

SEQ ID NO: 3457346 - DNA, 17 bp, Homo sapiens
accctggtggttgctgt

SEQ ID NO: 3457347 - DNA, 18 bp, Homo sapiens
accctggtggttgctgtt

SEQ ID NO: 3457348 - DNA, 15 bp, Homo sapiens
accctgtatatagcc

SEQ ID NO: 3457349 - DNA, 18 bp, Homo sapiens
accctgtatatagcccag

SEQ ID NO: 3457350 - DNA, 15 bp, Homo sapiens
accctgtcttcctct

SEQ ID NO: 3457351 - DNA, 18 bp, Homo sapiens
accctgtgccctccttcc

SEQ ID NO: 3457352 - DNA, 17 bp, Homo sapiens
accctgttaccattttg

SEQ ID NO: 3457353 - DNA, 13 bp, Homo sapiens
acccttacagtag

SEQ ID NO: 3457354 - DNA, 19 bp, Homo sapiens
acccttacagtaggagccc

SEQ ID NO: 3457355 - DNA, 15 bp, Homo sapiens
acccttcatcttcct

SEQ ID NO: 3457356 - DNA, 22 bp, Homo sapiens
acccttcccctccttctccctt

SEQ ID NO: 3457357 - DNA, 17 bp, Homo sapiens
acccttggcttgcccac

SEQ ID NO: 3457358 - DNA, 19 bp, Homo sapiens
accctttcgctggctttcc

SEQ ID NO: 3457359 - DNA, 20 bp, Homo sapiens
accgcgactaatttcaaaat

SEQ ID NO: 3457360 - DNA, 15 bp, Homo sapiens
accgcgttgtaaaat

SEQ ID NO: 3457361 - DNA, 12 bp, Homo sapiens
accgctccaggt

SEQ ID NO: 3457362 - DNA, 14 bp, Homo sapiens
accgggcactcaga

SEQ ID NO: 3457363 - DNA, 20 bp, Homo sapiens
accgggcactcagaagacac

SEQ ID NO: 3457364 - DNA, 18 bp, Homo sapiens
accgtgggcagggagcgg

SEQ ID NO: 3457365 - DNA, 16 bp, Homo sapiens
accgtgggctccctga

SEQ ID NO: 3457366 - DNA, 17 bp, Homo sapiens
accgtggtatgtctgcc

SEQ ID NO: 3457367 - DNA, 14 bp, Homo sapiens
accgtgtcaagctg

SEQ ID NO: 3457368 - DNA, 17 bp, Homo sapiens
accgtgtcaagctgctc

SEQ ID NO: 3457369 - DNA, 20 bp, Homo sapiens
acctaagtttcagttgattt

SEQ ID NO: 3457370 - DNA, 20 bp, Homo sapiens
acctaatccaggcagatcca

SEQ ID NO: 3457371 - DNA, 21 bp, Homo sapiens
acctaatccaggcagatccag

SEQ ID NO: 3457372 - DNA, 24 bp, Homo sapiens
acctacctgttgagcatcacagaa

SEQ ID NO: 3457373 - DNA, 19 bp, Homo sapiens
acctactgcccaggcactg

SEQ ID NO: 3457374 - DNA, 23 bp, Homo sapiens
acctactgcccaggcactgcaaa

SEQ ID NO: 3457375 - DNA, 19 bp, Homo sapiens
acctaggcagtaggccggt

SEQ ID NO: 3457376 - DNA, 12 bp, Homo sapiens
acctaggcagtg

SEQ ID NO: 3457377 - DNA, 18 bp, Homo sapiens
acctaggcagtgggaggc

SEQ ID NO: 3457378 - DNA, 13 bp, Homo sapiens
acctaggctcctc

SEQ ID NO: 3457379 - DNA, 15 bp, Homo sapiens
acctataaaacaggt

SEQ ID NO: 3457380 - DNA, 18 bp, Homo sapiens
acctataaaacaggtcaa

SEQ ID NO: 3457381 - DNA, 21 bp, Homo sapiens
acctatatgcagtctctttat

SEQ ID NO: 3457382 - DNA, 16 bp, Homo sapiens
acctcacgcacctccc

SEQ ID NO: 3457383 - DNA, 18 bp, Homo sapiens
acctcagagtatggagct

SEQ ID NO: 3457384 - DNA, 11 bp, Homo sapiens
acctcagcctc

SEQ ID NO: 3457385 - DNA, 20 bp, Homo sapiens
acctcagcctggccagacac

SEQ ID NO: 3457386 - DNA, 15 bp, Homo sapiens
acctcaggtgatcca

SEQ ID NO: 3457387 - DNA, 22 bp, Homo sapiens
acctcagttattacatgtaatt

SEQ ID NO: 3457388 - DNA, 20 bp, Homo sapiens
acctcatgacagccagagcc

SEQ ID NO: 3457389 - DNA, 16 bp, Homo sapiens
acctcccacactccca

SEQ ID NO: 3457390 - DNA, 23 bp, Homo sapiens
acctccccagcattccagcccct

SEQ ID NO: 3457391 - DNA, 13 bp, Homo sapiens
acctccccagcct

SEQ ID NO: 3457392 - DNA, 15 bp, Homo sapiens
acctccccagcctgc

SEQ ID NO: 3457393 - DNA, 13 bp, Homo sapiens
acctccctgcctc

SEQ ID NO: 3457394 - DNA, 13 bp, Homo sapiens
acctcctctgtga

SEQ ID NO: 3457395 - DNA, 13 bp, Homo sapiens
acctcctgggcta

SEQ ID NO: 3457396 - DNA, 15 bp, Homo sapiens
acctcctgtctctgg

SEQ ID NO: 3457397 - DNA, 16 bp, Homo sapiens
acctcctgtctctggc

SEQ ID NO: 3457398 - DNA, 22 bp, Homo sapiens
acctcctttcatcacactgggt

SEQ ID NO: 3457399 - DNA, 14 bp, Homo sapiens
acctcgagtactgt

SEQ ID NO: 3457400 - DNA, 19 bp, Homo sapiens
acctcgagtactgtgggca

SEQ ID NO: 3457401 - DNA, 22 bp, Homo sapiens
acctcgccctctcctttgttcc

SEQ ID NO: 3457402 - DNA, 18 bp, Homo sapiens
acctcgctggactctcag

SEQ ID NO: 3457403 - DNA, 17 bp, Homo sapiens
acctcggtgccttcctc

SEQ ID NO: 3457404 - DNA, 13 bp, Homo sapiens
acctctcccaggg

SEQ ID NO: 3457405 - DNA, 15 bp, Homo sapiens
acctctctgtccctt

SEQ ID NO: 3457406 - DNA, 16 bp, Homo sapiens
acctctctgtcccttg

SEQ ID NO: 3457407 - DNA, 22 bp, Homo sapiens
acctctcttatagaatatttat

SEQ ID NO: 3457408 - DNA, 16 bp, Homo sapiens
acctctgcacaagctg

SEQ ID NO: 3457409 - DNA, 23 bp, Homo sapiens
acctctgcctgaagtcacacagt

SEQ ID NO: 3457410 - DNA, 17 bp, Homo sapiens
acctctgcttcccaggt

SEQ ID NO: 3457411 - DNA, 18 bp, Homo sapiens
acctctgttcagtgtaaa

SEQ ID NO: 3457412 - DNA, 18 bp, Homo sapiens
acctcttcagaggccctc

SEQ ID NO: 3457413 - DNA, 22 bp, Homo sapiens
acctcttccgactctttctgag

SEQ ID NO: 3457414 - DNA, 16 bp, Homo sapiens
acctcttctggctcaa

SEQ ID NO: 3457415 - DNA, 18 bp, Homo sapiens
acctctttttaaggacac

SEQ ID NO: 3457416 - DNA, 18 bp, Homo sapiens
acctgaagactcattctt

SEQ ID NO: 3457417 - DNA, 16 bp, Homo sapiens
acctgacactcccttg

SEQ ID NO: 3457418 - DNA, 17 bp, Homo sapiens
acctgacactcccttgg

SEQ ID NO: 3457419 - DNA, 12 bp, Homo sapiens
acctgaggctgt

SEQ ID NO: 3457420 - DNA, 13 bp, Homo sapiens
acctgatcctgga

SEQ ID NO: 3457421 - DNA, 15 bp, Homo sapiens
acctgcaaaaaatac

SEQ ID NO: 3457422 - DNA, 22 bp, Homo sapiens
acctgcaaagatctgtcctcag

SEQ ID NO: 3457423 - DNA, 16 bp, Homo sapiens
acctgcatctggggcc

SEQ ID NO: 3457424 - DNA, 16 bp, Homo sapiens
acctgcccccaatcca

SEQ ID NO: 3457425 - DNA, 18 bp, Homo sapiens
acctgcccttttttctgc

SEQ ID NO: 3457426 - DNA, 20 bp, Homo sapiens
acctgcccttttttctgcct

SEQ ID NO: 3457427 - DNA, 21 bp, Homo sapiens
acctgcccttttttctgcctc

SEQ ID NO: 3457428 - DNA, 21 bp, Homo sapiens
acctgcctgacatttggagtg

SEQ ID NO: 3457429 - DNA, 11 bp, Homo sapiens
acctgcctgta

SEQ ID NO: 3457430 - DNA, 14 bp, Homo sapiens
acctggcagctctg

SEQ ID NO: 3457431 - DNA, 17 bp, Homo sapiens
acctggcagctctggac

SEQ ID NO: 3457432 - DNA, 21 bp, Homo sapiens
acctggccgcctccaggagcc

SEQ ID NO: 3457433 - DNA, 16 bp, Homo sapiens
acctggctgccatact

SEQ ID NO: 3457434 - DNA, 18 bp, Homo sapiens
acctgggattcaggaatg

SEQ ID NO: 3457435 - DNA, 16 bp, Homo sapiens
acctggggttgtcagc

SEQ ID NO: 3457436 - DNA, 21 bp, Homo sapiens
acctggggttgtcagctctca

SEQ ID NO: 3457437 - DNA, 16 bp, Homo sapiens
acctgggttgcagaca

SEQ ID NO: 3457438 - DNA, 18 bp, Homo sapiens
acctgggttgcagacagg

SEQ ID NO: 3457439 - DNA, 15 bp, Homo sapiens
acctggtccacaggg

SEQ ID NO: 3457440 - DNA, 17 bp, Homo sapiens
acctggtccacagggca

SEQ ID NO: 3457441 - DNA, 16 bp, Homo sapiens
acctgtaatcccagca

SEQ ID NO: 3457442 - DNA, 19 bp, Homo sapiens
acctgtaatcccagctact

SEQ ID NO: 3457443 - DNA, 24 bp, Homo sapiens
acctgtcaaacaaagccagaagct

SEQ ID NO: 3457444 - DNA, 18 bp, Homo sapiens
actgggccctgagccaga

SEQ ID NO: 3457445 - DNA, 22 bp, Homo sapiens
actgggctcccgggccccacag

SEQ ID NO: 3457446 - DNA, 16 bp, Homo sapiens
actgggctctggctct

SEQ ID NO: 3457447 - DNA, 13 bp, Homo sapiens
actgggctgaggg

SEQ ID NO: 3457448 - DNA, 16 bp, Homo sapiens
actggggcctccagaa

SEQ ID NO: 3457449 - DNA, 18 bp, Homo sapiens
actgggtacttgtggaca

SEQ ID NO: 3457450 - DNA, 23 bp, Homo sapiens
actgggttcttaaccagatggtt

SEQ ID NO: 3457451 - DNA, 20 bp, Homo sapiens
actgggttgactttcaggta

SEQ ID NO: 3457452 - DNA, 15 bp, Homo sapiens
actggtaggaccaag

SEQ ID NO: 3457453 - DNA, 16 bp, Homo sapiens
actggtattctgttct

SEQ ID NO: 3457454 - DNA, 13 bp, Homo sapiens
actggtgcacttt

SEQ ID NO: 3457455 - DNA, 18 bp, Homo sapiens
actggtgcactttgtaaa

SEQ ID NO: 3457456 - DNA, 21 bp, Homo sapiens
actggtgcactttgtaaattc

SEQ ID NO: 3457457 - DNA, 22 bp, Homo sapiens
actggttggctcccgcggtgcc

SEQ ID NO: 3457458 - DNA, 13 bp, Homo sapiens
actgtaaactaat

SEQ ID NO: 3457459 - DNA, 16 bp, Homo sapiens
actgtaaatatgaatc

SEQ ID NO: 3457460 - DNA, 23 bp, Homo sapiens
actgtaaattgctggcagatgct

SEQ ID NO: 3457461 - DNA, 16 bp, Homo sapiens
actgtaactgattaca

SEQ ID NO: 3457462 - DNA, 15 bp, Homo sapiens
actgtatctaggcaa

SEQ ID NO: 3457463 - DNA, 15 bp, Homo sapiens
actgtatgatttata

SEQ ID NO: 3457464 - DNA, 16 bp, Homo sapiens
actgtatgtgatgaat

SEQ ID NO: 3457465 - DNA, 23 bp, Homo sapiens
actgtcaaaaagtttggttctgt

SEQ ID NO: 3457466 - DNA, 22 bp, Homo sapiens
actgtcaaggctgcttagaatc

SEQ ID NO: 3457467 - DNA, 23 bp, Homo sapiens
actgtcctacccaccctcctttc

SEQ ID NO: 3457468 - DNA, 16 bp, Homo sapiens
actgtcctccaagcca

SEQ ID NO: 3457469 - DNA, 19 bp, Homo sapiens
actgtcctgggcctgcaga

SEQ ID NO: 3457470 - DNA, 12 bp, Homo sapiens
actgtctttcct

SEQ ID NO: 3457471 - DNA, 14 bp, Homo sapiens
actgtctttcctag

SEQ ID NO: 3457472 - DNA, 16 bp, Homo sapiens
actgtgaacagcttgc

SEQ ID NO: 3457473 - DNA, 20 bp, Homo sapiens
actgtgaacagcttgctgtc

SEQ ID NO: 3457474 - DNA, 21 bp, Homo sapiens
actgtgaacagcttgctgtca

SEQ ID NO: 3457475 - DNA, 16 bp, Homo sapiens
actgtgaagagaacca

SEQ ID NO: 3457476 - DNA, 19 bp, Homo sapiens
actgtgacccccagctccg

SEQ ID NO: 3457477 - DNA, 12 bp, Homo sapiens
actgtgcaccta

SEQ ID NO: 3457478 - DNA, 23 bp, Homo sapiens
actgtgccacaatgcagttctga

SEQ ID NO: 3457479 - DNA, 21 bp, Homo sapiens
actgtgcttctctatgataat

SEQ ID NO: 3457480 - DNA, 15 bp, Homo sapiens
actgtgggcaattta

SEQ ID NO: 3457481 - DNA, 18 bp, Homo sapiens
actgtgggcaatttagaa

SEQ ID NO: 3457482 - DNA, 16 bp, Homo sapiens
actgtgtgctgactga

SEQ ID NO: 3457483 - DNA, 19 bp, Homo sapiens
actgtgtgctgactgaaca

SEQ ID NO: 3457484 - DNA, 17 bp, Homo sapiens
actgtgtgtaattgttc

SEQ ID NO: 3457485 - DNA, 15 bp, Homo sapiens
actgtgtgtgtgaat

SEQ ID NO: 3457486 - DNA, 22 bp, Homo sapiens
actgtgtgttgccacaggacac

SEQ ID NO: 3457487 - DNA, 18 bp, Homo sapiens
actgtgtttcaagttcaa

SEQ ID NO: 3457488 - DNA, 16 bp, Homo sapiens
actgttaaaggaaaaa

SEQ ID NO: 3457489 - DNA, 15 bp, Homo sapiens
actgttccccctgtg

SEQ ID NO: 3457490 - DNA, 20 bp, Homo sapiens
actgttctgggactccaggt

SEQ ID NO: 3457491 - DNA, 13 bp, Homo sapiens
actgttgcaaagc

SEQ ID NO: 3457492 - DNA, 12 bp, Homo sapiens
actgttgcccag

SEQ ID NO: 3457493 - DNA, 18 bp, Homo sapiens
actgttgcccaggctggc

SEQ ID NO: 3457494 - DNA, 18 bp, Homo sapiens
actgttggggtgggtata

SEQ ID NO: 3457495 - DNA, 20 bp, Homo sapiens
actgttggggtgggtataaa

SEQ ID NO: 3457496 - DNA, 21 bp, Homo sapiens
actgttggggtgggtataaaa

SEQ ID NO: 3457497 - DNA, 22 bp, Homo sapiens
actgttggggtgggtataaaag

SEQ ID NO: 3457498 - DNA, 19 bp, Homo sapiens
actgttgtacaatcatgtt

SEQ ID NO: 3457499 - DNA, 18 bp, Homo sapiens
actgtttgttactatgta

SEQ ID NO: 3457500 - DNA, 12 bp, Homo sapiens
actgtttgttat

SEQ ID NO: 3457501 - DNA, 21 bp, Homo sapiens
actgtttgtttttatttaaat

SEQ ID NO: 3457502 - DNA, 20 bp, Homo sapiens
actgttttttggcttgctta

SEQ ID NO: 3457503 - DNA, 22 bp, Homo sapiens
acttaaaagtcagtatcatatt

SEQ ID NO: 3457504 - DNA, 13 bp, Homo sapiens
acttaacaaatac

SEQ ID NO: 3457505 - DNA, 22 bp, Homo sapiens
acttaacaaatacattcaaatt

SEQ ID NO: 3457506 - DNA, 14 bp, Homo sapiens
acttaactgtttca

SEQ ID NO: 3457507 - DNA, 14 bp, Homo sapiens
acttaagagaatat

SEQ ID NO: 3457508 - DNA, 19 bp, Homo sapiens
acttaagagaatattttaa

SEQ ID NO: 3457509 - DNA, 14 bp, Homo sapiens
acttaatagaaaca

SEQ ID NO: 3457510 - DNA, 13 bp, Homo sapiens
acttacttgctta

SEQ ID NO: 3457511 - DNA, 18 bp, Homo sapiens
acttagaaagtaagagct

SEQ ID NO: 3457512 - DNA, 18 bp, Homo sapiens
acttatcctaaaacaaat

SEQ ID NO: 3457513 - DNA, 12 bp, Homo sapiens
acttattaacaa

SEQ ID NO: 3457514 - DNA, 13 bp, Homo sapiens
acttcaaggccca

SEQ ID NO: 3457515 - DNA, 19 bp, Homo sapiens
acttcagtatgttgtcaaa

SEQ ID NO: 3457516 - DNA, 17 bp, Homo sapiens
acttcatagaaacctct

SEQ ID NO: 3457517 - DNA, 22 bp, Homo sapiens
acttcatagaaacctctctatt

SEQ ID NO: 3457518 - DNA, 16 bp, Homo sapiens
acttcatctggctgcc

SEQ ID NO: 3457519 - DNA, 21 bp, Homo sapiens
acttcatctggctgcctttgc

SEQ ID NO: 3457520 - DNA, 21 bp, Homo sapiens
acttcattcttgaaagctgtg

SEQ ID NO: 3457521 - DNA, 15 bp, Homo sapiens
acttcattttcagag

SEQ ID NO: 3457522 - DNA, 12 bp, Homo sapiens
acttccatgcct

SEQ ID NO: 3457523 - DNA, 14 bp, Homo sapiens
acttccatgcctta

SEQ ID NO: 3457524 - DNA, 19 bp, Homo sapiens
acttcccgggccagggctg

SEQ ID NO: 3457525 - DNA, 14 bp, Homo sapiens
acttccctgctgcc

SEQ ID NO: 3457526 - DNA, 16 bp, Homo sapiens
acttccctgctgcctg

SEQ ID NO: 3457527 - DNA, 16 bp, Homo sapiens
acttcctgactctcac

SEQ ID NO: 3457528 - DNA, 21 bp, Homo sapiens
acttcgctgtcccccaacact

SEQ ID NO: 3457529 - DNA, 18 bp, Homo sapiens
acttcggggtagaggctg

SEQ ID NO: 3457530 - DNA, 23 bp, Homo sapiens
acttcggggtagaggctgggagg

SEQ ID NO: 3457531 - DNA, 19 bp, Homo sapiens
acttctctataaaaaatat

SEQ ID NO: 3457532 - DNA, 23 bp, Homo sapiens
acttctctataaaaaatatgtat

SEQ ID NO: 3457533 - DNA, 18 bp, Homo sapiens
acttctgccatattctgt

SEQ ID NO: 3457534 - DNA, 12 bp, Homo sapiens
acttctgcctgg

SEQ ID NO: 3457535 - DNA, 13 bp, Homo sapiens
acttctgcctgga

SEQ ID NO: 3457536 - DNA, 22 bp, Homo sapiens
acttctggctccctcttctttc

SEQ ID NO: 3457537 - DNA, 21 bp, Homo sapiens
acttcttatggaattgatttg

SEQ ID NO: 3457538 - DNA, 23 bp, Homo sapiens
acttcttatggaattgatttgca

SEQ ID NO: 3457539 - DNA, 19 bp, Homo sapiens
acttcttcacctcttccac

SEQ ID NO: 3457540 - DNA, 21 bp, Homo sapiens
acttcttcagagctgacacag

SEQ ID NO: 3457541 - DNA, 19 bp, Homo sapiens
acttcttcataattttagt

SEQ ID NO: 3457542 - DNA, 12 bp, Homo sapiens
acttcttgaagg

SEQ ID NO: 3457543 - DNA, 16 bp, Homo sapiens
acttcttgccctgggg

SEQ ID NO: 3457544 - DNA, 15 bp, Homo sapiens
acttctttcagcaga

SEQ ID NO: 3457545 - DNA, 14 bp, Homo sapiens
acttgaacttgcct

SEQ ID NO: 3457546 - DNA, 16 bp, Homo sapiens
acttgaactttcctgg

SEQ ID NO: 3457547 - DNA, 21 bp, Homo sapiens
acttgaagaatattcccaata

SEQ ID NO: 3457548 - DNA, 11 bp, Homo sapiens
acttgaagttg

SEQ ID NO: 3457549 - DNA, 22 bp, Homo sapiens
acttgaagttgcttttttgact

SEQ ID NO: 3457550 - DNA, 20 bp, Homo sapiens
acttgatggaaggatctctc

SEQ ID NO: 3457551 - DNA, 22 bp, Homo sapiens
acttgcagactctacagaggcc

SEQ ID NO: 3457552 - DNA, 21 bp, Homo sapiens
acttgccatgtgactctggct

SEQ ID NO: 3457553 - DNA, 17 bp, Homo sapiens
acttgcctcttccttga

SEQ ID NO: 3457554 - DNA, 23 bp, Homo sapiens
acttgcctcttttacctgctgct

SEQ ID NO: 3457555 - DNA, 24 bp, Homo sapiens
acttgccttcctaagcctgtggct

SEQ ID NO: 3457556 - DNA, 22 bp, Homo sapiens
acttgctcaggtacttgtaaat

SEQ ID NO: 3457557 - DNA, 14 bp, Homo sapiens
acttggaagctccg

SEQ ID NO: 3457558 - DNA, 21 bp, Homo sapiens
acttggacttgtcctcagcag

SEQ ID NO: 3457559 - DNA, 13 bp, Homo sapiens
acttggattctct

SEQ ID NO: 3457560 - DNA, 15 bp, Homo sapiens
acttggattctctaa

SEQ ID NO: 3457561 - DNA, 17 bp, Homo sapiens
acttggctacacaggga

SEQ ID NO: 3457562 - DNA, 18 bp, Homo sapiens
acttggctcgaatctctg

SEQ ID NO: 3457563 - DNA, 21 bp, Homo sapiens
acttggggagttaagacctgg

SEQ ID NO: 3457564 - DNA, 23 bp, Homo sapiens
acttggggagttaagacctggca

SEQ ID NO: 3457565 - DNA, 20 bp, Homo sapiens
acttgggggttcaggcccgg

SEQ ID NO: 3457566 - DNA, 18 bp, Homo sapiens
acttgtcaagcctgtgca

SEQ ID NO: 3457567 - DNA, 20 bp, Homo sapiens
acttgtgattatttattatt

SEQ ID NO: 3457568 - DNA, 13 bp, Homo sapiens
acttgtgccaaca

SEQ ID NO: 3457569 - DNA, 19 bp, Homo sapiens
acttgtttctctgttgtaa

SEQ ID NO: 3457570 - DNA, 16 bp, Homo sapiens
actttaaaaggagcca

SEQ ID NO: 3457571 - DNA, 13 bp, Homo sapiens
actttaatgtttt

SEQ ID NO: 3457572 - DNA, 10 bp, Homo sapiens
actttaattt

SEQ ID NO: 3457573 - DNA, 18 bp, Homo sapiens
actttagaaagctgacat

SEQ ID NO: 3457574 - DNA, 21 bp, Homo sapiens
actttagaagcacagtaaata

SEQ ID NO: 3457575 - DNA, 22 bp, Homo sapiens
actttagccactggtttctcag

SEQ ID NO: 3457576 - DNA, 16 bp, Homo sapiens
agagggcacacactgt

SEQ ID NO: 3457577 - DNA, 16 bp, Homo sapiens
agagggcactctgctt

SEQ ID NO: 3457578 - DNA, 11 bp, Homo sapiens
agagggctgga

SEQ ID NO: 3457579 - DNA, 17 bp, Homo sapiens
agagggctggaggccca

SEQ ID NO: 3457580 - DNA, 19 bp, Homo sapiens
agagggctggaggcccagg

SEQ ID NO: 3457581 - DNA, 21 bp, Homo sapiens
agaggggctgaatagcagaag

SEQ ID NO: 3457582 - DNA, 12 bp, Homo sapiens
agagggggcctg

SEQ ID NO: 3457583 - DNA, 22 bp, Homo sapiens
agagggggcctgggacttccat

SEQ ID NO: 3457584 - DNA, 22 bp, Homo sapiens
agaggggggaagatcaggtcat

SEQ ID NO: 3457585 - DNA, 20 bp, Homo sapiens
agagggtctgaggaatccag

SEQ ID NO: 3457586 - DNA, 15 bp, Homo sapiens
agagggtgagggcct

SEQ ID NO: 3457587 - DNA, 16 bp, Homo sapiens
agagggtgagggcctt

SEQ ID NO: 3457588 - DNA, 19 bp, Homo sapiens
agagggtgagggccttctt

SEQ ID NO: 3457589 - DNA, 20 bp, Homo sapiens
agagggtggtgacctctgcc

SEQ ID NO: 3457590 - DNA, 16 bp, Homo sapiens
agaggtgcttcaccct

SEQ ID NO: 3457591 - DNA, 24 bp, Homo sapiens
agaggtgggccagtctgtggatca

SEQ ID NO: 3457592 - DNA, 17 bp, Homo sapiens
agaggttatctgtccca

SEQ ID NO: 3457593 - DNA, 22 bp, Homo sapiens
agaggtttgactagatgatgga

SEQ ID NO: 3457594 - DNA, 21 bp, Homo sapiens
agagtatggagctcagagagg

SEQ ID NO: 3457595 - DNA, 14 bp, Homo sapiens
agagtcacaagcct

SEQ ID NO: 3457596 - DNA, 19 bp, Homo sapiens
agagtcagctctctgccct

SEQ ID NO: 3457597 - DNA, 22 bp, Homo sapiens
agagtcggaacggagaaaggtg

SEQ ID NO: 3457598 - DNA, 21 bp, Homo sapiens
agagtctaatagtctttgcca

SEQ ID NO: 3457599 - DNA, 21 bp, Homo sapiens
agagtgacacccaagagggct

SEQ ID NO: 3457600 - DNA, 23 bp, Homo sapiens
agagtgacacccaagagggctgc

SEQ ID NO: 3457601 - DNA, 19 bp, Homo sapiens
agagtgagactctgtctca

SEQ ID NO: 3457602 - DNA, 15 bp, Homo sapiens
agagtggaggcgggc

SEQ ID NO: 3457603 - DNA, 19 bp, Homo sapiens
agagtggggatatgattta

SEQ ID NO: 3457604 - DNA, 16 bp, Homo sapiens
agagtggtcagttgaa

SEQ ID NO: 3457605 - DNA, 14 bp, Homo sapiens
agagtgtctttcca

SEQ ID NO: 3457606 - DNA, 23 bp, Homo sapiens
agagttaaatagagtatatgcac

SEQ ID NO: 3457607 - DNA, 18 bp, Homo sapiens
agagttgccccgtctctg

SEQ ID NO: 3457608 - DNA, 13 bp, Homo sapiens
agagttgtaaata

SEQ ID NO: 3457609 - DNA, 15 bp, Homo sapiens
agagttgtaaatata

SEQ ID NO: 3457610 - DNA, 17 bp, Homo sapiens
agagttgtaaatatata

SEQ ID NO: 3457611 - DNA, 13 bp, Homo sapiens
agagttttggatg

SEQ ID NO: 3457612 - DNA, 14 bp, Homo sapiens
agataaagatttct

SEQ ID NO: 3457613 - DNA, 18 bp, Homo sapiens
agataaagatttcttgag

SEQ ID NO: 3457614 - DNA, 13 bp, Homo sapiens
agataactaggaa

SEQ ID NO: 3457615 - DNA, 16 bp, Homo sapiens
agataagtgtattttt

SEQ ID NO: 3457616 - DNA, 20 bp, Homo sapiens
agataagtgtatttttcaat

SEQ ID NO: 3457617 - DNA, 13 bp, Homo sapiens
agataatgtgaaa

SEQ ID NO: 3457618 - DNA, 14 bp, Homo sapiens
agatacaggaaaaa

SEQ ID NO: 3457619 - DNA, 19 bp, Homo sapiens
agatacaggaaaagctgct

SEQ ID NO: 3457620 - DNA, 20 bp, Homo sapiens
agatacaggaaaagctgctg

SEQ ID NO: 3457621 - DNA, 14 bp, Homo sapiens
agataccagcgagg

SEQ ID NO: 3457622 - DNA, 12 bp, Homo sapiens
agatagggaaaa

SEQ ID NO: 3457623 - DNA, 14 bp, Homo sapiens
agatagtaactgta

SEQ ID NO: 3457624 - DNA, 23 bp, Homo sapiens
agatagtcatgctgctagatctt

SEQ ID NO: 3457625 - DNA, 20 bp, Homo sapiens
agatataactattgcccagg

SEQ ID NO: 3457626 - DNA, 17 bp, Homo sapiens
agatataagtgctgtat

SEQ ID NO: 3457627 - DNA, 13 bp, Homo sapiens
agatatattaaaa

SEQ ID NO: 3457628 - DNA, 18 bp, Homo sapiens
agatatattaaaaatata

SEQ ID NO: 3457629 - DNA, 19 bp, Homo sapiens
agatatcttcagtttaatg

SEQ ID NO: 3457630 - DNA, 15 bp, Homo sapiens
agatattatgtataa

SEQ ID NO: 3457631 - DNA, 21 bp, Homo sapiens
agatattatgtataaaatgta

SEQ ID NO: 3457632 - DNA, 23 bp, Homo sapiens
agatattatgtataaaatgtaac

SEQ ID NO: 3457633 - DNA, 17 bp, Homo sapiens
agatattggacaaagaa

SEQ ID NO: 3457634 - DNA, 19 bp, Homo sapiens
agatattttgggcatgtgg

SEQ ID NO: 3457635 - DNA, 19 bp, Homo sapiens
agatcaaccccttcgctcc

SEQ ID NO: 3457636 - DNA, 21 bp, Homo sapiens
agatcaaccccttcgctcctg

SEQ ID NO: 3457637 - DNA, 18 bp, Homo sapiens
agatcaaggagcccagaa

SEQ ID NO: 3457638 - DNA, 19 bp, Homo sapiens
agatcaaggagcccagaaa

SEQ ID NO: 3457639 - DNA, 14 bp, Homo sapiens
agatcacgccactg

SEQ ID NO: 3457640 - DNA, 17 bp, Homo sapiens
agatcacgccactgcac

SEQ ID NO: 3457641 - DNA, 15 bp, Homo sapiens
agatcagcctgggca

SEQ ID NO: 3457642 - DNA, 18 bp, Homo sapiens
agatccaaaagaagcccc

SEQ ID NO: 3457643 - DNA, 21 bp, Homo sapiens
agatccaaaagaagcccccag

SEQ ID NO: 3457644 - DNA, 14 bp, Homo sapiens
agatccagcctggg

SEQ ID NO: 3457645 - DNA, 20 bp, Homo sapiens
agatcccaggcccctggagg

SEQ ID NO: 3457646 - DNA, 13 bp, Homo sapiens
agatcctctctgg

SEQ ID NO: 3457647 - DNA, 16 bp, Homo sapiens
agatcctctctggggc

SEQ ID NO: 3457648 - DNA, 21 bp, Homo sapiens
agatcctcttctcaaagctgg

SEQ ID NO: 3457649 - DNA, 23 bp, Homo sapiens
agatcctgtgaggagccccatct

SEQ ID NO: 3457650 - DNA, 22 bp, Homo sapiens
agatctcggtttgccaaaattc

SEQ ID NO: 3457651 - DNA, 16 bp, Homo sapiens
agatctctgcagggcc

SEQ ID NO: 3457652 - DNA, 18 bp, Homo sapiens
agatctgtaatttttatt

SEQ ID NO: 3457653 - DNA, 14 bp, Homo sapiens
agatctgtcctcag

SEQ ID NO: 3457654 - DNA, 14 bp, Homo sapiens
agatctgttttgaa

SEQ ID NO: 3457655 - DNA, 21 bp, Homo sapiens
agatctgttttgaaggcaaaa

SEQ ID NO: 3457656 - DNA, 12 bp, Homo sapiens
agatcttaatat

SEQ ID NO: 3457657 - DNA, 13 bp, Homo sapiens
agatcttaatata

SEQ ID NO: 3457658 - DNA, 15 bp, Homo sapiens
agatcttaatataaa

SEQ ID NO: 3457659 - DNA, 19 bp, Homo sapiens
agatcttaatataaattca

SEQ ID NO: 3457660 - DNA, 23 bp, Homo sapiens
agatgaaatcttacagctgggtg

SEQ ID NO: 3457661 - DNA, 15 bp, Homo sapiens
agatgaagttttaca

SEQ ID NO: 3457662 - DNA, 13 bp, Homo sapiens
agatgacagctct

SEQ ID NO: 3457663 - DNA, 15 bp, Homo sapiens
agatgacagctcttc

SEQ ID NO: 3457664 - DNA, 16 bp, Homo sapiens
agatgaccataaccac

SEQ ID NO: 3457665 - DNA, 20 bp, Homo sapiens
agatgaccataaccactgaa

SEQ ID NO: 3457666 - DNA, 20 bp, Homo sapiens
agatgactatgcagaggcct

SEQ ID NO: 3457667 - DNA, 20 bp, Homo sapiens
agatgagttatctaagaata

SEQ ID NO: 3457668 - DNA, 15 bp, Homo sapiens
agatgattatatatt

SEQ ID NO: 3457669 - DNA, 21 bp, Homo sapiens
agatgattatatattgttgtt

SEQ ID NO: 3457670 - DNA, 15 bp, Homo sapiens
agatgcaaagaggca

SEQ ID NO: 3457671 - DNA, 16 bp, Homo sapiens
agatgcaaagaggcaa

SEQ ID NO: 3457672 - DNA, 16 bp, Homo sapiens
agatgcaagtctcttg

SEQ ID NO: 3457673 - DNA, 18 bp, Homo sapiens
agatgcaccaccaagcca

SEQ ID NO: 3457674 - DNA, 14 bp, Homo sapiens
agatgcaccagccc

SEQ ID NO: 3457675 - DNA, 15 bp, Homo sapiens
agatgcaccagccct

SEQ ID NO: 3457676 - DNA, 13 bp, Homo sapiens
agatgcagggcag

SEQ ID NO: 3457677 - DNA, 17 bp, Homo sapiens
agatgcatgttgaccat

SEQ ID NO: 3457678 - DNA, 22 bp, Homo sapiens
agatgcattcttggttggctgg

SEQ ID NO: 3457679 - DNA, 15 bp, Homo sapiens
agatgccccagggat

SEQ ID NO: 3457680 - DNA, 19 bp, Homo sapiens
agatgcccgagggagggga

SEQ ID NO: 3457681 - DNA, 19 bp, Homo sapiens
agatgcgcagccccatctg

SEQ ID NO: 3457682 - DNA, 23 bp, Homo sapiens
agatgcgcattctaacctggagg

SEQ ID NO: 3457683 - DNA, 20 bp, Homo sapiens
agatgcgttcagcagactgg

SEQ ID NO: 3457684 - DNA, 13 bp, Homo sapiens
agatgctccaggg

SEQ ID NO: 3457685 - DNA, 19 bp, Homo sapiens
agatgctgcagagtcacaa

SEQ ID NO: 3457686 - DNA, 19 bp, Homo sapiens
agatgctggcttgggcagc

SEQ ID NO: 3457687 - DNA, 19 bp, Homo sapiens
agatgctttcctaaatcag

SEQ ID NO: 3457688 - DNA, 11 bp, Homo sapiens
agatgctttta

SEQ ID NO: 3457689 - DNA, 17 bp, Homo sapiens
agatggaaccgcaggaa

SEQ ID NO: 3457690 - DNA, 20 bp, Homo sapiens
agatggaaccgcaggaagct

SEQ ID NO: 3457691 - DNA, 13 bp, Homo sapiens
agatggaagcttg

SEQ ID NO: 3457692 - DNA, 22 bp, Homo sapiens
agatggaagttgcagtgagctg

SEQ ID NO: 3457693 - DNA, 23 bp, Homo sapiens
agatggaagttgcagtgagctga

SEQ ID NO: 3457694 - DNA, 16 bp, Homo sapiens
agatggacagagaact

SEQ ID NO: 3457695 - DNA, 13 bp, Homo sapiens
agatggattctcc

SEQ ID NO: 3457696 - DNA, 18 bp, Homo sapiens
agatggattctccactca

SEQ ID NO: 3457697 - DNA, 16 bp, Homo sapiens
agatggcaaatgacca

SEQ ID NO: 3457698 - DNA, 22 bp, Homo sapiens
agatgggcatatgtgtcagtgg

SEQ ID NO: 3457699 - DNA, 17 bp, Homo sapiens
agatgggggcagggctg

SEQ ID NO: 3457700 - DNA, 21 bp, Homo sapiens
agatgggtgaaggctggcatg

SEQ ID NO: 3457701 - DNA, 22 bp, Homo sapiens
agatggtacaacctttattctt

SEQ ID NO: 3457702 - DNA, 21 bp, Homo sapiens
agatggtcacgcacctgggtg

SEQ ID NO: 3457703 - DNA, 20 bp, Homo sapiens
agatggtggcacattccttt

SEQ ID NO: 3457704 - DNA, 13 bp, Homo sapiens
agatggttgtgta

SEQ ID NO: 3457705 - DNA, 17 bp, Homo sapiens
agatggtttccacattt

SEQ ID NO: 3457706 - DNA, 21 bp, Homo sapiens
agatgtggccttccatttata

SEQ ID NO: 3457707 - DNA, 22 bp, Homo sapiens
agatgtggttgcataaggtttt

SEQ ID NO: 3457708 - DNA, 15 bp, Homo sapiens
agctaatgggacact

SEQ ID NO: 3457709 - DNA, 13 bp, Homo sapiens
agctaatttgcat

SEQ ID NO: 3457710 - DNA, 21 bp, Homo sapiens
agctacgaaaggatgagcaga

SEQ ID NO: 3457711 - DNA, 23 bp, Homo sapiens
agctacgaaaggatgagcagagc

SEQ ID NO: 3457712 - DNA, 23 bp, Homo sapiens
agctactctccccacgagggctg

SEQ ID NO: 3457713 - DNA, 14 bp, Homo sapiens
agctactctgatcc

SEQ ID NO: 3457714 - DNA, 17 bp, Homo sapiens
agctactctgatccctc

SEQ ID NO: 3457715 - DNA, 20 bp, Homo sapiens
agctactgtgtgtgtgaatg

SEQ ID NO: 3457716 - DNA, 16 bp, Homo sapiens
agctacttgggaggct

SEQ ID NO: 3457717 - DNA, 14 bp, Homo sapiens
agctacttggtttg

SEQ ID NO: 3457718 - DNA, 16 bp, Homo sapiens
agctacttggtttgtg

SEQ ID NO: 3457719 - DNA, 21 bp, Homo sapiens
agctacttggtttgtgttctt

SEQ ID NO: 3457720 - DNA, 20 bp, Homo sapiens
agctagaggaaccaaccccc

SEQ ID NO: 3457721 - DNA, 17 bp, Homo sapiens
agctagccagaggactg

SEQ ID NO: 3457722 - DNA, 16 bp, Homo sapiens
agctagctcaactagt

SEQ ID NO: 3457723 - DNA, 17 bp, Homo sapiens
agctaggagaagggctg

SEQ ID NO: 3457724 - DNA, 16 bp, Homo sapiens
agctaggcctggccag

SEQ ID NO: 3457725 - DNA, 18 bp, Homo sapiens
agctagtgtacctcctct

SEQ ID NO: 3457726 - DNA, 19 bp, Homo sapiens
agctagtgtacctcctctc

SEQ ID NO: 3457727 - DNA, 23 bp, Homo sapiens
agctagtgtacctcctctcagtg

SEQ ID NO: 3457728 - DNA, 22 bp, Homo sapiens
agctagttttattcttggtttt

SEQ ID NO: 3457729 - DNA, 23 bp, Homo sapiens
agctataaattcctctttgcttt

SEQ ID NO: 3457730 - DNA, 18 bp, Homo sapiens
agctatagacccgaggaa

SEQ ID NO: 3457731 - DNA, 19 bp, Homo sapiens
agctatagacccgaggaaa

SEQ ID NO: 3457732 - DNA, 18 bp, Homo sapiens
agctatgttatattgaaa

SEQ ID NO: 3457733 - DNA, 23 bp, Homo sapiens
agctcaccagccccagtgcccac

SEQ ID NO: 3457734 - DNA, 15 bp, Homo sapiens
agctcagacattttc

SEQ ID NO: 3457735 - DNA, 18 bp, Homo sapiens
agctcagacattttcttt

SEQ ID NO: 3457736 - DNA, 21 bp, Homo sapiens
agctcagagagggcaggcatg

SEQ ID NO: 3457737 - DNA, 17 bp, Homo sapiens
agctcaggacagatgcc

SEQ ID NO: 3457738 - DNA, 18 bp, Homo sapiens
agctcaggacagatgcca

SEQ ID NO: 3457739 - DNA, 20 bp, Homo sapiens
agctcaggtgtccctgcact

SEQ ID NO: 3457740 - DNA, 20 bp, Homo sapiens
agctcatatgctgacagctc

SEQ ID NO: 3457741 - DNA, 14 bp, Homo sapiens
agctcattcccaac

SEQ ID NO: 3457742 - DNA, 13 bp, Homo sapiens
agctccaacctgc

SEQ ID NO: 3457743 - DNA, 14 bp, Homo sapiens
agctccaacctgca

SEQ ID NO: 3457744 - DNA, 15 bp, Homo sapiens
agctccaacctgcaa

SEQ ID NO: 3457745 - DNA, 15 bp, Homo sapiens
agctccaagccccat

SEQ ID NO: 3457746 - DNA, 15 bp, Homo sapiens
agctccaccctggcc

SEQ ID NO: 3457747 - DNA, 17 bp, Homo sapiens
agctccactctgcttct

SEQ ID NO: 3457748 - DNA, 18 bp, Homo sapiens
agctccactctgcttctc

SEQ ID NO: 3457749 - DNA, 17 bp, Homo sapiens
agctccagctcaccagc

SEQ ID NO: 3457750 - DNA, 21 bp, Homo sapiens
agctccagctcaccagcccca

SEQ ID NO: 3457751 - DNA, 13 bp, Homo sapiens
agctccattttct

SEQ ID NO: 3457752 - DNA, 22 bp, Homo sapiens
agctcccaagggatggtgccct

SEQ ID NO: 3457753 - DNA, 21 bp, Homo sapiens
agctcccaggtgcagccagag

SEQ ID NO: 3457754 - DNA, 22 bp, Homo sapiens
agctcccaggtgcagccagagg

SEQ ID NO: 3457755 - DNA, 13 bp, Homo sapiens
agctccccagagt

SEQ ID NO: 3457756 - DNA, 18 bp, Homo sapiens
agctccccagagtcctct

SEQ ID NO: 3457757 - DNA, 23 bp, Homo sapiens
agctccccaggactcaccctcat

SEQ ID NO: 3457758 - DNA, 20 bp, Homo sapiens
agctccgctttctacccagc

SEQ ID NO: 3457759 - DNA, 14 bp, Homo sapiens
agctcctcctccct

SEQ ID NO: 3457760 - DNA, 16 bp, Homo sapiens
agctcctcctccctgc

SEQ ID NO: 3457761 - DNA, 21 bp, Homo sapiens
agctcctcctccctgcatctg

SEQ ID NO: 3457762 - DNA, 17 bp, Homo sapiens
agctcctctccccagcc

SEQ ID NO: 3457763 - DNA, 18 bp, Homo sapiens
agctcctctccccagccc

SEQ ID NO: 3457764 - DNA, 19 bp, Homo sapiens
agctcctctccccagccca

SEQ ID NO: 3457765 - DNA, 22 bp, Homo sapiens
agctcctctccccagcccagag

SEQ ID NO: 3457766 - DNA, 13 bp, Homo sapiens
agctcctgtggcc

SEQ ID NO: 3457767 - DNA, 15 bp, Homo sapiens
agctcctgtggcccc

SEQ ID NO: 3457768 - DNA, 22 bp, Homo sapiens
agctcctgtggccccaccctgg

SEQ ID NO: 3457769 - DNA, 15 bp, Homo sapiens
agctccttctgtcct

SEQ ID NO: 3457770 - DNA, 12 bp, Homo sapiens
agctccttggga

SEQ ID NO: 3457771 - DNA, 22 bp, Homo sapiens
agctcggtacccggggcccagg

SEQ ID NO: 3457772 - DNA, 13 bp, Homo sapiens
agctctacccagg

SEQ ID NO: 3457773 - DNA, 17 bp, Homo sapiens
agctctacccagggcct

SEQ ID NO: 3457774 - DNA, 20 bp, Homo sapiens
agctctacccagggcctgca

SEQ ID NO: 3457775 - DNA, 14 bp, Homo sapiens
agctctagttcaaa

SEQ ID NO: 3457776 - DNA, 23 bp, Homo sapiens
agctctcatctgaggcatccagc

SEQ ID NO: 3457777 - DNA, 14 bp, Homo sapiens
agctctcctgactt

SEQ ID NO: 3457778 - DNA, 17 bp, Homo sapiens
agctctcggaactgcat

SEQ ID NO: 3457779 - DNA, 16 bp, Homo sapiens
agctctctcctccctt

SEQ ID NO: 3457780 - DNA, 14 bp, Homo sapiens
agctctctgccctg

SEQ ID NO: 3457781 - DNA, 16 bp, Homo sapiens
agctctctgccctgtg

SEQ ID NO: 3457782 - DNA, 19 bp, Homo sapiens
agctctcttcaatgacata

SEQ ID NO: 3457783 - DNA, 22 bp, Homo sapiens
agctctgctcctctccccagca

SEQ ID NO: 3457784 - DNA, 18 bp, Homo sapiens
agctctggacagccccac

SEQ ID NO: 3457785 - DNA, 16 bp, Homo sapiens
agctctggaggggagg

SEQ ID NO: 3457786 - DNA, 23 bp, Homo sapiens
agctctgtatcaggacccagagg

SEQ ID NO: 3457787 - DNA, 12 bp, Homo sapiens
agctctgtcctg

SEQ ID NO: 3457788 - DNA, 19 bp, Homo sapiens
agctctgtttataaaaaca

SEQ ID NO: 3457789 - DNA, 20 bp, Homo sapiens
agctctgtttataaaaacaa

SEQ ID NO: 3457790 - DNA, 17 bp, Homo sapiens
agctcttcatctgccca

SEQ ID NO: 3457791 - DNA, 23 bp, Homo sapiens
agctcttctgccggccctggggc

SEQ ID NO: 3457792 - DNA, 21 bp, Homo sapiens
agctgaacaataggctgttcc

SEQ ID NO: 3457793 - DNA, 19 bp, Homo sapiens
agctgacacaaacctgcct

SEQ ID NO: 3457794 - DNA, 20 bp, Homo sapiens
agctgacacaaacctgcctg

SEQ ID NO: 3457795 - DNA, 16 bp, Homo sapiens
agctgacattgccaaa

SEQ ID NO: 3457796 - DNA, 18 bp, Homo sapiens
agctgacattgccaaaaa

SEQ ID NO: 3457797 - DNA, 16 bp, Homo sapiens
agctgacccagcccct

SEQ ID NO: 3457798 - DNA, 20 bp, Homo sapiens
agctgacttgcacagggatt

SEQ ID NO: 3457799 - DNA, 15 bp, Homo sapiens
agctgacttttctgt

SEQ ID NO: 3457800 - DNA, 19 bp, Homo sapiens
agctgagactacaagtgtg

SEQ ID NO: 3457801 - DNA, 12 bp, Homo sapiens
agctgagcgcca

SEQ ID NO: 3457802 - DNA, 16 bp, Homo sapiens
agctgaggcagcagtg

SEQ ID NO: 3457803 - DNA, 13 bp, Homo sapiens
agctgaggccaca

SEQ ID NO: 3457804 - DNA, 14 bp, Homo sapiens
agctgcaaaggaca

SEQ ID NO: 3457805 - DNA, 15 bp, Homo sapiens
agctgcaaaggacag

SEQ ID NO: 3457806 - DNA, 20 bp, Homo sapiens
agctgcaaagtgttttgtac

SEQ ID NO: 3457807 - DNA, 13 bp, Homo sapiens
agctgcaccctca

SEQ ID NO: 3457808 - DNA, 19 bp, Homo sapiens
agctgcaccctcaggcagg

SEQ ID NO: 3457809 - DNA, 16 bp, Homo sapiens
agctgccccggcccct

SEQ ID NO: 3457810 - DNA, 17 bp, Homo sapiens
agctgccccggcccctc

SEQ ID NO: 3457811 - DNA, 19 bp, Homo sapiens
agctgccccggcccctccc

SEQ ID NO: 3457812 - DNA, 15 bp, Homo sapiens
agctgcccctctctg

SEQ ID NO: 3457813 - DNA, 14 bp, Homo sapiens
agctgcccctggct

SEQ ID NO: 3457814 - DNA, 17 bp, Homo sapiens
agctgccctatgggcct

SEQ ID NO: 3457815 - DNA, 19 bp, Homo sapiens
agctgccctatgggcctgc

SEQ ID NO: 3457816 - DNA, 21 bp, Homo sapiens
agctgccctatgggcctgccg

SEQ ID NO: 3457817 - DNA, 23 bp, Homo sapiens
agctgccctcccctccggactgg

SEQ ID NO: 3457818 - DNA, 22 bp, Homo sapiens
agctgcctaggtcccccaagca

SEQ ID NO: 3457819 - DNA, 23 bp, Homo sapiens
agctgcctcccctctccttcctg

SEQ ID NO: 3457820 - DNA, 13 bp, Homo sapiens
agctgccttagct

SEQ ID NO: 3457821 - DNA, 20 bp, Homo sapiens
agctgccttagcttcaggaa

SEQ ID NO: 3457822 - DNA, 23 bp, Homo sapiens
agctgccttagcttcaggaacct

SEQ ID NO: 3457823 - DNA, 14 bp, Homo sapiens
agctgccttggctc

SEQ ID NO: 3457824 - DNA, 16 bp, Homo sapiens
agctgcggtccaccca

SEQ ID NO: 3457825 - DNA, 20 bp, Homo sapiens
agctgcggtccacccaggag

SEQ ID NO: 3457826 - DNA, 18 bp, Homo sapiens
agctgctaccttctttgg

SEQ ID NO: 3457827 - DNA, 16 bp, Homo sapiens
agctgctatagcctgg

SEQ ID NO: 3457828 - DNA, 21 bp, Homo sapiens
agctgctatagcctggggtgg

SEQ ID NO: 3457829 - DNA, 13 bp, Homo sapiens
agctgctccccag

SEQ ID NO: 3457830 - DNA, 17 bp, Homo sapiens
agctgctccccagcagc

SEQ ID NO: 3457831 - DNA, 20 bp, Homo sapiens
agctgctccccagcagcgga

SEQ ID NO: 3457832 - DNA, 14 bp, Homo sapiens
agctgctgacagtg

SEQ ID NO: 3457833 - DNA, 13 bp, Homo sapiens
agctgctgtctct

SEQ ID NO: 3457834 - DNA, 15 bp, Homo sapiens
agctggagcctggtg

SEQ ID NO: 3457835 - DNA, 17 bp, Homo sapiens
agctggagcctggtgcc

SEQ ID NO: 3457836 - DNA, 20 bp, Homo sapiens
agctggatgatggtcttcag

SEQ ID NO: 3457837 - DNA, 12 bp, Homo sapiens
agctggccaggc

SEQ ID NO: 3457838 - DNA, 23 bp, Homo sapiens
agctggccaggccactgggccct

SEQ ID NO: 3457839 - DNA, 19 bp, Homo sapiens
agctggccgtgggcctggg

SEQ ID NO: 3457840 - DNA, 20 bp, Homo sapiens
aggccagctatctgcctgac

SEQ ID NO: 3457841 - DNA, 20 bp, Homo sapiens
aggccagctggcagcagagt

SEQ ID NO: 3457842 - DNA, 15 bp, Homo sapiens
aggccaggccagctg

SEQ ID NO: 3457843 - DNA, 12 bp, Homo sapiens
aggccaggccgg

SEQ ID NO: 3457844 - DNA, 21 bp, Homo sapiens
aggccatcatcagtggagcca

SEQ ID NO: 3457845 - DNA, 16 bp, Homo sapiens
aggccatggagagctg

SEQ ID NO: 3457846 - DNA, 16 bp, Homo sapiens
aggccatgggcctcct

SEQ ID NO: 3457847 - DNA, 13 bp, Homo sapiens
aggcccaggctgg

SEQ ID NO: 3457848 - DNA, 13 bp, Homo sapiens
aggcccagtgaga

SEQ ID NO: 3457849 - DNA, 17 bp, Homo sapiens
aggcccagttcaccctg

SEQ ID NO: 3457850 - DNA, 12 bp, Homo sapiens
aggccccagcct

SEQ ID NO: 3457851 - DNA, 14 bp, Homo sapiens
aggccccaggaagc

SEQ ID NO: 3457852 - DNA, 17 bp, Homo sapiens
aggcccccacttgcctc

SEQ ID NO: 3457853 - DNA, 14 bp, Homo sapiens
aggcccccagccca

SEQ ID NO: 3457854 - DNA, 17 bp, Homo sapiens
aggcccccagcccaggg

SEQ ID NO: 3457855 - DNA, 18 bp, Homo sapiens
aggcccccagcccagggc

SEQ ID NO: 3457856 - DNA, 13 bp, Homo sapiens
aggcccctgccct

SEQ ID NO: 3457857 - DNA, 13 bp, Homo sapiens
aggcccctggagg

SEQ ID NO: 3457858 - DNA, 19 bp, Homo sapiens
aggcccctggaggctgcct

SEQ ID NO: 3457859 - DNA, 22 bp, Homo sapiens
aggcccctggaggctgcctccc

SEQ ID NO: 3457860 - DNA, 12 bp, Homo sapiens
aggcccggccta

SEQ ID NO: 3457861 - DNA, 14 bp, Homo sapiens
aggcccggctccag

SEQ ID NO: 3457862 - DNA, 16 bp, Homo sapiens
aggcccggctccaggc

SEQ ID NO: 3457863 - DNA, 18 bp, Homo sapiens
aggcccggctccaggctc

SEQ ID NO: 3457864 - DNA, 13 bp, Homo sapiens
aggccctgccagt

SEQ ID NO: 3457865 - DNA, 15 bp, Homo sapiens
aggccctggcctccc

SEQ ID NO: 3457866 - DNA, 21 bp, Homo sapiens
aggccctggcctcccctgcca

SEQ ID NO: 3457867 - DNA, 22 bp, Homo sapiens
aggccctggcctcccctgccac

SEQ ID NO: 3457868 - DNA, 13 bp, Homo sapiens
aggccctttgctg

SEQ ID NO: 3457869 - DNA, 20 bp, Homo sapiens
aggccgcagctccattttct

SEQ ID NO: 3457870 - DNA, 20 bp, Homo sapiens
aggccgctgccccagccccg

SEQ ID NO: 3457871 - DNA, 19 bp, Homo sapiens
aggcctaccccgcagacac

SEQ ID NO: 3457872 - DNA, 14 bp, Homo sapiens
aggcctcagccaga

SEQ ID NO: 3457873 - DNA, 14 bp, Homo sapiens
aggcctcaggtgct

SEQ ID NO: 3457874 - DNA, 18 bp, Homo sapiens
aggcctcttttcctgaag

SEQ ID NO: 3457875 - DNA, 19 bp, Homo sapiens
aggcctcttttcctgaaga

SEQ ID NO: 3457876 - DNA, 18 bp, Homo sapiens
aggcctgaaaggagccct

SEQ ID NO: 3457877 - DNA, 23 bp, Homo sapiens
aggcctgaatcatgagcctgctg

SEQ ID NO: 3457878 - DNA, 16 bp, Homo sapiens
aggcctgagatttcat

SEQ ID NO: 3457879 - DNA, 19 bp, Homo sapiens
aggcctgagatttcatctg

SEQ ID NO: 3457880 - DNA, 22 bp, Homo sapiens
aggcctgagatttcatctgctc

SEQ ID NO: 3457881 - DNA, 14 bp, Homo sapiens
aggcctgagcgctc

SEQ ID NO: 3457882 - DNA, 13 bp, Homo sapiens
aggcctgagctgc

SEQ ID NO: 3457883 - DNA, 16 bp, Homo sapiens
aggcctgagctgcttc

SEQ ID NO: 3457884 - DNA, 24 bp, Homo sapiens
aggcctgagctgcttcactaggga

SEQ ID NO: 3457885 - DNA, 19 bp, Homo sapiens
aggcctgcctccagggctg

SEQ ID NO: 3457886 - DNA, 13 bp, Homo sapiens
aggcctgtctgtg

SEQ ID NO: 3457887 - DNA, 22 bp, Homo sapiens
aggcctgtctgtgacctgcatc

SEQ ID NO: 3457888 - DNA, 15 bp, Homo sapiens
aggccttcagacaca

SEQ ID NO: 3457889 - DNA, 16 bp, Homo sapiens
aggccttcagacacat

SEQ ID NO: 3457890 - DNA, 14 bp, Homo sapiens
aggccttcagttta

SEQ ID NO: 3457891 - DNA, 20 bp, Homo sapiens
aggccttcagtttatttcca

SEQ ID NO: 3457892 - DNA, 19 bp, Homo sapiens
aggccttcctctctccaga

SEQ ID NO: 3457893 - DNA, 18 bp, Homo sapiens
aggccttgcctggcctga

SEQ ID NO: 3457894 - DNA, 19 bp, Homo sapiens
aggcgatcacaacgtgcat

SEQ ID NO: 3457895 - DNA, 23 bp, Homo sapiens
aggcgatccacctgtctcagcct

SEQ ID NO: 3457896 - DNA, 14 bp, Homo sapiens
aggcggtgggcacc

SEQ ID NO: 3457897 - DNA, 17 bp, Homo sapiens
aggcgtggagctgcctg

SEQ ID NO: 3457898 - DNA, 18 bp, Homo sapiens
aggcgtggagctgcctga

SEQ ID NO: 3457899 - DNA, 15 bp, Homo sapiens
aggcgttgctttcac

SEQ ID NO: 3457900 - DNA, 13 bp, Homo sapiens
aggctacactgac

SEQ ID NO: 3457901 - DNA, 21 bp, Homo sapiens
aggctattgtcccctaaacca

SEQ ID NO: 3457902 - DNA, 19 bp, Homo sapiens
aggctcacccccttctcca

SEQ ID NO: 3457903 - DNA, 13 bp, Homo sapiens
aggctcatggccc

SEQ ID NO: 3457904 - DNA, 15 bp, Homo sapiens
aggctcatggccctg

SEQ ID NO: 3457905 - DNA, 13 bp, Homo sapiens
aggctccagaggg

SEQ ID NO: 3457906 - DNA, 14 bp, Homo sapiens
aggctccagagggc

SEQ ID NO: 3457907 - DNA, 11 bp, Homo sapiens
aggctcctctt

SEQ ID NO: 3457908 - DNA, 17 bp, Homo sapiens
aggctcgattttgtatc

SEQ ID NO: 3457909 - DNA, 22 bp, Homo sapiens
aggctcgattttgtatctgcag

SEQ ID NO: 3457910 - DNA, 14 bp, Homo sapiens
aggctcgccaaggc

SEQ ID NO: 3457911 - DNA, 15 bp, Homo sapiens
aggctcgccaaggcc

SEQ ID NO: 3457912 - DNA, 17 bp, Homo sapiens
aggctcttctccccaga

SEQ ID NO: 3457913 - DNA, 18 bp, Homo sapiens
aggctcttctccccagag

SEQ ID NO: 3457914 - DNA, 21 bp, Homo sapiens
aggctcttctccttggaggac

SEQ ID NO: 3457915 - DNA, 23 bp, Homo sapiens
aggctcttctccttggaggacag

SEQ ID NO: 3457916 - DNA, 15 bp, Homo sapiens
aggctcttctttccc

SEQ ID NO: 3457917 - DNA, 15 bp, Homo sapiens
aggctgaaaagaagg

SEQ ID NO: 3457918 - DNA, 14 bp, Homo sapiens
aggctgaccacagc

SEQ ID NO: 3457919 - DNA, 16 bp, Homo sapiens
aggctgaccacagcac

SEQ ID NO: 3457920 - DNA, 17 bp, Homo sapiens
aggctgaccacagcaca

SEQ ID NO: 3457921 - DNA, 18 bp, Homo sapiens
aggctgaccacagcacag

SEQ ID NO: 3457922 - DNA, 20 bp, Homo sapiens
aggctgactggatgtccaga

SEQ ID NO: 3457923 - DNA, 16 bp, Homo sapiens
aggctgagaacactgt

SEQ ID NO: 3457924 - DNA, 19 bp, Homo sapiens
aggctgagaacactgtgaa

SEQ ID NO: 3457925 - DNA, 19 bp, Homo sapiens
aggctgagcacctttggaa

SEQ ID NO: 3457926 - DNA, 22 bp, Homo sapiens
aggctgaggaaaggccagctgg

SEQ ID NO: 3457927 - DNA, 16 bp, Homo sapiens
aggctgaggctggcac

SEQ ID NO: 3457928 - DNA, 22 bp, Homo sapiens
aggctgcaggacttctgcctga

SEQ ID NO: 3457929 - DNA, 14 bp, Homo sapiens
aggctgcttagaat

SEQ ID NO: 3457930 - DNA, 13 bp, Homo sapiens
aggctggagccca

SEQ ID NO: 3457931 - DNA, 20 bp, Homo sapiens
aggctggagtggagtggcgt

SEQ ID NO: 3457932 - DNA, 14 bp, Homo sapiens
aggctggcacagga

SEQ ID NO: 3457933 - DNA, 17 bp, Homo sapiens
aggctggccagtccagg

SEQ ID NO: 3457934 - DNA, 17 bp, Homo sapiens
aggctggcgagagtctg

SEQ ID NO: 3457935 - DNA, 22 bp, Homo sapiens
aggctggcgagagtctggccct

SEQ ID NO: 3457936 - DNA, 20 bp, Homo sapiens
aggctggcgtgcagtggtgc

SEQ ID NO: 3457937 - DNA, 14 bp, Homo sapiens
aggctggcttgtcc

SEQ ID NO: 3457938 - DNA, 19 bp, Homo sapiens
aggctgggaggagcccctg

SEQ ID NO: 3457939 - DNA, 22 bp, Homo sapiens
aggctgggcagcacaaggcctt

SEQ ID NO: 3457940 - DNA, 20 bp, Homo sapiens
aggctgggcttcagtggcag

SEQ ID NO: 3457941 - DNA, 23 bp, Homo sapiens
aggctgggcttcagtggcagctg

SEQ ID NO: 3457942 - DNA, 16 bp, Homo sapiens
aggctggggaagtcct

SEQ ID NO: 3457943 - DNA, 18 bp, Homo sapiens
aggctggggaagtcctct

SEQ ID NO: 3457944 - DNA, 22 bp, Homo sapiens
aggctgggggaagaagctctct

SEQ ID NO: 3457945 - DNA, 22 bp, Homo sapiens
aggctggggtttttgttttgtt

SEQ ID NO: 3457946 - DNA, 11 bp, Homo sapiens
aggctggtctt

SEQ ID NO: 3457947 - DNA, 17 bp, Homo sapiens
aggctggtggcccagga

SEQ ID NO: 3457948 - DNA, 22 bp, Homo sapiens
aggctgtatcccatgagcctca

SEQ ID NO: 3457949 - DNA, 17 bp, Homo sapiens
aggctgtgactcttctc

SEQ ID NO: 3457950 - DNA, 22 bp, Homo sapiens
aggctgtgactcttctctcaac

SEQ ID NO: 3457951 - DNA, 21 bp, Homo sapiens
aggctgtgtttggctttcagg

SEQ ID NO: 3457952 - DNA, 15 bp, Homo sapiens
aggcttagctttgct

SEQ ID NO: 3457953 - DNA, 17 bp, Homo sapiens
aggcttgcctgcaggca

SEQ ID NO: 3457954 - DNA, 16 bp, Homo sapiens
aggcttgttgtgcttt

SEQ ID NO: 3457955 - DNA, 19 bp, Homo sapiens
aggctttgattagttttct

SEQ ID NO: 3457956 - DNA, 18 bp, Homo sapiens
agggaaaaaaaacaggag

SEQ ID NO: 3457957 - DNA, 23 bp, Homo sapiens
agggaaagaaagttgcacggctg

SEQ ID NO: 3457958 - DNA, 13 bp, Homo sapiens
agggaaatttcag

SEQ ID NO: 3457959 - DNA, 23 bp, Homo sapiens
agggaacccagctctaatacatt

SEQ ID NO: 3457960 - DNA, 16 bp, Homo sapiens
agggaagggcctgcca

SEQ ID NO: 3457961 - DNA, 12 bp, Homo sapiens
agggaagggtgg

SEQ ID NO: 3457962 - DNA, 16 bp, Homo sapiens
agggaagtaacagtaa

SEQ ID NO: 3457963 - DNA, 15 bp, Homo sapiens
agggaagtccccagg

SEQ ID NO: 3457964 - DNA, 15 bp, Homo sapiens
agggaatcacatctt

SEQ ID NO: 3457965 - DNA, 15 bp, Homo sapiens
agggaatcctgcggc

SEQ ID NO: 3457966 - DNA, 21 bp, Homo sapiens
agggaatcctgcggcaggact

SEQ ID NO: 3457967 - DNA, 13 bp, Homo sapiens
agggaatgcctga

SEQ ID NO: 3457968 - DNA, 21 bp, Homo sapiens
agggaatgcctgagtgcctgg

SEQ ID NO: 3457969 - DNA, 19 bp, Homo sapiens
agggacaagtggactcagg

SEQ ID NO: 3457970 - DNA, 22 bp, Homo sapiens
agggacaagtggactcagggca

SEQ ID NO: 3457971 - DNA, 17 bp, Homo sapiens
agggacagaggccccag

SEQ ID NO: 3457972 - DNA, 20 bp, Homo sapiens
agtgacagagacccagatct

SEQ ID NO: 3457973 - DNA, 20 bp, Homo sapiens
agtgacagtggattgcattt

SEQ ID NO: 3457974 - DNA, 17 bp, Homo sapiens
agtgactaatggcatga

SEQ ID NO: 3457975 - DNA, 14 bp, Homo sapiens
agtgactctccagg

SEQ ID NO: 3457976 - DNA, 13 bp, Homo sapiens
agtgagactctgt

SEQ ID NO: 3457977 - DNA, 17 bp, Homo sapiens
agtgagactctgtctca

SEQ ID NO: 3457978 - DNA, 22 bp, Homo sapiens
agtgagcggtgctgtcctcagg

SEQ ID NO: 3457979 - DNA, 23 bp, Homo sapiens
agtgagcggtgctgtcctcaggt

SEQ ID NO: 3457980 - DNA, 15 bp, Homo sapiens
agtgagtcgaggaca

SEQ ID NO: 3457981 - DNA, 14 bp, Homo sapiens
agtgatcacagcag

SEQ ID NO: 3457982 - DNA, 16 bp, Homo sapiens
agtgatcacagcagct

SEQ ID NO: 3457983 - DNA, 14 bp, Homo sapiens
agtgatcctcccac

SEQ ID NO: 3457984 - DNA, 15 bp, Homo sapiens
agtgatcctcccacc

SEQ ID NO: 3457985 - DNA, 18 bp, Homo sapiens
agtgatcctcccacctca

SEQ ID NO: 3457986 - DNA, 22 bp, Homo sapiens
agtgatcctcccacctcagcct

SEQ ID NO: 3457987 - DNA, 23 bp, Homo sapiens
agtgatcctcccacctcagcctc

SEQ ID NO: 3457988 - DNA, 15 bp, Homo sapiens
agtgattctcctgcc

SEQ ID NO: 3457989 - DNA, 17 bp, Homo sapiens
agtgattctcctgcctc

SEQ ID NO: 3457990 - DNA, 20 bp, Homo sapiens
agtgattttcaagtctgtgt

SEQ ID NO: 3457991 - DNA, 14 bp, Homo sapiens
agtgcaacctctgc

SEQ ID NO: 3457992 - DNA, 15 bp, Homo sapiens
agtgcaagcccctgc

SEQ ID NO: 3457993 - DNA, 18 bp, Homo sapiens
agtgcaagcccctgctcc

SEQ ID NO: 3457994 - DNA, 20 bp, Homo sapiens
agtgcaataaatctgaccca

SEQ ID NO: 3457995 - DNA, 22 bp, Homo sapiens
agtgcaatggtataaatttcaa

SEQ ID NO: 3457996 - DNA, 14 bp, Homo sapiens
agtgcagcatatac

SEQ ID NO: 3457997 - DNA, 18 bp, Homo sapiens
agtgcagcatatacaata

SEQ ID NO: 3457998 - DNA, 21 bp, Homo sapiens
agtgcagcatatacaataatg

SEQ ID NO: 3457999 - DNA, 13 bp, Homo sapiens
agtgcagccaagt

SEQ ID NO: 3458000 - DNA, 22 bp, Homo sapiens
agtgcagccaagtagcctctcc

SEQ ID NO: 3458001 - DNA, 18 bp, Homo sapiens
agtgcagccgtttgagaa

SEQ ID NO: 3458002 - DNA, 14 bp, Homo sapiens
agtgcatctacttg

SEQ ID NO: 3458003 - DNA, 15 bp, Homo sapiens
agtgcattgtttctg

SEQ ID NO: 3458004 - DNA, 17 bp, Homo sapiens
agtgcattgtttctgtg

SEQ ID NO: 3458005 - DNA, 20 bp, Homo sapiens
agtgcattgtttctgtgggc

SEQ ID NO: 3458006 - DNA, 23 bp, Homo sapiens
agtgcatttacaaggttaaagat

SEQ ID NO: 3458007 - DNA, 20 bp, Homo sapiens
agtgccaagacacagcaggg

SEQ ID NO: 3458008 - DNA, 18 bp, Homo sapiens
agtgcccccactgaccag

SEQ ID NO: 3458009 - DNA, 17 bp, Homo sapiens
agtgccgcaaattgtac

SEQ ID NO: 3458010 - DNA, 20 bp, Homo sapiens
agtgccttatgctatgagac

SEQ ID NO: 3458011 - DNA, 14 bp, Homo sapiens
agtgcgtgctcagt

SEQ ID NO: 3458012 - DNA, 18 bp, Homo sapiens
agtgctaagtgtgaactg

SEQ ID NO: 3458013 - DNA, 19 bp, Homo sapiens
agtgctaagtgtgaactgg

SEQ ID NO: 3458014 - DNA, 22 bp, Homo sapiens
agtgctcgagtcacattctgct

SEQ ID NO: 3458015 - DNA, 14 bp, Homo sapiens
agtgctcgctgttg

SEQ ID NO: 3458016 - DNA, 17 bp, Homo sapiens
agtgctcgctgttgctg

SEQ ID NO: 3458017 - DNA, 11 bp, Homo sapiens
agtgctctgat

SEQ ID NO: 3458018 - DNA, 16 bp, Homo sapiens
agtgctctgatccctc

SEQ ID NO: 3458019 - DNA, 17 bp, Homo sapiens
agtgctctgatccctct

SEQ ID NO: 3458020 - DNA, 21 bp, Homo sapiens
agtgctgcagctccctggctt

SEQ ID NO: 3458021 - DNA, 23 bp, Homo sapiens
agtgctgcagctccctggcttct

SEQ ID NO: 3458022 - DNA, 15 bp, Homo sapiens
agtgctggagaaatc

SEQ ID NO: 3458023 - DNA, 12 bp, Homo sapiens
agtgctgtataa

SEQ ID NO: 3458024 - DNA, 19 bp, Homo sapiens
agtgctgtataaaatcagc

SEQ ID NO: 3458025 - DNA, 17 bp, Homo sapiens
agtgctgtgctgtgcta

SEQ ID NO: 3458026 - DNA, 15 bp, Homo sapiens
agtgcttgccacaga

SEQ ID NO: 3458027 - DNA, 16 bp, Homo sapiens
agtgcttgccacagag

SEQ ID NO: 3458028 - DNA, 22 bp, Homo sapiens
agtgctttccttttttaaaaat

SEQ ID NO: 3458029 - DNA, 11 bp, Homo sapiens
agtggaaaaag

SEQ ID NO: 3458030 - DNA, 19 bp, Homo sapiens
agtggaaggcattgtcctg

SEQ ID NO: 3458031 - DNA, 14 bp, Homo sapiens
agtggacaacaggt

SEQ ID NO: 3458032 - DNA, 15 bp, Homo sapiens
agtggacagtctgct

SEQ ID NO: 3458033 - DNA, 17 bp, Homo sapiens
agtggaccttaggcctt

SEQ ID NO: 3458034 - DNA, 19 bp, Homo sapiens
agtggaggcgggcttggaa

SEQ ID NO: 3458035 - DNA, 23 bp, Homo sapiens
agtggaggtgggctgggccctct

SEQ ID NO: 3458036 - DNA, 23 bp, Homo sapiens
agtggaggttaaggctgaggaaa

SEQ ID NO: 3458037 - DNA, 13 bp, Homo sapiens
agtggatgatgtt

SEQ ID NO: 3458038 - DNA, 12 bp, Homo sapiens
agtggcagctgc

SEQ ID NO: 3458039 - DNA, 14 bp, Homo sapiens
agtggccactaagc

SEQ ID NO: 3458040 - DNA, 14 bp, Homo sapiens
agtggcctctttgt

SEQ ID NO: 3458041 - DNA, 14 bp, Homo sapiens
agtggctgctgccc

SEQ ID NO: 3458042 - DNA, 19 bp, Homo sapiens
agtggctgctgcccaggcc

SEQ ID NO: 3458043 - DNA, 22 bp, Homo sapiens
agtggctgctgcccaggcccag

SEQ ID NO: 3458044 - DNA, 23 bp, Homo sapiens
agtggcttaaaacaacactcaca

SEQ ID NO: 3458045 - DNA, 15 bp, Homo sapiens
agtgggatgaaccag

SEQ ID NO: 3458046 - DNA, 15 bp, Homo sapiens
agtggggtttcctgg

SEQ ID NO: 3458047 - DNA, 21 bp, Homo sapiens
agtggggtttcgcagcctgag

SEQ ID NO: 3458048 - DNA, 15 bp, Homo sapiens
agtgggtaaaattag

SEQ ID NO: 3458049 - DNA, 19 bp, Homo sapiens
agtgggtgaataatacagt

SEQ ID NO: 3458050 - DNA, 21 bp, Homo sapiens
agtgggtttcacaagtgaaaa

SEQ ID NO: 3458051 - DNA, 17 bp, Homo sapiens
agtggtccacatcccgg

SEQ ID NO: 3458052 - DNA, 23 bp, Homo sapiens
agtggtgccatcattgctgtctg

SEQ ID NO: 3458053 - DNA, 18 bp, Homo sapiens
agtggtggtaaccctggt

SEQ ID NO: 3458054 - DNA, 21 bp, Homo sapiens
agtggttttaggatacttaac

SEQ ID NO: 3458055 - DNA, 15 bp, Homo sapiens
agtgtacctcctctc

SEQ ID NO: 3458056 - DNA, 22 bp, Homo sapiens
agtgtaggcagacacagggact

SEQ ID NO: 3458057 - DNA, 20 bp, Homo sapiens
agtgtagttaaggagcctaa

SEQ ID NO: 3458058 - DNA, 16 bp, Homo sapiens
agtgtatttttcaata

SEQ ID NO: 3458059 - DNA, 22 bp, Homo sapiens
agtgtcctcttccctctctgca

SEQ ID NO: 3458060 - DNA, 14 bp, Homo sapiens
agtgtccttagaac

SEQ ID NO: 3458061 - DNA, 18 bp, Homo sapiens
agtgtgaggccagggcag

SEQ ID NO: 3458062 - DNA, 19 bp, Homo sapiens
agtgtgcacccctccccat

SEQ ID NO: 3458063 - DNA, 18 bp, Homo sapiens
agtgtgctttatgctgaa

SEQ ID NO: 3458064 - DNA, 19 bp, Homo sapiens
agtgtgggacaggctcttc

SEQ ID NO: 3458065 - DNA, 11 bp, Homo sapiens
agtgtgtatta

SEQ ID NO: 3458066 - DNA, 15 bp, Homo sapiens
agtgttacctgtgtg

SEQ ID NO: 3458067 - DNA, 15 bp, Homo sapiens
agtgttagggaaggg

SEQ ID NO: 3458068 - DNA, 19 bp, Homo sapiens
agtgttagggaagggcctg

SEQ ID NO: 3458069 - DNA, 15 bp, Homo sapiens
agtgttcacaacctg

SEQ ID NO: 3458070 - DNA, 13 bp, Homo sapiens
agtgtttctatga

SEQ ID NO: 3458071 - DNA, 20 bp, Homo sapiens
agtgtttctatgagtggaaa

SEQ ID NO: 3458072 - DNA, 22 bp, Homo sapiens
agtgtttgttggatccgtttga

SEQ ID NO: 3458073 - DNA, 20 bp, Homo sapiens
agtgttttaagataaattat

SEQ ID NO: 3458074 - DNA, 21 bp, Homo sapiens
agtgttttatgagaaagcctt

SEQ ID NO: 3458075 - DNA, 11 bp, Homo sapiens
agtgttttctt

SEQ ID NO: 3458076 - DNA, 14 bp, Homo sapiens
agtgttttggactc

SEQ ID NO: 3458077 - DNA, 15 bp, Homo sapiens
agtgttttggactcc

SEQ ID NO: 3458078 - DNA, 18 bp, Homo sapiens
agtgttttggactccatc

SEQ ID NO: 3458079 - DNA, 19 bp, Homo sapiens
agtgttttggactccatct

SEQ ID NO: 3458080 - DNA, 20 bp, Homo sapiens
agtgttttggactccatctc

SEQ ID NO: 3458081 - DNA, 19 bp, Homo sapiens
agttaagacatgatttcct

SEQ ID NO: 3458082 - DNA, 17 bp, Homo sapiens
agttaagacctggcagc

SEQ ID NO: 3458083 - DNA, 16 bp, Homo sapiens
agttaatgcttaagag

SEQ ID NO: 3458084 - DNA, 20 bp, Homo sapiens
agttacacagaaatgctgct

SEQ ID NO: 3458085 - DNA, 16 bp, Homo sapiens
agttactaggtaactt

SEQ ID NO: 3458086 - DNA, 18 bp, Homo sapiens
agttactaggtaacttca

SEQ ID NO: 3458087 - DNA, 17 bp, Homo sapiens
agttactccagtgccaa

SEQ ID NO: 3458088 - DNA, 22 bp, Homo sapiens
agttagattattgaaatattat

SEQ ID NO: 3458089 - DNA, 18 bp, Homo sapiens
agttaggctattcacaac

SEQ ID NO: 3458090 - DNA, 16 bp, Homo sapiens
agttagttaagttggg

SEQ ID NO: 3458091 - DNA, 14 bp, Homo sapiens
agttatctaagaat

SEQ ID NO: 3458092 - DNA, 21 bp, Homo sapiens
agttatctaagaatacagctt

SEQ ID NO: 3458093 - DNA, 18 bp, Homo sapiens
agttatggcctatacact

SEQ ID NO: 3458094 - DNA, 21 bp, Homo sapiens
agttatggcctatacactatt

SEQ ID NO: 3458095 - DNA, 18 bp, Homo sapiens
agttattaagttctttaa

SEQ ID NO: 3458096 - DNA, 20 bp, Homo sapiens
agttattatatttacaaatg

SEQ ID NO: 3458097 - DNA, 12 bp, Homo sapiens
agttattggtgg

SEQ ID NO: 3458098 - DNA, 14 bp, Homo sapiens
agttattttccagg

SEQ ID NO: 3458099 - DNA, 17 bp, Homo sapiens
agttatttttgtacatg

SEQ ID NO: 3458100 - DNA, 18 bp, Homo sapiens
agttatttttgtacatgt

SEQ ID NO: 3458101 - DNA, 23 bp, Homo sapiens
agttcaaggaacttgaaaaatac

SEQ ID NO: 3458102 - DNA, 15 bp, Homo sapiens
agttcacagtgtttc

SEQ ID NO: 3458103 - DNA, 15 bp, Homo sapiens
agttcagaaatttaa

SEQ ID NO: 3458104 - DNA, 14 bp, Homo sapiens
atatttaaaaatgt

SEQ ID NO: 3458105 - DNA, 21 bp, Homo sapiens
atatttaatggcactgagaaa

SEQ ID NO: 3458106 - DNA, 15 bp, Homo sapiens
atatttaatgtttta

SEQ ID NO: 3458107 - DNA, 19 bp, Homo sapiens
atatttataggtacccaat

SEQ ID NO: 3458108 - DNA, 15 bp, Homo sapiens
atatttatccaaaat

SEQ ID NO: 3458109 - DNA, 20 bp, Homo sapiens
atatttatccaaaatgtgta

SEQ ID NO: 3458110 - DNA, 18 bp, Homo sapiens
atatttcagatgtaatgt

SEQ ID NO: 3458111 - DNA, 20 bp, Homo sapiens
atatttcagatgtaatgttt

SEQ ID NO: 3458112 - DNA, 21 bp, Homo sapiens
atatttccctcccctggggac

SEQ ID NO: 3458113 - DNA, 15 bp, Homo sapiens
atatttcgaaagctg

SEQ ID NO: 3458114 - DNA, 14 bp, Homo sapiens
atatttctattgaa

SEQ ID NO: 3458115 - DNA, 11 bp, Homo sapiens
atatttgaatc

SEQ ID NO: 3458116 - DNA, 18 bp, Homo sapiens
atatttgaatcttgtctc

SEQ ID NO: 3458117 - DNA, 13 bp, Homo sapiens
atatttgtaggag

SEQ ID NO: 3458118 - DNA, 23 bp, Homo sapiens
atatttgtcaatttatgaatata

SEQ ID NO: 3458119 - DNA, 14 bp, Homo sapiens
atattttacataca

SEQ ID NO: 3458120 - DNA, 20 bp, Homo sapiens
atattttcaactatgtaggt

SEQ ID NO: 3458121 - DNA, 15 bp, Homo sapiens
atattttccatatat

SEQ ID NO: 3458122 - DNA, 20 bp, Homo sapiens
atattttccatatattggca

SEQ ID NO: 3458123 - DNA, 13 bp, Homo sapiens
atattttctattt

SEQ ID NO: 3458124 - DNA, 14 bp, Homo sapiens
atatttttatagac

SEQ ID NO: 3458125 - DNA, 16 bp, Homo sapiens
atatttttttttggat

SEQ ID NO: 3458126 - DNA, 22 bp, Homo sapiens
atatttttttttggatgaaggt

SEQ ID NO: 3458127 - DNA, 22 bp, Homo sapiens
atcaaacccggcggtcccctcc

SEQ ID NO: 3458128 - DNA, 20 bp, Homo sapiens
atcaaagaggttttaaaaaa

SEQ ID NO: 3458129 - DNA, 17 bp, Homo sapiens
atcaaataaagagagaa

SEQ ID NO: 3458130 - DNA, 19 bp, Homo sapiens
atcaaatgcagtatatttc

SEQ ID NO: 3458131 - DNA, 17 bp, Homo sapiens
atcaaatggaagacaca

SEQ ID NO: 3458132 - DNA, 17 bp, Homo sapiens
atcaacaataaaatttt

SEQ ID NO: 3458133 - DNA, 22 bp, Homo sapiens
atcaacaataaaatttttttaa

SEQ ID NO: 3458134 - DNA, 14 bp, Homo sapiens
atcaactcaagaat

SEQ ID NO: 3458135 - DNA, 13 bp, Homo sapiens
atcaactttttat

SEQ ID NO: 3458136 - DNA, 19 bp, Homo sapiens
atcaactttttattgcctt

SEQ ID NO: 3458137 - DNA, 21 bp, Homo sapiens
atcaactttttattgccttct

SEQ ID NO: 3458138 - DNA, 14 bp, Homo sapiens
atcaagcagccaag

SEQ ID NO: 3458139 - DNA, 16 bp, Homo sapiens
atcaaggagcccagaa

SEQ ID NO: 3458140 - DNA, 14 bp, Homo sapiens
atcaaggcactgcc

SEQ ID NO: 3458141 - DNA, 15 bp, Homo sapiens
atcaaggcactgcct

SEQ ID NO: 3458142 - DNA, 19 bp, Homo sapiens
atcaagggtgcgtctggga

SEQ ID NO: 3458143 - DNA, 20 bp, Homo sapiens
atcaagtatttgggaagtga

SEQ ID NO: 3458144 - DNA, 15 bp, Homo sapiens
atcaagtctgtttac

SEQ ID NO: 3458145 - DNA, 13 bp, Homo sapiens
atcaagttttaag

SEQ ID NO: 3458146 - DNA, 17 bp, Homo sapiens
atcaagttttaagtgaa

SEQ ID NO: 3458147 - DNA, 21 bp, Homo sapiens
atcaataaaaaacaaatatat

SEQ ID NO: 3458148 - DNA, 13 bp, Homo sapiens
atcaatcaaaccc

SEQ ID NO: 3458149 - DNA, 20 bp, Homo sapiens
atcaattaactgagtagctc

SEQ ID NO: 3458150 - DNA, 17 bp, Homo sapiens
atcacaacgtgcattgt

SEQ ID NO: 3458151 - DNA, 18 bp, Homo sapiens
atcacaacgtgcattgtg

SEQ ID NO: 3458152 - DNA, 14 bp, Homo sapiens
atcacacctgccct

SEQ ID NO: 3458153 - DNA, 20 bp, Homo sapiens
atcaccgtgggctccctgac

SEQ ID NO: 3458154 - DNA, 22 bp, Homo sapiens
atcacctatttccattcaacaa

SEQ ID NO: 3458155 - DNA, 18 bp, Homo sapiens
atcacctcattctgaacc

SEQ ID NO: 3458156 - DNA, 18 bp, Homo sapiens
atcaccttaggcagggaa

SEQ ID NO: 3458157 - DNA, 20 bp, Homo sapiens
atcaccttaggcagggaagt

SEQ ID NO: 3458158 - DNA, 15 bp, Homo sapiens
atcacgatgtaaatt

SEQ ID NO: 3458159 - DNA, 19 bp, Homo sapiens
atcacgatgtaaattatta

SEQ ID NO: 3458160 - DNA, 14 bp, Homo sapiens
atcacgccactgca

SEQ ID NO: 3458161 - DNA, 18 bp, Homo sapiens
atcacggctcactgcagc

SEQ ID NO: 3458162 - DNA, 17 bp, Homo sapiens
atcacgttagaggaaaa

SEQ ID NO: 3458163 - DNA, 22 bp, Homo sapiens
atcacgttagaggaaaaatatt

SEQ ID NO: 3458164 - DNA, 21 bp, Homo sapiens
atcactggggtcacttgggaa

SEQ ID NO: 3458165 - DNA, 22 bp, Homo sapiens
atcactggttgcacttatgatt

SEQ ID NO: 3458166 - DNA, 16 bp, Homo sapiens
atcactgtctttccta

SEQ ID NO: 3458167 - DNA, 14 bp, Homo sapiens
atcactgtggctgt

SEQ ID NO: 3458168 - DNA, 16 bp, Homo sapiens
atcactgtggctgtct

SEQ ID NO: 3458169 - DNA, 23 bp, Homo sapiens
atcagaaatacagattttgatag

SEQ ID NO: 3458170 - DNA, 13 bp, Homo sapiens
atcagagaccagg

SEQ ID NO: 3458171 - DNA, 16 bp, Homo sapiens
atcagattgcatgtga

SEQ ID NO: 3458172 - DNA, 14 bp, Homo sapiens
atcagcaccccagt

SEQ ID NO: 3458173 - DNA, 14 bp, Homo sapiens
atcagccaattatg

SEQ ID NO: 3458174 - DNA, 15 bp, Homo sapiens
atcagccaattatgt

SEQ ID NO: 3458175 - DNA, 18 bp, Homo sapiens
atcagccaattatgttaa

SEQ ID NO: 3458176 - DNA, 15 bp, Homo sapiens
atcagccacattcta

SEQ ID NO: 3458177 - DNA, 18 bp, Homo sapiens
atcagcctgctccagctg

SEQ ID NO: 3458178 - DNA, 22 bp, Homo sapiens
atcagctggtcaaacaaactct

SEQ ID NO: 3458179 - DNA, 18 bp, Homo sapiens
atcaggacccagaggaag

SEQ ID NO: 3458180 - DNA, 22 bp, Homo sapiens
atcaggagaaaaagcctccagt

SEQ ID NO: 3458181 - DNA, 23 bp, Homo sapiens
atcagggcattgcctgtgactga

SEQ ID NO: 3458182 - DNA, 15 bp, Homo sapiens
atcaggtgctgccat

SEQ ID NO: 3458183 - DNA, 16 bp, Homo sapiens
atcagtataaacaaag

SEQ ID NO: 3458184 - DNA, 21 bp, Homo sapiens
atcagtcagtgctggagaaat

SEQ ID NO: 3458185 - DNA, 19 bp, Homo sapiens
atcagtctgattcccaagc

SEQ ID NO: 3458186 - DNA, 19 bp, Homo sapiens
atcagtggttatttaggga

SEQ ID NO: 3458187 - DNA, 19 bp, Homo sapiens
atcagtgtaccatttgcct

SEQ ID NO: 3458188 - DNA, 23 bp, Homo sapiens
atcagtgtttgttggatccgttt

SEQ ID NO: 3458189 - DNA, 22 bp, Homo sapiens
atcagttacccactcggtccca

SEQ ID NO: 3458190 - DNA, 23 bp, Homo sapiens
atcagttacccactcggtcccag

SEQ ID NO: 3458191 - DNA, 15 bp, Homo sapiens
atcagttagagctga

SEQ ID NO: 3458192 - DNA, 13 bp, Homo sapiens
atcataattacca

SEQ ID NO: 3458193 - DNA, 18 bp, Homo sapiens
atcatcagtggagccatg

SEQ ID NO: 3458194 - DNA, 15 bp, Homo sapiens
atcatcatagaaaaa

SEQ ID NO: 3458195 - DNA, 18 bp, Homo sapiens
atcatcatgtgtgtccac

SEQ ID NO: 3458196 - DNA, 13 bp, Homo sapiens
atcatcgccagag

SEQ ID NO: 3458197 - DNA, 23 bp, Homo sapiens
atcatctcctgccttcctcctgg

SEQ ID NO: 3458198 - DNA, 19 bp, Homo sapiens
atcatgaatttattgcaca

SEQ ID NO: 3458199 - DNA, 15 bp, Homo sapiens
atcatgagcctgctg

SEQ ID NO: 3458200 - DNA, 19 bp, Homo sapiens
atcatgcaaatgctgtatt

SEQ ID NO: 3458201 - DNA, 15 bp, Homo sapiens
atcatggcctcttga

SEQ ID NO: 3458202 - DNA, 16 bp, Homo sapiens
atcatggcctcttgaa

SEQ ID NO: 3458203 - DNA, 22 bp, Homo sapiens
atcatggcctcttgaagagaaa

SEQ ID NO: 3458204 - DNA, 23 bp, Homo sapiens
atcatggcctcttgaagagaaaa

SEQ ID NO: 3458205 - DNA, 15 bp, Homo sapiens
atcatggtgaaaagc

SEQ ID NO: 3458206 - DNA, 23 bp, Homo sapiens
atcatgttctggtggtttgattg

SEQ ID NO: 3458207 - DNA, 14 bp, Homo sapiens
atcattctctgtct

SEQ ID NO: 3458208 - DNA, 16 bp, Homo sapiens
atcattgctcccctga

SEQ ID NO: 3458209 - DNA, 23 bp, Homo sapiens
atcattgctcccctgatagaaga

SEQ ID NO: 3458210 - DNA, 14 bp, Homo sapiens
atcattgctgtctg

SEQ ID NO: 3458211 - DNA, 14 bp, Homo sapiens
atcatttaataata

SEQ ID NO: 3458212 - DNA, 18 bp, Homo sapiens
atcatttaataatatact

SEQ ID NO: 3458213 - DNA, 19 bp, Homo sapiens
atcatttattttttacatt

SEQ ID NO: 3458214 - DNA, 18 bp, Homo sapiens
atcattttatatgtcaaa

SEQ ID NO: 3458215 - DNA, 14 bp, Homo sapiens
atccaaaatgtgta

SEQ ID NO: 3458216 - DNA, 23 bp, Homo sapiens
atccaaaatgtgtatttcttata

SEQ ID NO: 3458217 - DNA, 15 bp, Homo sapiens
atccaaagcagacag

SEQ ID NO: 3458218 - DNA, 19 bp, Homo sapiens
atccaagatattttaaaat

SEQ ID NO: 3458219 - DNA, 18 bp, Homo sapiens
atccaagctggtcccact

SEQ ID NO: 3458220 - DNA, 24 bp, Homo sapiens
atccaatattttctttaatgcttt

SEQ ID NO: 3458221 - DNA, 20 bp, Homo sapiens
atccacccacctcagcctcc

SEQ ID NO: 3458222 - DNA, 21 bp, Homo sapiens
atccacgtattccccttccca

SEQ ID NO: 3458223 - DNA, 22 bp, Homo sapiens
atccacgtattccccttcccac

SEQ ID NO: 3458224 - DNA, 21 bp, Homo sapiens
atccactagtgcaaatcatag

SEQ ID NO: 3458225 - DNA, 15 bp, Homo sapiens
atccagatggtggga

SEQ ID NO: 3458226 - DNA, 17 bp, Homo sapiens
atccagcctggggtctg

SEQ ID NO: 3458227 - DNA, 15 bp, Homo sapiens
atccagctatgttat

SEQ ID NO: 3458228 - DNA, 22 bp, Homo sapiens
atccagctgggctagaggctga

SEQ ID NO: 3458229 - DNA, 19 bp, Homo sapiens
atccagcttgccagatgct

SEQ ID NO: 3458230 - DNA, 19 bp, Homo sapiens
atccaggcagatccaggac

SEQ ID NO: 3458231 - DNA, 13 bp, Homo sapiens
atccagggacaga

SEQ ID NO: 3458232 - DNA, 16 bp, Homo sapiens
atccagggacagaggc

SEQ ID NO: 3458233 - DNA, 16 bp, Homo sapiens
atccaggttcagcttg

SEQ ID NO: 3458234 - DNA, 23 bp, Homo sapiens
atccagtgtgcacccctccccat

SEQ ID NO: 3458235 - DNA, 19 bp, Homo sapiens
atgctggctgttggctggg

SEQ ID NO: 3458236 - DNA, 15 bp, Homo sapiens
atgctgggactcagc

SEQ ID NO: 3458237 - DNA, 12 bp, Homo sapiens
atgctgtacatc

SEQ ID NO: 3458238 - DNA, 23 bp, Homo sapiens
atgctgtacatctattttggatt

SEQ ID NO: 3458239 - DNA, 19 bp, Homo sapiens
atgctgtattcttctttgg

SEQ ID NO: 3458240 - DNA, 21 bp, Homo sapiens
atgctgtggagtcccaacccc

SEQ ID NO: 3458241 - DNA, 19 bp, Homo sapiens
atgcttcatcattccctct

SEQ ID NO: 3458242 - DNA, 20 bp, Homo sapiens
atgcttctcactgccatgcc

SEQ ID NO: 3458243 - DNA, 14 bp, Homo sapiens
atgcttctttcaaa

SEQ ID NO: 3458244 - DNA, 18 bp, Homo sapiens
atgcttgatgtttggcct

SEQ ID NO: 3458245 - DNA, 17 bp, Homo sapiens
atgctttgaaacagaaa

SEQ ID NO: 3458246 - DNA, 17 bp, Homo sapiens
atgcttttactgaactt

SEQ ID NO: 3458247 - DNA, 22 bp, Homo sapiens
atgctttttattattattattt

SEQ ID NO: 3458248 - DNA, 23 bp, Homo sapiens
atgctttttatttctgcatatgt

SEQ ID NO: 3458249 - DNA, 21 bp, Homo sapiens
atggaaaaacttgtgctataa

SEQ ID NO: 3458250 - DNA, 19 bp, Homo sapiens
atggaaccgcaggaagctg

SEQ ID NO: 3458251 - DNA, 21 bp, Homo sapiens
atggaacctgacgtagctgca

SEQ ID NO: 3458252 - DNA, 16 bp, Homo sapiens
atggaacttagccatt

SEQ ID NO: 3458253 - DNA, 13 bp, Homo sapiens
atggaagacacat

SEQ ID NO: 3458254 - DNA, 19 bp, Homo sapiens
atggaagaggctacagggc

SEQ ID NO: 3458255 - DNA, 16 bp, Homo sapiens
atggaataactctgtg

SEQ ID NO: 3458256 - DNA, 13 bp, Homo sapiens
atggaattgattt

SEQ ID NO: 3458257 - DNA, 16 bp, Homo sapiens
atggaattgatttgca

SEQ ID NO: 3458258 - DNA, 14 bp, Homo sapiens
atggacacttttca

SEQ ID NO: 3458259 - DNA, 16 bp, Homo sapiens
atggacacttttcacc

SEQ ID NO: 3458260 - DNA, 22 bp, Homo sapiens
atggacagagaactttattttg

SEQ ID NO: 3458261 - DNA, 13 bp, Homo sapiens
atggacggtgctc

SEQ ID NO: 3458262 - DNA, 21 bp, Homo sapiens
atggacggtgctccaggcagg

SEQ ID NO: 3458263 - DNA, 17 bp, Homo sapiens
atggactatctgtctgg

SEQ ID NO: 3458264 - DNA, 22 bp, Homo sapiens
atggactatctgtctggtggcc

SEQ ID NO: 3458265 - DNA, 23 bp, Homo sapiens
atggagagctggagcctggtgcc

SEQ ID NO: 3458266 - DNA, 14 bp, Homo sapiens
atggagattaagat

SEQ ID NO: 3458267 - DNA, 17 bp, Homo sapiens
atggagattaagatgcc

SEQ ID NO: 3458268 - DNA, 20 bp, Homo sapiens
atggagattaagatgccttg

SEQ ID NO: 3458269 - DNA, 18 bp, Homo sapiens
atggagcatcaagccact

SEQ ID NO: 3458270 - DNA, 11 bp, Homo sapiens
atggagccagc

SEQ ID NO: 3458271 - DNA, 23 bp, Homo sapiens
atggagccagctccctctattta

SEQ ID NO: 3458272 - DNA, 14 bp, Homo sapiens
atggatcagatctg

SEQ ID NO: 3458273 - DNA, 18 bp, Homo sapiens
atggatcatgtccccctt

SEQ ID NO: 3458274 - DNA, 13 bp, Homo sapiens
atggatgccaata

SEQ ID NO: 3458275 - DNA, 22 bp, Homo sapiens
atggatgccaatattaaatctg

SEQ ID NO: 3458276 - DNA, 19 bp, Homo sapiens
atggattctccactcagtt

SEQ ID NO: 3458277 - DNA, 23 bp, Homo sapiens
atggatttaacagcatgacaaaa

SEQ ID NO: 3458278 - DNA, 15 bp, Homo sapiens
atggatttccagcca

SEQ ID NO: 3458279 - DNA, 18 bp, Homo sapiens
atggcaaaggaaggtgga

SEQ ID NO: 3458280 - DNA, 15 bp, Homo sapiens
atggcaacagatctg

SEQ ID NO: 3458281 - DNA, 22 bp, Homo sapiens
atggcacttgatgtgtagacat

SEQ ID NO: 3458282 - DNA, 21 bp, Homo sapiens
atggcagaaggcaaacccatc

SEQ ID NO: 3458283 - DNA, 15 bp, Homo sapiens
atggcagagttgtaa

SEQ ID NO: 3458284 - DNA, 14 bp, Homo sapiens
atggcagctgccac

SEQ ID NO: 3458285 - DNA, 17 bp, Homo sapiens
atggcaggaaggcttgt

SEQ ID NO: 3458286 - DNA, 17 bp, Homo sapiens
atggcaggatggcctgg

SEQ ID NO: 3458287 - DNA, 19 bp, Homo sapiens
atggcatgagaaatacaaa

SEQ ID NO: 3458288 - DNA, 15 bp, Homo sapiens
atggcctaaatttat

SEQ ID NO: 3458289 - DNA, 18 bp, Homo sapiens
atggcctcatgtggctgg

SEQ ID NO: 3458290 - DNA, 13 bp, Homo sapiens
atggcctcttgaa

SEQ ID NO: 3458291 - DNA, 15 bp, Homo sapiens
atggcctcttgaaga

SEQ ID NO: 3458292 - DNA, 19 bp, Homo sapiens
atggccttcccgccggagg

SEQ ID NO: 3458293 - DNA, 20 bp, Homo sapiens
atggccttcccgccggaggc

SEQ ID NO: 3458294 - DNA, 23 bp, Homo sapiens
atggccttcccgccggaggccag

SEQ ID NO: 3458295 - DNA, 12 bp, Homo sapiens
atggctcctctc

SEQ ID NO: 3458296 - DNA, 13 bp, Homo sapiens
atggctgcctgca

SEQ ID NO: 3458297 - DNA, 17 bp, Homo sapiens
atggcttatccagctgg

SEQ ID NO: 3458298 - DNA, 18 bp, Homo sapiens
atgggaaaactgccaata

SEQ ID NO: 3458299 - DNA, 18 bp, Homo sapiens
atgggaaggggaggaccc

SEQ ID NO: 3458300 - DNA, 23 bp, Homo sapiens
atgggagctgaggccacactcag

SEQ ID NO: 3458301 - DNA, 15 bp, Homo sapiens
atgggatcatgaaag

SEQ ID NO: 3458302 - DNA, 18 bp, Homo sapiens
atgggatggtggagggcc

SEQ ID NO: 3458303 - DNA, 23 bp, Homo sapiens
atgggccactgaaatctgtcaag

SEQ ID NO: 3458304 - DNA, 18 bp, Homo sapiens
atgggcctttgagcctga

SEQ ID NO: 3458305 - DNA, 14 bp, Homo sapiens
atgggctgggggct

SEQ ID NO: 3458306 - DNA, 11 bp, Homo sapiens
atggggaggga

SEQ ID NO: 3458307 - DNA, 19 bp, Homo sapiens
atggggccagatccagcct

SEQ ID NO: 3458308 - DNA, 11 bp, Homo sapiens
atgggggaaag

SEQ ID NO: 3458309 - DNA, 16 bp, Homo sapiens
atgggggaccccttcc

SEQ ID NO: 3458310 - DNA, 19 bp, Homo sapiens
atgggggaccccttcccac

SEQ ID NO: 3458311 - DNA, 14 bp, Homo sapiens
atgggggcagggct

SEQ ID NO: 3458312 - DNA, 15 bp, Homo sapiens
atgggggcagggctg

SEQ ID NO: 3458313 - DNA, 17 bp, Homo sapiens
atggggtcctggccatc

SEQ ID NO: 3458314 - DNA, 14 bp, Homo sapiens
atgggtcagagcta

SEQ ID NO: 3458315 - DNA, 13 bp, Homo sapiens
atgggtcgggaga

SEQ ID NO: 3458316 - DNA, 16 bp, Homo sapiens
atgggtgcaaggaaaa

SEQ ID NO: 3458317 - DNA, 20 bp, Homo sapiens
atgggtgcaaggaaaattag

SEQ ID NO: 3458318 - DNA, 19 bp, Homo sapiens
atggtacatttttcaactt

SEQ ID NO: 3458319 - DNA, 16 bp, Homo sapiens
atggtaccagatgcag

SEQ ID NO: 3458320 - DNA, 18 bp, Homo sapiens
atggtatgtaactcttaa

SEQ ID NO: 3458321 - DNA, 15 bp, Homo sapiens
atggtcacacactga

SEQ ID NO: 3458322 - DNA, 18 bp, Homo sapiens
atggtcacacactgatgc

SEQ ID NO: 3458323 - DNA, 17 bp, Homo sapiens
atggtcacgcacctggg

SEQ ID NO: 3458324 - DNA, 13 bp, Homo sapiens
atggtctggtcta

SEQ ID NO: 3458325 - DNA, 17 bp, Homo sapiens
atggtcttcagcctctt

SEQ ID NO: 3458326 - DNA, 19 bp, Homo sapiens
atggtgcattacgtgggca

SEQ ID NO: 3458327 - DNA, 22 bp, Homo sapiens
atggtgccccaggaccagctca

SEQ ID NO: 3458328 - DNA, 12 bp, Homo sapiens
atggtgctgaga

SEQ ID NO: 3458329 - DNA, 20 bp, Homo sapiens
atggtggaggattgctgcca

SEQ ID NO: 3458330 - DNA, 21 bp, Homo sapiens
atggtggaggattgctgccag

SEQ ID NO: 3458331 - DNA, 14 bp, Homo sapiens
atggtggagggcca

SEQ ID NO: 3458332 - DNA, 18 bp, Homo sapiens
atggtggcacattccttt

SEQ ID NO: 3458333 - DNA, 16 bp, Homo sapiens
atggtggcgcgcacct

SEQ ID NO: 3458334 - DNA, 15 bp, Homo sapiens
atggtggctgggttg

SEQ ID NO: 3458335 - DNA, 16 bp, Homo sapiens
atggtgggcttcaggg

SEQ ID NO: 3458336 - DNA, 13 bp, Homo sapiens
atggttgtattag

SEQ ID NO: 3458337 - DNA, 14 bp, Homo sapiens
atggttgtattaga

SEQ ID NO: 3458338 - DNA, 16 bp, Homo sapiens
atggttgtattagatg

SEQ ID NO: 3458339 - DNA, 12 bp, Homo sapiens
atggttgtgtat

SEQ ID NO: 3458340 - DNA, 17 bp, Homo sapiens
atgtaaaagactttttt

SEQ ID NO: 3458341 - DNA, 23 bp, Homo sapiens
atgtaaaaggccaaacctctgtt

SEQ ID NO: 3458342 - DNA, 18 bp, Homo sapiens
atgtaaacataccaacat

SEQ ID NO: 3458343 - DNA, 20 bp, Homo sapiens
atgtaaacataccaacatgt

SEQ ID NO: 3458344 - DNA, 14 bp, Homo sapiens
atgtaaagccatgc

SEQ ID NO: 3458345 - DNA, 14 bp, Homo sapiens
atgtaaatccccac

SEQ ID NO: 3458346 - DNA, 17 bp, Homo sapiens
atgtaacatgatgttaa

SEQ ID NO: 3458347 - DNA, 17 bp, Homo sapiens
atgtaaccaatcctact

SEQ ID NO: 3458348 - DNA, 20 bp, Homo sapiens
atgtaactgcattgagaact

SEQ ID NO: 3458349 - DNA, 23 bp, Homo sapiens
atgtaactgcattgagaactgca

SEQ ID NO: 3458350 - DNA, 15 bp, Homo sapiens
atgtaagcatacttt

SEQ ID NO: 3458351 - DNA, 13 bp, Homo sapiens
atgtaaggcctta

SEQ ID NO: 3458352 - DNA, 17 bp, Homo sapiens
atgtaaggccttagcca

SEQ ID NO: 3458353 - DNA, 23 bp, Homo sapiens
atgtaatctgatggcttctccag

SEQ ID NO: 3458354 - DNA, 19 bp, Homo sapiens
atgtaatcttgaattgtaa

SEQ ID NO: 3458355 - DNA, 18 bp, Homo sapiens
atgtaatgttaatgttat

SEQ ID NO: 3458356 - DNA, 17 bp, Homo sapiens
atgtaattgtaattttg

SEQ ID NO: 3458357 - DNA, 19 bp, Homo sapiens
atgtaattgtaattttgaa

SEQ ID NO: 3458358 - DNA, 13 bp, Homo sapiens
atgtaatttagtc

SEQ ID NO: 3458359 - DNA, 18 bp, Homo sapiens
atgtacagacatatttaa

SEQ ID NO: 3458360 - DNA, 18 bp, Homo sapiens
atgtaccatgaaacaaag

SEQ ID NO: 3458361 - DNA, 15 bp, Homo sapiens
atgtactagtgttct

SEQ ID NO: 3458362 - DNA, 17 bp, Homo sapiens
atgtagaagtctttcag

SEQ ID NO: 3458363 - DNA, 17 bp, Homo sapiens
atgtagagagataccat

SEQ ID NO: 3458364 - DNA, 19 bp, Homo sapiens
atgtagataaactcagaaa

SEQ ID NO: 3458365 - DNA, 16 bp, Homo sapiens
atgtagccttcacaca

SEQ ID NO: 3458366 - DNA, 17 bp, Homo sapiens
atgtaggaaaaaaatag

SEQ ID NO: 3458367 - DNA, 18 bp, Homo sapiens
atgtagtaattgacatgt

SEQ ID NO: 3458368 - DNA, 20 bp, Homo sapiens
attgccttctcaccagctgc

SEQ ID NO: 3458369 - DNA, 22 bp, Homo sapiens
attgccttctcaccagctgcaa

SEQ ID NO: 3458370 - DNA, 17 bp, Homo sapiens
attgcctttgaatgtta

SEQ ID NO: 3458371 - DNA, 18 bp, Homo sapiens
attgcctttgaatgttaa

SEQ ID NO: 3458372 - DNA, 22 bp, Homo sapiens
attgcctttgaatgttaatttt

SEQ ID NO: 3458373 - DNA, 13 bp, Homo sapiens
attgcgttggtct

SEQ ID NO: 3458374 - DNA, 17 bp, Homo sapiens
attgcgttggtctctgc

SEQ ID NO: 3458375 - DNA, 21 bp, Homo sapiens
attgcgtttgaccttttatgt

SEQ ID NO: 3458376 - DNA, 12 bp, Homo sapiens
attgctgactgt

SEQ ID NO: 3458377 - DNA, 14 bp, Homo sapiens
attgctgagcctct

SEQ ID NO: 3458378 - DNA, 22 bp, Homo sapiens
attgctgagcctctgctcccca

SEQ ID NO: 3458379 - DNA, 21 bp, Homo sapiens
attgctgccccatcagtgctc

SEQ ID NO: 3458380 - DNA, 12 bp, Homo sapiens
attgctgcttga

SEQ ID NO: 3458381 - DNA, 15 bp, Homo sapiens
attgctgttgtccaa

SEQ ID NO: 3458382 - DNA, 17 bp, Homo sapiens
attgcttcttctcctat

SEQ ID NO: 3458383 - DNA, 17 bp, Homo sapiens
attgcttgggtctctct

SEQ ID NO: 3458384 - DNA, 23 bp, Homo sapiens
attgctttcctgcctccttgaaa

SEQ ID NO: 3458385 - DNA, 12 bp, Homo sapiens
attgctttgagc

SEQ ID NO: 3458386 - DNA, 14 bp, Homo sapiens
attggacccttcca

SEQ ID NO: 3458387 - DNA, 22 bp, Homo sapiens
attggagaagtaatcctaggga

SEQ ID NO: 3458388 - DNA, 19 bp, Homo sapiens
attggctatttaaagacaa

SEQ ID NO: 3458389 - DNA, 15 bp, Homo sapiens
attggctcacactga

SEQ ID NO: 3458390 - DNA, 12 bp, Homo sapiens
attgggagaaag

SEQ ID NO: 3458391 - DNA, 15 bp, Homo sapiens
attggggtccctcta

SEQ ID NO: 3458392 - DNA, 15 bp, Homo sapiens
attggggtttgattt

SEQ ID NO: 3458393 - DNA, 18 bp, Homo sapiens
attggggtttgatttgct

SEQ ID NO: 3458394 - DNA, 18 bp, Homo sapiens
attgggtgggcaggaaaa

SEQ ID NO: 3458395 - DNA, 18 bp, Homo sapiens
attggtatgatgctgccg

SEQ ID NO: 3458396 - DNA, 14 bp, Homo sapiens
attggtctcctctc

SEQ ID NO: 3458397 - DNA, 20 bp, Homo sapiens
attgtaaaaaattcacataa

SEQ ID NO: 3458398 - DNA, 16 bp, Homo sapiens
attgtaaattgaatca

SEQ ID NO: 3458399 - DNA, 15 bp, Homo sapiens
attgtactaaagcca

SEQ ID NO: 3458400 - DNA, 16 bp, Homo sapiens
attgtagtcctgtaat

SEQ ID NO: 3458401 - DNA, 15 bp, Homo sapiens
attgtatattcactt

SEQ ID NO: 3458402 - DNA, 17 bp, Homo sapiens
attgtatattgtgtttg

SEQ ID NO: 3458403 - DNA, 14 bp, Homo sapiens
attgtatttattca

SEQ ID NO: 3458404 - DNA, 16 bp, Homo sapiens
attgtatttattcaat

SEQ ID NO: 3458405 - DNA, 19 bp, Homo sapiens
attgtatttattcaataaa

SEQ ID NO: 3458406 - DNA, 20 bp, Homo sapiens
attgtatttattcaataaag

SEQ ID NO: 3458407 - DNA, 18 bp, Homo sapiens
attgtccaatcctatgtt

SEQ ID NO: 3458408 - DNA, 19 bp, Homo sapiens
attgtctagggtgttctgt

SEQ ID NO: 3458409 - DNA, 23 bp, Homo sapiens
attgtctcctatatatttctatt

SEQ ID NO: 3458410 - DNA, 17 bp, Homo sapiens
attgtgaaccaatgcaa

SEQ ID NO: 3458411 - DNA, 15 bp, Homo sapiens
attgtgcttctttct

SEQ ID NO: 3458412 - DNA, 17 bp, Homo sapiens
attgtggaatgttggat

SEQ ID NO: 3458413 - DNA, 14 bp, Homo sapiens
attgtggtgccaca

SEQ ID NO: 3458414 - DNA, 16 bp, Homo sapiens
attgtgtttgtcatta

SEQ ID NO: 3458415 - DNA, 13 bp, Homo sapiens
attgtttcaattg

SEQ ID NO: 3458416 - DNA, 22 bp, Homo sapiens
attgtttcaattgcatctccca

SEQ ID NO: 3458417 - DNA, 15 bp, Homo sapiens
attgtttctgtgggc

SEQ ID NO: 3458418 - DNA, 15 bp, Homo sapiens
attgtttgctgctat

SEQ ID NO: 3458419 - DNA, 21 bp, Homo sapiens
attgtttggggatgagaaagg

SEQ ID NO: 3458420 - DNA, 21 bp, Homo sapiens
attgtttgtctttaactgtca

SEQ ID NO: 3458421 - DNA, 14 bp, Homo sapiens
atttaaaaaaaatc

SEQ ID NO: 3458422 - DNA, 15 bp, Homo sapiens
atttaaaaatgtctt

SEQ ID NO: 3458423 - DNA, 21 bp, Homo sapiens
atttaaaagcagagcattttt

SEQ ID NO: 3458424 - DNA, 16 bp, Homo sapiens
atttaacaaaaagtgc

SEQ ID NO: 3458425 - DNA, 20 bp, Homo sapiens
atttaacaaaaagtgcttca

SEQ ID NO: 3458426 - DNA, 19 bp, Homo sapiens
atttaacagcatgacaaaa

SEQ ID NO: 3458427 - DNA, 22 bp, Homo sapiens
atttaacagctgaattatctat

SEQ ID NO: 3458428 - DNA, 19 bp, Homo sapiens
atttaagggaatgtgagca

SEQ ID NO: 3458429 - DNA, 16 bp, Homo sapiens
atttaataatatactt

SEQ ID NO: 3458430 - DNA, 17 bp, Homo sapiens
atttaattcatgtttct

SEQ ID NO: 3458431 - DNA, 16 bp, Homo sapiens
atttaatttagatatt

SEQ ID NO: 3458432 - DNA, 16 bp, Homo sapiens
atttacaaagtgtgta

SEQ ID NO: 3458433 - DNA, 17 bp, Homo sapiens
atttacaaagtgtgtat

SEQ ID NO: 3458434 - DNA, 16 bp, Homo sapiens
atttacaaatgggaaa

SEQ ID NO: 3458435 - DNA, 23 bp, Homo sapiens
atttacagccagtgggagatgtt

SEQ ID NO: 3458436 - DNA, 13 bp, Homo sapiens
atttactgagctt

SEQ ID NO: 3458437 - DNA, 21 bp, Homo sapiens
atttactgagcttctctgtga

SEQ ID NO: 3458438 - DNA, 20 bp, Homo sapiens
atttagaaaaagaacatgca

SEQ ID NO: 3458439 - DNA, 20 bp, Homo sapiens
atttagatattttccatata

SEQ ID NO: 3458440 - DNA, 23 bp, Homo sapiens
atttagatattttccatatattg

SEQ ID NO: 3458441 - DNA, 22 bp, Homo sapiens
atttagctaaacggattccaaa

SEQ ID NO: 3458442 - DNA, 23 bp, Homo sapiens
atttagctaaacggattccaaag

SEQ ID NO: 3458443 - DNA, 17 bp, Homo sapiens
atttagctgtattcata

SEQ ID NO: 3458444 - DNA, 21 bp, Homo sapiens
atttagtattgaatacttaca

SEQ ID NO: 3458445 - DNA, 22 bp, Homo sapiens
atttagtttgattattcagtgt

SEQ ID NO: 3458446 - DNA, 21 bp, Homo sapiens
atttataaaacttctcaagat

SEQ ID NO: 3458447 - DNA, 17 bp, Homo sapiens
atttataaacagacaat

SEQ ID NO: 3458448 - DNA, 23 bp, Homo sapiens
atttataaacagacaatatgtga

SEQ ID NO: 3458449 - DNA, 15 bp, Homo sapiens
atttatagatcattt

SEQ ID NO: 3458450 - DNA, 18 bp, Homo sapiens
atttatagatcatttcta

SEQ ID NO: 3458451 - DNA, 13 bp, Homo sapiens
atttatagtaatg

SEQ ID NO: 3458452 - DNA, 15 bp, Homo sapiens
atttatatgtacatg

SEQ ID NO: 3458453 - DNA, 17 bp, Homo sapiens
atttatatgtacatgag

SEQ ID NO: 3458454 - DNA, 17 bp, Homo sapiens
atttatccaaaatgtgt

SEQ ID NO: 3458455 - DNA, 19 bp, Homo sapiens
atttatcttgtctctgggc

SEQ ID NO: 3458456 - DNA, 13 bp, Homo sapiens
atttatgaatata

SEQ ID NO: 3458457 - DNA, 16 bp, Homo sapiens
atttatgtaacttgaa

SEQ ID NO: 3458458 - DNA, 13 bp, Homo sapiens
atttatgtttgca

SEQ ID NO: 3458459 - DNA, 17 bp, Homo sapiens
atttattaattgctttg

SEQ ID NO: 3458460 - DNA, 18 bp, Homo sapiens
atttattcaataaagtat

SEQ ID NO: 3458461 - DNA, 18 bp, Homo sapiens
atttattcaattcctctg

SEQ ID NO: 3458462 - DNA, 14 bp, Homo sapiens
atttattctgctca

SEQ ID NO: 3458463 - DNA, 20 bp, Homo sapiens
atttattgcacattgttcaa

SEQ ID NO: 3458464 - DNA, 21 bp, Homo sapiens
atttattgcaggatggtgtct

SEQ ID NO: 3458465 - DNA, 17 bp, Homo sapiens
atttattgtttatgtaa

SEQ ID NO: 3458466 - DNA, 19 bp, Homo sapiens
atttattgtttatgtaaat

SEQ ID NO: 3458467 - DNA, 13 bp, Homo sapiens
atttatttacaga

SEQ ID NO: 3458468 - DNA, 15 bp, Homo sapiens
atttattttataaga

SEQ ID NO: 3458469 - DNA, 16 bp, Homo sapiens
atttcaaaatgctttt

SEQ ID NO: 3458470 - DNA, 22 bp, Homo sapiens
atttcaaatatttacagtactt

SEQ ID NO: 3458471 - DNA, 14 bp, Homo sapiens
atttcaagtttact

SEQ ID NO: 3458472 - DNA, 13 bp, Homo sapiens
atttcacattaat

SEQ ID NO: 3458473 - DNA, 21 bp, Homo sapiens
atttcacccctccctttctcc

SEQ ID NO: 3458474 - DNA, 18 bp, Homo sapiens
atttcagactcccattcc

SEQ ID NO: 3458475 - DNA, 16 bp, Homo sapiens
atttcagatgtaatgt

SEQ ID NO: 3458476 - DNA, 19 bp, Homo sapiens
atttcagatgtaatgtttt

SEQ ID NO: 3458477 - DNA, 17 bp, Homo sapiens
atttcaggctccccaga

SEQ ID NO: 3458478 - DNA, 19 bp, Homo sapiens
atttcagtgttacctgtgt

SEQ ID NO: 3458479 - DNA, 18 bp, Homo sapiens
atttcatattctttcaat

SEQ ID NO: 3458480 - DNA, 20 bp, Homo sapiens
atttcatctgctctccttcc

SEQ ID NO: 3458481 - DNA, 19 bp, Homo sapiens
atttcattggttaattttt

SEQ ID NO: 3458482 - DNA, 13 bp, Homo sapiens
atttccagtctcc

SEQ ID NO: 3458483 - DNA, 23 bp, Homo sapiens
atttcccccctccgcctccagga

SEQ ID NO: 3458484 - DNA, 20 bp, Homo sapiens
atttcctagttctgtagaaa

SEQ ID NO: 3458485 - DNA, 21 bp, Homo sapiens
atttcctcagcttatctcttt

SEQ ID NO: 3458486 - DNA, 14 bp, Homo sapiens
atttcctggatgtt

SEQ ID NO: 3458487 - DNA, 16 bp, Homo sapiens
atttcctgtgtcaatc

SEQ ID NO: 3458488 - DNA, 21 bp, Homo sapiens
atttctagaacatccctgcca

SEQ ID NO: 3458489 - DNA, 23 bp, Homo sapiens
atttctagaacatccctgccagc

SEQ ID NO: 3458490 - DNA, 14 bp, Homo sapiens
atttctagagacaa

SEQ ID NO: 3458491 - DNA, 22 bp, Homo sapiens
atttctaggcaaaattgtgaag

SEQ ID NO: 3458492 - DNA, 22 bp, Homo sapiens
atttctattattaattgcaaaa

SEQ ID NO: 3458493 - DNA, 13 bp, Homo sapiens
atttctatttatt

SEQ ID NO: 3458494 - DNA, 13 bp, Homo sapiens
atttctgcatatg

SEQ ID NO: 3458495 - DNA, 11 bp, Homo sapiens
atttctgtaaa

SEQ ID NO: 3458496 - DNA, 11 bp, Homo sapiens
atttctgtgtt

SEQ ID NO: 3458497 - DNA, 15 bp, Homo sapiens
atttctgtgttgcca

SEQ ID NO: 3458498 - DNA, 15 bp, Homo sapiens
atttcttcagagttt

SEQ ID NO: 3458499 - DNA, 21 bp, Homo sapiens
atttcttcataggtagaaaca

SEQ ID NO: 3458500 - DNA, 12 bp, Homo sapiens
caagagggtctg

SEQ ID NO: 3458501 - DNA, 22 bp, Homo sapiens
caagagtagttatataattgtt

SEQ ID NO: 3458502 - DNA, 16 bp, Homo sapiens
caagatattatgtata

SEQ ID NO: 3458503 - DNA, 21 bp, Homo sapiens
caagatattatgtataaaatg

SEQ ID NO: 3458504 - DNA, 22 bp, Homo sapiens
caagatattatgtataaaatgt

SEQ ID NO: 3458505 - DNA, 21 bp, Homo sapiens
caagatattttaaaatctgtc

SEQ ID NO: 3458506 - DNA, 18 bp, Homo sapiens
caagatgaaggagaggca

SEQ ID NO: 3458507 - DNA, 19 bp, Homo sapiens
caagatgagagaactggag

SEQ ID NO: 3458508 - DNA, 18 bp, Homo sapiens
caagattgcttaaaatag

SEQ ID NO: 3458509 - DNA, 14 bp, Homo sapiens
caagcaacagcctt

SEQ ID NO: 3458510 - DNA, 12 bp, Homo sapiens
caagcacagcag

SEQ ID NO: 3458511 - DNA, 13 bp, Homo sapiens
caagcacagcagc

SEQ ID NO: 3458512 - DNA, 20 bp, Homo sapiens
caagcacatctgcattttca

SEQ ID NO: 3458513 - DNA, 17 bp, Homo sapiens
caagcactaaacaaaga

SEQ ID NO: 3458514 - DNA, 13 bp, Homo sapiens
caagcagccaagc

SEQ ID NO: 3458515 - DNA, 21 bp, Homo sapiens
caagcagcctgagcaactctt

SEQ ID NO: 3458516 - DNA, 17 bp, Homo sapiens
caagcaggaagctcaga

SEQ ID NO: 3458517 - DNA, 21 bp, Homo sapiens
caagcaggaagctcagactgg

SEQ ID NO: 3458518 - DNA, 16 bp, Homo sapiens
caagcagtagacaagc

SEQ ID NO: 3458519 - DNA, 15 bp, Homo sapiens
caagcagtcgtgcct

SEQ ID NO: 3458520 - DNA, 16 bp, Homo sapiens
caagcagtcgtgcctg

SEQ ID NO: 3458521 - DNA, 18 bp, Homo sapiens
caagcagtcgtgcctgtg

SEQ ID NO: 3458522 - DNA, 15 bp, Homo sapiens
caagccaagcagcca

SEQ ID NO: 3458523 - DNA, 16 bp, Homo sapiens
caagccaagcagccaa

SEQ ID NO: 3458524 - DNA, 19 bp, Homo sapiens
caagccaagcagccaagct

SEQ ID NO: 3458525 - DNA, 22 bp, Homo sapiens
caagccactcggcggcagcatg

SEQ ID NO: 3458526 - DNA, 12 bp, Homo sapiens
caagccagctgc

SEQ ID NO: 3458527 - DNA, 17 bp, Homo sapiens
caagcccagcactgctt

SEQ ID NO: 3458528 - DNA, 14 bp, Homo sapiens
caagcccccccttc

SEQ ID NO: 3458529 - DNA, 16 bp, Homo sapiens
caagcctgtgcaaaaa

SEQ ID NO: 3458530 - DNA, 17 bp, Homo sapiens
caagcgattctcctgcc

SEQ ID NO: 3458531 - DNA, 18 bp, Homo sapiens
caagcgattcttctgctt

SEQ ID NO: 3458532 - DNA, 20 bp, Homo sapiens
caagcgattcttctgcttca

SEQ ID NO: 3458533 - DNA, 17 bp, Homo sapiens
caagcgtgagccactgc

SEQ ID NO: 3458534 - DNA, 16 bp, Homo sapiens
caagctcaaagcgtgg

SEQ ID NO: 3458535 - DNA, 13 bp, Homo sapiens
caagctccaagcc

SEQ ID NO: 3458536 - DNA, 18 bp, Homo sapiens
caagctcccaagggatgg

SEQ ID NO: 3458537 - DNA, 17 bp, Homo sapiens
caagctccgcaggactt

SEQ ID NO: 3458538 - DNA, 14 bp, Homo sapiens
caagctcctcctcc

SEQ ID NO: 3458539 - DNA, 14 bp, Homo sapiens
caagctctgctcct

SEQ ID NO: 3458540 - DNA, 14 bp, Homo sapiens
caagctgcaccctc

SEQ ID NO: 3458541 - DNA, 23 bp, Homo sapiens
caagctggtcccactcagtccat

SEQ ID NO: 3458542 - DNA, 12 bp, Homo sapiens
caagcttccctc

SEQ ID NO: 3458543 - DNA, 18 bp, Homo sapiens
caaggaaaaaataacaat

SEQ ID NO: 3458544 - DNA, 20 bp, Homo sapiens
caaggaaaaaataacaatga

SEQ ID NO: 3458545 - DNA, 15 bp, Homo sapiens
caaggaaaaacaggt

SEQ ID NO: 3458546 - DNA, 18 bp, Homo sapiens
caaggaaaccacagctgc

SEQ ID NO: 3458547 - DNA, 20 bp, Homo sapiens
caaggaaaccacagctgctg

SEQ ID NO: 3458548 - DNA, 20 bp, Homo sapiens
caaggaaacgctacctctct

SEQ ID NO: 3458549 - DNA, 13 bp, Homo sapiens
caaggaaactttc

SEQ ID NO: 3458550 - DNA, 22 bp, Homo sapiens
caaggaactaatttcttctcct

SEQ ID NO: 3458551 - DNA, 18 bp, Homo sapiens
caaggaacttgaaaaata

SEQ ID NO: 3458552 - DNA, 16 bp, Homo sapiens
caaggaaggaaaagaa

SEQ ID NO: 3458553 - DNA, 17 bp, Homo sapiens
caaggaaggaaaagaaa

SEQ ID NO: 3458554 - DNA, 16 bp, Homo sapiens
caaggacattcttgta

SEQ ID NO: 3458555 - DNA, 21 bp, Homo sapiens
caaggacttcctgtccagctc

SEQ ID NO: 3458556 - DNA, 20 bp, Homo sapiens
caaggagacacaacaactcc

SEQ ID NO: 3458557 - DNA, 15 bp, Homo sapiens
caaggagaggaggca

SEQ ID NO: 3458558 - DNA, 14 bp, Homo sapiens
caaggagcccagaa

SEQ ID NO: 3458559 - DNA, 11 bp, Homo sapiens
caaggagctgc

SEQ ID NO: 3458560 - DNA, 21 bp, Homo sapiens
caaggatagatgctggcccag

SEQ ID NO: 3458561 - DNA, 22 bp, Homo sapiens
caaggatagatgctggcccagg

SEQ ID NO: 3458562 - DNA, 13 bp, Homo sapiens
caaggcactgcct

SEQ ID NO: 3458563 - DNA, 14 bp, Homo sapiens
caaggcactgcctg

SEQ ID NO: 3458564 - DNA, 17 bp, Homo sapiens
caaggccatccttccct

SEQ ID NO: 3458565 - DNA, 22 bp, Homo sapiens
caaggctcttctccttggagga

SEQ ID NO: 3458566 - DNA, 23 bp, Homo sapiens
caaggctcttctccttggaggac

SEQ ID NO: 3458567 - DNA, 17 bp, Homo sapiens
caaggctgcagtgagcc

SEQ ID NO: 3458568 - DNA, 21 bp, Homo sapiens
caaggctgggggaagaagctc

SEQ ID NO: 3458569 - DNA, 15 bp, Homo sapiens
caaggcttcagtctc

SEQ ID NO: 3458570 - DNA, 20 bp, Homo sapiens
caagggctttgttttgcaca

SEQ ID NO: 3458571 - DNA, 21 bp, Homo sapiens
caaggggaatgtttgcctctg

SEQ ID NO: 3458572 - DNA, 22 bp, Homo sapiens
caaggggcttcaggtccaggct

SEQ ID NO: 3458573 - DNA, 16 bp, Homo sapiens
caaggtcacctgggct

SEQ ID NO: 3458574 - DNA, 21 bp, Homo sapiens
caaggtttaggctggtggccc

SEQ ID NO: 3458575 - DNA, 24 bp, Homo sapiens
caaggtttaggctggtggcccagg

SEQ ID NO: 3458576 - DNA, 17 bp, Homo sapiens
caagtaagaggctggag

SEQ ID NO: 3458577 - DNA, 23 bp, Homo sapiens
caagtagaatctcagttgatttt

SEQ ID NO: 3458578 - DNA, 19 bp, Homo sapiens
caagtatttgggaagtgaa

SEQ ID NO: 3458579 - DNA, 16 bp, Homo sapiens
caagtcaaattaataa

SEQ ID NO: 3458580 - DNA, 16 bp, Homo sapiens
caagtcatgtgcattt

SEQ ID NO: 3458581 - DNA, 14 bp, Homo sapiens
caagtcctcttttc

SEQ ID NO: 3458582 - DNA, 16 bp, Homo sapiens
caagtccttttgtaaa

SEQ ID NO: 3458583 - DNA, 22 bp, Homo sapiens
caagtctttaggtctttgtaag

SEQ ID NO: 3458584 - DNA, 22 bp, Homo sapiens
caagtgaaaaaggaggaagaga

SEQ ID NO: 3458585 - DNA, 11 bp, Homo sapiens
caagtgaaggt

SEQ ID NO: 3458586 - DNA, 19 bp, Homo sapiens
caagtgattctcctgcctc

SEQ ID NO: 3458587 - DNA, 21 bp, Homo sapiens
caagtgattctcctgcctcag

SEQ ID NO: 3458588 - DNA, 17 bp, Homo sapiens
caagtgccgcaaattgt

SEQ ID NO: 3458589 - DNA, 18 bp, Homo sapiens
caagtgccgcaaattgta

SEQ ID NO: 3458590 - DNA, 15 bp, Homo sapiens
caagtgctcagggaa

SEQ ID NO: 3458591 - DNA, 16 bp, Homo sapiens
caagtgctcagggaaa

SEQ ID NO: 3458592 - DNA, 23 bp, Homo sapiens
caagtgctcagggaaatggcctt

SEQ ID NO: 3458593 - DNA, 22 bp, Homo sapiens
caagtggaccttaggccttcct

SEQ ID NO: 3458594 - DNA, 13 bp, Homo sapiens
caagtgtcttttt

SEQ ID NO: 3458595 - DNA, 16 bp, Homo sapiens
caagtgttcacaacct

SEQ ID NO: 3458596 - DNA, 17 bp, Homo sapiens
caagttgaagactttgt

SEQ ID NO: 3458597 - DNA, 19 bp, Homo sapiens
caagttgaagactttgttt

SEQ ID NO: 3458598 - DNA, 20 bp, Homo sapiens
caagtttactccttctgttt

SEQ ID NO: 3458599 - DNA, 18 bp, Homo sapiens
caataaaaaacaaatata

SEQ ID NO: 3458600 - DNA, 18 bp, Homo sapiens
caataaaatttttttaaa

SEQ ID NO: 3458601 - DNA, 19 bp, Homo sapiens
caataaaattttttttcat

SEQ ID NO: 3458602 - DNA, 16 bp, Homo sapiens
caataaagcactgagc

SEQ ID NO: 3458603 - DNA, 14 bp, Homo sapiens
caataaagcattta

SEQ ID NO: 3458604 - DNA, 16 bp, Homo sapiens
caataaagcatttata

SEQ ID NO: 3458605 - DNA, 20 bp, Homo sapiens
caataaagtatttaattagt

SEQ ID NO: 3458606 - DNA, 22 bp, Homo sapiens
caataaagtatttaattagtgc

SEQ ID NO: 3458607 - DNA, 17 bp, Homo sapiens
caatacagtacaggcag

SEQ ID NO: 3458608 - DNA, 18 bp, Homo sapiens
caatacagtacaggcagc

SEQ ID NO: 3458609 - DNA, 20 bp, Homo sapiens
caatagcacccctactcaca

SEQ ID NO: 3458610 - DNA, 18 bp, Homo sapiens
caatataacattctattg

SEQ ID NO: 3458611 - DNA, 12 bp, Homo sapiens
caatatcctttg

SEQ ID NO: 3458612 - DNA, 13 bp, Homo sapiens
caatatcctttgc

SEQ ID NO: 3458613 - DNA, 14 bp, Homo sapiens
caatatgccagctt

SEQ ID NO: 3458614 - DNA, 17 bp, Homo sapiens
caatatgtgagtgcctt

SEQ ID NO: 3458615 - DNA, 20 bp, Homo sapiens
caatatgtgagtgccttttg

SEQ ID NO: 3458616 - DNA, 22 bp, Homo sapiens
caatatgtgagtgccttttgca

SEQ ID NO: 3458617 - DNA, 18 bp, Homo sapiens
caatattgaatttttcct

SEQ ID NO: 3458618 - DNA, 16 bp, Homo sapiens
caatattgactttgtc

SEQ ID NO: 3458619 - DNA, 16 bp, Homo sapiens
caatattttctttaat

SEQ ID NO: 3458620 - DNA, 19 bp, Homo sapiens
caatattttctttaatgct

SEQ ID NO: 3458621 - DNA, 15 bp, Homo sapiens
caatcaagtctgttt

SEQ ID NO: 3458622 - DNA, 20 bp, Homo sapiens
caatcaataaaaaacaaata

SEQ ID NO: 3458623 - DNA, 18 bp, Homo sapiens
caatcagctccttcctgg

SEQ ID NO: 3458624 - DNA, 17 bp, Homo sapiens
caatcatgaaatatgca

SEQ ID NO: 3458625 - DNA, 13 bp, Homo sapiens
caatcatgttctg

SEQ ID NO: 3458626 - DNA, 18 bp, Homo sapiens
caatccagatggtgggat

SEQ ID NO: 3458627 - DNA, 12 bp, Homo sapiens
caatcccagcta

SEQ ID NO: 3458628 - DNA, 15 bp, Homo sapiens
caatcctagtgcttt

SEQ ID NO: 3458629 - DNA, 20 bp, Homo sapiens
caatcctatgtttttgttca

SEQ ID NO: 3458630 - DNA, 14 bp, Homo sapiens
caatccttaaatat

SEQ ID NO: 3458631 - DNA, 14 bp, Homo sapiens
caatcttctttttc

SEQ ID NO: 3458632 - DNA, 22 bp, Homo sapiens
cactcggcggcagcatggagct

SEQ ID NO: 3458633 - DNA, 12 bp, Homo sapiens
cactcggtccca

SEQ ID NO: 3458634 - DNA, 20 bp, Homo sapiens
cactcggtcccagttttgtt

SEQ ID NO: 3458635 - DNA, 16 bp, Homo sapiens
cactctcccccacccc

SEQ ID NO: 3458636 - DNA, 18 bp, Homo sapiens
cactctcccccaccccct

SEQ ID NO: 3458637 - DNA, 16 bp, Homo sapiens
cactctgatagaatta

SEQ ID NO: 3458638 - DNA, 15 bp, Homo sapiens
cactctgcctgcctg

SEQ ID NO: 3458639 - DNA, 15 bp, Homo sapiens
cactctgggctccag

SEQ ID NO: 3458640 - DNA, 19 bp, Homo sapiens
cactctgtcgcccagtctg

SEQ ID NO: 3458641 - DNA, 20 bp, Homo sapiens
cactctgtcgcccagtctgg

SEQ ID NO: 3458642 - DNA, 18 bp, Homo sapiens
cactcttattgcccacgc

SEQ ID NO: 3458643 - DNA, 21 bp, Homo sapiens
cactcttattgcccacgctgg

SEQ ID NO: 3458644 - DNA, 17 bp, Homo sapiens
cactgaattccattttt

SEQ ID NO: 3458645 - DNA, 15 bp, Homo sapiens
cactgacagcctccc

SEQ ID NO: 3458646 - DNA, 20 bp, Homo sapiens
cactgacagcctcccacccc

SEQ ID NO: 3458647 - DNA, 23 bp, Homo sapiens
cactgacatcaattttaccctga

SEQ ID NO: 3458648 - DNA, 13 bp, Homo sapiens
cactgaccagaac

SEQ ID NO: 3458649 - DNA, 15 bp, Homo sapiens
cactgaccagaacta

SEQ ID NO: 3458650 - DNA, 18 bp, Homo sapiens
cactgagaatgtaagaac

SEQ ID NO: 3458651 - DNA, 20 bp, Homo sapiens
cactgagaatgtaagaacta

SEQ ID NO: 3458652 - DNA, 21 bp, Homo sapiens
cactgagaatgtaagaactac

SEQ ID NO: 3458653 - DNA, 18 bp, Homo sapiens
cactgagataccagcgag

SEQ ID NO: 3458654 - DNA, 19 bp, Homo sapiens
cactgagataccagcgagg

SEQ ID NO: 3458655 - DNA, 12 bp, Homo sapiens
cactgagcaagt

SEQ ID NO: 3458656 - DNA, 15 bp, Homo sapiens
cactgagctgtcatg

SEQ ID NO: 3458657 - DNA, 14 bp, Homo sapiens
cactgaggaagaac

SEQ ID NO: 3458658 - DNA, 16 bp, Homo sapiens
cactgaggcagggaag

SEQ ID NO: 3458659 - DNA, 15 bp, Homo sapiens
cactgagttttccat

SEQ ID NO: 3458660 - DNA, 22 bp, Homo sapiens
cactgagttttccatggcagga

SEQ ID NO: 3458661 - DNA, 24 bp, Homo sapiens
cactgatgggcaacccccagcctg

SEQ ID NO: 3458662 - DNA, 20 bp, Homo sapiens
cactgcaaaccgccacctcc

SEQ ID NO: 3458663 - DNA, 13 bp, Homo sapiens
cactgcaaagaga

SEQ ID NO: 3458664 - DNA, 20 bp, Homo sapiens
cactgcaagtccttttgtaa

SEQ ID NO: 3458665 - DNA, 16 bp, Homo sapiens
cactgcactccagcct

SEQ ID NO: 3458666 - DNA, 13 bp, Homo sapiens
cactgcagcctca

SEQ ID NO: 3458667 - DNA, 19 bp, Homo sapiens
cactgcagcctcaacctcc

SEQ ID NO: 3458668 - DNA, 21 bp, Homo sapiens
cactgcagcctcaacctcctg

SEQ ID NO: 3458669 - DNA, 17 bp, Homo sapiens
cactgccacaccctccc

SEQ ID NO: 3458670 - DNA, 13 bp, Homo sapiens
cactgccactcca

SEQ ID NO: 3458671 - DNA, 20 bp, Homo sapiens
cactgccactccagtcctgc

SEQ ID NO: 3458672 - DNA, 19 bp, Homo sapiens
cactgccagagataaacta

SEQ ID NO: 3458673 - DNA, 17 bp, Homo sapiens
cactgccatgcagggcc

SEQ ID NO: 3458674 - DNA, 19 bp, Homo sapiens
cactgccatgcagggcctc

SEQ ID NO: 3458675 - DNA, 17 bp, Homo sapiens
cactgccatgccagctt

SEQ ID NO: 3458676 - DNA, 22 bp, Homo sapiens
cactgcctgatggacctgtcac

SEQ ID NO: 3458677 - DNA, 21 bp, Homo sapiens
cactgccttcgcttcttgcct

SEQ ID NO: 3458678 - DNA, 23 bp, Homo sapiens
cactgccttcgcttcttgcctct

SEQ ID NO: 3458679 - DNA, 15 bp, Homo sapiens
cactgctaaaataga

SEQ ID NO: 3458680 - DNA, 20 bp, Homo sapiens
cactgctaaaatagaatata

SEQ ID NO: 3458681 - DNA, 22 bp, Homo sapiens
cactgctagagacgctgatcca

SEQ ID NO: 3458682 - DNA, 15 bp, Homo sapiens
cactgctctcagcct

SEQ ID NO: 3458683 - DNA, 18 bp, Homo sapiens
cactgctctcagcctccc

SEQ ID NO: 3458684 - DNA, 14 bp, Homo sapiens
cactgcttgaggaa

SEQ ID NO: 3458685 - DNA, 21 bp, Homo sapiens
cactgcttttggtctgtgtga

SEQ ID NO: 3458686 - DNA, 19 bp, Homo sapiens
cactggactccggccctcc

SEQ ID NO: 3458687 - DNA, 17 bp, Homo sapiens
cactggactgacctggt

SEQ ID NO: 3458688 - DNA, 14 bp, Homo sapiens
cactggacttgcct

SEQ ID NO: 3458689 - DNA, 19 bp, Homo sapiens
cactggatgcaaagaaaat

SEQ ID NO: 3458690 - DNA, 19 bp, Homo sapiens
cactggcagactgtgtaaa

SEQ ID NO: 3458691 - DNA, 21 bp, Homo sapiens
cactggcagactgtgtaaaat

SEQ ID NO: 3458692 - DNA, 21 bp, Homo sapiens
cactgggaggccagtgagcca

SEQ ID NO: 3458693 - DNA, 15 bp, Homo sapiens
cactgggctcccggg

SEQ ID NO: 3458694 - DNA, 14 bp, Homo sapiens
cactggggcctaca

SEQ ID NO: 3458695 - DNA, 16 bp, Homo sapiens
cactggggcctacagc

SEQ ID NO: 3458696 - DNA, 22 bp, Homo sapiens
cactgggtggtggcctggtccc

SEQ ID NO: 3458697 - DNA, 16 bp, Homo sapiens
cactggtattcctgcc

SEQ ID NO: 3458698 - DNA, 15 bp, Homo sapiens
cactggtttctcaga

SEQ ID NO: 3458699 - DNA, 13 bp, Homo sapiens
cactgtctttcct

SEQ ID NO: 3458700 - DNA, 13 bp, Homo sapiens
cactgtgaaggac

SEQ ID NO: 3458701 - DNA, 15 bp, Homo sapiens
cactgtgaaggaccc

SEQ ID NO: 3458702 - DNA, 17 bp, Homo sapiens
cactgtgaaggaccctt

SEQ ID NO: 3458703 - DNA, 13 bp, Homo sapiens
cactgtgctcagg

SEQ ID NO: 3458704 - DNA, 15 bp, Homo sapiens
cactgtgctcagggc

SEQ ID NO: 3458705 - DNA, 16 bp, Homo sapiens
cactgtgctcagggct

SEQ ID NO: 3458706 - DNA, 17 bp, Homo sapiens
cactgtgggaaggccag

SEQ ID NO: 3458707 - DNA, 20 bp, Homo sapiens
cactgtgggaaggccagctg

SEQ ID NO: 3458708 - DNA, 15 bp, Homo sapiens
cactgtgtgctattt

SEQ ID NO: 3458709 - DNA, 16 bp, Homo sapiens
cactgtgttactgctt

SEQ ID NO: 3458710 - DNA, 16 bp, Homo sapiens
cactgttcatgctggc

SEQ ID NO: 3458711 - DNA, 17 bp, Homo sapiens
cactgttcatgctggcg

SEQ ID NO: 3458712 - DNA, 17 bp, Homo sapiens
cactgttgaattttctc

SEQ ID NO: 3458713 - DNA, 16 bp, Homo sapiens
cactgttgcccaggct

SEQ ID NO: 3458714 - DNA, 23 bp, Homo sapiens
cactgttgcccaggctggcgtgc

SEQ ID NO: 3458715 - DNA, 16 bp, Homo sapiens
cacttaaattatgata

SEQ ID NO: 3458716 - DNA, 19 bp, Homo sapiens
cacttactgtaagacatta

SEQ ID NO: 3458717 - DNA, 21 bp, Homo sapiens
cacttcagctgacttttctgt

SEQ ID NO: 3458718 - DNA, 22 bp, Homo sapiens
cacttcattcttgaaagctgtg

SEQ ID NO: 3458719 - DNA, 12 bp, Homo sapiens
cacttccctgct

SEQ ID NO: 3458720 - DNA, 13 bp, Homo sapiens
cacttccctgctg

SEQ ID NO: 3458721 - DNA, 21 bp, Homo sapiens
cacttcgggaggtcgaggcag

SEQ ID NO: 3458722 - DNA, 23 bp, Homo sapiens
cacttcgggaggtcgaggcagga

SEQ ID NO: 3458723 - DNA, 22 bp, Homo sapiens
cacttctgccatattctgttgg

SEQ ID NO: 3458724 - DNA, 18 bp, Homo sapiens
cacttctgggtggggcag

SEQ ID NO: 3458725 - DNA, 12 bp, Homo sapiens
cacttcttcacc

SEQ ID NO: 3458726 - DNA, 18 bp, Homo sapiens
cacttgaacccgggaggc

SEQ ID NO: 3458727 - DNA, 14 bp, Homo sapiens
cacttgcagactct

SEQ ID NO: 3458728 - DNA, 17 bp, Homo sapiens
cacttgcctcttccttg

SEQ ID NO: 3458729 - DNA, 19 bp, Homo sapiens
cacttggcatcagctggcg

SEQ ID NO: 3458730 - DNA, 15 bp, Homo sapiens
cacttggtaattgta

SEQ ID NO: 3458731 - DNA, 14 bp, Homo sapiens
cacttgtccagctg

SEQ ID NO: 3458732 - DNA, 15 bp, Homo sapiens
cacttgtccagctga

SEQ ID NO: 3458733 - DNA, 23 bp, Homo sapiens
cacttgtccccaaatccgaacct

SEQ ID NO: 3458734 - DNA, 14 bp, Homo sapiens
cacttgtttgcact

SEQ ID NO: 3458735 - DNA, 17 bp, Homo sapiens
cacttgtttgcactgtg

SEQ ID NO: 3458736 - DNA, 21 bp, Homo sapiens
cactttacaatgttcatccca

SEQ ID NO: 3458737 - DNA, 19 bp, Homo sapiens
cactttatggtaagtagca

SEQ ID NO: 3458738 - DNA, 19 bp, Homo sapiens
cactttctacaatgtgaac

SEQ ID NO: 3458739 - DNA, 23 bp, Homo sapiens
cactttctacaatgtgaacttta

SEQ ID NO: 3458740 - DNA, 13 bp, Homo sapiens
cactttgggaggc

SEQ ID NO: 3458741 - DNA, 21 bp, Homo sapiens
cactttgtttcgtggggaggt

SEQ ID NO: 3458742 - DNA, 18 bp, Homo sapiens
cacttttgacaaaggcaa

SEQ ID NO: 3458743 - DNA, 21 bp, Homo sapiens
cacttttggaaggtgactttt

SEQ ID NO: 3458744 - DNA, 22 bp, Homo sapiens
cagaaaaatatgtaccaagaat

SEQ ID NO: 3458745 - DNA, 14 bp, Homo sapiens
cagaaaatgttgag

SEQ ID NO: 3458746 - DNA, 18 bp, Homo sapiens
cagaaaatgttgagaatc

SEQ ID NO: 3458747 - DNA, 13 bp, Homo sapiens
cagaaacaggacc

SEQ ID NO: 3458748 - DNA, 19 bp, Homo sapiens
cagaaacatcagttactct

SEQ ID NO: 3458749 - DNA, 19 bp, Homo sapiens
cagaaactgttcccacctg

SEQ ID NO: 3458750 - DNA, 17 bp, Homo sapiens
cagaaagcagttctgat

SEQ ID NO: 3458751 - DNA, 22 bp, Homo sapiens
cagaaaggaaaagattcctgtc

SEQ ID NO: 3458752 - DNA, 16 bp, Homo sapiens
cagaaagtgtgcttta

SEQ ID NO: 3458753 - DNA, 17 bp, Homo sapiens
cagaaagtgtgctttat

SEQ ID NO: 3458754 - DNA, 16 bp, Homo sapiens
cagaaatgctgctggc

SEQ ID NO: 3458755 - DNA, 18 bp, Homo sapiens
cagaaatgctgctggcca

SEQ ID NO: 3458756 - DNA, 20 bp, Homo sapiens
cagaacaggtgttggtgaca

SEQ ID NO: 3458757 - DNA, 24 bp, Homo sapiens
cagaacaggtgttggtgacaattg

SEQ ID NO: 3458758 - DNA, 15 bp, Homo sapiens
cagaaccctgccatg

SEQ ID NO: 3458759 - DNA, 16 bp, Homo sapiens
cagaaccttgttattt

SEQ ID NO: 3458760 - DNA, 21 bp, Homo sapiens
cagaaccttgttatttctcag

SEQ ID NO: 3458761 - DNA, 19 bp, Homo sapiens
cagaactaaactcatttat

SEQ ID NO: 3458762 - DNA, 20 bp, Homo sapiens
cagaactaaactcatttata

SEQ ID NO: 3458763 - DNA, 17 bp, Homo sapiens
cagaactcttaaaaatg

SEQ ID NO: 3458764 - DNA, 12 bp, Homo sapiens
cagctgcactga

SEQ ID NO: 3458765 - DNA, 15 bp, Homo sapiens
cagctgcagtcaaca

SEQ ID NO: 3458766 - DNA, 19 bp, Homo sapiens
cagctgcagtcaacagttc

SEQ ID NO: 3458767 - DNA, 15 bp, Homo sapiens
cagctgccccagcca

SEQ ID NO: 3458768 - DNA, 22 bp, Homo sapiens
cagctgccccggcccctccccc

SEQ ID NO: 3458769 - DNA, 11 bp, Homo sapiens
cagctgcctag

SEQ ID NO: 3458770 - DNA, 19 bp, Homo sapiens
cagctgccttagcttcagg

SEQ ID NO: 3458771 - DNA, 21 bp, Homo sapiens
cagctgccttagcttcaggaa

SEQ ID NO: 3458772 - DNA, 18 bp, Homo sapiens
cagctgcggtccacccag

SEQ ID NO: 3458773 - DNA, 19 bp, Homo sapiens
cagctgcggtccacccagg

SEQ ID NO: 3458774 - DNA, 12 bp, Homo sapiens
cagctgctccta

SEQ ID NO: 3458775 - DNA, 14 bp, Homo sapiens
cagctgctggagac

SEQ ID NO: 3458776 - DNA, 15 bp, Homo sapiens
cagctgctggagact

SEQ ID NO: 3458777 - DNA, 18 bp, Homo sapiens
cagctggatgatggtctt

SEQ ID NO: 3458778 - DNA, 19 bp, Homo sapiens
cagctgggctagaggctga

SEQ ID NO: 3458779 - DNA, 14 bp, Homo sapiens
cagctgggtcaggc

SEQ ID NO: 3458780 - DNA, 15 bp, Homo sapiens
cagctgggtcaggca

SEQ ID NO: 3458781 - DNA, 16 bp, Homo sapiens
cagctgggtcaggcag

SEQ ID NO: 3458782 - DNA, 17 bp, Homo sapiens
cagctgggtggcactgc

SEQ ID NO: 3458783 - DNA, 18 bp, Homo sapiens
cagctgggtggcactgcc

SEQ ID NO: 3458784 - DNA, 24 bp, Homo sapiens
cagctgtgctctggacaggcatgt

SEQ ID NO: 3458785 - DNA, 21 bp, Homo sapiens
cagcttatctcttttatattt

SEQ ID NO: 3458786 - DNA, 19 bp, Homo sapiens
cagcttcatttcctgtgtc

SEQ ID NO: 3458787 - DNA, 18 bp, Homo sapiens
cagcttcctgtccccatc

SEQ ID NO: 3458788 - DNA, 19 bp, Homo sapiens
cagcttctcatcctgcagg

SEQ ID NO: 3458789 - DNA, 16 bp, Homo sapiens
cagcttgacctgaggc

SEQ ID NO: 3458790 - DNA, 17 bp, Homo sapiens
cagcttgacctgaggct

SEQ ID NO: 3458791 - DNA, 20 bp, Homo sapiens
cagcttgacctgaggctgtg

SEQ ID NO: 3458792 - DNA, 14 bp, Homo sapiens
cagcttgagagggc

SEQ ID NO: 3458793 - DNA, 20 bp, Homo sapiens
cagcttgccagatgctgcag

SEQ ID NO: 3458794 - DNA, 15 bp, Homo sapiens
cagcttgctgtcact

SEQ ID NO: 3458795 - DNA, 21 bp, Homo sapiens
cagcttgtaaatagctcaggt

SEQ ID NO: 3458796 - DNA, 22 bp, Homo sapiens
cagcttgtaaatagctcaggtg

SEQ ID NO: 3458797 - DNA, 21 bp, Homo sapiens
cagctttctgaccttcagctc

SEQ ID NO: 3458798 - DNA, 17 bp, Homo sapiens
cagctttgatccctgac

SEQ ID NO: 3458799 - DNA, 12 bp, Homo sapiens
cagctttgctgc

SEQ ID NO: 3458800 - DNA, 23 bp, Homo sapiens
cagctttgtttgttgtcagctga

SEQ ID NO: 3458801 - DNA, 15 bp, Homo sapiens
caggaaaaatgaaaa

SEQ ID NO: 3458802 - DNA, 14 bp, Homo sapiens
caggaaaagcacaa

SEQ ID NO: 3458803 - DNA, 19 bp, Homo sapiens
caggaaaagctgctgacag

SEQ ID NO: 3458804 - DNA, 22 bp, Homo sapiens
caggaaacaaggggtctgagga

SEQ ID NO: 3458805 - DNA, 21 bp, Homo sapiens
caggaaatgaaaatgtcttgt

SEQ ID NO: 3458806 - DNA, 19 bp, Homo sapiens
caggaacctcgagtactgt

SEQ ID NO: 3458807 - DNA, 21 bp, Homo sapiens
caggaacctcgagtactgtgg

SEQ ID NO: 3458808 - DNA, 17 bp, Homo sapiens
caggaagctcagactgg

SEQ ID NO: 3458809 - DNA, 21 bp, Homo sapiens
caggaagctttggtgagaacc

SEQ ID NO: 3458810 - DNA, 23 bp, Homo sapiens
caggaagctttggtgagaacctg

SEQ ID NO: 3458811 - DNA, 13 bp, Homo sapiens
caggaatctcaga

SEQ ID NO: 3458812 - DNA, 17 bp, Homo sapiens
caggaatctcagagaca

SEQ ID NO: 3458813 - DNA, 16 bp, Homo sapiens
caggaatgtgtggcct

SEQ ID NO: 3458814 - DNA, 19 bp, Homo sapiens
caggaatgtgtggcctgca

SEQ ID NO: 3458815 - DNA, 16 bp, Homo sapiens
caggaatttcccagga

SEQ ID NO: 3458816 - DNA, 18 bp, Homo sapiens
caggaatttcccaggacc

SEQ ID NO: 3458817 - DNA, 15 bp, Homo sapiens
caggacaacgaggaa

SEQ ID NO: 3458818 - DNA, 18 bp, Homo sapiens
caggacaacgaggaagcc

SEQ ID NO: 3458819 - DNA, 13 bp, Homo sapiens
caggacacagtca

SEQ ID NO: 3458820 - DNA, 22 bp, Homo sapiens
caggacacctggccgcctccag

SEQ ID NO: 3458821 - DNA, 13 bp, Homo sapiens
caggacagatgcc

SEQ ID NO: 3458822 - DNA, 14 bp, Homo sapiens
caggacagatgcca

SEQ ID NO: 3458823 - DNA, 17 bp, Homo sapiens
caggacagatgccacac

SEQ ID NO: 3458824 - DNA, 13 bp, Homo sapiens
caggacatgctga

SEQ ID NO: 3458825 - DNA, 12 bp, Homo sapiens
caggaccagctc

SEQ ID NO: 3458826 - DNA, 12 bp, Homo sapiens
caggaccctcgc

SEQ ID NO: 3458827 - DNA, 17 bp, Homo sapiens
caggaccctgaaggggc

SEQ ID NO: 3458828 - DNA, 17 bp, Homo sapiens
caggacctccaagccac

SEQ ID NO: 3458829 - DNA, 20 bp, Homo sapiens
caggacctccaagccactga

SEQ ID NO: 3458830 - DNA, 15 bp, Homo sapiens
caggacctgcctgta

SEQ ID NO: 3458831 - DNA, 17 bp, Homo sapiens
caggacctggctgccat

SEQ ID NO: 3458832 - DNA, 18 bp, Homo sapiens
caggacctggctgccata

SEQ ID NO: 3458833 - DNA, 21 bp, Homo sapiens
caggaccttcgggctgtgccc

SEQ ID NO: 3458834 - DNA, 17 bp, Homo sapiens
caggacgtgggctgggc

SEQ ID NO: 3458835 - DNA, 18 bp, Homo sapiens
caggactcagaagcctct

SEQ ID NO: 3458836 - DNA, 18 bp, Homo sapiens
caggactcagctccccag

SEQ ID NO: 3458837 - DNA, 18 bp, Homo sapiens
caggactccaggcccaag

SEQ ID NO: 3458838 - DNA, 13 bp, Homo sapiens
caggactgcacag

SEQ ID NO: 3458839 - DNA, 19 bp, Homo sapiens
caggactgcagagcagatg

SEQ ID NO: 3458840 - DNA, 21 bp, Homo sapiens
caggactgcagagcagatggc

SEQ ID NO: 3458841 - DNA, 12 bp, Homo sapiens
caggactgggcc

SEQ ID NO: 3458842 - DNA, 19 bp, Homo sapiens
caggagaaggccaattcct

SEQ ID NO: 3458843 - DNA, 21 bp, Homo sapiens
caggagaaggccaattcctat

SEQ ID NO: 3458844 - DNA, 15 bp, Homo sapiens
caggagactgggctc

SEQ ID NO: 3458845 - DNA, 19 bp, Homo sapiens
caggagactgggctctggc

SEQ ID NO: 3458846 - DNA, 20 bp, Homo sapiens
caggagatggaagttgcagt

SEQ ID NO: 3458847 - DNA, 23 bp, Homo sapiens
caggagcagcctcagaacaaagt

SEQ ID NO: 3458848 - DNA, 15 bp, Homo sapiens
caggagccccgaggc

SEQ ID NO: 3458849 - DNA, 18 bp, Homo sapiens
caggagccccgaggcctt

SEQ ID NO: 3458850 - DNA, 22 bp, Homo sapiens
caggagccccgaggccttctct

SEQ ID NO: 3458851 - DNA, 16 bp, Homo sapiens
caggagcctaccccct

SEQ ID NO: 3458852 - DNA, 22 bp, Homo sapiens
caggagctgggatcctaagggc

SEQ ID NO: 3458853 - DNA, 19 bp, Homo sapiens
caggagctgtcaccaagga

SEQ ID NO: 3458854 - DNA, 21 bp, Homo sapiens
caggagctgtcaccaaggaaa

SEQ ID NO: 3458855 - DNA, 23 bp, Homo sapiens
caggagcttcctgtcctcccagc

SEQ ID NO: 3458856 - DNA, 18 bp, Homo sapiens
caggaggagttagccaaa

SEQ ID NO: 3458857 - DNA, 21 bp, Homo sapiens
caggaggcatctggaaagggg

SEQ ID NO: 3458858 - DNA, 22 bp, Homo sapiens
caggagggcgttcttaggctgc

SEQ ID NO: 3458859 - DNA, 19 bp, Homo sapiens
caggaggtttttttgtcaa

SEQ ID NO: 3458860 - DNA, 14 bp, Homo sapiens
caggagtccacttt

SEQ ID NO: 3458861 - DNA, 21 bp, Homo sapiens
caggagtgtcctcttccctct

SEQ ID NO: 3458862 - DNA, 17 bp, Homo sapiens
caggagttcgagaccag

SEQ ID NO: 3458863 - DNA, 21 bp, Homo sapiens
caggagttcgagaccagcctg

SEQ ID NO: 3458864 - DNA, 19 bp, Homo sapiens
caggatagagactggaaca

SEQ ID NO: 3458865 - DNA, 24 bp, Homo sapiens
caggatcagattgcatgtgactct

SEQ ID NO: 3458866 - DNA, 14 bp, Homo sapiens
caggatccagcctc

SEQ ID NO: 3458867 - DNA, 15 bp, Homo sapiens
caggatccagcctca

SEQ ID NO: 3458868 - DNA, 23 bp, Homo sapiens
caggatctcttagcattttaatt

SEQ ID NO: 3458869 - DNA, 15 bp, Homo sapiens
caggatggcctggcc

SEQ ID NO: 3458870 - DNA, 16 bp, Homo sapiens
caggatggcctggcca

SEQ ID NO: 3458871 - DNA, 17 bp, Homo sapiens
caggatggcctggccag

SEQ ID NO: 3458872 - DNA, 20 bp, Homo sapiens
caggatgtgtttgctttctg

SEQ ID NO: 3458873 - DNA, 17 bp, Homo sapiens
caggcaaattggggagg

SEQ ID NO: 3458874 - DNA, 16 bp, Homo sapiens
caggcaagcacctcct

SEQ ID NO: 3458875 - DNA, 14 bp, Homo sapiens
caggcaatgctggc

SEQ ID NO: 3458876 - DNA, 15 bp, Homo sapiens
caggcaatgctggct

SEQ ID NO: 3458877 - DNA, 12 bp, Homo sapiens
caggcacacagc

SEQ ID NO: 3458878 - DNA, 14 bp, Homo sapiens
caggcacaggacac

SEQ ID NO: 3458879 - DNA, 18 bp, Homo sapiens
caggcacccaccatcatg

SEQ ID NO: 3458880 - DNA, 10 bp, Homo sapiens
caggcagaca

SEQ ID NO: 3458881 - DNA, 18 bp, Homo sapiens
caggcagatacaggaaaa

SEQ ID NO: 3458882 - DNA, 13 bp, Homo sapiens
caggcagatccag

SEQ ID NO: 3458883 - DNA, 18 bp, Homo sapiens
caggcagatccaggacta

SEQ ID NO: 3458884 - DNA, 20 bp, Homo sapiens
caggcaggctaaggcgtgga

SEQ ID NO: 3458885 - DNA, 18 bp, Homo sapiens
caggcaggctcccaggga

SEQ ID NO: 3458886 - DNA, 20 bp, Homo sapiens
caggcagggccaacccttct

SEQ ID NO: 3458887 - DNA, 22 bp, Homo sapiens
caggcagggccaacccttctcc

SEQ ID NO: 3458888 - DNA, 22 bp, Homo sapiens
caggcaggtcttgaactcctgg

SEQ ID NO: 3458889 - DNA, 16 bp, Homo sapiens
caggcagtttcagaga

SEQ ID NO: 3458890 - DNA, 17 bp, Homo sapiens
caggcatggtggcccac

SEQ ID NO: 3458891 - DNA, 19 bp, Homo sapiens
caggccacctccccagcat

SEQ ID NO: 3458892 - DNA, 15 bp, Homo sapiens
caggccagagggagt

SEQ ID NO: 3458893 - DNA, 23 bp, Homo sapiens
caggccagagggagtgacagagg

SEQ ID NO: 3458894 - DNA, 15 bp, Homo sapiens
caggccattgtgaac

SEQ ID NO: 3458895 - DNA, 16 bp, Homo sapiens
caggcccaaggctccc

SEQ ID NO: 3458896 - DNA, 12 bp, Homo sapiens
catcaagccact

SEQ ID NO: 3458897 - DNA, 16 bp, Homo sapiens
catcaaggcactgcct

SEQ ID NO: 3458898 - DNA, 22 bp, Homo sapiens
catcaagtctttcacatttaaa

SEQ ID NO: 3458899 - DNA, 12 bp, Homo sapiens
catcacacacac

SEQ ID NO: 3458900 - DNA, 14 bp, Homo sapiens
catcacactgggtg

SEQ ID NO: 3458901 - DNA, 21 bp, Homo sapiens
catcacagatcgcatttccta

SEQ ID NO: 3458902 - DNA, 13 bp, Homo sapiens
catcacctccacc

SEQ ID NO: 3458903 - DNA, 14 bp, Homo sapiens
catcacctccacca

SEQ ID NO: 3458904 - DNA, 16 bp, Homo sapiens
catcaccttaggcagg

SEQ ID NO: 3458905 - DNA, 23 bp, Homo sapiens
catcactgagttttccatggcag

SEQ ID NO: 3458906 - DNA, 14 bp, Homo sapiens
catcactgttcatg

SEQ ID NO: 3458907 - DNA, 20 bp, Homo sapiens
catcactgttcatgctggcg

SEQ ID NO: 3458908 - DNA, 18 bp, Homo sapiens
catcagctaaacaccacg

SEQ ID NO: 3458909 - DNA, 20 bp, Homo sapiens
catcagctaaacaccacgtc

SEQ ID NO: 3458910 - DNA, 16 bp, Homo sapiens
catcagttagagctga

SEQ ID NO: 3458911 - DNA, 13 bp, Homo sapiens
catcatcagagcc

SEQ ID NO: 3458912 - DNA, 13 bp, Homo sapiens
catcatctcctgc

SEQ ID NO: 3458913 - DNA, 20 bp, Homo sapiens
catcatctcctgccttcctc

SEQ ID NO: 3458914 - DNA, 17 bp, Homo sapiens
catcatgagttctgctg

SEQ ID NO: 3458915 - DNA, 18 bp, Homo sapiens
catcatgagttctgctga

SEQ ID NO: 3458916 - DNA, 16 bp, Homo sapiens
catcatgcatcttact

SEQ ID NO: 3458917 - DNA, 20 bp, Homo sapiens
catcattccctctcatctca

SEQ ID NO: 3458918 - DNA, 12 bp, Homo sapiens
catcattctctg

SEQ ID NO: 3458919 - DNA, 14 bp, Homo sapiens
catcattctctgtc

SEQ ID NO: 3458920 - DNA, 22 bp, Homo sapiens
catcattttccatatcctggtg

SEQ ID NO: 3458921 - DNA, 15 bp, Homo sapiens
catccaaagcagaca

SEQ ID NO: 3458922 - DNA, 16 bp, Homo sapiens
catccaaagcagacag

SEQ ID NO: 3458923 - DNA, 17 bp, Homo sapiens
catccaaagcagacagc

SEQ ID NO: 3458924 - DNA, 14 bp, Homo sapiens
catccaatgctcaa

SEQ ID NO: 3458925 - DNA, 21 bp, Homo sapiens
catccactagtgcaaatcata

SEQ ID NO: 3458926 - DNA, 23 bp, Homo sapiens
catccagaactgctaccttccta

SEQ ID NO: 3458927 - DNA, 16 bp, Homo sapiens
catccagcagtctctg

SEQ ID NO: 3458928 - DNA, 15 bp, Homo sapiens
catccagcttgccag

SEQ ID NO: 3458929 - DNA, 11 bp, Homo sapiens
catccagggcc

SEQ ID NO: 3458930 - DNA, 14 bp, Homo sapiens
catccatcatcatg

SEQ ID NO: 3458931 - DNA, 16 bp, Homo sapiens
catccattgtctcttc

SEQ ID NO: 3458932 - DNA, 14 bp, Homo sapiens
catcccacaccctg

SEQ ID NO: 3458933 - DNA, 20 bp, Homo sapiens
catcccccactgccacaccc

SEQ ID NO: 3458934 - DNA, 23 bp, Homo sapiens
catcccccactgccacaccctcc

SEQ ID NO: 3458935 - DNA, 17 bp, Homo sapiens
catcccgagcacctcca

SEQ ID NO: 3458936 - DNA, 23 bp, Homo sapiens
catccctaccgacccagggttcc

SEQ ID NO: 3458937 - DNA, 21 bp, Homo sapiens
catccctgccagctcttctgc

SEQ ID NO: 3458938 - DNA, 16 bp, Homo sapiens
catccctttttgaagt

SEQ ID NO: 3458939 - DNA, 18 bp, Homo sapiens
catccctttttgaagtgt

SEQ ID NO: 3458940 - DNA, 20 bp, Homo sapiens
catccctttttgaagtgtag

SEQ ID NO: 3458941 - DNA, 20 bp, Homo sapiens
catccgcaggtgctggtccc

SEQ ID NO: 3458942 - DNA, 17 bp, Homo sapiens
catcctcaaacactgca

SEQ ID NO: 3458943 - DNA, 18 bp, Homo sapiens
catcctcaaacactgcag

SEQ ID NO: 3458944 - DNA, 19 bp, Homo sapiens
catcctcaaacactgcagg

SEQ ID NO: 3458945 - DNA, 22 bp, Homo sapiens
catcctcaaacactgcaggcat

SEQ ID NO: 3458946 - DNA, 13 bp, Homo sapiens
catcctccagcag

SEQ ID NO: 3458947 - DNA, 16 bp, Homo sapiens
catcctcctcccaccc

SEQ ID NO: 3458948 - DNA, 15 bp, Homo sapiens
catcctctgccctta

SEQ ID NO: 3458949 - DNA, 23 bp, Homo sapiens
catcctggcacccggcccctgct

SEQ ID NO: 3458950 - DNA, 13 bp, Homo sapiens
catcctggctgcg

SEQ ID NO: 3458951 - DNA, 17 bp, Homo sapiens
catcctgtttgtatgaa

SEQ ID NO: 3458952 - DNA, 19 bp, Homo sapiens
catcctgtttgtatgaaat

SEQ ID NO: 3458953 - DNA, 20 bp, Homo sapiens
catcctgtttgtatgaaatt

SEQ ID NO: 3458954 - DNA, 23 bp, Homo sapiens
catcctgtttgtatgaaattata

SEQ ID NO: 3458955 - DNA, 22 bp, Homo sapiens
catccttatccttcatctttta

SEQ ID NO: 3458956 - DNA, 22 bp, Homo sapiens
catccttccctgtctgccaggg

SEQ ID NO: 3458957 - DNA, 13 bp, Homo sapiens
catccttcccttt

SEQ ID NO: 3458958 - DNA, 21 bp, Homo sapiens
catcgaatctactaattccac

SEQ ID NO: 3458959 - DNA, 17 bp, Homo sapiens
catcgagatggagctac

SEQ ID NO: 3458960 - DNA, 18 bp, Homo sapiens
catcgcaccattctgact

SEQ ID NO: 3458961 - DNA, 19 bp, Homo sapiens
catcgcaccattctgactc

SEQ ID NO: 3458962 - DNA, 16 bp, Homo sapiens
catcggcctagggccc

SEQ ID NO: 3458963 - DNA, 16 bp, Homo sapiens
catcgtcatttgctgt

SEQ ID NO: 3458964 - DNA, 18 bp, Homo sapiens
catctagcaaatgttatg

SEQ ID NO: 3458965 - DNA, 20 bp, Homo sapiens
catctatggcagtccagcca

SEQ ID NO: 3458966 - DNA, 14 bp, Homo sapiens
catctattttggat

SEQ ID NO: 3458967 - DNA, 22 bp, Homo sapiens
catctcaattgtgctttgtatc

SEQ ID NO: 3458968 - DNA, 14 bp, Homo sapiens
catctcaggccaga

SEQ ID NO: 3458969 - DNA, 19 bp, Homo sapiens
catctcatgaggggagagg

SEQ ID NO: 3458970 - DNA, 23 bp, Homo sapiens
catctcatgaggggagaggagac

SEQ ID NO: 3458971 - DNA, 21 bp, Homo sapiens
catctcccacctagcagcacc

SEQ ID NO: 3458972 - DNA, 22 bp, Homo sapiens
catctcccagataatgtgaaaa

SEQ ID NO: 3458973 - DNA, 24 bp, Homo sapiens
catctcccccatcccccactgcca

SEQ ID NO: 3458974 - DNA, 13 bp, Homo sapiens
catctcccctcag

SEQ ID NO: 3458975 - DNA, 17 bp, Homo sapiens
catctcccctcagctcg

SEQ ID NO: 3458976 - DNA, 21 bp, Homo sapiens
catctcccctcagctcggctc

SEQ ID NO: 3458977 - DNA, 19 bp, Homo sapiens
catctcgctccctcccagg

SEQ ID NO: 3458978 - DNA, 20 bp, Homo sapiens
catctcgctccctcccagga

SEQ ID NO: 3458979 - DNA, 22 bp, Homo sapiens
catctcgctccctcccaggact

SEQ ID NO: 3458980 - DNA, 20 bp, Homo sapiens
catctctaacagctcaggat

SEQ ID NO: 3458981 - DNA, 21 bp, Homo sapiens
catctctaacagctcaggatc

SEQ ID NO: 3458982 - DNA, 16 bp, Homo sapiens
catctctacaaaaagc

SEQ ID NO: 3458983 - DNA, 15 bp, Homo sapiens
catctctctgcccaa

SEQ ID NO: 3458984 - DNA, 16 bp, Homo sapiens
catctctctgcccaac

SEQ ID NO: 3458985 - DNA, 21 bp, Homo sapiens
catctctgcttgagtcaggtt

SEQ ID NO: 3458986 - DNA, 15 bp, Homo sapiens
catctgaagagcaga

SEQ ID NO: 3458987 - DNA, 19 bp, Homo sapiens
catctgaaggggcaaattc

SEQ ID NO: 3458988 - DNA, 14 bp, Homo sapiens
catctgaccagcag

SEQ ID NO: 3458989 - DNA, 15 bp, Homo sapiens
catctgaccagcagc

SEQ ID NO: 3458990 - DNA, 19 bp, Homo sapiens
catctgcacccccctgggc

SEQ ID NO: 3458991 - DNA, 13 bp, Homo sapiens
catctgcatgtct

SEQ ID NO: 3458992 - DNA, 17 bp, Homo sapiens
catctgcattgcccagt

SEQ ID NO: 3458993 - DNA, 22 bp, Homo sapiens
catctgcccaactgtgtagcat

SEQ ID NO: 3458994 - DNA, 19 bp, Homo sapiens
catctgctggtccgtggga

SEQ ID NO: 3458995 - DNA, 15 bp, Homo sapiens
catctggaaaggggg

SEQ ID NO: 3458996 - DNA, 19 bp, Homo sapiens
catctggaatctgaggcat

SEQ ID NO: 3458997 - DNA, 16 bp, Homo sapiens
catctggaatctggag

SEQ ID NO: 3458998 - DNA, 17 bp, Homo sapiens
catctggctgcctttgc

SEQ ID NO: 3458999 - DNA, 20 bp, Homo sapiens
catctgggctcctccagggt

SEQ ID NO: 3459000 - DNA, 21 bp, Homo sapiens
catctggggcccatactggtt

SEQ ID NO: 3459001 - DNA, 20 bp, Homo sapiens
catctgtataagtaagaaaa

SEQ ID NO: 3459002 - DNA, 20 bp, Homo sapiens
catctgtcttgccagccaga

SEQ ID NO: 3459003 - DNA, 21 bp, Homo sapiens
catctgtgcactgcccatgga

SEQ ID NO: 3459004 - DNA, 11 bp, Homo sapiens
catctgtgtct

SEQ ID NO: 3459005 - DNA, 13 bp, Homo sapiens
catcttactgaag

SEQ ID NO: 3459006 - DNA, 22 bp, Homo sapiens
catcttacttggctttttacta

SEQ ID NO: 3459007 - DNA, 22 bp, Homo sapiens
catcttaggttggcaaaaaggc

SEQ ID NO: 3459008 - DNA, 15 bp, Homo sapiens
catcttcctgtgtcc

SEQ ID NO: 3459009 - DNA, 16 bp, Homo sapiens
catcttcctgtgtcct

SEQ ID NO: 3459010 - DNA, 17 bp, Homo sapiens
catcttcctgtgtcctg

SEQ ID NO: 3459011 - DNA, 15 bp, Homo sapiens
catcttcgggaccag

SEQ ID NO: 3459012 - DNA, 22 bp, Homo sapiens
catcttgaaaatattgaagaat

SEQ ID NO: 3459013 - DNA, 17 bp, Homo sapiens
catcttgaccaagcagg

SEQ ID NO: 3459014 - DNA, 20 bp, Homo sapiens
catcttgaccaagcaggaag

SEQ ID NO: 3459015 - DNA, 22 bp, Homo sapiens
catcttgccaagggtccctgtg

SEQ ID NO: 3459016 - DNA, 13 bp, Homo sapiens
catcttgctggct

SEQ ID NO: 3459017 - DNA, 14 bp, Homo sapiens
catcttgcttccct

SEQ ID NO: 3459018 - DNA, 22 bp, Homo sapiens
catctttacaaaactacatgag

SEQ ID NO: 3459019 - DNA, 17 bp, Homo sapiens
catctttattgaacttg

SEQ ID NO: 3459020 - DNA, 21 bp, Homo sapiens
catctttcctgatggcaggat

SEQ ID NO: 3459021 - DNA, 20 bp, Homo sapiens
catctttctcttttctaaaa

SEQ ID NO: 3459022 - DNA, 14 bp, Homo sapiens
catcttttaagaca

SEQ ID NO: 3459023 - DNA, 16 bp, Homo sapiens
catcttttaagacaaa

SEQ ID NO: 3459024 - DNA, 16 bp, Homo sapiens
catgaaatttttgtaa

SEQ ID NO: 3459025 - DNA, 17 bp, Homo sapiens
catgaaatttttgtaaa

SEQ ID NO: 3459026 - DNA, 16 bp, Homo sapiens
catgaagccaggtgtg

SEQ ID NO: 3459027 - DNA, 22 bp, Homo sapiens
catttcgtgagccccatcttca

SEQ ID NO: 3459028 - DNA, 19 bp, Homo sapiens
catttctatttctcctcca

SEQ ID NO: 3459029 - DNA, 17 bp, Homo sapiens
catttctgtattttttg

SEQ ID NO: 3459030 - DNA, 22 bp, Homo sapiens
catttctgtattttttgtttgt

SEQ ID NO: 3459031 - DNA, 15 bp, Homo sapiens
catttgaatgcattt

SEQ ID NO: 3459032 - DNA, 16 bp, Homo sapiens
catttgatgcatgtct

SEQ ID NO: 3459033 - DNA, 17 bp, Homo sapiens
catttgattaacatttg

SEQ ID NO: 3459034 - DNA, 17 bp, Homo sapiens
catttggaatttttgct

SEQ ID NO: 3459035 - DNA, 17 bp, Homo sapiens
catttggggtagctaga

SEQ ID NO: 3459036 - DNA, 16 bp, Homo sapiens
catttgtgctagaaat

SEQ ID NO: 3459037 - DNA, 22 bp, Homo sapiens
catttgtggtgatatagaatta

SEQ ID NO: 3459038 - DNA, 21 bp, Homo sapiens
cattttaaaaacatagaaaaa

SEQ ID NO: 3459039 - DNA, 16 bp, Homo sapiens
cattttactgttgtac

SEQ ID NO: 3459040 - DNA, 23 bp, Homo sapiens
cattttactgttgtacaatcatg

SEQ ID NO: 3459041 - DNA, 16 bp, Homo sapiens
cattttcagagtgaca

SEQ ID NO: 3459042 - DNA, 17 bp, Homo sapiens
cattttccatatcctgg

SEQ ID NO: 3459043 - DNA, 19 bp, Homo sapiens
cattttccatatcctggtg

SEQ ID NO: 3459044 - DNA, 13 bp, Homo sapiens
cattttctagata

SEQ ID NO: 3459045 - DNA, 17 bp, Homo sapiens
cattttctagatacaat

SEQ ID NO: 3459046 - DNA, 20 bp, Homo sapiens
cattttctagatacaataaa

SEQ ID NO: 3459047 - DNA, 23 bp, Homo sapiens
cattttctagatacaataaattg

SEQ ID NO: 3459048 - DNA, 22 bp, Homo sapiens
cattttcttgaatttttttctg

SEQ ID NO: 3459049 - DNA, 21 bp, Homo sapiens
cattttctttttttaactggt

SEQ ID NO: 3459050 - DNA, 12 bp, Homo sapiens
cattttgcactg

SEQ ID NO: 3459051 - DNA, 20 bp, Homo sapiens
cattttggggtacccactgc

SEQ ID NO: 3459052 - DNA, 22 bp, Homo sapiens
cattttggggtacccactgctc

SEQ ID NO: 3459053 - DNA, 15 bp, Homo sapiens
cattttggtgagaaa

SEQ ID NO: 3459054 - DNA, 20 bp, Homo sapiens
cattttgtttggtattgtat

SEQ ID NO: 3459055 - DNA, 22 bp, Homo sapiens
cattttgtttggtattgtattt

SEQ ID NO: 3459056 - DNA, 13 bp, Homo sapiens
catttttaaatgt

SEQ ID NO: 3459057 - DNA, 18 bp, Homo sapiens
catttttaccatcactga

SEQ ID NO: 3459058 - DNA, 19 bp, Homo sapiens
catttttcaactttgaata

SEQ ID NO: 3459059 - DNA, 19 bp, Homo sapiens
catttttccgtttgctttt

SEQ ID NO: 3459060 - DNA, 19 bp, Homo sapiens
catttttgtaataacattt

SEQ ID NO: 3459061 - DNA, 22 bp, Homo sapiens
catttttgtaataacatttaat

SEQ ID NO: 3459062 - DNA, 18 bp, Homo sapiens
cattttttaaaaaagcaa

SEQ ID NO: 3459063 - DNA, 17 bp, Homo sapiens
catttttttattcagca

SEQ ID NO: 3459064 - DNA, 22 bp, Homo sapiens
cattttttttttctttttgggg

SEQ ID NO: 3459065 - DNA, 22 bp, Homo sapiens
ccaaaaaagctgtattttgaaa

SEQ ID NO: 3459066 - DNA, 23 bp, Homo sapiens
ccaaaacctcatgacagccagag

SEQ ID NO: 3459067 - DNA, 19 bp, Homo sapiens
ccaaaataaaaaccttcca

SEQ ID NO: 3459068 - DNA, 23 bp, Homo sapiens
ccaaaatgtaggcttagtttgtg

SEQ ID NO: 3459069 - DNA, 22 bp, Homo sapiens
ccaaaatttattttataagaaa

SEQ ID NO: 3459070 - DNA, 21 bp, Homo sapiens
ccaaaattttgtcccatctct

SEQ ID NO: 3459071 - DNA, 16 bp, Homo sapiens
ccaaacaaatatgcaa

SEQ ID NO: 3459072 - DNA, 14 bp, Homo sapiens
ccaaacccatggct

SEQ ID NO: 3459073 - DNA, 14 bp, Homo sapiens
ccaaaccctgtctg

SEQ ID NO: 3459074 - DNA, 12 bp, Homo sapiens
ccaaacctctgt

SEQ ID NO: 3459075 - DNA, 13 bp, Homo sapiens
ccaaacctctgtt

SEQ ID NO: 3459076 - DNA, 17 bp, Homo sapiens
ccaaacctctgttcagt

SEQ ID NO: 3459077 - DNA, 13 bp, Homo sapiens
ccaaacgggagct

SEQ ID NO: 3459078 - DNA, 16 bp, Homo sapiens
ccaaacttggattttt

SEQ ID NO: 3459079 - DNA, 20 bp, Homo sapiens
ccaaagaaaaagggctgccg

SEQ ID NO: 3459080 - DNA, 16 bp, Homo sapiens
ccaaagagcctttcca

SEQ ID NO: 3459081 - DNA, 17 bp, Homo sapiens
ccaaagagcctttccaa

SEQ ID NO: 3459082 - DNA, 15 bp, Homo sapiens
ccaaagcagggtctg

SEQ ID NO: 3459083 - DNA, 16 bp, Homo sapiens
ccaaagctttcatgta

SEQ ID NO: 3459084 - DNA, 14 bp, Homo sapiens
ccaaaggaacactg

SEQ ID NO: 3459085 - DNA, 20 bp, Homo sapiens
ccaaaggccatggagagctg

SEQ ID NO: 3459086 - DNA, 22 bp, Homo sapiens
ccaaaggtgaaggaatatatgg

SEQ ID NO: 3459087 - DNA, 19 bp, Homo sapiens
ccaaagtgtcttttgacat

SEQ ID NO: 3459088 - DNA, 15 bp, Homo sapiens
ccaaataatgtctct

SEQ ID NO: 3459089 - DNA, 15 bp, Homo sapiens
ccaaatcccctaagc

SEQ ID NO: 3459090 - DNA, 22 bp, Homo sapiens
ccaaatctcaatgaagccagct

SEQ ID NO: 3459091 - DNA, 14 bp, Homo sapiens
ccaaatctggaagc

SEQ ID NO: 3459092 - DNA, 21 bp, Homo sapiens
ccaaatgctctctcttcttat

SEQ ID NO: 3459093 - DNA, 18 bp, Homo sapiens
ccaaatttaagactctcg

SEQ ID NO: 3459094 - DNA, 23 bp, Homo sapiens
ccaacaccaagcacagcagcctg

SEQ ID NO: 3459095 - DNA, 17 bp, Homo sapiens
ccaacacgcacctgcct

SEQ ID NO: 3459096 - DNA, 20 bp, Homo sapiens
ccaacacgcacctgcctcag

SEQ ID NO: 3459097 - DNA, 21 bp, Homo sapiens
ccaacactcaagaagcaggct

SEQ ID NO: 3459098 - DNA, 17 bp, Homo sapiens
ccaacatgtggctcctc

SEQ ID NO: 3459099 - DNA, 14 bp, Homo sapiens
ccaaccccagggcc

SEQ ID NO: 3459100 - DNA, 13 bp, Homo sapiens
ccaaccccccagc

SEQ ID NO: 3459101 - DNA, 20 bp, Homo sapiens
ccaaccccccagcactgagg

SEQ ID NO: 3459102 - DNA, 21 bp, Homo sapiens
ccaaccccccagcactgagga

SEQ ID NO: 3459103 - DNA, 13 bp, Homo sapiens
ccaacccttctcc

SEQ ID NO: 3459104 - DNA, 21 bp, Homo sapiens
ccaacctattttgaagtacca

SEQ ID NO: 3459105 - DNA, 13 bp, Homo sapiens
ccaacctgtttct

SEQ ID NO: 3459106 - DNA, 22 bp, Homo sapiens
ccaacctgtttctacctatatg

SEQ ID NO: 3459107 - DNA, 19 bp, Homo sapiens
ccaacgtgcaaagccaagg

SEQ ID NO: 3459108 - DNA, 22 bp, Homo sapiens
ccaacgtttggaagatcctgtg

SEQ ID NO: 3459109 - DNA, 17 bp, Homo sapiens
ccaactagcccctgggg

SEQ ID NO: 3459110 - DNA, 23 bp, Homo sapiens
ccaactatttattgactctgggt

SEQ ID NO: 3459111 - DNA, 14 bp, Homo sapiens
ccaactcagaaggg

SEQ ID NO: 3459112 - DNA, 23 bp, Homo sapiens
ccaactgaaggctaaaaagcaac

SEQ ID NO: 3459113 - DNA, 18 bp, Homo sapiens
ccaacttcttcagagctg

SEQ ID NO: 3459114 - DNA, 17 bp, Homo sapiens
ccaacttggctgcagga

SEQ ID NO: 3459115 - DNA, 17 bp, Homo sapiens
ccaagacctcagggcac

SEQ ID NO: 3459116 - DNA, 24 bp, Homo sapiens
ccaagagactccttgagagaccag

SEQ ID NO: 3459117 - DNA, 18 bp, Homo sapiens
ccaagagtccaggaggcc

SEQ ID NO: 3459118 - DNA, 18 bp, Homo sapiens
ccaagcaacagcctttga

SEQ ID NO: 3459119 - DNA, 14 bp, Homo sapiens
ccaagcacagcagc

SEQ ID NO: 3459120 - DNA, 17 bp, Homo sapiens
ccaagcacagcagcctg

SEQ ID NO: 3459121 - DNA, 18 bp, Homo sapiens
ccaagcacttctttttct

SEQ ID NO: 3459122 - DNA, 14 bp, Homo sapiens
ccaagcaggaagct

SEQ ID NO: 3459123 - DNA, 17 bp, Homo sapiens
ccaagcaggaagctcag

SEQ ID NO: 3459124 - DNA, 20 bp, Homo sapiens
ccaagcaggaagctcagact

SEQ ID NO: 3459125 - DNA, 19 bp, Homo sapiens
ccaagcaggacagtgcttg

SEQ ID NO: 3459126 - DNA, 17 bp, Homo sapiens
ccaagcagtgcctgcct

SEQ ID NO: 3459127 - DNA, 16 bp, Homo sapiens
ccaagccagaggctgg

SEQ ID NO: 3459128 - DNA, 17 bp, Homo sapiens
ccaagccagaggctggg

SEQ ID NO: 3459129 - DNA, 18 bp, Homo sapiens
ccaagccagctgcctagg

SEQ ID NO: 3459130 - DNA, 20 bp, Homo sapiens
ccaagctcaggaccaggcaa

SEQ ID NO: 3459131 - DNA, 15 bp, Homo sapiens
ccaagctccaagccc

SEQ ID NO: 3459132 - DNA, 17 bp, Homo sapiens
ccaagctccttgggagg

SEQ ID NO: 3459133 - DNA, 18 bp, Homo sapiens
ccaagcttcaaccctcag

SEQ ID NO: 3459134 - DNA, 22 bp, Homo sapiens
ccaagcttcaaccctcagcctt

SEQ ID NO: 3459135 - DNA, 23 bp, Homo sapiens
ccaagcttcaaccctcagccttg

SEQ ID NO: 3459136 - DNA, 14 bp, Homo sapiens
ccaaggagctgcta

SEQ ID NO: 3459137 - DNA, 16 bp, Homo sapiens
ccaaggagctgctata

SEQ ID NO: 3459138 - DNA, 22 bp, Homo sapiens
ccaaggagctgctatagcctgg

SEQ ID NO: 3459139 - DNA, 17 bp, Homo sapiens
ccaaggcagcgacccca

SEQ ID NO: 3459140 - DNA, 13 bp, Homo sapiens
ccaaggccaggtt

SEQ ID NO: 3459141 - DNA, 10 bp, Homo sapiens
ccaaggccta

SEQ ID NO: 3459142 - DNA, 14 bp, Homo sapiens
ccaaggcctaggac

SEQ ID NO: 3459143 - DNA, 17 bp, Homo sapiens
ccaagggaacctgtgtc

SEQ ID NO: 3459144 - DNA, 21 bp, Homo sapiens
ccaagggatctggtcctaccc

SEQ ID NO: 3459145 - DNA, 19 bp, Homo sapiens
ccaagggatgaaagagaag

SEQ ID NO: 3459146 - DNA, 13 bp, Homo sapiens
ccaagggccagac

SEQ ID NO: 3459147 - DNA, 21 bp, Homo sapiens
ccaagggctttgttttgcaca

SEQ ID NO: 3459148 - DNA, 21 bp, Homo sapiens
ccaaggtgtcatttatgtgtc

SEQ ID NO: 3459149 - DNA, 20 bp, Homo sapiens
ccaaggttggagcccagggc

SEQ ID NO: 3459150 - DNA, 20 bp, Homo sapiens
ccaaggttttataaggctga

SEQ ID NO: 3459151 - DNA, 14 bp, Homo sapiens
ccaagtagaggggc

SEQ ID NO: 3459152 - DNA, 17 bp, Homo sapiens
ccaagtcggcacccttt

SEQ ID NO: 3459153 - DNA, 13 bp, Homo sapiens
ccaagtcttctcc

SEQ ID NO: 3459154 - DNA, 18 bp, Homo sapiens
ccaagtgccaagacacag

SEQ ID NO: 3459155 - DNA, 13 bp, Homo sapiens
ccaagtggcagag

SEQ ID NO: 3459156 - DNA, 15 bp, Homo sapiens
ccaatacctcttgga

SEQ ID NO: 3459157 - DNA, 20 bp, Homo sapiens
ccaatatgccagcttggaca

SEQ ID NO: 3459158 - DNA, 23 bp, Homo sapiens
ccagctcaggacagatgccacac

SEQ ID NO: 3459159 - DNA, 20 bp, Homo sapiens
ccagctccaacctgcaaaga

SEQ ID NO: 3459160 - DNA, 12 bp, Homo sapiens
ccagctccccag

SEQ ID NO: 3459161 - DNA, 17 bp, Homo sapiens
ccagctccccaggactc

SEQ ID NO: 3459162 - DNA, 19 bp, Homo sapiens
ccagctccccaggactcac

SEQ ID NO: 3459163 - DNA, 18 bp, Homo sapiens
ccagctcccgctgtggcc

SEQ ID NO: 3459164 - DNA, 14 bp, Homo sapiens
ccagctccctctat

SEQ ID NO: 3459165 - DNA, 15 bp, Homo sapiens
ccagctcctgggcag

SEQ ID NO: 3459166 - DNA, 21 bp, Homo sapiens
ccagctctgaaaccagtgtta

SEQ ID NO: 3459167 - DNA, 14 bp, Homo sapiens
ccagctctgtatca

SEQ ID NO: 3459168 - DNA, 15 bp, Homo sapiens
ccagctgcaaagtgt

SEQ ID NO: 3459169 - DNA, 17 bp, Homo sapiens
ccagctgcaaagtgttt

SEQ ID NO: 3459170 - DNA, 20 bp, Homo sapiens
ccagctgccctatgggcctg

SEQ ID NO: 3459171 - DNA, 13 bp, Homo sapiens
ccagctggcagca

SEQ ID NO: 3459172 - DNA, 16 bp, Homo sapiens
ccagctgggtcaggca

SEQ ID NO: 3459173 - DNA, 15 bp, Homo sapiens
ccagctgtcaagggc

SEQ ID NO: 3459174 - DNA, 14 bp, Homo sapiens
ccagctgtgcttat

SEQ ID NO: 3459175 - DNA, 13 bp, Homo sapiens
ccagcttcccgag

SEQ ID NO: 3459176 - DNA, 18 bp, Homo sapiens
ccagcttgccagatgctg

SEQ ID NO: 3459177 - DNA, 17 bp, Homo sapiens
ccagcttgttatttata

SEQ ID NO: 3459178 - DNA, 24 bp, Homo sapiens
ccaggaaccacaccacatctaagc

SEQ ID NO: 3459179 - DNA, 20 bp, Homo sapiens
ccaggaagccgtgccctgcc

SEQ ID NO: 3459180 - DNA, 20 bp, Homo sapiens
ccaggaccagctcaggacag

SEQ ID NO: 3459181 - DNA, 18 bp, Homo sapiens
ccaggaccctgaaggggc

SEQ ID NO: 3459182 - DNA, 19 bp, Homo sapiens
ccaggaccctgaaggggcc

SEQ ID NO: 3459183 - DNA, 15 bp, Homo sapiens
ccaggactcaccctc

SEQ ID NO: 3459184 - DNA, 12 bp, Homo sapiens
ccaggactgggc

SEQ ID NO: 3459185 - DNA, 17 bp, Homo sapiens
ccaggactgggccactt

SEQ ID NO: 3459186 - DNA, 19 bp, Homo sapiens
ccaggagaagggctggggc

SEQ ID NO: 3459187 - DNA, 16 bp, Homo sapiens
ccaggagccccgaggc

SEQ ID NO: 3459188 - DNA, 18 bp, Homo sapiens
ccaggagcctaccccctg

SEQ ID NO: 3459189 - DNA, 20 bp, Homo sapiens
ccaggagcctaccccctgaa

SEQ ID NO: 3459190 - DNA, 20 bp, Homo sapiens
ccaggaggagttagccaaac

SEQ ID NO: 3459191 - DNA, 23 bp, Homo sapiens
ccaggaggccctggtcctggcct

SEQ ID NO: 3459192 - DNA, 21 bp, Homo sapiens
ccaggagtgtggccacgtggg

SEQ ID NO: 3459193 - DNA, 14 bp, Homo sapiens
ccaggatcagattg

SEQ ID NO: 3459194 - DNA, 21 bp, Homo sapiens
ccaggatggaacacggccaca

SEQ ID NO: 3459195 - DNA, 16 bp, Homo sapiens
ccaggcacggtttgga

SEQ ID NO: 3459196 - DNA, 20 bp, Homo sapiens
ccaggcaggctaaggcgtgg

SEQ ID NO: 3459197 - DNA, 21 bp, Homo sapiens
ccaggcaggctaaggcgtgga

SEQ ID NO: 3459198 - DNA, 16 bp, Homo sapiens
ccaggcattgccaagg

SEQ ID NO: 3459199 - DNA, 17 bp, Homo sapiens
ccaggccacctccccag

SEQ ID NO: 3459200 - DNA, 16 bp, Homo sapiens
ccaggccccaggaagc

SEQ ID NO: 3459201 - DNA, 19 bp, Homo sapiens
ccaggcccccaagcctgca

SEQ ID NO: 3459202 - DNA, 20 bp, Homo sapiens
ccaggcccccaagcctgcag

SEQ ID NO: 3459203 - DNA, 14 bp, Homo sapiens
ccaggcccctgcca

SEQ ID NO: 3459204 - DNA, 14 bp, Homo sapiens
ccaggccctgccag

SEQ ID NO: 3459205 - DNA, 21 bp, Homo sapiens
ccaggccctgccagagcaggg

SEQ ID NO: 3459206 - DNA, 16 bp, Homo sapiens
ccaggcctcttggcag

SEQ ID NO: 3459207 - DNA, 18 bp, Homo sapiens
ccaggcctcttggcagtc

SEQ ID NO: 3459208 - DNA, 15 bp, Homo sapiens
ccaggcctgagctgc

SEQ ID NO: 3459209 - DNA, 17 bp, Homo sapiens
ccaggcctgagctgctt

SEQ ID NO: 3459210 - DNA, 13 bp, Homo sapiens
ccaggcctgggcc

SEQ ID NO: 3459211 - DNA, 17 bp, Homo sapiens
ccaggcctgggccagag

SEQ ID NO: 3459212 - DNA, 18 bp, Homo sapiens
ccaggcgcggtggctcac

SEQ ID NO: 3459213 - DNA, 20 bp, Homo sapiens
ccaggctcctttagcgccca

SEQ ID NO: 3459214 - DNA, 21 bp, Homo sapiens
ccaggctcctttagcgcccag

SEQ ID NO: 3459215 - DNA, 15 bp, Homo sapiens
ccaggctgaccacag

SEQ ID NO: 3459216 - DNA, 17 bp, Homo sapiens
ccaggctgaccacagca

SEQ ID NO: 3459217 - DNA, 18 bp, Homo sapiens
ccaggctgaccacagcac

SEQ ID NO: 3459218 - DNA, 20 bp, Homo sapiens
ccaggctgaccacagcacag

SEQ ID NO: 3459219 - DNA, 21 bp, Homo sapiens
ccaggctgaccacagcacagc

SEQ ID NO: 3459220 - DNA, 15 bp, Homo sapiens
ccaggctgccgtggg

SEQ ID NO: 3459221 - DNA, 18 bp, Homo sapiens
ccaggctgggcaaggagg

SEQ ID NO: 3459222 - DNA, 14 bp, Homo sapiens
ccaggctggtctca

SEQ ID NO: 3459223 - DNA, 22 bp, Homo sapiens
ccaggctggtcttgaagtcctg

SEQ ID NO: 3459224 - DNA, 18 bp, Homo sapiens
ccaggcttgcctgcaggc

SEQ ID NO: 3459225 - DNA, 23 bp, Homo sapiens
ccaggcttgtcactagcagctgc

SEQ ID NO: 3459226 - DNA, 18 bp, Homo sapiens
ccagggacacctgggaga

SEQ ID NO: 3459227 - DNA, 20 bp, Homo sapiens
ccagggacacctgggagaaa

SEQ ID NO: 3459228 - DNA, 13 bp, Homo sapiens
ccagggacagagg

SEQ ID NO: 3459229 - DNA, 21 bp, Homo sapiens
ccagggacagaggccccagcc

SEQ ID NO: 3459230 - DNA, 23 bp, Homo sapiens
ccagggacagaggccccagcctc

SEQ ID NO: 3459231 - DNA, 15 bp, Homo sapiens
ccagggagaagctcc

SEQ ID NO: 3459232 - DNA, 16 bp, Homo sapiens
ccagggagacctggac

SEQ ID NO: 3459233 - DNA, 18 bp, Homo sapiens
ccagggagacctggacac

SEQ ID NO: 3459234 - DNA, 18 bp, Homo sapiens
ccagggagactccgctgt

SEQ ID NO: 3459235 - DNA, 22 bp, Homo sapiens
ccagggagactccgctgtggga

SEQ ID NO: 3459236 - DNA, 20 bp, Homo sapiens
ccagggagcattttcctcca

SEQ ID NO: 3459237 - DNA, 20 bp, Homo sapiens
ccagggaggtggaaggaccc

SEQ ID NO: 3459238 - DNA, 17 bp, Homo sapiens
ccagggcaagctccgca

SEQ ID NO: 3459239 - DNA, 22 bp, Homo sapiens
ccagggcaagggttaaggcctg

SEQ ID NO: 3459240 - DNA, 13 bp, Homo sapiens
ccagggcccagag

SEQ ID NO: 3459241 - DNA, 16 bp, Homo sapiens
ccagggcccccacagg

SEQ ID NO: 3459242 - DNA, 18 bp, Homo sapiens
ccagggcctgagcctggc

SEQ ID NO: 3459243 - DNA, 23 bp, Homo sapiens
ccagggcctgcaggacctgcctg

SEQ ID NO: 3459244 - DNA, 20 bp, Homo sapiens
ccagggcctggaagacagag

SEQ ID NO: 3459245 - DNA, 21 bp, Homo sapiens
ccagggcctggaagacagaga

SEQ ID NO: 3459246 - DNA, 12 bp, Homo sapiens
ccagggctcctg

SEQ ID NO: 3459247 - DNA, 20 bp, Homo sapiens
ccagggctcctgcacttact

SEQ ID NO: 3459248 - DNA, 14 bp, Homo sapiens
ccagggctgcccct

SEQ ID NO: 3459249 - DNA, 20 bp, Homo sapiens
ccagggctgctagacggagg

SEQ ID NO: 3459250 - DNA, 18 bp, Homo sapiens
ccagggctggactgaggc

SEQ ID NO: 3459251 - DNA, 22 bp, Homo sapiens
ccagggctggactgaggcctga

SEQ ID NO: 3459252 - DNA, 19 bp, Homo sapiens
ccaggggaaaatcagcctg

SEQ ID NO: 3459253 - DNA, 20 bp, Homo sapiens
ccaggggaaaatcagcctgc

SEQ ID NO: 3459254 - DNA, 16 bp, Homo sapiens
ccaggggagttgtgtc

SEQ ID NO: 3459255 - DNA, 18 bp, Homo sapiens
ccaggggatgagtggagg

SEQ ID NO: 3459256 - DNA, 23 bp, Homo sapiens
ccaggggggacaatatgtgccaa

SEQ ID NO: 3459257 - DNA, 18 bp, Homo sapiens
ccagggtccctctgtgta

SEQ ID NO: 3459258 - DNA, 13 bp, Homo sapiens
ccagggtccctgg

SEQ ID NO: 3459259 - DNA, 18 bp, Homo sapiens
ccagggttgaccccagag

SEQ ID NO: 3459260 - DNA, 21 bp, Homo sapiens
ccagggttgaccccagaggat

SEQ ID NO: 3459261 - DNA, 18 bp, Homo sapiens
ccaggtaccttgaccttt

SEQ ID NO: 3459262 - DNA, 16 bp, Homo sapiens
ccaggtctctccactg

SEQ ID NO: 3459263 - DNA, 21 bp, Homo sapiens
ccaggtctctccactgctctc

SEQ ID NO: 3459264 - DNA, 23 bp, Homo sapiens
ccaggtcttgaggagagagacag

SEQ ID NO: 3459265 - DNA, 15 bp, Homo sapiens
ccaggttcaacccac

SEQ ID NO: 3459266 - DNA, 14 bp, Homo sapiens
ccaggttcagcttg

SEQ ID NO: 3459267 - DNA, 15 bp, Homo sapiens
ccaggttcagcttgt

SEQ ID NO: 3459268 - DNA, 21 bp, Homo sapiens
ccaggttctccgttagctcct

SEQ ID NO: 3459269 - DNA, 22 bp, Homo sapiens
ccaggttctccgttagctcctg

SEQ ID NO: 3459270 - DNA, 23 bp, Homo sapiens
ccaggttctccgttagctcctgt

SEQ ID NO: 3459271 - DNA, 13 bp, Homo sapiens
ccaggtttaagct

SEQ ID NO: 3459272 - DNA, 14 bp, Homo sapiens
ccagtaccttgctt

SEQ ID NO: 3459273 - DNA, 13 bp, Homo sapiens
ccagtacttgtca

SEQ ID NO: 3459274 - DNA, 15 bp, Homo sapiens
ccagtacttgtcata

SEQ ID NO: 3459275 - DNA, 22 bp, Homo sapiens
ccagtcaaatctgggctcactc

SEQ ID NO: 3459276 - DNA, 19 bp, Homo sapiens
ccagtccaggctgccgtgg

SEQ ID NO: 3459277 - DNA, 16 bp, Homo sapiens
ccagtcccaccctgct

SEQ ID NO: 3459278 - DNA, 18 bp, Homo sapiens
ccagtccctgtccggaat

SEQ ID NO: 3459279 - DNA, 15 bp, Homo sapiens
ccagtcctgccacca

SEQ ID NO: 3459280 - DNA, 19 bp, Homo sapiens
ccagtcgaccccaaaggaa

SEQ ID NO: 3459281 - DNA, 15 bp, Homo sapiens
ccagtctcctctcca

SEQ ID NO: 3459282 - DNA, 18 bp, Homo sapiens
ccagtctggaatgcagtg

SEQ ID NO: 3459283 - DNA, 12 bp, Homo sapiens
ccagtctgtgga

SEQ ID NO: 3459284 - DNA, 17 bp, Homo sapiens
ccagtgaatttttgcaa

SEQ ID NO: 3459285 - DNA, 18 bp, Homo sapiens
ccagtgaatttttgcaat

SEQ ID NO: 3459286 - DNA, 17 bp, Homo sapiens
ccagtgacctgaggaag

SEQ ID NO: 3459287 - DNA, 18 bp, Homo sapiens
ccagtgacctgaggaagc

SEQ ID NO: 3459288 - DNA, 23 bp, Homo sapiens
ccagtgcccacaggatcagtctg

SEQ ID NO: 3459289 - DNA, 13 bp, Homo sapiens
ccccgccccctgc

SEQ ID NO: 3459290 - DNA, 17 bp, Homo sapiens
ccccgccccctgccctc

SEQ ID NO: 3459291 - DNA, 18 bp, Homo sapiens
ccccgccccctgccctcc

SEQ ID NO: 3459292 - DNA, 16 bp, Homo sapiens
ccccgcttccccacag

SEQ ID NO: 3459293 - DNA, 18 bp, Homo sapiens
ccccgcttccccacagaa

SEQ ID NO: 3459294 - DNA, 17 bp, Homo sapiens
ccccggtggctgggcag

SEQ ID NO: 3459295 - DNA, 13 bp, Homo sapiens
cccctactgctgt

SEQ ID NO: 3459296 - DNA, 14 bp, Homo sapiens
cccctactgctgtg

SEQ ID NO: 3459297 - DNA, 21 bp, Homo sapiens
cccctagccggttcctgtccc

SEQ ID NO: 3459298 - DNA, 15 bp, Homo sapiens
cccctcaacacctct

SEQ ID NO: 3459299 - DNA, 13 bp, Homo sapiens
cccctcacctact

SEQ ID NO: 3459300 - DNA, 15 bp, Homo sapiens
cccctcagctcggct

SEQ ID NO: 3459301 - DNA, 17 bp, Homo sapiens
cccctcagttgtgcagc

SEQ ID NO: 3459302 - DNA, 20 bp, Homo sapiens
cccctcatctctctgcccaa

SEQ ID NO: 3459303 - DNA, 13 bp, Homo sapiens
cccctcccagaac

SEQ ID NO: 3459304 - DNA, 12 bp, Homo sapiens
cccctcccagag

SEQ ID NO: 3459305 - DNA, 16 bp, Homo sapiens
cccctccgccctgcca

SEQ ID NO: 3459306 - DNA, 17 bp, Homo sapiens
cccctccgccctgccac

SEQ ID NO: 3459307 - DNA, 15 bp, Homo sapiens
cccctcctccactct

SEQ ID NO: 3459308 - DNA, 23 bp, Homo sapiens
cccctcctctgaaacagctgcct

SEQ ID NO: 3459309 - DNA, 13 bp, Homo sapiens
cccctccttcaga

SEQ ID NO: 3459310 - DNA, 22 bp, Homo sapiens
cccctccttccctgtgtctttt

SEQ ID NO: 3459311 - DNA, 23 bp, Homo sapiens
cccctctggtcgctcctgcccac

SEQ ID NO: 3459312 - DNA, 14 bp, Homo sapiens
cccctgatagaaga

SEQ ID NO: 3459313 - DNA, 20 bp, Homo sapiens
cccctgccaccaggccacct

SEQ ID NO: 3459314 - DNA, 15 bp, Homo sapiens
cccctgccacctcct

SEQ ID NO: 3459315 - DNA, 17 bp, Homo sapiens
cccctgccacctcctgc

SEQ ID NO: 3459316 - DNA, 14 bp, Homo sapiens
cccctgccagggca

SEQ ID NO: 3459317 - DNA, 15 bp, Homo sapiens
cccctgccagggcag

SEQ ID NO: 3459318 - DNA, 23 bp, Homo sapiens
cccctgccagggcagggccccag

SEQ ID NO: 3459319 - DNA, 17 bp, Homo sapiens
cccctgcccccaggact

SEQ ID NO: 3459320 - DNA, 23 bp, Homo sapiens
cccctgcccccaggactgggcca

SEQ ID NO: 3459321 - DNA, 17 bp, Homo sapiens
cccctgcccggctgcgg

SEQ ID NO: 3459322 - DNA, 13 bp, Homo sapiens
cccctgctggttc

SEQ ID NO: 3459323 - DNA, 14 bp, Homo sapiens
cccctgctgtctct

SEQ ID NO: 3459324 - DNA, 19 bp, Homo sapiens
cccctgctgtctctctggg

SEQ ID NO: 3459325 - DNA, 21 bp, Homo sapiens
cccctggacatgcctgtcctg

SEQ ID NO: 3459326 - DNA, 16 bp, Homo sapiens
cccctggccccgcctg

SEQ ID NO: 3459327 - DNA, 19 bp, Homo sapiens
cccctggctccttcaccac

SEQ ID NO: 3459328 - DNA, 11 bp, Homo sapiens
cccctggctct

SEQ ID NO: 3459329 - DNA, 15 bp, Homo sapiens
cccctggctctgggc

SEQ ID NO: 3459330 - DNA, 13 bp, Homo sapiens
cccctggggtggc

SEQ ID NO: 3459331 - DNA, 19 bp, Homo sapiens
cccctggggtggccaccag

SEQ ID NO: 3459332 - DNA, 15 bp, Homo sapiens
cccctggttctcatc

SEQ ID NO: 3459333 - DNA, 14 bp, Homo sapiens
cccctgtctagaga

SEQ ID NO: 3459334 - DNA, 22 bp, Homo sapiens
ccccttaatcttgctttcttta

SEQ ID NO: 3459335 - DNA, 14 bp, Homo sapiens
ccccttcacaaagc

SEQ ID NO: 3459336 - DNA, 11 bp, Homo sapiens
ccccttcccac

SEQ ID NO: 3459337 - DNA, 15 bp, Homo sapiens
ccccttcccacatat

SEQ ID NO: 3459338 - DNA, 19 bp, Homo sapiens
ccccttcgctcctgtgtct

SEQ ID NO: 3459339 - DNA, 16 bp, Homo sapiens
ccccttctcagaatct

SEQ ID NO: 3459340 - DNA, 17 bp, Homo sapiens
cccgaagagtcagcccc

SEQ ID NO: 3459341 - DNA, 16 bp, Homo sapiens
cccgaatagctgggac

SEQ ID NO: 3459342 - DNA, 13 bp, Homo sapiens
cccgagtagctgg

SEQ ID NO: 3459343 - DNA, 16 bp, Homo sapiens
cccgagtagctgggac

SEQ ID NO: 3459344 - DNA, 23 bp, Homo sapiens
cccgagtcattcgttctgtggag

SEQ ID NO: 3459345 - DNA, 15 bp, Homo sapiens
cccgcagacaccttg

SEQ ID NO: 3459346 - DNA, 21 bp, Homo sapiens
cccgcagacctctggattagg

SEQ ID NO: 3459347 - DNA, 22 bp, Homo sapiens
cccgcagagcgcgcccctagcc

SEQ ID NO: 3459348 - DNA, 18 bp, Homo sapiens
cccgccgcctggtactca

SEQ ID NO: 3459349 - DNA, 15 bp, Homo sapiens
cccgctgtggccgca

SEQ ID NO: 3459350 - DNA, 15 bp, Homo sapiens
cccgcttccccacag

SEQ ID NO: 3459351 - DNA, 18 bp, Homo sapiens
cccgcttccccacagaac

SEQ ID NO: 3459352 - DNA, 13 bp, Homo sapiens
cccggagaaggcc

SEQ ID NO: 3459353 - DNA, 19 bp, Homo sapiens
cccggagaaggccgctgcc

SEQ ID NO: 3459354 - DNA, 22 bp, Homo sapiens
cccggagaaggccgctgcccca

SEQ ID NO: 3459355 - DNA, 12 bp, Homo sapiens
cccggcagggcg

SEQ ID NO: 3459356 - DNA, 15 bp, Homo sapiens
cccggcccctgctgg

SEQ ID NO: 3459357 - DNA, 16 bp, Homo sapiens
cccggcccctgctggt

SEQ ID NO: 3459358 - DNA, 13 bp, Homo sapiens
cccggctccaggc

SEQ ID NO: 3459359 - DNA, 15 bp, Homo sapiens
cccggctccaggctc

SEQ ID NO: 3459360 - DNA, 12 bp, Homo sapiens
cccggctgcgga

SEQ ID NO: 3459361 - DNA, 22 bp, Homo sapiens
cccgggaacctccccagcctgc

SEQ ID NO: 3459362 - DNA, 14 bp, Homo sapiens
cccggggccagcac

SEQ ID NO: 3459363 - DNA, 16 bp, Homo sapiens
cccggggccagcactt

SEQ ID NO: 3459364 - DNA, 19 bp, Homo sapiens
cccgggggtggggggtggg

SEQ ID NO: 3459365 - DNA, 16 bp, Homo sapiens
cccgggtccccagctc

SEQ ID NO: 3459366 - DNA, 22 bp, Homo sapiens
cccggtctatgtcgagagctgg

SEQ ID NO: 3459367 - DNA, 22 bp, Homo sapiens
cccgtactttgtcccgtggcat

SEQ ID NO: 3459368 - DNA, 13 bp, Homo sapiens
cccgtcctgcctg

SEQ ID NO: 3459369 - DNA, 15 bp, Homo sapiens
cccgtcctgcctgtg

SEQ ID NO: 3459370 - DNA, 21 bp, Homo sapiens
cccgtgaggatgtcactcaga

SEQ ID NO: 3459371 - DNA, 20 bp, Homo sapiens
ccctaaggcatgtgtgaaac

SEQ ID NO: 3459372 - DNA, 22 bp, Homo sapiens
ccctaattcagccatgtacaga

SEQ ID NO: 3459373 - DNA, 17 bp, Homo sapiens
ccctactgctgtgaacc

SEQ ID NO: 3459374 - DNA, 19 bp, Homo sapiens
ccctacttcattttcagag

SEQ ID NO: 3459375 - DNA, 13 bp, Homo sapiens
ccctagactttag

SEQ ID NO: 3459376 - DNA, 22 bp, Homo sapiens
ccctagactttaggctttcagc

SEQ ID NO: 3459377 - DNA, 23 bp, Homo sapiens
ccctagttttctttcctcctttc

SEQ ID NO: 3459378 - DNA, 16 bp, Homo sapiens
ccctcaacacctctgc

SEQ ID NO: 3459379 - DNA, 16 bp, Homo sapiens
ccctcaagaacatgat

SEQ ID NO: 3459380 - DNA, 18 bp, Homo sapiens
ccctcagaacccttggct

SEQ ID NO: 3459381 - DNA, 21 bp, Homo sapiens
ccctcagaacccttggcttgc

SEQ ID NO: 3459382 - DNA, 13 bp, Homo sapiens
ccctcagccttga

SEQ ID NO: 3459383 - DNA, 16 bp, Homo sapiens
ccctcagctcggctca

SEQ ID NO: 3459384 - DNA, 19 bp, Homo sapiens
ccctcagctcggctcagct

SEQ ID NO: 3459385 - DNA, 14 bp, Homo sapiens
ccctcagttgtgca

SEQ ID NO: 3459386 - DNA, 19 bp, Homo sapiens
ccctcataccatctgctgc

SEQ ID NO: 3459387 - DNA, 12 bp, Homo sapiens
ccctcattaatg

SEQ ID NO: 3459388 - DNA, 17 bp, Homo sapiens
ccctccatgtgggctag

SEQ ID NO: 3459389 - DNA, 20 bp, Homo sapiens
ccctcccaggactctgaccc

SEQ ID NO: 3459390 - DNA, 17 bp, Homo sapiens
ccctccccgcccttttt

SEQ ID NO: 3459391 - DNA, 14 bp, Homo sapiens
ccctccctttctcc

SEQ ID NO: 3459392 - DNA, 18 bp, Homo sapiens
ccctccgccaggcgagat

SEQ ID NO: 3459393 - DNA, 13 bp, Homo sapiens
ccctccgccctgc

SEQ ID NO: 3459394 - DNA, 14 bp, Homo sapiens
ccctccgccctgcc

SEQ ID NO: 3459395 - DNA, 15 bp, Homo sapiens
ccctccgccctgcca

SEQ ID NO: 3459396 - DNA, 13 bp, Homo sapiens
ccctccgcctcca

SEQ ID NO: 3459397 - DNA, 17 bp, Homo sapiens
ccctcctaccctgcgcc

SEQ ID NO: 3459398 - DNA, 21 bp, Homo sapiens
ccctcctcactcccacctgca

SEQ ID NO: 3459399 - DNA, 14 bp, Homo sapiens
ccctcctccactct

SEQ ID NO: 3459400 - DNA, 21 bp, Homo sapiens
ccctcctctgaaacagctgcc

SEQ ID NO: 3459401 - DNA, 12 bp, Homo sapiens
ccctcctgaccc

SEQ ID NO: 3459402 - DNA, 12 bp, Homo sapiens
ccctccttcaga

SEQ ID NO: 3459403 - DNA, 14 bp, Homo sapiens
ccctcgctgccagc

SEQ ID NO: 3459404 - DNA, 13 bp, Homo sapiens
ccctctacaggtc

SEQ ID NO: 3459405 - DNA, 20 bp, Homo sapiens
ccctctcatctcaggtagaa

SEQ ID NO: 3459406 - DNA, 11 bp, Homo sapiens
ccctctccctg

SEQ ID NO: 3459407 - DNA, 21 bp, Homo sapiens
ccctctcctttgttcccggct

SEQ ID NO: 3459408 - DNA, 20 bp, Homo sapiens
ccctctctgcagacttccca

SEQ ID NO: 3459409 - DNA, 14 bp, Homo sapiens
ccctctctgctctg

SEQ ID NO: 3459410 - DNA, 15 bp, Homo sapiens
ccctctctgctctgc

SEQ ID NO: 3459411 - DNA, 13 bp, Homo sapiens
ccctctgccccat

SEQ ID NO: 3459412 - DNA, 18 bp, Homo sapiens
ccctctggagtggccact

SEQ ID NO: 3459413 - DNA, 15 bp, Homo sapiens
ccctctgggggctct

SEQ ID NO: 3459414 - DNA, 18 bp, Homo sapiens
ccctctggtcgctcctgc

SEQ ID NO: 3459415 - DNA, 13 bp, Homo sapiens
ccctcttctgagc

SEQ ID NO: 3459416 - DNA, 14 bp, Homo sapiens
ccctctttgctgca

SEQ ID NO: 3459417 - DNA, 20 bp, Homo sapiens
ccctgaaagtgacagagacc

SEQ ID NO: 3459418 - DNA, 21 bp, Homo sapiens
ccctgaagatttcagaggctg

SEQ ID NO: 3459419 - DNA, 17 bp, Homo sapiens
ccctgaaggggccatga

SEQ ID NO: 3459420 - DNA, 16 bp, Homo sapiens
ccctgaccctgtatat

SEQ ID NO: 3459421 - DNA, 16 bp, Homo sapiens
ccctgacctgtgagcc

SEQ ID NO: 3459422 - DNA, 19 bp, Homo sapiens
ccctgactcattctgaagg

SEQ ID NO: 3459423 - DNA, 19 bp, Homo sapiens
cctctctatatttcgggtc

SEQ ID NO: 3459424 - DNA, 12 bp, Homo sapiens
cctctctgcacc

SEQ ID NO: 3459425 - DNA, 23 bp, Homo sapiens
cctctctgcagacttcccagcta

SEQ ID NO: 3459426 - DNA, 18 bp, Homo sapiens
cctctctggggctgtgtt

SEQ ID NO: 3459427 - DNA, 14 bp, Homo sapiens
cctctgaaacagct

SEQ ID NO: 3459428 - DNA, 17 bp, Homo sapiens
cctctgaaacagctgcc

SEQ ID NO: 3459429 - DNA, 18 bp, Homo sapiens
cctctgaaacagctgcct

SEQ ID NO: 3459430 - DNA, 19 bp, Homo sapiens
cctctgaaacagctgcctt

SEQ ID NO: 3459431 - DNA, 22 bp, Homo sapiens
cctctgaaacagctgccttagc

SEQ ID NO: 3459432 - DNA, 19 bp, Homo sapiens
cctctgaaaccctggacca

SEQ ID NO: 3459433 - DNA, 18 bp, Homo sapiens
cctctgaaagttgtacat

SEQ ID NO: 3459434 - DNA, 20 bp, Homo sapiens
cctctgaatgaaccttctgg

SEQ ID NO: 3459435 - DNA, 15 bp, Homo sapiens
cctctgacacacagc

SEQ ID NO: 3459436 - DNA, 19 bp, Homo sapiens
cctctgacacacagctctg

SEQ ID NO: 3459437 - DNA, 21 bp, Homo sapiens
cctctgacacacagctctgtc

SEQ ID NO: 3459438 - DNA, 16 bp, Homo sapiens
cctctgactcagggct

SEQ ID NO: 3459439 - DNA, 16 bp, Homo sapiens
cctctgactccactca

SEQ ID NO: 3459440 - DNA, 21 bp, Homo sapiens
cctctgataatatattttcaa

SEQ ID NO: 3459441 - DNA, 15 bp, Homo sapiens
cctctgatacctcaa

SEQ ID NO: 3459442 - DNA, 21 bp, Homo sapiens
cctctgcctgaagtcacacag

SEQ ID NO: 3459443 - DNA, 13 bp, Homo sapiens
cctctgctcccca

SEQ ID NO: 3459444 - DNA, 14 bp, Homo sapiens
cctctgcttcccag

SEQ ID NO: 3459445 - DNA, 22 bp, Homo sapiens
cctctggcttgggcagggtctg

SEQ ID NO: 3459446 - DNA, 15 bp, Homo sapiens
cctctgggggctctg

SEQ ID NO: 3459447 - DNA, 19 bp, Homo sapiens
cctctgggggctctggcca

SEQ ID NO: 3459448 - DNA, 23 bp, Homo sapiens
cctctgggggctctggccaaggg

SEQ ID NO: 3459449 - DNA, 20 bp, Homo sapiens
cctctggtcgctcctgccca

SEQ ID NO: 3459450 - DNA, 17 bp, Homo sapiens
cctctgtaccccatgac

SEQ ID NO: 3459451 - DNA, 21 bp, Homo sapiens
cctctgtccaggcactgagat

SEQ ID NO: 3459452 - DNA, 22 bp, Homo sapiens
cctctgtccccttctctcatct

SEQ ID NO: 3459453 - DNA, 19 bp, Homo sapiens
cctctgtgaccaatgtctt

SEQ ID NO: 3459454 - DNA, 16 bp, Homo sapiens
cctctgtgctgtgtgt

SEQ ID NO: 3459455 - DNA, 16 bp, Homo sapiens
cctctgttcagtgtaa

SEQ ID NO: 3459456 - DNA, 13 bp, Homo sapiens
cctcttcagaggc

SEQ ID NO: 3459457 - DNA, 19 bp, Homo sapiens
cctcttccactccttctct

SEQ ID NO: 3459458 - DNA, 14 bp, Homo sapiens
cctcttctgagcta

SEQ ID NO: 3459459 - DNA, 13 bp, Homo sapiens
cctcttctgggag

SEQ ID NO: 3459460 - DNA, 16 bp, Homo sapiens
cctcttctgggcctga

SEQ ID NO: 3459461 - DNA, 20 bp, Homo sapiens
cctcttctgtccctgttaga

SEQ ID NO: 3459462 - DNA, 13 bp, Homo sapiens
cctcttgtaaata

SEQ ID NO: 3459463 - DNA, 12 bp, Homo sapiens
cctctttagagt

SEQ ID NO: 3459464 - DNA, 13 bp, Homo sapiens
cctctttgctttg

SEQ ID NO: 3459465 - DNA, 21 bp, Homo sapiens
cctctttgctttgctttctgc

SEQ ID NO: 3459466 - DNA, 23 bp, Homo sapiens
cctctttgtctaaaacaataaaa

SEQ ID NO: 3459467 - DNA, 18 bp, Homo sapiens
cctcttttacctgctgct

SEQ ID NO: 3459468 - DNA, 19 bp, Homo sapiens
cctcttttacctgctgctt

SEQ ID NO: 3459469 - DNA, 22 bp, Homo sapiens
cctcttttacctgctgcttctc

SEQ ID NO: 3459470 - DNA, 17 bp, Homo sapiens
cctcttttcctgaagaa

SEQ ID NO: 3459471 - DNA, 17 bp, Homo sapiens
cctgaaaacactgtgca

SEQ ID NO: 3459472 - DNA, 18 bp, Homo sapiens
cctgaaaacactgtgcac

SEQ ID NO: 3459473 - DNA, 21 bp, Homo sapiens
cctgaaacgctcctttgtgtg

SEQ ID NO: 3459474 - DNA, 14 bp, Homo sapiens
cctgaaactatatt

SEQ ID NO: 3459475 - DNA, 19 bp, Homo sapiens
cctgaaactatattttgtc

SEQ ID NO: 3459476 - DNA, 13 bp, Homo sapiens
cctgaaactttga

SEQ ID NO: 3459477 - DNA, 19 bp, Homo sapiens
cctgaaactttgaggataa

SEQ ID NO: 3459478 - DNA, 22 bp, Homo sapiens
cctgaaactttgaggataactt

SEQ ID NO: 3459479 - DNA, 23 bp, Homo sapiens
cctgaaactttgaggataacttt

SEQ ID NO: 3459480 - DNA, 18 bp, Homo sapiens
cctgaaagccctgagctt

SEQ ID NO: 3459481 - DNA, 13 bp, Homo sapiens
cctgaaagcggct

SEQ ID NO: 3459482 - DNA, 17 bp, Homo sapiens
cctgaaagcggctgcct

SEQ ID NO: 3459483 - DNA, 18 bp, Homo sapiens
cctgaagatttcagaggc

SEQ ID NO: 3459484 - DNA, 15 bp, Homo sapiens
cctgaagtcacacag

SEQ ID NO: 3459485 - DNA, 14 bp, Homo sapiens
cctgaatcatgagc

SEQ ID NO: 3459486 - DNA, 17 bp, Homo sapiens
cctgaatcatgagcctg

SEQ ID NO: 3459487 - DNA, 19 bp, Homo sapiens
cctgaatcatgagcctgct

SEQ ID NO: 3459488 - DNA, 21 bp, Homo sapiens
cctgaatcatgagcctgctgg

SEQ ID NO: 3459489 - DNA, 22 bp, Homo sapiens
cctgaatcatgagcctgctgga

SEQ ID NO: 3459490 - DNA, 15 bp, Homo sapiens
cctgacaaggccagc

SEQ ID NO: 3459491 - DNA, 23 bp, Homo sapiens
cctgaccaaacagccaactagcc

SEQ ID NO: 3459492 - DNA, 17 bp, Homo sapiens
cctgaccctgtatatag

SEQ ID NO: 3459493 - DNA, 16 bp, Homo sapiens
cctgacctccctctaa

SEQ ID NO: 3459494 - DNA, 20 bp, Homo sapiens
cctgacctgtgagcccagct

SEQ ID NO: 3459495 - DNA, 21 bp, Homo sapiens
cctgacctgtgagcccagctg

SEQ ID NO: 3459496 - DNA, 14 bp, Homo sapiens
cctgactgcccagc

SEQ ID NO: 3459497 - DNA, 13 bp, Homo sapiens
cctgactgctcag

SEQ ID NO: 3459498 - DNA, 22 bp, Homo sapiens
cctgagaaacccaccagcctaa

SEQ ID NO: 3459499 - DNA, 23 bp, Homo sapiens
cctgagagtcagctctctgccct

SEQ ID NO: 3459500 - DNA, 14 bp, Homo sapiens
cctgagcaactctt

SEQ ID NO: 3459501 - DNA, 23 bp, Homo sapiens
cctgagcaactcttgattatcca

SEQ ID NO: 3459502 - DNA, 12 bp, Homo sapiens
cctgagcctggc

SEQ ID NO: 3459503 - DNA, 13 bp, Homo sapiens
cctgagcctggcc

SEQ ID NO: 3459504 - DNA, 18 bp, Homo sapiens
cctgagctgaggcagcag

SEQ ID NO: 3459505 - DNA, 13 bp, Homo sapiens
cctgagctgcttc

SEQ ID NO: 3459506 - DNA, 23 bp, Homo sapiens
cctgaggaagcgtgaaggccgag

SEQ ID NO: 3459507 - DNA, 20 bp, Homo sapiens
cctgaggctttggatttgac

SEQ ID NO: 3459508 - DNA, 23 bp, Homo sapiens
cctgagtttccttttctgtctct

SEQ ID NO: 3459509 - DNA, 17 bp, Homo sapiens
cctgataaagcacagct

SEQ ID NO: 3459510 - DNA, 13 bp, Homo sapiens
cctgatagaagat

SEQ ID NO: 3459511 - DNA, 13 bp, Homo sapiens
cctgatcagagcc

SEQ ID NO: 3459512 - DNA, 15 bp, Homo sapiens
cctgatcctggaggc

SEQ ID NO: 3459513 - DNA, 19 bp, Homo sapiens
cctgatcctggaggcccag

SEQ ID NO: 3459514 - DNA, 20 bp, Homo sapiens
cctgatcctggaggcccagt

SEQ ID NO: 3459515 - DNA, 15 bp, Homo sapiens
cctgatgcagtcacg

SEQ ID NO: 3459516 - DNA, 16 bp, Homo sapiens
cctgatgcagtcacgt

SEQ ID NO: 3459517 - DNA, 23 bp, Homo sapiens
cctgatgctgacattcacctgcc

SEQ ID NO: 3459518 - DNA, 20 bp, Homo sapiens
cctgattgtgtatattcata

SEQ ID NO: 3459519 - DNA, 20 bp, Homo sapiens
cctgatttaggagaagccag

SEQ ID NO: 3459520 - DNA, 22 bp, Homo sapiens
cctgatttaggagaagccagga

SEQ ID NO: 3459521 - DNA, 19 bp, Homo sapiens
cctgcaaaaggactctcag

SEQ ID NO: 3459522 - DNA, 15 bp, Homo sapiens
cctgcaaacgctgcc

SEQ ID NO: 3459523 - DNA, 22 bp, Homo sapiens
cctgcaaacgctgcctgcccgt

SEQ ID NO: 3459524 - DNA, 18 bp, Homo sapiens
cctgcactccctcctgga

SEQ ID NO: 3459525 - DNA, 21 bp, Homo sapiens
cctgcactccctcctggagct

SEQ ID NO: 3459526 - DNA, 17 bp, Homo sapiens
cctgcacttgcagactc

SEQ ID NO: 3459527 - DNA, 22 bp, Homo sapiens
cctgcacttgcagactctacag

SEQ ID NO: 3459528 - DNA, 22 bp, Homo sapiens
cctgcagaagtaagcctcatca

SEQ ID NO: 3459529 - DNA, 17 bp, Homo sapiens
cctgcaggacctgcctg

SEQ ID NO: 3459530 - DNA, 18 bp, Homo sapiens
cctgcaggacctgcctgt

SEQ ID NO: 3459531 - DNA, 12 bp, Homo sapiens
cctgcaggccag

SEQ ID NO: 3459532 - DNA, 18 bp, Homo sapiens
cctgcaggccaggccagc

SEQ ID NO: 3459533 - DNA, 16 bp, Homo sapiens
cctgcatctaagccca

SEQ ID NO: 3459534 - DNA, 14 bp, Homo sapiens
cctgcatctggggc

SEQ ID NO: 3459535 - DNA, 23 bp, Homo sapiens
cctgcatgtaaacacgcctgcaa

SEQ ID NO: 3459536 - DNA, 16 bp, Homo sapiens
cctgccaccactataa

SEQ ID NO: 3459537 - DNA, 16 bp, Homo sapiens
cctgccaccagcatcc

SEQ ID NO: 3459538 - DNA, 19 bp, Homo sapiens
cctgccaccaggccacctc

SEQ ID NO: 3459539 - DNA, 12 bp, Homo sapiens
cctgccaccctg

SEQ ID NO: 3459540 - DNA, 22 bp, Homo sapiens
cctgccaccctggggagaaagt

SEQ ID NO: 3459541 - DNA, 13 bp, Homo sapiens
cctgccactcact

SEQ ID NO: 3459542 - DNA, 21 bp, Homo sapiens
cctgccactcactaggccccc

SEQ ID NO: 3459543 - DNA, 13 bp, Homo sapiens
cctgccagagcag

SEQ ID NO: 3459544 - DNA, 15 bp, Homo sapiens
cctgccaggcatggt

SEQ ID NO: 3459545 - DNA, 17 bp, Homo sapiens
cctgccagggcagggcc

SEQ ID NO: 3459546 - DNA, 19 bp, Homo sapiens
cctgccagggcagggcccc

SEQ ID NO: 3459547 - DNA, 22 bp, Homo sapiens
cctgccatggaactgtttcctt

SEQ ID NO: 3459548 - DNA, 14 bp, Homo sapiens
cctgcccacctgtc

SEQ ID NO: 3459549 - DNA, 13 bp, Homo sapiens
cctgcccaggccc

SEQ ID NO: 3459550 - DNA, 19 bp, Homo sapiens
cctgcccagtcgaccccaa

SEQ ID NO: 3459551 - DNA, 14 bp, Homo sapiens
cctgcccccaggac

SEQ ID NO: 3459552 - DNA, 16 bp, Homo sapiens
cctgcccccaggactg

SEQ ID NO: 3459553 - DNA, 17 bp, Homo sapiens
cctgcccgtgtacatag

SEQ ID NO: 3459554 - DNA, 16 bp, Homo sapiens
cctgccctcacctccc

SEQ ID NO: 3459555 - DNA, 13 bp, Homo sapiens
ccttgaattgtct

SEQ ID NO: 3459556 - DNA, 16 bp, Homo sapiens
ccttgacaactggcag

SEQ ID NO: 3459557 - DNA, 21 bp, Homo sapiens
ccttgacagggcacaccgggc

SEQ ID NO: 3459558 - DNA, 12 bp, Homo sapiens
ccttgaccaggc

SEQ ID NO: 3459559 - DNA, 20 bp, Homo sapiens
ccttgacctgcattgtaaat

SEQ ID NO: 3459560 - DNA, 16 bp, Homo sapiens
ccttgacctttgtaca

SEQ ID NO: 3459561 - DNA, 21 bp, Homo sapiens
ccttgaggaaacaacagcttt

SEQ ID NO: 3459562 - DNA, 14 bp, Homo sapiens
ccttgatctgtata

SEQ ID NO: 3459563 - DNA, 23 bp, Homo sapiens
ccttgatgactgccttgcctcct

SEQ ID NO: 3459564 - DNA, 13 bp, Homo sapiens
ccttgccagagat

SEQ ID NO: 3459565 - DNA, 21 bp, Homo sapiens
ccttgccagggaggtggaagg

SEQ ID NO: 3459566 - DNA, 15 bp, Homo sapiens
ccttgcctcctcagt

SEQ ID NO: 3459567 - DNA, 18 bp, Homo sapiens
ccttgcctttcgaggcct

SEQ ID NO: 3459568 - DNA, 20 bp, Homo sapiens
ccttgcctttcgaggcctga

SEQ ID NO: 3459569 - DNA, 20 bp, Homo sapiens
ccttgctgtatgctgatcat

SEQ ID NO: 3459570 - DNA, 21 bp, Homo sapiens
ccttgctgtatgctgatcatc

SEQ ID NO: 3459571 - DNA, 17 bp, Homo sapiens
ccttgcttttgcttcta

SEQ ID NO: 3459572 - DNA, 22 bp, Homo sapiens
ccttggaagttgcatggcatca

SEQ ID NO: 3459573 - DNA, 16 bp, Homo sapiens
ccttggacatcctcct

SEQ ID NO: 3459574 - DNA, 17 bp, Homo sapiens
ccttggacatcctcctc

SEQ ID NO: 3459575 - DNA, 17 bp, Homo sapiens
ccttggaggacagtggg

SEQ ID NO: 3459576 - DNA, 12 bp, Homo sapiens
ccttggaggcca

SEQ ID NO: 3459577 - DNA, 22 bp, Homo sapiens
ccttggcaccagacacccagga

SEQ ID NO: 3459578 - DNA, 13 bp, Homo sapiens
ccttggctgcagg

SEQ ID NO: 3459579 - DNA, 14 bp, Homo sapiens
ccttggctggtgca

SEQ ID NO: 3459580 - DNA, 21 bp, Homo sapiens
ccttggcttttactgaagcct

SEQ ID NO: 3459581 - DNA, 18 bp, Homo sapiens
ccttgggagccactgcca

SEQ ID NO: 3459582 - DNA, 19 bp, Homo sapiens
ccttgggagccactgccac

SEQ ID NO: 3459583 - DNA, 20 bp, Homo sapiens
ccttgggagccactgccact

SEQ ID NO: 3459584 - DNA, 12 bp, Homo sapiens
ccttgggccctt

SEQ ID NO: 3459585 - DNA, 14 bp, Homo sapiens
ccttgtccccatga

SEQ ID NO: 3459586 - DNA, 18 bp, Homo sapiens
ccttgttacccatgaaaa

SEQ ID NO: 3459587 - DNA, 21 bp, Homo sapiens
ccttgttcctagagtagagtg

SEQ ID NO: 3459588 - DNA, 16 bp, Homo sapiens
cctttaactcatgagg

SEQ ID NO: 3459589 - DNA, 19 bp, Homo sapiens
cctttaagcctgcattctt

SEQ ID NO: 3459590 - DNA, 14 bp, Homo sapiens
cctttacggacacc

SEQ ID NO: 3459591 - DNA, 17 bp, Homo sapiens
cctttactgaccctggg

SEQ ID NO: 3459592 - DNA, 12 bp, Homo sapiens
cctttagaaaat

SEQ ID NO: 3459593 - DNA, 20 bp, Homo sapiens
cctttagcgcccagttgggt

SEQ ID NO: 3459594 - DNA, 16 bp, Homo sapiens
cctttatcacctcatt

SEQ ID NO: 3459595 - DNA, 15 bp, Homo sapiens
cctttattgtgtttg

SEQ ID NO: 3459596 - DNA, 20 bp, Homo sapiens
cctttattgtgtttgtcatt

SEQ ID NO: 3459597 - DNA, 21 bp, Homo sapiens
cctttattgtgtttgtcatta

SEQ ID NO: 3459598 - DNA, 15 bp, Homo sapiens
cctttcaaatttaga

SEQ ID NO: 3459599 - DNA, 22 bp, Homo sapiens
cctttcaaatttagaaactaat

SEQ ID NO: 3459600 - DNA, 14 bp, Homo sapiens
cctttcctgtccca

SEQ ID NO: 3459601 - DNA, 13 bp, Homo sapiens
cctttcgaggcct

SEQ ID NO: 3459602 - DNA, 16 bp, Homo sapiens
cctttcgaggcctgaa

SEQ ID NO: 3459603 - DNA, 18 bp, Homo sapiens
cctttcgaggcctgaagc

SEQ ID NO: 3459604 - DNA, 19 bp, Homo sapiens
cctttctagagcactgcca

SEQ ID NO: 3459605 - DNA, 14 bp, Homo sapiens
cctttctcctttgt

SEQ ID NO: 3459606 - DNA, 15 bp, Homo sapiens
cctttctcctttgta

SEQ ID NO: 3459607 - DNA, 22 bp, Homo sapiens
cctttctcttttcccctttcct

SEQ ID NO: 3459608 - DNA, 19 bp, Homo sapiens
cctttctggcaggtcctcc

SEQ ID NO: 3459609 - DNA, 18 bp, Homo sapiens
cctttgaatgttaatttt

SEQ ID NO: 3459610 - DNA, 19 bp, Homo sapiens
cctttgagtgcagtcctga

SEQ ID NO: 3459611 - DNA, 21 bp, Homo sapiens
cctttgattaaagactccagt

SEQ ID NO: 3459612 - DNA, 13 bp, Homo sapiens
cctttgcctccag

SEQ ID NO: 3459613 - DNA, 14 bp, Homo sapiens
cctttgcctccaga

SEQ ID NO: 3459614 - DNA, 16 bp, Homo sapiens
cctttgcgcctgtgac

SEQ ID NO: 3459615 - DNA, 13 bp, Homo sapiens
cctttgctctttc

SEQ ID NO: 3459616 - DNA, 12 bp, Homo sapiens
cctttgggtatg

SEQ ID NO: 3459617 - DNA, 23 bp, Homo sapiens
cctttgggtatgttaacctaggc

SEQ ID NO: 3459618 - DNA, 14 bp, Homo sapiens
cctttggttctggc

SEQ ID NO: 3459619 - DNA, 16 bp, Homo sapiens
cctttggtttggcctc

SEQ ID NO: 3459620 - DNA, 19 bp, Homo sapiens
cctttggtttggcctccat

SEQ ID NO: 3459621 - DNA, 21 bp, Homo sapiens
cctttggtttggcctccatcc

SEQ ID NO: 3459622 - DNA, 14 bp, Homo sapiens
cctttgtgctctat

SEQ ID NO: 3459623 - DNA, 21 bp, Homo sapiens
cctttgtgtgtgtgtcagctg

SEQ ID NO: 3459624 - DNA, 14 bp, Homo sapiens
cctttgttcccggc

SEQ ID NO: 3459625 - DNA, 20 bp, Homo sapiens
ccttttactacagctatgaa

SEQ ID NO: 3459626 - DNA, 19 bp, Homo sapiens
ccttttgcagaagagggtg

SEQ ID NO: 3459627 - DNA, 12 bp, Homo sapiens
ccttttgccaat

SEQ ID NO: 3459628 - DNA, 12 bp, Homo sapiens
ccttttggggga

SEQ ID NO: 3459629 - DNA, 17 bp, Homo sapiens
ccttttgtagaatgaac

SEQ ID NO: 3459630 - DNA, 11 bp, Homo sapiens
cctttttaagg

SEQ ID NO: 3459631 - DNA, 22 bp, Homo sapiens
ccttttttcacggaagttttca

SEQ ID NO: 3459632 - DNA, 21 bp, Homo sapiens
ccttttttcccataagacaat

SEQ ID NO: 3459633 - DNA, 16 bp, Homo sapiens
ccttttttttttttcc

SEQ ID NO: 3459634 - DNA, 13 bp, Homo sapiens
cgaaaaccaggcc

SEQ ID NO: 3459635 - DNA, 22 bp, Homo sapiens
cgaaaaccaggccttatctcca

SEQ ID NO: 3459636 - DNA, 17 bp, Homo sapiens
cgaaacacagaaacctt

SEQ ID NO: 3459637 - DNA, 14 bp, Homo sapiens
cgaaaggatgagca

SEQ ID NO: 3459638 - DNA, 11 bp, Homo sapiens
cgaaaggcctt

SEQ ID NO: 3459639 - DNA, 19 bp, Homo sapiens
cgaaaggccttcagacaca

SEQ ID NO: 3459640 - DNA, 19 bp, Homo sapiens
cgaaagggacttggaagct

SEQ ID NO: 3459641 - DNA, 19 bp, Homo sapiens
cgaacatccaaccttccca

SEQ ID NO: 3459642 - DNA, 16 bp, Homo sapiens
cgaacctcctctgtga

SEQ ID NO: 3459643 - DNA, 17 bp, Homo sapiens
cgaaccttggcctgggc

SEQ ID NO: 3459644 - DNA, 19 bp, Homo sapiens
cgaaccttggcctgggccg

SEQ ID NO: 3459645 - DNA, 12 bp, Homo sapiens
cgaactggctgc

SEQ ID NO: 3459646 - DNA, 15 bp, Homo sapiens
cgaatagctgggact

SEQ ID NO: 3459647 - DNA, 16 bp, Homo sapiens
cgaatagctgggacta

SEQ ID NO: 3459648 - DNA, 17 bp, Homo sapiens
cgaatctactaattcca

SEQ ID NO: 3459649 - DNA, 16 bp, Homo sapiens
cgaatttctgtgccct

SEQ ID NO: 3459650 - DNA, 16 bp, Homo sapiens
cgacgcttgctctgtt

SEQ ID NO: 3459651 - DNA, 21 bp, Homo sapiens
cgactaaactagattttcact

SEQ ID NO: 3459652 - DNA, 14 bp, Homo sapiens
cgactaatttcaaa

SEQ ID NO: 3459653 - DNA, 20 bp, Homo sapiens
cgactctatagactctagga

SEQ ID NO: 3459654 - DNA, 19 bp, Homo sapiens
cgactctttctgagtgcct

SEQ ID NO: 3459655 - DNA, 22 bp, Homo sapiens
cgactctttctgagtgccttct

SEQ ID NO: 3459656 - DNA, 17 bp, Homo sapiens
cgactgcccggcagggt

SEQ ID NO: 3459657 - DNA, 17 bp, Homo sapiens
cgactggccagggccac

SEQ ID NO: 3459658 - DNA, 15 bp, Homo sapiens
cgacttcctgactct

SEQ ID NO: 3459659 - DNA, 17 bp, Homo sapiens
cgagaactttcattttt

SEQ ID NO: 3459660 - DNA, 15 bp, Homo sapiens
cgagaccagcctggc

SEQ ID NO: 3459661 - DNA, 14 bp, Homo sapiens
cgagaggtgggcca

SEQ ID NO: 3459662 - DNA, 14 bp, Homo sapiens
cgagagtctggccc

SEQ ID NO: 3459663 - DNA, 15 bp, Homo sapiens
cgagagtctggccct

SEQ ID NO: 3459664 - DNA, 17 bp, Homo sapiens
cgagagtctggccctag

SEQ ID NO: 3459665 - DNA, 20 bp, Homo sapiens
cgagagtctggccctagact

SEQ ID NO: 3459666 - DNA, 23 bp, Homo sapiens
cgagatggcagattcccactgcc

SEQ ID NO: 3459667 - DNA, 18 bp, Homo sapiens
cgagcacctccagcctga

SEQ ID NO: 3459668 - DNA, 21 bp, Homo sapiens
cgagcagtcctgcctcagcct

SEQ ID NO: 3459669 - DNA, 14 bp, Homo sapiens
cgagcccctcggct

SEQ ID NO: 3459670 - DNA, 16 bp, Homo sapiens
cgagcccctcggctct

SEQ ID NO: 3459671 - DNA, 21 bp, Homo sapiens
cgagcccctcggctctggagg

SEQ ID NO: 3459672 - DNA, 19 bp, Homo sapiens
cgagccctggtggcagtgg

SEQ ID NO: 3459673 - DNA, 23 bp, Homo sapiens
cgagccctgtggatgagccctca

SEQ ID NO: 3459674 - DNA, 14 bp, Homo sapiens
cgaggaaactcaga

SEQ ID NO: 3459675 - DNA, 12 bp, Homo sapiens
cgaggacaggga

SEQ ID NO: 3459676 - DNA, 19 bp, Homo sapiens
cgaggccagtacctttcca

SEQ ID NO: 3459677 - DNA, 23 bp, Homo sapiens
cgaggcctaccccgcagacacct

SEQ ID NO: 3459678 - DNA, 19 bp, Homo sapiens
cgagggctggctggcctca

SEQ ID NO: 3459679 - DNA, 13 bp, Homo sapiens
cgagtagctggga

SEQ ID NO: 3459680 - DNA, 16 bp, Homo sapiens
cgagtcacattctgct

SEQ ID NO: 3459681 - DNA, 20 bp, Homo sapiens
cgagtcattcgttctgtgga

SEQ ID NO: 3459682 - DNA, 21 bp, Homo sapiens
cgagtgctaagtgtaggatat

SEQ ID NO: 3459683 - DNA, 22 bp, Homo sapiens
cgagtgtgaagcttccttggct

SEQ ID NO: 3459684 - DNA, 19 bp, Homo sapiens
cgatactgcgactttctgc

SEQ ID NO: 3459685 - DNA, 23 bp, Homo sapiens
cgatactgcgactttctgcctgg

SEQ ID NO: 3459686 - DNA, 15 bp, Homo sapiens
cgatatactctagat

SEQ ID NO: 3459687 - DNA, 18 bp, Homo sapiens
cgatatcagaatttgtgt

SEQ ID NO: 3459688 - DNA, 17 bp, Homo sapiens
cgttgtctgtggatggt

SEQ ID NO: 3459689 - DNA, 17 bp, Homo sapiens
cgtttactatgcctgtg

SEQ ID NO: 3459690 - DNA, 19 bp, Homo sapiens
cgtttggaagatcctgtga

SEQ ID NO: 3459691 - DNA, 11 bp, Homo sapiens
ctaaaaaagat

SEQ ID NO: 3459692 - DNA, 13 bp, Homo sapiens
ctaaaaaagatat

SEQ ID NO: 3459693 - DNA, 15 bp, Homo sapiens
ctaaaaaagatatat

SEQ ID NO: 3459694 - DNA, 21 bp, Homo sapiens
ctaaaaatctgagaaactcta

SEQ ID NO: 3459695 - DNA, 20 bp, Homo sapiens
ctaaaagatataagtgctgt

SEQ ID NO: 3459696 - DNA, 21 bp, Homo sapiens
ctaaaagatataagtgctgta

SEQ ID NO: 3459697 - DNA, 22 bp, Homo sapiens
ctaaaataagggcagagtcaca

SEQ ID NO: 3459698 - DNA, 14 bp, Homo sapiens
ctaaaatagaatat

SEQ ID NO: 3459699 - DNA, 23 bp, Homo sapiens
ctaaaatagaatatagcatcttt

SEQ ID NO: 3459700 - DNA, 22 bp, Homo sapiens
ctaaaatgcctcagtgtatttg

SEQ ID NO: 3459701 - DNA, 19 bp, Homo sapiens
ctaaacaatgctgatttgg

SEQ ID NO: 3459702 - DNA, 18 bp, Homo sapiens
ctaaacatccaatatttt

SEQ ID NO: 3459703 - DNA, 17 bp, Homo sapiens
ctaaaccaaggactgag

SEQ ID NO: 3459704 - DNA, 20 bp, Homo sapiens
ctaaaccaaggactgagcac

SEQ ID NO: 3459705 - DNA, 19 bp, Homo sapiens
ctaaaccccagattcttca

SEQ ID NO: 3459706 - DNA, 22 bp, Homo sapiens
ctaaactcatttataaagctaa

SEQ ID NO: 3459707 - DNA, 11 bp, Homo sapiens
ctaaactgcat

SEQ ID NO: 3459708 - DNA, 14 bp, Homo sapiens
ctaaagactgggtt

SEQ ID NO: 3459709 - DNA, 19 bp, Homo sapiens
ctaaagagtttattttaag

SEQ ID NO: 3459710 - DNA, 18 bp, Homo sapiens
ctaaagccaaacatatat

SEQ ID NO: 3459711 - DNA, 15 bp, Homo sapiens
ctaaagtagagccct

SEQ ID NO: 3459712 - DNA, 11 bp, Homo sapiens
ctaaatccaaa

SEQ ID NO: 3459713 - DNA, 13 bp, Homo sapiens
ctaaatggcctca

SEQ ID NO: 3459714 - DNA, 16 bp, Homo sapiens
ctaaattttctgaaac

SEQ ID NO: 3459715 - DNA, 22 bp, Homo sapiens
ctaacaatcagctccttcctgg

SEQ ID NO: 3459716 - DNA, 14 bp, Homo sapiens
ctaacacttacccc

SEQ ID NO: 3459717 - DNA, 13 bp, Homo sapiens
ctaactaaactct

SEQ ID NO: 3459718 - DNA, 17 bp, Homo sapiens
ctaactccttaacaact

SEQ ID NO: 3459719 - DNA, 15 bp, Homo sapiens
ctaactgtaaatcat

SEQ ID NO: 3459720 - DNA, 17 bp, Homo sapiens
ctaactgtaaatcatgt

SEQ ID NO: 3459721 - DNA, 15 bp, Homo sapiens
ctaagaagctctggc

SEQ ID NO: 3459722 - DNA, 21 bp, Homo sapiens
ctaagaagctctggccccagg

SEQ ID NO: 3459723 - DNA, 20 bp, Homo sapiens
ctaagaatacagctttctga

SEQ ID NO: 3459724 - DNA, 12 bp, Homo sapiens
ctaagagtgtcc

SEQ ID NO: 3459725 - DNA, 21 bp, Homo sapiens
ctaagagttgagctctcggaa

SEQ ID NO: 3459726 - DNA, 13 bp, Homo sapiens
ctaagcagaggag

SEQ ID NO: 3459727 - DNA, 18 bp, Homo sapiens
ctaagcagaggaggggcc

SEQ ID NO: 3459728 - DNA, 23 bp, Homo sapiens
ctaagcagaggaggggccgctgc

SEQ ID NO: 3459729 - DNA, 15 bp, Homo sapiens
ctaagccccagcaag

SEQ ID NO: 3459730 - DNA, 11 bp, Homo sapiens
ctaagcctgtg

SEQ ID NO: 3459731 - DNA, 13 bp, Homo sapiens
ctaagcctgtggc

SEQ ID NO: 3459732 - DNA, 23 bp, Homo sapiens
ctaaggaggggaaaaaaatgttg

SEQ ID NO: 3459733 - DNA, 20 bp, Homo sapiens
ctaaggcatgtgtgaaacat

SEQ ID NO: 3459734 - DNA, 16 bp, Homo sapiens
ctaaggcgtggagctg

SEQ ID NO: 3459735 - DNA, 17 bp, Homo sapiens
ctaaggcgtggagctgc

SEQ ID NO: 3459736 - DNA, 19 bp, Homo sapiens
ctaaggcgtggagctgcct

SEQ ID NO: 3459737 - DNA, 18 bp, Homo sapiens
ctaaggggcccggccagc

SEQ ID NO: 3459738 - DNA, 21 bp, Homo sapiens
ctaagtacctttcctacattt

SEQ ID NO: 3459739 - DNA, 16 bp, Homo sapiens
ctaagtctttccattg

SEQ ID NO: 3459740 - DNA, 13 bp, Homo sapiens
ctaagttcacagt

SEQ ID NO: 3459741 - DNA, 21 bp, Homo sapiens
ctaagttcacagtgtttctta

SEQ ID NO: 3459742 - DNA, 18 bp, Homo sapiens
ctaagttttcaaatttgt

SEQ ID NO: 3459743 - DNA, 12 bp, Homo sapiens
ctaataaaccag

SEQ ID NO: 3459744 - DNA, 20 bp, Homo sapiens
ctaatagaactcagttttaa

SEQ ID NO: 3459745 - DNA, 16 bp, Homo sapiens
ctaatcatccaatgct

SEQ ID NO: 3459746 - DNA, 18 bp, Homo sapiens
ctaatctatggtcgggag

SEQ ID NO: 3459747 - DNA, 12 bp, Homo sapiens
ctaatgaccaac

SEQ ID NO: 3459748 - DNA, 19 bp, Homo sapiens
ctaatgctccttgttccta

SEQ ID NO: 3459749 - DNA, 14 bp, Homo sapiens
ctaatggcatgaga

SEQ ID NO: 3459750 - DNA, 12 bp, Homo sapiens
ctaatgggacac

SEQ ID NO: 3459751 - DNA, 18 bp, Homo sapiens
ctaatgttgctggatcag

SEQ ID NO: 3459752 - DNA, 20 bp, Homo sapiens
ctaattaaaacactttcaaa

SEQ ID NO: 3459753 - DNA, 18 bp, Homo sapiens
ctaattaaccttactaat

SEQ ID NO: 3459754 - DNA, 18 bp, Homo sapiens
ctaattcttctgtcctga

SEQ ID NO: 3459755 - DNA, 17 bp, Homo sapiens
ctaattgactttagaaa

SEQ ID NO: 3459756 - DNA, 17 bp, Homo sapiens
ctaatttcaaaatgctt

SEQ ID NO: 3459757 - DNA, 21 bp, Homo sapiens
ctaatttgcattaaattcaca

SEQ ID NO: 3459758 - DNA, 13 bp, Homo sapiens
ctacaaacaaaat

SEQ ID NO: 3459759 - DNA, 15 bp, Homo sapiens
ctacaaacaaaattt

SEQ ID NO: 3459760 - DNA, 20 bp, Homo sapiens
ctacaaacaaaatttctatt

SEQ ID NO: 3459761 - DNA, 10 bp, Homo sapiens
ctacaaatca

SEQ ID NO: 3459762 - DNA, 13 bp, Homo sapiens
ctacaatgtgaac

SEQ ID NO: 3459763 - DNA, 17 bp, Homo sapiens
ctacaatgtgaacttta

SEQ ID NO: 3459764 - DNA, 18 bp, Homo sapiens
ctacaattcctctgataa

SEQ ID NO: 3459765 - DNA, 14 bp, Homo sapiens
ctacacagggatgt

SEQ ID NO: 3459766 - DNA, 20 bp, Homo sapiens
ctacacctttctcctttgta

SEQ ID NO: 3459767 - DNA, 15 bp, Homo sapiens
ctacactgacactgg

SEQ ID NO: 3459768 - DNA, 17 bp, Homo sapiens
ctacagagcttccctga

SEQ ID NO: 3459769 - DNA, 20 bp, Homo sapiens
ctacagagcttccctgactc

SEQ ID NO: 3459770 - DNA, 18 bp, Homo sapiens
ctacagccttgtccccct

SEQ ID NO: 3459771 - DNA, 19 bp, Homo sapiens
ctacagccttgtccccctc

SEQ ID NO: 3459772 - DNA, 19 bp, Homo sapiens
ctacagttgaaaaacagct

SEQ ID NO: 3459773 - DNA, 17 bp, Homo sapiens
ctacatgagaacaaaca

SEQ ID NO: 3459774 - DNA, 12 bp, Homo sapiens
ctacattttctt

SEQ ID NO: 3459775 - DNA, 21 bp, Homo sapiens
ctacattttctttttttatta

SEQ ID NO: 3459776 - DNA, 19 bp, Homo sapiens
ctaccaagctatcctggct

SEQ ID NO: 3459777 - DNA, 15 bp, Homo sapiens
ctaccacacatctgt

SEQ ID NO: 3459778 - DNA, 12 bp, Homo sapiens
ctaccactcctg

SEQ ID NO: 3459779 - DNA, 14 bp, Homo sapiens
ctaccactcctgcc

SEQ ID NO: 3459780 - DNA, 21 bp, Homo sapiens
ctaccagcgtatatataagaa

SEQ ID NO: 3459781 - DNA, 19 bp, Homo sapiens
ctacccaaaacaagcctgg

SEQ ID NO: 3459782 - DNA, 13 bp, Homo sapiens
ctacccaccctcc

SEQ ID NO: 3459783 - DNA, 15 bp, Homo sapiens
ctacccagcgagccc

SEQ ID NO: 3459784 - DNA, 11 bp, Homo sapiens
ctacccagggc

SEQ ID NO: 3459785 - DNA, 13 bp, Homo sapiens
ctaccccctgaaa

SEQ ID NO: 3459786 - DNA, 20 bp, Homo sapiens
ctaccccgcagacaccttgg

SEQ ID NO: 3459787 - DNA, 17 bp, Homo sapiens
ctaccctcttagaaaaa

SEQ ID NO: 3459788 - DNA, 12 bp, Homo sapiens
ctaccctgagct

SEQ ID NO: 3459789 - DNA, 18 bp, Homo sapiens
ctaccctgagctgaggca

SEQ ID NO: 3459790 - DNA, 17 bp, Homo sapiens
ctaccctgtgctaagca

SEQ ID NO: 3459791 - DNA, 14 bp, Homo sapiens
ctacctatatgcag

SEQ ID NO: 3459792 - DNA, 11 bp, Homo sapiens
ctacctccctc

SEQ ID NO: 3459793 - DNA, 19 bp, Homo sapiens
ctacctgacactcccttgg

SEQ ID NO: 3459794 - DNA, 17 bp, Homo sapiens
ctaccttctctacccat

SEQ ID NO: 3459795 - DNA, 13 bp, Homo sapiens
ctaccttctttgg

SEQ ID NO: 3459796 - DNA, 19 bp, Homo sapiens
ctaccttgaaaataagaat

SEQ ID NO: 3459797 - DNA, 19 bp, Homo sapiens
ctacgcctcttctgtccct

SEQ ID NO: 3459798 - DNA, 19 bp, Homo sapiens
ctactaaaaatacaaaaat

SEQ ID NO: 3459799 - DNA, 20 bp, Homo sapiens
ctactaaaagtttagaactt

SEQ ID NO: 3459800 - DNA, 23 bp, Homo sapiens
ctactaacaatcagctccttcct

SEQ ID NO: 3459801 - DNA, 12 bp, Homo sapiens
ctactaataaac

SEQ ID NO: 3459802 - DNA, 18 bp, Homo sapiens
ctactagctctttgagat

SEQ ID NO: 3459803 - DNA, 21 bp, Homo sapiens
ctactcataagttggaccaga

SEQ ID NO: 3459804 - DNA, 20 bp, Homo sapiens
ctactcgcttgctagaagta

SEQ ID NO: 3459805 - DNA, 17 bp, Homo sapiens
ctactctccccacgagg

SEQ ID NO: 3459806 - DNA, 19 bp, Homo sapiens
ctactctccccacgagggc

SEQ ID NO: 3459807 - DNA, 21 bp, Homo sapiens
ctactctccccacgagggctg

SEQ ID NO: 3459808 - DNA, 23 bp, Homo sapiens
ctactctccccacgagggctggc

SEQ ID NO: 3459809 - DNA, 17 bp, Homo sapiens
ctactctcctcatctct

SEQ ID NO: 3459810 - DNA, 12 bp, Homo sapiens
ctactctgtgtc

SEQ ID NO: 3459811 - DNA, 16 bp, Homo sapiens
ctactctgtgtcaggt

SEQ ID NO: 3459812 - DNA, 21 bp, Homo sapiens
ctactctgtgtcaggtggggc

SEQ ID NO: 3459813 - DNA, 19 bp, Homo sapiens
ctactctgttccttcacat

SEQ ID NO: 3459814 - DNA, 16 bp, Homo sapiens
ctactgcaagagccaa

SEQ ID NO: 3459815 - DNA, 15 bp, Homo sapiens
ctactgcccaggcac

SEQ ID NO: 3459816 - DNA, 20 bp, Homo sapiens
ctactgctgtgaaccctggg

SEQ ID NO: 3459817 - DNA, 22 bp, Homo sapiens
ctactgtaataaagatgattgt

SEQ ID NO: 3459818 - DNA, 15 bp, Homo sapiens
ctactgtgtgtgtga

SEQ ID NO: 3459819 - DNA, 17 bp, Homo sapiens
ctactgtgtgtgtgaat

SEQ ID NO: 3459820 - DNA, 20 bp, Homo sapiens
ctactgtgtgtgtgaatgaa

SEQ ID NO: 3459821 - DNA, 21 bp, Homo sapiens
ctcagccttgccagagatcca

SEQ ID NO: 3459822 - DNA, 22 bp, Homo sapiens
ctcagccttgccagagatccaa

SEQ ID NO: 3459823 - DNA, 14 bp, Homo sapiens
ctcagcggggacag

SEQ ID NO: 3459824 - DNA, 15 bp, Homo sapiens
ctcagcggggacagc

SEQ ID NO: 3459825 - DNA, 20 bp, Homo sapiens
ctcagcggggacagctcctt

SEQ ID NO: 3459826 - DNA, 21 bp, Homo sapiens
ctcagcggggacagctccttc

SEQ ID NO: 3459827 - DNA, 15 bp, Homo sapiens
ctcagctcggctcag

SEQ ID NO: 3459828 - DNA, 19 bp, Homo sapiens
ctcagctctggtccaggcc

SEQ ID NO: 3459829 - DNA, 23 bp, Homo sapiens
ctcagctggatgatggtcttcag

SEQ ID NO: 3459830 - DNA, 14 bp, Homo sapiens
ctcaggacagatgc

SEQ ID NO: 3459831 - DNA, 14 bp, Homo sapiens
ctcaggactcagaa

SEQ ID NO: 3459832 - DNA, 16 bp, Homo sapiens
ctcaggactcagaagc

SEQ ID NO: 3459833 - DNA, 21 bp, Homo sapiens
ctcaggactcagaagcctctg

SEQ ID NO: 3459834 - DNA, 14 bp, Homo sapiens
ctcaggactgcgac

SEQ ID NO: 3459835 - DNA, 22 bp, Homo sapiens
ctcaggagcttgcaagaagcag

SEQ ID NO: 3459836 - DNA, 16 bp, Homo sapiens
ctcaggaggcaggacc

SEQ ID NO: 3459837 - DNA, 18 bp, Homo sapiens
ctcaggaggcaggacctt

SEQ ID NO: 3459838 - DNA, 14 bp, Homo sapiens
ctcaggcacacagc

SEQ ID NO: 3459839 - DNA, 15 bp, Homo sapiens
ctcaggcaggtggga

SEQ ID NO: 3459840 - DNA, 18 bp, Homo sapiens
ctcaggcaggtgggatgg

SEQ ID NO: 3459841 - DNA, 20 bp, Homo sapiens
ctcaggccaagaaacgtctt

SEQ ID NO: 3459842 - DNA, 19 bp, Homo sapiens
ctcaggccggcagccccag

SEQ ID NO: 3459843 - DNA, 21 bp, Homo sapiens
ctcaggcgatccacctgtctc

SEQ ID NO: 3459844 - DNA, 23 bp, Homo sapiens
ctcagggaaaagcagctctcccc

SEQ ID NO: 3459845 - DNA, 21 bp, Homo sapiens
ctcagggaaatggccttcccg

SEQ ID NO: 3459846 - DNA, 10 bp, Homo sapiens
ctcagggcag

SEQ ID NO: 3459847 - DNA, 20 bp, Homo sapiens
ctcagggcagcgccaggctg

SEQ ID NO: 3459848 - DNA, 15 bp, Homo sapiens
ctcagggccatgctg

SEQ ID NO: 3459849 - DNA, 14 bp, Homo sapiens
ctcagggcctggtc

SEQ ID NO: 3459850 - DNA, 15 bp, Homo sapiens
ctcagggcctggtcg

SEQ ID NO: 3459851 - DNA, 22 bp, Homo sapiens
ctcagggctaaacgggcattgc

SEQ ID NO: 3459852 - DNA, 13 bp, Homo sapiens
ctcagggctcctg

SEQ ID NO: 3459853 - DNA, 17 bp, Homo sapiens
ctcagggctcctgggtt

SEQ ID NO: 3459854 - DNA, 13 bp, Homo sapiens
ctcagggtccaga

SEQ ID NO: 3459855 - DNA, 17 bp, Homo sapiens
ctcagggtccagaccct

SEQ ID NO: 3459856 - DNA, 18 bp, Homo sapiens
ctcagggtctctgctgcc

SEQ ID NO: 3459857 - DNA, 15 bp, Homo sapiens
ctcaggtacttgtaa

SEQ ID NO: 3459858 - DNA, 16 bp, Homo sapiens
ctcaggtgagaagcag

SEQ ID NO: 3459859 - DNA, 22 bp, Homo sapiens
ctcaggtgatccacccacctca

SEQ ID NO: 3459860 - DNA, 15 bp, Homo sapiens
ctcaggtgtccctgc

SEQ ID NO: 3459861 - DNA, 21 bp, Homo sapiens
ctcagtaagacgacaaggaaa

SEQ ID NO: 3459862 - DNA, 12 bp, Homo sapiens
ctcagtactttg

SEQ ID NO: 3459863 - DNA, 18 bp, Homo sapiens
ctcagtactttggaggcc

SEQ ID NO: 3459864 - DNA, 23 bp, Homo sapiens
ctcagtactttggaggcccctat

SEQ ID NO: 3459865 - DNA, 17 bp, Homo sapiens
ctcagtatgtgggggct

SEQ ID NO: 3459866 - DNA, 13 bp, Homo sapiens
ctcagtctctgag

SEQ ID NO: 3459867 - DNA, 16 bp, Homo sapiens
ctcagtgcaacctctg

SEQ ID NO: 3459868 - DNA, 17 bp, Homo sapiens
ctcagtgcatttgtgct

SEQ ID NO: 3459869 - DNA, 16 bp, Homo sapiens
ctcagtgtatttgtat

SEQ ID NO: 3459870 - DNA, 17 bp, Homo sapiens
ctcagtgttttggactc

SEQ ID NO: 3459871 - DNA, 21 bp, Homo sapiens
ctcagttcagaatcacttctg

SEQ ID NO: 3459872 - DNA, 14 bp, Homo sapiens
ctcagttctgcctt

SEQ ID NO: 3459873 - DNA, 13 bp, Homo sapiens
ctcagttgcagcc

SEQ ID NO: 3459874 - DNA, 14 bp, Homo sapiens
ctcataaacatttg

SEQ ID NO: 3459875 - DNA, 18 bp, Homo sapiens
ctcataaacatttgagtt

SEQ ID NO: 3459876 - DNA, 12 bp, Homo sapiens
ctcataccatct

SEQ ID NO: 3459877 - DNA, 15 bp, Homo sapiens
ctcataccatctgct

SEQ ID NO: 3459878 - DNA, 19 bp, Homo sapiens
ctcataggttgagcaattt

SEQ ID NO: 3459879 - DNA, 18 bp, Homo sapiens
ctcatagtatggtggctg

SEQ ID NO: 3459880 - DNA, 19 bp, Homo sapiens
ctcatagtatggtggctgg

SEQ ID NO: 3459881 - DNA, 21 bp, Homo sapiens
ctcatagtatggtggctgggt

SEQ ID NO: 3459882 - DNA, 15 bp, Homo sapiens
ctcatatagcacttt

SEQ ID NO: 3459883 - DNA, 18 bp, Homo sapiens
ctcatcaacttaaaagtc

SEQ ID NO: 3459884 - DNA, 13 bp, Homo sapiens
ctcatcactgtgg

SEQ ID NO: 3459885 - DNA, 13 bp, Homo sapiens
ctcatcattctct

SEQ ID NO: 3459886 - DNA, 14 bp, Homo sapiens
ctcatcattctctg

SEQ ID NO: 3459887 - DNA, 23 bp, Homo sapiens
ctcatcattctctgtctcatcca

SEQ ID NO: 3459888 - DNA, 10 bp, Homo sapiens
ctcatcccat

SEQ ID NO: 3459889 - DNA, 18 bp, Homo sapiens
ctcatccctaatgctgca

SEQ ID NO: 3459890 - DNA, 18 bp, Homo sapiens
ctcatctctaacagctca

SEQ ID NO: 3459891 - DNA, 20 bp, Homo sapiens
ctcatctctaacagctcagg

SEQ ID NO: 3459892 - DNA, 16 bp, Homo sapiens
ctcatctctctgccca

SEQ ID NO: 3459893 - DNA, 15 bp, Homo sapiens
ctcatctctcttggg

SEQ ID NO: 3459894 - DNA, 16 bp, Homo sapiens
ctcatctctgcctgac

SEQ ID NO: 3459895 - DNA, 15 bp, Homo sapiens
ctcatctttcttgat

SEQ ID NO: 3459896 - DNA, 13 bp, Homo sapiens
ctcatgaatctgc

SEQ ID NO: 3459897 - DNA, 14 bp, Homo sapiens
ctcatgacagccag

SEQ ID NO: 3459898 - DNA, 18 bp, Homo sapiens
ctcatgacagccagagcc

SEQ ID NO: 3459899 - DNA, 19 bp, Homo sapiens
ctcatgacagccagagcct

SEQ ID NO: 3459900 - DNA, 14 bp, Homo sapiens
ctcatgaggggaga

SEQ ID NO: 3459901 - DNA, 19 bp, Homo sapiens
ctcatgaggggagaggaga

SEQ ID NO: 3459902 - DNA, 17 bp, Homo sapiens
ctcatgcccctggctgg

SEQ ID NO: 3459903 - DNA, 17 bp, Homo sapiens
ctcatggaaactggcca

SEQ ID NO: 3459904 - DNA, 12 bp, Homo sapiens
ctcatgtggctg

SEQ ID NO: 3459905 - DNA, 15 bp, Homo sapiens
ctcatgtggctggaa

SEQ ID NO: 3459906 - DNA, 17 bp, Homo sapiens
ctcatgttttcaactgc

SEQ ID NO: 3459907 - DNA, 20 bp, Homo sapiens
ctcatgttttcaactgccaa

SEQ ID NO: 3459908 - DNA, 11 bp, Homo sapiens
ctcattaaatt

SEQ ID NO: 3459909 - DNA, 21 bp, Homo sapiens
ctcattactgcttcatttttg

SEQ ID NO: 3459910 - DNA, 15 bp, Homo sapiens
ctcattcaaaagttg

SEQ ID NO: 3459911 - DNA, 15 bp, Homo sapiens
ctcattctgcacctt

SEQ ID NO: 3459912 - DNA, 18 bp, Homo sapiens
ctcattctgcaccttgcc

SEQ ID NO: 3459913 - DNA, 19 bp, Homo sapiens
ctcattgctgagcctctgc

SEQ ID NO: 3459914 - DNA, 18 bp, Homo sapiens
ctcattggacccttccat

SEQ ID NO: 3459915 - DNA, 14 bp, Homo sapiens
ctcatttcacccct

SEQ ID NO: 3459916 - DNA, 22 bp, Homo sapiens
ctcatttcacccctccctttct

SEQ ID NO: 3459917 - DNA, 17 bp, Homo sapiens
ctcatttgtcacacact

SEQ ID NO: 3459918 - DNA, 21 bp, Homo sapiens
ctcatttgtcacacactttgg

SEQ ID NO: 3459919 - DNA, 16 bp, Homo sapiens
ctccaaaaatctgcct

SEQ ID NO: 3459920 - DNA, 19 bp, Homo sapiens
ctccaaaaatctgcctggg

SEQ ID NO: 3459921 - DNA, 22 bp, Homo sapiens
ctccaaactgaagcagcctctc

SEQ ID NO: 3459922 - DNA, 15 bp, Homo sapiens
ctccaaactgattaa

SEQ ID NO: 3459923 - DNA, 16 bp, Homo sapiens
ctccaacaccaagcac

SEQ ID NO: 3459924 - DNA, 18 bp, Homo sapiens
ctccaacaccaagcacag

SEQ ID NO: 3459925 - DNA, 15 bp, Homo sapiens
ctccaaccccccagc

SEQ ID NO: 3459926 - DNA, 23 bp, Homo sapiens
ctccaaccccccagcactgagga

SEQ ID NO: 3459927 - DNA, 21 bp, Homo sapiens
ctccaacctgcaaagatctgt

SEQ ID NO: 3459928 - DNA, 17 bp, Homo sapiens
ctccaagccccatcttc

SEQ ID NO: 3459929 - DNA, 20 bp, Homo sapiens
ctccaaggggaatcagaact

SEQ ID NO: 3459930 - DNA, 19 bp, Homo sapiens
ctccacagggcttgttttc

SEQ ID NO: 3459931 - DNA, 21 bp, Homo sapiens
ctccacagggcttgttttcca

SEQ ID NO: 3459932 - DNA, 15 bp, Homo sapiens
ctccacatcctccac

SEQ ID NO: 3459933 - DNA, 17 bp, Homo sapiens
ctccacatcctccacgt

SEQ ID NO: 3459934 - DNA, 15 bp, Homo sapiens
ctccaccaggaacct

SEQ ID NO: 3459935 - DNA, 11 bp, Homo sapiens
ctccaccctgc

SEQ ID NO: 3459936 - DNA, 13 bp, Homo sapiens
ctccaccctgctc

SEQ ID NO: 3459937 - DNA, 15 bp, Homo sapiens
ctccaccctgctctc

SEQ ID NO: 3459938 - DNA, 20 bp, Homo sapiens
ctccacgttctgctcatcat

SEQ ID NO: 3459939 - DNA, 15 bp, Homo sapiens
ctccactctgcttct

SEQ ID NO: 3459940 - DNA, 20 bp, Homo sapiens
ctccactgctctcagcctcc

SEQ ID NO: 3459941 - DNA, 15 bp, Homo sapiens
ctccagaagatagct

SEQ ID NO: 3459942 - DNA, 20 bp, Homo sapiens
ctccagaagcactgggatca

SEQ ID NO: 3459943 - DNA, 11 bp, Homo sapiens
ctccagacctg

SEQ ID NO: 3459944 - DNA, 21 bp, Homo sapiens
ctccagatagctcatttcatt

SEQ ID NO: 3459945 - DNA, 16 bp, Homo sapiens
ctccagatgcagggca

SEQ ID NO: 3459946 - DNA, 22 bp, Homo sapiens
ctccagccaaacgggagctttt

SEQ ID NO: 3459947 - DNA, 21 bp, Homo sapiens
ctccagccccttctcagaatc

SEQ ID NO: 3459948 - DNA, 20 bp, Homo sapiens
ctccagcctgaacagaagct

SEQ ID NO: 3459949 - DNA, 15 bp, Homo sapiens
ctccagctcaccagc

SEQ ID NO: 3459950 - DNA, 16 bp, Homo sapiens
ctccagctcaccagcc

SEQ ID NO: 3459951 - DNA, 19 bp, Homo sapiens
ctccagctcaccagcccca

SEQ ID NO: 3459952 - DNA, 15 bp, Homo sapiens
ctccagctcatatgc

SEQ ID NO: 3459953 - DNA, 13 bp, Homo sapiens
ctccagctgcccc

SEQ ID NO: 3459954 - DNA, 18 bp, Homo sapiens
ctctttggacactcacac

SEQ ID NO: 3459955 - DNA, 21 bp, Homo sapiens
ctctttggcgacctcctttca

SEQ ID NO: 3459956 - DNA, 23 bp, Homo sapiens
ctctttgtgggtttttcatcttt

SEQ ID NO: 3459957 - DNA, 16 bp, Homo sapiens
ctcttttacctgctgc

SEQ ID NO: 3459958 - DNA, 23 bp, Homo sapiens
ctcttttatatttgtaggagaaa

SEQ ID NO: 3459959 - DNA, 23 bp, Homo sapiens
ctcttttccactccattgtcgta

SEQ ID NO: 3459960 - DNA, 18 bp, Homo sapiens
ctcttttcccctttcctg

SEQ ID NO: 3459961 - DNA, 19 bp, Homo sapiens
ctcttttcccctttcctgt

SEQ ID NO: 3459962 - DNA, 11 bp, Homo sapiens
ctcttttggac

SEQ ID NO: 3459963 - DNA, 17 bp, Homo sapiens
ctgaaaacactgtgcac

SEQ ID NO: 3459964 - DNA, 20 bp, Homo sapiens
ctgaaaacctctcctcatgt

SEQ ID NO: 3459965 - DNA, 10 bp, Homo sapiens
ctgaaacagc

SEQ ID NO: 3459966 - DNA, 12 bp, Homo sapiens
ctgaaacagctg

SEQ ID NO: 3459967 - DNA, 14 bp, Homo sapiens
ctgaaacagctgcc

SEQ ID NO: 3459968 - DNA, 19 bp, Homo sapiens
ctgaaacagctgccttagc

SEQ ID NO: 3459969 - DNA, 14 bp, Homo sapiens
ctgaaaccagtgtt

SEQ ID NO: 3459970 - DNA, 14 bp, Homo sapiens
ctgaaagcggctgc

SEQ ID NO: 3459971 - DNA, 22 bp, Homo sapiens
ctgaaagcggctgcctccatta

SEQ ID NO: 3459972 - DNA, 18 bp, Homo sapiens
ctgaaagtgacagagacc

SEQ ID NO: 3459973 - DNA, 14 bp, Homo sapiens
ctgaaagttgtaca

SEQ ID NO: 3459974 - DNA, 16 bp, Homo sapiens
ctgaaagttgtacatg

SEQ ID NO: 3459975 - DNA, 20 bp, Homo sapiens
ctgaaagttgtacatgaaat

SEQ ID NO: 3459976 - DNA, 14 bp, Homo sapiens
ctgaaattctcctg

SEQ ID NO: 3459977 - DNA, 20 bp, Homo sapiens
ctgaaattctcctggaggtc

SEQ ID NO: 3459978 - DNA, 19 bp, Homo sapiens
ctgaacaataggctgttcc

SEQ ID NO: 3459979 - DNA, 13 bp, Homo sapiens
ctgaacagaagct

SEQ ID NO: 3459980 - DNA, 19 bp, Homo sapiens
ctgaacattagttgcacta

SEQ ID NO: 3459981 - DNA, 15 bp, Homo sapiens
ctgaaccctcagcct

SEQ ID NO: 3459982 - DNA, 19 bp, Homo sapiens
ctgaaccctcagccttgac

SEQ ID NO: 3459983 - DNA, 23 bp, Homo sapiens
ctgaacctatttcttaaacactt

SEQ ID NO: 3459984 - DNA, 23 bp, Homo sapiens
ctgaacgtttccccgaagagtca

SEQ ID NO: 3459985 - DNA, 15 bp, Homo sapiens
ctgaactgagcctag

SEQ ID NO: 3459986 - DNA, 16 bp, Homo sapiens
ctgaactgagcctagc

SEQ ID NO: 3459987 - DNA, 15 bp, Homo sapiens
ctgaactgtgtgtaa

SEQ ID NO: 3459988 - DNA, 13 bp, Homo sapiens
ctgaagaaatcca

SEQ ID NO: 3459989 - DNA, 13 bp, Homo sapiens
ctgaagaacagta

SEQ ID NO: 3459990 - DNA, 22 bp, Homo sapiens
ctgaagaaccagtccccccacc

SEQ ID NO: 3459991 - DNA, 14 bp, Homo sapiens
ctgaagacttgccc

SEQ ID NO: 3459992 - DNA, 21 bp, Homo sapiens
ctgaagcaaggcggtggactt

SEQ ID NO: 3459993 - DNA, 14 bp, Homo sapiens
ctgaagcagatgca

SEQ ID NO: 3459994 - DNA, 22 bp, Homo sapiens
ctgaagcagatgcaaagaggca

SEQ ID NO: 3459995 - DNA, 15 bp, Homo sapiens
ctgaagcagcctctc

SEQ ID NO: 3459996 - DNA, 20 bp, Homo sapiens
ctgaagcagcctctccccag

SEQ ID NO: 3459997 - DNA, 19 bp, Homo sapiens
ctgaaggacattgcggaca

SEQ ID NO: 3459998 - DNA, 13 bp, Homo sapiens
ctgaaggagcccc

SEQ ID NO: 3459999 - DNA, 17 bp, Homo sapiens
ctgaaggctaaaaagca

SEQ ID NO: 3460000 - DNA, 22 bp, Homo sapiens
ctgaaggctaaaaagcaacagg

SEQ ID NO: 3460001 - DNA, 15 bp, Homo sapiens
ctgaaggtaaaattg

SEQ ID NO: 3460002 - DNA, 17 bp, Homo sapiens
ctgaaggtaaaattgaa

SEQ ID NO: 3460003 - DNA, 18 bp, Homo sapiens
ctgaagtcacacagtgag

SEQ ID NO: 3460004 - DNA, 16 bp, Homo sapiens
ctgaatacattctgct

SEQ ID NO: 3460005 - DNA, 15 bp, Homo sapiens
ctgaatagcagaagg

SEQ ID NO: 3460006 - DNA, 18 bp, Homo sapiens
ctgaataggcgatcacaa

SEQ ID NO: 3460007 - DNA, 23 bp, Homo sapiens
ctgaataggcgatcacaacgtgc

SEQ ID NO: 3460008 - DNA, 13 bp, Homo sapiens
ctgaatcatgagc

SEQ ID NO: 3460009 - DNA, 20 bp, Homo sapiens
ctgaatcatgagcctgctgg

SEQ ID NO: 3460010 - DNA, 19 bp, Homo sapiens
ctgaatgggatcatgaaag

SEQ ID NO: 3460011 - DNA, 15 bp, Homo sapiens
ctgaatttgcaaagt

SEQ ID NO: 3460012 - DNA, 21 bp, Homo sapiens
ctgaatttgcaaagtactgta

SEQ ID NO: 3460013 - DNA, 17 bp, Homo sapiens
ctgaattttataaataa

SEQ ID NO: 3460014 - DNA, 14 bp, Homo sapiens
ctgacaaggccagc

SEQ ID NO: 3460015 - DNA, 15 bp, Homo sapiens
ctgacaaggccagca

SEQ ID NO: 3460016 - DNA, 14 bp, Homo sapiens
ctgacacaaacctg

SEQ ID NO: 3460017 - DNA, 22 bp, Homo sapiens
ctgacactggtattcctgcctc

SEQ ID NO: 3460018 - DNA, 16 bp, Homo sapiens
ctgacagacacaggcc

SEQ ID NO: 3460019 - DNA, 13 bp, Homo sapiens
ctgacagcctccc

SEQ ID NO: 3460020 - DNA, 14 bp, Homo sapiens
ctgacagcctccca

SEQ ID NO: 3460021 - DNA, 17 bp, Homo sapiens
ctgacagcctcccaccc

SEQ ID NO: 3460022 - DNA, 13 bp, Homo sapiens
ctgacagctgctc

SEQ ID NO: 3460023 - DNA, 15 bp, Homo sapiens
ctgacagctgctcct

SEQ ID NO: 3460024 - DNA, 16 bp, Homo sapiens
ctgacagctgctccta

SEQ ID NO: 3460025 - DNA, 11 bp, Homo sapiens
ctgacaggcaa

SEQ ID NO: 3460026 - DNA, 17 bp, Homo sapiens
ctgacaggcaatgctgg

SEQ ID NO: 3460027 - DNA, 21 bp, Homo sapiens
ctgacaggcaatgctggctgt

SEQ ID NO: 3460028 - DNA, 21 bp, Homo sapiens
ctgacaggctgtgactcttct

SEQ ID NO: 3460029 - DNA, 18 bp, Homo sapiens
ctgacagtgtgggacagg

SEQ ID NO: 3460030 - DNA, 24 bp, Homo sapiens
ctgacagtgtgggacaggctcttc

SEQ ID NO: 3460031 - DNA, 16 bp, Homo sapiens
ctgacagtttttctgt

SEQ ID NO: 3460032 - DNA, 20 bp, Homo sapiens
ctgacatcaattttaccctg

SEQ ID NO: 3460033 - DNA, 20 bp, Homo sapiens
ctgacatgattccttcctgt

SEQ ID NO: 3460034 - DNA, 16 bp, Homo sapiens
ctgacattgccaaaaa

SEQ ID NO: 3460035 - DNA, 21 bp, Homo sapiens
ctgacattgccaaaaaggata

SEQ ID NO: 3460036 - DNA, 21 bp, Homo sapiens
ctgacatttggagtgttcccc

SEQ ID NO: 3460037 - DNA, 18 bp, Homo sapiens
ctgaccacagcacagcca

SEQ ID NO: 3460038 - DNA, 14 bp, Homo sapiens
ctgaccagcagcgc

SEQ ID NO: 3460039 - DNA, 20 bp, Homo sapiens
ctgaccagcagcgcctttcc

SEQ ID NO: 3460040 - DNA, 22 bp, Homo sapiens
ctgaccagcagcgcctttccca

SEQ ID NO: 3460041 - DNA, 15 bp, Homo sapiens
ctgaccatgctcatc

SEQ ID NO: 3460042 - DNA, 21 bp, Homo sapiens
ctgaccatgctcatctgctgg

SEQ ID NO: 3460043 - DNA, 22 bp, Homo sapiens
ctgaccatgctcatctgctggt

SEQ ID NO: 3460044 - DNA, 12 bp, Homo sapiens
ctgacccactgc

SEQ ID NO: 3460045 - DNA, 13 bp, Homo sapiens
ctgacccactgct

SEQ ID NO: 3460046 - DNA, 13 bp, Homo sapiens
ctgacccagtgcc

SEQ ID NO: 3460047 - DNA, 23 bp, Homo sapiens
ctgacccagtgcccccactgacc

SEQ ID NO: 3460048 - DNA, 16 bp, Homo sapiens
ctgacccattgctgtt

SEQ ID NO: 3460049 - DNA, 14 bp, Homo sapiens
ctgaccctggggct

SEQ ID NO: 3460050 - DNA, 13 bp, Homo sapiens
ctgaccctgtata

SEQ ID NO: 3460051 - DNA, 13 bp, Homo sapiens
ctgaccctgtgga

SEQ ID NO: 3460052 - DNA, 20 bp, Homo sapiens
ctgacctggtccacagggca

SEQ ID NO: 3460053 - DNA, 18 bp, Homo sapiens
ctgacctgtgagcccagc

SEQ ID NO: 3460054 - DNA, 20 bp, Homo sapiens
ctgacctgtgagcccagctg

SEQ ID NO: 3460055 - DNA, 21 bp, Homo sapiens
ctgacctgtgagcccagctgg

SEQ ID NO: 3460056 - DNA, 15 bp, Homo sapiens
ctgaccttcagctca

SEQ ID NO: 3460057 - DNA, 19 bp, Homo sapiens
ctgacctttaactgagggc

SEQ ID NO: 3460058 - DNA, 23 bp, Homo sapiens
ctgacctttgtcatctttcttct

SEQ ID NO: 3460059 - DNA, 19 bp, Homo sapiens
ctgacggccagggagaagc

SEQ ID NO: 3460060 - DNA, 20 bp, Homo sapiens
ctgacggccagggagaagct

SEQ ID NO: 3460061 - DNA, 18 bp, Homo sapiens
ctgactagggagccatgt

SEQ ID NO: 3460062 - DNA, 12 bp, Homo sapiens
ctgactcagggc

SEQ ID NO: 3460063 - DNA, 16 bp, Homo sapiens
ctgactcatcatttgt

SEQ ID NO: 3460064 - DNA, 16 bp, Homo sapiens
ctgactcattctgaag

SEQ ID NO: 3460065 - DNA, 23 bp, Homo sapiens
ctgactccactcaaagagggtga

SEQ ID NO: 3460066 - DNA, 15 bp, Homo sapiens
ctgactcggtttctc

SEQ ID NO: 3460067 - DNA, 18 bp, Homo sapiens
ctgactcggtttctccaa

SEQ ID NO: 3460068 - DNA, 18 bp, Homo sapiens
ctgactgcccagcatttg

SEQ ID NO: 3460069 - DNA, 21 bp, Homo sapiens
ctgactgctcagaacttgctg

SEQ ID NO: 3460070 - DNA, 24 bp, Homo sapiens
ctgacttaagcaaaagaaaaagat

SEQ ID NO: 3460071 - DNA, 12 bp, Homo sapiens
ctgacttctgcc

SEQ ID NO: 3460072 - DNA, 13 bp, Homo sapiens
ctgacttctgcct

SEQ ID NO: 3460073 - DNA, 14 bp, Homo sapiens
ctgacttctgcctg

SEQ ID NO: 3460074 - DNA, 16 bp, Homo sapiens
ctgacttctgcctgga

SEQ ID NO: 3460075 - DNA, 18 bp, Homo sapiens
ctgacttctgcctggaga

SEQ ID NO: 3460076 - DNA, 12 bp, Homo sapiens
ctgacttgggga

SEQ ID NO: 3460077 - DNA, 23 bp, Homo sapiens
ctgagaaacccaccagcctaaga

SEQ ID NO: 3460078 - DNA, 15 bp, Homo sapiens
ctgagaacactgtga

SEQ ID NO: 3460079 - DNA, 17 bp, Homo sapiens
ctgagaatgtaagaact

SEQ ID NO: 3460080 - DNA, 22 bp, Homo sapiens
ctgagaggacttttctttgtgg

SEQ ID NO: 3460081 - DNA, 17 bp, Homo sapiens
ctgagagtcagctctct

SEQ ID NO: 3460082 - DNA, 21 bp, Homo sapiens
ctgagatcaaaacggttttac

SEQ ID NO: 3460083 - DNA, 14 bp, Homo sapiens
ctgagattccctca

SEQ ID NO: 3460084 - DNA, 22 bp, Homo sapiens
ctgagatttcatctgctctcct

SEQ ID NO: 3460085 - DNA, 11 bp, Homo sapiens
ctgagcacaga

SEQ ID NO: 3460086 - DNA, 18 bp, Homo sapiens
ctgcctcgaactggctgc

SEQ ID NO: 3460087 - DNA, 19 bp, Homo sapiens
ctgcctcgaactggctgca

SEQ ID NO: 3460088 - DNA, 19 bp, Homo sapiens
ctgcctctcattggcacca

SEQ ID NO: 3460089 - DNA, 15 bp, Homo sapiens
ctgcctctgacacac

SEQ ID NO: 3460090 - DNA, 18 bp, Homo sapiens
ctgcctctgacacacagc

SEQ ID NO: 3460091 - DNA, 13 bp, Homo sapiens
ctgcctcttctct

SEQ ID NO: 3460092 - DNA, 14 bp, Homo sapiens
ctgcctcttctcta

SEQ ID NO: 3460093 - DNA, 16 bp, Homo sapiens
ctgcctcttctgggag

SEQ ID NO: 3460094 - DNA, 15 bp, Homo sapiens
ctgcctgaagtcaca

SEQ ID NO: 3460095 - DNA, 17 bp, Homo sapiens
ctgcctgacaaggccag

SEQ ID NO: 3460096 - DNA, 16 bp, Homo sapiens
ctgcctgcccacacag

SEQ ID NO: 3460097 - DNA, 15 bp, Homo sapiens
ctgcctgcccaggcc

SEQ ID NO: 3460098 - DNA, 16 bp, Homo sapiens
ctgcctgcccaggccc

SEQ ID NO: 3460099 - DNA, 21 bp, Homo sapiens
ctgcctgcccaggcccctgcc

SEQ ID NO: 3460100 - DNA, 22 bp, Homo sapiens
ctgcctggacttggcccctgcc

SEQ ID NO: 3460101 - DNA, 15 bp, Homo sapiens
ctgcctgtagcccac

SEQ ID NO: 3460102 - DNA, 13 bp, Homo sapiens
ctgcctgtctgcc

SEQ ID NO: 3460103 - DNA, 14 bp, Homo sapiens
ctgcctgtctgccc

SEQ ID NO: 3460104 - DNA, 14 bp, Homo sapiens
ctgcctgttcagct

SEQ ID NO: 3460105 - DNA, 15 bp, Homo sapiens
ctgcctgttcagctc

SEQ ID NO: 3460106 - DNA, 18 bp, Homo sapiens
ctgcctgttcagctccag

SEQ ID NO: 3460107 - DNA, 23 bp, Homo sapiens
ctgcctgttcagctccagctcac

SEQ ID NO: 3460108 - DNA, 22 bp, Homo sapiens
ctgccttatctaaatcaccaga

SEQ ID NO: 3460109 - DNA, 21 bp, Homo sapiens
ctgccttcgcttcttgcctct

SEQ ID NO: 3460110 - DNA, 13 bp, Homo sapiens
ctgccttgcctcc

SEQ ID NO: 3460111 - DNA, 19 bp, Homo sapiens
ctgccttgcctcctcagta

SEQ ID NO: 3460112 - DNA, 12 bp, Homo sapiens
ctgccttgcctt

SEQ ID NO: 3460113 - DNA, 14 bp, Homo sapiens
ctgccttgccttta

SEQ ID NO: 3460114 - DNA, 15 bp, Homo sapiens
ctgccttggctcaga

SEQ ID NO: 3460115 - DNA, 22 bp, Homo sapiens
ctgccttggctcagacatgttt

SEQ ID NO: 3460116 - DNA, 15 bp, Homo sapiens
ctgcctttagaaaat

SEQ ID NO: 3460117 - DNA, 22 bp, Homo sapiens
ctgcctttattgtgtttgtcat

SEQ ID NO: 3460118 - DNA, 16 bp, Homo sapiens
ctgcctttgcctccag

SEQ ID NO: 3460119 - DNA, 21 bp, Homo sapiens
ctgcctttgcctccagaagca

SEQ ID NO: 3460120 - DNA, 23 bp, Homo sapiens
ctgcgacgcttgctctgtttgtg

SEQ ID NO: 3460121 - DNA, 17 bp, Homo sapiens
ctgcgactttctgcctg

SEQ ID NO: 3460122 - DNA, 20 bp, Homo sapiens
ctgcgactttctgcctggag

SEQ ID NO: 3460123 - DNA, 18 bp, Homo sapiens
ctgcgcccagtccttcca

SEQ ID NO: 3460124 - DNA, 23 bp, Homo sapiens
ctgcgcccagtccttccacctcg

SEQ ID NO: 3460125 - DNA, 12 bp, Homo sapiens
ctgcgcctgctg

SEQ ID NO: 3460126 - DNA, 20 bp, Homo sapiens
ctgcggaatgaaccacatct

SEQ ID NO: 3460127 - DNA, 14 bp, Homo sapiens
ctgcggcaggactg

SEQ ID NO: 3460128 - DNA, 15 bp, Homo sapiens
ctgcggcaggactgc

SEQ ID NO: 3460129 - DNA, 23 bp, Homo sapiens
ctgcggcaggactgcagagcaga

SEQ ID NO: 3460130 - DNA, 14 bp, Homo sapiens
ctgcgggaagctga

SEQ ID NO: 3460131 - DNA, 18 bp, Homo sapiens
ctgcgggacagaggacca

SEQ ID NO: 3460132 - DNA, 13 bp, Homo sapiens
ctgcgggtggggc

SEQ ID NO: 3460133 - DNA, 15 bp, Homo sapiens
ctgcggtccacccag

SEQ ID NO: 3460134 - DNA, 17 bp, Homo sapiens
ctgcggtccacccagga

SEQ ID NO: 3460135 - DNA, 16 bp, Homo sapiens
ctgcgtgcccctgctg

SEQ ID NO: 3460136 - DNA, 14 bp, Homo sapiens
ctgctaacaagtca

SEQ ID NO: 3460137 - DNA, 18 bp, Homo sapiens
ctgctactctgttccttc

SEQ ID NO: 3460138 - DNA, 19 bp, Homo sapiens
ctgctagagacgctgatcc

SEQ ID NO: 3460139 - DNA, 20 bp, Homo sapiens
ctgctagctagctcaactag

SEQ ID NO: 3460140 - DNA, 21 bp, Homo sapiens
ctgctagctagctcaactagt

SEQ ID NO: 3460141 - DNA, 14 bp, Homo sapiens
ctgctatagcctgg

SEQ ID NO: 3460142 - DNA, 14 bp, Homo sapiens
ctgctcacatatct

SEQ ID NO: 3460143 - DNA, 16 bp, Homo sapiens
ctgctcacatatctgt

SEQ ID NO: 3460144 - DNA, 19 bp, Homo sapiens
ctgctcacatatctgtcat

SEQ ID NO: 3460145 - DNA, 12 bp, Homo sapiens
ctgctcacttta

SEQ ID NO: 3460146 - DNA, 22 bp, Homo sapiens
ctgctcagaacttgctgctgtc

SEQ ID NO: 3460147 - DNA, 13 bp, Homo sapiens
ctgctcagctctg

SEQ ID NO: 3460148 - DNA, 17 bp, Homo sapiens
ctgctcagctctggtcc

SEQ ID NO: 3460149 - DNA, 22 bp, Homo sapiens
ctgctcagggaaaagcagctct

SEQ ID NO: 3460150 - DNA, 17 bp, Homo sapiens
ctgctcatcattctctg

SEQ ID NO: 3460151 - DNA, 18 bp, Homo sapiens
ctgctcatcattctctgt

SEQ ID NO: 3460152 - DNA, 15 bp, Homo sapiens
ctgctccagacctga

SEQ ID NO: 3460153 - DNA, 20 bp, Homo sapiens
ctgctccagctgttcagctg

SEQ ID NO: 3460154 - DNA, 15 bp, Homo sapiens
ctgctcctagaggga

SEQ ID NO: 3460155 - DNA, 17 bp, Homo sapiens
ctgctcctagagggagg

SEQ ID NO: 3460156 - DNA, 21 bp, Homo sapiens
ctgctcctagagggaggggcc

SEQ ID NO: 3460157 - DNA, 17 bp, Homo sapiens
ctgctcctccctctgac

SEQ ID NO: 3460158 - DNA, 17 bp, Homo sapiens
ctgctcctctccccagc

SEQ ID NO: 3460159 - DNA, 15 bp, Homo sapiens
ctgctcctttcccct

SEQ ID NO: 3460160 - DNA, 20 bp, Homo sapiens
ctgctctagatgagctgggc

SEQ ID NO: 3460161 - DNA, 21 bp, Homo sapiens
ctgctctattccaaaaaggtt

SEQ ID NO: 3460162 - DNA, 19 bp, Homo sapiens
ctgctctccttcctggagc

SEQ ID NO: 3460163 - DNA, 20 bp, Homo sapiens
ctgctctccttcctggagcc

SEQ ID NO: 3460164 - DNA, 21 bp, Homo sapiens
ctgctctgcgtgtcacctgtg

SEQ ID NO: 3460165 - DNA, 18 bp, Homo sapiens
ctgctgaagacttgcccc

SEQ ID NO: 3460166 - DNA, 15 bp, Homo sapiens
ctgctgacagacaca

SEQ ID NO: 3460167 - DNA, 19 bp, Homo sapiens
ctgctgacagacacaggcc

SEQ ID NO: 3460168 - DNA, 20 bp, Homo sapiens
ctgctgacagacacaggccc

SEQ ID NO: 3460169 - DNA, 13 bp, Homo sapiens
ctgctgacagtgt

SEQ ID NO: 3460170 - DNA, 14 bp, Homo sapiens
ctgctgcatgccct

SEQ ID NO: 3460171 - DNA, 15 bp, Homo sapiens
ctgctgcatgccctc

SEQ ID NO: 3460172 - DNA, 12 bp, Homo sapiens
ctgctgcccagg

SEQ ID NO: 3460173 - DNA, 19 bp, Homo sapiens
ctgctgccgccccacccag

SEQ ID NO: 3460174 - DNA, 20 bp, Homo sapiens
ctgctgccgccccacccaga

SEQ ID NO: 3460175 - DNA, 16 bp, Homo sapiens
ctgctgctcctccctc

SEQ ID NO: 3460176 - DNA, 22 bp, Homo sapiens
ctgctgctcctccctctgaccc

SEQ ID NO: 3460177 - DNA, 15 bp, Homo sapiens
ctgctgctgcctgcc

SEQ ID NO: 3460178 - DNA, 15 bp, Homo sapiens
ctgctgctgtcacct

SEQ ID NO: 3460179 - DNA, 13 bp, Homo sapiens
ctgctggaagccc

SEQ ID NO: 3460180 - DNA, 15 bp, Homo sapiens
ctgctggacagtatc

SEQ ID NO: 3460181 - DNA, 15 bp, Homo sapiens
ctgctggaggcctca

SEQ ID NO: 3460182 - DNA, 16 bp, Homo sapiens
ctgctggaggcctcag

SEQ ID NO: 3460183 - DNA, 18 bp, Homo sapiens
ctgctggaggcctcaggt

SEQ ID NO: 3460184 - DNA, 20 bp, Homo sapiens
ctgctggccaaatagcaaag

SEQ ID NO: 3460185 - DNA, 16 bp, Homo sapiens
ctgctggcccagccaa

SEQ ID NO: 3460186 - DNA, 19 bp, Homo sapiens
ctgctgggatggtgggctt

SEQ ID NO: 3460187 - DNA, 13 bp, Homo sapiens
ctgctggttcagg

SEQ ID NO: 3460188 - DNA, 19 bp, Homo sapiens
ctgctgtcaagtcccccag

SEQ ID NO: 3460189 - DNA, 16 bp, Homo sapiens
ctgctgtcacctctcc

SEQ ID NO: 3460190 - DNA, 19 bp, Homo sapiens
ctgctgtcacctctcccac

SEQ ID NO: 3460191 - DNA, 21 bp, Homo sapiens
ctgctgtcacctctcccacgg

SEQ ID NO: 3460192 - DNA, 17 bp, Homo sapiens
ctgctgtccagtgccta

SEQ ID NO: 3460193 - DNA, 16 bp, Homo sapiens
ctgctgtctctctggg

SEQ ID NO: 3460194 - DNA, 19 bp, Homo sapiens
ctgctgtctctctgggctg

SEQ ID NO: 3460195 - DNA, 12 bp, Homo sapiens
ctgctgtcttgt

SEQ ID NO: 3460196 - DNA, 21 bp, Homo sapiens
ctgctgttggtcctctctctg

SEQ ID NO: 3460197 - DNA, 23 bp, Homo sapiens
ctgctgttggtcctctctctgtg

SEQ ID NO: 3460198 - DNA, 18 bp, Homo sapiens
ctgcttaaagttgtaaca

SEQ ID NO: 3460199 - DNA, 17 bp, Homo sapiens
ctgcttactagccctgc

SEQ ID NO: 3460200 - DNA, 15 bp, Homo sapiens
ctgcttcactaggga

SEQ ID NO: 3460201 - DNA, 16 bp, Homo sapiens
ctgcttcactagggaa

SEQ ID NO: 3460202 - DNA, 17 bp, Homo sapiens
ctgcttcactagggaat

SEQ ID NO: 3460203 - DNA, 14 bp, Homo sapiens
ctgcttcatttttg

SEQ ID NO: 3460204 - DNA, 12 bp, Homo sapiens
ctgcttcctcct

SEQ ID NO: 3460205 - DNA, 23 bp, Homo sapiens
ctgcttctccaaaaatctgcctg

SEQ ID NO: 3460206 - DNA, 14 bp, Homo sapiens
ctgcttctctgact

SEQ ID NO: 3460207 - DNA, 21 bp, Homo sapiens
ctgcttctctgacttctgcct

SEQ ID NO: 3460208 - DNA, 22 bp, Homo sapiens
ctgcttctctgacttctgcctg

SEQ ID NO: 3460209 - DNA, 17 bp, Homo sapiens
ctgcttgacaacatctg

SEQ ID NO: 3460210 - DNA, 16 bp, Homo sapiens
ctgcttgaggaaaaca

SEQ ID NO: 3460211 - DNA, 20 bp, Homo sapiens
ctgcttgaggcaactcatct

SEQ ID NO: 3460212 - DNA, 15 bp, Homo sapiens
ctgctttgcaaagac

SEQ ID NO: 3460213 - DNA, 15 bp, Homo sapiens
ctgctttggcagtgc

SEQ ID NO: 3460214 - DNA, 20 bp, Homo sapiens
ctgctttgggaagccgtgct

SEQ ID NO: 3460215 - DNA, 19 bp, Homo sapiens
ctgcttttgtctatgggac

SEQ ID NO: 3460216 - DNA, 17 bp, Homo sapiens
ctggaaaataatactgc

SEQ ID NO: 3460217 - DNA, 20 bp, Homo sapiens
ctggaaaataatactgctga

SEQ ID NO: 3460218 - DNA, 19 bp, Homo sapiens
ctggaaacattcaggagct

SEQ ID NO: 3460219 - DNA, 19 bp, Homo sapiens
ctgtgccctccttcccaat

SEQ ID NO: 3460220 - DNA, 15 bp, Homo sapiens
ctgtgcctccatcag

SEQ ID NO: 3460221 - DNA, 16 bp, Homo sapiens
ctgtgcctccatcagc

SEQ ID NO: 3460222 - DNA, 18 bp, Homo sapiens
ctgtgctacctgagccaa

SEQ ID NO: 3460223 - DNA, 15 bp, Homo sapiens
ctgtgctcaggactc

SEQ ID NO: 3460224 - DNA, 22 bp, Homo sapiens
ctgtgctccctggttctgatga

SEQ ID NO: 3460225 - DNA, 14 bp, Homo sapiens
ctgtgctctggaca

SEQ ID NO: 3460226 - DNA, 14 bp, Homo sapiens
ctgtgctgggagaa

SEQ ID NO: 3460227 - DNA, 19 bp, Homo sapiens
ctgtgcttcgggcccttcc

SEQ ID NO: 3460228 - DNA, 21 bp, Homo sapiens
ctgtgcttcgggcccttccca

SEQ ID NO: 3460229 - DNA, 17 bp, Homo sapiens
ctgtgcttgaaggccct

SEQ ID NO: 3460230 - DNA, 18 bp, Homo sapiens
ctgtgcttgaaggccctg

SEQ ID NO: 3460231 - DNA, 20 bp, Homo sapiens
ctgtgcttgaaggccctgct

SEQ ID NO: 3460232 - DNA, 19 bp, Homo sapiens
ctgtggaaaagaaacacgc

SEQ ID NO: 3460233 - DNA, 15 bp, Homo sapiens
ctgtggagtcccaac

SEQ ID NO: 3460234 - DNA, 15 bp, Homo sapiens
ctgtggatcagagat

SEQ ID NO: 3460235 - DNA, 20 bp, Homo sapiens
ctgtggatgagccctcagaa

SEQ ID NO: 3460236 - DNA, 16 bp, Homo sapiens
ctgtggccccaccctg

SEQ ID NO: 3460237 - DNA, 20 bp, Homo sapiens
ctgtggccccaccctgggcc

SEQ ID NO: 3460238 - DNA, 15 bp, Homo sapiens
ctgtggccgcacgcc

SEQ ID NO: 3460239 - DNA, 18 bp, Homo sapiens
ctgtggccgcacgcctct

SEQ ID NO: 3460240 - DNA, 22 bp, Homo sapiens
ctgtggccgcacgcctctccct

SEQ ID NO: 3460241 - DNA, 19 bp, Homo sapiens
ctgtggcgccgtctccagg

SEQ ID NO: 3460242 - DNA, 21 bp, Homo sapiens
ctgtggcgccgtctccagggg

SEQ ID NO: 3460243 - DNA, 24 bp, Homo sapiens
ctgtggcgccgtctccaggggctg

SEQ ID NO: 3460244 - DNA, 15 bp, Homo sapiens
ctgtggctgtctgga

SEQ ID NO: 3460245 - DNA, 18 bp, Homo sapiens
ctgtgggaaggccagctg

SEQ ID NO: 3460246 - DNA, 17 bp, Homo sapiens
ctgtgggcgggcccagc

SEQ ID NO: 3460247 - DNA, 19 bp, Homo sapiens
ctgtgggcgggcccagcac

SEQ ID NO: 3460248 - DNA, 13 bp, Homo sapiens
ctgtggggactcc

SEQ ID NO: 3460249 - DNA, 19 bp, Homo sapiens
ctgtggggactccggctgt

SEQ ID NO: 3460250 - DNA, 16 bp, Homo sapiens
ctgtgggtgtgtgact

SEQ ID NO: 3460251 - DNA, 16 bp, Homo sapiens
ctgtgtaaaaagagag

SEQ ID NO: 3460252 - DNA, 15 bp, Homo sapiens
ctgtgtaaaatgtaa

SEQ ID NO: 3460253 - DNA, 18 bp, Homo sapiens
ctgtgtaaccttgggtgg

SEQ ID NO: 3460254 - DNA, 16 bp, Homo sapiens
ctgtgtacttcccggg

SEQ ID NO: 3460255 - DNA, 19 bp, Homo sapiens
ctgtgtcagcatagaagta

SEQ ID NO: 3460256 - DNA, 18 bp, Homo sapiens
ctgtgtccatgcgctcag

SEQ ID NO: 3460257 - DNA, 21 bp, Homo sapiens
ctgtgtccatgcgctcagggc

SEQ ID NO: 3460258 - DNA, 23 bp, Homo sapiens
ctgtgtccatgcgctcagggcca

SEQ ID NO: 3460259 - DNA, 12 bp, Homo sapiens
ctgtgtctaaac

SEQ ID NO: 3460260 - DNA, 13 bp, Homo sapiens
ctgtgtctgtgtt

SEQ ID NO: 3460261 - DNA, 21 bp, Homo sapiens
ctgtgtcttgcaatggcagcc

SEQ ID NO: 3460262 - DNA, 23 bp, Homo sapiens
ctgtgtcttgcaatggcagcctt

SEQ ID NO: 3460263 - DNA, 12 bp, Homo sapiens
ctgtgtcttttt

SEQ ID NO: 3460264 - DNA, 20 bp, Homo sapiens
ctgtgtcttttttcactaca

SEQ ID NO: 3460265 - DNA, 21 bp, Homo sapiens
ctgtgtgattgacagctttgc

SEQ ID NO: 3460266 - DNA, 21 bp, Homo sapiens
ctgtgtggccacttctgtcca

SEQ ID NO: 3460267 - DNA, 22 bp, Homo sapiens
ctgtgtgtccaaaactgcctca

SEQ ID NO: 3460268 - DNA, 16 bp, Homo sapiens
ctgtgtgtgtgaatga

SEQ ID NO: 3460269 - DNA, 18 bp, Homo sapiens
ctgtgtgtgtgaatgaac

SEQ ID NO: 3460270 - DNA, 23 bp, Homo sapiens
ctgtgtgtgtgaatgaacactct

SEQ ID NO: 3460271 - DNA, 17 bp, Homo sapiens
ctgtgtgtgtgtgtgca

SEQ ID NO: 3460272 - DNA, 14 bp, Homo sapiens
ctgtgttactgctt

SEQ ID NO: 3460273 - DNA, 16 bp, Homo sapiens
ctgtgttactgctttg

SEQ ID NO: 3460274 - DNA, 17 bp, Homo sapiens
ctgtgtttggctttcag

SEQ ID NO: 3460275 - DNA, 13 bp, Homo sapiens
ctgttactgtctt

SEQ ID NO: 3460276 - DNA, 20 bp, Homo sapiens
ctgttcaaacccagtcttgt

SEQ ID NO: 3460277 - DNA, 23 bp, Homo sapiens
ctgttcaagagcacacttggccc

SEQ ID NO: 3460278 - DNA, 12 bp, Homo sapiens
ctgttcagctgg

SEQ ID NO: 3460279 - DNA, 19 bp, Homo sapiens
ctgttcagctggttgaggt

SEQ ID NO: 3460280 - DNA, 21 bp, Homo sapiens
ctgttcagctggttgaggttt

SEQ ID NO: 3460281 - DNA, 20 bp, Homo sapiens
ctgttcccatgtagccccct

SEQ ID NO: 3460282 - DNA, 13 bp, Homo sapiens
ctgttccccagag

SEQ ID NO: 3460283 - DNA, 14 bp, Homo sapiens
ctgttccccagaga

SEQ ID NO: 3460284 - DNA, 17 bp, Homo sapiens
ctgttccccctgtgcag

SEQ ID NO: 3460285 - DNA, 15 bp, Homo sapiens
ctgttcccccttcac

SEQ ID NO: 3460286 - DNA, 21 bp, Homo sapiens
ctgttccttcacatcctgtgt

SEQ ID NO: 3460287 - DNA, 13 bp, Homo sapiens
ctgttctggagga

SEQ ID NO: 3460288 - DNA, 19 bp, Homo sapiens
ctgttctgggactccaggt

SEQ ID NO: 3460289 - DNA, 21 bp, Homo sapiens
ctgttctgggactccaggtct

SEQ ID NO: 3460290 - DNA, 22 bp, Homo sapiens
ctgttgaattttgttctctggg

SEQ ID NO: 3460291 - DNA, 17 bp, Homo sapiens
ctgttgacacaggtctt

SEQ ID NO: 3460292 - DNA, 21 bp, Homo sapiens
ctgttgacacaggtctttcct

SEQ ID NO: 3460293 - DNA, 22 bp, Homo sapiens
ctgttgacacaggtctttccta

SEQ ID NO: 3460294 - DNA, 19 bp, Homo sapiens
ctgttgacatatttaatgt

SEQ ID NO: 3460295 - DNA, 21 bp, Homo sapiens
ctgttgacatatttaatgttt

SEQ ID NO: 3460296 - DNA, 23 bp, Homo sapiens
ctgttgacatatttaatgtttta

SEQ ID NO: 3460297 - DNA, 15 bp, Homo sapiens
ctgttgactggctgt

SEQ ID NO: 3460298 - DNA, 21 bp, Homo sapiens
ctgttgctaagccccagcaag

SEQ ID NO: 3460299 - DNA, 23 bp, Homo sapiens
ctgttgctaagccccagcaagca

SEQ ID NO: 3460300 - DNA, 19 bp, Homo sapiens
ctgttggctgggggcctca

SEQ ID NO: 3460301 - DNA, 18 bp, Homo sapiens
ctgttgggaacagcatgg

SEQ ID NO: 3460302 - DNA, 17 bp, Homo sapiens
ctgttggggtgggtata

SEQ ID NO: 3460303 - DNA, 19 bp, Homo sapiens
ctgttgtacaatcatgttc

SEQ ID NO: 3460304 - DNA, 19 bp, Homo sapiens
ctgtttaggttcccctgtc

SEQ ID NO: 3460305 - DNA, 21 bp, Homo sapiens
ctgtttaggttcccctgtcaa

SEQ ID NO: 3460306 - DNA, 16 bp, Homo sapiens
ctgtttataaaaacaa

SEQ ID NO: 3460307 - DNA, 17 bp, Homo sapiens
ctgtttataaaaacaaa

SEQ ID NO: 3460308 - DNA, 21 bp, Homo sapiens
ctgtttcaaagccaagacctc

SEQ ID NO: 3460309 - DNA, 17 bp, Homo sapiens
ctgtttcaacacagacc

SEQ ID NO: 3460310 - DNA, 11 bp, Homo sapiens
ctgtttcacaa

SEQ ID NO: 3460311 - DNA, 12 bp, Homo sapiens
ctgtttcccagc

SEQ ID NO: 3460312 - DNA, 19 bp, Homo sapiens
ctgtttcctgacattgtct

SEQ ID NO: 3460313 - DNA, 18 bp, Homo sapiens
ctgtttctacctatatgc

SEQ ID NO: 3460314 - DNA, 21 bp, Homo sapiens
ctgtttctctgccgctacctc

SEQ ID NO: 3460315 - DNA, 19 bp, Homo sapiens
ctgtttgctgatggtctgg

SEQ ID NO: 3460316 - DNA, 21 bp, Homo sapiens
ctgtttgcttcaccgtggatt

SEQ ID NO: 3460317 - DNA, 18 bp, Homo sapiens
ctgtttgtggggtgacgg

SEQ ID NO: 3460318 - DNA, 13 bp, Homo sapiens
ctgtttgttacta

SEQ ID NO: 3460319 - DNA, 13 bp, Homo sapiens
ctgttttccctga

SEQ ID NO: 3460320 - DNA, 14 bp, Homo sapiens
ctgttttcctccct

SEQ ID NO: 3460321 - DNA, 15 bp, Homo sapiens
ctgttttcctccctt

SEQ ID NO: 3460322 - DNA, 21 bp, Homo sapiens
ctgttttcctcccttctgcta

SEQ ID NO: 3460323 - DNA, 17 bp, Homo sapiens
ctgttttctcttgagag

SEQ ID NO: 3460324 - DNA, 18 bp, Homo sapiens
ctgttttgagttttgtag

SEQ ID NO: 3460325 - DNA, 22 bp, Homo sapiens
ctgttttgtttggcaaggaaag

SEQ ID NO: 3460326 - DNA, 15 bp, Homo sapiens
ctgtttttaagctgt

SEQ ID NO: 3460327 - DNA, 17 bp, Homo sapiens
ctgtttttaagctgttt

SEQ ID NO: 3460328 - DNA, 19 bp, Homo sapiens
ctgtttttaagctgtttcc

SEQ ID NO: 3460329 - DNA, 14 bp, Homo sapiens
ctgtttttgttgtg

SEQ ID NO: 3460330 - DNA, 18 bp, Homo sapiens
ctgttttttggcttgctt

SEQ ID NO: 3460331 - DNA, 17 bp, Homo sapiens
cttaaaaagtggaaaaa

SEQ ID NO: 3460332 - DNA, 13 bp, Homo sapiens
cttaaaaatcaca

SEQ ID NO: 3460333 - DNA, 21 bp, Homo sapiens
cttaaaaatcacactgtaaat

SEQ ID NO: 3460334 - DNA, 22 bp, Homo sapiens
cttaaaatagcaacactctata

SEQ ID NO: 3460335 - DNA, 12 bp, Homo sapiens
cttaacaaatac

SEQ ID NO: 3460336 - DNA, 14 bp, Homo sapiens
cttaacaaatacat

SEQ ID NO: 3460337 - DNA, 13 bp, Homo sapiens
cttaagagaatat

SEQ ID NO: 3460338 - DNA, 23 bp, Homo sapiens
cttaagagaatattttaagtatt

SEQ ID NO: 3460339 - DNA, 17 bp, Homo sapiens
cttaagagatgcctcat

SEQ ID NO: 3460340 - DNA, 18 bp, Homo sapiens
cttaagatttgtttttct

SEQ ID NO: 3460341 - DNA, 17 bp, Homo sapiens
cttaaggtgaggcctgt

SEQ ID NO: 3460342 - DNA, 19 bp, Homo sapiens
cttaaggtgaggcctgtct

SEQ ID NO: 3460343 - DNA, 20 bp, Homo sapiens
cttaaggtgaggcctgtctg

SEQ ID NO: 3460344 - DNA, 22 bp, Homo sapiens
cttaaggtgaggcctgtctgtg

SEQ ID NO: 3460345 - DNA, 14 bp, Homo sapiens
cttaaggtgtagcc

SEQ ID NO: 3460346 - DNA, 14 bp, Homo sapiens
cttaatataaattc

SEQ ID NO: 3460347 - DNA, 20 bp, Homo sapiens
cttaatcttgctttctttag

SEQ ID NO: 3460348 - DNA, 14 bp, Homo sapiens
cttaatgaagtttg

SEQ ID NO: 3460349 - DNA, 18 bp, Homo sapiens
cttaatgaagtttgaatg

SEQ ID NO: 3460350 - DNA, 17 bp, Homo sapiens
cttgttgtgcttttagt

SEQ ID NO: 3460351 - DNA, 20 bp, Homo sapiens
cttgttgttggttgtttttt

SEQ ID NO: 3460352 - DNA, 16 bp, Homo sapiens
cttgtttgctcacctg

SEQ ID NO: 3460353 - DNA, 16 bp, Homo sapiens
cttgttttccaaagaa

SEQ ID NO: 3460354 - DNA, 16 bp, Homo sapiens
ctttaaaagagagaga

SEQ ID NO: 3460355 - DNA, 22 bp, Homo sapiens
ctttaaaagagagagagagaaa

SEQ ID NO: 3460356 - DNA, 16 bp, Homo sapiens
ctttaaaatgtaaagc

SEQ ID NO: 3460357 - DNA, 19 bp, Homo sapiens
ctttaaaatgtaaagccat

SEQ ID NO: 3460358 - DNA, 14 bp, Homo sapiens
ctttaaaattcaag

SEQ ID NO: 3460359 - DNA, 23 bp, Homo sapiens
ctttaaaatttttttagaaagca

SEQ ID NO: 3460360 - DNA, 23 bp, Homo sapiens
ctttaaacctgtttttttttcat

SEQ ID NO: 3460361 - DNA, 16 bp, Homo sapiens
ctttaaatatatatta

SEQ ID NO: 3460362 - DNA, 20 bp, Homo sapiens
ctttaactgagggctgatct

SEQ ID NO: 3460363 - DNA, 20 bp, Homo sapiens
ctttaactggaaggctgctt

SEQ ID NO: 3460364 - DNA, 20 bp, Homo sapiens
ctttaagcctgcattcttaa

SEQ ID NO: 3460365 - DNA, 19 bp, Homo sapiens
ctttaaggggaagataaga

SEQ ID NO: 3460366 - DNA, 23 bp, Homo sapiens
ctttaatgcatctagattatgga

SEQ ID NO: 3460367 - DNA, 20 bp, Homo sapiens
ctttaatgtcacaggcaggt

SEQ ID NO: 3460368 - DNA, 20 bp, Homo sapiens
ctttaatttttttaaccaaa

SEQ ID NO: 3460369 - DNA, 23 bp, Homo sapiens
ctttaatttttttaaccaaaggt

SEQ ID NO: 3460370 - DNA, 17 bp, Homo sapiens
ctttaccccatccctgt

SEQ ID NO: 3460371 - DNA, 14 bp, Homo sapiens
ctttaccttcctga

SEQ ID NO: 3460372 - DNA, 18 bp, Homo sapiens
ctttacggacaccccctc

SEQ ID NO: 3460373 - DNA, 16 bp, Homo sapiens
ctttactattaaaata

SEQ ID NO: 3460374 - DNA, 22 bp, Homo sapiens
ctttactattaaaatattttgg

SEQ ID NO: 3460375 - DNA, 14 bp, Homo sapiens
ctttactgaccctg

SEQ ID NO: 3460376 - DNA, 19 bp, Homo sapiens
ctttactgaccctggggct

SEQ ID NO: 3460377 - DNA, 12 bp, Homo sapiens
ctttactgtttg

SEQ ID NO: 3460378 - DNA, 14 bp, Homo sapiens
ctttactttaaaat

SEQ ID NO: 3460379 - DNA, 17 bp, Homo sapiens
ctttagagttagactgt

SEQ ID NO: 3460380 - DNA, 23 bp, Homo sapiens
ctttagcaaaaaaaacccatgtg

SEQ ID NO: 3460381 - DNA, 22 bp, Homo sapiens
ctttagccagaatctcattact

SEQ ID NO: 3460382 - DNA, 21 bp, Homo sapiens
ctttaggagggagttatctaa

SEQ ID NO: 3460383 - DNA, 16 bp, Homo sapiens
ctttagggttctgcct

SEQ ID NO: 3460384 - DNA, 18 bp, Homo sapiens
ctttagggttctgcctct

SEQ ID NO: 3460385 - DNA, 15 bp, Homo sapiens
ctttaggtctttgta

SEQ ID NO: 3460386 - DNA, 17 bp, Homo sapiens
ctttaggtctttgtaag

SEQ ID NO: 3460387 - DNA, 14 bp, Homo sapiens
ctttagtctgcaaa

SEQ ID NO: 3460388 - DNA, 20 bp, Homo sapiens
ctttagtgatcacagcagct

SEQ ID NO: 3460389 - DNA, 20 bp, Homo sapiens
ctttataagtcattgtatgt

SEQ ID NO: 3460390 - DNA, 19 bp, Homo sapiens
ctttatcacctcattctga

SEQ ID NO: 3460391 - DNA, 20 bp, Homo sapiens
ctttatcacctcattctgaa

SEQ ID NO: 3460392 - DNA, 12 bp, Homo sapiens
ctttatgctgaa

SEQ ID NO: 3460393 - DNA, 13 bp, Homo sapiens
ctttatgcttgca

SEQ ID NO: 3460394 - DNA, 11 bp, Homo sapiens
ctttatggtaa

SEQ ID NO: 3460395 - DNA, 20 bp, Homo sapiens
ctttattaatcactattgtt

SEQ ID NO: 3460396 - DNA, 14 bp, Homo sapiens
ctttattatggaaa

SEQ ID NO: 3460397 - DNA, 23 bp, Homo sapiens
ctttattccagaatgctgtacat

SEQ ID NO: 3460398 - DNA, 16 bp, Homo sapiens
ctttattctttactat

SEQ ID NO: 3460399 - DNA, 13 bp, Homo sapiens
ctttattcttttc

SEQ ID NO: 3460400 - DNA, 16 bp, Homo sapiens
ctttattgagaaagag

SEQ ID NO: 3460401 - DNA, 18 bp, Homo sapiens
ctttattgtgtttgtcat

SEQ ID NO: 3460402 - DNA, 20 bp, Homo sapiens
ctttattgtgtttgtcatta

SEQ ID NO: 3460403 - DNA, 14 bp, Homo sapiens
ctttatttttgtta

SEQ ID NO: 3460404 - DNA, 15 bp, Homo sapiens
ctttatttttgttaa

SEQ ID NO: 3460405 - DNA, 22 bp, Homo sapiens
ctttcaagcagtcgtgcctgtg

SEQ ID NO: 3460406 - DNA, 16 bp, Homo sapiens
ctttcaccccagggcc

SEQ ID NO: 3460407 - DNA, 22 bp, Homo sapiens
ctttcaccccagggcctgagcc

SEQ ID NO: 3460408 - DNA, 16 bp, Homo sapiens
ctttcagacttgccat

SEQ ID NO: 3460409 - DNA, 18 bp, Homo sapiens
ctttcagacttgccatgt

SEQ ID NO: 3460410 - DNA, 21 bp, Homo sapiens
ctttcagtacttttttaaata

SEQ ID NO: 3460411 - DNA, 23 bp, Homo sapiens
ctttcatgctacagaaagctgct

SEQ ID NO: 3460412 - DNA, 11 bp, Homo sapiens
ctttccaaaga

SEQ ID NO: 3460413 - DNA, 19 bp, Homo sapiens
ctttccaaatgcccagctt

SEQ ID NO: 3460414 - DNA, 15 bp, Homo sapiens
ctttccaccacagcc

SEQ ID NO: 3460415 - DNA, 22 bp, Homo sapiens
ctttccaccacagccagcacct

SEQ ID NO: 3460416 - DNA, 16 bp, Homo sapiens
ctttccagcttagaat

SEQ ID NO: 3460417 - DNA, 21 bp, Homo sapiens
ctttcccaaaattagggagct

SEQ ID NO: 3460418 - DNA, 17 bp, Homo sapiens
ctttcccatggggaggg

SEQ ID NO: 3460419 - DNA, 18 bp, Homo sapiens
ctttccccttccttttaa

SEQ ID NO: 3460420 - DNA, 19 bp, Homo sapiens
ctttccgtggcactgcata

SEQ ID NO: 3460421 - DNA, 16 bp, Homo sapiens
ctttcctaagacctgg

SEQ ID NO: 3460422 - DNA, 17 bp, Homo sapiens
ctttcctaaggctgcaa

SEQ ID NO: 3460423 - DNA, 20 bp, Homo sapiens
ctttcctagatggcagtcac

SEQ ID NO: 3460424 - DNA, 18 bp, Homo sapiens
ctttcctcattaaattac

SEQ ID NO: 3460425 - DNA, 22 bp, Homo sapiens
ctttcctcctcaggcacacagc

SEQ ID NO: 3460426 - DNA, 15 bp, Homo sapiens
ctttcctcctctgac

SEQ ID NO: 3460427 - DNA, 13 bp, Homo sapiens
ctttcctcctttc

SEQ ID NO: 3460428 - DNA, 16 bp, Homo sapiens
ctttcctctctatatt

SEQ ID NO: 3460429 - DNA, 19 bp, Homo sapiens
ctttcctgcctccttgaaa

SEQ ID NO: 3460430 - DNA, 13 bp, Homo sapiens
ctttcctgtccca

SEQ ID NO: 3460431 - DNA, 17 bp, Homo sapiens
ctttccttggctttatg

SEQ ID NO: 3460432 - DNA, 19 bp, Homo sapiens
ctttccttgttccccatca

SEQ ID NO: 3460433 - DNA, 15 bp, Homo sapiens
ctttccttttcttta

SEQ ID NO: 3460434 - DNA, 13 bp, Homo sapiens
ctttcgaggcctg

SEQ ID NO: 3460435 - DNA, 14 bp, Homo sapiens
ctttcgaggcctga

SEQ ID NO: 3460436 - DNA, 17 bp, Homo sapiens
ctttcgtctactgcaag

SEQ ID NO: 3460437 - DNA, 15 bp, Homo sapiens
ctttctacaatgtga

SEQ ID NO: 3460438 - DNA, 20 bp, Homo sapiens
ctttctacaatgtgaacttt

SEQ ID NO: 3460439 - DNA, 15 bp, Homo sapiens
ctttctagcttccct

SEQ ID NO: 3460440 - DNA, 12 bp, Homo sapiens
ctttctctgtgt

SEQ ID NO: 3460441 - DNA, 20 bp, Homo sapiens
ctttctcttttctaaaagac

SEQ ID NO: 3460442 - DNA, 18 bp, Homo sapiens
ctttctgaccttcagctc

SEQ ID NO: 3460443 - DNA, 16 bp, Homo sapiens
ctttctgagtgccttc

SEQ ID NO: 3460444 - DNA, 18 bp, Homo sapiens
ctttctgagtgccttctg

SEQ ID NO: 3460445 - DNA, 19 bp, Homo sapiens
ctttctgctcagcttctcc

SEQ ID NO: 3460446 - DNA, 19 bp, Homo sapiens
ctttctggtgttttatttc

SEQ ID NO: 3460447 - DNA, 21 bp, Homo sapiens
ctttcttacacaagagctgga

SEQ ID NO: 3460448 - DNA, 13 bp, Homo sapiens
ctttcttagaaat

SEQ ID NO: 3460449 - DNA, 14 bp, Homo sapiens
ctttcttagaaatt

SEQ ID NO: 3460450 - DNA, 16 bp, Homo sapiens
ctttcttctattttat

SEQ ID NO: 3460451 - DNA, 15 bp, Homo sapiens
ctttctttcttagaa

SEQ ID NO: 3460452 - DNA, 16 bp, Homo sapiens
ctttctttcttagaaa

SEQ ID NO: 3460453 - DNA, 22 bp, Homo sapiens
ctttctttgggaatatttgaat

SEQ ID NO: 3460454 - DNA, 23 bp, Homo sapiens
ctttgaaaaagttaatgcttaag

SEQ ID NO: 3460455 - DNA, 18 bp, Homo sapiens
ctttgaataaagaatact

SEQ ID NO: 3460456 - DNA, 23 bp, Homo sapiens
ctttgaatgctaagaatgcatta

SEQ ID NO: 3460457 - DNA, 14 bp, Homo sapiens
ctttgaatgtaacc

SEQ ID NO: 3460458 - DNA, 15 bp, Homo sapiens
ctttgaatgtaacca

SEQ ID NO: 3460459 - DNA, 14 bp, Homo sapiens
ctttgaatgttaat

SEQ ID NO: 3460460 - DNA, 20 bp, Homo sapiens
ctttgagataatacattccg

SEQ ID NO: 3460461 - DNA, 20 bp, Homo sapiens
ctttgaggataactttttaa

SEQ ID NO: 3460462 - DNA, 22 bp, Homo sapiens
ctttgatacagtcaacaagcct

SEQ ID NO: 3460463 - DNA, 13 bp, Homo sapiens
ctttgattctcct

SEQ ID NO: 3460464 - DNA, 16 bp, Homo sapiens
ctttgattctccttca

SEQ ID NO: 3460465 - DNA, 13 bp, Homo sapiens
ctttgattctgat

SEQ ID NO: 3460466 - DNA, 12 bp, Homo sapiens
ctttgcaaagac

SEQ ID NO: 3460467 - DNA, 15 bp, Homo sapiens
ctttgcagacaggca

SEQ ID NO: 3460468 - DNA, 16 bp, Homo sapiens
ctttgcagacaggcaa

SEQ ID NO: 3460469 - DNA, 20 bp, Homo sapiens
ctttgcagacaggcaagcac

SEQ ID NO: 3460470 - DNA, 22 bp, Homo sapiens
ctttgcatagcagctgctacta

SEQ ID NO: 3460471 - DNA, 22 bp, Homo sapiens
ctttgcatttggaatttttgct

SEQ ID NO: 3460472 - DNA, 15 bp, Homo sapiens
ctttgcgcctgtgac

SEQ ID NO: 3460473 - DNA, 12 bp, Homo sapiens
ctttgctgcaga

SEQ ID NO: 3460474 - DNA, 19 bp, Homo sapiens
ctttgctgctgaaggctca

SEQ ID NO: 3460475 - DNA, 18 bp, Homo sapiens
ctttgctgtaagatgtct

SEQ ID NO: 3460476 - DNA, 14 bp, Homo sapiens
ctttgctgtcccat

SEQ ID NO: 3460477 - DNA, 22 bp, Homo sapiens
ctttgctgtcccatagtccctg

SEQ ID NO: 3460478 - DNA, 12 bp, Homo sapiens
ctttgctttctg

SEQ ID NO: 3460479 - DNA, 16 bp, Homo sapiens
ctttgctttctgctca

SEQ ID NO: 3460480 - DNA, 17 bp, Homo sapiens
ctttgctttctgctcag

SEQ ID NO: 3460481 - DNA, 21 bp, Homo sapiens
ctttgctttctgctcagcttc

SEQ ID NO: 3460482 - DNA, 14 bp, Homo sapiens
gaaaccctgagcag

SEQ ID NO: 3460483 - DNA, 14 bp, Homo sapiens
gaaaccctggacca

SEQ ID NO: 3460484 - DNA, 13 bp, Homo sapiens
gaaacctactgcc

SEQ ID NO: 3460485 - DNA, 19 bp, Homo sapiens
gaaacctactgcccaggca

SEQ ID NO: 3460486 - DNA, 19 bp, Homo sapiens
gaaaccttagtttcaagag

SEQ ID NO: 3460487 - DNA, 16 bp, Homo sapiens
gaaacctttttttgat

SEQ ID NO: 3460488 - DNA, 20 bp, Homo sapiens
gaaacgctacctctctgtcc

SEQ ID NO: 3460489 - DNA, 16 bp, Homo sapiens
gaaacgtcttctaaac

SEQ ID NO: 3460490 - DNA, 22 bp, Homo sapiens
gaaactactgcctttagaaaat

SEQ ID NO: 3460491 - DNA, 19 bp, Homo sapiens
gaaactatattttgtcata

SEQ ID NO: 3460492 - DNA, 22 bp, Homo sapiens
gaaactcagagtcggaacggag

SEQ ID NO: 3460493 - DNA, 18 bp, Homo sapiens
gaaactcccatgtatgga

SEQ ID NO: 3460494 - DNA, 20 bp, Homo sapiens
gaaactgttcccacctgctg

SEQ ID NO: 3460495 - DNA, 22 bp, Homo sapiens
gaaacttcgctgtcccccaaca

SEQ ID NO: 3460496 - DNA, 15 bp, Homo sapiens
gaaactttcctttaa

SEQ ID NO: 3460497 - DNA, 16 bp, Homo sapiens
gaaactttgctttggg

SEQ ID NO: 3460498 - DNA, 17 bp, Homo sapiens
gaaagaaagaaagaaag

SEQ ID NO: 3460499 - DNA, 22 bp, Homo sapiens
gaaagaatgttactgccttaat

SEQ ID NO: 3460500 - DNA, 17 bp, Homo sapiens
gaaagaatttcatatgc

SEQ ID NO: 3460501 - DNA, 16 bp, Homo sapiens
gaaagacagcttctca

SEQ ID NO: 3460502 - DNA, 17 bp, Homo sapiens
gaaagactgaagaaagt

SEQ ID NO: 3460503 - DNA, 20 bp, Homo sapiens
gaaagactgggacagcccag

SEQ ID NO: 3460504 - DNA, 19 bp, Homo sapiens
gaaagagacacacacacag

SEQ ID NO: 3460505 - DNA, 16 bp, Homo sapiens
gaaagagcacttaaga

SEQ ID NO: 3460506 - DNA, 23 bp, Homo sapiens
gaaagagcacttaagagaatatt

SEQ ID NO: 3460507 - DNA, 12 bp, Homo sapiens
gaaagcatttga

SEQ ID NO: 3460508 - DNA, 17 bp, Homo sapiens
gaaagccctgagctttc

SEQ ID NO: 3460509 - DNA, 17 bp, Homo sapiens
gaaaggcattctctgaa

SEQ ID NO: 3460510 - DNA, 22 bp, Homo sapiens
gaaaggccagctggcagcagag

SEQ ID NO: 3460511 - DNA, 15 bp, Homo sapiens
gaaagggcccagaga

SEQ ID NO: 3460512 - DNA, 16 bp, Homo sapiens
gaaaggtgattccagg

SEQ ID NO: 3460513 - DNA, 14 bp, Homo sapiens
gaaaggtggtgttt

SEQ ID NO: 3460514 - DNA, 16 bp, Homo sapiens
gaaaggtggtgtttct

SEQ ID NO: 3460515 - DNA, 22 bp, Homo sapiens
gaaaggtggtgtttctgtaaga

SEQ ID NO: 3460516 - DNA, 13 bp, Homo sapiens
gaaaggttttgag

SEQ ID NO: 3460517 - DNA, 14 bp, Homo sapiens
gaaagtcattggct

SEQ ID NO: 3460518 - DNA, 17 bp, Homo sapiens
gaaagtcattggcttta

SEQ ID NO: 3460519 - DNA, 18 bp, Homo sapiens
gaaagtcattggctttat

SEQ ID NO: 3460520 - DNA, 16 bp, Homo sapiens
gaaagtgacagagacc

SEQ ID NO: 3460521 - DNA, 13 bp, Homo sapiens
gaaagttctggaa

SEQ ID NO: 3460522 - DNA, 18 bp, Homo sapiens
gaaagttgccattattct

SEQ ID NO: 3460523 - DNA, 17 bp, Homo sapiens
gaaagttgtacatgaaa

SEQ ID NO: 3460524 - DNA, 18 bp, Homo sapiens
gaaagttttttcctccct

SEQ ID NO: 3460525 - DNA, 16 bp, Homo sapiens
gaaataaaaggaagcc

SEQ ID NO: 3460526 - DNA, 17 bp, Homo sapiens
gaaataaaaggaagcca

SEQ ID NO: 3460527 - DNA, 19 bp, Homo sapiens
gaaataaagttaagtttgt

SEQ ID NO: 3460528 - DNA, 18 bp, Homo sapiens
gaaatacaaaaatactca

SEQ ID NO: 3460529 - DNA, 22 bp, Homo sapiens
gaaatacagattttgatagcaa

SEQ ID NO: 3460530 - DNA, 18 bp, Homo sapiens
gaaatactgcaagaaaat

SEQ ID NO: 3460531 - DNA, 13 bp, Homo sapiens
gaaatatcattta

SEQ ID NO: 3460532 - DNA, 20 bp, Homo sapiens
gaaatatcccgggggtgggg

SEQ ID NO: 3460533 - DNA, 15 bp, Homo sapiens
gaaatatcctgcttg

SEQ ID NO: 3460534 - DNA, 15 bp, Homo sapiens
gaaatattccctaga

SEQ ID NO: 3460535 - DNA, 18 bp, Homo sapiens
gaaatattgctgtatagc

SEQ ID NO: 3460536 - DNA, 15 bp, Homo sapiens
gaaatcaacttgctt

SEQ ID NO: 3460537 - DNA, 12 bp, Homo sapiens
gaaatctcaccc

SEQ ID NO: 3460538 - DNA, 22 bp, Homo sapiens
gaaatctggcttctggccagga

SEQ ID NO: 3460539 - DNA, 23 bp, Homo sapiens
gaaatctggcttctggccaggaa

SEQ ID NO: 3460540 - DNA, 12 bp, Homo sapiens
gaaatgcattta

SEQ ID NO: 3460541 - DNA, 15 bp, Homo sapiens
gaaatggagaagctc

SEQ ID NO: 3460542 - DNA, 18 bp, Homo sapiens
gaaatggagaagctctgt

SEQ ID NO: 3460543 - DNA, 17 bp, Homo sapiens
gaaatgggaatcatggc

SEQ ID NO: 3460544 - DNA, 17 bp, Homo sapiens
gaaatgggacttaactc

SEQ ID NO: 3460545 - DNA, 15 bp, Homo sapiens
gaaatggttgtatta

SEQ ID NO: 3460546 - DNA, 18 bp, Homo sapiens
gaaatggttgtattagat

SEQ ID NO: 3460547 - DNA, 22 bp, Homo sapiens
gaaattaagaaggcaaaaatgt

SEQ ID NO: 3460548 - DNA, 14 bp, Homo sapiens
gaaattctcctgga

SEQ ID NO: 3460549 - DNA, 16 bp, Homo sapiens
gaaattctcctggagg

SEQ ID NO: 3460550 - DNA, 15 bp, Homo sapiens
gaaattctgaatttg

SEQ ID NO: 3460551 - DNA, 21 bp, Homo sapiens
gaaattgacacaagtggacct

SEQ ID NO: 3460552 - DNA, 20 bp, Homo sapiens
gaaattgcctatcctgctgt

SEQ ID NO: 3460553 - DNA, 21 bp, Homo sapiens
gaaattgcctatcctgctgtt

SEQ ID NO: 3460554 - DNA, 21 bp, Homo sapiens
gaaattttcaagagtctaata

SEQ ID NO: 3460555 - DNA, 16 bp, Homo sapiens
gaaatttttgtaaatc

SEQ ID NO: 3460556 - DNA, 19 bp, Homo sapiens
gaacaaagcagccacgagg

SEQ ID NO: 3460557 - DNA, 15 bp, Homo sapiens
gaacaaagtgagaca

SEQ ID NO: 3460558 - DNA, 19 bp, Homo sapiens
gaacaatattgactttgtc

SEQ ID NO: 3460559 - DNA, 19 bp, Homo sapiens
gaacacaaactgtaaataa

SEQ ID NO: 3460560 - DNA, 20 bp, Homo sapiens
gaacacaaagaccaaaatga

SEQ ID NO: 3460561 - DNA, 21 bp, Homo sapiens
gaacacaaagaccaaaatgaa

SEQ ID NO: 3460562 - DNA, 16 bp, Homo sapiens
gaacacgcgtatttac

SEQ ID NO: 3460563 - DNA, 20 bp, Homo sapiens
gaacactactcttacatgta

SEQ ID NO: 3460564 - DNA, 23 bp, Homo sapiens
gaacactactcttacatgtataa

SEQ ID NO: 3460565 - DNA, 11 bp, Homo sapiens
gaacactgaca

SEQ ID NO: 3460566 - DNA, 19 bp, Homo sapiens
gaacactggcagactgtgt

SEQ ID NO: 3460567 - DNA, 12 bp, Homo sapiens
gaacagaaattg

SEQ ID NO: 3460568 - DNA, 13 bp, Homo sapiens
gaacagaagaaaa

SEQ ID NO: 3460569 - DNA, 11 bp, Homo sapiens
gaacaggacta

SEQ ID NO: 3460570 - DNA, 20 bp, Homo sapiens
gaacagggaaaataggcagg

SEQ ID NO: 3460571 - DNA, 21 bp, Homo sapiens
gaacataaaggtaaaacaaaa

SEQ ID NO: 3460572 - DNA, 17 bp, Homo sapiens
gaacatccaaccttccc

SEQ ID NO: 3460573 - DNA, 12 bp, Homo sapiens
gaacatgcagtt

SEQ ID NO: 3460574 - DNA, 13 bp, Homo sapiens
gaacatgcagttt

SEQ ID NO: 3460575 - DNA, 15 bp, Homo sapiens
gaacatgcagtttga

SEQ ID NO: 3460576 - DNA, 16 bp, Homo sapiens
gaacatgcagtttgaa

SEQ ID NO: 3460577 - DNA, 20 bp, Homo sapiens
gaacatgcagtttgaaattc

SEQ ID NO: 3460578 - DNA, 23 bp, Homo sapiens
gaacatgcagtttgaaattctga

SEQ ID NO: 3460579 - DNA, 19 bp, Homo sapiens
gaacatgtgagaggtttga

SEQ ID NO: 3460580 - DNA, 13 bp, Homo sapiens
gaacattttactg

SEQ ID NO: 3460581 - DNA, 14 bp, Homo sapiens
gaacattttactgt

SEQ ID NO: 3460582 - DNA, 15 bp, Homo sapiens
gaacattttactgtt

SEQ ID NO: 3460583 - DNA, 16 bp, Homo sapiens
gaaccaccacacccag

SEQ ID NO: 3460584 - DNA, 21 bp, Homo sapiens
gaaccaccacacccagcccac

SEQ ID NO: 3460585 - DNA, 23 bp, Homo sapiens
gaaccaccacacccagcccactt

SEQ ID NO: 3460586 - DNA, 12 bp, Homo sapiens
gaaccagcctca

SEQ ID NO: 3460587 - DNA, 15 bp, Homo sapiens
gaaccaggcttggaa

SEQ ID NO: 3460588 - DNA, 19 bp, Homo sapiens
gaaccagtccccccaccct

SEQ ID NO: 3460589 - DNA, 14 bp, Homo sapiens
gaacccaagcctca

SEQ ID NO: 3460590 - DNA, 19 bp, Homo sapiens
gaacccagactcagacatt

SEQ ID NO: 3460591 - DNA, 17 bp, Homo sapiens
gaaccccaaggagggag

SEQ ID NO: 3460592 - DNA, 14 bp, Homo sapiens
gaacccctggctcc

SEQ ID NO: 3460593 - DNA, 21 bp, Homo sapiens
gaacccctggctccttcacca

SEQ ID NO: 3460594 - DNA, 20 bp, Homo sapiens
gaacccggtgctccctctgt

SEQ ID NO: 3460595 - DNA, 14 bp, Homo sapiens
gaaccgcaggaagc

SEQ ID NO: 3460596 - DNA, 16 bp, Homo sapiens
gaaccgcaggaagctg

SEQ ID NO: 3460597 - DNA, 20 bp, Homo sapiens
gaaccgcaggaagctgctcc

SEQ ID NO: 3460598 - DNA, 15 bp, Homo sapiens
gaacctatgaagcaa

SEQ ID NO: 3460599 - DNA, 17 bp, Homo sapiens
gaacctcacgcacctcc

SEQ ID NO: 3460600 - DNA, 15 bp, Homo sapiens
gaacctcagcctggc

SEQ ID NO: 3460601 - DNA, 16 bp, Homo sapiens
gaacctccccagcctg

SEQ ID NO: 3460602 - DNA, 17 bp, Homo sapiens
gaacctccccagcctgc

SEQ ID NO: 3460603 - DNA, 14 bp, Homo sapiens
gaacctcctctgtg

SEQ ID NO: 3460604 - DNA, 15 bp, Homo sapiens
gaacctcctctgtga

SEQ ID NO: 3460605 - DNA, 15 bp, Homo sapiens
gaacctcgagtactg

SEQ ID NO: 3460606 - DNA, 17 bp, Homo sapiens
gaacctgacgtagctgc

SEQ ID NO: 3460607 - DNA, 21 bp, Homo sapiens
gaacctgggttgcagacagga

SEQ ID NO: 3460608 - DNA, 18 bp, Homo sapiens
gaacgatttagaaagaag

SEQ ID NO: 3460609 - DNA, 18 bp, Homo sapiens
gaacgcccccccccaccc

SEQ ID NO: 3460610 - DNA, 20 bp, Homo sapiens
gaacgcccccccccacccct

SEQ ID NO: 3460611 - DNA, 15 bp, Homo sapiens
gaacggtaaatttct

SEQ ID NO: 3460612 - DNA, 20 bp, Homo sapiens
gaactaccttggttccccca

SEQ ID NO: 3460613 - DNA, 15 bp, Homo sapiens
gaactataaagaagt

SEQ ID NO: 3460614 - DNA, 21 bp, Homo sapiens
gaactcacctggggctgctgg

SEQ ID NO: 3460615 - DNA, 22 bp, Homo sapiens
gacctaatgctccttgttccta

SEQ ID NO: 3460616 - DNA, 13 bp, Homo sapiens
gacctaggctcct

SEQ ID NO: 3460617 - DNA, 13 bp, Homo sapiens
gacctcagggcac

SEQ ID NO: 3460618 - DNA, 14 bp, Homo sapiens
gacctcctgcctcc

SEQ ID NO: 3460619 - DNA, 14 bp, Homo sapiens
gacctcttctggag

SEQ ID NO: 3460620 - DNA, 13 bp, Homo sapiens
gacctgaggaagc

SEQ ID NO: 3460621 - DNA, 17 bp, Homo sapiens
gacctgaggctgtggtc

SEQ ID NO: 3460622 - DNA, 21 bp, Homo sapiens
gacctgatcctggaggcccag

SEQ ID NO: 3460623 - DNA, 16 bp, Homo sapiens
gacctgcattgtaaat

SEQ ID NO: 3460624 - DNA, 12 bp, Homo sapiens
gacctgcctgta

SEQ ID NO: 3460625 - DNA, 16 bp, Homo sapiens
gacctggcaaggacac

SEQ ID NO: 3460626 - DNA, 10 bp, Homo sapiens
gacctggcag

SEQ ID NO: 3460627 - DNA, 17 bp, Homo sapiens
gacctggtccacagggc

SEQ ID NO: 3460628 - DNA, 16 bp, Homo sapiens
gacctgtgagcccagc

SEQ ID NO: 3460629 - DNA, 19 bp, Homo sapiens
gacctgttagcagacaggc

SEQ ID NO: 3460630 - DNA, 17 bp, Homo sapiens
gacctgtttatgagatg

SEQ ID NO: 3460631 - DNA, 13 bp, Homo sapiens
gaccttaggcctt

SEQ ID NO: 3460632 - DNA, 16 bp, Homo sapiens
gaccttcatttcatgt

SEQ ID NO: 3460633 - DNA, 23 bp, Homo sapiens
gaccttgaactgggtacttgtgg

SEQ ID NO: 3460634 - DNA, 13 bp, Homo sapiens
gacctttccacca

SEQ ID NO: 3460635 - DNA, 17 bp, Homo sapiens
gacctttccaccacagc

SEQ ID NO: 3460636 - DNA, 21 bp, Homo sapiens
gacctttgtcatctttcttct

SEQ ID NO: 3460637 - DNA, 17 bp, Homo sapiens
gaccttttgggggaggg

SEQ ID NO: 3460638 - DNA, 21 bp, Homo sapiens
gacgaacatccaaccttccca

SEQ ID NO: 3460639 - DNA, 21 bp, Homo sapiens
gacgaacttccatggccctca

SEQ ID NO: 3460640 - DNA, 13 bp, Homo sapiens
gacgcaggcccct

SEQ ID NO: 3460641 - DNA, 14 bp, Homo sapiens
gacgcaggcccctc

SEQ ID NO: 3460642 - DNA, 16 bp, Homo sapiens
gacgcaggcccctctc

SEQ ID NO: 3460643 - DNA, 17 bp, Homo sapiens
gacgcaggcccctctcc

SEQ ID NO: 3460644 - DNA, 12 bp, Homo sapiens
gacgcctggggg

SEQ ID NO: 3460645 - DNA, 23 bp, Homo sapiens
gacggagtcccaccttggctgca

SEQ ID NO: 3460646 - DNA, 23 bp, Homo sapiens
gacgggactcaggcgggacagtg

SEQ ID NO: 3460647 - DNA, 23 bp, Homo sapiens
gacggtgcccaagccagaggctg

SEQ ID NO: 3460648 - DNA, 20 bp, Homo sapiens
gacgtactccaacagaagaa

SEQ ID NO: 3460649 - DNA, 21 bp, Homo sapiens
gacgtagctgcaaaggacaga

SEQ ID NO: 3460650 - DNA, 22 bp, Homo sapiens
gacgtcagtagtttgagaccag

SEQ ID NO: 3460651 - DNA, 22 bp, Homo sapiens
gacgtgaccggacttttctgca

SEQ ID NO: 3460652 - DNA, 22 bp, Homo sapiens
gacgtgattcaattcaacactc

SEQ ID NO: 3460653 - DNA, 12 bp, Homo sapiens
gacgtggctcag

SEQ ID NO: 3460654 - DNA, 14 bp, Homo sapiens
gacgtggctcagcc

SEQ ID NO: 3460655 - DNA, 20 bp, Homo sapiens
gacgtgggctgggcccacaa

SEQ ID NO: 3460656 - DNA, 13 bp, Homo sapiens
gactaaaagatat

SEQ ID NO: 3460657 - DNA, 20 bp, Homo sapiens
gactaatggcatgagaaata

SEQ ID NO: 3460658 - DNA, 18 bp, Homo sapiens
gactacaggcacccacca

SEQ ID NO: 3460659 - DNA, 17 bp, Homo sapiens
gactactcccccaggtg

SEQ ID NO: 3460660 - DNA, 16 bp, Homo sapiens
gactagggagccatgt

SEQ ID NO: 3460661 - DNA, 21 bp, Homo sapiens
gactatatttgggcctgctcc

SEQ ID NO: 3460662 - DNA, 17 bp, Homo sapiens
gactatgcagaggcctg

SEQ ID NO: 3460663 - DNA, 22 bp, Homo sapiens
gactatgcagaggcctggggga

SEQ ID NO: 3460664 - DNA, 23 bp, Homo sapiens
gactcaaaacccatctgggctcc

SEQ ID NO: 3460665 - DNA, 17 bp, Homo sapiens
gactcagaaagccaaca

SEQ ID NO: 3460666 - DNA, 15 bp, Homo sapiens
gactcagaagcctct

SEQ ID NO: 3460667 - DNA, 15 bp, Homo sapiens
gactcagccttcaga

SEQ ID NO: 3460668 - DNA, 19 bp, Homo sapiens
gactcagccttcagacaga

SEQ ID NO: 3460669 - DNA, 18 bp, Homo sapiens
gactcagctccccagagt

SEQ ID NO: 3460670 - DNA, 20 bp, Homo sapiens
gactcagctccccagagtcc

SEQ ID NO: 3460671 - DNA, 13 bp, Homo sapiens
gactcagggcagc

SEQ ID NO: 3460672 - DNA, 17 bp, Homo sapiens
gactcagggcagcgcca

SEQ ID NO: 3460673 - DNA, 23 bp, Homo sapiens
gactcagggcagcgccaggctga

SEQ ID NO: 3460674 - DNA, 14 bp, Homo sapiens
gactcattcttctg

SEQ ID NO: 3460675 - DNA, 12 bp, Homo sapiens
gactccaggccc

SEQ ID NO: 3460676 - DNA, 14 bp, Homo sapiens
gactccaggcccaa

SEQ ID NO: 3460677 - DNA, 13 bp, Homo sapiens
gactccaggtctt

SEQ ID NO: 3460678 - DNA, 23 bp, Homo sapiens
gactcccattcctgaagaaccag

SEQ ID NO: 3460679 - DNA, 14 bp, Homo sapiens
gactccggccctcc

SEQ ID NO: 3460680 - DNA, 15 bp, Homo sapiens
gactccggccctcct

SEQ ID NO: 3460681 - DNA, 22 bp, Homo sapiens
gactccggccctcctaccctgc

SEQ ID NO: 3460682 - DNA, 16 bp, Homo sapiens
gactccggctgtgctg

SEQ ID NO: 3460683 - DNA, 18 bp, Homo sapiens
gactccggctgtgctggg

SEQ ID NO: 3460684 - DNA, 17 bp, Homo sapiens
gactccgttggccactc

SEQ ID NO: 3460685 - DNA, 15 bp, Homo sapiens
gactcctaagggact

SEQ ID NO: 3460686 - DNA, 23 bp, Homo sapiens
gactcctaggcaggacatgctga

SEQ ID NO: 3460687 - DNA, 14 bp, Homo sapiens
gactcgggggtggg

SEQ ID NO: 3460688 - DNA, 19 bp, Homo sapiens
gactcggggtgcttccttg

SEQ ID NO: 3460689 - DNA, 19 bp, Homo sapiens
gactcggtttctccaaact

SEQ ID NO: 3460690 - DNA, 15 bp, Homo sapiens
gactctacagaggcc

SEQ ID NO: 3460691 - DNA, 19 bp, Homo sapiens
gactctgaaatatcccggg

SEQ ID NO: 3460692 - DNA, 16 bp, Homo sapiens
gactctggcttggcct

SEQ ID NO: 3460693 - DNA, 13 bp, Homo sapiens
gactctgggtcct

SEQ ID NO: 3460694 - DNA, 12 bp, Homo sapiens
gactctgtctca

SEQ ID NO: 3460695 - DNA, 19 bp, Homo sapiens
gactctgtctcaaaaaaac

SEQ ID NO: 3460696 - DNA, 16 bp, Homo sapiens
gactctttctgagtgc

SEQ ID NO: 3460697 - DNA, 19 bp, Homo sapiens
gactctttctgagtgcctt

SEQ ID NO: 3460698 - DNA, 18 bp, Homo sapiens
gactgaaaacctctcctc

SEQ ID NO: 3460699 - DNA, 20 bp, Homo sapiens
gactgaaaacctctcctcat

SEQ ID NO: 3460700 - DNA, 20 bp, Homo sapiens
gactgacctggtccacaggg

SEQ ID NO: 3460701 - DNA, 18 bp, Homo sapiens
gactgagcaccctctgga

SEQ ID NO: 3460702 - DNA, 15 bp, Homo sapiens
gactgctcagaactt

SEQ ID NO: 3460703 - DNA, 14 bp, Homo sapiens
gactggaagcacag

SEQ ID NO: 3460704 - DNA, 15 bp, Homo sapiens
gactggactggacca

SEQ ID NO: 3460705 - DNA, 23 bp, Homo sapiens
gactggctgtgtaaccttgggtg

SEQ ID NO: 3460706 - DNA, 16 bp, Homo sapiens
gactggtgccctcctc

SEQ ID NO: 3460707 - DNA, 18 bp, Homo sapiens
gactgtgaacagcttgct

SEQ ID NO: 3460708 - DNA, 21 bp, Homo sapiens
gactgtgtgttgccacaggac

SEQ ID NO: 3460709 - DNA, 14 bp, Homo sapiens
gactgttcaagagc

SEQ ID NO: 3460710 - DNA, 23 bp, Homo sapiens
gactgttcaagagcacacttggc

SEQ ID NO: 3460711 - DNA, 23 bp, Homo sapiens
gacttaatgtgattactgctcta

SEQ ID NO: 3460712 - DNA, 16 bp, Homo sapiens
gacttacctgttcagt

SEQ ID NO: 3460713 - DNA, 17 bp, Homo sapiens
gacttagggcaccaggg

SEQ ID NO: 3460714 - DNA, 12 bp, Homo sapiens
gacttcagattg

SEQ ID NO: 3460715 - DNA, 20 bp, Homo sapiens
gacttcagtatgttgtcaaa

SEQ ID NO: 3460716 - DNA, 18 bp, Homo sapiens
gacttccccggagggctg

SEQ ID NO: 3460717 - DNA, 16 bp, Homo sapiens
gacttccttgagacac

SEQ ID NO: 3460718 - DNA, 15 bp, Homo sapiens
gacttctgcctggag

SEQ ID NO: 3460719 - DNA, 16 bp, Homo sapiens
gacttctgcctggaga

SEQ ID NO: 3460720 - DNA, 13 bp, Homo sapiens
gacttgaagttgt

SEQ ID NO: 3460721 - DNA, 15 bp, Homo sapiens
gacttgaagttgtta

SEQ ID NO: 3460722 - DNA, 22 bp, Homo sapiens
gacttgccttcctaagcctgtg

SEQ ID NO: 3460723 - DNA, 19 bp, Homo sapiens
gactttagaaagctgacat

SEQ ID NO: 3460724 - DNA, 12 bp, Homo sapiens
gactttctgcct

SEQ ID NO: 3460725 - DNA, 16 bp, Homo sapiens
gactttctgcctggag

SEQ ID NO: 3460726 - DNA, 21 bp, Homo sapiens
gacttttaatgtcatttgtta

SEQ ID NO: 3460727 - DNA, 13 bp, Homo sapiens
gacttttctgcaa

SEQ ID NO: 3460728 - DNA, 16 bp, Homo sapiens
gactttttataaaatg

SEQ ID NO: 3460729 - DNA, 14 bp, Homo sapiens
gacttttttgtaca

SEQ ID NO: 3460730 - DNA, 19 bp, Homo sapiens
gacttttttgtacataaat

SEQ ID NO: 3460731 - DNA, 10 bp, Homo sapiens
gagaaaaaaa

SEQ ID NO: 3460732 - DNA, 15 bp, Homo sapiens
gagaaaaaagtcacc

SEQ ID NO: 3460733 - DNA, 13 bp, Homo sapiens
gagaaacagacag

SEQ ID NO: 3460734 - DNA, 21 bp, Homo sapiens
gagaaaccctaaaaagagaag

SEQ ID NO: 3460735 - DNA, 23 bp, Homo sapiens
gagaaaccttattgtacctctct

SEQ ID NO: 3460736 - DNA, 18 bp, Homo sapiens
gagaaaggggagcccact

SEQ ID NO: 3460737 - DNA, 16 bp, Homo sapiens
gagaaaggttgaagca

SEQ ID NO: 3460738 - DNA, 23 bp, Homo sapiens
gagaaagtacttctccaccctgc

SEQ ID NO: 3460739 - DNA, 22 bp, Homo sapiens
gagaacacagccgattcacctg

SEQ ID NO: 3460740 - DNA, 18 bp, Homo sapiens
gagaacaggtggttttta

SEQ ID NO: 3460741 - DNA, 12 bp, Homo sapiens
gagaacatttta

SEQ ID NO: 3460742 - DNA, 23 bp, Homo sapiens
gagaacattttactgttgtacaa

SEQ ID NO: 3460743 - DNA, 13 bp, Homo sapiens
gagaaccaaatct

SEQ ID NO: 3460744 - DNA, 23 bp, Homo sapiens
gagaactcatccctaatgctgca

SEQ ID NO: 3460745 - DNA, 15 bp, Homo sapiens
gagaactcctagggt

SEQ ID NO: 3460746 - DNA, 18 bp, Homo sapiens
gagaactgcatatgtttc

SEQ ID NO: 3460747 - DNA, 19 bp, Homo sapiens
gagaactgcatatgtttcg

SEQ ID NO: 3460748 - DNA, 22 bp, Homo sapiens
gatggccgggcgcggtggctca

SEQ ID NO: 3460749 - DNA, 19 bp, Homo sapiens
gatggcgctattgcactcc

SEQ ID NO: 3460750 - DNA, 12 bp, Homo sapiens
gatggctcctct

SEQ ID NO: 3460751 - DNA, 14 bp, Homo sapiens
gatggctcctctca

SEQ ID NO: 3460752 - DNA, 23 bp, Homo sapiens
gatgggcatatgtgtcagtgggg

SEQ ID NO: 3460753 - DNA, 22 bp, Homo sapiens
gatgggggaactcagatccagg

SEQ ID NO: 3460754 - DNA, 17 bp, Homo sapiens
gatgggggcagggctgt

SEQ ID NO: 3460755 - DNA, 16 bp, Homo sapiens
gatggggtctgtaaaa

SEQ ID NO: 3460756 - DNA, 15 bp, Homo sapiens
gatgggtcagagcta

SEQ ID NO: 3460757 - DNA, 21 bp, Homo sapiens
gatgggtgaaggctggcatga

SEQ ID NO: 3460758 - DNA, 18 bp, Homo sapiens
gatgggtttgacaaggtt

SEQ ID NO: 3460759 - DNA, 19 bp, Homo sapiens
gatggtacgtgaccctctg

SEQ ID NO: 3460760 - DNA, 18 bp, Homo sapiens
gatggtatgtgagctagg

SEQ ID NO: 3460761 - DNA, 15 bp, Homo sapiens
gatggtggagggcca

SEQ ID NO: 3460762 - DNA, 21 bp, Homo sapiens
gatggtgtctcttctttagaa

SEQ ID NO: 3460763 - DNA, 17 bp, Homo sapiens
gatggtgtgccttccag

SEQ ID NO: 3460764 - DNA, 13 bp, Homo sapiens
gatgtaaggcctt

SEQ ID NO: 3460765 - DNA, 21 bp, Homo sapiens
gatgtcctcaccacatgcgga

SEQ ID NO: 3460766 - DNA, 21 bp, Homo sapiens
gatgtctgaactttgggaagc

SEQ ID NO: 3460767 - DNA, 12 bp, Homo sapiens
gatgtgaagcca

SEQ ID NO: 3460768 - DNA, 23 bp, Homo sapiens
gatgtgaagccaattcagacagg

SEQ ID NO: 3460769 - DNA, 18 bp, Homo sapiens
gatgtgattgtggaatgg

SEQ ID NO: 3460770 - DNA, 14 bp, Homo sapiens
gatgttaactttgt

SEQ ID NO: 3460771 - DNA, 20 bp, Homo sapiens
gatgttatgtaaaaggccaa

SEQ ID NO: 3460772 - DNA, 14 bp, Homo sapiens
gatgttctgggaca

SEQ ID NO: 3460773 - DNA, 13 bp, Homo sapiens
gatgtttcatttt

SEQ ID NO: 3460774 - DNA, 23 bp, Homo sapiens
gatgtttcttttgtatgtaaatg

SEQ ID NO: 3460775 - DNA, 14 bp, Homo sapiens
gatgtttttcttta

SEQ ID NO: 3460776 - DNA, 17 bp, Homo sapiens
gattaaatatttgaaga

SEQ ID NO: 3460777 - DNA, 18 bp, Homo sapiens
gattaaatatttgaagag

SEQ ID NO: 3460778 - DNA, 20 bp, Homo sapiens
gattaagacagagaaacaga

SEQ ID NO: 3460779 - DNA, 14 bp, Homo sapiens
gattaatatgaaaa

SEQ ID NO: 3460780 - DNA, 17 bp, Homo sapiens
gattaggtatgtttgta

SEQ ID NO: 3460781 - DNA, 20 bp, Homo sapiens
gattaggtatgtttgtaact

SEQ ID NO: 3460782 - DNA, 19 bp, Homo sapiens
gattaggtttcagcagagc

SEQ ID NO: 3460783 - DNA, 16 bp, Homo sapiens
gattagttttcttgtt

SEQ ID NO: 3460784 - DNA, 23 bp, Homo sapiens
gattagttttcttgttgctttgt

SEQ ID NO: 3460785 - DNA, 14 bp, Homo sapiens
gattattcagtgtc

SEQ ID NO: 3460786 - DNA, 16 bp, Homo sapiens
gattcaaaatatttaa

SEQ ID NO: 3460787 - DNA, 16 bp, Homo sapiens
gattcaaactgctcca

SEQ ID NO: 3460788 - DNA, 23 bp, Homo sapiens
gattcaactaaaaaaaaaaaagt

SEQ ID NO: 3460789 - DNA, 13 bp, Homo sapiens
gattcaagccatt

SEQ ID NO: 3460790 - DNA, 17 bp, Homo sapiens
gattcaagccattccaa

SEQ ID NO: 3460791 - DNA, 13 bp, Homo sapiens
gattcaggaatgt

SEQ ID NO: 3460792 - DNA, 20 bp, Homo sapiens
gattcagtgttaaatgtgat

SEQ ID NO: 3460793 - DNA, 22 bp, Homo sapiens
gattcagttttcatttggttca

SEQ ID NO: 3460794 - DNA, 19 bp, Homo sapiens
gattcatagtaacttctta

SEQ ID NO: 3460795 - DNA, 19 bp, Homo sapiens
gattccaaagagtagaatt

SEQ ID NO: 3460796 - DNA, 16 bp, Homo sapiens
gattcccaagctctgc

SEQ ID NO: 3460797 - DNA, 18 bp, Homo sapiens
gattcccaagctctgctc

SEQ ID NO: 3460798 - DNA, 19 bp, Homo sapiens
gattcccaagctctgctcc

SEQ ID NO: 3460799 - DNA, 22 bp, Homo sapiens
gattcccaagctctgctcctct

SEQ ID NO: 3460800 - DNA, 21 bp, Homo sapiens
gattcccctaacctcattccc

SEQ ID NO: 3460801 - DNA, 12 bp, Homo sapiens
gattctccttca

SEQ ID NO: 3460802 - DNA, 12 bp, Homo sapiens
gattctgaatct

SEQ ID NO: 3460803 - DNA, 19 bp, Homo sapiens
gattctgataatgctcact

SEQ ID NO: 3460804 - DNA, 21 bp, Homo sapiens
gattctggacagtcagctctt

SEQ ID NO: 3460805 - DNA, 15 bp, Homo sapiens
gattcttctgcttca

SEQ ID NO: 3460806 - DNA, 20 bp, Homo sapiens
gattcttctgcttcagcctc

SEQ ID NO: 3460807 - DNA, 17 bp, Homo sapiens
gattgacagctttgctg

SEQ ID NO: 3460808 - DNA, 19 bp, Homo sapiens
gattgacagctttgctgct

SEQ ID NO: 3460809 - DNA, 17 bp, Homo sapiens
gattgatttgaagaaca

SEQ ID NO: 3460810 - DNA, 15 bp, Homo sapiens
gattgcaacaggctg

SEQ ID NO: 3460811 - DNA, 16 bp, Homo sapiens
gattgcaacaggctgg

SEQ ID NO: 3460812 - DNA, 13 bp, Homo sapiens
gattgctgccaga

SEQ ID NO: 3460813 - DNA, 15 bp, Homo sapiens
gattgctgccagaga

SEQ ID NO: 3460814 - DNA, 15 bp, Homo sapiens
gattggaatgcagag

SEQ ID NO: 3460815 - DNA, 22 bp, Homo sapiens
gattggagatagggaaagaaag

SEQ ID NO: 3460816 - DNA, 15 bp, Homo sapiens
gattggcgcccccct

SEQ ID NO: 3460817 - DNA, 20 bp, Homo sapiens
gattgggtgggcaggaaaag

SEQ ID NO: 3460818 - DNA, 22 bp, Homo sapiens
gattgtaaaccgctttggcctg

SEQ ID NO: 3460819 - DNA, 20 bp, Homo sapiens
gattgttggtgaattttcaa

SEQ ID NO: 3460820 - DNA, 13 bp, Homo sapiens
gattgtttacagg

SEQ ID NO: 3460821 - DNA, 14 bp, Homo sapiens
gatttaacagcatg

SEQ ID NO: 3460822 - DNA, 19 bp, Homo sapiens
gatttaacagcatgacaaa

SEQ ID NO: 3460823 - DNA, 20 bp, Homo sapiens
gatttaagttacaatgtttt

SEQ ID NO: 3460824 - DNA, 16 bp, Homo sapiens
gatttagccatgtgaa

SEQ ID NO: 3460825 - DNA, 20 bp, Homo sapiens
gatttaggagaagccaggaa

SEQ ID NO: 3460826 - DNA, 11 bp, Homo sapiens
gatttatttgc

SEQ ID NO: 3460827 - DNA, 15 bp, Homo sapiens
gatttatttgcttct

SEQ ID NO: 3460828 - DNA, 17 bp, Homo sapiens
gatttatttgcttcttc

SEQ ID NO: 3460829 - DNA, 17 bp, Homo sapiens
gatttcatctgctctcc

SEQ ID NO: 3460830 - DNA, 20 bp, Homo sapiens
gatttcatctgctctccttc

SEQ ID NO: 3460831 - DNA, 22 bp, Homo sapiens
gatttcatctgctctccttcct

SEQ ID NO: 3460832 - DNA, 22 bp, Homo sapiens
gatttcctgctttgggaagccg

SEQ ID NO: 3460833 - DNA, 11 bp, Homo sapiens
gatttcctgtg

SEQ ID NO: 3460834 - DNA, 20 bp, Homo sapiens
gatttctgtctactaagtga

SEQ ID NO: 3460835 - DNA, 18 bp, Homo sapiens
gatttgaagaacatgtga

SEQ ID NO: 3460836 - DNA, 13 bp, Homo sapiens
gatttgacattgc

SEQ ID NO: 3460837 - DNA, 20 bp, Homo sapiens
gatttgcatttcagaatatt

SEQ ID NO: 3460838 - DNA, 19 bp, Homo sapiens
gatttgttaatgatagcta

SEQ ID NO: 3460839 - DNA, 23 bp, Homo sapiens
gattttaatagggaatatatctc

SEQ ID NO: 3460840 - DNA, 15 bp, Homo sapiens
gattttaattttgaa

SEQ ID NO: 3460841 - DNA, 18 bp, Homo sapiens
gattttacaattgaaatg

SEQ ID NO: 3460842 - DNA, 16 bp, Homo sapiens
gattttgtaacccaga

SEQ ID NO: 3460843 - DNA, 21 bp, Homo sapiens
gatttttaaaaaatattttct

SEQ ID NO: 3460844 - DNA, 11 bp, Homo sapiens
gcaaaaaatac

SEQ ID NO: 3460845 - DNA, 18 bp, Homo sapiens
gcaaaaaatactttttct

SEQ ID NO: 3460846 - DNA, 15 bp, Homo sapiens
gcaaaaacatgtatg

SEQ ID NO: 3460847 - DNA, 22 bp, Homo sapiens
gcaaaaacatgtatgtgcattt

SEQ ID NO: 3460848 - DNA, 23 bp, Homo sapiens
gcaaaaatatttataaaacttct

SEQ ID NO: 3460849 - DNA, 17 bp, Homo sapiens
gcaaaactctacttaat

SEQ ID NO: 3460850 - DNA, 15 bp, Homo sapiens
gcaaaagatgcttct

SEQ ID NO: 3460851 - DNA, 22 bp, Homo sapiens
gcaaaagatgcttctcactgcc

SEQ ID NO: 3460852 - DNA, 23 bp, Homo sapiens
gcaaaaggatctttgtggccaag

SEQ ID NO: 3460853 - DNA, 13 bp, Homo sapiens
gcaaaattgcaaa

SEQ ID NO: 3460854 - DNA, 15 bp, Homo sapiens
gcaaacccagacggc

SEQ ID NO: 3460855 - DNA, 15 bp, Homo sapiens
gcaaacgctgcctgc

SEQ ID NO: 3460856 - DNA, 18 bp, Homo sapiens
gcaaactatttgcgactc

SEQ ID NO: 3460857 - DNA, 18 bp, Homo sapiens
gcaaactgtgcttctcta

SEQ ID NO: 3460858 - DNA, 19 bp, Homo sapiens
gcaaactgtgcttctctat

SEQ ID NO: 3460859 - DNA, 21 bp, Homo sapiens
gcaaactgtgcttctctatga

SEQ ID NO: 3460860 - DNA, 21 bp, Homo sapiens
gcaaagactattcccttctaa

SEQ ID NO: 3460861 - DNA, 22 bp, Homo sapiens
gcaaagactattcccttctaac

SEQ ID NO: 3460862 - DNA, 13 bp, Homo sapiens
gcaaagaggcaag

SEQ ID NO: 3460863 - DNA, 20 bp, Homo sapiens
gcaaagatctgtcctcagcc

SEQ ID NO: 3460864 - DNA, 18 bp, Homo sapiens
gcaaagccaaggcagcga

SEQ ID NO: 3460865 - DNA, 18 bp, Homo sapiens
gcaaagggagcactgggt

SEQ ID NO: 3460866 - DNA, 14 bp, Homo sapiens
gcaaagggcatggg

SEQ ID NO: 3460867 - DNA, 13 bp, Homo sapiens
gcaaaggggacag

SEQ ID NO: 3460868 - DNA, 14 bp, Homo sapiens
gcaaaggggacagc

SEQ ID NO: 3460869 - DNA, 19 bp, Homo sapiens
gcaaaggggacagctgtgt

SEQ ID NO: 3460870 - DNA, 13 bp, Homo sapiens
gcaaagtactgta

SEQ ID NO: 3460871 - DNA, 14 bp, Homo sapiens
gcaaagtactgtaa

SEQ ID NO: 3460872 - DNA, 22 bp, Homo sapiens
gcaaagtactgtaagaataatt

SEQ ID NO: 3460873 - DNA, 22 bp, Homo sapiens
gcaaagtcatgcaaaggctggg

SEQ ID NO: 3460874 - DNA, 17 bp, Homo sapiens
gcaaagtgttttgtacc

SEQ ID NO: 3460875 - DNA, 12 bp, Homo sapiens
gcaaataaaagt

SEQ ID NO: 3460876 - DNA, 15 bp, Homo sapiens
gcaaatcatagctgg

SEQ ID NO: 3460877 - DNA, 12 bp, Homo sapiens
gcaaatcttgaa

SEQ ID NO: 3460878 - DNA, 17 bp, Homo sapiens
gcaaatgtttaaacatt

SEQ ID NO: 3460879 - DNA, 16 bp, Homo sapiens
gcaaattcttttgaat

SEQ ID NO: 3460880 - DNA, 14 bp, Homo sapiens
gcccaagcttccct

SEQ ID NO: 3460881 - DNA, 15 bp, Homo sapiens
gcccaagcttccctc

SEQ ID NO: 3460882 - DNA, 20 bp, Homo sapiens
gcccaagcttccctccatcc

SEQ ID NO: 3460883 - DNA, 15 bp, Homo sapiens
gcccaaggctcccgg

SEQ ID NO: 3460884 - DNA, 15 bp, Homo sapiens
gcccacccctcaaca

SEQ ID NO: 3460885 - DNA, 13 bp, Homo sapiens
gcccaccttggct

SEQ ID NO: 3460886 - DNA, 15 bp, Homo sapiens
gcccaccttggctca

SEQ ID NO: 3460887 - DNA, 21 bp, Homo sapiens
gcccacgctggagtgcagtga

SEQ ID NO: 3460888 - DNA, 24 bp, Homo sapiens
gcccactgtcctgggcctgcagaa

SEQ ID NO: 3460889 - DNA, 17 bp, Homo sapiens
gcccagaaaacctccag

SEQ ID NO: 3460890 - DNA, 17 bp, Homo sapiens
gcccagaccggcttctc

SEQ ID NO: 3460891 - DNA, 15 bp, Homo sapiens
gcccagagcccagct

SEQ ID NO: 3460892 - DNA, 21 bp, Homo sapiens
gcccagcactgcttgaggaaa

SEQ ID NO: 3460893 - DNA, 20 bp, Homo sapiens
gcccagccaaaccctgtctg

SEQ ID NO: 3460894 - DNA, 14 bp, Homo sapiens
gcccagccaggccc

SEQ ID NO: 3460895 - DNA, 17 bp, Homo sapiens
gcccagcccctactgct

SEQ ID NO: 3460896 - DNA, 18 bp, Homo sapiens
gcccagcccctactgctg

SEQ ID NO: 3460897 - DNA, 16 bp, Homo sapiens
gcccagccctccccat

SEQ ID NO: 3460898 - DNA, 13 bp, Homo sapiens
gcccagctctgaa

SEQ ID NO: 3460899 - DNA, 13 bp, Homo sapiens
gcccagctgggtc

SEQ ID NO: 3460900 - DNA, 13 bp, Homo sapiens
gcccaggcaggtc

SEQ ID NO: 3460901 - DNA, 14 bp, Homo sapiens
gcccaggcaggtct

SEQ ID NO: 3460902 - DNA, 11 bp, Homo sapiens
gcccaggcccc

SEQ ID NO: 3460903 - DNA, 12 bp, Homo sapiens
gcccaggctggc

SEQ ID NO: 3460904 - DNA, 16 bp, Homo sapiens
gcccaggctggcgtgc

SEQ ID NO: 3460905 - DNA, 20 bp, Homo sapiens
gcccaggctggcgtgcagtg

SEQ ID NO: 3460906 - DNA, 13 bp, Homo sapiens
gcccaggctggga

SEQ ID NO: 3460907 - DNA, 16 bp, Homo sapiens
gcccagggagcggaaa

SEQ ID NO: 3460908 - DNA, 16 bp, Homo sapiens
gcccagggcaagctcc

SEQ ID NO: 3460909 - DNA, 21 bp, Homo sapiens
gcccagggcatcttgctggct

SEQ ID NO: 3460910 - DNA, 23 bp, Homo sapiens
gcccagggcatcttgctggctac

SEQ ID NO: 3460911 - DNA, 16 bp, Homo sapiens
gcccagggcccagagc

SEQ ID NO: 3460912 - DNA, 20 bp, Homo sapiens
gcccagggcccagagcccag

SEQ ID NO: 3460913 - DNA, 23 bp, Homo sapiens
gcccagggcccagagcccagctc

SEQ ID NO: 3460914 - DNA, 15 bp, Homo sapiens
gcccagggctcctgc

SEQ ID NO: 3460915 - DNA, 18 bp, Homo sapiens
gcccagggctcctgcact

SEQ ID NO: 3460916 - DNA, 18 bp, Homo sapiens
gcccagtccttccacctc

SEQ ID NO: 3460917 - DNA, 21 bp, Homo sapiens
gcccagtcgaccccaaaggaa

SEQ ID NO: 3460918 - DNA, 14 bp, Homo sapiens
gcccagtctgttga

SEQ ID NO: 3460919 - DNA, 22 bp, Homo sapiens
gcccagtgttttctttgaggac

SEQ ID NO: 3460920 - DNA, 19 bp, Homo sapiens
gcccagttgggtggatgcc

SEQ ID NO: 3460921 - DNA, 16 bp, Homo sapiens
gcccatactggttggc

SEQ ID NO: 3460922 - DNA, 18 bp, Homo sapiens
gcccatccccaggcacct

SEQ ID NO: 3460923 - DNA, 13 bp, Homo sapiens
gcccatccttccc

SEQ ID NO: 3460924 - DNA, 20 bp, Homo sapiens
gcccatggacaggctggctc

SEQ ID NO: 3460925 - DNA, 15 bp, Homo sapiens
gcccatttcgtgagc

SEQ ID NO: 3460926 - DNA, 18 bp, Homo sapiens
gccccaaacaaatatgca

SEQ ID NO: 3460927 - DNA, 22 bp, Homo sapiens
gccccaaagtaaaagaaaccac

SEQ ID NO: 3460928 - DNA, 21 bp, Homo sapiens
gccccaactctcccctgacct

SEQ ID NO: 3460929 - DNA, 19 bp, Homo sapiens
gccccaatccctttattac

SEQ ID NO: 3460930 - DNA, 21 bp, Homo sapiens
gccccacatgtggccatggcc

SEQ ID NO: 3460931 - DNA, 22 bp, Homo sapiens
gccccacccagatgggggaaag

SEQ ID NO: 3460932 - DNA, 12 bp, Homo sapiens
gccccaccctgg

SEQ ID NO: 3460933 - DNA, 14 bp, Homo sapiens
gccccaccctgggc

SEQ ID NO: 3460934 - DNA, 24 bp, Homo sapiens
gccccaccctgggccctgggctgg

SEQ ID NO: 3460935 - DNA, 14 bp, Homo sapiens
gccccactctgcct

SEQ ID NO: 3460936 - DNA, 14 bp, Homo sapiens
gccccagcccagat

SEQ ID NO: 3460937 - DNA, 16 bp, Homo sapiens
gccccagcctccctga

SEQ ID NO: 3460938 - DNA, 21 bp, Homo sapiens
gccccagcctccctgaagcct

SEQ ID NO: 3460939 - DNA, 12 bp, Homo sapiens
gccccagcctgc

SEQ ID NO: 3460940 - DNA, 13 bp, Homo sapiens
gccccagcctgct

SEQ ID NO: 3460941 - DNA, 17 bp, Homo sapiens
gccccagcctgctagct

SEQ ID NO: 3460942 - DNA, 14 bp, Homo sapiens
gccccaggaagccg

SEQ ID NO: 3460943 - DNA, 12 bp, Homo sapiens
gccccaggacca

SEQ ID NO: 3460944 - DNA, 18 bp, Homo sapiens
gccccaggaccagctcag

SEQ ID NO: 3460945 - DNA, 22 bp, Homo sapiens
gccccaggcagggccaaccctt

SEQ ID NO: 3460946 - DNA, 23 bp, Homo sapiens
gccccagtcccaccctgctgctg

SEQ ID NO: 3460947 - DNA, 15 bp, Homo sapiens
gccccagtgcccaca

SEQ ID NO: 3460948 - DNA, 17 bp, Homo sapiens
gccccagtgcccacagg

SEQ ID NO: 3460949 - DNA, 17 bp, Homo sapiens
gccccatcctccagcag

SEQ ID NO: 3460950 - DNA, 20 bp, Homo sapiens
gccccatctcccctcagctc

SEQ ID NO: 3460951 - DNA, 15 bp, Homo sapiens
gccccatctgtgcat

SEQ ID NO: 3460952 - DNA, 20 bp, Homo sapiens
gccccattctgcctgcccag

SEQ ID NO: 3460953 - DNA, 23 bp, Homo sapiens
gccccattctgcctgcccaggcc

SEQ ID NO: 3460954 - DNA, 22 bp, Homo sapiens
gccccattcttttgtaatttaa

SEQ ID NO: 3460955 - DNA, 11 bp, Homo sapiens
gcccccacagg

SEQ ID NO: 3460956 - DNA, 13 bp, Homo sapiens
gcccccacaggcc

SEQ ID NO: 3460957 - DNA, 17 bp, Homo sapiens
gcccccactgaccagaa

SEQ ID NO: 3460958 - DNA, 14 bp, Homo sapiens
gcccccacttgcct

SEQ ID NO: 3460959 - DNA, 21 bp, Homo sapiens
gcccccacttgcctcttcctt

SEQ ID NO: 3460960 - DNA, 17 bp, Homo sapiens
gcccccagcccagggct

SEQ ID NO: 3460961 - DNA, 18 bp, Homo sapiens
gcccccagcccagggctc

SEQ ID NO: 3460962 - DNA, 21 bp, Homo sapiens
gcccccagctaagaacctgga

SEQ ID NO: 3460963 - DNA, 12 bp, Homo sapiens
gcccccaggact

SEQ ID NO: 3460964 - DNA, 13 bp, Homo sapiens
gcccccaggactg

SEQ ID NO: 3460965 - DNA, 15 bp, Homo sapiens
gcccccaggactggg

SEQ ID NO: 3460966 - DNA, 17 bp, Homo sapiens
gcccccaggactgggcc

SEQ ID NO: 3460967 - DNA, 13 bp, Homo sapiens
gcccccatctcat

SEQ ID NO: 3460968 - DNA, 21 bp, Homo sapiens
gccccccacccctggaagagc

SEQ ID NO: 3460969 - DNA, 13 bp, Homo sapiens
gccccccgcagca

SEQ ID NO: 3460970 - DNA, 23 bp, Homo sapiens
gcccccctttggtttggcctcca

SEQ ID NO: 3460971 - DNA, 20 bp, Homo sapiens
gccccctccgccctgccact

SEQ ID NO: 3460972 - DNA, 19 bp, Homo sapiens
gccccctgcccgtgtacat

SEQ ID NO: 3460973 - DNA, 12 bp, Homo sapiens
gccccctgccct

SEQ ID NO: 3460974 - DNA, 19 bp, Homo sapiens
gccccctgccctcccctct

SEQ ID NO: 3460975 - DNA, 23 bp, Homo sapiens
gccccgaggccttctctgaagga

SEQ ID NO: 3460976 - DNA, 20 bp, Homo sapiens
gccccgcttccccacagaac

SEQ ID NO: 3460977 - DNA, 18 bp, Homo sapiens
gccccggtggctgggcag

SEQ ID NO: 3460978 - DNA, 13 bp, Homo sapiens
gccccgtgaggca

SEQ ID NO: 3460979 - DNA, 17 bp, Homo sapiens
gcccctaatctctgtag

SEQ ID NO: 3460980 - DNA, 19 bp, Homo sapiens
gcccctactgctgtgaacc

SEQ ID NO: 3460981 - DNA, 22 bp, Homo sapiens
gcccctctcctccgtggcacat

SEQ ID NO: 3460982 - DNA, 18 bp, Homo sapiens
gcccctctggtcgctcct

SEQ ID NO: 3460983 - DNA, 22 bp, Homo sapiens
gcccctctggtcgctcctgccc

SEQ ID NO: 3460984 - DNA, 14 bp, Homo sapiens
gcccctgccaccct

SEQ ID NO: 3460985 - DNA, 15 bp, Homo sapiens
gcccctgctgctgtc

SEQ ID NO: 3460986 - DNA, 15 bp, Homo sapiens
gcccctgctggttca

SEQ ID NO: 3460987 - DNA, 21 bp, Homo sapiens
gcccctggaggctgcctccca

SEQ ID NO: 3460988 - DNA, 13 bp, Homo sapiens
gcccctggcccca

SEQ ID NO: 3460989 - DNA, 18 bp, Homo sapiens
gcccctggccccgcctgc

SEQ ID NO: 3460990 - DNA, 22 bp, Homo sapiens
gccccttactatgatctcagga

SEQ ID NO: 3460991 - DNA, 15 bp, Homo sapiens
gccccttctgctcag

SEQ ID NO: 3460992 - DNA, 15 bp, Homo sapiens
gcccctttacggaca

SEQ ID NO: 3460993 - DNA, 18 bp, Homo sapiens
gcccgcggggacattggg

SEQ ID NO: 3460994 - DNA, 17 bp, Homo sapiens
gcccggagctccggcct

SEQ ID NO: 3460995 - DNA, 15 bp, Homo sapiens
gcccggcagggcggg

SEQ ID NO: 3460996 - DNA, 17 bp, Homo sapiens
gcccggcagggcgggca

SEQ ID NO: 3460997 - DNA, 12 bp, Homo sapiens
gcccggccagcc

SEQ ID NO: 3460998 - DNA, 18 bp, Homo sapiens
gcccggcctattgcttgg

SEQ ID NO: 3460999 - DNA, 16 bp, Homo sapiens
gcccggctccaggctc

SEQ ID NO: 3461000 - DNA, 17 bp, Homo sapiens
gcccgtaaacacgcctg

SEQ ID NO: 3461001 - DNA, 13 bp, Homo sapiens
gcccgtcctgcct

SEQ ID NO: 3461002 - DNA, 18 bp, Homo sapiens
gccctaaaccctgttcct

SEQ ID NO: 3461003 - DNA, 12 bp, Homo sapiens
gccctaacttct

SEQ ID NO: 3461004 - DNA, 16 bp, Homo sapiens
gccctaattcagccat

SEQ ID NO: 3461005 - DNA, 21 bp, Homo sapiens
gccctacttctttgctttgcc

SEQ ID NO: 3461006 - DNA, 18 bp, Homo sapiens
gccctcacccctggttct

SEQ ID NO: 3461007 - DNA, 21 bp, Homo sapiens
gccctcacccctggttctcat

SEQ ID NO: 3461008 - DNA, 17 bp, Homo sapiens
gccctcagaacccttgg

SEQ ID NO: 3461009 - DNA, 19 bp, Homo sapiens
gccctcagaacccttggct

SEQ ID NO: 3461010 - DNA, 15 bp, Homo sapiens
gccctcccctctctg

SEQ ID NO: 3461011 - DNA, 19 bp, Homo sapiens
gccctcccctctctgcacc

SEQ ID NO: 3461012 - DNA, 22 bp, Homo sapiens
gccctccctgttccccagagaa

SEQ ID NO: 3461013 - DNA, 22 bp, Homo sapiens
gctcaagtcctcttttctgaga

SEQ ID NO: 3461014 - DNA, 13 bp, Homo sapiens
gctcacacacctg

SEQ ID NO: 3461015 - DNA, 13 bp, Homo sapiens
gctcacagctgtg

SEQ ID NO: 3461016 - DNA, 12 bp, Homo sapiens
gctcaccagccc

SEQ ID NO: 3461017 - DNA, 15 bp, Homo sapiens
gctcaccagccccag

SEQ ID NO: 3461018 - DNA, 19 bp, Homo sapiens
gctcaccagccccagtgcc

SEQ ID NO: 3461019 - DNA, 11 bp, Homo sapiens
gctcacctggg

SEQ ID NO: 3461020 - DNA, 12 bp, Homo sapiens
gctcacctgggg

SEQ ID NO: 3461021 - DNA, 13 bp, Homo sapiens
gctcacctggggt

SEQ ID NO: 3461022 - DNA, 18 bp, Homo sapiens
gctcacgcttcacagtga

SEQ ID NO: 3461023 - DNA, 22 bp, Homo sapiens
gctcacgtgagagtgtcttcac

SEQ ID NO: 3461024 - DNA, 12 bp, Homo sapiens
gctcactgcagc

SEQ ID NO: 3461025 - DNA, 13 bp, Homo sapiens
gctcactgcagcc

SEQ ID NO: 3461026 - DNA, 14 bp, Homo sapiens
gctcactgcagcct

SEQ ID NO: 3461027 - DNA, 16 bp, Homo sapiens
gctcactgcagcctca

SEQ ID NO: 3461028 - DNA, 20 bp, Homo sapiens
gctcagaacttgctgctgtc

SEQ ID NO: 3461029 - DNA, 16 bp, Homo sapiens
gctcagacatgttttc

SEQ ID NO: 3461030 - DNA, 14 bp, Homo sapiens
gctcagacattttc

SEQ ID NO: 3461031 - DNA, 16 bp, Homo sapiens
gctcagaccagctctt

SEQ ID NO: 3461032 - DNA, 16 bp, Homo sapiens
gctcagagagggcagg

SEQ ID NO: 3461033 - DNA, 19 bp, Homo sapiens
gctcagagagggcaggcat

SEQ ID NO: 3461034 - DNA, 19 bp, Homo sapiens
gctcagaggcgcactgtga

SEQ ID NO: 3461035 - DNA, 20 bp, Homo sapiens
gctcagaggcgcactgtgac

SEQ ID NO: 3461036 - DNA, 13 bp, Homo sapiens
gctcagccagcac

SEQ ID NO: 3461037 - DNA, 23 bp, Homo sapiens
gctcagcggggacagctccttct

SEQ ID NO: 3461038 - DNA, 16 bp, Homo sapiens
gctcagctctgggcca

SEQ ID NO: 3461039 - DNA, 13 bp, Homo sapiens
gctcagcttctcc

SEQ ID NO: 3461040 - DNA, 16 bp, Homo sapiens
gctcagcttctcctgt

SEQ ID NO: 3461041 - DNA, 16 bp, Homo sapiens
gctcaggaccaggcaa

SEQ ID NO: 3461042 - DNA, 16 bp, Homo sapiens
gctcaggactcagaag

SEQ ID NO: 3461043 - DNA, 15 bp, Homo sapiens
gctcagggaaatggc

SEQ ID NO: 3461044 - DNA, 18 bp, Homo sapiens
gctcagggaaatggcctt

SEQ ID NO: 3461045 - DNA, 16 bp, Homo sapiens
gctcaggtacttgtaa

SEQ ID NO: 3461046 - DNA, 16 bp, Homo sapiens
gctcaggtgtccctgc

SEQ ID NO: 3461047 - DNA, 17 bp, Homo sapiens
gctcaggtgtccctgca

SEQ ID NO: 3461048 - DNA, 17 bp, Homo sapiens
gctcagtgcaacctctg

SEQ ID NO: 3461049 - DNA, 17 bp, Homo sapiens
gctcagttcagaatcac

SEQ ID NO: 3461050 - DNA, 18 bp, Homo sapiens
gctcataacggatcagaa

SEQ ID NO: 3461051 - DNA, 13 bp, Homo sapiens
gctcatctatttg

SEQ ID NO: 3461052 - DNA, 17 bp, Homo sapiens
gctcatgtgtgcaacag

SEQ ID NO: 3461053 - DNA, 15 bp, Homo sapiens
gctcattctgcacct

SEQ ID NO: 3461054 - DNA, 15 bp, Homo sapiens
gctccaacctgcaaa

SEQ ID NO: 3461055 - DNA, 19 bp, Homo sapiens
gctccaccctggccgagtc

SEQ ID NO: 3461056 - DNA, 22 bp, Homo sapiens
gctccagacctgatcctggagg

SEQ ID NO: 3461057 - DNA, 20 bp, Homo sapiens
gctccagagggcactctgct

SEQ ID NO: 3461058 - DNA, 21 bp, Homo sapiens
gctccagatgcagggcagtca

SEQ ID NO: 3461059 - DNA, 22 bp, Homo sapiens
gctccagatgcagggcagtcat

SEQ ID NO: 3461060 - DNA, 14 bp, Homo sapiens
gctccagctcacca

SEQ ID NO: 3461061 - DNA, 13 bp, Homo sapiens
gctccagctgccc

SEQ ID NO: 3461062 - DNA, 16 bp, Homo sapiens
gctccagctgccccgg

SEQ ID NO: 3461063 - DNA, 21 bp, Homo sapiens
gctccagctgccccggcccct

SEQ ID NO: 3461064 - DNA, 24 bp, Homo sapiens
gctccaggctcctttagcgcccag

SEQ ID NO: 3461065 - DNA, 21 bp, Homo sapiens
gctccaggtaccttgaccttt

SEQ ID NO: 3461066 - DNA, 17 bp, Homo sapiens
gctccatttacaaacta

SEQ ID NO: 3461067 - DNA, 12 bp, Homo sapiens
gctcccagcctc

SEQ ID NO: 3461068 - DNA, 13 bp, Homo sapiens
gctcccagcctca

SEQ ID NO: 3461069 - DNA, 17 bp, Homo sapiens
gctcccagcctcagcgc

SEQ ID NO: 3461070 - DNA, 22 bp, Homo sapiens
gctcccagggacacctgggaga

SEQ ID NO: 3461071 - DNA, 20 bp, Homo sapiens
gctcccaggtgcagccagag

SEQ ID NO: 3461072 - DNA, 14 bp, Homo sapiens
gctcccgctgtggc

SEQ ID NO: 3461073 - DNA, 14 bp, Homo sapiens
gctcccgtggcctg

SEQ ID NO: 3461074 - DNA, 20 bp, Homo sapiens
gctccctaccacctccccag

SEQ ID NO: 3461075 - DNA, 14 bp, Homo sapiens
gctccctcccagga

SEQ ID NO: 3461076 - DNA, 15 bp, Homo sapiens
gctccctcccaggac

SEQ ID NO: 3461077 - DNA, 16 bp, Homo sapiens
gctccctgactgggag

SEQ ID NO: 3461078 - DNA, 21 bp, Homo sapiens
gctccctgtaacctcttcaga

SEQ ID NO: 3461079 - DNA, 15 bp, Homo sapiens
gctccgaaattccaa

SEQ ID NO: 3461080 - DNA, 14 bp, Homo sapiens
gctccgcaggactt

SEQ ID NO: 3461081 - DNA, 16 bp, Homo sapiens
gctccgcaggacttcc

SEQ ID NO: 3461082 - DNA, 18 bp, Homo sapiens
gctccgctttctacccag

SEQ ID NO: 3461083 - DNA, 15 bp, Homo sapiens
gctcctagagggagg

SEQ ID NO: 3461084 - DNA, 18 bp, Homo sapiens
gctcctcatccagggctc

SEQ ID NO: 3461085 - DNA, 15 bp, Homo sapiens
gctcctccctctgac

SEQ ID NO: 3461086 - DNA, 20 bp, Homo sapiens
gctcctcctccctgcatctg

SEQ ID NO: 3461087 - DNA, 18 bp, Homo sapiens
gctcctctccccagccca

SEQ ID NO: 3461088 - DNA, 23 bp, Homo sapiens
gctcctctccccagcccagagac

SEQ ID NO: 3461089 - DNA, 13 bp, Homo sapiens
gctcctctctttg

SEQ ID NO: 3461090 - DNA, 17 bp, Homo sapiens
gctcctgagggagctcc

SEQ ID NO: 3461091 - DNA, 12 bp, Homo sapiens
gctcctgcactt

SEQ ID NO: 3461092 - DNA, 20 bp, Homo sapiens
gctcctggcccactgcatcg

SEQ ID NO: 3461093 - DNA, 14 bp, Homo sapiens
gctcctgggcagct

SEQ ID NO: 3461094 - DNA, 20 bp, Homo sapiens
gctcctgtggccccaccctg

SEQ ID NO: 3461095 - DNA, 23 bp, Homo sapiens
gctccttcctggagactgcccag

SEQ ID NO: 3461096 - DNA, 15 bp, Homo sapiens
gctccttctgtccta

SEQ ID NO: 3461097 - DNA, 22 bp, Homo sapiens
gctccttgggaggccccactgg

SEQ ID NO: 3461098 - DNA, 11 bp, Homo sapiens
gctccttgggc

SEQ ID NO: 3461099 - DNA, 14 bp, Homo sapiens
gctccttgggccct

SEQ ID NO: 3461100 - DNA, 16 bp, Homo sapiens
gctccttgttcctaga

SEQ ID NO: 3461101 - DNA, 13 bp, Homo sapiens
gctcctttgtgtg

SEQ ID NO: 3461102 - DNA, 16 bp, Homo sapiens
gctcgaatctctgtgc

SEQ ID NO: 3461103 - DNA, 20 bp, Homo sapiens
gctcgagcagtcctgcctca

SEQ ID NO: 3461104 - DNA, 13 bp, Homo sapiens
gctcgccaaggcc

SEQ ID NO: 3461105 - DNA, 16 bp, Homo sapiens
gctcgccaaggcctag

SEQ ID NO: 3461106 - DNA, 18 bp, Homo sapiens
gctcgccaaggcctagga

SEQ ID NO: 3461107 - DNA, 19 bp, Homo sapiens
gctcgccaaggcctaggac

SEQ ID NO: 3461108 - DNA, 14 bp, Homo sapiens
gctcgctgttgctg

SEQ ID NO: 3461109 - DNA, 13 bp, Homo sapiens
gctcggctcagct

SEQ ID NO: 3461110 - DNA, 18 bp, Homo sapiens
gctctacccagggcctgc

SEQ ID NO: 3461111 - DNA, 14 bp, Homo sapiens
gctctagatgagct

SEQ ID NO: 3461112 - DNA, 15 bp, Homo sapiens
gctctagtgccttct

SEQ ID NO: 3461113 - DNA, 16 bp, Homo sapiens
gctctatgtttacaaa

SEQ ID NO: 3461114 - DNA, 20 bp, Homo sapiens
gctctatttcttcttcacat

SEQ ID NO: 3461115 - DNA, 18 bp, Homo sapiens
gctctcaagttatcaggg

SEQ ID NO: 3461116 - DNA, 14 bp, Homo sapiens
gctctcatctgagg

SEQ ID NO: 3461117 - DNA, 15 bp, Homo sapiens
gctctcatctgaggc

SEQ ID NO: 3461118 - DNA, 16 bp, Homo sapiens
gctctccaaaccactt

SEQ ID NO: 3461119 - DNA, 17 bp, Homo sapiens
gctctcctgtgcattgt

SEQ ID NO: 3461120 - DNA, 11 bp, Homo sapiens
gctctccttcc

SEQ ID NO: 3461121 - DNA, 12 bp, Homo sapiens
gctctccttcct

SEQ ID NO: 3461122 - DNA, 14 bp, Homo sapiens
gctctctgccctgt

SEQ ID NO: 3461123 - DNA, 15 bp, Homo sapiens
gctctctgccctgtg

SEQ ID NO: 3461124 - DNA, 22 bp, Homo sapiens
gctctctttttctccagggtca

SEQ ID NO: 3461125 - DNA, 20 bp, Homo sapiens
gctctgatcatccactgtgc

SEQ ID NO: 3461126 - DNA, 22 bp, Homo sapiens
gctctgatcatccactgtgcca

SEQ ID NO: 3461127 - DNA, 23 bp, Homo sapiens
gctctgccaacttcttcagagct

SEQ ID NO: 3461128 - DNA, 22 bp, Homo sapiens
gctctgccttcgaggtcagagg

SEQ ID NO: 3461129 - DNA, 14 bp, Homo sapiens
gctctgctgacaga

SEQ ID NO: 3461130 - DNA, 22 bp, Homo sapiens
gctctggacagccccaccctgg

SEQ ID NO: 3461131 - DNA, 17 bp, Homo sapiens
gctctggccaagggcca

SEQ ID NO: 3461132 - DNA, 18 bp, Homo sapiens
gctctggccaagggccag

SEQ ID NO: 3461133 - DNA, 14 bp, Homo sapiens
gctctgggccattc

SEQ ID NO: 3461134 - DNA, 16 bp, Homo sapiens
gctctggtccaggccc

SEQ ID NO: 3461135 - DNA, 21 bp, Homo sapiens
gctctgtctacttgctcaggt

SEQ ID NO: 3461136 - DNA, 17 bp, Homo sapiens
gctctgtgggtctctgg

SEQ ID NO: 3461137 - DNA, 13 bp, Homo sapiens
gctctgtgggtga

SEQ ID NO: 3461138 - DNA, 15 bp, Homo sapiens
gctctgtttgtgggg

SEQ ID NO: 3461139 - DNA, 18 bp, Homo sapiens
gctctgtttgtggggtga

SEQ ID NO: 3461140 - DNA, 14 bp, Homo sapiens
gctcttactctttc

SEQ ID NO: 3461141 - DNA, 23 bp, Homo sapiens
gctcttagcaaaaacatgtatgt

SEQ ID NO: 3461142 - DNA, 12 bp, Homo sapiens
gctcttctcatt

SEQ ID NO: 3461143 - DNA, 16 bp, Homo sapiens
gctcttctcatttcac

SEQ ID NO: 3461144 - DNA, 23 bp, Homo sapiens
gctcttctcatttcacccctccc

SEQ ID NO: 3461145 - DNA, 16 bp, Homo sapiens
gctcttctccaggctg

SEQ ID NO: 3461146 - DNA, 14 bp, Homo sapiens
gctcttctttccca

SEQ ID NO: 3461147 - DNA, 19 bp, Homo sapiens
ggatagctaactgtaaatc

SEQ ID NO: 3461148 - DNA, 13 bp, Homo sapiens
ggatattaaaatg

SEQ ID NO: 3461149 - DNA, 14 bp, Homo sapiens
ggatcagaaataca

SEQ ID NO: 3461150 - DNA, 16 bp, Homo sapiens
ggatcagaaatacaga

SEQ ID NO: 3461151 - DNA, 21 bp, Homo sapiens
ggatcagatctggggcagcac

SEQ ID NO: 3461152 - DNA, 16 bp, Homo sapiens
ggatcagattgcatgt

SEQ ID NO: 3461153 - DNA, 12 bp, Homo sapiens
ggatcatgaaag

SEQ ID NO: 3461154 - DNA, 19 bp, Homo sapiens
ggatcatgaaagtagacag

SEQ ID NO: 3461155 - DNA, 13 bp, Homo sapiens
ggatccctcatct

SEQ ID NO: 3461156 - DNA, 17 bp, Homo sapiens
ggatccgactgctttgg

SEQ ID NO: 3461157 - DNA, 21 bp, Homo sapiens
ggatccgactgctttggacct

SEQ ID NO: 3461158 - DNA, 21 bp, Homo sapiens
ggatcgaagggtttttagaga

SEQ ID NO: 3461159 - DNA, 15 bp, Homo sapiens
ggatctgagaatctt

SEQ ID NO: 3461160 - DNA, 18 bp, Homo sapiens
ggatctggggctctggga

SEQ ID NO: 3461161 - DNA, 17 bp, Homo sapiens
ggatctttgtggccaag

SEQ ID NO: 3461162 - DNA, 21 bp, Homo sapiens
ggatgacatgcactcagctct

SEQ ID NO: 3461163 - DNA, 21 bp, Homo sapiens
ggatgagaatttgagtgctct

SEQ ID NO: 3461164 - DNA, 20 bp, Homo sapiens
ggatgagagttttggatgca

SEQ ID NO: 3461165 - DNA, 12 bp, Homo sapiens
ggatgagcagag

SEQ ID NO: 3461166 - DNA, 20 bp, Homo sapiens
ggatgagcatggagctggcc

SEQ ID NO: 3461167 - DNA, 21 bp, Homo sapiens
ggatgcatgttttccagctcc

SEQ ID NO: 3461168 - DNA, 20 bp, Homo sapiens
ggatgccactcctccctccg

SEQ ID NO: 3461169 - DNA, 13 bp, Homo sapiens
ggatgccctggag

SEQ ID NO: 3461170 - DNA, 21 bp, Homo sapiens
ggatgcctggtggcagctgcg

SEQ ID NO: 3461171 - DNA, 14 bp, Homo sapiens
ggatgcgcagtgcc

SEQ ID NO: 3461172 - DNA, 16 bp, Homo sapiens
ggatgcggatggccgg

SEQ ID NO: 3461173 - DNA, 21 bp, Homo sapiens
ggatggcaggacgtgggctgg

SEQ ID NO: 3461174 - DNA, 14 bp, Homo sapiens
ggatggccccagca

SEQ ID NO: 3461175 - DNA, 16 bp, Homo sapiens
ggatggccccagcaca

SEQ ID NO: 3461176 - DNA, 18 bp, Homo sapiens
ggatggccgtggatggcc

SEQ ID NO: 3461177 - DNA, 16 bp, Homo sapiens
ggatggcctggccagg

SEQ ID NO: 3461178 - DNA, 19 bp, Homo sapiens
ggatgggcctttgagcctg

SEQ ID NO: 3461179 - DNA, 21 bp, Homo sapiens
ggatgggggaactcagatcca

SEQ ID NO: 3461180 - DNA, 23 bp, Homo sapiens
ggatgggggaactcagatccagg

SEQ ID NO: 3461181 - DNA, 16 bp, Homo sapiens
ggatgggtcagagcta

SEQ ID NO: 3461182 - DNA, 16 bp, Homo sapiens
ggatgggtggatggcc

SEQ ID NO: 3461183 - DNA, 14 bp, Homo sapiens
ggatgggttttatg

SEQ ID NO: 3461184 - DNA, 17 bp, Homo sapiens
ggatggtgggcttcagg

SEQ ID NO: 3461185 - DNA, 12 bp, Homo sapiens
ggatggtgtctc

SEQ ID NO: 3461186 - DNA, 19 bp, Homo sapiens
ggatgtagcttttcacctt

SEQ ID NO: 3461187 - DNA, 20 bp, Homo sapiens
ggatgtccagagctggccag

SEQ ID NO: 3461188 - DNA, 21 bp, Homo sapiens
ggatgtccagagctggccagg

SEQ ID NO: 3461189 - DNA, 17 bp, Homo sapiens
ggatgtggttttcttaa

SEQ ID NO: 3461190 - DNA, 23 bp, Homo sapiens
ggatgttattatccttgggggct

SEQ ID NO: 3461191 - DNA, 23 bp, Homo sapiens
ggattacaagcgtgagccactgc

SEQ ID NO: 3461192 - DNA, 21 bp, Homo sapiens
ggattcaggaatgtgtggcct

SEQ ID NO: 3461193 - DNA, 16 bp, Homo sapiens
ggattctctaaccttt

SEQ ID NO: 3461194 - DNA, 14 bp, Homo sapiens
ggattctttaaata

SEQ ID NO: 3461195 - DNA, 13 bp, Homo sapiens
ggattgagtctgt

SEQ ID NO: 3461196 - DNA, 13 bp, Homo sapiens
ggattgctgccag

SEQ ID NO: 3461197 - DNA, 16 bp, Homo sapiens
ggattggggtccctct

SEQ ID NO: 3461198 - DNA, 15 bp, Homo sapiens
ggatttaacagcatg

SEQ ID NO: 3461199 - DNA, 19 bp, Homo sapiens
ggatttccagccagggctg

SEQ ID NO: 3461200 - DNA, 13 bp, Homo sapiens
ggatttgcctcac

SEQ ID NO: 3461201 - DNA, 16 bp, Homo sapiens
ggatttttagaattaa

SEQ ID NO: 3461202 - DNA, 12 bp, Homo sapiens
ggcaaaactcta

SEQ ID NO: 3461203 - DNA, 13 bp, Homo sapiens
ggcaaaattgcaa

SEQ ID NO: 3461204 - DNA, 13 bp, Homo sapiens
ggcaaacccatca

SEQ ID NO: 3461205 - DNA, 18 bp, Homo sapiens
ggcaaagcttttagaaat

SEQ ID NO: 3461206 - DNA, 17 bp, Homo sapiens
ggcaaaggaaggtggat

SEQ ID NO: 3461207 - DNA, 13 bp, Homo sapiens
ggcaaatgagcct

SEQ ID NO: 3461208 - DNA, 21 bp, Homo sapiens
ggcaaatgagccttaagaaat

SEQ ID NO: 3461209 - DNA, 18 bp, Homo sapiens
ggcaaattcttttgaatt

SEQ ID NO: 3461210 - DNA, 14 bp, Homo sapiens
ggcaacagatctgg

SEQ ID NO: 3461211 - DNA, 16 bp, Homo sapiens
ggcaacccccagcctg

SEQ ID NO: 3461212 - DNA, 10 bp, Homo sapiens
ggcaaggaaa

SEQ ID NO: 3461213 - DNA, 14 bp, Homo sapiens
ggcaaggacacaga

SEQ ID NO: 3461214 - DNA, 13 bp, Homo sapiens
ggcaaggctgtgc

SEQ ID NO: 3461215 - DNA, 19 bp, Homo sapiens
ggcaagggttaaggcctga

SEQ ID NO: 3461216 - DNA, 21 bp, Homo sapiens
ggcaatatagcaagatcccat

SEQ ID NO: 3461217 - DNA, 12 bp, Homo sapiens
ggcaatgaagaa

SEQ ID NO: 3461218 - DNA, 15 bp, Homo sapiens
ggcaatgctggctgt

SEQ ID NO: 3461219 - DNA, 20 bp, Homo sapiens
ggcaatgggagctgaggcca

SEQ ID NO: 3461220 - DNA, 16 bp, Homo sapiens
ggcaatttagaaaaag

SEQ ID NO: 3461221 - DNA, 18 bp, Homo sapiens
ggcacaccgggcactcag

SEQ ID NO: 3461222 - DNA, 18 bp, Homo sapiens
ggcacacgcctcccactg

SEQ ID NO: 3461223 - DNA, 15 bp, Homo sapiens
ggcacagatgctcca

SEQ ID NO: 3461224 - DNA, 19 bp, Homo sapiens
ggcacagctgggatacaca

SEQ ID NO: 3461225 - DNA, 13 bp, Homo sapiens
ggcaccagacacc

SEQ ID NO: 3461226 - DNA, 16 bp, Homo sapiens
ggcaccagacacccag

SEQ ID NO: 3461227 - DNA, 18 bp, Homo sapiens
ggcaccagacacccagga

SEQ ID NO: 3461228 - DNA, 19 bp, Homo sapiens
ggcaccagacacccaggac

SEQ ID NO: 3461229 - DNA, 13 bp, Homo sapiens
ggcaccagccagc

SEQ ID NO: 3461230 - DNA, 15 bp, Homo sapiens
ggcacccggcccctg

SEQ ID NO: 3461231 - DNA, 17 bp, Homo sapiens
ggcacccggcccctgct

SEQ ID NO: 3461232 - DNA, 22 bp, Homo sapiens
ggcacccggcccctgctggttc

SEQ ID NO: 3461233 - DNA, 16 bp, Homo sapiens
ggcacctaatccaggc

SEQ ID NO: 3461234 - DNA, 17 bp, Homo sapiens
ggcacctaatccaggca

SEQ ID NO: 3461235 - DNA, 19 bp, Homo sapiens
ggcacctcacaggccccag

SEQ ID NO: 3461236 - DNA, 22 bp, Homo sapiens
ggcacctgccaccctgggcctg

SEQ ID NO: 3461237 - DNA, 23 bp, Homo sapiens
ggcactcagaagacactgatggg

SEQ ID NO: 3461238 - DNA, 18 bp, Homo sapiens
ggcacttccctgctgcct

SEQ ID NO: 3461239 - DNA, 17 bp, Homo sapiens
ggcagacacagggactt

SEQ ID NO: 3461240 - DNA, 17 bp, Homo sapiens
ggcagacacggatctga

SEQ ID NO: 3461241 - DNA, 19 bp, Homo sapiens
ggcagacacggatctgaga

SEQ ID NO: 3461242 - DNA, 21 bp, Homo sapiens
ggcagacacggatctgagaat

SEQ ID NO: 3461243 - DNA, 16 bp, Homo sapiens
ggcagagctggctctg

SEQ ID NO: 3461244 - DNA, 17 bp, Homo sapiens
ggcagagctggctctga

SEQ ID NO: 3461245 - DNA, 13 bp, Homo sapiens
ggcagagcttctt

SEQ ID NO: 3461246 - DNA, 21 bp, Homo sapiens
ggcagagcttggactggatgc

SEQ ID NO: 3461247 - DNA, 14 bp, Homo sapiens
ggcagagggctgga

SEQ ID NO: 3461248 - DNA, 21 bp, Homo sapiens
ggcagagggctggaggcccag

SEQ ID NO: 3461249 - DNA, 21 bp, Homo sapiens
ggcagaggttgcagtgagccg

SEQ ID NO: 3461250 - DNA, 14 bp, Homo sapiens
ggcagagttgtaaa

SEQ ID NO: 3461251 - DNA, 18 bp, Homo sapiens
ggcagagttgtaaatata

SEQ ID NO: 3461252 - DNA, 17 bp, Homo sapiens
ggcagcaccctataaat

SEQ ID NO: 3461253 - DNA, 19 bp, Homo sapiens
ggcagcaccctataaatca

SEQ ID NO: 3461254 - DNA, 13 bp, Homo sapiens
ggcagcagggcta

SEQ ID NO: 3461255 - DNA, 21 bp, Homo sapiens
ggcagcagggctaccctgagc

SEQ ID NO: 3461256 - DNA, 20 bp, Homo sapiens
ggcagcagtgtgaggccagg

SEQ ID NO: 3461257 - DNA, 16 bp, Homo sapiens
ggcagccccattctgc

SEQ ID NO: 3461258 - DNA, 14 bp, Homo sapiens
ggcagcgccaggct

SEQ ID NO: 3461259 - DNA, 21 bp, Homo sapiens
ggcagcgccaggctgaccaca

SEQ ID NO: 3461260 - DNA, 15 bp, Homo sapiens
ggcagctcatctctg

SEQ ID NO: 3461261 - DNA, 17 bp, Homo sapiens
ggcagcttgagggttgg

SEQ ID NO: 3461262 - DNA, 21 bp, Homo sapiens
ggcagcttgagggttgggctg

SEQ ID NO: 3461263 - DNA, 23 bp, Homo sapiens
ggcaggaagcccaattgctggag

SEQ ID NO: 3461264 - DNA, 18 bp, Homo sapiens
ggcaggacaacgaggaag

SEQ ID NO: 3461265 - DNA, 20 bp, Homo sapiens
ggcaggacaacgaggaagcc

SEQ ID NO: 3461266 - DNA, 16 bp, Homo sapiens
ggcaggactgcagagc

SEQ ID NO: 3461267 - DNA, 18 bp, Homo sapiens
ggcaggaggatcacttga

SEQ ID NO: 3461268 - DNA, 16 bp, Homo sapiens
ggcaggatggcctggc

SEQ ID NO: 3461269 - DNA, 18 bp, Homo sapiens
ggcaggcaggctcccagg

SEQ ID NO: 3461270 - DNA, 10 bp, Homo sapiens
ggcaggcagt

SEQ ID NO: 3461271 - DNA, 17 bp, Homo sapiens
ggcaggctggccagtcc

SEQ ID NO: 3461272 - DNA, 20 bp, Homo sapiens
ggcaggctggccagtccagg

SEQ ID NO: 3461273 - DNA, 22 bp, Homo sapiens
ggcaggctgtctggccaggcct

SEQ ID NO: 3461274 - DNA, 22 bp, Homo sapiens
ggcagggagcggccggccagcc

SEQ ID NO: 3461275 - DNA, 18 bp, Homo sapiens
ggcagggccaacccttct

SEQ ID NO: 3461276 - DNA, 21 bp, Homo sapiens
ggcagggcgggcagagggctg

SEQ ID NO: 3461277 - DNA, 23 bp, Homo sapiens
ggcagggcgggcagagggctgga

SEQ ID NO: 3461278 - DNA, 15 bp, Homo sapiens
ggcagggctgactct

SEQ ID NO: 3461279 - DNA, 14 bp, Homo sapiens
gggcacagatgcct

SEQ ID NO: 3461280 - DNA, 13 bp, Homo sapiens
gggcacagggtct

SEQ ID NO: 3461281 - DNA, 18 bp, Homo sapiens
gggcacttccctgctgcc

SEQ ID NO: 3461282 - DNA, 13 bp, Homo sapiens
gggcagagggctg

SEQ ID NO: 3461283 - DNA, 22 bp, Homo sapiens
gggcagagggctggaggcccag

SEQ ID NO: 3461284 - DNA, 12 bp, Homo sapiens
gggcagagtcac

SEQ ID NO: 3461285 - DNA, 16 bp, Homo sapiens
gggcagagtcacacgg

SEQ ID NO: 3461286 - DNA, 18 bp, Homo sapiens
gggcagatcttggactca

SEQ ID NO: 3461287 - DNA, 20 bp, Homo sapiens
gggcagatcttggactcatg

SEQ ID NO: 3461288 - DNA, 11 bp, Homo sapiens
gggcaggcagt

SEQ ID NO: 3461289 - DNA, 12 bp, Homo sapiens
gggcagggctgt

SEQ ID NO: 3461290 - DNA, 17 bp, Homo sapiens
gggcaggttggtggggg

SEQ ID NO: 3461291 - DNA, 17 bp, Homo sapiens
gggcagtcattatccag

SEQ ID NO: 3461292 - DNA, 18 bp, Homo sapiens
gggcagtgggtcccagat

SEQ ID NO: 3461293 - DNA, 17 bp, Homo sapiens
gggcatgggtcgggaga

SEQ ID NO: 3461294 - DNA, 14 bp, Homo sapiens
gggccaagccagct

SEQ ID NO: 3461295 - DNA, 13 bp, Homo sapiens
gggccaagcccag

SEQ ID NO: 3461296 - DNA, 16 bp, Homo sapiens
gggccacagagaaagt

SEQ ID NO: 3461297 - DNA, 19 bp, Homo sapiens
gggccacatgggaggctca

SEQ ID NO: 3461298 - DNA, 17 bp, Homo sapiens
gggccacgctccagctg

SEQ ID NO: 3461299 - DNA, 22 bp, Homo sapiens
gggccacttctgggtggggcag

SEQ ID NO: 3461300 - DNA, 20 bp, Homo sapiens
gggccagacagaccttcaca

SEQ ID NO: 3461301 - DNA, 16 bp, Homo sapiens
gggccagggctgcccc

SEQ ID NO: 3461302 - DNA, 21 bp, Homo sapiens
gggccatgctgaggcctgggc

SEQ ID NO: 3461303 - DNA, 18 bp, Homo sapiens
gggccattctccacagca

SEQ ID NO: 3461304 - DNA, 11 bp, Homo sapiens
gggcccagagc

SEQ ID NO: 3461305 - DNA, 12 bp, Homo sapiens
gggcccagagcc

SEQ ID NO: 3461306 - DNA, 13 bp, Homo sapiens
gggcccagagccc

SEQ ID NO: 3461307 - DNA, 15 bp, Homo sapiens
gggcccagagcccag

SEQ ID NO: 3461308 - DNA, 20 bp, Homo sapiens
gggcccagagcccagctcca

SEQ ID NO: 3461309 - DNA, 13 bp, Homo sapiens
gggcccggccagc

SEQ ID NO: 3461310 - DNA, 13 bp, Homo sapiens
gggccctgagcca

SEQ ID NO: 3461311 - DNA, 17 bp, Homo sapiens
gggccctttgagtgcag

SEQ ID NO: 3461312 - DNA, 17 bp, Homo sapiens
gggccgccgcctctttc

SEQ ID NO: 3461313 - DNA, 14 bp, Homo sapiens
gggccgctgccacc

SEQ ID NO: 3461314 - DNA, 21 bp, Homo sapiens
gggccgctgccacccacctcc

SEQ ID NO: 3461315 - DNA, 14 bp, Homo sapiens
gggcctcagtgcca

SEQ ID NO: 3461316 - DNA, 22 bp, Homo sapiens
gggcctcggtgtggagaagcgg

SEQ ID NO: 3461317 - DNA, 14 bp, Homo sapiens
gggcctgactgctc

SEQ ID NO: 3461318 - DNA, 15 bp, Homo sapiens
gggcctgagcctggc

SEQ ID NO: 3461319 - DNA, 18 bp, Homo sapiens
gggcctgcaggacctgcc

SEQ ID NO: 3461320 - DNA, 21 bp, Homo sapiens
gggcctgcaggacctgcctgt

SEQ ID NO: 3461321 - DNA, 24 bp, Homo sapiens
gggcctgcaggacctgcctgtagc

SEQ ID NO: 3461322 - DNA, 15 bp, Homo sapiens
gggcctgccgggctg

SEQ ID NO: 3461323 - DNA, 15 bp, Homo sapiens
gggcctgctccagac

SEQ ID NO: 3461324 - DNA, 14 bp, Homo sapiens
gggcctgctggagg

SEQ ID NO: 3461325 - DNA, 13 bp, Homo sapiens
gggcctggggctc

SEQ ID NO: 3461326 - DNA, 23 bp, Homo sapiens
gggccttatcgggctccagccat

SEQ ID NO: 3461327 - DNA, 23 bp, Homo sapiens
gggccttgatgactgccttgcct

SEQ ID NO: 3461328 - DNA, 13 bp, Homo sapiens
gggcgcaaagggc

SEQ ID NO: 3461329 - DNA, 22 bp, Homo sapiens
gggcgccgcaaaccacactgga

SEQ ID NO: 3461330 - DNA, 18 bp, Homo sapiens
gggcgcgatcccacacag

SEQ ID NO: 3461331 - DNA, 21 bp, Homo sapiens
gggcggcaggggcctggagat

SEQ ID NO: 3461332 - DNA, 15 bp, Homo sapiens
gggcgggaggatgtt

SEQ ID NO: 3461333 - DNA, 13 bp, Homo sapiens
gggctaccctgag

SEQ ID NO: 3461334 - DNA, 16 bp, Homo sapiens
gggctaccctgagctg

SEQ ID NO: 3461335 - DNA, 19 bp, Homo sapiens
gggctaccctgagctgagg

SEQ ID NO: 3461336 - DNA, 20 bp, Homo sapiens
gggctaccctgagctgaggc

SEQ ID NO: 3461337 - DNA, 15 bp, Homo sapiens
gggctagttgggctt

SEQ ID NO: 3461338 - DNA, 22 bp, Homo sapiens
gggctcagcaaaagatgcttct

SEQ ID NO: 3461339 - DNA, 19 bp, Homo sapiens
gggctcagcggggacagct

SEQ ID NO: 3461340 - DNA, 12 bp, Homo sapiens
gggctccctgac

SEQ ID NO: 3461341 - DNA, 21 bp, Homo sapiens
gggctccctgtaacctcttca

SEQ ID NO: 3461342 - DNA, 11 bp, Homo sapiens
gggctcctgca

SEQ ID NO: 3461343 - DNA, 22 bp, Homo sapiens
gggctcctgcacttacttgctt

SEQ ID NO: 3461344 - DNA, 23 bp, Homo sapiens
gggctctcatgttttcaactgcc

SEQ ID NO: 3461345 - DNA, 20 bp, Homo sapiens
gggctctggccaagggccag

SEQ ID NO: 3461346 - DNA, 13 bp, Homo sapiens
gggctctggctct

SEQ ID NO: 3461347 - DNA, 12 bp, Homo sapiens
gggctcttctca

SEQ ID NO: 3461348 - DNA, 18 bp, Homo sapiens
gggctgagagaacctcac

SEQ ID NO: 3461349 - DNA, 16 bp, Homo sapiens
gggctgagggtgccct

SEQ ID NO: 3461350 - DNA, 16 bp, Homo sapiens
gggctgcatgatgttt

SEQ ID NO: 3461351 - DNA, 22 bp, Homo sapiens
gggctgcgacgcttgctctgtt

SEQ ID NO: 3461352 - DNA, 20 bp, Homo sapiens
gggctgcggcgtacaggctg

SEQ ID NO: 3461353 - DNA, 17 bp, Homo sapiens
gggctgctgacctccac

SEQ ID NO: 3461354 - DNA, 12 bp, Homo sapiens
gggctgcttcct

SEQ ID NO: 3461355 - DNA, 18 bp, Homo sapiens
gggctgcttcctcctgga

SEQ ID NO: 3461356 - DNA, 15 bp, Homo sapiens
gggctggactgaggc

SEQ ID NO: 3461357 - DNA, 16 bp, Homo sapiens
gggctggaggcccagg

SEQ ID NO: 3461358 - DNA, 16 bp, Homo sapiens
gggctgtcatctgtgc

SEQ ID NO: 3461359 - DNA, 24 bp, Homo sapiens
gggcttagagcagtttctgtcctg

SEQ ID NO: 3461360 - DNA, 14 bp, Homo sapiens
gggcttcagtggca

SEQ ID NO: 3461361 - DNA, 19 bp, Homo sapiens
gggcttcagtggcagctgc

SEQ ID NO: 3461362 - DNA, 17 bp, Homo sapiens
gggcttcatctctttag

SEQ ID NO: 3461363 - DNA, 20 bp, Homo sapiens
gggcttcccagtggctgctg

SEQ ID NO: 3461364 - DNA, 22 bp, Homo sapiens
gggcttcccagtggctgctgcc

SEQ ID NO: 3461365 - DNA, 15 bp, Homo sapiens
gggctttgtgtgaag

SEQ ID NO: 3461366 - DNA, 20 bp, Homo sapiens
gggctttgtgtgaaggcaga

SEQ ID NO: 3461367 - DNA, 13 bp, Homo sapiens
ggggaaagcacag

SEQ ID NO: 3461368 - DNA, 17 bp, Homo sapiens
ggggaaaggcaaggtcc

SEQ ID NO: 3461369 - DNA, 22 bp, Homo sapiens
ggggaaaggcaaggtccggccc

SEQ ID NO: 3461370 - DNA, 21 bp, Homo sapiens
ggggaactcagatccagggac

SEQ ID NO: 3461371 - DNA, 13 bp, Homo sapiens
ggggaaggagcca

SEQ ID NO: 3461372 - DNA, 14 bp, Homo sapiens
ggggaaggggcggt

SEQ ID NO: 3461373 - DNA, 16 bp, Homo sapiens
ggggaagtcctctggg

SEQ ID NO: 3461374 - DNA, 12 bp, Homo sapiens
ggggacagctcc

SEQ ID NO: 3461375 - DNA, 13 bp, Homo sapiens
ggggacagggatg

SEQ ID NO: 3461376 - DNA, 21 bp, Homo sapiens
ggggacccaatgtaggagctg

SEQ ID NO: 3461377 - DNA, 13 bp, Homo sapiens
ggggacgcaggcc

SEQ ID NO: 3461378 - DNA, 14 bp, Homo sapiens
ggggacgcaggccc

SEQ ID NO: 3461379 - DNA, 16 bp, Homo sapiens
ggggagacagttgaga

SEQ ID NO: 3461380 - DNA, 11 bp, Homo sapiens
ggggagcccac

SEQ ID NO: 3461381 - DNA, 20 bp, Homo sapiens
ggggagggtgacagtggccg

SEQ ID NO: 3461382 - DNA, 17 bp, Homo sapiens
ggggagtctgaagcaga

SEQ ID NO: 3461383 - DNA, 22 bp, Homo sapiens
ggggatcatctgccgtgcctgg

SEQ ID NO: 3461384 - DNA, 17 bp, Homo sapiens
ggggccaccctggcccg

SEQ ID NO: 3461385 - DNA, 12 bp, Homo sapiens
ggggccagaggc

SEQ ID NO: 3461386 - DNA, 14 bp, Homo sapiens
ggggccctgccctg

SEQ ID NO: 3461387 - DNA, 15 bp, Homo sapiens
ggggcctcagtgcca

SEQ ID NO: 3461388 - DNA, 23 bp, Homo sapiens
ggggcctgggacttccatgcctt

SEQ ID NO: 3461389 - DNA, 18 bp, Homo sapiens
ggggcgtctgttccccct

SEQ ID NO: 3461390 - DNA, 24 bp, Homo sapiens
ggggctctcatgttttcaactgcc

SEQ ID NO: 3461391 - DNA, 17 bp, Homo sapiens
ggggctctggccaaggg

SEQ ID NO: 3461392 - DNA, 23 bp, Homo sapiens
ggggctgaattgccaggggcgag

SEQ ID NO: 3461393 - DNA, 21 bp, Homo sapiens
ggggctgctgacctccacagc

SEQ ID NO: 3461394 - DNA, 22 bp, Homo sapiens
ggggcttagggtcggaacccaa

SEQ ID NO: 3461395 - DNA, 21 bp, Homo sapiens
ggggcttctggacctagggtg

SEQ ID NO: 3461396 - DNA, 21 bp, Homo sapiens
gggggaaacaggttgggatgg

SEQ ID NO: 3461397 - DNA, 12 bp, Homo sapiens
gggggaaagcac

SEQ ID NO: 3461398 - DNA, 19 bp, Homo sapiens
gggggctcccgtggcctgt

SEQ ID NO: 3461399 - DNA, 11 bp, Homo sapiens
gggggcttcat

SEQ ID NO: 3461400 - DNA, 21 bp, Homo sapiens
ggggtaaagggcgcaaagggc

SEQ ID NO: 3461401 - DNA, 22 bp, Homo sapiens
ggggtaaagggcgcaaagggca

SEQ ID NO: 3461402 - DNA, 13 bp, Homo sapiens
ggggtagaggctg

SEQ ID NO: 3461403 - DNA, 18 bp, Homo sapiens
ggggtagctagaggaacc

SEQ ID NO: 3461404 - DNA, 15 bp, Homo sapiens
ggggtagttggcaga

SEQ ID NO: 3461405 - DNA, 22 bp, Homo sapiens
ggggtcacttgggaagaggact

SEQ ID NO: 3461406 - DNA, 21 bp, Homo sapiens
ggggtcatgccctcctctccc

SEQ ID NO: 3461407 - DNA, 14 bp, Homo sapiens
ggggtgcttccttg

SEQ ID NO: 3461408 - DNA, 15 bp, Homo sapiens
ggggtggcctgtgtg

SEQ ID NO: 3461409 - DNA, 14 bp, Homo sapiens
ggggtgggccaggc

SEQ ID NO: 3461410 - DNA, 15 bp, Homo sapiens
ggggtgggtataaaa

SEQ ID NO: 3461411 - DNA, 14 bp, Homo sapiens
ggggttcaggcccg

SEQ ID NO: 3461412 - DNA, 11 bp, Homo sapiens
gtatgtctgcc

SEQ ID NO: 3461413 - DNA, 23 bp, Homo sapiens
gtatgtgggggcttcatctcttt

SEQ ID NO: 3461414 - DNA, 17 bp, Homo sapiens
gtatgtgtgtgtgtata

SEQ ID NO: 3461415 - DNA, 12 bp, Homo sapiens
gtatgttaacct

SEQ ID NO: 3461416 - DNA, 13 bp, Homo sapiens
gtatgttgtcaaa

SEQ ID NO: 3461417 - DNA, 15 bp, Homo sapiens
gtatgtttgtaactt

SEQ ID NO: 3461418 - DNA, 22 bp, Homo sapiens
gtatgtttgtaactttttacat

SEQ ID NO: 3461419 - DNA, 22 bp, Homo sapiens
gtattaaaaaaaacaaaaagaa

SEQ ID NO: 3461420 - DNA, 15 bp, Homo sapiens
gtattacttctgcta

SEQ ID NO: 3461421 - DNA, 14 bp, Homo sapiens
gtattcatatattg

SEQ ID NO: 3461422 - DNA, 12 bp, Homo sapiens
gtattccccttc

SEQ ID NO: 3461423 - DNA, 16 bp, Homo sapiens
gtattccccttcccac

SEQ ID NO: 3461424 - DNA, 14 bp, Homo sapiens
gtattcctgcctcc

SEQ ID NO: 3461425 - DNA, 11 bp, Homo sapiens
gtattctctga

SEQ ID NO: 3461426 - DNA, 18 bp, Homo sapiens
gtattgtaaaaaattcac

SEQ ID NO: 3461427 - DNA, 19 bp, Homo sapiens
gtattgtaaattatatttg

SEQ ID NO: 3461428 - DNA, 13 bp, Homo sapiens
gtattgtatttat

SEQ ID NO: 3461429 - DNA, 15 bp, Homo sapiens
gtattgtatttattc

SEQ ID NO: 3461430 - DNA, 18 bp, Homo sapiens
gtattgtatttattcaat

SEQ ID NO: 3461431 - DNA, 15 bp, Homo sapiens
gtatttaccaaaaat

SEQ ID NO: 3461432 - DNA, 19 bp, Homo sapiens
gtatttacgctttgattca

SEQ ID NO: 3461433 - DNA, 14 bp, Homo sapiens
gtatttattcaata

SEQ ID NO: 3461434 - DNA, 17 bp, Homo sapiens
gtatttattcaataaag

SEQ ID NO: 3461435 - DNA, 20 bp, Homo sapiens
gtatttattcaataaagtat

SEQ ID NO: 3461436 - DNA, 22 bp, Homo sapiens
gtatttattcaataaagtattt

SEQ ID NO: 3461437 - DNA, 23 bp, Homo sapiens
gtatttattcaataaagtattta

SEQ ID NO: 3461438 - DNA, 22 bp, Homo sapiens
gtatttgcttttttgttttggc

SEQ ID NO: 3461439 - DNA, 20 bp, Homo sapiens
gtatttgggaagtgaagact

SEQ ID NO: 3461440 - DNA, 19 bp, Homo sapiens
gtattttagtgaacttgaa

SEQ ID NO: 3461441 - DNA, 22 bp, Homo sapiens
gtattttatctttgattctcct

SEQ ID NO: 3461442 - DNA, 23 bp, Homo sapiens
gtattttatctttgattctcctt

SEQ ID NO: 3461443 - DNA, 18 bp, Homo sapiens
gtattttgtattgtttca

SEQ ID NO: 3461444 - DNA, 15 bp, Homo sapiens
gtcaaacaaagccag

SEQ ID NO: 3461445 - DNA, 16 bp, Homo sapiens
gtcaaacaaagccaga

SEQ ID NO: 3461446 - DNA, 17 bp, Homo sapiens
gtcaaacaaagccagaa

SEQ ID NO: 3461447 - DNA, 23 bp, Homo sapiens
gtcaaagcaggggagtatgcaaa

SEQ ID NO: 3461448 - DNA, 13 bp, Homo sapiens
gtcaaagtaaaac

SEQ ID NO: 3461449 - DNA, 17 bp, Homo sapiens
gtcaacagttcaaagaa

SEQ ID NO: 3461450 - DNA, 21 bp, Homo sapiens
gtcaacagttttcctatgctt

SEQ ID NO: 3461451 - DNA, 19 bp, Homo sapiens
gtcaacctgggcaaagcct

SEQ ID NO: 3461452 - DNA, 15 bp, Homo sapiens
gtcaagaagaaaaag

SEQ ID NO: 3461453 - DNA, 16 bp, Homo sapiens
gtcaagcctagcctga

SEQ ID NO: 3461454 - DNA, 17 bp, Homo sapiens
gtcaagctcctcctccc

SEQ ID NO: 3461455 - DNA, 21 bp, Homo sapiens
gtcaagctcctcctccctgca

SEQ ID NO: 3461456 - DNA, 22 bp, Homo sapiens
gtcaagctgctctgagccacag

SEQ ID NO: 3461457 - DNA, 20 bp, Homo sapiens
gtcaagtcccccagcagaac

SEQ ID NO: 3461458 - DNA, 14 bp, Homo sapiens
gtcaagtctctgct

SEQ ID NO: 3461459 - DNA, 17 bp, Homo sapiens
gtcaagtgcgtccacga

SEQ ID NO: 3461460 - DNA, 21 bp, Homo sapiens
gtcaatgccaggatttctcat

SEQ ID NO: 3461461 - DNA, 21 bp, Homo sapiens
gtcacaaatcctaaaagaagc

SEQ ID NO: 3461462 - DNA, 21 bp, Homo sapiens
gtcacaagcctcgaggtgcct

SEQ ID NO: 3461463 - DNA, 20 bp, Homo sapiens
gtcacacagtattacttctg

SEQ ID NO: 3461464 - DNA, 12 bp, Homo sapiens
gtcacagccacc

SEQ ID NO: 3461465 - DNA, 13 bp, Homo sapiens
gtcacatgaaaca

SEQ ID NO: 3461466 - DNA, 14 bp, Homo sapiens
gtcacattctgctt

SEQ ID NO: 3461467 - DNA, 22 bp, Homo sapiens
gtcaccaaaagacactgcagaa

SEQ ID NO: 3461468 - DNA, 14 bp, Homo sapiens
gtcaccaaggaaac

SEQ ID NO: 3461469 - DNA, 14 bp, Homo sapiens
gtcaccattctgca

SEQ ID NO: 3461470 - DNA, 24 bp, Homo sapiens
gtcaccattctgcatttagctgta

SEQ ID NO: 3461471 - DNA, 22 bp, Homo sapiens
gtcacctcttccgactctttct

SEQ ID NO: 3461472 - DNA, 16 bp, Homo sapiens
gtcactagcagctgca

SEQ ID NO: 3461473 - DNA, 18 bp, Homo sapiens
gtcactcattgctgagcc

SEQ ID NO: 3461474 - DNA, 19 bp, Homo sapiens
gtcactcattgctgagcct

SEQ ID NO: 3461475 - DNA, 21 bp, Homo sapiens
gtcacttcttcacctcttcca

SEQ ID NO: 3461476 - DNA, 16 bp, Homo sapiens
gtcagacgcctgagga

SEQ ID NO: 3461477 - DNA, 17 bp, Homo sapiens
gtcagacgcctgaggaa

SEQ ID NO: 3461478 - DNA, 22 bp, Homo sapiens
gtcagagccacagggtctgcct

SEQ ID NO: 3461479 - DNA, 16 bp, Homo sapiens
gtcagaggagagatag

SEQ ID NO: 3461480 - DNA, 22 bp, Homo sapiens
gtcagaggagagatagcctgtg

SEQ ID NO: 3461481 - DNA, 23 bp, Homo sapiens
gtcagaggagagatagcctgtgg

SEQ ID NO: 3461482 - DNA, 14 bp, Homo sapiens
gtcagatttccagt

SEQ ID NO: 3461483 - DNA, 16 bp, Homo sapiens
gtcagcaaaaagcaaa

SEQ ID NO: 3461484 - DNA, 22 bp, Homo sapiens
gtcagcaaaaagcaaaatcatt

SEQ ID NO: 3461485 - DNA, 14 bp, Homo sapiens
gtcagcatttgatc

SEQ ID NO: 3461486 - DNA, 13 bp, Homo sapiens
gtcagccctaggg

SEQ ID NO: 3461487 - DNA, 22 bp, Homo sapiens
gtcagccctagggtggagagcc

SEQ ID NO: 3461488 - DNA, 17 bp, Homo sapiens
gtcagcgacagcctggg

SEQ ID NO: 3461489 - DNA, 18 bp, Homo sapiens
gtcagcgacagcctgggc

SEQ ID NO: 3461490 - DNA, 15 bp, Homo sapiens
gtcagctctctgccc

SEQ ID NO: 3461491 - DNA, 17 bp, Homo sapiens
gtcagctctctgccctg

SEQ ID NO: 3461492 - DNA, 23 bp, Homo sapiens
gtcaggagttcgagaccagcctg

SEQ ID NO: 3461493 - DNA, 16 bp, Homo sapiens
gtcaggtggggcagct

SEQ ID NO: 3461494 - DNA, 17 bp, Homo sapiens
gtcaggtggggcagctt

SEQ ID NO: 3461495 - DNA, 14 bp, Homo sapiens
gtcagtcacagcca

SEQ ID NO: 3461496 - DNA, 16 bp, Homo sapiens
gtcagtcacagccacc

SEQ ID NO: 3461497 - DNA, 22 bp, Homo sapiens
gtcagtggtccacatcccggga

SEQ ID NO: 3461498 - DNA, 23 bp, Homo sapiens
gtcagtgtccaaagcagggtctg

SEQ ID NO: 3461499 - DNA, 19 bp, Homo sapiens
gtcatagatgtttccttgc

SEQ ID NO: 3461500 - DNA, 17 bp, Homo sapiens
gtcatatactgccatgt

SEQ ID NO: 3461501 - DNA, 14 bp, Homo sapiens
gtcatatcaaataa

SEQ ID NO: 3461502 - DNA, 21 bp, Homo sapiens
gtcatcccatcattttccata

SEQ ID NO: 3461503 - DNA, 17 bp, Homo sapiens
gtcatctgattggacag

SEQ ID NO: 3461504 - DNA, 17 bp, Homo sapiens
gtcatctgttagggcct

SEQ ID NO: 3461505 - DNA, 16 bp, Homo sapiens
gtcatgccctcctctc

SEQ ID NO: 3461506 - DNA, 18 bp, Homo sapiens
gtcatgccctcctctccc

SEQ ID NO: 3461507 - DNA, 18 bp, Homo sapiens
gtcatgctgctagatctt

SEQ ID NO: 3461508 - DNA, 15 bp, Homo sapiens
gtcatgcttgtgtta

SEQ ID NO: 3461509 - DNA, 16 bp, Homo sapiens
gtcatgtgcctctgtc

SEQ ID NO: 3461510 - DNA, 19 bp, Homo sapiens
gtcattagcctgagtagaa

SEQ ID NO: 3461511 - DNA, 21 bp, Homo sapiens
gtcattagcctgagtagaaag

SEQ ID NO: 3461512 - DNA, 13 bp, Homo sapiens
gtcattctttatt

SEQ ID NO: 3461513 - DNA, 17 bp, Homo sapiens
gtcattctttattcttt

SEQ ID NO: 3461514 - DNA, 11 bp, Homo sapiens
gtcattgctgt

SEQ ID NO: 3461515 - DNA, 15 bp, Homo sapiens
gtcattgctgtagga

SEQ ID NO: 3461516 - DNA, 19 bp, Homo sapiens
gtcatttgagcagggctca

SEQ ID NO: 3461517 - DNA, 13 bp, Homo sapiens
gtcattttgcact

SEQ ID NO: 3461518 - DNA, 17 bp, Homo sapiens
gtccaagcaacagcctt

SEQ ID NO: 3461519 - DNA, 22 bp, Homo sapiens
gtccaagcaacagcctttgaat

SEQ ID NO: 3461520 - DNA, 12 bp, Homo sapiens
gtccaatcctat

SEQ ID NO: 3461521 - DNA, 13 bp, Homo sapiens
gtccacagcttcc

SEQ ID NO: 3461522 - DNA, 13 bp, Homo sapiens
gtccacaggaagt

SEQ ID NO: 3461523 - DNA, 13 bp, Homo sapiens
gtccacccaggag

SEQ ID NO: 3461524 - DNA, 18 bp, Homo sapiens
gtccacgactgtctccat

SEQ ID NO: 3461525 - DNA, 15 bp, Homo sapiens
gtccacgtgtgtgtg

SEQ ID NO: 3461526 - DNA, 16 bp, Homo sapiens
gtccagaaggagacag

SEQ ID NO: 3461527 - DNA, 14 bp, Homo sapiens
gtccagaccctgaa

SEQ ID NO: 3461528 - DNA, 15 bp, Homo sapiens
gtccagccagctcct

SEQ ID NO: 3461529 - DNA, 23 bp, Homo sapiens
gtccagccagctcctgggcagct

SEQ ID NO: 3461530 - DNA, 14 bp, Homo sapiens
gtccagctctggag

SEQ ID NO: 3461531 - DNA, 16 bp, Homo sapiens
gtccagctctggaggg

SEQ ID NO: 3461532 - DNA, 21 bp, Homo sapiens
gtccagctctggaggggaggg

SEQ ID NO: 3461533 - DNA, 15 bp, Homo sapiens
gtccaggccctgtgg

SEQ ID NO: 3461534 - DNA, 16 bp, Homo sapiens
gtccaggctgccgtgg

SEQ ID NO: 3461535 - DNA, 12 bp, Homo sapiens
gtccagtgccta

SEQ ID NO: 3461536 - DNA, 14 bp, Homo sapiens
gtccagtgcctaca

SEQ ID NO: 3461537 - DNA, 13 bp, Homo sapiens
gtccatgggcaga

SEQ ID NO: 3461538 - DNA, 14 bp, Homo sapiens
gtccatgggcagag

SEQ ID NO: 3461539 - DNA, 14 bp, Homo sapiens
gtcccaccttggct

SEQ ID NO: 3461540 - DNA, 16 bp, Homo sapiens
gtcccaccttggctgc

SEQ ID NO: 3461541 - DNA, 23 bp, Homo sapiens
gtcccaccttggctgcagggagt

SEQ ID NO: 3461542 - DNA, 21 bp, Homo sapiens
gtcccactcaagccaagcagc

SEQ ID NO: 3461543 - DNA, 15 bp, Homo sapiens
gtcccactcagtcca

SEQ ID NO: 3461544 - DNA, 17 bp, Homo sapiens
gtcccaggttatctggg

SEQ ID NO: 3461545 - DNA, 17 bp, Homo sapiens
gtgggatgaaccagccg

SEQ ID NO: 3461546 - DNA, 20 bp, Homo sapiens
gtgggcattgatggggaagg

SEQ ID NO: 3461547 - DNA, 17 bp, Homo sapiens
gtgggccagtctgtgga

SEQ ID NO: 3461548 - DNA, 16 bp, Homo sapiens
gtgggcttcagggcag

SEQ ID NO: 3461549 - DNA, 17 bp, Homo sapiens
gtggggcacagatgcct

SEQ ID NO: 3461550 - DNA, 13 bp, Homo sapiens
gtggggcagcttg

SEQ ID NO: 3461551 - DNA, 15 bp, Homo sapiens
gtggggctgagctgg

SEQ ID NO: 3461552 - DNA, 17 bp, Homo sapiens
gtggggctgagctgggg

SEQ ID NO: 3461553 - DNA, 23 bp, Homo sapiens
gtgggggtgcagatgaggttgct

SEQ ID NO: 3461554 - DNA, 15 bp, Homo sapiens
gtggggtcatgccct

SEQ ID NO: 3461555 - DNA, 22 bp, Homo sapiens
gtggggtcctgccggagaggaa

SEQ ID NO: 3461556 - DNA, 13 bp, Homo sapiens
gtgggtaaaatta

SEQ ID NO: 3461557 - DNA, 24 bp, Homo sapiens
gtgggtctgtaagaccttggtagg

SEQ ID NO: 3461558 - DNA, 22 bp, Homo sapiens
gtggtatgacattggatagaac

SEQ ID NO: 3461559 - DNA, 15 bp, Homo sapiens
gtggtcacagcggag

SEQ ID NO: 3461560 - DNA, 22 bp, Homo sapiens
gtggtcacagcggaggtgtgga

SEQ ID NO: 3461561 - DNA, 18 bp, Homo sapiens
gtggtctaaagtgtttag

SEQ ID NO: 3461562 - DNA, 14 bp, Homo sapiens
gtggtctgcaggca

SEQ ID NO: 3461563 - DNA, 23 bp, Homo sapiens
gtggtctgttggcaggctggcca

SEQ ID NO: 3461564 - DNA, 17 bp, Homo sapiens
gtggtgacctctgcctg

SEQ ID NO: 3461565 - DNA, 12 bp, Homo sapiens
gtggtggagcca

SEQ ID NO: 3461566 - DNA, 13 bp, Homo sapiens
gtggtggcctggt

SEQ ID NO: 3461567 - DNA, 22 bp, Homo sapiens
gtggtgtggagaagccacaggc

SEQ ID NO: 3461568 - DNA, 18 bp, Homo sapiens
gtggttgctgttttcctc

SEQ ID NO: 3461569 - DNA, 19 bp, Homo sapiens
gtggttgctgttttcctcc

SEQ ID NO: 3461570 - DNA, 17 bp, Homo sapiens
gtggtttgattgtttac

SEQ ID NO: 3461571 - DNA, 14 bp, Homo sapiens
gtggttttaggata

SEQ ID NO: 3461572 - DNA, 18 bp, Homo sapiens
gtggttttaggatactta

SEQ ID NO: 3461573 - DNA, 22 bp, Homo sapiens
gtggttttaggatacttaacaa

SEQ ID NO: 3461574 - DNA, 23 bp, Homo sapiens
gtgtaacactgcaagaagtcttg

SEQ ID NO: 3461575 - DNA, 18 bp, Homo sapiens
gtgtaactggcagttttc

SEQ ID NO: 3461576 - DNA, 19 bp, Homo sapiens
gtgtacttcccgggccagg

SEQ ID NO: 3461577 - DNA, 16 bp, Homo sapiens
gtgtattaaaaaaaac

SEQ ID NO: 3461578 - DNA, 17 bp, Homo sapiens
gtgtatttaacagggag

SEQ ID NO: 3461579 - DNA, 21 bp, Homo sapiens
gtgtatttacgctttgattca

SEQ ID NO: 3461580 - DNA, 14 bp, Homo sapiens
gtgtatttgctttt

SEQ ID NO: 3461581 - DNA, 16 bp, Homo sapiens
gtgtcaagctgctctg

SEQ ID NO: 3461582 - DNA, 17 bp, Homo sapiens
gtgtcaagctgctctga

SEQ ID NO: 3461583 - DNA, 21 bp, Homo sapiens
gtgtcactcaaggcggtgctt

SEQ ID NO: 3461584 - DNA, 14 bp, Homo sapiens
gtgtcagctgaggc

SEQ ID NO: 3461585 - DNA, 14 bp, Homo sapiens
gtgtcaggtggggc

SEQ ID NO: 3461586 - DNA, 19 bp, Homo sapiens
gtgtcaggtggggcagctt

SEQ ID NO: 3461587 - DNA, 21 bp, Homo sapiens
gtgtcatgattcacccccaaa

SEQ ID NO: 3461588 - DNA, 18 bp, Homo sapiens
gtgtccacgactgtctcc

SEQ ID NO: 3461589 - DNA, 20 bp, Homo sapiens
gtgtccatgcgctcagggcc

SEQ ID NO: 3461590 - DNA, 13 bp, Homo sapiens
gtgtccctgcact

SEQ ID NO: 3461591 - DNA, 23 bp, Homo sapiens
gtgtccctgcacttgcagactct

SEQ ID NO: 3461592 - DNA, 15 bp, Homo sapiens
gtgtcctcacggtgc

SEQ ID NO: 3461593 - DNA, 20 bp, Homo sapiens
gtgtcctgaaacgctccttt

SEQ ID NO: 3461594 - DNA, 23 bp, Homo sapiens
gtgtccttttctcatttgtggct

SEQ ID NO: 3461595 - DNA, 13 bp, Homo sapiens
gtgtctaaactgc

SEQ ID NO: 3461596 - DNA, 13 bp, Homo sapiens
gtgtctccaaccc

SEQ ID NO: 3461597 - DNA, 17 bp, Homo sapiens
gtgtctccaacccccca

SEQ ID NO: 3461598 - DNA, 19 bp, Homo sapiens
gtgtctccaaccccccagc

SEQ ID NO: 3461599 - DNA, 21 bp, Homo sapiens
gtgtctggattcccaggatga

SEQ ID NO: 3461600 - DNA, 14 bp, Homo sapiens
gtgtctgtgtgtgt

SEQ ID NO: 3461601 - DNA, 17 bp, Homo sapiens
gtgtcttgcaatggcag

SEQ ID NO: 3461602 - DNA, 18 bp, Homo sapiens
gtgtcttgcaatggcagc

SEQ ID NO: 3461603 - DNA, 23 bp, Homo sapiens
gtgtcttgggcagagctggctct

SEQ ID NO: 3461604 - DNA, 19 bp, Homo sapiens
gtgtctttcggaattttta

SEQ ID NO: 3461605 - DNA, 18 bp, Homo sapiens
gtgtcttttttcactaca

SEQ ID NO: 3461606 - DNA, 14 bp, Homo sapiens
gtgtgaactggacc

SEQ ID NO: 3461607 - DNA, 13 bp, Homo sapiens
gtgtgaatgaaca

SEQ ID NO: 3461608 - DNA, 22 bp, Homo sapiens
gtgtgacaaggattgctactgt

SEQ ID NO: 3461609 - DNA, 19 bp, Homo sapiens
gtgtgacatttggagaggg

SEQ ID NO: 3461610 - DNA, 12 bp, Homo sapiens
gtgtgaggccag

SEQ ID NO: 3461611 - DNA, 15 bp, Homo sapiens
gtgtgaggccagggc

SEQ ID NO: 3461612 - DNA, 17 bp, Homo sapiens
gtgtgaggccagggcag

SEQ ID NO: 3461613 - DNA, 14 bp, Homo sapiens
gtgtgatcgtctga

SEQ ID NO: 3461614 - DNA, 21 bp, Homo sapiens
gtgtgattgacagctttgctg

SEQ ID NO: 3461615 - DNA, 17 bp, Homo sapiens
gtgtgattgcacgtgcc

SEQ ID NO: 3461616 - DNA, 19 bp, Homo sapiens
gtgtgcaatgtctgagtga

SEQ ID NO: 3461617 - DNA, 16 bp, Homo sapiens
gtgtgcaccagggttg

SEQ ID NO: 3461618 - DNA, 18 bp, Homo sapiens
gtgtgcctgactgcccag

SEQ ID NO: 3461619 - DNA, 12 bp, Homo sapiens
gtgtgctctgat

SEQ ID NO: 3461620 - DNA, 22 bp, Homo sapiens
gtgtgctctgatcatccactgt

SEQ ID NO: 3461621 - DNA, 17 bp, Homo sapiens
gtgtgctgatgggcgta

SEQ ID NO: 3461622 - DNA, 11 bp, Homo sapiens
gtgtgctggga

SEQ ID NO: 3461623 - DNA, 12 bp, Homo sapiens
gtgtgctgggag

SEQ ID NO: 3461624 - DNA, 22 bp, Homo sapiens
gtgtgctttatgctgaaacaga

SEQ ID NO: 3461625 - DNA, 23 bp, Homo sapiens
gtgtggagaagccacaggcctga

SEQ ID NO: 3461626 - DNA, 13 bp, Homo sapiens
gtgtggagaagcg

SEQ ID NO: 3461627 - DNA, 20 bp, Homo sapiens
gtgtgggacaggctcttctt

SEQ ID NO: 3461628 - DNA, 15 bp, Homo sapiens
gtgtggttatgaact

SEQ ID NO: 3461629 - DNA, 18 bp, Homo sapiens
gtgtgtccaaaactgcct

SEQ ID NO: 3461630 - DNA, 17 bp, Homo sapiens
gtgtgtccccctctgtc

SEQ ID NO: 3461631 - DNA, 18 bp, Homo sapiens
gtgtgtccccctctgtcc

SEQ ID NO: 3461632 - DNA, 17 bp, Homo sapiens
gtgtgtgcatatgtgtg

SEQ ID NO: 3461633 - DNA, 17 bp, Homo sapiens
gtgtgtgctctgcttca

SEQ ID NO: 3461634 - DNA, 13 bp, Homo sapiens
gtgtgtgtgtgca

SEQ ID NO: 3461635 - DNA, 12 bp, Homo sapiens
gtgtgtgtgtgt

SEQ ID NO: 3461636 - DNA, 13 bp, Homo sapiens
gtgtgtgtgtgtg

SEQ ID NO: 3461637 - DNA, 14 bp, Homo sapiens
gtgtgtgtgtgtgc

SEQ ID NO: 3461638 - DNA, 15 bp, Homo sapiens
gtgtgtgtgtgtgtc

SEQ ID NO: 3461639 - DNA, 16 bp, Homo sapiens
gtgttacctgaaaaca

SEQ ID NO: 3461640 - DNA, 15 bp, Homo sapiens
gtgttacctgtgtgc

SEQ ID NO: 3461641 - DNA, 18 bp, Homo sapiens
gtgttactgctttgcaaa

SEQ ID NO: 3461642 - DNA, 20 bp, Homo sapiens
gtgttactgctttgcaaaga

SEQ ID NO: 3461643 - DNA, 19 bp, Homo sapiens
gtgttactgtaattcctca

SEQ ID NO: 3461644 - DNA, 22 bp, Homo sapiens
gtgttagggaagggcctgccac

SEQ ID NO: 3461645 - DNA, 13 bp, Homo sapiens
gtgttatgtattt

SEQ ID NO: 3461646 - DNA, 14 bp, Homo sapiens
gtgttatgtatttc

SEQ ID NO: 3461647 - DNA, 16 bp, Homo sapiens
gtgttattctttgcgt

SEQ ID NO: 3461648 - DNA, 16 bp, Homo sapiens
gtgttctgagctgtat

SEQ ID NO: 3461649 - DNA, 18 bp, Homo sapiens
gtgttgccaagctccaag

SEQ ID NO: 3461650 - DNA, 15 bp, Homo sapiens
gtgttgtctcttgag

SEQ ID NO: 3461651 - DNA, 12 bp, Homo sapiens
gtgtttaaaaaa

SEQ ID NO: 3461652 - DNA, 12 bp, Homo sapiens
gtgtttctatga

SEQ ID NO: 3461653 - DNA, 15 bp, Homo sapiens
gtgtttgtcattagc

SEQ ID NO: 3461654 - DNA, 14 bp, Homo sapiens
gtgttttgtaccag

SEQ ID NO: 3461655 - DNA, 19 bp, Homo sapiens
gttaaaaaaatggcagtga

SEQ ID NO: 3461656 - DNA, 20 bp, Homo sapiens
gttaaactagcatatctgcc

SEQ ID NO: 3461657 - DNA, 23 bp, Homo sapiens
gttaaactagcatatctgccttt

SEQ ID NO: 3461658 - DNA, 18 bp, Homo sapiens
gttaaataaattgtatat

SEQ ID NO: 3461659 - DNA, 19 bp, Homo sapiens
gttaaataaattgtatatt

SEQ ID NO: 3461660 - DNA, 22 bp, Homo sapiens
gttaaataaattgtatattcac

SEQ ID NO: 3461661 - DNA, 19 bp, Homo sapiens
gttaaatagagtatatgca

SEQ ID NO: 3461662 - DNA, 20 bp, Homo sapiens
gttaacatcatgaatttatt

SEQ ID NO: 3461663 - DNA, 21 bp, Homo sapiens
gttaacgtattagttgccaat

SEQ ID NO: 3461664 - DNA, 14 bp, Homo sapiens
gttaactacatatt

SEQ ID NO: 3461665 - DNA, 19 bp, Homo sapiens
gttaagacatgatttcctt

SEQ ID NO: 3461666 - DNA, 16 bp, Homo sapiens
gttaaggcctgaatca

SEQ ID NO: 3461667 - DNA, 15 bp, Homo sapiens
gttaaggtgggcccg

SEQ ID NO: 3461668 - DNA, 18 bp, Homo sapiens
gttaatgatagctactgt

SEQ ID NO: 3461669 - DNA, 16 bp, Homo sapiens
gttaattgaaagtata

SEQ ID NO: 3461670 - DNA, 21 bp, Homo sapiens
gttacagcacaaaatgatggc

SEQ ID NO: 3461671 - DNA, 18 bp, Homo sapiens
gttacagcctgttagtaa

SEQ ID NO: 3461672 - DNA, 16 bp, Homo sapiens
gttacagtatgcttgc

SEQ ID NO: 3461673 - DNA, 17 bp, Homo sapiens
gttacagtatgcttgct

SEQ ID NO: 3461674 - DNA, 18 bp, Homo sapiens
gttacagtatgcttgctc

SEQ ID NO: 3461675 - DNA, 23 bp, Homo sapiens
gttaccattttggggtacccact

SEQ ID NO: 3461676 - DNA, 20 bp, Homo sapiens
gttacccagggtggagtgca

SEQ ID NO: 3461677 - DNA, 15 bp, Homo sapiens
taactctgtcttcac

SEQ ID NO: 3461678 - DNA, 20 bp, Homo sapiens
taactgagggctgatcttta

SEQ ID NO: 3461679 - DNA, 24 bp, Homo sapiens
taactggcagttttccattggttt

SEQ ID NO: 3461680 - DNA, 15 bp, Homo sapiens
taactggtgaagaga

SEQ ID NO: 3461681 - DNA, 20 bp, Homo sapiens
taactggtgcactttgtaaa

SEQ ID NO: 3461682 - DNA, 18 bp, Homo sapiens
taactgtgccagttcttt

SEQ ID NO: 3461683 - DNA, 11 bp, Homo sapiens
taactgtttca

SEQ ID NO: 3461684 - DNA, 13 bp, Homo sapiens
taacttctgcctg

SEQ ID NO: 3461685 - DNA, 13 bp, Homo sapiens
taacttcttcata

SEQ ID NO: 3461686 - DNA, 20 bp, Homo sapiens
taacttttcaatgacatttt

SEQ ID NO: 3461687 - DNA, 23 bp, Homo sapiens
taactttttaaaaaaataaaaca

SEQ ID NO: 3461688 - DNA, 17 bp, Homo sapiens
taactttttacattaca

SEQ ID NO: 3461689 - DNA, 22 bp, Homo sapiens
taactttttacattacagaata

SEQ ID NO: 3461690 - DNA, 20 bp, Homo sapiens
taagaaaaaataacacacat

SEQ ID NO: 3461691 - DNA, 11 bp, Homo sapiens
taagaaaaact

SEQ ID NO: 3461692 - DNA, 20 bp, Homo sapiens
taagaaaaacttttttggtt

SEQ ID NO: 3461693 - DNA, 14 bp, Homo sapiens
taagaaaagatttt

SEQ ID NO: 3461694 - DNA, 14 bp, Homo sapiens
taagaaagacatct

SEQ ID NO: 3461695 - DNA, 16 bp, Homo sapiens
taagaaagacatcttt

SEQ ID NO: 3461696 - DNA, 21 bp, Homo sapiens
taagaaagacatctttctctt

SEQ ID NO: 3461697 - DNA, 18 bp, Homo sapiens
taagaaatggtggaactg

SEQ ID NO: 3461698 - DNA, 17 bp, Homo sapiens
taagaaattttgccttt

SEQ ID NO: 3461699 - DNA, 13 bp, Homo sapiens
taagaacccctct

SEQ ID NO: 3461700 - DNA, 17 bp, Homo sapiens
taagaactaaagaagat

SEQ ID NO: 3461701 - DNA, 13 bp, Homo sapiens
taagaaggcaaaa

SEQ ID NO: 3461702 - DNA, 15 bp, Homo sapiens
taagaataaaatgtt

SEQ ID NO: 3461703 - DNA, 19 bp, Homo sapiens
taagaataaaatgttgaaa

SEQ ID NO: 3461704 - DNA, 14 bp, Homo sapiens
taagaatacagctt

SEQ ID NO: 3461705 - DNA, 16 bp, Homo sapiens
taagaatacagctttc

SEQ ID NO: 3461706 - DNA, 17 bp, Homo sapiens
taagaatggaaaagaga

SEQ ID NO: 3461707 - DNA, 17 bp, Homo sapiens
taagaattttaaatatt

SEQ ID NO: 3461708 - DNA, 19 bp, Homo sapiens
taagacatgatttccttga

SEQ ID NO: 3461709 - DNA, 20 bp, Homo sapiens
taagacatgatttccttgaa

SEQ ID NO: 3461710 - DNA, 21 bp, Homo sapiens
taagacatgatttccttgaat

SEQ ID NO: 3461711 - DNA, 19 bp, Homo sapiens
taagacgtatgtaacatga

SEQ ID NO: 3461712 - DNA, 15 bp, Homo sapiens
taagagacagacact

SEQ ID NO: 3461713 - DNA, 19 bp, Homo sapiens
taagagctctaagtacctt

SEQ ID NO: 3461714 - DNA, 21 bp, Homo sapiens
taagaggacataatggggtcc

SEQ ID NO: 3461715 - DNA, 17 bp, Homo sapiens
taagagggcacacactg

SEQ ID NO: 3461716 - DNA, 21 bp, Homo sapiens
taagatcactgccagagataa

SEQ ID NO: 3461717 - DNA, 14 bp, Homo sapiens
taagatgccttgaa

SEQ ID NO: 3461718 - DNA, 22 bp, Homo sapiens
taagatttgtttttctcttttc

SEQ ID NO: 3461719 - DNA, 23 bp, Homo sapiens
taagcaaagggagcactgggttg

SEQ ID NO: 3461720 - DNA, 22 bp, Homo sapiens
taagcaaaggggacagctgtgt

SEQ ID NO: 3461721 - DNA, 23 bp, Homo sapiens
taagcaacatctagcaaatgtta

SEQ ID NO: 3461722 - DNA, 17 bp, Homo sapiens
taagcagaggaggggcc

SEQ ID NO: 3461723 - DNA, 16 bp, Homo sapiens
taagcagctaaatttt

SEQ ID NO: 3461724 - DNA, 19 bp, Homo sapiens
taagcatactttgtaaata

SEQ ID NO: 3461725 - DNA, 17 bp, Homo sapiens
taagcatctacttcagg

SEQ ID NO: 3461726 - DNA, 20 bp, Homo sapiens
taagccacttaaaatgttca

SEQ ID NO: 3461727 - DNA, 16 bp, Homo sapiens
taagccccagcaagca

SEQ ID NO: 3461728 - DNA, 13 bp, Homo sapiens
taagccctggcag

SEQ ID NO: 3461729 - DNA, 15 bp, Homo sapiens
taagccctggccccc

SEQ ID NO: 3461730 - DNA, 14 bp, Homo sapiens
taagcctgaagagc

SEQ ID NO: 3461731 - DNA, 17 bp, Homo sapiens
taagctagaagaagtga

SEQ ID NO: 3461732 - DNA, 22 bp, Homo sapiens
taagctgttcctgttcagtaat

SEQ ID NO: 3461733 - DNA, 13 bp, Homo sapiens
taaggaagacaat

SEQ ID NO: 3461734 - DNA, 18 bp, Homo sapiens
taaggacactggggtctg

SEQ ID NO: 3461735 - DNA, 19 bp, Homo sapiens
taaggacactggggtctgt

SEQ ID NO: 3461736 - DNA, 21 bp, Homo sapiens
taaggatgtagcttttcacct

SEQ ID NO: 3461737 - DNA, 22 bp, Homo sapiens
taaggatgtagcttttcacctt

SEQ ID NO: 3461738 - DNA, 18 bp, Homo sapiens
taaggcatgtgtgaaaca

SEQ ID NO: 3461739 - DNA, 19 bp, Homo sapiens
taaggccattattgtactt

SEQ ID NO: 3461740 - DNA, 17 bp, Homo sapiens
taaggcgtggagctgcc

SEQ ID NO: 3461741 - DNA, 13 bp, Homo sapiens
taaggctgaggaa

SEQ ID NO: 3461742 - DNA, 22 bp, Homo sapiens
taaggctttgattagttttctt

SEQ ID NO: 3461743 - DNA, 14 bp, Homo sapiens
taagggcagagtca

SEQ ID NO: 3461744 - DNA, 16 bp, Homo sapiens
taaggggcccggccag

SEQ ID NO: 3461745 - DNA, 21 bp, Homo sapiens
taaggtctttcagtacttttt

SEQ ID NO: 3461746 - DNA, 18 bp, Homo sapiens
taaggtgatatatttaaa

SEQ ID NO: 3461747 - DNA, 20 bp, Homo sapiens
taaggtgatatatttaaaaa

SEQ ID NO: 3461748 - DNA, 13 bp, Homo sapiens
taaggtgtagcca

SEQ ID NO: 3461749 - DNA, 21 bp, Homo sapiens
taaggtgtagccacaccagga

SEQ ID NO: 3461750 - DNA, 12 bp, Homo sapiens
taagtaagaaaa

SEQ ID NO: 3461751 - DNA, 13 bp, Homo sapiens
taagtaagaaaat

SEQ ID NO: 3461752 - DNA, 19 bp, Homo sapiens
taagtacctttcctacatt

SEQ ID NO: 3461753 - DNA, 19 bp, Homo sapiens
taagtattgcatctgtata

SEQ ID NO: 3461754 - DNA, 17 bp, Homo sapiens
taagtattgtttcctga

SEQ ID NO: 3461755 - DNA, 15 bp, Homo sapiens
taagtcaacctgcct

SEQ ID NO: 3461756 - DNA, 22 bp, Homo sapiens
taagtcaccctagccctctccc

SEQ ID NO: 3461757 - DNA, 19 bp, Homo sapiens
taagtgaaagtgaggaaat

SEQ ID NO: 3461758 - DNA, 18 bp, Homo sapiens
taagtgaactattgtggg

SEQ ID NO: 3461759 - DNA, 14 bp, Homo sapiens
taagtgcacaacat

SEQ ID NO: 3461760 - DNA, 22 bp, Homo sapiens
taagtgcacaacattacaggga

SEQ ID NO: 3461761 - DNA, 12 bp, Homo sapiens
taagtgctgtat

SEQ ID NO: 3461762 - DNA, 14 bp, Homo sapiens
taagtgctgtataa

SEQ ID NO: 3461763 - DNA, 16 bp, Homo sapiens
taagtggaggcacttt

SEQ ID NO: 3461764 - DNA, 17 bp, Homo sapiens
taagtggaggcacttta

SEQ ID NO: 3461765 - DNA, 20 bp, Homo sapiens
taagtgtatttttcaataaa

SEQ ID NO: 3461766 - DNA, 22 bp, Homo sapiens
taagtgtgaactggaccctgtt

SEQ ID NO: 3461767 - DNA, 19 bp, Homo sapiens
taagttatttttgtacatg

SEQ ID NO: 3461768 - DNA, 18 bp, Homo sapiens
taagttgagaaggtgcct

SEQ ID NO: 3461769 - DNA, 17 bp, Homo sapiens
taagttggaccagagga

SEQ ID NO: 3461770 - DNA, 17 bp, Homo sapiens
taagtttcagttgattt

SEQ ID NO: 3461771 - DNA, 19 bp, Homo sapiens
taagtttccttccagccca

SEQ ID NO: 3461772 - DNA, 21 bp, Homo sapiens
taagtttccttccagcccaga

SEQ ID NO: 3461773 - DNA, 15 bp, Homo sapiens
taagtttccttccct

SEQ ID NO: 3461774 - DNA, 14 bp, Homo sapiens
taataaaaaggcac

SEQ ID NO: 3461775 - DNA, 17 bp, Homo sapiens
taataaactttaatata

SEQ ID NO: 3461776 - DNA, 14 bp, Homo sapiens
taataaaggttgtg

SEQ ID NO: 3461777 - DNA, 16 bp, Homo sapiens
taataaaggttgtgaa

SEQ ID NO: 3461778 - DNA, 17 bp, Homo sapiens
taataacatttaattta

SEQ ID NO: 3461779 - DNA, 18 bp, Homo sapiens
taataacgtgaaacttat

SEQ ID NO: 3461780 - DNA, 11 bp, Homo sapiens
taataagaaaa

SEQ ID NO: 3461781 - DNA, 22 bp, Homo sapiens
taataatatacttgtggactaa

SEQ ID NO: 3461782 - DNA, 21 bp, Homo sapiens
taatagtaatttgtaaagttg

SEQ ID NO: 3461783 - DNA, 21 bp, Homo sapiens
taatataaaaagcttccatga

SEQ ID NO: 3461784 - DNA, 21 bp, Homo sapiens
taatataaagtagtcctgtga

SEQ ID NO: 3461785 - DNA, 21 bp, Homo sapiens
taatatcaaatgcagtatatt

SEQ ID NO: 3461786 - DNA, 15 bp, Homo sapiens
taatatcaatagaag

SEQ ID NO: 3461787 - DNA, 21 bp, Homo sapiens
taatatctaaagttatatttc

SEQ ID NO: 3461788 - DNA, 14 bp, Homo sapiens
taatatgaaaactt

SEQ ID NO: 3461789 - DNA, 10 bp, Homo sapiens
taatatgcat

SEQ ID NO: 3461790 - DNA, 21 bp, Homo sapiens
taatatgctgcaacaaaatgt

SEQ ID NO: 3461791 - DNA, 22 bp, Homo sapiens
taatatgctgcaacaaaatgta

SEQ ID NO: 3461792 - DNA, 17 bp, Homo sapiens
taatatttaacctcttt

SEQ ID NO: 3461793 - DNA, 16 bp, Homo sapiens
taatattttacataca

SEQ ID NO: 3461794 - DNA, 14 bp, Homo sapiens
taatcaagttgaat

SEQ ID NO: 3461795 - DNA, 17 bp, Homo sapiens
taatcatccaatgctca

SEQ ID NO: 3461796 - DNA, 21 bp, Homo sapiens
taatcatttgtttacatttga

SEQ ID NO: 3461797 - DNA, 13 bp, Homo sapiens
taatcattttcat

SEQ ID NO: 3461798 - DNA, 19 bp, Homo sapiens
taatccaatacctcttgga

SEQ ID NO: 3461799 - DNA, 13 bp, Homo sapiens
taatccagctgat

SEQ ID NO: 3461800 - DNA, 17 bp, Homo sapiens
taatccaggcagatcca

SEQ ID NO: 3461801 - DNA, 19 bp, Homo sapiens
taatccaggcagatccagg

SEQ ID NO: 3461802 - DNA, 21 bp, Homo sapiens
taatccccagtaaaattgcca

SEQ ID NO: 3461803 - DNA, 14 bp, Homo sapiens
taatctgtgagtga

SEQ ID NO: 3461804 - DNA, 22 bp, Homo sapiens
taatctgtgagtgaaagttgcc

SEQ ID NO: 3461805 - DNA, 13 bp, Homo sapiens
taatctgttatgt

SEQ ID NO: 3461806 - DNA, 16 bp, Homo sapiens
taatcttgaattgtaa

SEQ ID NO: 3461807 - DNA, 22 bp, Homo sapiens
taatcttgaattgtaactgttc

SEQ ID NO: 3461808 - DNA, 20 bp, Homo sapiens
taatcttgctctgcttgaca

SEQ ID NO: 3461809 - DNA, 17 bp, Homo sapiens
tacattcaaattctttt

SEQ ID NO: 3461810 - DNA, 13 bp, Homo sapiens
tacattcatttag

SEQ ID NO: 3461811 - DNA, 14 bp, Homo sapiens
tacattgttcaatt

SEQ ID NO: 3461812 - DNA, 16 bp, Homo sapiens
tacatttttcaacttt

SEQ ID NO: 3461813 - DNA, 19 bp, Homo sapiens
tacatttttcaactttgaa

SEQ ID NO: 3461814 - DNA, 21 bp, Homo sapiens
taccaaagtgtcttttgacat

SEQ ID NO: 3461815 - DNA, 15 bp, Homo sapiens
taccacccaatgctg

SEQ ID NO: 3461816 - DNA, 13 bp, Homo sapiens
taccagaagggaa

SEQ ID NO: 3461817 - DNA, 13 bp, Homo sapiens
taccagcgaggag

SEQ ID NO: 3461818 - DNA, 15 bp, Homo sapiens
taccagcgaggaggc

SEQ ID NO: 3461819 - DNA, 21 bp, Homo sapiens
taccagcgtatatataagaaa

SEQ ID NO: 3461820 - DNA, 20 bp, Homo sapiens
taccagtgaatttttgcaat

SEQ ID NO: 3461821 - DNA, 22 bp, Homo sapiens
taccagtgaatttttgcaataa

SEQ ID NO: 3461822 - DNA, 15 bp, Homo sapiens
taccatgaaacaaag

SEQ ID NO: 3461823 - DNA, 14 bp, Homo sapiens
taccatgtaaataa

SEQ ID NO: 3461824 - DNA, 14 bp, Homo sapiens
taccatttatacaa

SEQ ID NO: 3461825 - DNA, 18 bp, Homo sapiens
taccatttatacaaatta

SEQ ID NO: 3461826 - DNA, 11 bp, Homo sapiens
tacccaaagga

SEQ ID NO: 3461827 - DNA, 15 bp, Homo sapiens
tacccaatagctgcc

SEQ ID NO: 3461828 - DNA, 17 bp, Homo sapiens
tacccactcggtcccag

SEQ ID NO: 3461829 - DNA, 14 bp, Homo sapiens
tacccactgccatg

SEQ ID NO: 3461830 - DNA, 12 bp, Homo sapiens
tacccactgctc

SEQ ID NO: 3461831 - DNA, 14 bp, Homo sapiens
tacccactgctctg

SEQ ID NO: 3461832 - DNA, 15 bp, Homo sapiens
tacccactgctctgg

SEQ ID NO: 3461833 - DNA, 19 bp, Homo sapiens
tacccagagcacccagatc

SEQ ID NO: 3461834 - DNA, 16 bp, Homo sapiens
tacccagggcctgcag

SEQ ID NO: 3461835 - DNA, 18 bp, Homo sapiens
tacccagggtggagtgca

SEQ ID NO: 3461836 - DNA, 15 bp, Homo sapiens
tacccaggtgggtcc

SEQ ID NO: 3461837 - DNA, 19 bp, Homo sapiens
tacccagtccccattttct

SEQ ID NO: 3461838 - DNA, 23 bp, Homo sapiens
tacccatacaccccctcttctga

SEQ ID NO: 3461839 - DNA, 20 bp, Homo sapiens
taccccctcaaaccctgccc

SEQ ID NO: 3461840 - DNA, 16 bp, Homo sapiens
taccccctccttcaga

SEQ ID NO: 3461841 - DNA, 15 bp, Homo sapiens
taccctctttgctgc

SEQ ID NO: 3461842 - DNA, 17 bp, Homo sapiens
taccctgagctgaggca

SEQ ID NO: 3461843 - DNA, 17 bp, Homo sapiens
taccgagagccaaacag

SEQ ID NO: 3461844 - DNA, 14 bp, Homo sapiens
taccgcgttgtaaa

SEQ ID NO: 3461845 - DNA, 23 bp, Homo sapiens
tacctaaaaggaaatctcacccc

SEQ ID NO: 3461846 - DNA, 22 bp, Homo sapiens
tacctaagcatatcgtaaagct

SEQ ID NO: 3461847 - DNA, 18 bp, Homo sapiens
tacctatggctgcctgca

SEQ ID NO: 3461848 - DNA, 12 bp, Homo sapiens
tacctatttgac

SEQ ID NO: 3461849 - DNA, 22 bp, Homo sapiens
tacctcaacccccatttctatt

SEQ ID NO: 3461850 - DNA, 19 bp, Homo sapiens
tacctcctcccccctcctc

SEQ ID NO: 3461851 - DNA, 11 bp, Homo sapiens
tacctcctcct

SEQ ID NO: 3461852 - DNA, 14 bp, Homo sapiens
tacctcctgagaaa

SEQ ID NO: 3461853 - DNA, 23 bp, Homo sapiens
tacctctccagcctcagctctca

SEQ ID NO: 3461854 - DNA, 14 bp, Homo sapiens
tacctctctgtccc

SEQ ID NO: 3461855 - DNA, 18 bp, Homo sapiens
tacctctctgtcccttgc

SEQ ID NO: 3461856 - DNA, 17 bp, Homo sapiens
tacctctcttatagaat

SEQ ID NO: 3461857 - DNA, 23 bp, Homo sapiens
tacctctcttatagaatatttat

SEQ ID NO: 3461858 - DNA, 15 bp, Homo sapiens
tacctgtattcccag

SEQ ID NO: 3461859 - DNA, 18 bp, Homo sapiens
tacctgtcattttgcact

SEQ ID NO: 3461860 - DNA, 13 bp, Homo sapiens
tacctgtgaaata

SEQ ID NO: 3461861 - DNA, 13 bp, Homo sapiens
tacctgtgtgctt

SEQ ID NO: 3461862 - DNA, 21 bp, Homo sapiens
tacctgttgagcatcacagaa

SEQ ID NO: 3461863 - DNA, 18 bp, Homo sapiens
tacctttcctacattttc

SEQ ID NO: 3461864 - DNA, 18 bp, Homo sapiens
taccttttttgttccact

SEQ ID NO: 3461865 - DNA, 21 bp, Homo sapiens
taccttttttgttttttcaaa

SEQ ID NO: 3461866 - DNA, 20 bp, Homo sapiens
tacgagcacctccagcctga

SEQ ID NO: 3461867 - DNA, 22 bp, Homo sapiens
tacgagcacctccagcctgaac

SEQ ID NO: 3461868 - DNA, 21 bp, Homo sapiens
tacgagtgctaagtgtaggat

SEQ ID NO: 3461869 - DNA, 14 bp, Homo sapiens
tacgatacgctact

SEQ ID NO: 3461870 - DNA, 22 bp, Homo sapiens
tacgcagcgtgctttaaaaaat

SEQ ID NO: 3461871 - DNA, 17 bp, Homo sapiens
tacgcctgcatgtaaac

SEQ ID NO: 3461872 - DNA, 14 bp, Homo sapiens
tacgtctgacaggc

SEQ ID NO: 3461873 - DNA, 15 bp, Homo sapiens
tacgtctgacaggca

SEQ ID NO: 3461874 - DNA, 21 bp, Homo sapiens
tacgtgaccctctgctgaaga

SEQ ID NO: 3461875 - DNA, 18 bp, Homo sapiens
tactaaaagtttagaact

SEQ ID NO: 3461876 - DNA, 18 bp, Homo sapiens
tactaaagccaaacatat

SEQ ID NO: 3461877 - DNA, 15 bp, Homo sapiens
tactaactaaactct

SEQ ID NO: 3461878 - DNA, 23 bp, Homo sapiens
tactaagtgatgctgtgatacct

SEQ ID NO: 3461879 - DNA, 15 bp, Homo sapiens
tactaataaaccagt

SEQ ID NO: 3461880 - DNA, 13 bp, Homo sapiens
tactaattccaca

SEQ ID NO: 3461881 - DNA, 15 bp, Homo sapiens
tactagaaatgggaa

SEQ ID NO: 3461882 - DNA, 16 bp, Homo sapiens
tactaggtaacttcat

SEQ ID NO: 3461883 - DNA, 18 bp, Homo sapiens
tactagtcctctagaaat

SEQ ID NO: 3461884 - DNA, 16 bp, Homo sapiens
tactagtgttctgttt

SEQ ID NO: 3461885 - DNA, 14 bp, Homo sapiens
tactataaagagaa

SEQ ID NO: 3461886 - DNA, 17 bp, Homo sapiens
tactataagaactttga

SEQ ID NO: 3461887 - DNA, 13 bp, Homo sapiens
tactattaacatg

SEQ ID NO: 3461888 - DNA, 23 bp, Homo sapiens
tactcagataaggtaaaatgcca

SEQ ID NO: 3461889 - DNA, 16 bp, Homo sapiens
tactccagtatgacag

SEQ ID NO: 3461890 - DNA, 21 bp, Homo sapiens
tactcctcacacttactgtaa

SEQ ID NO: 3461891 - DNA, 17 bp, Homo sapiens
tactcctctttacactg

SEQ ID NO: 3461892 - DNA, 23 bp, Homo sapiens
tactctacaattcctctgataat

SEQ ID NO: 3461893 - DNA, 22 bp, Homo sapiens
tactctaccctcttagaaaaac

SEQ ID NO: 3461894 - DNA, 20 bp, Homo sapiens
tactctccccacgagggctg

SEQ ID NO: 3461895 - DNA, 14 bp, Homo sapiens
tactctcttcttct

SEQ ID NO: 3461896 - DNA, 19 bp, Homo sapiens
tactctgaagggcatcatg

SEQ ID NO: 3461897 - DNA, 14 bp, Homo sapiens
tactctgccctcta

SEQ ID NO: 3461898 - DNA, 19 bp, Homo sapiens
tactctgttccttcacatc

SEQ ID NO: 3461899 - DNA, 21 bp, Homo sapiens
tactcttaggaagagaaacca

SEQ ID NO: 3461900 - DNA, 13 bp, Homo sapiens
tactctttctgta

SEQ ID NO: 3461901 - DNA, 17 bp, Homo sapiens
tactgactgagaatata

SEQ ID NO: 3461902 - DNA, 17 bp, Homo sapiens
tactgagcttctctgtg

SEQ ID NO: 3461903 - DNA, 21 bp, Homo sapiens
tactgcaaggttcaacttatt

SEQ ID NO: 3461904 - DNA, 20 bp, Homo sapiens
tactgcagcctttgcctccc

SEQ ID NO: 3461905 - DNA, 11 bp, Homo sapiens
tactgccaaag

SEQ ID NO: 3461906 - DNA, 22 bp, Homo sapiens
tactgccctccagctctttcct

SEQ ID NO: 3461907 - DNA, 23 bp, Homo sapiens
tactgccctccagctctttcctc

SEQ ID NO: 3461908 - DNA, 22 bp, Homo sapiens
tactgccttaataaaaaatgaa

SEQ ID NO: 3461909 - DNA, 19 bp, Homo sapiens
tactgcctttagaaaatat

SEQ ID NO: 3461910 - DNA, 20 bp, Homo sapiens
tactgcgactttctgcctgg

SEQ ID NO: 3461911 - DNA, 21 bp, Homo sapiens
tactgcgactttctgcctgga

SEQ ID NO: 3461912 - DNA, 20 bp, Homo sapiens
tactgctactgtaattttat

SEQ ID NO: 3461913 - DNA, 21 bp, Homo sapiens
tactgctgagatacatacaga

SEQ ID NO: 3461914 - DNA, 24 bp, Homo sapiens
tactgcttggagctgagcaaatca

SEQ ID NO: 3461915 - DNA, 12 bp, Homo sapiens
tactgtaagaat

SEQ ID NO: 3461916 - DNA, 18 bp, Homo sapiens
tactgtaagaataattta

SEQ ID NO: 3461917 - DNA, 18 bp, Homo sapiens
tactgtacaataaaaaca

SEQ ID NO: 3461918 - DNA, 22 bp, Homo sapiens
tactgtatttttacctttttcc

SEQ ID NO: 3461919 - DNA, 16 bp, Homo sapiens
tactgtcctacccacc

SEQ ID NO: 3461920 - DNA, 18 bp, Homo sapiens
tactgtgggcaatttaga

SEQ ID NO: 3461921 - DNA, 15 bp, Homo sapiens
tactgttaaaggaaa

SEQ ID NO: 3461922 - DNA, 15 bp, Homo sapiens
tactgttgcaaagct

SEQ ID NO: 3461923 - DNA, 17 bp, Homo sapiens
tactgttgcaaagcttc

SEQ ID NO: 3461924 - DNA, 20 bp, Homo sapiens
tactgttgtacaatcatgtt

SEQ ID NO: 3461925 - DNA, 19 bp, Homo sapiens
tacttacccaggtgggtcc

SEQ ID NO: 3461926 - DNA, 17 bp, Homo sapiens
tacttagtagattaaaa

SEQ ID NO: 3461927 - DNA, 18 bp, Homo sapiens
tacttcattttcagagtg

SEQ ID NO: 3461928 - DNA, 19 bp, Homo sapiens
tacttcccgggccagggct

SEQ ID NO: 3461929 - DNA, 20 bp, Homo sapiens
tacttcccgggccagggctg

SEQ ID NO: 3461930 - DNA, 22 bp, Homo sapiens
tacttccttatgcttctttcaa

SEQ ID NO: 3461931 - DNA, 13 bp, Homo sapiens
tacttctccaccc

SEQ ID NO: 3461932 - DNA, 14 bp, Homo sapiens
tacttcttgaaggt

SEQ ID NO: 3461933 - DNA, 11 bp, Homo sapiens
tacttgaactt

SEQ ID NO: 3461934 - DNA, 23 bp, Homo sapiens
tacttgccttattagagtgtctt

SEQ ID NO: 3461935 - DNA, 12 bp, Homo sapiens
tacttgggaggc

SEQ ID NO: 3461936 - DNA, 13 bp, Homo sapiens
tacttggtttgtg

SEQ ID NO: 3461937 - DNA, 14 bp, Homo sapiens
tacttggtttgtgt

SEQ ID NO: 3461938 - DNA, 20 bp, Homo sapiens
tacttggtttgtgttcttct

SEQ ID NO: 3461939 - DNA, 18 bp, Homo sapiens
tacttgtggacacagctc

SEQ ID NO: 3461940 - DNA, 16 bp, Homo sapiens
tacttgtggactaaaa

SEQ ID NO: 3461941 - DNA, 19 bp, Homo sapiens
tatgtgattttaactctgt

SEQ ID NO: 3461942 - DNA, 19 bp, Homo sapiens
tatgtgggggcttcatctc

SEQ ID NO: 3461943 - DNA, 14 bp, Homo sapiens
tatgtgtaggtgaa

SEQ ID NO: 3461944 - DNA, 14 bp, Homo sapiens
tatgtgtgtgtgtg

SEQ ID NO: 3461945 - DNA, 15 bp, Homo sapiens
tatgtgtttttcaca

SEQ ID NO: 3461946 - DNA, 16 bp, Homo sapiens
tatgtgtttttcacat

SEQ ID NO: 3461947 - DNA, 21 bp, Homo sapiens
tatgttaaactagcatatctg

SEQ ID NO: 3461948 - DNA, 15 bp, Homo sapiens
tatgttgaatacttt

SEQ ID NO: 3461949 - DNA, 18 bp, Homo sapiens
tatgttgaatacttttta

SEQ ID NO: 3461950 - DNA, 13 bp, Homo sapiens
tatgttgcccagg

SEQ ID NO: 3461951 - DNA, 20 bp, Homo sapiens
tatgttgcccaggcaggtct

SEQ ID NO: 3461952 - DNA, 16 bp, Homo sapiens
tatgttgtcaaagaga

SEQ ID NO: 3461953 - DNA, 19 bp, Homo sapiens
tatgtttaatctgttatgt

SEQ ID NO: 3461954 - DNA, 14 bp, Homo sapiens
tatgtttgtaactt

SEQ ID NO: 3461955 - DNA, 16 bp, Homo sapiens
tatgtttgtaactttt

SEQ ID NO: 3461956 - DNA, 17 bp, Homo sapiens
tatgttttaagaggcag

SEQ ID NO: 3461957 - DNA, 16 bp, Homo sapiens
tatgtttttgttcaaa

SEQ ID NO: 3461958 - DNA, 23 bp, Homo sapiens
tattaaaaaaaacaaaaagaaca

SEQ ID NO: 3461959 - DNA, 14 bp, Homo sapiens
tattaaaaatataa

SEQ ID NO: 3461960 - DNA, 15 bp, Homo sapiens
tattaaaaatataaa

SEQ ID NO: 3461961 - DNA, 19 bp, Homo sapiens
tattaaaaatataaaactg

SEQ ID NO: 3461962 - DNA, 15 bp, Homo sapiens
tattaaaattctgaa

SEQ ID NO: 3461963 - DNA, 23 bp, Homo sapiens
tattaaacagatatcttcagttt

SEQ ID NO: 3461964 - DNA, 23 bp, Homo sapiens
tattaaataaaatgcacaaaact

SEQ ID NO: 3461965 - DNA, 17 bp, Homo sapiens
tattaaatagttaatat

SEQ ID NO: 3461966 - DNA, 20 bp, Homo sapiens
tattaatagtaatttgtaaa

SEQ ID NO: 3461967 - DNA, 13 bp, Homo sapiens
tattaattgcttt

SEQ ID NO: 3461968 - DNA, 17 bp, Homo sapiens
tattaatttatgcagaa

SEQ ID NO: 3461969 - DNA, 21 bp, Homo sapiens
tattaccatgtaaataatctg

SEQ ID NO: 3461970 - DNA, 21 bp, Homo sapiens
tattaccccctccttcagaca

SEQ ID NO: 3461971 - DNA, 13 bp, Homo sapiens
tattacttctgct

SEQ ID NO: 3461972 - DNA, 21 bp, Homo sapiens
tattagatgttctctatcatt

SEQ ID NO: 3461973 - DNA, 22 bp, Homo sapiens
tattagatgttctctatcattt

SEQ ID NO: 3461974 - DNA, 15 bp, Homo sapiens
tattagggagaaaat

SEQ ID NO: 3461975 - DNA, 14 bp, Homo sapiens
tattagttgccaat

SEQ ID NO: 3461976 - DNA, 17 bp, Homo sapiens
tattatatttacaaatg

SEQ ID NO: 3461977 - DNA, 22 bp, Homo sapiens
tattatcatgcaaatgctgtat

SEQ ID NO: 3461978 - DNA, 20 bp, Homo sapiens
tattatcattgctcccctga

SEQ ID NO: 3461979 - DNA, 22 bp, Homo sapiens
tattatcctcctgttctgaaac

SEQ ID NO: 3461980 - DNA, 12 bp, Homo sapiens
tattattctcat

SEQ ID NO: 3461981 - DNA, 20 bp, Homo sapiens
tattcaataaagtatttaat

SEQ ID NO: 3461982 - DNA, 16 bp, Homo sapiens
tattcaatatcctttg

SEQ ID NO: 3461983 - DNA, 16 bp, Homo sapiens
tattcaatcaaaattt

SEQ ID NO: 3461984 - DNA, 17 bp, Homo sapiens
tattcaattcctctggg

SEQ ID NO: 3461985 - DNA, 21 bp, Homo sapiens
tattcacatcgcttctgtgta

SEQ ID NO: 3461986 - DNA, 23 bp, Homo sapiens
tattcagcagactttctctgtgt

SEQ ID NO: 3461987 - DNA, 15 bp, Homo sapiens
tattcatctcaagga

SEQ ID NO: 3461988 - DNA, 22 bp, Homo sapiens
tattcctatatagtttattgac

SEQ ID NO: 3461989 - DNA, 18 bp, Homo sapiens
tattctatgtagtggttt

SEQ ID NO: 3461990 - DNA, 23 bp, Homo sapiens
tattctatgtagtggttttagga

SEQ ID NO: 3461991 - DNA, 12 bp, Homo sapiens
tattctcattta

SEQ ID NO: 3461992 - DNA, 13 bp, Homo sapiens
tattcttggtttt

SEQ ID NO: 3461993 - DNA, 14 bp, Homo sapiens
tattcttggttttc

SEQ ID NO: 3461994 - DNA, 21 bp, Homo sapiens
tattctttcaattctgtaggt

SEQ ID NO: 3461995 - DNA, 12 bp, Homo sapiens
tattcttttcca

SEQ ID NO: 3461996 - DNA, 18 bp, Homo sapiens
tattgaaagaattatcct

SEQ ID NO: 3461997 - DNA, 18 bp, Homo sapiens
tattgaacttggaaagaa

SEQ ID NO: 3461998 - DNA, 17 bp, Homo sapiens
tattgaatacttacatt

SEQ ID NO: 3461999 - DNA, 22 bp, Homo sapiens
tattgaatttttcctatgctat

SEQ ID NO: 3462000 - DNA, 17 bp, Homo sapiens
tattgacaagtgtcttt

SEQ ID NO: 3462001 - DNA, 13 bp, Homo sapiens
tattgacaataat

SEQ ID NO: 3462002 - DNA, 17 bp, Homo sapiens
tattgacaataatttca

SEQ ID NO: 3462003 - DNA, 18 bp, Homo sapiens
tattgacaataatttcag

SEQ ID NO: 3462004 - DNA, 23 bp, Homo sapiens
tattgacacagaaaatgttgaga

SEQ ID NO: 3462005 - DNA, 14 bp, Homo sapiens
tattgactctgggt

SEQ ID NO: 3462006 - DNA, 20 bp, Homo sapiens
tattgactctgggtccttcc

SEQ ID NO: 3462007 - DNA, 12 bp, Homo sapiens
tattgcacatgt

SEQ ID NO: 3462008 - DNA, 23 bp, Homo sapiens
tattgcacatgtcttaatgaagt

SEQ ID NO: 3462009 - DNA, 15 bp, Homo sapiens
tattgcacattgttc

SEQ ID NO: 3462010 - DNA, 16 bp, Homo sapiens
tattgcatctgtataa

SEQ ID NO: 3462011 - DNA, 13 bp, Homo sapiens
tattgcatttctg

SEQ ID NO: 3462012 - DNA, 14 bp, Homo sapiens
tattgcccacgctg

SEQ ID NO: 3462013 - DNA, 17 bp, Homo sapiens
tattgccttttaatttt

SEQ ID NO: 3462014 - DNA, 21 bp, Homo sapiens
tattgccttttaatttttaat

SEQ ID NO: 3462015 - DNA, 11 bp, Homo sapiens
tattgctgggg

SEQ ID NO: 3462016 - DNA, 23 bp, Homo sapiens
tattgcttgggtctctctccatt

SEQ ID NO: 3462017 - DNA, 18 bp, Homo sapiens
tattggcctcccaaaaga

SEQ ID NO: 3462018 - DNA, 17 bp, Homo sapiens
tattgtaaaaaattcac

SEQ ID NO: 3462019 - DNA, 13 bp, Homo sapiens
tattgtaaattat

SEQ ID NO: 3462020 - DNA, 14 bp, Homo sapiens
tattgtacctctct

SEQ ID NO: 3462021 - DNA, 14 bp, Homo sapiens
tattgtgtttgtca

SEQ ID NO: 3462022 - DNA, 21 bp, Homo sapiens
tattgtgtttgtcattagcct

SEQ ID NO: 3462023 - DNA, 13 bp, Homo sapiens
tattgttccttat

SEQ ID NO: 3462024 - DNA, 12 bp, Homo sapiens
tattgtttcaat

SEQ ID NO: 3462025 - DNA, 11 bp, Homo sapiens
tattgtttcta

SEQ ID NO: 3462026 - DNA, 18 bp, Homo sapiens
tatttaaaaatatttttg

SEQ ID NO: 3462027 - DNA, 12 bp, Homo sapiens
tatttaaaaatg

SEQ ID NO: 3462028 - DNA, 15 bp, Homo sapiens
tatttaaaaatgtct

SEQ ID NO: 3462029 - DNA, 18 bp, Homo sapiens
tatttaaaaatgtcttgc

SEQ ID NO: 3462030 - DNA, 12 bp, Homo sapiens
tatttaaagaca

SEQ ID NO: 3462031 - DNA, 13 bp, Homo sapiens
tatttaaagacaa

SEQ ID NO: 3462032 - DNA, 17 bp, Homo sapiens
tatttaaagacaaagac

SEQ ID NO: 3462033 - DNA, 14 bp, Homo sapiens
tatttaaattacaa

SEQ ID NO: 3462034 - DNA, 15 bp, Homo sapiens
tatttaacagctgaa

SEQ ID NO: 3462035 - DNA, 21 bp, Homo sapiens
tatttaacagctgaattatct

SEQ ID NO: 3462036 - DNA, 23 bp, Homo sapiens
tatttaactggtgcactttgtaa

SEQ ID NO: 3462037 - DNA, 13 bp, Homo sapiens
tatttaatgtttt

SEQ ID NO: 3462038 - DNA, 17 bp, Homo sapiens
tatttaatgttttaaat

SEQ ID NO: 3462039 - DNA, 19 bp, Homo sapiens
tatttaattagtgctaagt

SEQ ID NO: 3462040 - DNA, 23 bp, Homo sapiens
tatttaatttttttgagacagag

SEQ ID NO: 3462041 - DNA, 15 bp, Homo sapiens
tatttacgctttgat

SEQ ID NO: 3462042 - DNA, 16 bp, Homo sapiens
tatttactgagcttct

SEQ ID NO: 3462043 - DNA, 17 bp, Homo sapiens
tatttagattgttaaaa

SEQ ID NO: 3462044 - DNA, 18 bp, Homo sapiens
tatttagggaactgcttg

SEQ ID NO: 3462045 - DNA, 15 bp, Homo sapiens
tatttatatgtacat

SEQ ID NO: 3462046 - DNA, 15 bp, Homo sapiens
tatttatctgattaa

SEQ ID NO: 3462047 - DNA, 12 bp, Homo sapiens
tatttattcatt

SEQ ID NO: 3462048 - DNA, 13 bp, Homo sapiens
tatttatttactg

SEQ ID NO: 3462049 - DNA, 14 bp, Homo sapiens
tatttcaaattgga

SEQ ID NO: 3462050 - DNA, 16 bp, Homo sapiens
tatttcagatgtaatg

SEQ ID NO: 3462051 - DNA, 18 bp, Homo sapiens
tatttccattcaacaaga

SEQ ID NO: 3462052 - DNA, 16 bp, Homo sapiens
tatttctaaagttgta

SEQ ID NO: 3462053 - DNA, 17 bp, Homo sapiens
tatttctgcatatgttg

SEQ ID NO: 3462054 - DNA, 19 bp, Homo sapiens
tatttcttcgttcttttta

SEQ ID NO: 3462055 - DNA, 15 bp, Homo sapiens
tatttgaacaagtgg

SEQ ID NO: 3462056 - DNA, 20 bp, Homo sapiens
tatttgactttaatttatgt

SEQ ID NO: 3462057 - DNA, 15 bp, Homo sapiens
tatttgattcaaaat

SEQ ID NO: 3462058 - DNA, 24 bp, Homo sapiens
tatttgtactgtttaatgttctgt

SEQ ID NO: 3462059 - DNA, 21 bp, Homo sapiens
tatttgtatttttttgcaagt

SEQ ID NO: 3462060 - DNA, 17 bp, Homo sapiens
tatttgtgctatagtat

SEQ ID NO: 3462061 - DNA, 21 bp, Homo sapiens
tatttgtgctatagtatttga

SEQ ID NO: 3462062 - DNA, 18 bp, Homo sapiens
tattttaagactgatttt

SEQ ID NO: 3462063 - DNA, 23 bp, Homo sapiens
tattttaagactgattttaatag

SEQ ID NO: 3462064 - DNA, 21 bp, Homo sapiens
tattttagtgaacttgaaata

SEQ ID NO: 3462065 - DNA, 15 bp, Homo sapiens
tattttataagaaaa

SEQ ID NO: 3462066 - DNA, 17 bp, Homo sapiens
tattttataagaaaaac

SEQ ID NO: 3462067 - DNA, 23 bp, Homo sapiens
tattttataatgttgtatttaat

SEQ ID NO: 3462068 - DNA, 19 bp, Homo sapiens
tattttattccctttcaca

SEQ ID NO: 3462069 - DNA, 13 bp, Homo sapiens
tattttcaaagaa

SEQ ID NO: 3462070 - DNA, 19 bp, Homo sapiens
tattttctattttaagact

SEQ ID NO: 3462071 - DNA, 20 bp, Homo sapiens
tattttggattgtatattgt

SEQ ID NO: 3462072 - DNA, 23 bp, Homo sapiens
tattttgtgtcctccaggagctt

SEQ ID NO: 3462073 - DNA, 15 bp, Homo sapiens
tatttttaaagatag

SEQ ID NO: 3462074 - DNA, 14 bp, Homo sapiens
tcatcattccttga

SEQ ID NO: 3462075 - DNA, 14 bp, Homo sapiens
tcatcattctctgt

SEQ ID NO: 3462076 - DNA, 19 bp, Homo sapiens
tcatcattctctgtctcat

SEQ ID NO: 3462077 - DNA, 14 bp, Homo sapiens
tcatcatttttcct

SEQ ID NO: 3462078 - DNA, 20 bp, Homo sapiens
tcatccactagtgcaaatca

SEQ ID NO: 3462079 - DNA, 21 bp, Homo sapiens
tcatccactagtgcaaatcat

SEQ ID NO: 3462080 - DNA, 16 bp, Homo sapiens
tcatccatcatcatgt

SEQ ID NO: 3462081 - DNA, 21 bp, Homo sapiens
tcatcccgagcacctccacat

SEQ ID NO: 3462082 - DNA, 17 bp, Homo sapiens
tcatccctaatgctgca

SEQ ID NO: 3462083 - DNA, 13 bp, Homo sapiens
tcatcctccagta

SEQ ID NO: 3462084 - DNA, 21 bp, Homo sapiens
tcatcgaatctactaattcca

SEQ ID NO: 3462085 - DNA, 16 bp, Homo sapiens
tcatcgagatggagct

SEQ ID NO: 3462086 - DNA, 20 bp, Homo sapiens
tcatcgattcaaactgctcc

SEQ ID NO: 3462087 - DNA, 22 bp, Homo sapiens
tcatcggagtcagccaggagct

SEQ ID NO: 3462088 - DNA, 18 bp, Homo sapiens
tcatctagcgcaattgaa

SEQ ID NO: 3462089 - DNA, 20 bp, Homo sapiens
tcatctatggcagtccagcc

SEQ ID NO: 3462090 - DNA, 23 bp, Homo sapiens
tcatctcattacccttttctggg

SEQ ID NO: 3462091 - DNA, 22 bp, Homo sapiens
tcatctcccacctagcagcacc

SEQ ID NO: 3462092 - DNA, 15 bp, Homo sapiens
tcatctctgcctgac

SEQ ID NO: 3462093 - DNA, 20 bp, Homo sapiens
tcatctcttagctcccctcc

SEQ ID NO: 3462094 - DNA, 13 bp, Homo sapiens
tcatctctttaga

SEQ ID NO: 3462095 - DNA, 23 bp, Homo sapiens
tcatctgaaggggcaaattcttt

SEQ ID NO: 3462096 - DNA, 21 bp, Homo sapiens
tcatctgattggacaggcatg

SEQ ID NO: 3462097 - DNA, 21 bp, Homo sapiens
tcatctgcccaactgtgtagc

SEQ ID NO: 3462098 - DNA, 19 bp, Homo sapiens
tcatctgtagggccacccc

SEQ ID NO: 3462099 - DNA, 17 bp, Homo sapiens
tcatctgtccctccggg

SEQ ID NO: 3462100 - DNA, 13 bp, Homo sapiens
tcatcttcctgtg

SEQ ID NO: 3462101 - DNA, 19 bp, Homo sapiens
tcatcttgaccaagcagga

SEQ ID NO: 3462102 - DNA, 23 bp, Homo sapiens
tcatcttgaccaagcaggaagct

SEQ ID NO: 3462103 - DNA, 13 bp, Homo sapiens
tcatctttcttga

SEQ ID NO: 3462104 - DNA, 22 bp, Homo sapiens
tcatctttcttgatcaacatct

SEQ ID NO: 3462105 - DNA, 16 bp, Homo sapiens
tcatcttttaaagaaa

SEQ ID NO: 3462106 - DNA, 23 bp, Homo sapiens
tcatgaatttattgcacattgtt

SEQ ID NO: 3462107 - DNA, 13 bp, Homo sapiens
tcatgacagccag

SEQ ID NO: 3462108 - DNA, 19 bp, Homo sapiens
tcatgacagccagagcctg

SEQ ID NO: 3462109 - DNA, 13 bp, Homo sapiens
tcatgagcctgct

SEQ ID NO: 3462110 - DNA, 17 bp, Homo sapiens
tcatgcaaaggctggga

SEQ ID NO: 3462111 - DNA, 15 bp, Homo sapiens
tcatgcctggcttcg

SEQ ID NO: 3462112 - DNA, 17 bp, Homo sapiens
tcatgcctggcttcgca

SEQ ID NO: 3462113 - DNA, 13 bp, Homo sapiens
tcatgctacagaa

SEQ ID NO: 3462114 - DNA, 18 bp, Homo sapiens
tcatgctacccagccatt

SEQ ID NO: 3462115 - DNA, 18 bp, Homo sapiens
tcatgctgctagatcttt

SEQ ID NO: 3462116 - DNA, 20 bp, Homo sapiens
tcatgctggaacctgcaaaa

SEQ ID NO: 3462117 - DNA, 17 bp, Homo sapiens
tcatggaaactggccag

SEQ ID NO: 3462118 - DNA, 21 bp, Homo sapiens
tcatggaaagactgggacagc

SEQ ID NO: 3462119 - DNA, 21 bp, Homo sapiens
tcatggaccaagaatgagctg

SEQ ID NO: 3462120 - DNA, 18 bp, Homo sapiens
tcatggagggggctgcag

SEQ ID NO: 3462121 - DNA, 17 bp, Homo sapiens
tcatggcctcttgaaga

SEQ ID NO: 3462122 - DNA, 22 bp, Homo sapiens
tcatgtaaacataccaacatgt

SEQ ID NO: 3462123 - DNA, 17 bp, Homo sapiens
tcatgtacaagatgaag

SEQ ID NO: 3462124 - DNA, 18 bp, Homo sapiens
tcatgtacaagatgaagg

SEQ ID NO: 3462125 - DNA, 23 bp, Homo sapiens
tcatgtgtgtccacgactgtctc

SEQ ID NO: 3462126 - DNA, 19 bp, Homo sapiens
tcatgttgatcatgtactt

SEQ ID NO: 3462127 - DNA, 22 bp, Homo sapiens
tcatgttgcacacccactcagc

SEQ ID NO: 3462128 - DNA, 19 bp, Homo sapiens
tcatgttggtttattttca

SEQ ID NO: 3462129 - DNA, 13 bp, Homo sapiens
tcatgttttaaca

SEQ ID NO: 3462130 - DNA, 14 bp, Homo sapiens
tcatgttttggtga

SEQ ID NO: 3462131 - DNA, 14 bp, Homo sapiens
tcattaaattacct

SEQ ID NO: 3462132 - DNA, 22 bp, Homo sapiens
tcattaaggtcattactctcaa

SEQ ID NO: 3462133 - DNA, 13 bp, Homo sapiens
tcattaattctat

SEQ ID NO: 3462134 - DNA, 12 bp, Homo sapiens
tcattactataa

SEQ ID NO: 3462135 - DNA, 18 bp, Homo sapiens
tcattagaagttaccaaa

SEQ ID NO: 3462136 - DNA, 18 bp, Homo sapiens
tcattagcctgagtagaa

SEQ ID NO: 3462137 - DNA, 19 bp, Homo sapiens
tcattagcctgagtagaaa

SEQ ID NO: 3462138 - DNA, 18 bp, Homo sapiens
tcattcaaaagttgaaat

SEQ ID NO: 3462139 - DNA, 23 bp, Homo sapiens
tcattcagcagcaaattttcagc

SEQ ID NO: 3462140 - DNA, 18 bp, Homo sapiens
tcattccagatcccaggc

SEQ ID NO: 3462141 - DNA, 15 bp, Homo sapiens
tcattcgggatgatt

SEQ ID NO: 3462142 - DNA, 17 bp, Homo sapiens
tcattcgggctgggcgc

SEQ ID NO: 3462143 - DNA, 15 bp, Homo sapiens
tcattcgttctgtgg

SEQ ID NO: 3462144 - DNA, 22 bp, Homo sapiens
tcattgaggataaattgccata

SEQ ID NO: 3462145 - DNA, 16 bp, Homo sapiens
tcattgctgagcctct

SEQ ID NO: 3462146 - DNA, 18 bp, Homo sapiens
tcattgtattcagataat

SEQ ID NO: 3462147 - DNA, 17 bp, Homo sapiens
tcattgttctgtacaaa

SEQ ID NO: 3462148 - DNA, 21 bp, Homo sapiens
tcattgttggtgttaattgaa

SEQ ID NO: 3462149 - DNA, 14 bp, Homo sapiens
tcatttaataatat

SEQ ID NO: 3462150 - DNA, 20 bp, Homo sapiens
tcatttaataatatacttgt

SEQ ID NO: 3462151 - DNA, 21 bp, Homo sapiens
tcatttaataatatacttgtg

SEQ ID NO: 3462152 - DNA, 22 bp, Homo sapiens
tcatttataaagctaaaataac

SEQ ID NO: 3462153 - DNA, 21 bp, Homo sapiens
tcatttcacccctccctttct

SEQ ID NO: 3462154 - DNA, 16 bp, Homo sapiens
tcatttcaggagcagc

SEQ ID NO: 3462155 - DNA, 16 bp, Homo sapiens
tcatttcctgtgtctt

SEQ ID NO: 3462156 - DNA, 15 bp, Homo sapiens
tcatttcttatgaat

SEQ ID NO: 3462157 - DNA, 20 bp, Homo sapiens
tcatttggttcattaattct

SEQ ID NO: 3462158 - DNA, 21 bp, Homo sapiens
tcatttgtggcagtcccttat

SEQ ID NO: 3462159 - DNA, 12 bp, Homo sapiens
tcatttgtttac

SEQ ID NO: 3462160 - DNA, 18 bp, Homo sapiens
tcatttgtttacatttga

SEQ ID NO: 3462161 - DNA, 16 bp, Homo sapiens
tcattttatatgtcaa

SEQ ID NO: 3462162 - DNA, 15 bp, Homo sapiens
tcattttcagagtga

SEQ ID NO: 3462163 - DNA, 12 bp, Homo sapiens
tcattttctaga

SEQ ID NO: 3462164 - DNA, 21 bp, Homo sapiens
tcattttctagatacaataaa

SEQ ID NO: 3462165 - DNA, 14 bp, Homo sapiens
tcatttttaaatgt

SEQ ID NO: 3462166 - DNA, 19 bp, Homo sapiens
tcatttttagtagagacag

SEQ ID NO: 3462167 - DNA, 13 bp, Homo sapiens
tcatttttgtaat

SEQ ID NO: 3462168 - DNA, 16 bp, Homo sapiens
tcatttttgtaataac

SEQ ID NO: 3462169 - DNA, 17 bp, Homo sapiens
tcatttttgtaataaca

SEQ ID NO: 3462170 - DNA, 15 bp, Homo sapiens
tccaaaaatctgcct

SEQ ID NO: 3462171 - DNA, 12 bp, Homo sapiens
tccaaaactgcc

SEQ ID NO: 3462172 - DNA, 13 bp, Homo sapiens
tccaaaactgcct

SEQ ID NO: 3462173 - DNA, 14 bp, Homo sapiens
tccaaaagaagccc

SEQ ID NO: 3462174 - DNA, 23 bp, Homo sapiens
tccaaaagtggcctctttgtcta

SEQ ID NO: 3462175 - DNA, 19 bp, Homo sapiens
tccaaaatgtgtatttctt

SEQ ID NO: 3462176 - DNA, 19 bp, Homo sapiens
tccaaactgaagcagcctc

SEQ ID NO: 3462177 - DNA, 22 bp, Homo sapiens
tccaaacttggatttttgactc

SEQ ID NO: 3462178 - DNA, 23 bp, Homo sapiens
tccaaagaaaagtattgtttgga

SEQ ID NO: 3462179 - DNA, 19 bp, Homo sapiens
tccaaagcaaaaccagaac

SEQ ID NO: 3462180 - DNA, 15 bp, Homo sapiens
tccaaagcagacagc

SEQ ID NO: 3462181 - DNA, 22 bp, Homo sapiens
tccaaataattccacagtcctg

SEQ ID NO: 3462182 - DNA, 13 bp, Homo sapiens
tccaaatctccaa

SEQ ID NO: 3462183 - DNA, 14 bp, Homo sapiens
tccaaatctccaag

SEQ ID NO: 3462184 - DNA, 18 bp, Homo sapiens
tccaaatggcgtctggaa

SEQ ID NO: 3462185 - DNA, 13 bp, Homo sapiens
tccaaattcacaa

SEQ ID NO: 3462186 - DNA, 14 bp, Homo sapiens
tccaacaggagctg

SEQ ID NO: 3462187 - DNA, 17 bp, Homo sapiens
tccaaccccccagcact

SEQ ID NO: 3462188 - DNA, 23 bp, Homo sapiens
tccaaccccccagcactgaggaa

SEQ ID NO: 3462189 - DNA, 21 bp, Homo sapiens
tccaacctggggggcagtggt

SEQ ID NO: 3462190 - DNA, 21 bp, Homo sapiens
tccaacgtttggaagatcctg

SEQ ID NO: 3462191 - DNA, 19 bp, Homo sapiens
tccaagaatagcatctgta

SEQ ID NO: 3462192 - DNA, 23 bp, Homo sapiens
tccaagaatagcatctgtacaaa

SEQ ID NO: 3462193 - DNA, 16 bp, Homo sapiens
tccaagcaacagcctt

SEQ ID NO: 3462194 - DNA, 18 bp, Homo sapiens
tccaagcaacagcctttg

SEQ ID NO: 3462195 - DNA, 17 bp, Homo sapiens
tccaagccactgagcaa

SEQ ID NO: 3462196 - DNA, 19 bp, Homo sapiens
tccaagccccatcttctaa

SEQ ID NO: 3462197 - DNA, 12 bp, Homo sapiens
tccaagctggga

SEQ ID NO: 3462198 - DNA, 11 bp, Homo sapiens
tccaagctggt

SEQ ID NO: 3462199 - DNA, 20 bp, Homo sapiens
tccaagctggtcccactcag

SEQ ID NO: 3462200 - DNA, 21 bp, Homo sapiens
tccaagctggtcccactcagt

SEQ ID NO: 3462201 - DNA, 20 bp, Homo sapiens
tccaaggaaaccacagctgc

SEQ ID NO: 3462202 - DNA, 23 bp, Homo sapiens
tccaaggaaaccacagctgctgg

SEQ ID NO: 3462203 - DNA, 21 bp, Homo sapiens
tccaaggggaatcagaactca

SEQ ID NO: 3462204 - DNA, 22 bp, Homo sapiens
tccaagtggtgggaatcagatc

SEQ ID NO: 3462205 - DNA, 11 bp, Homo sapiens
tcctctctctg

SEQ ID NO: 3462206 - DNA, 19 bp, Homo sapiens
tcctctctggggctgtgtt

SEQ ID NO: 3462207 - DNA, 14 bp, Homo sapiens
tcctctctttgtgg

SEQ ID NO: 3462208 - DNA, 10 bp, Homo sapiens
tcctctgaaa

SEQ ID NO: 3462209 - DNA, 12 bp, Homo sapiens
tcctctgaaaca

SEQ ID NO: 3462210 - DNA, 13 bp, Homo sapiens
tcctctgaaacag

SEQ ID NO: 3462211 - DNA, 17 bp, Homo sapiens
tcctctgaaacagctgc

SEQ ID NO: 3462212 - DNA, 21 bp, Homo sapiens
tcctctgaaacagctgcctta

SEQ ID NO: 3462213 - DNA, 15 bp, Homo sapiens
tcctctgactcaggg

SEQ ID NO: 3462214 - DNA, 18 bp, Homo sapiens
tcctctgactcagggctc

SEQ ID NO: 3462215 - DNA, 13 bp, Homo sapiens
tcctctgactcca

SEQ ID NO: 3462216 - DNA, 22 bp, Homo sapiens
tcctctgactccactcaaagag

SEQ ID NO: 3462217 - DNA, 19 bp, Homo sapiens
tcctctgtcagtcacagcc

SEQ ID NO: 3462218 - DNA, 19 bp, Homo sapiens
tcctctgtgaccaatgtct

SEQ ID NO: 3462219 - DNA, 21 bp, Homo sapiens
tcctctgtgaccaatgtcttg

SEQ ID NO: 3462220 - DNA, 13 bp, Homo sapiens
tcctcttctgggc

SEQ ID NO: 3462221 - DNA, 17 bp, Homo sapiens
tcctcttctgggcctga

SEQ ID NO: 3462222 - DNA, 19 bp, Homo sapiens
tcctcttgtaaataaagcc

SEQ ID NO: 3462223 - DNA, 15 bp, Homo sapiens
tcctctttagagtta

SEQ ID NO: 3462224 - DNA, 16 bp, Homo sapiens
tcctctttgctttgct

SEQ ID NO: 3462225 - DNA, 13 bp, Homo sapiens
tcctgaaagcggc

SEQ ID NO: 3462226 - DNA, 19 bp, Homo sapiens
tcctgaaagcggctgcctc

SEQ ID NO: 3462227 - DNA, 12 bp, Homo sapiens
tcctgaagaaat

SEQ ID NO: 3462228 - DNA, 13 bp, Homo sapiens
tcctgaagaacca

SEQ ID NO: 3462229 - DNA, 18 bp, Homo sapiens
tcctgaagaaccagtccc

SEQ ID NO: 3462230 - DNA, 21 bp, Homo sapiens
tcctgacaagttcctaggaaa

SEQ ID NO: 3462231 - DNA, 14 bp, Homo sapiens
tcctgacattgtct

SEQ ID NO: 3462232 - DNA, 24 bp, Homo sapiens
tcctgagaaaaaaggttccgcttg

SEQ ID NO: 3462233 - DNA, 18 bp, Homo sapiens
tcctgataaagcacagct

SEQ ID NO: 3462234 - DNA, 20 bp, Homo sapiens
tcctgataaagcacagctgt

SEQ ID NO: 3462235 - DNA, 21 bp, Homo sapiens
tcctgcacttacttgcttatt

SEQ ID NO: 3462236 - DNA, 14 bp, Homo sapiens
tcctgccaccaccc

SEQ ID NO: 3462237 - DNA, 23 bp, Homo sapiens
tcctgccaccaccctgtcttcct

SEQ ID NO: 3462238 - DNA, 14 bp, Homo sapiens
tcctgccaggcatg

SEQ ID NO: 3462239 - DNA, 21 bp, Homo sapiens
tcctgcccgcagacctctgga

SEQ ID NO: 3462240 - DNA, 15 bp, Homo sapiens
tcctgccgcagagct

SEQ ID NO: 3462241 - DNA, 16 bp, Homo sapiens
tcctgccgcagagctg

SEQ ID NO: 3462242 - DNA, 20 bp, Homo sapiens
tcctgccgcagagctggccg

SEQ ID NO: 3462243 - DNA, 19 bp, Homo sapiens
tcctgccggagaggaagag

SEQ ID NO: 3462244 - DNA, 22 bp, Homo sapiens
tcctgccggagaggaagagaca

SEQ ID NO: 3462245 - DNA, 14 bp, Homo sapiens
tcctgcctcagcct

SEQ ID NO: 3462246 - DNA, 17 bp, Homo sapiens
tcctgcctcagcctccg

SEQ ID NO: 3462247 - DNA, 20 bp, Homo sapiens
tcctgcctcgaactggctgc

SEQ ID NO: 3462248 - DNA, 16 bp, Homo sapiens
tcctgcctgtctgccc

SEQ ID NO: 3462249 - DNA, 19 bp, Homo sapiens
tcctgcctgtctgccccag

SEQ ID NO: 3462250 - DNA, 12 bp, Homo sapiens
tcctgcctgtgg

SEQ ID NO: 3462251 - DNA, 14 bp, Homo sapiens
tcctgccttcctcc

SEQ ID NO: 3462252 - DNA, 16 bp, Homo sapiens
tcctgccttcctcctg

SEQ ID NO: 3462253 - DNA, 22 bp, Homo sapiens
tcctgccttcctcctgggccct

SEQ ID NO: 3462254 - DNA, 14 bp, Homo sapiens
tcctgcctttgcct

SEQ ID NO: 3462255 - DNA, 15 bp, Homo sapiens
tcctgcctttgcctc

SEQ ID NO: 3462256 - DNA, 23 bp, Homo sapiens
tcctgcggcaggactgcagagca

SEQ ID NO: 3462257 - DNA, 14 bp, Homo sapiens
tcctgcgggtgggg

SEQ ID NO: 3462258 - DNA, 21 bp, Homo sapiens
tcctgctacctcccttgcctt

SEQ ID NO: 3462259 - DNA, 23 bp, Homo sapiens
tcctgctacctcccttgcctttc

SEQ ID NO: 3462260 - DNA, 18 bp, Homo sapiens
tcctgctactctgttcct

SEQ ID NO: 3462261 - DNA, 18 bp, Homo sapiens
tcctgctttgggaagccg

SEQ ID NO: 3462262 - DNA, 22 bp, Homo sapiens
tcctggacatgaagattctttc

SEQ ID NO: 3462263 - DNA, 15 bp, Homo sapiens
tcctggagcccagag

SEQ ID NO: 3462264 - DNA, 22 bp, Homo sapiens
tcctggagcccagaggagggca

SEQ ID NO: 3462265 - DNA, 15 bp, Homo sapiens
tcctggaggcccagt

SEQ ID NO: 3462266 - DNA, 18 bp, Homo sapiens
tcctggaggcccagttca

SEQ ID NO: 3462267 - DNA, 16 bp, Homo sapiens
tcctggagttgcattg

SEQ ID NO: 3462268 - DNA, 19 bp, Homo sapiens
tcctggcactggaccccag

SEQ ID NO: 3462269 - DNA, 11 bp, Homo sapiens
tcctggccatc

SEQ ID NO: 3462270 - DNA, 16 bp, Homo sapiens
tcctggccatcccaca

SEQ ID NO: 3462271 - DNA, 17 bp, Homo sapiens
tcctggcccactgcatc

SEQ ID NO: 3462272 - DNA, 12 bp, Homo sapiens
tcctggctgcgg

SEQ ID NO: 3462273 - DNA, 22 bp, Homo sapiens
tcctggctgcggcgtctgtctg

SEQ ID NO: 3462274 - DNA, 13 bp, Homo sapiens
tcctggcttcagg

SEQ ID NO: 3462275 - DNA, 14 bp, Homo sapiens
tcctgggagtgagc

SEQ ID NO: 3462276 - DNA, 17 bp, Homo sapiens
tcctgggagtgagctgg

SEQ ID NO: 3462277 - DNA, 15 bp, Homo sapiens
tcctgggcagcttga

SEQ ID NO: 3462278 - DNA, 21 bp, Homo sapiens
tcctgggccctctctgctctg

SEQ ID NO: 3462279 - DNA, 22 bp, Homo sapiens
tcctgggtggtctgcaggcagg

SEQ ID NO: 3462280 - DNA, 17 bp, Homo sapiens
tcctgggttttgtattc

SEQ ID NO: 3462281 - DNA, 23 bp, Homo sapiens
tcctggtttcataacttcctgta

SEQ ID NO: 3462282 - DNA, 17 bp, Homo sapiens
tcctgtattcagacaga

SEQ ID NO: 3462283 - DNA, 19 bp, Homo sapiens
tcctgtccacacccagctc

SEQ ID NO: 3462284 - DNA, 22 bp, Homo sapiens
tcctgtccacacccagctcagc

SEQ ID NO: 3462285 - DNA, 22 bp, Homo sapiens
tcctgtccctgcgcctttcctt

SEQ ID NO: 3462286 - DNA, 10 bp, Homo sapiens
tcctgtcctc

SEQ ID NO: 3462287 - DNA, 20 bp, Homo sapiens
tcctgtgatacatttctgaa

SEQ ID NO: 3462288 - DNA, 12 bp, Homo sapiens
tcctgtggcccc

SEQ ID NO: 3462289 - DNA, 23 bp, Homo sapiens
tcctgtggccccaccctgggccc

SEQ ID NO: 3462290 - DNA, 18 bp, Homo sapiens
tcctgtgtgtgcgcctac

SEQ ID NO: 3462291 - DNA, 12 bp, Homo sapiens
tcctgtgtttct

SEQ ID NO: 3462292 - DNA, 22 bp, Homo sapiens
tcctgttaacgtcatctcaggg

SEQ ID NO: 3462293 - DNA, 12 bp, Homo sapiens
tcctgttctgaa

SEQ ID NO: 3462294 - DNA, 20 bp, Homo sapiens
tccttaaaaaaaaaaaaatt

SEQ ID NO: 3462295 - DNA, 17 bp, Homo sapiens
tccttaatccagctgat

SEQ ID NO: 3462296 - DNA, 18 bp, Homo sapiens
tccttaatggtgttctct

SEQ ID NO: 3462297 - DNA, 17 bp, Homo sapiens
tccttagatctggcatg

SEQ ID NO: 3462298 - DNA, 20 bp, Homo sapiens
tccttcacatcctgtgtttc

SEQ ID NO: 3462299 - DNA, 23 bp, Homo sapiens
tccttcagacaccctcaacctct

SEQ ID NO: 3462300 - DNA, 13 bp, Homo sapiens
tccttcagccctc

SEQ ID NO: 3462301 - DNA, 15 bp, Homo sapiens
tccttcagccctcac

SEQ ID NO: 3462302 - DNA, 20 bp, Homo sapiens
tccttcatcttttaaagaaa

SEQ ID NO: 3462303 - DNA, 22 bp, Homo sapiens
tccttcccaagtaagaggctgg

SEQ ID NO: 3462304 - DNA, 13 bp, Homo sapiens
tccttccctaccc

SEQ ID NO: 3462305 - DNA, 19 bp, Homo sapiens
tccttccgatgacagtgct

SEQ ID NO: 3462306 - DNA, 21 bp, Homo sapiens
tccttcctcacaccaggcttg

SEQ ID NO: 3462307 - DNA, 14 bp, Homo sapiens
tccttcctgaaact

SEQ ID NO: 3462308 - DNA, 15 bp, Homo sapiens
tccttcctggcctga

SEQ ID NO: 3462309 - DNA, 17 bp, Homo sapiens
tccttcctggcctgaga

SEQ ID NO: 3462310 - DNA, 16 bp, Homo sapiens
tccttcctgttctgaa

SEQ ID NO: 3462311 - DNA, 19 bp, Homo sapiens
tccttcgaaaggccttcag

SEQ ID NO: 3462312 - DNA, 18 bp, Homo sapiens
tccttctcccatctcttc

SEQ ID NO: 3462313 - DNA, 12 bp, Homo sapiens
tccttctccctt

SEQ ID NO: 3462314 - DNA, 13 bp, Homo sapiens
tccttctctcact

SEQ ID NO: 3462315 - DNA, 12 bp, Homo sapiens
tccttctgtcct

SEQ ID NO: 3462316 - DNA, 20 bp, Homo sapiens
tccttgaagaactgcaggcc

SEQ ID NO: 3462317 - DNA, 21 bp, Homo sapiens
tccttgcaggtgggggttgct

SEQ ID NO: 3462318 - DNA, 21 bp, Homo sapiens
tccttggcagtggactcagaa

SEQ ID NO: 3462319 - DNA, 20 bp, Homo sapiens
tccttgggaggccccactgg

SEQ ID NO: 3462320 - DNA, 21 bp, Homo sapiens
tccttgggaggccccactggg

SEQ ID NO: 3462321 - DNA, 13 bp, Homo sapiens
tccttgggccctt

SEQ ID NO: 3462322 - DNA, 14 bp, Homo sapiens
tccttggggcaggc

SEQ ID NO: 3462323 - DNA, 15 bp, Homo sapiens
tccttggggcaggca

SEQ ID NO: 3462324 - DNA, 18 bp, Homo sapiens
tccttgtggcctgggcct

SEQ ID NO: 3462325 - DNA, 15 bp, Homo sapiens
tcctttaaaaaagaa

SEQ ID NO: 3462326 - DNA, 18 bp, Homo sapiens
tcctttaaaaaagaaaag

SEQ ID NO: 3462327 - DNA, 19 bp, Homo sapiens
tcctttagcgcccagttgg

SEQ ID NO: 3462328 - DNA, 15 bp, Homo sapiens
tcctttcaccacatg

SEQ ID NO: 3462329 - DNA, 19 bp, Homo sapiens
tcctttctagagcactgcc

SEQ ID NO: 3462330 - DNA, 22 bp, Homo sapiens
tcctttctgggtaacaagccct

SEQ ID NO: 3462331 - DNA, 12 bp, Homo sapiens
tcctttgaagat

SEQ ID NO: 3462332 - DNA, 18 bp, Homo sapiens
tcctttgtactttgtgct

SEQ ID NO: 3462333 - DNA, 20 bp, Homo sapiens
tccttttgaccttcatttca

SEQ ID NO: 3462334 - DNA, 23 bp, Homo sapiens
tccttttgaccttcatttcatgt

SEQ ID NO: 3462335 - DNA, 15 bp, Homo sapiens
tccttttgtaaagtg

SEQ ID NO: 3462336 - DNA, 21 bp, Homo sapiens
tccttttgtaaagtgaagaat

SEQ ID NO: 3462337 - DNA, 23 bp, Homo sapiens
tctctcatcctccagtaccttgc

SEQ ID NO: 3462338 - DNA, 22 bp, Homo sapiens
tctctcatctcttagctcccct

SEQ ID NO: 3462339 - DNA, 23 bp, Homo sapiens
tctctcatctcttagctcccctc

SEQ ID NO: 3462340 - DNA, 14 bp, Homo sapiens
tctctcctgtactt

SEQ ID NO: 3462341 - DNA, 13 bp, Homo sapiens
tctctcctgtcct

SEQ ID NO: 3462342 - DNA, 14 bp, Homo sapiens
tctctcctgtcctc

SEQ ID NO: 3462343 - DNA, 12 bp, Homo sapiens
tctctctccatt

SEQ ID NO: 3462344 - DNA, 12 bp, Homo sapiens
tctctctgccca

SEQ ID NO: 3462345 - DNA, 16 bp, Homo sapiens
tctctctgcccaaccc

SEQ ID NO: 3462346 - DNA, 23 bp, Homo sapiens
tctctcttcttattacccaaacc

SEQ ID NO: 3462347 - DNA, 21 bp, Homo sapiens
tctctcttgggccaagccagc

SEQ ID NO: 3462348 - DNA, 23 bp, Homo sapiens
tctctcttgggccaagccagctg

SEQ ID NO: 3462349 - DNA, 22 bp, Homo sapiens
tctctgaagagtgggtttcaca

SEQ ID NO: 3462350 - DNA, 19 bp, Homo sapiens
tctctgacttctgcctgga

SEQ ID NO: 3462351 - DNA, 17 bp, Homo sapiens
tctctgaggacactaac

SEQ ID NO: 3462352 - DNA, 15 bp, Homo sapiens
tctctgcagacttcc

SEQ ID NO: 3462353 - DNA, 20 bp, Homo sapiens
tctctgcagacttcccagct

SEQ ID NO: 3462354 - DNA, 13 bp, Homo sapiens
tctctgcctgaca

SEQ ID NO: 3462355 - DNA, 14 bp, Homo sapiens
tctctgccttgcct

SEQ ID NO: 3462356 - DNA, 12 bp, Homo sapiens
tctctgctgccg

SEQ ID NO: 3462357 - DNA, 12 bp, Homo sapiens
tctctgctggcc

SEQ ID NO: 3462358 - DNA, 16 bp, Homo sapiens
tctctgctggcccagc

SEQ ID NO: 3462359 - DNA, 15 bp, Homo sapiens
tctctggatgcctga

SEQ ID NO: 3462360 - DNA, 16 bp, Homo sapiens
tctctggcgacagttt

SEQ ID NO: 3462361 - DNA, 22 bp, Homo sapiens
tctctggctgagggatgactta

SEQ ID NO: 3462362 - DNA, 17 bp, Homo sapiens
tctctgggagaaaatca

SEQ ID NO: 3462363 - DNA, 21 bp, Homo sapiens
tctctgtacttttcattctct

SEQ ID NO: 3462364 - DNA, 12 bp, Homo sapiens
tctctgtctcat

SEQ ID NO: 3462365 - DNA, 16 bp, Homo sapiens
tctctgtctcatccat

SEQ ID NO: 3462366 - DNA, 17 bp, Homo sapiens
tctctgtctctctgtct

SEQ ID NO: 3462367 - DNA, 22 bp, Homo sapiens
tctctgtgagactcgagaactt

SEQ ID NO: 3462368 - DNA, 18 bp, Homo sapiens
tctcttagctcccctcca

SEQ ID NO: 3462369 - DNA, 21 bp, Homo sapiens
tctcttatagaatatttatta

SEQ ID NO: 3462370 - DNA, 18 bp, Homo sapiens
tctcttcatgtctattcc

SEQ ID NO: 3462371 - DNA, 14 bp, Homo sapiens
tctcttgagcctgg

SEQ ID NO: 3462372 - DNA, 15 bp, Homo sapiens
tctcttgagcctggg

SEQ ID NO: 3462373 - DNA, 14 bp, Homo sapiens
tctctttaaaatgc

SEQ ID NO: 3462374 - DNA, 21 bp, Homo sapiens
tctctttaatgtcacaggcag

SEQ ID NO: 3462375 - DNA, 15 bp, Homo sapiens
tctctttcatgagtt

SEQ ID NO: 3462376 - DNA, 20 bp, Homo sapiens
tctcttttatatttgtagga

SEQ ID NO: 3462377 - DNA, 20 bp, Homo sapiens
tctcttttcccctttcctgt

SEQ ID NO: 3462378 - DNA, 18 bp, Homo sapiens
tctctttttgctttcgaa

SEQ ID NO: 3462379 - DNA, 14 bp, Homo sapiens
tctgaaacagctgc

SEQ ID NO: 3462380 - DNA, 17 bp, Homo sapiens
tctgaaagtaaaacaat

SEQ ID NO: 3462381 - DNA, 21 bp, Homo sapiens
tctgaaggacattgcggacag

SEQ ID NO: 3462382 - DNA, 22 bp, Homo sapiens
tctgaaggacattgcggacagc

SEQ ID NO: 3462383 - DNA, 19 bp, Homo sapiens
tctgaaggggcaaattctt

SEQ ID NO: 3462384 - DNA, 15 bp, Homo sapiens
tctgaatttgcaaag

SEQ ID NO: 3462385 - DNA, 20 bp, Homo sapiens
tctgaatttgcaaagtactg

SEQ ID NO: 3462386 - DNA, 22 bp, Homo sapiens
tctgaatttgcaaagtactgta

SEQ ID NO: 3462387 - DNA, 15 bp, Homo sapiens
tctgacacacagctc

SEQ ID NO: 3462388 - DNA, 13 bp, Homo sapiens
tctgaccagcagc

SEQ ID NO: 3462389 - DNA, 13 bp, Homo sapiens
tctgacccactgc

SEQ ID NO: 3462390 - DNA, 15 bp, Homo sapiens
tctgacccagtgccc

SEQ ID NO: 3462391 - DNA, 23 bp, Homo sapiens
tctgacccagtgcccccactgac

SEQ ID NO: 3462392 - DNA, 14 bp, Homo sapiens
tctgactcagggct

SEQ ID NO: 3462393 - DNA, 20 bp, Homo sapiens
tctgactcggtttctccaaa

SEQ ID NO: 3462394 - DNA, 19 bp, Homo sapiens
tctgacttaagcaaaagaa

SEQ ID NO: 3462395 - DNA, 23 bp, Homo sapiens
tctgacttaagcaaaagaaaaag

SEQ ID NO: 3462396 - DNA, 14 bp, Homo sapiens
tctgacttctgcct

SEQ ID NO: 3462397 - DNA, 16 bp, Homo sapiens
tctgacttctgcctgg

SEQ ID NO: 3462398 - DNA, 19 bp, Homo sapiens
tctgacttctgcctggaga

SEQ ID NO: 3462399 - DNA, 24 bp, Homo sapiens
tctgagatcaaaacggttttactg

SEQ ID NO: 3462400 - DNA, 18 bp, Homo sapiens
tctgagattcaatattga

SEQ ID NO: 3462401 - DNA, 23 bp, Homo sapiens
tctgaggacactaaccacgctgg

SEQ ID NO: 3462402 - DNA, 15 bp, Homo sapiens
tctgaggcatcctct

SEQ ID NO: 3462403 - DNA, 18 bp, Homo sapiens
tctgagtatctcctcgca

SEQ ID NO: 3462404 - DNA, 12 bp, Homo sapiens
tctgagtctatg

SEQ ID NO: 3462405 - DNA, 20 bp, Homo sapiens
tctgagtgaacctgtataag

SEQ ID NO: 3462406 - DNA, 16 bp, Homo sapiens
tctgagtgccttctgt

SEQ ID NO: 3462407 - DNA, 14 bp, Homo sapiens
tctgataactagat

SEQ ID NO: 3462408 - DNA, 20 bp, Homo sapiens
tctgataactagatggtgct

SEQ ID NO: 3462409 - DNA, 21 bp, Homo sapiens
tctgataactagatggtgctg

SEQ ID NO: 3462410 - DNA, 13 bp, Homo sapiens
tctgataatatat

SEQ ID NO: 3462411 - DNA, 19 bp, Homo sapiens
tctgattcccaagctctgc

SEQ ID NO: 3462412 - DNA, 20 bp, Homo sapiens
tctgattcttctaaattaaa

SEQ ID NO: 3462413 - DNA, 23 bp, Homo sapiens
tctgcaaaatgaggaatgtatat

SEQ ID NO: 3462414 - DNA, 21 bp, Homo sapiens
tctgcaagaattgaagcagga

SEQ ID NO: 3462415 - DNA, 20 bp, Homo sapiens
tctgcaagcacatctgcatt

SEQ ID NO: 3462416 - DNA, 17 bp, Homo sapiens
tctgcaagtgctcaggg

SEQ ID NO: 3462417 - DNA, 18 bp, Homo sapiens
tctgcaagtgctcaggga

SEQ ID NO: 3462418 - DNA, 20 bp, Homo sapiens
tctgcaagtgctcagggaaa

SEQ ID NO: 3462419 - DNA, 12 bp, Homo sapiens
tctgcacagctt

SEQ ID NO: 3462420 - DNA, 15 bp, Homo sapiens
tctgcagaagaggag

SEQ ID NO: 3462421 - DNA, 23 bp, Homo sapiens
tctgcagaaggaaaaatgtgtaa

SEQ ID NO: 3462422 - DNA, 14 bp, Homo sapiens
tctgcaggcagaca

SEQ ID NO: 3462423 - DNA, 14 bp, Homo sapiens
tctgcaggcagggc

SEQ ID NO: 3462424 - DNA, 22 bp, Homo sapiens
tctgcaggcctaggtgcagctc

SEQ ID NO: 3462425 - DNA, 16 bp, Homo sapiens
tctgcaggggtctggg

SEQ ID NO: 3462426 - DNA, 17 bp, Homo sapiens
tctgcaggggtctggga

SEQ ID NO: 3462427 - DNA, 15 bp, Homo sapiens
tctgcatatgttgaa

SEQ ID NO: 3462428 - DNA, 19 bp, Homo sapiens
tctgcatatgttgaatact

SEQ ID NO: 3462429 - DNA, 14 bp, Homo sapiens
tctgcatgtactag

SEQ ID NO: 3462430 - DNA, 14 bp, Homo sapiens
tctgcatttagctg

SEQ ID NO: 3462431 - DNA, 21 bp, Homo sapiens
tctgcattttcaccccaccct

SEQ ID NO: 3462432 - DNA, 22 bp, Homo sapiens
tctgccacccctaaactccagg

SEQ ID NO: 3462433 - DNA, 18 bp, Homo sapiens
tctgccatattctgttgg

SEQ ID NO: 3462434 - DNA, 23 bp, Homo sapiens
tctgccatattctgttggccagt

SEQ ID NO: 3462435 - DNA, 19 bp, Homo sapiens
tctgccatgttgccccttt

SEQ ID NO: 3462436 - DNA, 16 bp, Homo sapiens
tctgccccagcccaga

SEQ ID NO: 3462437 - DNA, 20 bp, Homo sapiens
tctgccccagcccagattcc

SEQ ID NO: 3462438 - DNA, 15 bp, Homo sapiens
tctgccccatcctcc

SEQ ID NO: 3462439 - DNA, 18 bp, Homo sapiens
tctgccccatcctccagc

SEQ ID NO: 3462440 - DNA, 21 bp, Homo sapiens
tctgccccatcctccagcagg

SEQ ID NO: 3462441 - DNA, 18 bp, Homo sapiens
tctgcccttgccaacgga

SEQ ID NO: 3462442 - DNA, 12 bp, Homo sapiens
tctgcctcccta

SEQ ID NO: 3462443 - DNA, 15 bp, Homo sapiens
tctgcctctgacaca

SEQ ID NO: 3462444 - DNA, 18 bp, Homo sapiens
tctgcctctgacacacag

SEQ ID NO: 3462445 - DNA, 21 bp, Homo sapiens
tctgcctctgacacacagctc

SEQ ID NO: 3462446 - DNA, 14 bp, Homo sapiens
tctgcctcttctgg

SEQ ID NO: 3462447 - DNA, 17 bp, Homo sapiens
tctgcctcttctgggag

SEQ ID NO: 3462448 - DNA, 16 bp, Homo sapiens
tctgcctgaacctggg

SEQ ID NO: 3462449 - DNA, 14 bp, Homo sapiens
tctgcctgcccagg

SEQ ID NO: 3462450 - DNA, 21 bp, Homo sapiens
tctgcctgggttttgttccct

SEQ ID NO: 3462451 - DNA, 13 bp, Homo sapiens
tctgccttgcctt

SEQ ID NO: 3462452 - DNA, 11 bp, Homo sapiens
tctgcctttat

SEQ ID NO: 3462453 - DNA, 18 bp, Homo sapiens
tctgcctttattgtgttt

SEQ ID NO: 3462454 - DNA, 23 bp, Homo sapiens
tctgcctttattgtgtttgtcat

SEQ ID NO: 3462455 - DNA, 17 bp, Homo sapiens
tctgcgtcatgcttgtg

SEQ ID NO: 3462456 - DNA, 20 bp, Homo sapiens
tctgcgtgtcacctgtgctt

SEQ ID NO: 3462457 - DNA, 13 bp, Homo sapiens
tctgctcacttta

SEQ ID NO: 3462458 - DNA, 14 bp, Homo sapiens
tctgctcagctctg

SEQ ID NO: 3462459 - DNA, 16 bp, Homo sapiens
tctgctcagctctggg

SEQ ID NO: 3462460 - DNA, 12 bp, Homo sapiens
tctgctcatcat

SEQ ID NO: 3462461 - DNA, 18 bp, Homo sapiens
tctgctcatcattctctg

SEQ ID NO: 3462462 - DNA, 18 bp, Homo sapiens
tctgctcctctccccagc

SEQ ID NO: 3462463 - DNA, 16 bp, Homo sapiens
tctgctcctttcccct

SEQ ID NO: 3462464 - DNA, 12 bp, Homo sapiens
tctgctctcctt

SEQ ID NO: 3462465 - DNA, 14 bp, Homo sapiens
tctgctctccttcc

SEQ ID NO: 3462466 - DNA, 15 bp, Homo sapiens
tctgctctccttcct

SEQ ID NO: 3462467 - DNA, 20 bp, Homo sapiens
tctgctctccttcctggagc

SEQ ID NO: 3462468 - DNA, 23 bp, Homo sapiens
tctgctgccccgcttccccacag

SEQ ID NO: 3462469 - DNA, 17 bp, Homo sapiens
tgaagtgttctgagctg

SEQ ID NO: 3462470 - DNA, 15 bp, Homo sapiens
tgaagttgttactaa

SEQ ID NO: 3462471 - DNA, 15 bp, Homo sapiens
tgaagtttgaatgtt

SEQ ID NO: 3462472 - DNA, 17 bp, Homo sapiens
tgaagtttgaatgttaa

SEQ ID NO: 3462473 - DNA, 20 bp, Homo sapiens
tgaagtttgaatgttaaata

SEQ ID NO: 3462474 - DNA, 14 bp, Homo sapiens
tgaagttttacatt

SEQ ID NO: 3462475 - DNA, 15 bp, Homo sapiens
tgaagttttacattg

SEQ ID NO: 3462476 - DNA, 16 bp, Homo sapiens
tgaagttttacattgt

SEQ ID NO: 3462477 - DNA, 14 bp, Homo sapiens
tgaataaaaacttt

SEQ ID NO: 3462478 - DNA, 20 bp, Homo sapiens
tgaataaaaactttgctaaa

SEQ ID NO: 3462479 - DNA, 18 bp, Homo sapiens
tgaataaagaatacttga

SEQ ID NO: 3462480 - DNA, 19 bp, Homo sapiens
tgaataaagaatacttgaa

SEQ ID NO: 3462481 - DNA, 22 bp, Homo sapiens
tgaataaagaatacttgaactt

SEQ ID NO: 3462482 - DNA, 16 bp, Homo sapiens
tgaataaataaatgta

SEQ ID NO: 3462483 - DNA, 16 bp, Homo sapiens
tgaataataagcagga

SEQ ID NO: 3462484 - DNA, 20 bp, Homo sapiens
tgaataataagcaggatgtt

SEQ ID NO: 3462485 - DNA, 12 bp, Homo sapiens
tgaataatacag

SEQ ID NO: 3462486 - DNA, 13 bp, Homo sapiens
tgaataatacagt

SEQ ID NO: 3462487 - DNA, 21 bp, Homo sapiens
tgaatataatatatttgtgta

SEQ ID NO: 3462488 - DNA, 22 bp, Homo sapiens
tgaatataatatatttgtgtat

SEQ ID NO: 3462489 - DNA, 20 bp, Homo sapiens
tgaatcagtataaacaaagt

SEQ ID NO: 3462490 - DNA, 22 bp, Homo sapiens
tgaatcagtttccaattatttg

SEQ ID NO: 3462491 - DNA, 16 bp, Homo sapiens
tgaatctgctcacttt

SEQ ID NO: 3462492 - DNA, 13 bp, Homo sapiens
tgaatcttgtctc

SEQ ID NO: 3462493 - DNA, 15 bp, Homo sapiens
tgaatcttgtctcaa

SEQ ID NO: 3462494 - DNA, 24 bp, Homo sapiens
tgaatcttgtctcaatgctcataa

SEQ ID NO: 3462495 - DNA, 14 bp, Homo sapiens
tgaatgagaatcta

SEQ ID NO: 3462496 - DNA, 14 bp, Homo sapiens
tgaatgagaatgtg

SEQ ID NO: 3462497 - DNA, 22 bp, Homo sapiens
tgaatgcagtctgtccaggctc

SEQ ID NO: 3462498 - DNA, 15 bp, Homo sapiens
tgaatgcattttgtt

SEQ ID NO: 3462499 - DNA, 22 bp, Homo sapiens
tgaatgcattttgtttggtatt

SEQ ID NO: 3462500 - DNA, 20 bp, Homo sapiens
tgaatgctaagaatgcatta

SEQ ID NO: 3462501 - DNA, 19 bp, Homo sapiens
tgaatgcttataggtggcc

SEQ ID NO: 3462502 - DNA, 21 bp, Homo sapiens
tgaatgctttgcatttggaat

SEQ ID NO: 3462503 - DNA, 19 bp, Homo sapiens
tgaatgtatttatttggga

SEQ ID NO: 3462504 - DNA, 16 bp, Homo sapiens
tgaatgttaatttttt

SEQ ID NO: 3462505 - DNA, 16 bp, Homo sapiens
tgaattcctagaatta

SEQ ID NO: 3462506 - DNA, 21 bp, Homo sapiens
tgaattcttggttgaggaaac

SEQ ID NO: 3462507 - DNA, 22 bp, Homo sapiens
tgaattcttggttgaggaaaca

SEQ ID NO: 3462508 - DNA, 22 bp, Homo sapiens
tgaattgcgttggtctctgcat

SEQ ID NO: 3462509 - DNA, 19 bp, Homo sapiens
tgaattgtaactgttcttg

SEQ ID NO: 3462510 - DNA, 13 bp, Homo sapiens
tgaattgttacat

SEQ ID NO: 3462511 - DNA, 18 bp, Homo sapiens
tgaatttgcaaagtactg

SEQ ID NO: 3462512 - DNA, 19 bp, Homo sapiens
tgaatttgcaaagtactgt

SEQ ID NO: 3462513 - DNA, 20 bp, Homo sapiens
tgaatttgcaaagtactgta

SEQ ID NO: 3462514 - DNA, 17 bp, Homo sapiens
tgaattttaagggtttc

SEQ ID NO: 3462515 - DNA, 21 bp, Homo sapiens
tgaattttggggattttcaaa

SEQ ID NO: 3462516 - DNA, 22 bp, Homo sapiens
tgaattttgttctctgggagaa

SEQ ID NO: 3462517 - DNA, 15 bp, Homo sapiens
tgaatttttcctatg

SEQ ID NO: 3462518 - DNA, 13 bp, Homo sapiens
tgaatttttctct

SEQ ID NO: 3462519 - DNA, 15 bp, Homo sapiens
tgaatttttctctaa

SEQ ID NO: 3462520 - DNA, 15 bp, Homo sapiens
tgaatttttgcaata

SEQ ID NO: 3462521 - DNA, 23 bp, Homo sapiens
tgaatttttgcaataatgcagta

SEQ ID NO: 3462522 - DNA, 20 bp, Homo sapiens
tgaatttttttctgcacagc

SEQ ID NO: 3462523 - DNA, 21 bp, Homo sapiens
tgaatttttttctgcacagct

SEQ ID NO: 3462524 - DNA, 22 bp, Homo sapiens
tgaatttttttctgcacagctt

SEQ ID NO: 3462525 - DNA, 16 bp, Homo sapiens
tgacaagcctttgtgc

SEQ ID NO: 3462526 - DNA, 15 bp, Homo sapiens
tgacaagtgtctttt

SEQ ID NO: 3462527 - DNA, 15 bp, Homo sapiens
tgacaagttcctagg

SEQ ID NO: 3462528 - DNA, 14 bp, Homo sapiens
tgacaataatttca

SEQ ID NO: 3462529 - DNA, 17 bp, Homo sapiens
tgacaataatttcaggt

SEQ ID NO: 3462530 - DNA, 20 bp, Homo sapiens
tgacaattctgcatgtacta

SEQ ID NO: 3462531 - DNA, 22 bp, Homo sapiens
tgacaattctgcatgtactagt

SEQ ID NO: 3462532 - DNA, 16 bp, Homo sapiens
tgacaattctgttttt

SEQ ID NO: 3462533 - DNA, 13 bp, Homo sapiens
tgacaattgtcac

SEQ ID NO: 3462534 - DNA, 17 bp, Homo sapiens
tgacacaaacctgcctg

SEQ ID NO: 3462535 - DNA, 18 bp, Homo sapiens
tgacacaaacctgcctgg

SEQ ID NO: 3462536 - DNA, 19 bp, Homo sapiens
tgacacaaacctgcctggg

SEQ ID NO: 3462537 - DNA, 14 bp, Homo sapiens
tgacacacagctct

SEQ ID NO: 3462538 - DNA, 18 bp, Homo sapiens
tgacacacagctctgtcc

SEQ ID NO: 3462539 - DNA, 19 bp, Homo sapiens
tgacacacagctctgtcct

SEQ ID NO: 3462540 - DNA, 19 bp, Homo sapiens
tgacacagaaaatgttgag

SEQ ID NO: 3462541 - DNA, 16 bp, Homo sapiens
tgacacaggatgaagg

SEQ ID NO: 3462542 - DNA, 17 bp, Homo sapiens
tgacacccaagagggct

SEQ ID NO: 3462543 - DNA, 20 bp, Homo sapiens
tgacacgtctcgccaagcag

SEQ ID NO: 3462544 - DNA, 14 bp, Homo sapiens
tgacactcccttgg

SEQ ID NO: 3462545 - DNA, 19 bp, Homo sapiens
tgacactggtattcctgcc

SEQ ID NO: 3462546 - DNA, 19 bp, Homo sapiens
tgacacttccattgtttaa

SEQ ID NO: 3462547 - DNA, 14 bp, Homo sapiens
tgacagacacaggc

SEQ ID NO: 3462548 - DNA, 18 bp, Homo sapiens
tgacagacacaggcccgg

SEQ ID NO: 3462549 - DNA, 19 bp, Homo sapiens
tgacagagacccagatctc

SEQ ID NO: 3462550 - DNA, 22 bp, Homo sapiens
tgacagagcaagtgagaccctg

SEQ ID NO: 3462551 - DNA, 23 bp, Homo sapiens
tgacagaggaggatgtaaggcct

SEQ ID NO: 3462552 - DNA, 15 bp, Homo sapiens
tgacagaggcagccc

SEQ ID NO: 3462553 - DNA, 16 bp, Homo sapiens
tgacagaggcagcccc

SEQ ID NO: 3462554 - DNA, 12 bp, Homo sapiens
tgacagcctccc

SEQ ID NO: 3462555 - DNA, 22 bp, Homo sapiens
tgacagcctcccacccccatct

SEQ ID NO: 3462556 - DNA, 14 bp, Homo sapiens
tgacagcctctgca

SEQ ID NO: 3462557 - DNA, 14 bp, Homo sapiens
tgacagcctgcagc

SEQ ID NO: 3462558 - DNA, 18 bp, Homo sapiens
tgacagctcttctaagga

SEQ ID NO: 3462559 - DNA, 14 bp, Homo sapiens
tgacagctgctcct

SEQ ID NO: 3462560 - DNA, 22 bp, Homo sapiens
tgacagctgctcctagagggag

SEQ ID NO: 3462561 - DNA, 13 bp, Homo sapiens
tgacagctttgct

SEQ ID NO: 3462562 - DNA, 16 bp, Homo sapiens
tgacagctttgctgct

SEQ ID NO: 3462563 - DNA, 17 bp, Homo sapiens
tgacagctttgctgctg

SEQ ID NO: 3462564 - DNA, 20 bp, Homo sapiens
tgacaggcaatgctggctgt

SEQ ID NO: 3462565 - DNA, 20 bp, Homo sapiens
tgacagggcacaccgggcac

SEQ ID NO: 3462566 - DNA, 21 bp, Homo sapiens
tgacagtattatacgctggca

SEQ ID NO: 3462567 - DNA, 16 bp, Homo sapiens
tgacagtgctctaggc

SEQ ID NO: 3462568 - DNA, 21 bp, Homo sapiens
tgacagtgctctaggctgccc

SEQ ID NO: 3462569 - DNA, 17 bp, Homo sapiens
tgacagtttttctgttt

SEQ ID NO: 3462570 - DNA, 15 bp, Homo sapiens
tgacatatttaatgt

SEQ ID NO: 3462571 - DNA, 22 bp, Homo sapiens
tgacatatttaatgttttaaat

SEQ ID NO: 3462572 - DNA, 19 bp, Homo sapiens
tgacatggaggcactgaag

SEQ ID NO: 3462573 - DNA, 14 bp, Homo sapiens
tgacattgtctcct

SEQ ID NO: 3462574 - DNA, 20 bp, Homo sapiens
tgacattgttggccaaagcc

SEQ ID NO: 3462575 - DNA, 13 bp, Homo sapiens
tgacatttctttg

SEQ ID NO: 3462576 - DNA, 15 bp, Homo sapiens
tgacatttggagagg

SEQ ID NO: 3462577 - DNA, 15 bp, Homo sapiens
tgaccaagcaggaag

SEQ ID NO: 3462578 - DNA, 19 bp, Homo sapiens
tgaccaagcaggaagctca

SEQ ID NO: 3462579 - DNA, 15 bp, Homo sapiens
tgaccaatgtcttga

SEQ ID NO: 3462580 - DNA, 14 bp, Homo sapiens
tgaccaatttgcac

SEQ ID NO: 3462581 - DNA, 23 bp, Homo sapiens
tgaccaccaccccaacaaaccat

SEQ ID NO: 3462582 - DNA, 18 bp, Homo sapiens
tgaccaccagttaacgta

SEQ ID NO: 3462583 - DNA, 22 bp, Homo sapiens
tgaccacgctttctagctgttg

SEQ ID NO: 3462584 - DNA, 20 bp, Homo sapiens
tgaccaggcctgggccagag

SEQ ID NO: 3462585 - DNA, 19 bp, Homo sapiens
tgacccagccccttgagaa

SEQ ID NO: 3462586 - DNA, 23 bp, Homo sapiens
tgacccagccccttgagaaacct

SEQ ID NO: 3462587 - DNA, 12 bp, Homo sapiens
tgacccaggctg

SEQ ID NO: 3462588 - DNA, 13 bp, Homo sapiens
tgacccaggctgg

SEQ ID NO: 3462589 - DNA, 14 bp, Homo sapiens
tgacccaggctggg

SEQ ID NO: 3462590 - DNA, 17 bp, Homo sapiens
tgacccaggctgggcaa

SEQ ID NO: 3462591 - DNA, 19 bp, Homo sapiens
tgacccaggctgggcaagg

SEQ ID NO: 3462592 - DNA, 15 bp, Homo sapiens
tgacccattgctgtt

SEQ ID NO: 3462593 - DNA, 22 bp, Homo sapiens
tgaccccagcattctcaggcac

SEQ ID NO: 3462594 - DNA, 14 bp, Homo sapiens
tgacccccagctcc

SEQ ID NO: 3462595 - DNA, 13 bp, Homo sapiens
tgaccctattttt

SEQ ID NO: 3462596 - DNA, 21 bp, Homo sapiens
tgaccctctgctgaagacttg

SEQ ID NO: 3462597 - DNA, 20 bp, Homo sapiens
tgaccctgtatatagcccag

SEQ ID NO: 3462598 - DNA, 19 bp, Homo sapiens
tgaccgaaacagcgctggg

SEQ ID NO: 3462599 - DNA, 21 bp, Homo sapiens
tgacctcaggtgatccaccca

SEQ ID NO: 3462600 - DNA, 14 bp, Homo sapiens
tgacctccacagct

SEQ ID NO: 3462601 - DNA, 21 bp, Homo sapiens
tgcagggaaaattatttgcat

SEQ ID NO: 3462602 - DNA, 13 bp, Homo sapiens
tgcagggcagtca

SEQ ID NO: 3462603 - DNA, 13 bp, Homo sapiens
tgcaggtggggag

SEQ ID NO: 3462604 - DNA, 23 bp, Homo sapiens
tgcaggtgggggttgctgtataa

SEQ ID NO: 3462605 - DNA, 14 bp, Homo sapiens
tgcagtaaatcttt

SEQ ID NO: 3462606 - DNA, 13 bp, Homo sapiens
tgcagtatatttc

SEQ ID NO: 3462607 - DNA, 14 bp, Homo sapiens
tgcagtatatttct

SEQ ID NO: 3462608 - DNA, 22 bp, Homo sapiens
tgcagtatggtacatttttcaa

SEQ ID NO: 3462609 - DNA, 20 bp, Homo sapiens
tgcagtcaacagttcaaaga

SEQ ID NO: 3462610 - DNA, 19 bp, Homo sapiens
tgcagtcacgtggaggagc

SEQ ID NO: 3462611 - DNA, 16 bp, Homo sapiens
tgcagtcccatgcaca

SEQ ID NO: 3462612 - DNA, 19 bp, Homo sapiens
tgcagtcctgatcagagcc

SEQ ID NO: 3462613 - DNA, 19 bp, Homo sapiens
tgcagtctgtccaggctcg

SEQ ID NO: 3462614 - DNA, 14 bp, Homo sapiens
tgcagtgagccgag

SEQ ID NO: 3462615 - DNA, 21 bp, Homo sapiens
tgcagtgctcgctgttgctga

SEQ ID NO: 3462616 - DNA, 22 bp, Homo sapiens
tgcagtgctcgctgttgctgaa

SEQ ID NO: 3462617 - DNA, 23 bp, Homo sapiens
tgcagtggtgcgatctcggctca

SEQ ID NO: 3462618 - DNA, 20 bp, Homo sapiens
tgcagtggtgcgatctgggt

SEQ ID NO: 3462619 - DNA, 20 bp, Homo sapiens
tgcagttcatccgcactgta

SEQ ID NO: 3462620 - DNA, 14 bp, Homo sapiens
tgcagttctgagca

SEQ ID NO: 3462621 - DNA, 18 bp, Homo sapiens
tgcataacaattcctcta

SEQ ID NO: 3462622 - DNA, 18 bp, Homo sapiens
tgcataagtgaaaatctt

SEQ ID NO: 3462623 - DNA, 22 bp, Homo sapiens
tgcataagtgaaaatcttacaa

SEQ ID NO: 3462624 - DNA, 12 bp, Homo sapiens
tgcataccaacc

SEQ ID NO: 3462625 - DNA, 22 bp, Homo sapiens
tgcatagcagatggtttccaca

SEQ ID NO: 3462626 - DNA, 21 bp, Homo sapiens
tgcatagcagctgctactagc

SEQ ID NO: 3462627 - DNA, 15 bp, Homo sapiens
tgcatatgttgaata

SEQ ID NO: 3462628 - DNA, 19 bp, Homo sapiens
tgcatatgttgaatacttt

SEQ ID NO: 3462629 - DNA, 15 bp, Homo sapiens
tgcatcgtttcatct

SEQ ID NO: 3462630 - DNA, 16 bp, Homo sapiens
tgcatctaagcccatg

SEQ ID NO: 3462631 - DNA, 18 bp, Homo sapiens
tgcatctagattatggag

SEQ ID NO: 3462632 - DNA, 18 bp, Homo sapiens
tgcatctgaccagcagcg

SEQ ID NO: 3462633 - DNA, 22 bp, Homo sapiens
tgcatctgtataagtaagaaaa

SEQ ID NO: 3462634 - DNA, 17 bp, Homo sapiens
tgcatcttactgaaggt

SEQ ID NO: 3462635 - DNA, 17 bp, Homo sapiens
tgcatgatgtttgccca

SEQ ID NO: 3462636 - DNA, 19 bp, Homo sapiens
tgcatgcactgttccccct

SEQ ID NO: 3462637 - DNA, 16 bp, Homo sapiens
tgcatgccctctcagg

SEQ ID NO: 3462638 - DNA, 22 bp, Homo sapiens
tgcatggtgccccaggaccagc

SEQ ID NO: 3462639 - DNA, 23 bp, Homo sapiens
tgcatgtctactcagcatttgat

SEQ ID NO: 3462640 - DNA, 20 bp, Homo sapiens
tgcatgtgactctgaagctg

SEQ ID NO: 3462641 - DNA, 22 bp, Homo sapiens
tgcatgttaggaaaatttcaca

SEQ ID NO: 3462642 - DNA, 20 bp, Homo sapiens
tgcattaaattcacaaactt

SEQ ID NO: 3462643 - DNA, 23 bp, Homo sapiens
tgcattaccgcgttgtaaaatat

SEQ ID NO: 3462644 - DNA, 13 bp, Homo sapiens
tgcattgaacaca

SEQ ID NO: 3462645 - DNA, 22 bp, Homo sapiens
tgcattgaacacaaactgtaaa

SEQ ID NO: 3462646 - DNA, 17 bp, Homo sapiens
tgcattgagaactgcat

SEQ ID NO: 3462647 - DNA, 20 bp, Homo sapiens
tgcattgcccagtctttcat

SEQ ID NO: 3462648 - DNA, 18 bp, Homo sapiens
tgcattgtatcgatgtta

SEQ ID NO: 3462649 - DNA, 13 bp, Homo sapiens
tgcattgtgcttc

SEQ ID NO: 3462650 - DNA, 14 bp, Homo sapiens
tgcattgtttctgt

SEQ ID NO: 3462651 - DNA, 16 bp, Homo sapiens
tgcatttaaatacagt

SEQ ID NO: 3462652 - DNA, 24 bp, Homo sapiens
tgcatttaaatacagtcttccatt

SEQ ID NO: 3462653 - DNA, 14 bp, Homo sapiens
tgcatttagctgta

SEQ ID NO: 3462654 - DNA, 17 bp, Homo sapiens
tgcatttagctgtattc

SEQ ID NO: 3462655 - DNA, 21 bp, Homo sapiens
tgcatttagctgtattcatat

SEQ ID NO: 3462656 - DNA, 19 bp, Homo sapiens
tgcatttatagatcatttc

SEQ ID NO: 3462657 - DNA, 20 bp, Homo sapiens
tgcatttatagatcatttct

SEQ ID NO: 3462658 - DNA, 21 bp, Homo sapiens
tgcatttatagatcatttcta

SEQ ID NO: 3462659 - DNA, 13 bp, Homo sapiens
tgcatttcagaat

SEQ ID NO: 3462660 - DNA, 21 bp, Homo sapiens
tgcatttctgtattttttgtt

SEQ ID NO: 3462661 - DNA, 18 bp, Homo sapiens
tgcattttgtttggtatt

SEQ ID NO: 3462662 - DNA, 23 bp, Homo sapiens
tgcattttgtttggtattgtatt

SEQ ID NO: 3462663 - DNA, 20 bp, Homo sapiens
tgccaaaaaggatacataat

SEQ ID NO: 3462664 - DNA, 19 bp, Homo sapiens
tgccaaaatcattttaatg

SEQ ID NO: 3462665 - DNA, 17 bp, Homo sapiens
tgccaaaattcatttct

SEQ ID NO: 3462666 - DNA, 18 bp, Homo sapiens
tgccaaagggaaatatca

SEQ ID NO: 3462667 - DNA, 17 bp, Homo sapiens
tgccaaatataaataaa

SEQ ID NO: 3462668 - DNA, 22 bp, Homo sapiens
tgccaaatataaataaaaataa

SEQ ID NO: 3462669 - DNA, 15 bp, Homo sapiens
tgccaacaatcctag

SEQ ID NO: 3462670 - DNA, 14 bp, Homo sapiens
tgccaagcactgtg

SEQ ID NO: 3462671 - DNA, 15 bp, Homo sapiens
tgccaagctcaggac

SEQ ID NO: 3462672 - DNA, 13 bp, Homo sapiens
tgccaagctccaa

SEQ ID NO: 3462673 - DNA, 15 bp, Homo sapiens
tgccaagctccaagc

SEQ ID NO: 3462674 - DNA, 23 bp, Homo sapiens
tgccaagctccaagccccatctt

SEQ ID NO: 3462675 - DNA, 21 bp, Homo sapiens
tgccaagggctttgttttgca

SEQ ID NO: 3462676 - DNA, 19 bp, Homo sapiens
tgccaatatgccagcttgg

SEQ ID NO: 3462677 - DNA, 14 bp, Homo sapiens
tgccacaccctccc

SEQ ID NO: 3462678 - DNA, 16 bp, Homo sapiens
tgccacaccctcccca

SEQ ID NO: 3462679 - DNA, 17 bp, Homo sapiens
tgccacaccctccccat

SEQ ID NO: 3462680 - DNA, 18 bp, Homo sapiens
tgccacaccctccccatt

SEQ ID NO: 3462681 - DNA, 17 bp, Homo sapiens
tgccacagcctcccctg

SEQ ID NO: 3462682 - DNA, 22 bp, Homo sapiens
tgccacagcctcccctgccagg

SEQ ID NO: 3462683 - DNA, 16 bp, Homo sapiens
tgccaccaacttacaa

SEQ ID NO: 3462684 - DNA, 19 bp, Homo sapiens
tgccaccaacttacaaaaa

SEQ ID NO: 3462685 - DNA, 17 bp, Homo sapiens
tgccaccaccctgtctt

SEQ ID NO: 3462686 - DNA, 21 bp, Homo sapiens
tgccaccaccctgtcttcctc

SEQ ID NO: 3462687 - DNA, 13 bp, Homo sapiens
tgccacccacctc

SEQ ID NO: 3462688 - DNA, 18 bp, Homo sapiens
tgccacccacctccctgc

SEQ ID NO: 3462689 - DNA, 21 bp, Homo sapiens
tgccacccccagttcctatga

SEQ ID NO: 3462690 - DNA, 15 bp, Homo sapiens
tgccacgaatttctg

SEQ ID NO: 3462691 - DNA, 19 bp, Homo sapiens
tgccactcactaggccccc

SEQ ID NO: 3462692 - DNA, 16 bp, Homo sapiens
tgccactcctccctcc

SEQ ID NO: 3462693 - DNA, 17 bp, Homo sapiens
tgccactcctccctccg

SEQ ID NO: 3462694 - DNA, 14 bp, Homo sapiens
tgccagagatccaa

SEQ ID NO: 3462695 - DNA, 16 bp, Homo sapiens
tgccagatcctcttct

SEQ ID NO: 3462696 - DNA, 22 bp, Homo sapiens
tgccagccagaagcctctgcct

SEQ ID NO: 3462697 - DNA, 18 bp, Homo sapiens
tgccagcttatctcaggg

SEQ ID NO: 3462698 - DNA, 19 bp, Homo sapiens
tgccagcttggacatcagt

SEQ ID NO: 3462699 - DNA, 22 bp, Homo sapiens
tgccagcttggacatcagtgtt

SEQ ID NO: 3462700 - DNA, 14 bp, Homo sapiens
tgccaggcatggtg

SEQ ID NO: 3462701 - DNA, 22 bp, Homo sapiens
tgccagggcaatgatgaatgag

SEQ ID NO: 3462702 - DNA, 12 bp, Homo sapiens
tgccagggcagg

SEQ ID NO: 3462703 - DNA, 13 bp, Homo sapiens
tgccagggcttcc

SEQ ID NO: 3462704 - DNA, 19 bp, Homo sapiens
tgccaggtttttggtctga

SEQ ID NO: 3462705 - DNA, 12 bp, Homo sapiens
tgccataaaaca

SEQ ID NO: 3462706 - DNA, 22 bp, Homo sapiens
tgccataaaacattaagaaaat

SEQ ID NO: 3462707 - DNA, 16 bp, Homo sapiens
tgccataatatgatgc

SEQ ID NO: 3462708 - DNA, 18 bp, Homo sapiens
tgccataatatgatgcaa

SEQ ID NO: 3462709 - DNA, 18 bp, Homo sapiens
tgccatactgtatgcagt

SEQ ID NO: 3462710 - DNA, 15 bp, Homo sapiens
tgccatagccaggag

SEQ ID NO: 3462711 - DNA, 17 bp, Homo sapiens
tgccatattctgttggc

SEQ ID NO: 3462712 - DNA, 20 bp, Homo sapiens
tgccatattctgttggccag

SEQ ID NO: 3462713 - DNA, 19 bp, Homo sapiens
tgccatattgcacatgtct

SEQ ID NO: 3462714 - DNA, 20 bp, Homo sapiens
tgccatattgcacatgtctt

SEQ ID NO: 3462715 - DNA, 13 bp, Homo sapiens
tgccatattttca

SEQ ID NO: 3462716 - DNA, 17 bp, Homo sapiens
tgccatattttcaccat

SEQ ID NO: 3462717 - DNA, 15 bp, Homo sapiens
tgccatcattgctgt

SEQ ID NO: 3462718 - DNA, 18 bp, Homo sapiens
tgccatcattgctgtctg

SEQ ID NO: 3462719 - DNA, 21 bp, Homo sapiens
tgccatcattgctgtctgcag

SEQ ID NO: 3462720 - DNA, 21 bp, Homo sapiens
tgccatccaggttcagcttgt

SEQ ID NO: 3462721 - DNA, 23 bp, Homo sapiens
tgccatctcaattgtgctttgta

SEQ ID NO: 3462722 - DNA, 14 bp, Homo sapiens
tgccatggaagagg

SEQ ID NO: 3462723 - DNA, 17 bp, Homo sapiens
tgccatgttggccaggc

SEQ ID NO: 3462724 - DNA, 13 bp, Homo sapiens
tgccattattcta

SEQ ID NO: 3462725 - DNA, 17 bp, Homo sapiens
tgccattattctatgta

SEQ ID NO: 3462726 - DNA, 18 bp, Homo sapiens
tgccattctcttgcattg

SEQ ID NO: 3462727 - DNA, 17 bp, Homo sapiens
tgccattgcactccagc

SEQ ID NO: 3462728 - DNA, 19 bp, Homo sapiens
tgcccaaagttttattttt

SEQ ID NO: 3462729 - DNA, 14 bp, Homo sapiens
tgcccaagccagag

SEQ ID NO: 3462730 - DNA, 22 bp, Homo sapiens
tgcccaagccagaggctgggtt

SEQ ID NO: 3462731 - DNA, 16 bp, Homo sapiens
tgcccacaggatcagt

SEQ ID NO: 3462732 - DNA, 14 bp, Homo sapiens
tggacatgcctgtc

SEQ ID NO: 3462733 - DNA, 15 bp, Homo sapiens
tggacatgcctgtcc

SEQ ID NO: 3462734 - DNA, 19 bp, Homo sapiens
tggacatgcctgtcctgaa

SEQ ID NO: 3462735 - DNA, 12 bp, Homo sapiens
tggacatggccc

SEQ ID NO: 3462736 - DNA, 17 bp, Homo sapiens
tggacatggcccctgtg

SEQ ID NO: 3462737 - DNA, 12 bp, Homo sapiens
tggaccaagaat

SEQ ID NO: 3462738 - DNA, 16 bp, Homo sapiens
tggaccctgttgctaa

SEQ ID NO: 3462739 - DNA, 13 bp, Homo sapiens
tggacccttccat

SEQ ID NO: 3462740 - DNA, 17 bp, Homo sapiens
tggacctaaatggcctc

SEQ ID NO: 3462741 - DNA, 15 bp, Homo sapiens
tggaccttaggcctt

SEQ ID NO: 3462742 - DNA, 21 bp, Homo sapiens
tggaccttaggccttcctctc

SEQ ID NO: 3462743 - DNA, 18 bp, Homo sapiens
tggacgagaaaacaataa

SEQ ID NO: 3462744 - DNA, 14 bp, Homo sapiens
tggacggtgctcca

SEQ ID NO: 3462745 - DNA, 15 bp, Homo sapiens
tggactaaaagatat

SEQ ID NO: 3462746 - DNA, 14 bp, Homo sapiens
tggactatctgtct

SEQ ID NO: 3462747 - DNA, 15 bp, Homo sapiens
tggactatctgtctg

SEQ ID NO: 3462748 - DNA, 17 bp, Homo sapiens
tggactatctgtctggt

SEQ ID NO: 3462749 - DNA, 20 bp, Homo sapiens
tggactatctgtctggtggc

SEQ ID NO: 3462750 - DNA, 14 bp, Homo sapiens
tggactcagggcag

SEQ ID NO: 3462751 - DNA, 20 bp, Homo sapiens
tggactcagggcagcgccag

SEQ ID NO: 3462752 - DNA, 14 bp, Homo sapiens
tggactccagcctg

SEQ ID NO: 3462753 - DNA, 20 bp, Homo sapiens
tggactccagcctgcctggc

SEQ ID NO: 3462754 - DNA, 17 bp, Homo sapiens
tggactccggccctcct

SEQ ID NO: 3462755 - DNA, 22 bp, Homo sapiens
tggactgaatgggatcatgaaa

SEQ ID NO: 3462756 - DNA, 19 bp, Homo sapiens
tggactgacctggtccaca

SEQ ID NO: 3462757 - DNA, 16 bp, Homo sapiens
tggactgaggcctgag

SEQ ID NO: 3462758 - DNA, 13 bp, Homo sapiens
tggactgcagaag

SEQ ID NO: 3462759 - DNA, 18 bp, Homo sapiens
tggacttgaactttcctg

SEQ ID NO: 3462760 - DNA, 18 bp, Homo sapiens
tggagaagccacaggcct

SEQ ID NO: 3462761 - DNA, 22 bp, Homo sapiens
tggagaagcggctggcagccca

SEQ ID NO: 3462762 - DNA, 21 bp, Homo sapiens
tggagacaatgtctgcagccc

SEQ ID NO: 3462763 - DNA, 18 bp, Homo sapiens
tggagaccagggagcctt

SEQ ID NO: 3462764 - DNA, 19 bp, Homo sapiens
tggagaccagggagccttt

SEQ ID NO: 3462765 - DNA, 21 bp, Homo sapiens
tggagacttagggcaccaggg

SEQ ID NO: 3462766 - DNA, 13 bp, Homo sapiens
tggagagctggag

SEQ ID NO: 3462767 - DNA, 16 bp, Homo sapiens
tggagagggggcctgg

SEQ ID NO: 3462768 - DNA, 16 bp, Homo sapiens
tggagagtttcctgaa

SEQ ID NO: 3462769 - DNA, 16 bp, Homo sapiens
tggagatggaagcttg

SEQ ID NO: 3462770 - DNA, 22 bp, Homo sapiens
tggagatggaagcttgttgaaa

SEQ ID NO: 3462771 - DNA, 16 bp, Homo sapiens
tggagattaagatgcc

SEQ ID NO: 3462772 - DNA, 19 bp, Homo sapiens
tggagcactgggctcccgg

SEQ ID NO: 3462773 - DNA, 12 bp, Homo sapiens
tggagcagaggg

SEQ ID NO: 3462774 - DNA, 17 bp, Homo sapiens
tggagcatcaagccact

SEQ ID NO: 3462775 - DNA, 15 bp, Homo sapiens
tggagcccagaggag

SEQ ID NO: 3462776 - DNA, 20 bp, Homo sapiens
tggagcccagaggagggcag

SEQ ID NO: 3462777 - DNA, 14 bp, Homo sapiens
tggagcccagggca

SEQ ID NO: 3462778 - DNA, 14 bp, Homo sapiens
tggagcctggtgcc

SEQ ID NO: 3462779 - DNA, 23 bp, Homo sapiens
tggagctctgtgggtctctggaa

SEQ ID NO: 3462780 - DNA, 16 bp, Homo sapiens
tggaggagcaaaggct

SEQ ID NO: 3462781 - DNA, 20 bp, Homo sapiens
tggaggagcaaaggctgaga

SEQ ID NO: 3462782 - DNA, 15 bp, Homo sapiens
tggaggattgctgcc

SEQ ID NO: 3462783 - DNA, 14 bp, Homo sapiens
tggaggcaatccta

SEQ ID NO: 3462784 - DNA, 14 bp, Homo sapiens
tggaggccagccag

SEQ ID NO: 3462785 - DNA, 20 bp, Homo sapiens
tggaggctgcctcccaacag

SEQ ID NO: 3462786 - DNA, 20 bp, Homo sapiens
tggaggtcggtaggttcagc

SEQ ID NO: 3462787 - DNA, 16 bp, Homo sapiens
tggaggttaaggcata

SEQ ID NO: 3462788 - DNA, 17 bp, Homo sapiens
tggagtcatgtgcctct

SEQ ID NO: 3462789 - DNA, 14 bp, Homo sapiens
tggagtgtatgact

SEQ ID NO: 3462790 - DNA, 22 bp, Homo sapiens
tggagtgttccccttccactga

SEQ ID NO: 3462791 - DNA, 19 bp, Homo sapiens
tggagttgatctggaaccc

SEQ ID NO: 3462792 - DNA, 17 bp, Homo sapiens
tggagtttacaaagata

SEQ ID NO: 3462793 - DNA, 16 bp, Homo sapiens
tggatacataaagact

SEQ ID NO: 3462794 - DNA, 18 bp, Homo sapiens
tggatcatgtccccctta

SEQ ID NO: 3462795 - DNA, 23 bp, Homo sapiens
tggatccgtttgaccaatttgca

SEQ ID NO: 3462796 - DNA, 20 bp, Homo sapiens
tggatcctgaaatagaggct

SEQ ID NO: 3462797 - DNA, 14 bp, Homo sapiens
tggatcctgggctg

SEQ ID NO: 3462798 - DNA, 15 bp, Homo sapiens
tggatgagccctcag

SEQ ID NO: 3462799 - DNA, 16 bp, Homo sapiens
tggatgatgctgtgct

SEQ ID NO: 3462800 - DNA, 12 bp, Homo sapiens
tggatgatgttt

SEQ ID NO: 3462801 - DNA, 14 bp, Homo sapiens
tggatgcagtgctc

SEQ ID NO: 3462802 - DNA, 23 bp, Homo sapiens
tggatgcagtgctcgctgttgct

SEQ ID NO: 3462803 - DNA, 20 bp, Homo sapiens
tggatgccaatattaaatct

SEQ ID NO: 3462804 - DNA, 17 bp, Homo sapiens
tggatgcccattatatt

SEQ ID NO: 3462805 - DNA, 19 bp, Homo sapiens
tggatgcctggtggcagct

SEQ ID NO: 3462806 - DNA, 20 bp, Homo sapiens
tggatgcctggtggcagctg

SEQ ID NO: 3462807 - DNA, 24 bp, Homo sapiens
tggatgggcctttgagcctgatgt

SEQ ID NO: 3462808 - DNA, 18 bp, Homo sapiens
tggatgggggaactcaga

SEQ ID NO: 3462809 - DNA, 21 bp, Homo sapiens
tggatgggggaactcagatcc

SEQ ID NO: 3462810 - DNA, 18 bp, Homo sapiens
tggatggtcattgcagtt

SEQ ID NO: 3462811 - DNA, 15 bp, Homo sapiens
tggatgtctgaactt

SEQ ID NO: 3462812 - DNA, 15 bp, Homo sapiens
tggatgttgtgtgta

SEQ ID NO: 3462813 - DNA, 13 bp, Homo sapiens
tggattaggtctc

SEQ ID NO: 3462814 - DNA, 18 bp, Homo sapiens
tggattccccatctcagg

SEQ ID NO: 3462815 - DNA, 22 bp, Homo sapiens
tggattccccatctcaggccag

SEQ ID NO: 3462816 - DNA, 17 bp, Homo sapiens
tggattctccctgggcc

SEQ ID NO: 3462817 - DNA, 19 bp, Homo sapiens
tggattctccctgggcctc

SEQ ID NO: 3462818 - DNA, 17 bp, Homo sapiens
tggattctctaaccttt

SEQ ID NO: 3462819 - DNA, 14 bp, Homo sapiens
tggattggggtccc

SEQ ID NO: 3462820 - DNA, 14 bp, Homo sapiens
tggatttgacattg

SEQ ID NO: 3462821 - DNA, 22 bp, Homo sapiens
tggattttggttttgttcccct

SEQ ID NO: 3462822 - DNA, 12 bp, Homo sapiens
tggcaaaaaggc

SEQ ID NO: 3462823 - DNA, 21 bp, Homo sapiens
tggcaaaaggatctttgtggc

SEQ ID NO: 3462824 - DNA, 17 bp, Homo sapiens
tggcaaagcttttagaa

SEQ ID NO: 3462825 - DNA, 13 bp, Homo sapiens
tggcaacagatct

SEQ ID NO: 3462826 - DNA, 17 bp, Homo sapiens
tggcaacagatctggaa

SEQ ID NO: 3462827 - DNA, 11 bp, Homo sapiens
tggcaaggaaa

SEQ ID NO: 3462828 - DNA, 12 bp, Homo sapiens
tggcaaggaaag

SEQ ID NO: 3462829 - DNA, 12 bp, Homo sapiens
tggcaaggctgt

SEQ ID NO: 3462830 - DNA, 14 bp, Homo sapiens
tggcaaggctgtgc

SEQ ID NO: 3462831 - DNA, 15 bp, Homo sapiens
tggcaaggctgtgct

SEQ ID NO: 3462832 - DNA, 23 bp, Homo sapiens
tggcaaggctgtgctccctggtt

SEQ ID NO: 3462833 - DNA, 20 bp, Homo sapiens
tggcaccagacacccaggac

SEQ ID NO: 3462834 - DNA, 18 bp, Homo sapiens
tggcaccagcagcctgga

SEQ ID NO: 3462835 - DNA, 14 bp, Homo sapiens
tggcacccaagacc

SEQ ID NO: 3462836 - DNA, 19 bp, Homo sapiens
tggcacccggcccctgctg

SEQ ID NO: 3462837 - DNA, 20 bp, Homo sapiens
tggcacctaatccaggcaga

SEQ ID NO: 3462838 - DNA, 19 bp, Homo sapiens
tggcactgcatacaatctg

SEQ ID NO: 3462839 - DNA, 13 bp, Homo sapiens
tggcactgccatg

SEQ ID NO: 3462840 - DNA, 13 bp, Homo sapiens
tggcagagcttct

SEQ ID NO: 3462841 - DNA, 15 bp, Homo sapiens
tggcagagttgtaaa

SEQ ID NO: 3462842 - DNA, 20 bp, Homo sapiens
tggcagattcccactgccgc

SEQ ID NO: 3462843 - DNA, 11 bp, Homo sapiens
tggcagctctg

SEQ ID NO: 3462844 - DNA, 22 bp, Homo sapiens
tggcagctctggacagccccac

SEQ ID NO: 3462845 - DNA, 16 bp, Homo sapiens
tggcagctgccacgcc

SEQ ID NO: 3462846 - DNA, 13 bp, Homo sapiens
tggcagctgcttt

SEQ ID NO: 3462847 - DNA, 19 bp, Homo sapiens
tggcaggatggcctggcca

SEQ ID NO: 3462848 - DNA, 20 bp, Homo sapiens
tggcaggatggcctggccag

SEQ ID NO: 3462849 - DNA, 21 bp, Homo sapiens
tggcaggccgaggcaggtgga

SEQ ID NO: 3462850 - DNA, 14 bp, Homo sapiens
tggcaggctggcca

SEQ ID NO: 3462851 - DNA, 15 bp, Homo sapiens
tggcaggctggccag

SEQ ID NO: 3462852 - DNA, 18 bp, Homo sapiens
tggcaggctggccagtcc

SEQ ID NO: 3462853 - DNA, 17 bp, Homo sapiens
tggcagtcactgaattc

SEQ ID NO: 3462854 - DNA, 18 bp, Homo sapiens
tggcagtccagccagctc

SEQ ID NO: 3462855 - DNA, 23 bp, Homo sapiens
tggcagtggactcagaaagccaa

SEQ ID NO: 3462856 - DNA, 15 bp, Homo sapiens
tggcatcagctggcg

SEQ ID NO: 3462857 - DNA, 21 bp, Homo sapiens
tggcatcgcaccattctgact

SEQ ID NO: 3462858 - DNA, 13 bp, Homo sapiens
tggcatcttgcca

SEQ ID NO: 3462859 - DNA, 21 bp, Homo sapiens
tggcatgagaaatacaaaaat

SEQ ID NO: 3462860 - DNA, 19 bp, Homo sapiens
tggcatttcaattcctggc

SEQ ID NO: 3462861 - DNA, 14 bp, Homo sapiens
tggccaaagagcct

SEQ ID NO: 3462862 - DNA, 16 bp, Homo sapiens
tggccaaggagctgct

SEQ ID NO: 3462863 - DNA, 19 bp, Homo sapiens
tggccaagggccagacaga

SEQ ID NO: 3462864 - DNA, 17 bp, Homo sapiens
tggccacagtagtcttg

SEQ ID NO: 3462865 - DNA, 14 bp, Homo sapiens
tgtcctttctagag

SEQ ID NO: 3462866 - DNA, 17 bp, Homo sapiens
tgtcctttttgttatta

SEQ ID NO: 3462867 - DNA, 21 bp, Homo sapiens
tgtcgagagctggccaaagag

SEQ ID NO: 3462868 - DNA, 22 bp, Homo sapiens
tgtcgctcatgtgtgcaacagg

SEQ ID NO: 3462869 - DNA, 21 bp, Homo sapiens
tgtcgttaaaaagttgtttgt

SEQ ID NO: 3462870 - DNA, 23 bp, Homo sapiens
tgtcgttaaaaagttgtttgttt

SEQ ID NO: 3462871 - DNA, 15 bp, Homo sapiens
tgtctaaaacaataa

SEQ ID NO: 3462872 - DNA, 13 bp, Homo sapiens
tgtctaattaaaa

SEQ ID NO: 3462873 - DNA, 22 bp, Homo sapiens
tgtctactcagcatttgattaa

SEQ ID NO: 3462874 - DNA, 14 bp, Homo sapiens
tgtctagagaggga

SEQ ID NO: 3462875 - DNA, 22 bp, Homo sapiens
tgtctagagcctcttggggaag

SEQ ID NO: 3462876 - DNA, 14 bp, Homo sapiens
tgtctatgggactc

SEQ ID NO: 3462877 - DNA, 22 bp, Homo sapiens
tgtctattccattcccttcggc

SEQ ID NO: 3462878 - DNA, 16 bp, Homo sapiens
tgtctcaatgctcata

SEQ ID NO: 3462879 - DNA, 22 bp, Homo sapiens
tgtctcaatgctcataacggat

SEQ ID NO: 3462880 - DNA, 11 bp, Homo sapiens
tgtctcatcca

SEQ ID NO: 3462881 - DNA, 17 bp, Homo sapiens
tgtctcatccatcatca

SEQ ID NO: 3462882 - DNA, 11 bp, Homo sapiens
tgtctcatccc

SEQ ID NO: 3462883 - DNA, 12 bp, Homo sapiens
tgtctcatccca

SEQ ID NO: 3462884 - DNA, 11 bp, Homo sapiens
tgtctccaacc

SEQ ID NO: 3462885 - DNA, 20 bp, Homo sapiens
tgtctccaaccccccagcac

SEQ ID NO: 3462886 - DNA, 15 bp, Homo sapiens
tgtctccagcttccc

SEQ ID NO: 3462887 - DNA, 15 bp, Homo sapiens
tgtctccatggccct

SEQ ID NO: 3462888 - DNA, 22 bp, Homo sapiens
tgtctcctatatatttctatta

SEQ ID NO: 3462889 - DNA, 18 bp, Homo sapiens
tgtctccttaacactgag

SEQ ID NO: 3462890 - DNA, 17 bp, Homo sapiens
tgtctcctttaagagct

SEQ ID NO: 3462891 - DNA, 22 bp, Homo sapiens
tgtctcctttcaccccagggcc

SEQ ID NO: 3462892 - DNA, 13 bp, Homo sapiens
tgtctctctgggc

SEQ ID NO: 3462893 - DNA, 13 bp, Homo sapiens
tgtctctggcctg

SEQ ID NO: 3462894 - DNA, 13 bp, Homo sapiens
tgtctctgtgaga

SEQ ID NO: 3462895 - DNA, 17 bp, Homo sapiens
tgtctcttctttagaac

SEQ ID NO: 3462896 - DNA, 21 bp, Homo sapiens
tgtctctttaatgtcacaggc

SEQ ID NO: 3462897 - DNA, 12 bp, Homo sapiens
tgtctgaacttt

SEQ ID NO: 3462898 - DNA, 17 bp, Homo sapiens
tgtctgaactttgggaa

SEQ ID NO: 3462899 - DNA, 13 bp, Homo sapiens
tgtctgcagccct

SEQ ID NO: 3462900 - DNA, 16 bp, Homo sapiens
tgtctgcagccctgag

SEQ ID NO: 3462901 - DNA, 12 bp, Homo sapiens
tgtctgcagcct

SEQ ID NO: 3462902 - DNA, 13 bp, Homo sapiens
tgtctgcagcctt

SEQ ID NO: 3462903 - DNA, 19 bp, Homo sapiens
tgtctgcagtgtgcccccc

SEQ ID NO: 3462904 - DNA, 21 bp, Homo sapiens
tgtctgcatttcggtggctag

SEQ ID NO: 3462905 - DNA, 19 bp, Homo sapiens
tgtctgccccagcccagat

SEQ ID NO: 3462906 - DNA, 15 bp, Homo sapiens
tgtctggattcccag

SEQ ID NO: 3462907 - DNA, 15 bp, Homo sapiens
tgtctgggaagccct

SEQ ID NO: 3462908 - DNA, 13 bp, Homo sapiens
tgtctgtcattgt

SEQ ID NO: 3462909 - DNA, 17 bp, Homo sapiens
tgtctgtggatggtcat

SEQ ID NO: 3462910 - DNA, 20 bp, Homo sapiens
tgtctgtggatggtcattgc

SEQ ID NO: 3462911 - DNA, 18 bp, Homo sapiens
tgtcttaatgaagtttga

SEQ ID NO: 3462912 - DNA, 20 bp, Homo sapiens
tgtcttaatgaagtttgaat

SEQ ID NO: 3462913 - DNA, 21 bp, Homo sapiens
tgtcttaatgaagtttgaatg

SEQ ID NO: 3462914 - DNA, 13 bp, Homo sapiens
tgtcttcaaggct

SEQ ID NO: 3462915 - DNA, 20 bp, Homo sapiens
tgtcttgcaatggcagcctt

SEQ ID NO: 3462916 - DNA, 21 bp, Homo sapiens
tgtcttgcaatggcagccttg

SEQ ID NO: 3462917 - DNA, 16 bp, Homo sapiens
tgtcttgccagccaga

SEQ ID NO: 3462918 - DNA, 20 bp, Homo sapiens
tgtcttgctgttgacatatt

SEQ ID NO: 3462919 - DNA, 14 bp, Homo sapiens
tgtcttgttctgtc

SEQ ID NO: 3462920 - DNA, 15 bp, Homo sapiens
tgtctttaaaagaga

SEQ ID NO: 3462921 - DNA, 15 bp, Homo sapiens
tgtctttactcctca

SEQ ID NO: 3462922 - DNA, 18 bp, Homo sapiens
tgtctttcggaattttta

SEQ ID NO: 3462923 - DNA, 20 bp, Homo sapiens
tgtcttttaaaatgcaatgt

SEQ ID NO: 3462924 - DNA, 15 bp, Homo sapiens
tgtctttttgttgta

SEQ ID NO: 3462925 - DNA, 16 bp, Homo sapiens
tgtcttttttcactac

SEQ ID NO: 3462926 - DNA, 13 bp, Homo sapiens
tgtgaaaagaaaa

SEQ ID NO: 3462927 - DNA, 17 bp, Homo sapiens
tgtgaaaggaacatttt

SEQ ID NO: 3462928 - DNA, 21 bp, Homo sapiens
tgtgaaataaaactggctttg

SEQ ID NO: 3462929 - DNA, 14 bp, Homo sapiens
tgtgaaccaatgca

SEQ ID NO: 3462930 - DNA, 16 bp, Homo sapiens
tgtgaaccaccacacc

SEQ ID NO: 3462931 - DNA, 20 bp, Homo sapiens
tgtgaaccaccacacccagc

SEQ ID NO: 3462932 - DNA, 22 bp, Homo sapiens
tgtgaaccaccacacccagccc

SEQ ID NO: 3462933 - DNA, 22 bp, Homo sapiens
tgtgaaccctggggcctgactg

SEQ ID NO: 3462934 - DNA, 18 bp, Homo sapiens
tgtgaactggaccctgtt

SEQ ID NO: 3462935 - DNA, 14 bp, Homo sapiens
tgtgaaggaccctt

SEQ ID NO: 3462936 - DNA, 15 bp, Homo sapiens
tgtgaaggcagagaa

SEQ ID NO: 3462937 - DNA, 23 bp, Homo sapiens
tgtgaaggcagagaaagggacaa

SEQ ID NO: 3462938 - DNA, 17 bp, Homo sapiens
tgtgaatgccactgcct

SEQ ID NO: 3462939 - DNA, 20 bp, Homo sapiens
tgtgacacatcgttttgggg

SEQ ID NO: 3462940 - DNA, 22 bp, Homo sapiens
tgtgacatttggagagggggcc

SEQ ID NO: 3462941 - DNA, 13 bp, Homo sapiens
tgtgaccaccacc

SEQ ID NO: 3462942 - DNA, 15 bp, Homo sapiens
tgtgacccccagctc

SEQ ID NO: 3462943 - DNA, 17 bp, Homo sapiens
tgtgaccttaggcccgg

SEQ ID NO: 3462944 - DNA, 14 bp, Homo sapiens
tgtgactcttctct

SEQ ID NO: 3462945 - DNA, 17 bp, Homo sapiens
tgtgactcttctctcaa

SEQ ID NO: 3462946 - DNA, 18 bp, Homo sapiens
tgtgactcttctctcaac

SEQ ID NO: 3462947 - DNA, 23 bp, Homo sapiens
tgtgagaagtgaatgctgggact

SEQ ID NO: 3462948 - DNA, 23 bp, Homo sapiens
tgtgaggaaagtcattggcttta

SEQ ID NO: 3462949 - DNA, 17 bp, Homo sapiens
tgtgaggccagggcaga

SEQ ID NO: 3462950 - DNA, 16 bp, Homo sapiens
tgtgagtgccttttgc

SEQ ID NO: 3462951 - DNA, 17 bp, Homo sapiens
tgtgagtgccttttgca

SEQ ID NO: 3462952 - DNA, 19 bp, Homo sapiens
tgtgagtgccttttgcaga

SEQ ID NO: 3462953 - DNA, 16 bp, Homo sapiens
tgtgagtttaaagcaa

SEQ ID NO: 3462954 - DNA, 13 bp, Homo sapiens
tgtgataaggaaa

SEQ ID NO: 3462955 - DNA, 14 bp, Homo sapiens
tgtgatagcacttt

SEQ ID NO: 3462956 - DNA, 13 bp, Homo sapiens
tgtgatcgtctga

SEQ ID NO: 3462957 - DNA, 20 bp, Homo sapiens
tgtgatgtacacattttgta

SEQ ID NO: 3462958 - DNA, 16 bp, Homo sapiens
tgtgattgacagcttt

SEQ ID NO: 3462959 - DNA, 16 bp, Homo sapiens
tgtgattgcacgtgcc

SEQ ID NO: 3462960 - DNA, 14 bp, Homo sapiens
tgtgattgtgccta

SEQ ID NO: 3462961 - DNA, 16 bp, Homo sapiens
tgtgattttaactctg

SEQ ID NO: 3462962 - DNA, 18 bp, Homo sapiens
tgtgattttaactctgtc

SEQ ID NO: 3462963 - DNA, 11 bp, Homo sapiens
tgtgatttttt

SEQ ID NO: 3462964 - DNA, 17 bp, Homo sapiens
tgtgcaaaaaaattaaa

SEQ ID NO: 3462965 - DNA, 17 bp, Homo sapiens
tgtgcaataatttacat

SEQ ID NO: 3462966 - DNA, 16 bp, Homo sapiens
tgtgcacaagtgtgca

SEQ ID NO: 3462967 - DNA, 13 bp, Homo sapiens
tgtgcacatctct

SEQ ID NO: 3462968 - DNA, 17 bp, Homo sapiens
tgtgcacatctgtgtct

SEQ ID NO: 3462969 - DNA, 21 bp, Homo sapiens
tgtgcacatctgtgtcttgtt

SEQ ID NO: 3462970 - DNA, 19 bp, Homo sapiens
tgtgcaccaccacacccgg

SEQ ID NO: 3462971 - DNA, 12 bp, Homo sapiens
tgtgcactaagg

SEQ ID NO: 3462972 - DNA, 23 bp, Homo sapiens
tgtgcactaaggggcccggccag

SEQ ID NO: 3462973 - DNA, 13 bp, Homo sapiens
tgtgcactgccca

SEQ ID NO: 3462974 - DNA, 16 bp, Homo sapiens
tgtgcagcttttggtc

SEQ ID NO: 3462975 - DNA, 22 bp, Homo sapiens
tgtgcatatgtgtgtgtgtgca

SEQ ID NO: 3462976 - DNA, 21 bp, Homo sapiens
tgtgcattcttttaaaagaca

SEQ ID NO: 3462977 - DNA, 17 bp, Homo sapiens
tgtgccaccatgcctca

SEQ ID NO: 3462978 - DNA, 15 bp, Homo sapiens
tgtgccatgtataat

SEQ ID NO: 3462979 - DNA, 23 bp, Homo sapiens
tgtgccatgtataatttttttct

SEQ ID NO: 3462980 - DNA, 13 bp, Homo sapiens
tgtgccctcctga

SEQ ID NO: 3462981 - DNA, 12 bp, Homo sapiens
tgtgcctcggct

SEQ ID NO: 3462982 - DNA, 21 bp, Homo sapiens
tgtgctccctggttctgatga

SEQ ID NO: 3462983 - DNA, 19 bp, Homo sapiens
tgtgctctggacaggcatg

SEQ ID NO: 3462984 - DNA, 10 bp, Homo sapiens
tgtgctggga

SEQ ID NO: 3462985 - DNA, 17 bp, Homo sapiens
tgtgctgggagctccac

SEQ ID NO: 3462986 - DNA, 13 bp, Homo sapiens
tgtgcttctctat

SEQ ID NO: 3462987 - DNA, 18 bp, Homo sapiens
tgtgctttatgctgaaac

SEQ ID NO: 3462988 - DNA, 19 bp, Homo sapiens
tgtgctttatgctgaaaca

SEQ ID NO: 3462989 - DNA, 20 bp, Homo sapiens
tgtggaaaagaaacacgcac

SEQ ID NO: 3462990 - DNA, 13 bp, Homo sapiens
tgtggacacagct

SEQ ID NO: 3462991 - DNA, 16 bp, Homo sapiens
tgtggacacagctctt

SEQ ID NO: 3462992 - DNA, 19 bp, Homo sapiens
tgtggacacagctcttctc

SEQ ID NO: 3462993 - DNA, 15 bp, Homo sapiens
tgtggactaaaagat

SEQ ID NO: 3462994 - DNA, 17 bp, Homo sapiens
tgtggatcagagatgca

SEQ ID NO: 3462995 - DNA, 20 bp, Homo sapiens
tgtggccaaggagctgctat

SEQ ID NO: 3462996 - DNA, 23 bp, Homo sapiens
tgtggccccaccctgggccctgg

SEQ ID NO: 3462997 - DNA, 17 bp, Homo sapiens
tgtggcctgcacagtga

SEQ ID NO: 3462998 - DNA, 15 bp, Homo sapiens
tttcacattaatatt

SEQ ID NO: 3462999 - DNA, 16 bp, Homo sapiens
tttcacattcttggct

SEQ ID NO: 3463000 - DNA, 15 bp, Homo sapiens
tttcacattgtttgc

SEQ ID NO: 3463001 - DNA, 21 bp, Homo sapiens
tttcaccatgatggccaggct

SEQ ID NO: 3463002 - DNA, 22 bp, Homo sapiens
tttcaccccacccttcccctcc

SEQ ID NO: 3463003 - DNA, 14 bp, Homo sapiens
tttcacccctccct

SEQ ID NO: 3463004 - DNA, 14 bp, Homo sapiens
tttcacggaagttt

SEQ ID NO: 3463005 - DNA, 18 bp, Homo sapiens
tttcacggaagttttcaa

SEQ ID NO: 3463006 - DNA, 19 bp, Homo sapiens
tttcacggaagttttcaat

SEQ ID NO: 3463007 - DNA, 17 bp, Homo sapiens
tttcagaggctgcagga

SEQ ID NO: 3463008 - DNA, 11 bp, Homo sapiens
tttcagatgtg

SEQ ID NO: 3463009 - DNA, 14 bp, Homo sapiens
tttcagcagactga

SEQ ID NO: 3463010 - DNA, 15 bp, Homo sapiens
tttcagcattcagtc

SEQ ID NO: 3463011 - DNA, 23 bp, Homo sapiens
tttcagcgactccgttggccact

SEQ ID NO: 3463012 - DNA, 11 bp, Homo sapiens
tttcaggctcg

SEQ ID NO: 3463013 - DNA, 14 bp, Homo sapiens
tttcataagtattt

SEQ ID NO: 3463014 - DNA, 17 bp, Homo sapiens
tttcataatgaaaaact

SEQ ID NO: 3463015 - DNA, 16 bp, Homo sapiens
tttcatattctttcaa

SEQ ID NO: 3463016 - DNA, 22 bp, Homo sapiens
tttcatccccttacccttagaa

SEQ ID NO: 3463017 - DNA, 15 bp, Homo sapiens
tttcatctgctctcc

SEQ ID NO: 3463018 - DNA, 17 bp, Homo sapiens
tttcatctgctctcctt

SEQ ID NO: 3463019 - DNA, 23 bp, Homo sapiens
tttcatgttgcacacccactcag

SEQ ID NO: 3463020 - DNA, 12 bp, Homo sapiens
tttcattccctg

SEQ ID NO: 3463021 - DNA, 19 bp, Homo sapiens
tttcattgaggataaattg

SEQ ID NO: 3463022 - DNA, 18 bp, Homo sapiens
tttccaaaagtggcctct

SEQ ID NO: 3463023 - DNA, 24 bp, Homo sapiens
tttccaaaagtggcctctttgtct

SEQ ID NO: 3463024 - DNA, 16 bp, Homo sapiens
tttccaaaccttatct

SEQ ID NO: 3463025 - DNA, 17 bp, Homo sapiens
tttccaacgtttggaag

SEQ ID NO: 3463026 - DNA, 23 bp, Homo sapiens
tttccacggagccactcctctga

SEQ ID NO: 3463027 - DNA, 13 bp, Homo sapiens
tttccactactgc

SEQ ID NO: 3463028 - DNA, 16 bp, Homo sapiens
tttccactccattgtc

SEQ ID NO: 3463029 - DNA, 18 bp, Homo sapiens
tttccagacttccttgag

SEQ ID NO: 3463030 - DNA, 15 bp, Homo sapiens
tttccaggctggttc

SEQ ID NO: 3463031 - DNA, 22 bp, Homo sapiens
tttccaggctggttcggatttg

SEQ ID NO: 3463032 - DNA, 15 bp, Homo sapiens
tttccagtctccacc

SEQ ID NO: 3463033 - DNA, 18 bp, Homo sapiens
tttccatatattggcact

SEQ ID NO: 3463034 - DNA, 12 bp, Homo sapiens
tttccatcttta

SEQ ID NO: 3463035 - DNA, 12 bp, Homo sapiens
tttcccaactct

SEQ ID NO: 3463036 - DNA, 20 bp, Homo sapiens
tttcccagctacacctttct

SEQ ID NO: 3463037 - DNA, 14 bp, Homo sapiens
tttcccaggaccct

SEQ ID NO: 3463038 - DNA, 21 bp, Homo sapiens
tttcctaataaagttctgtac

SEQ ID NO: 3463039 - DNA, 20 bp, Homo sapiens
tttcctacttataaagtaga

SEQ ID NO: 3463040 - DNA, 14 bp, Homo sapiens
tttcctagaggttc

SEQ ID NO: 3463041 - DNA, 19 bp, Homo sapiens
tttcctcagcttatctctt

SEQ ID NO: 3463042 - DNA, 21 bp, Homo sapiens
tttcctcctgaggctttggat

SEQ ID NO: 3463043 - DNA, 12 bp, Homo sapiens
tttcctcctttc

SEQ ID NO: 3463044 - DNA, 17 bp, Homo sapiens
tttcctctctatatttc

SEQ ID NO: 3463045 - DNA, 15 bp, Homo sapiens
tttcctgaaatcaag

SEQ ID NO: 3463046 - DNA, 15 bp, Homo sapiens
tttcctgataataaa

SEQ ID NO: 3463047 - DNA, 16 bp, Homo sapiens
tttcctggatgtctga

SEQ ID NO: 3463048 - DNA, 12 bp, Homo sapiens
tttcctgtgtct

SEQ ID NO: 3463049 - DNA, 13 bp, Homo sapiens
tttccttaatcca

SEQ ID NO: 3463050 - DNA, 15 bp, Homo sapiens
tttccttccagccca

SEQ ID NO: 3463051 - DNA, 12 bp, Homo sapiens
tttccttctttg

SEQ ID NO: 3463052 - DNA, 22 bp, Homo sapiens
tttcgattcgttaagagagcaa

SEQ ID NO: 3463053 - DNA, 19 bp, Homo sapiens
tttcgtccacagcttcctg

SEQ ID NO: 3463054 - DNA, 20 bp, Homo sapiens
tttcgtccacagcttcctgt

SEQ ID NO: 3463055 - DNA, 23 bp, Homo sapiens
tttcgtccacagcttcctgtccc

SEQ ID NO: 3463056 - DNA, 15 bp, Homo sapiens
tttcgtctactgcaa

SEQ ID NO: 3463057 - DNA, 18 bp, Homo sapiens
tttctaacaattttcaga

SEQ ID NO: 3463058 - DNA, 23 bp, Homo sapiens
tttctaatgaggagagaaaatat

SEQ ID NO: 3463059 - DNA, 20 bp, Homo sapiens
tttctaatggaatggtttgg

SEQ ID NO: 3463060 - DNA, 22 bp, Homo sapiens
tttctacccagcgagccctggt

SEQ ID NO: 3463061 - DNA, 16 bp, Homo sapiens
tttctacctatatgca

SEQ ID NO: 3463062 - DNA, 17 bp, Homo sapiens
tttctagatacaataaa

SEQ ID NO: 3463063 - DNA, 15 bp, Homo sapiens
tttctagggaaatga

SEQ ID NO: 3463064 - DNA, 22 bp, Homo sapiens
tttctattaaattaaattttgt

SEQ ID NO: 3463065 - DNA, 19 bp, Homo sapiens
tttctcagaatccaaagat

SEQ ID NO: 3463066 - DNA, 16 bp, Homo sapiens
tttctcccctgccccc

SEQ ID NO: 3463067 - DNA, 17 bp, Homo sapiens
tttctcccctgccccca

SEQ ID NO: 3463068 - DNA, 15 bp, Homo sapiens
tttctcctttcacca

SEQ ID NO: 3463069 - DNA, 15 bp, Homo sapiens
tttctctgtactttt

SEQ ID NO: 3463070 - DNA, 17 bp, Homo sapiens
tttctctgtatagtact

SEQ ID NO: 3463071 - DNA, 22 bp, Homo sapiens
tttctcttttcccctttcctgt

SEQ ID NO: 3463072 - DNA, 15 bp, Homo sapiens
tttctcttttctaaa

SEQ ID NO: 3463073 - DNA, 18 bp, Homo sapiens
tttctgaaagtaaaacaa

SEQ ID NO: 3463074 - DNA, 17 bp, Homo sapiens
tttctgatcaaggcctt

SEQ ID NO: 3463075 - DNA, 12 bp, Homo sapiens
tttctgcacagc

SEQ ID NO: 3463076 - DNA, 13 bp, Homo sapiens
tttctgcacagct

SEQ ID NO: 3463077 - DNA, 22 bp, Homo sapiens
tttctgcacagcttttccaaaa

SEQ ID NO: 3463078 - DNA, 17 bp, Homo sapiens
tttctgcatatgttgaa

SEQ ID NO: 3463079 - DNA, 22 bp, Homo sapiens
tttctgcctggagtgtatgact

SEQ ID NO: 3463080 - DNA, 19 bp, Homo sapiens
tttctgctggaaacagact

SEQ ID NO: 3463081 - DNA, 14 bp, Homo sapiens
tttctggaaatgtt

SEQ ID NO: 3463082 - DNA, 23 bp, Homo sapiens
tttctggcaggtcctcccctctc

SEQ ID NO: 3463083 - DNA, 19 bp, Homo sapiens
tttctgggtttgaagctgc

SEQ ID NO: 3463084 - DNA, 20 bp, Homo sapiens
tttctggtggtctgttggca

SEQ ID NO: 3463085 - DNA, 22 bp, Homo sapiens
tttctgtaagaaacctactgcc

SEQ ID NO: 3463086 - DNA, 20 bp, Homo sapiens
tttctgtattttttgtttgt

SEQ ID NO: 3463087 - DNA, 12 bp, Homo sapiens
tttcttaaaaat

SEQ ID NO: 3463088 - DNA, 16 bp, Homo sapiens
tttcttaaggtgaggc

SEQ ID NO: 3463089 - DNA, 17 bp, Homo sapiens
tttcttacacaagagct

SEQ ID NO: 3463090 - DNA, 21 bp, Homo sapiens
tttcttacacaagagctggag

SEQ ID NO: 3463091 - DNA, 22 bp, Homo sapiens
tttcttagaaatttatttccta

SEQ ID NO: 3463092 - DNA, 14 bp, Homo sapiens
tttcttattgcgct

SEQ ID NO: 3463093 - DNA, 16 bp, Homo sapiens
tttcttctctttcata

SEQ ID NO: 3463094 - DNA, 23 bp, Homo sapiens
tttcttgaatttttttctgcaca

SEQ ID NO: 3463095 - DNA, 21 bp, Homo sapiens
tttcttgcctctgtccccttc

SEQ ID NO: 3463096 - DNA, 12 bp, Homo sapiens
tttcttgtagta

SEQ ID NO: 3463097 - DNA, 15 bp, Homo sapiens
tttctttcttagaaa

SEQ ID NO: 3463098 - DNA, 19 bp, Homo sapiens
tttctttgggaatatttga

SEQ ID NO: 3463099 - DNA, 16 bp, Homo sapiens
tttcttttgtaaatgt

SEQ ID NO: 3463100 - DNA, 21 bp, Homo sapiens
tttctttttttaactggtgaa

SEQ ID NO: 3463101 - DNA, 14 bp, Homo sapiens
tttctttttttcct

SEQ ID NO: 3463102 - DNA, 13 bp, Homo sapiens
tttgaaaaagtta

SEQ ID NO: 3463103 - DNA, 23 bp, Homo sapiens
tttgaaatgtggttttcctgaaa

SEQ ID NO: 3463104 - DNA, 14 bp, Homo sapiens
tttgaaattctgaa

SEQ ID NO: 3463105 - DNA, 22 bp, Homo sapiens
tttgaaattctgaatttgcaaa

SEQ ID NO: 3463106 - DNA, 16 bp, Homo sapiens
tttgaagctactgtgt

SEQ ID NO: 3463107 - DNA, 13 bp, Homo sapiens
tttgaagctgctg

SEQ ID NO: 3463108 - DNA, 12 bp, Homo sapiens
tttgaaggcaaa

SEQ ID NO: 3463109 - DNA, 13 bp, Homo sapiens
tttgaaggcaaaa

SEQ ID NO: 3463110 - DNA, 22 bp, Homo sapiens
tttgaagtcataccaatgaaaa

SEQ ID NO: 3463111 - DNA, 20 bp, Homo sapiens
tttgaagtgtaggcagacac

SEQ ID NO: 3463112 - DNA, 14 bp, Homo sapiens
tttgaataaagaat

SEQ ID NO: 3463113 - DNA, 16 bp, Homo sapiens
tttgaatcttgtctca

SEQ ID NO: 3463114 - DNA, 22 bp, Homo sapiens
tttgaatgctaagaatgcatta

SEQ ID NO: 3463115 - DNA, 13 bp, Homo sapiens
tttgaatgtaacc

SEQ ID NO: 3463116 - DNA, 15 bp, Homo sapiens
tttgaatgtaaccaa

SEQ ID NO: 3463117 - DNA, 13 bp, Homo sapiens
tttgaatgttaat

SEQ ID NO: 3463118 - DNA, 16 bp, Homo sapiens
tttgacacttccattg

SEQ ID NO: 3463119 - DNA, 19 bp, Homo sapiens
tttgacacttccattgttt

SEQ ID NO: 3463120 - DNA, 21 bp, Homo sapiens
tttgacacttccattgtttaa

SEQ ID NO: 3463121 - DNA, 13 bp, Homo sapiens
tttgaccttttat

SEQ ID NO: 3463122 - DNA, 16 bp, Homo sapiens
tttgactaattttaca

SEQ ID NO: 3463123 - DNA, 19 bp, Homo sapiens
tttgactagatgatggatg

SEQ ID NO: 3463124 - DNA, 14 bp, Homo sapiens
tttgagaagaaaac

SEQ ID NO: 3463125 - DNA, 16 bp, Homo sapiens
tttgagaatacaagat

SEQ ID NO: 3463126 - DNA, 13 bp, Homo sapiens
tttgagacaggag

SEQ ID NO: 3463127 - DNA, 14 bp, Homo sapiens
tttgagaccagcct

SEQ ID NO: 3463128 - DNA, 16 bp, Homo sapiens
tttgagatcagcctgg

SEQ ID NO: 3463129 - DNA, 16 bp, Homo sapiens
tttgagcatgggttca

SEQ ID NO: 3463130 - DNA, 15 bp, Homo sapiens
tttgaggataacttt

SEQ ID NO: 3463131 - DNA, 17 bp, Homo sapiens
cctgacaggctgtgact

SEQ ID NO: 3463132 - DNA, 21 bp, Homo sapiens
cctgacaggctgtgactcttc

SEQ ID NO: 3463133 - DNA, 23 bp, Homo sapiens
cctgacaggctgtgactcttctc

SEQ ID NO: 3463134 - DNA, 20 bp, Homo sapiens
cctgacccattgctgttgtc

SEQ ID NO: 3463135 - DNA, 18 bp, Homo sapiens
cctgacctgtgagcccag

SEQ ID NO: 3463136 - DNA, 19 bp, Homo sapiens
cctgacctgtgagcccagc

SEQ ID NO: 3463137 - DNA, 22 bp, Homo sapiens
cctgacctgtgagcccagctgg

SEQ ID NO: 3463138 - DNA, 13 bp, Homo sapiens
cctgactcattct

SEQ ID NO: 3463139 - DNA, 14 bp, Homo sapiens
cctgactgctcaga

SEQ ID NO: 3463140 - DNA, 13 bp, Homo sapiens
cctgacttttctg

SEQ ID NO: 3463141 - DNA, 18 bp, Homo sapiens
cctgagaaacccaccagc

SEQ ID NO: 3463142 - DNA, 15 bp, Homo sapiens
cctgagaaagccctg

SEQ ID NO: 3463143 - DNA, 15 bp, Homo sapiens
cctgagagtcagctc

SEQ ID NO: 3463144 - DNA, 22 bp, Homo sapiens
cctgagattattccttcttcta

SEQ ID NO: 3463145 - DNA, 17 bp, Homo sapiens
cctgagatttcatctgc

SEQ ID NO: 3463146 - DNA, 21 bp, Homo sapiens
cctgagcgctcctgccgcaga

SEQ ID NO: 3463147 - DNA, 14 bp, Homo sapiens
cctgagctgcttca

SEQ ID NO: 3463148 - DNA, 16 bp, Homo sapiens
cctgagctttctgcta

SEQ ID NO: 3463149 - DNA, 18 bp, Homo sapiens
cctgaggaacccttacag

SEQ ID NO: 3463150 - DNA, 12 bp, Homo sapiens
cctgaggaagcg

SEQ ID NO: 3463151 - DNA, 14 bp, Homo sapiens
cctgaggctgtggt

SEQ ID NO: 3463152 - DNA, 17 bp, Homo sapiens
cctgaggctgtggtcac

SEQ ID NO: 3463153 - DNA, 15 bp, Homo sapiens
cctgagggagctcca

SEQ ID NO: 3463154 - DNA, 14 bp, Homo sapiens
cctgagtgcctggc

SEQ ID NO: 3463155 - DNA, 15 bp, Homo sapiens
cctgagtgcctggcc

SEQ ID NO: 3463156 - DNA, 21 bp, Homo sapiens
cctgatatttccctcccctgg

SEQ ID NO: 3463157 - DNA, 14 bp, Homo sapiens
cctgatcagaccac

SEQ ID NO: 3463158 - DNA, 18 bp, Homo sapiens
cctgatcagaccacggct

SEQ ID NO: 3463159 - DNA, 15 bp, Homo sapiens
cctgatcctgtgaag

SEQ ID NO: 3463160 - DNA, 16 bp, Homo sapiens
cctgatgagattttta

SEQ ID NO: 3463161 - DNA, 23 bp, Homo sapiens
cctgatggcaggatggcctggcc

SEQ ID NO: 3463162 - DNA, 18 bp, Homo sapiens
cctgatttaggagaagcc

SEQ ID NO: 3463163 - DNA, 19 bp, Homo sapiens
cctgatttaggagaagcca

SEQ ID NO: 3463164 - DNA, 14 bp, Homo sapiens
cctgcaaaaaatac

SEQ ID NO: 3463165 - DNA, 15 bp, Homo sapiens
cctgcaaaaaatact

SEQ ID NO: 3463166 - DNA, 16 bp, Homo sapiens
cctgcaaacgctgcct

SEQ ID NO: 3463167 - DNA, 18 bp, Homo sapiens
cctgcaaacgctgcctgc

SEQ ID NO: 3463168 - DNA, 22 bp, Homo sapiens
cctgcaaacgctgcctgcccac

SEQ ID NO: 3463169 - DNA, 21 bp, Homo sapiens
cctgcaaacgctgcctgcccg

SEQ ID NO: 3463170 - DNA, 17 bp, Homo sapiens
cctgcactccctcctgg

SEQ ID NO: 3463171 - DNA, 16 bp, Homo sapiens
cctgcacttgcagact

SEQ ID NO: 3463172 - DNA, 16 bp, Homo sapiens
cctgcaggacctgcct

SEQ ID NO: 3463173 - DNA, 17 bp, Homo sapiens
cctgcatctaagcccat

SEQ ID NO: 3463174 - DNA, 19 bp, Homo sapiens
cctgcatctgaccagcagc

SEQ ID NO: 3463175 - DNA, 21 bp, Homo sapiens
cctgcatgtaaacacgcctgc

SEQ ID NO: 3463176 - DNA, 14 bp, Homo sapiens
cctgccaccaggcc

SEQ ID NO: 3463177 - DNA, 14 bp, Homo sapiens
cctgccaccctggg

SEQ ID NO: 3463178 - DNA, 16 bp, Homo sapiens
cctgccaccctgggga

SEQ ID NO: 3463179 - DNA, 17 bp, Homo sapiens
cctgccacctcctgcct

SEQ ID NO: 3463180 - DNA, 19 bp, Homo sapiens
cctgccacctcctgcctca

SEQ ID NO: 3463181 - DNA, 16 bp, Homo sapiens
cctgccactcactagg

SEQ ID NO: 3463182 - DNA, 18 bp, Homo sapiens
cctgccactcactaggcc

SEQ ID NO: 3463183 - DNA, 22 bp, Homo sapiens
cctgccactcactaggccccca

SEQ ID NO: 3463184 - DNA, 17 bp, Homo sapiens
cctgccagctgcactga

SEQ ID NO: 3463185 - DNA, 23 bp, Homo sapiens
cctgccagctgcactgatgctgc

SEQ ID NO: 3463186 - DNA, 12 bp, Homo sapiens
cctgccaggcat

SEQ ID NO: 3463187 - DNA, 16 bp, Homo sapiens
cctgccaggcatggtg

SEQ ID NO: 3463188 - DNA, 16 bp, Homo sapiens
cctgccatagccagga

SEQ ID NO: 3463189 - DNA, 17 bp, Homo sapiens
cctgccatagccaggag

SEQ ID NO: 3463190 - DNA, 19 bp, Homo sapiens
cctgccatagccaggagcg

SEQ ID NO: 3463191 - DNA, 15 bp, Homo sapiens
cctgcccaggcccct

SEQ ID NO: 3463192 - DNA, 14 bp, Homo sapiens
cctgcccatttcat

SEQ ID NO: 3463193 - DNA, 15 bp, Homo sapiens
cctgcccccaatcca

SEQ ID NO: 3463194 - DNA, 17 bp, Homo sapiens
cctgtttttaagctgtt

SEQ ID NO: 3463195 - DNA, 17 bp, Homo sapiens
cctgttttttttctttt

SEQ ID NO: 3463196 - DNA, 13 bp, Homo sapiens
ccttaaaaatcac

SEQ ID NO: 3463197 - DNA, 20 bp, Homo sapiens
ccttaaacaaaaattaaaat

SEQ ID NO: 3463198 - DNA, 12 bp, Homo sapiens
ccttaacactga

SEQ ID NO: 3463199 - DNA, 18 bp, Homo sapiens
ccttaagccctggccccc

SEQ ID NO: 3463200 - DNA, 13 bp, Homo sapiens
ccttaatcttgct

SEQ ID NO: 3463201 - DNA, 14 bp, Homo sapiens
ccttaatcttgctt

SEQ ID NO: 3463202 - DNA, 22 bp, Homo sapiens
ccttaatgaagagccagcccaa

SEQ ID NO: 3463203 - DNA, 19 bp, Homo sapiens
ccttaccccagttttttga

SEQ ID NO: 3463204 - DNA, 18 bp, Homo sapiens
ccttactatgatctcagg

SEQ ID NO: 3463205 - DNA, 13 bp, Homo sapiens
ccttacttcttgc

SEQ ID NO: 3463206 - DNA, 16 bp, Homo sapiens
ccttacttcttgccct

SEQ ID NO: 3463207 - DNA, 17 bp, Homo sapiens
ccttacttcttgccctg

SEQ ID NO: 3463208 - DNA, 16 bp, Homo sapiens
ccttagcaaattctgt

SEQ ID NO: 3463209 - DNA, 16 bp, Homo sapiens
ccttatccttcatctt

SEQ ID NO: 3463210 - DNA, 16 bp, Homo sapiens
ccttattagagtgtct

SEQ ID NO: 3463211 - DNA, 21 bp, Homo sapiens
ccttattagagtgtctttcca

SEQ ID NO: 3463212 - DNA, 16 bp, Homo sapiens
ccttattgtacctctc

SEQ ID NO: 3463213 - DNA, 11 bp, Homo sapiens
ccttcagacac

SEQ ID NO: 3463214 - DNA, 13 bp, Homo sapiens
ccttcagacacat

SEQ ID NO: 3463215 - DNA, 20 bp, Homo sapiens
ccttcagacaccctcaacct

SEQ ID NO: 3463216 - DNA, 13 bp, Homo sapiens
ccttcagccctca

SEQ ID NO: 3463217 - DNA, 13 bp, Homo sapiens
ccttcagtttatt

SEQ ID NO: 3463218 - DNA, 17 bp, Homo sapiens
ccttcatcttcctgtgt

SEQ ID NO: 3463219 - DNA, 22 bp, Homo sapiens
ccttcatcttcctgtgtcctga

SEQ ID NO: 3463220 - DNA, 13 bp, Homo sapiens
ccttcatctttta

SEQ ID NO: 3463221 - DNA, 20 bp, Homo sapiens
ccttcattgatttcctgtgt

SEQ ID NO: 3463222 - DNA, 20 bp, Homo sapiens
ccttccagggatttgcctca

SEQ ID NO: 3463223 - DNA, 21 bp, Homo sapiens
ccttccagggatttgcctcac

SEQ ID NO: 3463224 - DNA, 23 bp, Homo sapiens
ccttccatggtgtgatcgtctga

SEQ ID NO: 3463225 - DNA, 20 bp, Homo sapiens
ccttcccaagtaagaggctg

SEQ ID NO: 3463226 - DNA, 13 bp, Homo sapiens
ccttcccacatat

SEQ ID NO: 3463227 - DNA, 20 bp, Homo sapiens
ccttcccgccggaggccagc

SEQ ID NO: 3463228 - DNA, 18 bp, Homo sapiens
ccttccctgtctgccagg

SEQ ID NO: 3463229 - DNA, 16 bp, Homo sapiens
ccttcctaagcctgtg

SEQ ID NO: 3463230 - DNA, 23 bp, Homo sapiens
ccttcctaagcctgtggctgtgg

SEQ ID NO: 3463231 - DNA, 12 bp, Homo sapiens
ccttcctcctgg

SEQ ID NO: 3463232 - DNA, 15 bp, Homo sapiens
ccttcctctctccag

SEQ ID NO: 3463233 - DNA, 15 bp, Homo sapiens
ccttcctgttctgaa

SEQ ID NO: 3463234 - DNA, 22 bp, Homo sapiens
ccttccttgttacccatgaaaa

SEQ ID NO: 3463235 - DNA, 15 bp, Homo sapiens
ccttcgaaaggcctt

SEQ ID NO: 3463236 - DNA, 23 bp, Homo sapiens
ccttcgaaaggccttcagacaca

SEQ ID NO: 3463237 - DNA, 15 bp, Homo sapiens
ccttcgctcctgtgt

SEQ ID NO: 3463238 - DNA, 16 bp, Homo sapiens
ccttcgcttcttgcct

SEQ ID NO: 3463239 - DNA, 20 bp, Homo sapiens
ccttcggacaactcagtccc

SEQ ID NO: 3463240 - DNA, 16 bp, Homo sapiens
ccttcgtctttcccat

SEQ ID NO: 3463241 - DNA, 20 bp, Homo sapiens
ccttcgtttactatgcctgt

SEQ ID NO: 3463242 - DNA, 13 bp, Homo sapiens
ccttctaaaggtg

SEQ ID NO: 3463243 - DNA, 20 bp, Homo sapiens
ccttctagggttattgcatt

SEQ ID NO: 3463244 - DNA, 16 bp, Homo sapiens
ccttctcaccagctgc

SEQ ID NO: 3463245 - DNA, 17 bp, Homo sapiens
ccttctcaccagctgca

SEQ ID NO: 3463246 - DNA, 11 bp, Homo sapiens
ccttctccatc

SEQ ID NO: 3463247 - DNA, 22 bp, Homo sapiens
ccttctccatggccctgccatg

SEQ ID NO: 3463248 - DNA, 16 bp, Homo sapiens
ccttctcccctcttct

SEQ ID NO: 3463249 - DNA, 19 bp, Homo sapiens
ccttctcccctcttctgag

SEQ ID NO: 3463250 - DNA, 16 bp, Homo sapiens
ccttctcctcttgtaa

SEQ ID NO: 3463251 - DNA, 19 bp, Homo sapiens
ccttctctacccatctccc

SEQ ID NO: 3463252 - DNA, 13 bp, Homo sapiens
ccttctgctactg

SEQ ID NO: 3463253 - DNA, 16 bp, Homo sapiens
ccttctggaaactgtg

SEQ ID NO: 3463254 - DNA, 19 bp, Homo sapiens
ccttctggaaactgtgaag

SEQ ID NO: 3463255 - DNA, 17 bp, Homo sapiens
ccttctggcctcccaca

SEQ ID NO: 3463256 - DNA, 22 bp, Homo sapiens
ccttctgtcctactctgtgtca

SEQ ID NO: 3463257 - DNA, 16 bp, Homo sapiens
ccttgaactctgggct

SEQ ID NO: 3463258 - DNA, 14 bp, Homo sapiens
ccttgaactgggta

SEQ ID NO: 3463259 - DNA, 17 bp, Homo sapiens
ccttgaagaacctctca

SEQ ID NO: 3463260 - DNA, 21 bp, Homo sapiens
ccttgaagaactgcaggccct

SEQ ID NO: 3463261 - DNA, 23 bp, Homo sapiens
ccttgaagaactgcaggccctgg

SEQ ID NO: 3463262 - DNA, 15 bp, Homo sapiens
ccttgacaactggca

SEQ ID NO: 3463263 - DNA, 21 bp, Homo sapiens
ccttgacctttgtacagccca

SEQ ID NO: 3463264 - DNA, 19 bp, Homo sapiens
ccttgagaaaccttattgt

SEQ ID NO: 3463265 - DNA, 18 bp, Homo sapiens
ccttgagagaccaggcaa

SEQ ID NO: 3463266 - DNA, 20 bp, Homo sapiens
ccttgagagaccaggcaaag

SEQ ID NO: 3463267 - DNA, 21 bp, Homo sapiens
ccttgagggtgcttgttccct

SEQ ID NO: 3463268 - DNA, 22 bp, Homo sapiens
ccttgagttgattcagctctgc

SEQ ID NO: 3463269 - DNA, 14 bp, Homo sapiens
ttagctcccctcca

SEQ ID NO: 3463270 - DNA, 14 bp, Homo sapiens
ttagctcctgtggc

SEQ ID NO: 3463271 - DNA, 12 bp, Homo sapiens
ttagctgcttct

SEQ ID NO: 3463272 - DNA, 16 bp, Homo sapiens
ttagcttcaggaacct

SEQ ID NO: 3463273 - DNA, 16 bp, Homo sapiens
ttagctttactgtttg

SEQ ID NO: 3463274 - DNA, 18 bp, Homo sapiens
ttagctttttcatcccct

SEQ ID NO: 3463275 - DNA, 15 bp, Homo sapiens
ttaggaatgagaagt

SEQ ID NO: 3463276 - DNA, 16 bp, Homo sapiens
ttaggagaagccagga

SEQ ID NO: 3463277 - DNA, 19 bp, Homo sapiens
ttaggagggagttatctaa

SEQ ID NO: 3463278 - DNA, 15 bp, Homo sapiens
ttaggatggcaggac

SEQ ID NO: 3463279 - DNA, 15 bp, Homo sapiens
ttaggcagactcttt

SEQ ID NO: 3463280 - DNA, 14 bp, Homo sapiens
ttaggcctggctca

SEQ ID NO: 3463281 - DNA, 14 bp, Homo sapiens
ttaggcgggagctc

SEQ ID NO: 3463282 - DNA, 17 bp, Homo sapiens
ttaggctggtggcccag

SEQ ID NO: 3463283 - DNA, 18 bp, Homo sapiens
ttaggctggtggcccagg

SEQ ID NO: 3463284 - DNA, 14 bp, Homo sapiens
ttaggctttcagct

SEQ ID NO: 3463285 - DNA, 14 bp, Homo sapiens
ttagggaagggcct

SEQ ID NO: 3463286 - DNA, 13 bp, Homo sapiens
ttagggagaaaat

SEQ ID NO: 3463287 - DNA, 15 bp, Homo sapiens
ttagggagctcttga

SEQ ID NO: 3463288 - DNA, 22 bp, Homo sapiens
ttaggttccatcctttacgtgt

SEQ ID NO: 3463289 - DNA, 19 bp, Homo sapiens
ttaggtttttttgtatagt

SEQ ID NO: 3463290 - DNA, 22 bp, Homo sapiens
ttagtaaaaaatcaattaacca

SEQ ID NO: 3463291 - DNA, 24 bp, Homo sapiens
ttagtaacatgaggggacattttg

SEQ ID NO: 3463292 - DNA, 17 bp, Homo sapiens
ttagtaatttctttttt

SEQ ID NO: 3463293 - DNA, 13 bp, Homo sapiens
ttagtagagacag

SEQ ID NO: 3463294 - DNA, 16 bp, Homo sapiens
ttagtcgtgagctctt

SEQ ID NO: 3463295 - DNA, 19 bp, Homo sapiens
ttagtcgtgagctcttgtg

SEQ ID NO: 3463296 - DNA, 21 bp, Homo sapiens
ttagtcgtgagctcttgtgag

SEQ ID NO: 3463297 - DNA, 18 bp, Homo sapiens
ttagtctctaaagagttt

SEQ ID NO: 3463298 - DNA, 15 bp, Homo sapiens
ttagtgacaaaatag

SEQ ID NO: 3463299 - DNA, 20 bp, Homo sapiens
ttagtgctaagtgtgaactg

SEQ ID NO: 3463300 - DNA, 12 bp, Homo sapiens
ttagtggcttca

SEQ ID NO: 3463301 - DNA, 16 bp, Homo sapiens
ttagttcctcattagc

SEQ ID NO: 3463302 - DNA, 18 bp, Homo sapiens
ttagttgcactaactgct

SEQ ID NO: 3463303 - DNA, 15 bp, Homo sapiens
ttagtttgtgtgttg

SEQ ID NO: 3463304 - DNA, 16 bp, Homo sapiens
ttagtttgtgtgttgt

SEQ ID NO: 3463305 - DNA, 17 bp, Homo sapiens
ttataaaaacaaaaaca

SEQ ID NO: 3463306 - DNA, 13 bp, Homo sapiens
ttataaaacttct

SEQ ID NO: 3463307 - DNA, 13 bp, Homo sapiens
ttataaaatggct

SEQ ID NO: 3463308 - DNA, 19 bp, Homo sapiens
ttataaacagacaatatgt

SEQ ID NO: 3463309 - DNA, 18 bp, Homo sapiens
ttataaataaaatcatgt

SEQ ID NO: 3463310 - DNA, 12 bp, Homo sapiens
ttataatttaaa

SEQ ID NO: 3463311 - DNA, 14 bp, Homo sapiens
ttataattttccta

SEQ ID NO: 3463312 - DNA, 14 bp, Homo sapiens
ttatacgcttttct

SEQ ID NO: 3463313 - DNA, 19 bp, Homo sapiens
ttatactcttcctattttt

SEQ ID NO: 3463314 - DNA, 16 bp, Homo sapiens
ttatactctttctgta

SEQ ID NO: 3463315 - DNA, 17 bp, Homo sapiens
ttatactgtacaataaa

SEQ ID NO: 3463316 - DNA, 18 bp, Homo sapiens
ttatactgtacaataaaa

SEQ ID NO: 3463317 - DNA, 13 bp, Homo sapiens
ttatagtaatgag

SEQ ID NO: 3463318 - DNA, 21 bp, Homo sapiens
ttatagtgatgtaatcttgaa

SEQ ID NO: 3463319 - DNA, 21 bp, Homo sapiens
ttatatagggatcaaccagct

SEQ ID NO: 3463320 - DNA, 17 bp, Homo sapiens
ttatatatctaagttca

SEQ ID NO: 3463321 - DNA, 16 bp, Homo sapiens
ttatatgtacatgaga

SEQ ID NO: 3463322 - DNA, 20 bp, Homo sapiens
ttatattaatagtaatttgt

SEQ ID NO: 3463323 - DNA, 11 bp, Homo sapiens
ttatatttcag

SEQ ID NO: 3463324 - DNA, 22 bp, Homo sapiens
ttatatttcagatgtaatgttt

SEQ ID NO: 3463325 - DNA, 15 bp, Homo sapiens
ttatatttgtaggag

SEQ ID NO: 3463326 - DNA, 18 bp, Homo sapiens
ttatatttgtgctatagt

SEQ ID NO: 3463327 - DNA, 15 bp, Homo sapiens
ttatcagtcaatatt

SEQ ID NO: 3463328 - DNA, 23 bp, Homo sapiens
ttatcagtcaatatttttagata

SEQ ID NO: 3463329 - DNA, 16 bp, Homo sapiens
ttatcatgcaaatgct

SEQ ID NO: 3463330 - DNA, 19 bp, Homo sapiens
ttatcatggtctcagtcat

SEQ ID NO: 3463331 - DNA, 15 bp, Homo sapiens
ttatccaaaatgtgt

SEQ ID NO: 3463332 - DNA, 19 bp, Homo sapiens
ttatccatattgagtcaaa

SEQ ID NO: 3463333 - DNA, 13 bp, Homo sapiens
ttatccattccca

SEQ ID NO: 3463334 - DNA, 23 bp, Homo sapiens
ttatccattcccaagatgcctga

SEQ ID NO: 3463335 - DNA, 14 bp, Homo sapiens
ttatcctctttaga

SEQ ID NO: 3463336 - DNA, 17 bp, Homo sapiens
ttatcctctttagagtt

SEQ ID NO: 3463337 - DNA, 20 bp, Homo sapiens
ttatcctctttagagttaga

SEQ ID NO: 3463338 - DNA, 19 bp, Homo sapiens
ttatctatacatatcttta

SEQ ID NO: 3463339 - DNA, 21 bp, Homo sapiens
ttatctccacaacctcttccc

SEQ ID NO: 3463340 - DNA, 22 bp, Homo sapiens
ttatcttatactgtacaataaa

SEQ ID NO: 3463341 - DNA, 13 bp, Homo sapiens
ttatgagaaactg

SEQ ID NO: 3463342 - DNA, 17 bp, Homo sapiens
ttatgaggagctgcaga

SEQ ID NO: 3463343 - DNA, 20 bp, Homo sapiens
ttatgcaagggactgtgtgt

SEQ ID NO: 3463344 - DNA, 17 bp, Homo sapiens
ttatgctctcactgttt

SEQ ID NO: 3463345 - DNA, 22 bp, Homo sapiens
ttatgtacatctgtttgtagcc

SEQ ID NO: 3463346 - DNA, 20 bp, Homo sapiens
ttatgtactagtgttctgtt

SEQ ID NO: 3463347 - DNA, 15 bp, Homo sapiens
ttatgtagtaattga

SEQ ID NO: 3463348 - DNA, 19 bp, Homo sapiens
ttatgtagtaattgacatg

SEQ ID NO: 3463349 - DNA, 19 bp, Homo sapiens
ttatgtatttcctggatgt

SEQ ID NO: 3463350 - DNA, 19 bp, Homo sapiens
ttatgtgtaggtgaacagt

SEQ ID NO: 3463351 - DNA, 21 bp, Homo sapiens
ttatgtgtaggtgaacagtca

SEQ ID NO: 3463352 - DNA, 22 bp, Homo sapiens
ttatgttttttaaaatatttat

SEQ ID NO: 3463353 - DNA, 15 bp, Homo sapiens
ttattaaaattctga

SEQ ID NO: 3463354 - DNA, 14 bp, Homo sapiens
ttattaattgcttt

SEQ ID NO: 3463355 - DNA, 15 bp, Homo sapiens
ttattaattgctttg

SEQ ID NO: 3463356 - DNA, 12 bp, Homo sapiens
ttattacatctt

SEQ ID NO: 3463357 - DNA, 13 bp, Homo sapiens
ttattacatgtaa

SEQ ID NO: 3463358 - DNA, 19 bp, Homo sapiens
ttattacccaagtcttctc

SEQ ID NO: 3463359 - DNA, 20 bp, Homo sapiens
ttattaccccctccttcaga

SEQ ID NO: 3463360 - DNA, 17 bp, Homo sapiens
ttattagggagaaaatt

SEQ ID NO: 3463361 - DNA, 20 bp, Homo sapiens
ttattagtaaatgcttatca

SEQ ID NO: 3463362 - DNA, 15 bp, Homo sapiens
ttattatatttacaa

SEQ ID NO: 3463363 - DNA, 16 bp, Homo sapiens
ttattattatttttta

SEQ ID NO: 3463364 - DNA, 15 bp, Homo sapiens
ttattatttatttga

SEQ ID NO: 3463365 - DNA, 17 bp, Homo sapiens
ttattcaataaagtatt

SEQ ID NO: 3463366 - DNA, 20 bp, Homo sapiens
ttattcaataaagtatttaa

SEQ ID NO: 3463367 - DNA, 18 bp, Homo sapiens
ttattcaattcctctggg

SEQ ID NO: 3463368 - DNA, 19 bp, Homo sapiens
ttattcaattcctctggga

SEQ ID NO: 3463369 - DNA, 22 bp, Homo sapiens
ttattcctatatagtttattga

SEQ ID NO: 3463370 - DNA, 13 bp, Homo sapiens
ttattctatgtag

SEQ ID NO: 3463371 - DNA, 18 bp, Homo sapiens
ttattgaacttgaaatct

SEQ ID NO: 3463372 - DNA, 13 bp, Homo sapiens
ttattgaagtgtt

SEQ ID NO: 3463373 - DNA, 23 bp, Homo sapiens
ttattgacacagaaaatgttgag

SEQ ID NO: 3463374 - DNA, 16 bp, Homo sapiens
ttattgagaaagagca

SEQ ID NO: 3463375 - DNA, 23 bp, Homo sapiens
ttattgagattgtcctcatttct

SEQ ID NO: 3463376 - DNA, 17 bp, Homo sapiens
ttattgcacattgttca

SEQ ID NO: 3463377 - DNA, 23 bp, Homo sapiens
ttattgccttctcaccagctgca

SEQ ID NO: 3463378 - DNA, 15 bp, Homo sapiens
ttattgcgctgctac

SEQ ID NO: 3463379 - DNA, 14 bp, Homo sapiens
ttattgtacctctc

SEQ ID NO: 3463380 - DNA, 17 bp, Homo sapiens
ttattgtacctctctta

SEQ ID NO: 3463381 - DNA, 20 bp, Homo sapiens
ttattgtagaataagtcatt

SEQ ID NO: 3463382 - DNA, 17 bp, Homo sapiens
ttattgtgtttgtcatt

SEQ ID NO: 3463383 - DNA, 13 bp, Homo sapiens
ttatttaacagct

SEQ ID NO: 3463384 - DNA, 16 bp, Homo sapiens
ttatttagttccttga

SEQ ID NO: 3463385 - DNA, 18 bp, Homo sapiens
ttatttcacaaataatag

SEQ ID NO: 3463386 - DNA, 10 bp, Homo sapiens
ttatttccta

SEQ ID NO: 3463387 - DNA, 17 bp, Homo sapiens
ttatttcctatcataaa

SEQ ID NO: 3463388 - DNA, 22 bp, Homo sapiens
ttatttctcagactttggaaaa

SEQ ID NO: 3463389 - DNA, 15 bp, Homo sapiens
ttatttctgcatatg

SEQ ID NO: 3463390 - DNA, 18 bp, Homo sapiens
ttatttgccagagccaaa

SEQ ID NO: 3463391 - DNA, 13 bp, Homo sapiens
ttattttggaact

SEQ ID NO: 3463392 - DNA, 15 bp, Homo sapiens
ttattttggaactat

SEQ ID NO: 3463393 - DNA, 16 bp, Homo sapiens
ttattttggaactatg

SEQ ID NO: 3463394 - DNA, 14 bp, Homo sapiens
ttatttttgtacat

SEQ ID NO: 3463395 - DNA, 17 bp, Homo sapiens
ttatttttgtacatgtt

SEQ ID NO: 3463396 - DNA, 13 bp, Homo sapiens
ttcaaaatattta

SEQ ID NO: 3463397 - DNA, 15 bp, Homo sapiens
ttcaaaatatttaaa

SEQ ID NO: 3463398 - DNA, 15 bp, Homo sapiens
ttcaaactggggcct

SEQ ID NO: 3463399 - DNA, 13 bp, Homo sapiens
ttcaaagaagtca

SEQ ID NO: 3463400 - DNA, 12 bp, Homo sapiens
ttcaaagcaatt

SEQ ID NO: 3463401 - DNA, 16 bp, Homo sapiens
ttcaaagccaagacct

SEQ ID NO: 3463402 - DNA, 19 bp, Homo sapiens
ttccagggtccctctgtgt

SEQ ID NO: 3463403 - DNA, 20 bp, Homo sapiens
ttccagggtccctctgtgta

SEQ ID NO: 3463404 - DNA, 21 bp, Homo sapiens
ttccaggtacccttctcgctt

SEQ ID NO: 3463405 - DNA, 18 bp, Homo sapiens
ttccaggtttaagctgtt

SEQ ID NO: 3463406 - DNA, 22 bp, Homo sapiens
ttccagtctccaccaggaacct

SEQ ID NO: 3463407 - DNA, 22 bp, Homo sapiens
ttccagttcatctatggcagtc

SEQ ID NO: 3463408 - DNA, 13 bp, Homo sapiens
ttccatatattgg

SEQ ID NO: 3463409 - DNA, 15 bp, Homo sapiens
ttccatatattggca

SEQ ID NO: 3463410 - DNA, 22 bp, Homo sapiens
ttccatatattggcactgctaa

SEQ ID NO: 3463411 - DNA, 13 bp, Homo sapiens
ttccatgatgctg

SEQ ID NO: 3463412 - DNA, 17 bp, Homo sapiens
ttccatgattctattta

SEQ ID NO: 3463413 - DNA, 15 bp, Homo sapiens
ttccatggccctcat

SEQ ID NO: 3463414 - DNA, 22 bp, Homo sapiens
ttccatgggaccacaactattt

SEQ ID NO: 3463415 - DNA, 20 bp, Homo sapiens
ttccattcccttcggccaaa

SEQ ID NO: 3463416 - DNA, 16 bp, Homo sapiens
ttccattggatctcat

SEQ ID NO: 3463417 - DNA, 13 bp, Homo sapiens
ttccattgtttaa

SEQ ID NO: 3463418 - DNA, 17 bp, Homo sapiens
ttccatttgcaagggaa

SEQ ID NO: 3463419 - DNA, 19 bp, Homo sapiens
ttcccaaaattagggagct

SEQ ID NO: 3463420 - DNA, 23 bp, Homo sapiens
ttcccaaaattagggagctcttg

SEQ ID NO: 3463421 - DNA, 19 bp, Homo sapiens
ttcccaacgtgcaaagcca

SEQ ID NO: 3463422 - DNA, 15 bp, Homo sapiens
ttcccaagctctgct

SEQ ID NO: 3463423 - DNA, 18 bp, Homo sapiens
ttcccacaggacatttct

SEQ ID NO: 3463424 - DNA, 19 bp, Homo sapiens
ttcccagagtcatctgatt

SEQ ID NO: 3463425 - DNA, 21 bp, Homo sapiens
ttcccagcactatgctttcct

SEQ ID NO: 3463426 - DNA, 11 bp, Homo sapiens
ttcccaggacc

SEQ ID NO: 3463427 - DNA, 14 bp, Homo sapiens
ttcccagtggctgc

SEQ ID NO: 3463428 - DNA, 16 bp, Homo sapiens
ttcccagtggctgctg

SEQ ID NO: 3463429 - DNA, 20 bp, Homo sapiens
ttcccagtggctgctgccca

SEQ ID NO: 3463430 - DNA, 23 bp, Homo sapiens
ttcccatggggagggattctggt

SEQ ID NO: 3463431 - DNA, 17 bp, Homo sapiens
ttcccatttgtaatttg

SEQ ID NO: 3463432 - DNA, 18 bp, Homo sapiens
ttccccaaccacttcatt

SEQ ID NO: 3463433 - DNA, 13 bp, Homo sapiens
ttccccacagaac

SEQ ID NO: 3463434 - DNA, 17 bp, Homo sapiens
ttccccactgacagcct

SEQ ID NO: 3463435 - DNA, 12 bp, Homo sapiens
ttccccctaaac

SEQ ID NO: 3463436 - DNA, 17 bp, Homo sapiens
ttcccccttcacaaagc

SEQ ID NO: 3463437 - DNA, 15 bp, Homo sapiens
ttcccctcctccact

SEQ ID NO: 3463438 - DNA, 18 bp, Homo sapiens
ttcccctccttctccctt

SEQ ID NO: 3463439 - DNA, 21 bp, Homo sapiens
ttccccttccactgagggcag

SEQ ID NO: 3463440 - DNA, 14 bp, Homo sapiens
ttcccctttcctgt

SEQ ID NO: 3463441 - DNA, 15 bp, Homo sapiens
ttcccctttcctgtc

SEQ ID NO: 3463442 - DNA, 18 bp, Homo sapiens
ttcccgggccagggctgc

SEQ ID NO: 3463443 - DNA, 15 bp, Homo sapiens
ttccctcctgctact

SEQ ID NO: 3463444 - DNA, 14 bp, Homo sapiens
ttccctctcatctc

SEQ ID NO: 3463445 - DNA, 15 bp, Homo sapiens
ttccctgaatgtatt

SEQ ID NO: 3463446 - DNA, 16 bp, Homo sapiens
ttccctgactcattct

SEQ ID NO: 3463447 - DNA, 23 bp, Homo sapiens
ttccctgagaaacccaccagcct

SEQ ID NO: 3463448 - DNA, 20 bp, Homo sapiens
ttccctggggaaaacttgca

SEQ ID NO: 3463449 - DNA, 16 bp, Homo sapiens
ttcccttcggccaaac

SEQ ID NO: 3463450 - DNA, 21 bp, Homo sapiens
ttcccttcggccaaacagaca

SEQ ID NO: 3463451 - DNA, 19 bp, Homo sapiens
ttccgtaggttattttcag

SEQ ID NO: 3463452 - DNA, 15 bp, Homo sapiens
ttccgtttgcttttg

SEQ ID NO: 3463453 - DNA, 13 bp, Homo sapiens
ttcctaaagaaaa

SEQ ID NO: 3463454 - DNA, 16 bp, Homo sapiens
ttcctaaatattatga

SEQ ID NO: 3463455 - DNA, 14 bp, Homo sapiens
ttcctaacttttca

SEQ ID NO: 3463456 - DNA, 22 bp, Homo sapiens
ttcctaacttttcaatgacatt

SEQ ID NO: 3463457 - DNA, 14 bp, Homo sapiens
ttcctaaggctgca

SEQ ID NO: 3463458 - DNA, 22 bp, Homo sapiens
ttcctagatggcagtcactgaa

SEQ ID NO: 3463459 - DNA, 13 bp, Homo sapiens
ttcctatacgcag

SEQ ID NO: 3463460 - DNA, 21 bp, Homo sapiens
ttcctatatagtttattgaca

SEQ ID NO: 3463461 - DNA, 16 bp, Homo sapiens
ttcctatcataaaaat

SEQ ID NO: 3463462 - DNA, 14 bp, Homo sapiens
ttcctatgctttga

SEQ ID NO: 3463463 - DNA, 14 bp, Homo sapiens
ttcctatgtaactg

SEQ ID NO: 3463464 - DNA, 21 bp, Homo sapiens
ttcctattccaagcttccata

SEQ ID NO: 3463465 - DNA, 21 bp, Homo sapiens
ttcctccctgcttaaaaatgt

SEQ ID NO: 3463466 - DNA, 15 bp, Homo sapiens
ttcctcccttctgct

SEQ ID NO: 3463467 - DNA, 14 bp, Homo sapiens
ttcctcctggaaat

SEQ ID NO: 3463468 - DNA, 11 bp, Homo sapiens
ttcctcctggg

SEQ ID NO: 3463469 - DNA, 15 bp, Homo sapiens
ttcctcctgggccct

SEQ ID NO: 3463470 - DNA, 11 bp, Homo sapiens
ttcctcctttc

SEQ ID NO: 3463471 - DNA, 13 bp, Homo sapiens
ttcctctttgctt

SEQ ID NO: 3463472 - DNA, 16 bp, Homo sapiens
ttcctctttgctttgc

SEQ ID NO: 3463473 - DNA, 20 bp, Homo sapiens
ttcctgaaactatattttgt

SEQ ID NO: 3463474 - DNA, 15 bp, Homo sapiens
ttcctgaagaaccag

SEQ ID NO: 3463475 - DNA, 17 bp, Homo sapiens
ttcctgataataaagga

SEQ ID NO: 3463476 - DNA, 21 bp, Homo sapiens
ttcctgcaggccaggccagct

SEQ ID NO: 3463477 - DNA, 15 bp, Homo sapiens
ttcctggagcccaga

SEQ ID NO: 3463478 - DNA, 13 bp, Homo sapiens
ttcctggatgtct

SEQ ID NO: 3463479 - DNA, 16 bp, Homo sapiens
ttcctgtccagctcca

SEQ ID NO: 3463480 - DNA, 17 bp, Homo sapiens
ttcctgtccagctccaa

SEQ ID NO: 3463481 - DNA, 14 bp, Homo sapiens
ttcctgtccctgcg

SEQ ID NO: 3463482 - DNA, 15 bp, Homo sapiens
ttcctgtccctgcgc

SEQ ID NO: 3463483 - DNA, 21 bp, Homo sapiens
ttcctgtccctgcgcctttcc

SEQ ID NO: 3463484 - DNA, 20 bp, Homo sapiens
ttcctgtcctcccagctcct

SEQ ID NO: 3463485 - DNA, 20 bp, Homo sapiens
ttcctgtgatacatttctga

SEQ ID NO: 3463486 - DNA, 13 bp, Homo sapiens
ttcctgtgtcaat

SEQ ID NO: 3463487 - DNA, 11 bp, Homo sapiens
ttcctgtgtct

SEQ ID NO: 3463488 - DNA, 13 bp, Homo sapiens
ttcctgttctgaa

SEQ ID NO: 3463489 - DNA, 23 bp, Homo sapiens
ttccttacctttaccccatccct

SEQ ID NO: 3463490 - DNA, 19 bp, Homo sapiens
ttccttcgaaaggccttca

SEQ ID NO: 3463491 - DNA, 16 bp, Homo sapiens
ttccttctcatctgtg

SEQ ID NO: 3463492 - DNA, 15 bp, Homo sapiens
ttccttctcccatct

SEQ ID NO: 3463493 - DNA, 20 bp, Homo sapiens
ttccttctcccatctcttcc

SEQ ID NO: 3463494 - DNA, 22 bp, Homo sapiens
ttccttgacctgcattgtaaat

SEQ ID NO: 3463495 - DNA, 24 bp, Homo sapiens
ttccttgagacacggagcccagcc

SEQ ID NO: 3463496 - DNA, 15 bp, Homo sapiens
ttccttggctggtgc

SEQ ID NO: 3463497 - DNA, 13 bp, Homo sapiens
ttcctttaaaaaa

SEQ ID NO: 3463498 - DNA, 22 bp, Homo sapiens
ttcctttccaacgtttggaaga

SEQ ID NO: 3463499 - DNA, 13 bp, Homo sapiens
ttcctttgaagat

SEQ ID NO: 3463500 - DNA, 15 bp, Homo sapiens
ttcctttgctctttc

SEQ ID NO: 3463501 - DNA, 23 bp, Homo sapiens
ttcctttgggtatgttaacctag

SEQ ID NO: 3463502 - DNA, 20 bp, Homo sapiens
ttccttttgaacgccccccc

SEQ ID NO: 3463503 - DNA, 13 bp, Homo sapiens
ttccttttttccc

SEQ ID NO: 3463504 - DNA, 19 bp, Homo sapiens
ttccttttttcccataaga

SEQ ID NO: 3463505 - DNA, 13 bp, Homo sapiens
ttcgaaaggcctt

SEQ ID NO: 3463506 - DNA, 15 bp, Homo sapiens
ttcgaaaggccttca

SEQ ID NO: 3463507 - DNA, 14 bp, Homo sapiens
ttcgagaccagcct

SEQ ID NO: 3463508 - DNA, 15 bp, Homo sapiens
ttcgagaccagcctg

SEQ ID NO: 3463509 - DNA, 12 bp, Homo sapiens
ttcgaggcctga

SEQ ID NO: 3463510 - DNA, 15 bp, Homo sapiens
ttcgaggcctgaagc

SEQ ID NO: 3463511 - DNA, 18 bp, Homo sapiens
ttcgatggtacgtgaccc

SEQ ID NO: 3463512 - DNA, 14 bp, Homo sapiens
ttcgcatggtcaca

SEQ ID NO: 3463513 - DNA, 16 bp, Homo sapiens
ttcgcatggtcacaca

SEQ ID NO: 3463514 - DNA, 18 bp, Homo sapiens
ttcgcatggtcacacact

SEQ ID NO: 3463515 - DNA, 14 bp, Homo sapiens
ttcgccaaactgtc

SEQ ID NO: 3463516 - DNA, 22 bp, Homo sapiens
ttcgcgatggacagactcacaa

SEQ ID NO: 3463517 - DNA, 15 bp, Homo sapiens
ttcgctcctgtgtct

SEQ ID NO: 3463518 - DNA, 17 bp, Homo sapiens
ttcggaatttttaaaat

SEQ ID NO: 3463519 - DNA, 17 bp, Homo sapiens
ttcggatttggggtgga

SEQ ID NO: 3463520 - DNA, 16 bp, Homo sapiens
ttcggcctttgggtgt

SEQ ID NO: 3463521 - DNA, 20 bp, Homo sapiens
ttcgggaggtcgaggcagga

SEQ ID NO: 3463522 - DNA, 17 bp, Homo sapiens
ttcgggtgtgcaatgtc

SEQ ID NO: 3463523 - DNA, 17 bp, Homo sapiens
ttcgtccacagcttcct

SEQ ID NO: 3463524 - DNA, 12 bp, Homo sapiens
ttcgtctactgc

SEQ ID NO: 3463525 - DNA, 21 bp, Homo sapiens
ttcgtgaagtatactgtattt

SEQ ID NO: 3463526 - DNA, 18 bp, Homo sapiens
ttctaaacccaatccaaa

SEQ ID NO: 3463527 - DNA, 23 bp, Homo sapiens
ttctaaacccaatccaaatggcg

SEQ ID NO: 3463528 - DNA, 21 bp, Homo sapiens
ttctaaataaaagttttacaa

SEQ ID NO: 3463529 - DNA, 12 bp, Homo sapiens
ttctaaattaaa

SEQ ID NO: 3463530 - DNA, 23 bp, Homo sapiens
ttctaaggaaatggagaagctct

SEQ ID NO: 3463531 - DNA, 15 bp, Homo sapiens
ttctaagtctttcca

SEQ ID NO: 3463532 - DNA, 18 bp, Homo sapiens
ttctaatagaactcagtt

SEQ ID NO: 3463533 - DNA, 23 bp, Homo sapiens
ttctaatgaggagagaaaatata

SEQ ID NO: 3463534 - DNA, 15 bp, Homo sapiens
ttctacacagagcag

SEQ ID NO: 3463535 - DNA, 16 bp, Homo sapiens
ttcttatacgcttttc

SEQ ID NO: 3463536 - DNA, 17 bp, Homo sapiens
ttcttatacgcttttct

SEQ ID NO: 3463537 - DNA, 15 bp, Homo sapiens
ttcttatggaattga

SEQ ID NO: 3463538 - DNA, 22 bp, Homo sapiens
ttcttatggaattgatttgcat

SEQ ID NO: 3463539 - DNA, 19 bp, Homo sapiens
ttcttattgcgctgctacc

SEQ ID NO: 3463540 - DNA, 15 bp, Homo sapiens
ttcttcacctcttcc

SEQ ID NO: 3463541 - DNA, 22 bp, Homo sapiens
ttcttcactgtcctccaagcca

SEQ ID NO: 3463542 - DNA, 18 bp, Homo sapiens
ttcttcagagtttgtcat

SEQ ID NO: 3463543 - DNA, 20 bp, Homo sapiens
ttcttcatattctaaaacca

SEQ ID NO: 3463544 - DNA, 20 bp, Homo sapiens
ttcttcccttttacatactg

SEQ ID NO: 3463545 - DNA, 17 bp, Homo sapiens
ttcttcgaaaatctaga

SEQ ID NO: 3463546 - DNA, 15 bp, Homo sapiens
ttcttctcctatgtg

SEQ ID NO: 3463547 - DNA, 22 bp, Homo sapiens
ttcttcttcacatccattgtct

SEQ ID NO: 3463548 - DNA, 21 bp, Homo sapiens
ttcttgaatttaataatctgt

SEQ ID NO: 3463549 - DNA, 20 bp, Homo sapiens
ttcttgaatttttttctgca

SEQ ID NO: 3463550 - DNA, 22 bp, Homo sapiens
ttcttgaatttttttctgcaca

SEQ ID NO: 3463551 - DNA, 21 bp, Homo sapiens
ttcttgatggagattaagatg

SEQ ID NO: 3463552 - DNA, 15 bp, Homo sapiens
ttcttgcctctgtgc

SEQ ID NO: 3463553 - DNA, 17 bp, Homo sapiens
ttcttgcctctgtgctg

SEQ ID NO: 3463554 - DNA, 16 bp, Homo sapiens
ttcttgtttccttgtt

SEQ ID NO: 3463555 - DNA, 18 bp, Homo sapiens
ttctttaaatatatatta

SEQ ID NO: 3463556 - DNA, 18 bp, Homo sapiens
ttctttactattaaaata

SEQ ID NO: 3463557 - DNA, 17 bp, Homo sapiens
ttctttagatggtggca

SEQ ID NO: 3463558 - DNA, 18 bp, Homo sapiens
ttctttatttttgttaat

SEQ ID NO: 3463559 - DNA, 13 bp, Homo sapiens
ttctttcttagaa

SEQ ID NO: 3463560 - DNA, 15 bp, Homo sapiens
ttctttcttagaaat

SEQ ID NO: 3463561 - DNA, 17 bp, Homo sapiens
ttctttgagactgggtc

SEQ ID NO: 3463562 - DNA, 20 bp, Homo sapiens
ttctttgggaatatttgaat

SEQ ID NO: 3463563 - DNA, 22 bp, Homo sapiens
ttctttgggaatatttgaatct

SEQ ID NO: 3463564 - DNA, 15 bp, Homo sapiens
ttcttttatttgtta

SEQ ID NO: 3463565 - DNA, 15 bp, Homo sapiens
ttcttttgaattgtt

SEQ ID NO: 3463566 - DNA, 13 bp, Homo sapiens
ttcttttgtaatt

SEQ ID NO: 3463567 - DNA, 14 bp, Homo sapiens
ttcttttgtatgta

SEQ ID NO: 3463568 - DNA, 20 bp, Homo sapiens
ttcttttgtatgtaaatgtg

SEQ ID NO: 3463569 - DNA, 15 bp, Homo sapiens
ttctttttattgaat

SEQ ID NO: 3463570 - DNA, 13 bp, Homo sapiens
ttctttttctgag

SEQ ID NO: 3463571 - DNA, 18 bp, Homo sapiens
ttctttttttattaaaca

SEQ ID NO: 3463572 - DNA, 18 bp, Homo sapiens
ttctttttttccttttta

SEQ ID NO: 3463573 - DNA, 16 bp, Homo sapiens
ttgaaaacctgacaaa

SEQ ID NO: 3463574 - DNA, 17 bp, Homo sapiens
ttgaaactcactagtaa

SEQ ID NO: 3463575 - DNA, 12 bp, Homo sapiens
ttgaaagctgtg

SEQ ID NO: 3463576 - DNA, 15 bp, Homo sapiens
ttgaaagttctggaa

SEQ ID NO: 3463577 - DNA, 16 bp, Homo sapiens
ttgaaattctgaattt

SEQ ID NO: 3463578 - DNA, 20 bp, Homo sapiens
ttgaaattctgaatttgcaa

SEQ ID NO: 3463579 - DNA, 21 bp, Homo sapiens
ttgaaattctgaatttgcaaa

SEQ ID NO: 3463580 - DNA, 17 bp, Homo sapiens
ttgaaattgtattacaa

SEQ ID NO: 3463581 - DNA, 15 bp, Homo sapiens
ttgaacacaaactgt

SEQ ID NO: 3463582 - DNA, 22 bp, Homo sapiens
ttgaactttcctggatgtctga

SEQ ID NO: 3463583 - DNA, 16 bp, Homo sapiens
ttgaagaactgcaggc

SEQ ID NO: 3463584 - DNA, 20 bp, Homo sapiens
ttgaagaactgcaggccctg

SEQ ID NO: 3463585 - DNA, 19 bp, Homo sapiens
ttgaagagaaaaaagtcac

SEQ ID NO: 3463586 - DNA, 22 bp, Homo sapiens
ttgaagagaaaaaagtcaccat

SEQ ID NO: 3463587 - DNA, 17 bp, Homo sapiens
ttgaagctgctgtctct

SEQ ID NO: 3463588 - DNA, 12 bp, Homo sapiens
ttgaaggcaaaa

SEQ ID NO: 3463589 - DNA, 15 bp, Homo sapiens
ttgaaggccctgctg

SEQ ID NO: 3463590 - DNA, 20 bp, Homo sapiens
ttgaaggccctgctgagtca

SEQ ID NO: 3463591 - DNA, 17 bp, Homo sapiens
ttgaagtgtaggcagac

SEQ ID NO: 3463592 - DNA, 21 bp, Homo sapiens
ttgaagtgttctgagctgtat

SEQ ID NO: 3463593 - DNA, 19 bp, Homo sapiens
ttgaagttgttactaacta

SEQ ID NO: 3463594 - DNA, 12 bp, Homo sapiens
ttgaataaagaa

SEQ ID NO: 3463595 - DNA, 20 bp, Homo sapiens
ttgaataataagcaggatgt

SEQ ID NO: 3463596 - DNA, 13 bp, Homo sapiens
ttgaatacttttt

SEQ ID NO: 3463597 - DNA, 14 bp, Homo sapiens
ttgaatagcttatg

SEQ ID NO: 3463598 - DNA, 22 bp, Homo sapiens
ttgaatgtggcttgagaaatat

SEQ ID NO: 3463599 - DNA, 13 bp, Homo sapiens
ttgaatgttaaat

SEQ ID NO: 3463600 - DNA, 15 bp, Homo sapiens
ttgaattgtaactgt

SEQ ID NO: 3463601 - DNA, 14 bp, Homo sapiens
ttgaattgttacat

SEQ ID NO: 3463602 - DNA, 18 bp, Homo sapiens
ttgaatttttttctgcac

SEQ ID NO: 3463603 - DNA, 22 bp, Homo sapiens
ttgaatttttttctgcacagct

SEQ ID NO: 3463604 - DNA, 12 bp, Homo sapiens
ttgacaacatct

SEQ ID NO: 3463605 - DNA, 16 bp, Homo sapiens
ttgacaagtgtctttt

SEQ ID NO: 3463606 - DNA, 14 bp, Homo sapiens
ttgacaataaaata

SEQ ID NO: 3463607 - DNA, 15 bp, Homo sapiens
ttgacaataaaatat

SEQ ID NO: 3463608 - DNA, 18 bp, Homo sapiens
ttgacaataatttcaggt

SEQ ID NO: 3463609 - DNA, 14 bp, Homo sapiens
ttgacacaagtgga

SEQ ID NO: 3463610 - DNA, 19 bp, Homo sapiens
ttgacacaggtctttccta

SEQ ID NO: 3463611 - DNA, 11 bp, Homo sapiens
ttgacacatag

SEQ ID NO: 3463612 - DNA, 19 bp, Homo sapiens
ttgacagctttgctgctga

SEQ ID NO: 3463613 - DNA, 13 bp, Homo sapiens
ttgacatatttaa

SEQ ID NO: 3463614 - DNA, 18 bp, Homo sapiens
ttgacatatttaatgttt

SEQ ID NO: 3463615 - DNA, 18 bp, Homo sapiens
ttgacattgcgtttgacc

SEQ ID NO: 3463616 - DNA, 20 bp, Homo sapiens
ttgaccaagcaggaagctca

SEQ ID NO: 3463617 - DNA, 22 bp, Homo sapiens
ttgaccaatttgcaccagtttt

SEQ ID NO: 3463618 - DNA, 14 bp, Homo sapiens
ttgaccaccagtta

SEQ ID NO: 3463619 - DNA, 21 bp, Homo sapiens
ttgaccaccagttaacgtatt

SEQ ID NO: 3463620 - DNA, 22 bp, Homo sapiens
ttgaccaccagttaacgtatta

SEQ ID NO: 3463621 - DNA, 11 bp, Homo sapiens
ttgaccaggcc

SEQ ID NO: 3463622 - DNA, 21 bp, Homo sapiens
ttgacctcaggtgatccaccc

SEQ ID NO: 3463623 - DNA, 21 bp, Homo sapiens
ttgaccttttatgtagtaatt

SEQ ID NO: 3463624 - DNA, 19 bp, Homo sapiens
ttgactctgcctacttctg

SEQ ID NO: 3463625 - DNA, 18 bp, Homo sapiens
ttgactctgggtccttcc

SEQ ID NO: 3463626 - DNA, 19 bp, Homo sapiens
ttgactctgggtccttcct

SEQ ID NO: 3463627 - DNA, 13 bp, Homo sapiens
ttgacttcagatt

SEQ ID NO: 3463628 - DNA, 14 bp, Homo sapiens
ttgactttcaggta

SEQ ID NO: 3463629 - DNA, 15 bp, Homo sapiens
ttgactttcaggtac

SEQ ID NO: 3463630 - DNA, 21 bp, Homo sapiens
ttgactttcaggtactaaata

SEQ ID NO: 3463631 - DNA, 14 bp, Homo sapiens
ttgactttgctcct

SEQ ID NO: 3463632 - DNA, 12 bp, Homo sapiens
ttgactttgtct

SEQ ID NO: 3463633 - DNA, 15 bp, Homo sapiens
ttgagaacgtaaaga

SEQ ID NO: 3463634 - DNA, 15 bp, Homo sapiens
ttgagaagaaaacat

SEQ ID NO: 3463635 - DNA, 22 bp, Homo sapiens
ttgagaagacctcacctagaaa

SEQ ID NO: 3463636 - DNA, 19 bp, Homo sapiens
ttgagaaggtgcctgccat

SEQ ID NO: 3463637 - DNA, 23 bp, Homo sapiens
ttgagaatcccaaatttgattga

SEQ ID NO: 3463638 - DNA, 17 bp, Homo sapiens
ttgagagaccaggcaaa

SEQ ID NO: 3463639 - DNA, 19 bp, Homo sapiens
ttgagataatacattccga

SEQ ID NO: 3463640 - DNA, 15 bp, Homo sapiens
ttgagattgtcctca

SEQ ID NO: 3463641 - DNA, 21 bp, Homo sapiens
ttgagcacaaaacctgtccta

SEQ ID NO: 3463642 - DNA, 16 bp, Homo sapiens
ttgagcagggctcagc

SEQ ID NO: 3463643 - DNA, 20 bp, Homo sapiens
ttgagcatgacagcctgcag

SEQ ID NO: 3463644 - DNA, 21 bp, Homo sapiens
ttgagcatgacagcctgcagc

SEQ ID NO: 3463645 - DNA, 22 bp, Homo sapiens
ttgagccaagcttcaaccctca

SEQ ID NO: 3463646 - DNA, 12 bp, Homo sapiens
ttgagctgtttt

SEQ ID NO: 3463647 - DNA, 13 bp, Homo sapiens
ttgaggataaatt

SEQ ID NO: 3463648 - DNA, 17 bp, Homo sapiens
ttgaggataaattgcca

SEQ ID NO: 3463649 - DNA, 17 bp, Homo sapiens
ttgagggaaagagctta

SEQ ID NO: 3463650 - DNA, 20 bp, Homo sapiens
ttgagggacgctttgtctgt

SEQ ID NO: 3463651 - DNA, 21 bp, Homo sapiens
ttgagggacgctttgtctgtc

SEQ ID NO: 3463652 - DNA, 13 bp, Homo sapiens
ttgagggttgggc

SEQ ID NO: 3463653 - DNA, 16 bp, Homo sapiens
ttgagggttgggctgg

SEQ ID NO: 3463654 - DNA, 14 bp, Homo sapiens
ttgagtgctctgat

SEQ ID NO: 3463655 - DNA, 16 bp, Homo sapiens
ttgagttcaggtagct

SEQ ID NO: 3463656 - DNA, 11 bp, Homo sapiens
ttgagtttgtc

SEQ ID NO: 3463657 - DNA, 17 bp, Homo sapiens
ttgataattcaacattt

SEQ ID NO: 3463658 - DNA, 17 bp, Homo sapiens
ttgatcaacatcttttc

SEQ ID NO: 3463659 - DNA, 22 bp, Homo sapiens
ttgatcaacatcttttcttgcc

SEQ ID NO: 3463660 - DNA, 22 bp, Homo sapiens
ttgatctgttgcaagcccctct

SEQ ID NO: 3463661 - DNA, 13 bp, Homo sapiens
ttgatgactgcct

SEQ ID NO: 3463662 - DNA, 12 bp, Homo sapiens
ttgatgtttaga

SEQ ID NO: 3463663 - DNA, 13 bp, Homo sapiens
ttgatgtttagaa

SEQ ID NO: 3463664 - DNA, 18 bp, Homo sapiens
ttgattaggtatgtttgt

SEQ ID NO: 3463665 - DNA, 15 bp, Homo sapiens
ttgattattcagtgt

SEQ ID NO: 3463666 - DNA, 17 bp, Homo sapiens
ttgattattcagtgtca

SEQ ID NO: 3463667 - DNA, 18 bp, Homo sapiens
ttgattcaaaatatttaa

SEQ ID NO: 3463668 - DNA, 18 bp, Homo sapiens
ttggcctcccaaaagact

SEQ ID NO: 3463669 - DNA, 11 bp, Homo sapiens
ttggcctgagt

SEQ ID NO: 3463670 - DNA, 22 bp, Homo sapiens
ttggctaggacccctccatgtg

SEQ ID NO: 3463671 - DNA, 13 bp, Homo sapiens
ttggctcagacat

SEQ ID NO: 3463672 - DNA, 21 bp, Homo sapiens
ttggctcgaatctctgtgcct

SEQ ID NO: 3463673 - DNA, 19 bp, Homo sapiens
ttggctgaaattctcctgg

SEQ ID NO: 3463674 - DNA, 13 bp, Homo sapiens
ttggctgcaggga

SEQ ID NO: 3463675 - DNA, 22 bp, Homo sapiens
ttggctgggggcctcagtgcca

SEQ ID NO: 3463676 - DNA, 20 bp, Homo sapiens
ttggctgtgtctaaactgca

SEQ ID NO: 3463677 - DNA, 15 bp, Homo sapiens
ttggcttgcttatgt

SEQ ID NO: 3463678 - DNA, 22 bp, Homo sapiens
ttggctttatcctctttagagt

SEQ ID NO: 3463679 - DNA, 22 bp, Homo sapiens
ttggctttgggttgcaggacct

SEQ ID NO: 3463680 - DNA, 16 bp, Homo sapiens
ttgggaaacttggctc

SEQ ID NO: 3463681 - DNA, 22 bp, Homo sapiens
ttgggaacagcatggaggcaga

SEQ ID NO: 3463682 - DNA, 21 bp, Homo sapiens
ttgggaaggggacccccgccc

SEQ ID NO: 3463683 - DNA, 19 bp, Homo sapiens
ttgggaatatccatgtact

SEQ ID NO: 3463684 - DNA, 16 bp, Homo sapiens
ttgggaatatttgaat

SEQ ID NO: 3463685 - DNA, 17 bp, Homo sapiens
ttgggagagcaggaatg

SEQ ID NO: 3463686 - DNA, 15 bp, Homo sapiens
ttgggagccactgcc

SEQ ID NO: 3463687 - DNA, 12 bp, Homo sapiens
ttgggcagagct

SEQ ID NO: 3463688 - DNA, 17 bp, Homo sapiens
ttgggcagagctggctc

SEQ ID NO: 3463689 - DNA, 17 bp, Homo sapiens
ttgggcctgctccagac

SEQ ID NO: 3463690 - DNA, 19 bp, Homo sapiens
ttggggagttaagacctgg

SEQ ID NO: 3463691 - DNA, 21 bp, Homo sapiens
ttggggagttaagacctggca

SEQ ID NO: 3463692 - DNA, 15 bp, Homo sapiens
ttggggattttcaaa

SEQ ID NO: 3463693 - DNA, 22 bp, Homo sapiens
ttggggcaacattgttcacctt

SEQ ID NO: 3463694 - DNA, 21 bp, Homo sapiens
ttggggccttgatgactgcct

SEQ ID NO: 3463695 - DNA, 17 bp, Homo sapiens
ttggggtctggcagcct

SEQ ID NO: 3463696 - DNA, 20 bp, Homo sapiens
ttggggtgggtataaaagat

SEQ ID NO: 3463697 - DNA, 17 bp, Homo sapiens
ttgggtgggcaggaaaa

SEQ ID NO: 3463698 - DNA, 13 bp, Homo sapiens
ttggtacaaaaat

SEQ ID NO: 3463699 - DNA, 14 bp, Homo sapiens
ttggtacaaaaata

SEQ ID NO: 3463700 - DNA, 15 bp, Homo sapiens
ttggtacaaaaataa

SEQ ID NO: 3463701 - DNA, 22 bp, Homo sapiens
ttggtataggaatgtagaagtc

SEQ ID NO: 3463702 - DNA, 17 bp, Homo sapiens
ttggtatgatgctgccg

SEQ ID NO: 3463703 - DNA, 14 bp, Homo sapiens
ttggtattgtattt

SEQ ID NO: 3463704 - DNA, 20 bp, Homo sapiens
ttggtcctacctattatcct

SEQ ID NO: 3463705 - DNA, 15 bp, Homo sapiens
ttggtcctctctctg

SEQ ID NO: 3463706 - DNA, 21 bp, Homo sapiens
ttggttcaataaagcactgag

SEQ ID NO: 3463707 - DNA, 14 bp, Homo sapiens
ttggttcattaatt

SEQ ID NO: 3463708 - DNA, 15 bp, Homo sapiens
ttggtttattttcac

SEQ ID NO: 3463709 - DNA, 17 bp, Homo sapiens
ttggtttattttcacag

SEQ ID NO: 3463710 - DNA, 23 bp, Homo sapiens
ttggtttttacttaactgtttca

SEQ ID NO: 3463711 - DNA, 19 bp, Homo sapiens
ttgtaaaatgttctcttat

SEQ ID NO: 3463712 - DNA, 21 bp, Homo sapiens
ttgtaaagttggttggataag

SEQ ID NO: 3463713 - DNA, 18 bp, Homo sapiens
ttgtaaataggattttta

SEQ ID NO: 3463714 - DNA, 13 bp, Homo sapiens
ttgtaaatatata

SEQ ID NO: 3463715 - DNA, 17 bp, Homo sapiens
ttgtaaatatataaata

SEQ ID NO: 3463716 - DNA, 16 bp, Homo sapiens
ttgtaaattattaatt

SEQ ID NO: 3463717 - DNA, 18 bp, Homo sapiens
ttgtaatgaattcctaga

SEQ ID NO: 3463718 - DNA, 13 bp, Homo sapiens
ttgtaattttgaa

SEQ ID NO: 3463719 - DNA, 15 bp, Homo sapiens
ttgtacaatcatgtt

SEQ ID NO: 3463720 - DNA, 17 bp, Homo sapiens
ttgtacaatcatgttct

SEQ ID NO: 3463721 - DNA, 22 bp, Homo sapiens
ttgtacagaatatttctattga

SEQ ID NO: 3463722 - DNA, 18 bp, Homo sapiens
ttgtacatatgtaaaata

SEQ ID NO: 3463723 - DNA, 12 bp, Homo sapiens
ttgtacatgaaa

SEQ ID NO: 3463724 - DNA, 13 bp, Homo sapiens
ttgtacatgaaat

SEQ ID NO: 3463725 - DNA, 23 bp, Homo sapiens
ttgtaccagtgaatttttgcaat

SEQ ID NO: 3463726 - DNA, 22 bp, Homo sapiens
ttgtaccgatgcagctctcttt

SEQ ID NO: 3463727 - DNA, 11 bp, Homo sapiens
ttgtacctctc

SEQ ID NO: 3463728 - DNA, 15 bp, Homo sapiens
ttgtagagccagggt

SEQ ID NO: 3463729 - DNA, 19 bp, Homo sapiens
ttgtatattgtgtttgtgt

SEQ ID NO: 3463730 - DNA, 21 bp, Homo sapiens
ttgtatctgcaggcagacacg

SEQ ID NO: 3463731 - DNA, 16 bp, Homo sapiens
ttgtattaaagacaga

SEQ ID NO: 3463732 - DNA, 16 bp, Homo sapiens
ttgtattctctgagct

SEQ ID NO: 3463733 - DNA, 14 bp, Homo sapiens
ttgtatttattcaa

SEQ ID NO: 3463734 - DNA, 20 bp, Homo sapiens
ttgtatttattcaataaagt

SEQ ID NO: 3463735 - DNA, 13 bp, Homo sapiens
ttgtcaacattgt

SEQ ID NO: 3463736 - DNA, 15 bp, Homo sapiens
ttgtcaacattgtga

SEQ ID NO: 3463737 - DNA, 19 bp, Homo sapiens
ttgtcaatttatgaatata

SEQ ID NO: 3463738 - DNA, 17 bp, Homo sapiens
ttgtcactagcagctgc

SEQ ID NO: 3463739 - DNA, 21 bp, Homo sapiens
ttgtcatatgtagccttcaca

SEQ ID NO: 3463740 - DNA, 21 bp, Homo sapiens
ttgtcatctttcttctatttt

SEQ ID NO: 3463741 - DNA, 14 bp, Homo sapiens
ttgtcattagcctg

SEQ ID NO: 3463742 - DNA, 13 bp, Homo sapiens
ttgtccattgtcc

SEQ ID NO: 3463743 - DNA, 20 bp, Homo sapiens
ttgtcccactcaagccaagc

SEQ ID NO: 3463744 - DNA, 20 bp, Homo sapiens
ttgtcccatctctaccccct

SEQ ID NO: 3463745 - DNA, 23 bp, Homo sapiens
ttgtccccaaatccgaacctcct

SEQ ID NO: 3463746 - DNA, 15 bp, Homo sapiens
ttgtcctcatttctc

SEQ ID NO: 3463747 - DNA, 23 bp, Homo sapiens
ttgtcctgatgcttttgtctaat

SEQ ID NO: 3463748 - DNA, 11 bp, Homo sapiens
ttgtcctgtga

SEQ ID NO: 3463749 - DNA, 14 bp, Homo sapiens
ttgtcgctcatgtg

SEQ ID NO: 3463750 - DNA, 18 bp, Homo sapiens
ttgtctagggtgttctgt

SEQ ID NO: 3463751 - DNA, 14 bp, Homo sapiens
ttgtctctactttt

SEQ ID NO: 3463752 - DNA, 22 bp, Homo sapiens
ttgtcttaaaaagtggaaaaat

SEQ ID NO: 3463753 - DNA, 14 bp, Homo sapiens
ttgtctttaactgt

SEQ ID NO: 3463754 - DNA, 19 bp, Homo sapiens
ttgtgaagaaaaataaagt

SEQ ID NO: 3463755 - DNA, 22 bp, Homo sapiens
ttgtgaagaactattttattct

SEQ ID NO: 3463756 - DNA, 18 bp, Homo sapiens
ttgtgagccaccacgtcc

SEQ ID NO: 3463757 - DNA, 19 bp, Homo sapiens
ttgtgatagcactttctac

SEQ ID NO: 3463758 - DNA, 14 bp, Homo sapiens
ttgtgctacagatg

SEQ ID NO: 3463759 - DNA, 13 bp, Homo sapiens
ttgtgctataaag

SEQ ID NO: 3463760 - DNA, 17 bp, Homo sapiens
ttgtggacacagctctt

SEQ ID NO: 3463761 - DNA, 18 bp, Homo sapiens
ttgtggccaaggagctgc

SEQ ID NO: 3463762 - DNA, 19 bp, Homo sapiens
ttgtggggcacagatgcct

SEQ ID NO: 3463763 - DNA, 23 bp, Homo sapiens
ttgtgtatttacgctttgattca

SEQ ID NO: 3463764 - DNA, 19 bp, Homo sapiens
ttgtgtcctccaggagctt

SEQ ID NO: 3463765 - DNA, 13 bp, Homo sapiens
ttgtgttcacctt

SEQ ID NO: 3463766 - DNA, 17 bp, Homo sapiens
ttgtgttgaaggaactt

SEQ ID NO: 3463767 - DNA, 15 bp, Homo sapiens
ttgtgtttggatttg

SEQ ID NO: 3463768 - DNA, 20 bp, Homo sapiens
ttgtgtttgtcattagcctg

SEQ ID NO: 3463769 - DNA, 17 bp, Homo sapiens
ttgtgtttgtgtattta

SEQ ID NO: 3463770 - DNA, 17 bp, Homo sapiens
ttgttactaactaaact

SEQ ID NO: 3463771 - DNA, 14 bp, Homo sapiens
ttgttattgcctct

SEQ ID NO: 3463772 - DNA, 15 bp, Homo sapiens
ttgttcacctttgta

SEQ ID NO: 3463773 - DNA, 20 bp, Homo sapiens
ttgttccacttgtttgcact

SEQ ID NO: 3463774 - DNA, 21 bp, Homo sapiens
ttgttccacttgtttgcactg

SEQ ID NO: 3463775 - DNA, 19 bp, Homo sapiens
ttgttccccatcatctgtg

SEQ ID NO: 3463776 - DNA, 16 bp, Homo sapiens
ttgttcccctcctcca

SEQ ID NO: 3463777 - DNA, 14 bp, Homo sapiens
ttgttccctctccc

SEQ ID NO: 3463778 - DNA, 20 bp, Homo sapiens
ttgttctctgggagaaaatc

SEQ ID NO: 3463779 - DNA, 14 bp, Homo sapiens
ttgttctctgtcca

SEQ ID NO: 3463780 - DNA, 14 bp, Homo sapiens
ttgttcttatgaac

SEQ ID NO: 3463781 - DNA, 18 bp, Homo sapiens
ttgttgagctattgctgt

SEQ ID NO: 3463782 - DNA, 15 bp, Homo sapiens
ttgttgatcttttaa

SEQ ID NO: 3463783 - DNA, 21 bp, Homo sapiens
ttgttggatccgtttgaccaa

SEQ ID NO: 3463784 - DNA, 21 bp, Homo sapiens
ttgttgtaaaacaaaatttga

SEQ ID NO: 3463785 - DNA, 18 bp, Homo sapiens
ttgtttaaaaatacacat

SEQ ID NO: 3463786 - DNA, 13 bp, Homo sapiens
ttgtttagagaat

SEQ ID NO: 3463787 - DNA, 18 bp, Homo sapiens
ttgtttattaaatagtta

SEQ ID NO: 3463788 - DNA, 16 bp, Homo sapiens
ttgtttcgtggggagg

SEQ ID NO: 3463789 - DNA, 13 bp, Homo sapiens
ttgtttgcactgt

SEQ ID NO: 3463790 - DNA, 17 bp, Homo sapiens
ttgtttggcaaggaaag

SEQ ID NO: 3463791 - DNA, 13 bp, Homo sapiens
ttgtttgtcttta

SEQ ID NO: 3463792 - DNA, 16 bp, Homo sapiens
ttgttttccaaagaaa

SEQ ID NO: 3463793 - DNA, 20 bp, Homo sapiens
ttgttttgcacactttgcca

SEQ ID NO: 3463794 - DNA, 21 bp, Homo sapiens
ttgttttttcaaaatagaaaa

SEQ ID NO: 3463795 - DNA, 18 bp, Homo sapiens
tttaaaaaaataaaacag

SEQ ID NO: 3463796 - DNA, 20 bp, Homo sapiens
tttaaaaaaataaaacagta

SEQ ID NO: 3463797 - DNA, 19 bp, Homo sapiens
tttaaaaacatagaaaaat

SEQ ID NO: 3463798 - DNA, 17 bp, Homo sapiens
tttaaaaatacacatgg

SEQ ID NO: 3463799 - DNA, 17 bp, Homo sapiens
tttaaaaatagacactc

SEQ ID NO: 3463800 - DNA, 14 bp, Homo sapiens
aaaaaaagtattat

SEQ ID NO: 3463801 - DNA, 12 bp, Homo sapiens
aaaaaagccttt

SEQ ID NO: 3463802 - DNA, 20 bp, Homo sapiens
aaaaaagtcaccattctgca

SEQ ID NO: 3463803 - DNA, 22 bp, Homo sapiens
aaaaaagtcaccattctgcatt

SEQ ID NO: 3463804 - DNA, 24 bp, Homo sapiens
aaaaaagtcaccattctgcattta

SEQ ID NO: 3463805 - DNA, 17 bp, Homo sapiens
aaaaacaaaaccagctg

SEQ ID NO: 3463806 - DNA, 12 bp, Homo sapiens
aaaaacaaatat

SEQ ID NO: 3463807 - DNA, 15 bp, Homo sapiens
aaaaacatattcttg

SEQ ID NO: 3463808 - DNA, 16 bp, Homo sapiens
aaaaacatgtatgtgc

SEQ ID NO: 3463809 - DNA, 23 bp, Homo sapiens
aaaaaccctatatgcttactgtg

SEQ ID NO: 3463810 - DNA, 12 bp, Homo sapiens
aaaaaccttcca

SEQ ID NO: 3463811 - DNA, 23 bp, Homo sapiens
aaaaactattaaggatgtagctt

SEQ ID NO: 3463812 - DNA, 20 bp, Homo sapiens
aaaaactgtctttaaaagag

SEQ ID NO: 3463813 - DNA, 19 bp, Homo sapiens
aaaaactttgccagccatt

SEQ ID NO: 3463814 - DNA, 20 bp, Homo sapiens
aaaaagaacatgcagtttga

SEQ ID NO: 3463815 - DNA, 13 bp, Homo sapiens
aaaaagatatatt

SEQ ID NO: 3463816 - DNA, 17 bp, Homo sapiens
aaaaagatatattaaaa

SEQ ID NO: 3463817 - DNA, 20 bp, Homo sapiens
aaaaagcataaaaacatttt

SEQ ID NO: 3463818 - DNA, 17 bp, Homo sapiens
aaaaagcctccagtcca

SEQ ID NO: 3463819 - DNA, 15 bp, Homo sapiens
aaaaaggatacataa

SEQ ID NO: 3463820 - DNA, 17 bp, Homo sapiens
aaaaaggatacataatg

SEQ ID NO: 3463821 - DNA, 14 bp, Homo sapiens
aaaaaggctgaaaa

SEQ ID NO: 3463822 - DNA, 19 bp, Homo sapiens
aaaaagggctgtccatgta

SEQ ID NO: 3463823 - DNA, 16 bp, Homo sapiens
aaaaaggtgagtgggt

SEQ ID NO: 3463824 - DNA, 18 bp, Homo sapiens
aaaaaggtttacagaatt

SEQ ID NO: 3463825 - DNA, 13 bp, Homo sapiens
aaaaagtattatt

SEQ ID NO: 3463826 - DNA, 20 bp, Homo sapiens
aaaaagtccaattttaattt

SEQ ID NO: 3463827 - DNA, 18 bp, Homo sapiens
aaaaagtgcttcattctt

SEQ ID NO: 3463828 - DNA, 15 bp, Homo sapiens
aaaaagttaatgctt

SEQ ID NO: 3463829 - DNA, 14 bp, Homo sapiens
aaaaataaaacagt

SEQ ID NO: 3463830 - DNA, 18 bp, Homo sapiens
aaaaataaaacagtatct

SEQ ID NO: 3463831 - DNA, 17 bp, Homo sapiens
aaaaatacaaaaatttg

SEQ ID NO: 3463832 - DNA, 14 bp, Homo sapiens
aaaaatacatgcat

SEQ ID NO: 3463833 - DNA, 12 bp, Homo sapiens
aaaaatataaaa

SEQ ID NO: 3463834 - DNA, 15 bp, Homo sapiens
aaaaatattttttct

SEQ ID NO: 3463835 - DNA, 22 bp, Homo sapiens
aaaaatcaactttttattgcct

SEQ ID NO: 3463836 - DNA, 16 bp, Homo sapiens
aaaaatcaattaacca

SEQ ID NO: 3463837 - DNA, 20 bp, Homo sapiens
aaaaatctgcagaaggaaaa

SEQ ID NO: 3463838 - DNA, 13 bp, Homo sapiens
aaaaattaaaatg

SEQ ID NO: 3463839 - DNA, 17 bp, Homo sapiens
aaaaattaaaatggatg

SEQ ID NO: 3463840 - DNA, 18 bp, Homo sapiens
aaaaattggttctttatt

SEQ ID NO: 3463841 - DNA, 23 bp, Homo sapiens
aaaaattgtttcaaaataaaaac

SEQ ID NO: 3463842 - DNA, 12 bp, Homo sapiens
aaaaattgtttt

SEQ ID NO: 3463843 - DNA, 22 bp, Homo sapiens
aaaaattttataaaattaagca

SEQ ID NO: 3463844 - DNA, 16 bp, Homo sapiens
aaaacaataaaatttt

SEQ ID NO: 3463845 - DNA, 15 bp, Homo sapiens
aaaacaatattgttt

SEQ ID NO: 3463846 - DNA, 19 bp, Homo sapiens
aaaacactcaacaaactta

SEQ ID NO: 3463847 - DNA, 21 bp, Homo sapiens
aaaacaggtcttcatcgaatc

SEQ ID NO: 3463848 - DNA, 21 bp, Homo sapiens
aaaacatccagatacacccaa

SEQ ID NO: 3463849 - DNA, 16 bp, Homo sapiens
aaaacatctattctct

SEQ ID NO: 3463850 - DNA, 19 bp, Homo sapiens
aaaacattaagaaaatcat

SEQ ID NO: 3463851 - DNA, 15 bp, Homo sapiens
aaaacattcagagga

SEQ ID NO: 3463852 - DNA, 22 bp, Homo sapiens
aaaacattgcctttgaatgtta

SEQ ID NO: 3463853 - DNA, 18 bp, Homo sapiens
aaaacatttcaagtttac

SEQ ID NO: 3463854 - DNA, 21 bp, Homo sapiens
aaaaccaatgttctctcttct

SEQ ID NO: 3463855 - DNA, 15 bp, Homo sapiens
aaaaccacacaaaga

SEQ ID NO: 3463856 - DNA, 12 bp, Homo sapiens
aaaacccaagtg

SEQ ID NO: 3463857 - DNA, 19 bp, Homo sapiens
aaaaccctatatgcttact

SEQ ID NO: 3463858 - DNA, 22 bp, Homo sapiens
aaaaccctatatgcttactgtg

SEQ ID NO: 3463859 - DNA, 20 bp, Homo sapiens
aaaacctcatgacagccaga

SEQ ID NO: 3463860 - DNA, 20 bp, Homo sapiens
aaaacctccagtagtggaca

SEQ ID NO: 3463861 - DNA, 14 bp, Homo sapiens
aaaactgcatttca

SEQ ID NO: 3463862 - DNA, 19 bp, Homo sapiens
aaaactgcgttaaaggctc

SEQ ID NO: 3463863 - DNA, 22 bp, Homo sapiens
aaaactgctgactgttttctct

SEQ ID NO: 3463864 - DNA, 23 bp, Homo sapiens
aaaactgctgactgttttctctt

SEQ ID NO: 3463865 - DNA, 19 bp, Homo sapiens
aaaactgggcctgtagctc

SEQ ID NO: 3463866 - DNA, 11 bp, Homo sapiens
aaaagaaaaag

SEQ ID NO: 3463867 - DNA, 17 bp, Homo sapiens
aaaagaacatgcagttt

SEQ ID NO: 3463868 - DNA, 14 bp, Homo sapiens
aaaagacttcccta

SEQ ID NO: 3463869 - DNA, 20 bp, Homo sapiens
aaaagacttccctaacactt

SEQ ID NO: 3463870 - DNA, 22 bp, Homo sapiens
aaaagataatattttacataca

SEQ ID NO: 3463871 - DNA, 13 bp, Homo sapiens
aaaagatataagt

SEQ ID NO: 3463872 - DNA, 18 bp, Homo sapiens
aaaagatataagtgctgt

SEQ ID NO: 3463873 - DNA, 13 bp, Homo sapiens
aaaagatgcttct

SEQ ID NO: 3463874 - DNA, 13 bp, Homo sapiens
aaaagatgctttt

SEQ ID NO: 3463875 - DNA, 16 bp, Homo sapiens
aaaagcagctctcccc

SEQ ID NO: 3463876 - DNA, 18 bp, Homo sapiens
aaaagctgtattttgaaa

SEQ ID NO: 3463877 - DNA, 22 bp, Homo sapiens
aaaaggagccaatttaaagaaa

SEQ ID NO: 3463878 - DNA, 19 bp, Homo sapiens
aaaaggatctttgtggcca

SEQ ID NO: 3463879 - DNA, 23 bp, Homo sapiens
aaaaggatctttgtggccaagga

SEQ ID NO: 3463880 - DNA, 11 bp, Homo sapiens
aaaaggcagga

SEQ ID NO: 3463881 - DNA, 23 bp, Homo sapiens
aaaaggccaaacctctgttcagt

SEQ ID NO: 3463882 - DNA, 13 bp, Homo sapiens
aaaaggctgaaaa

SEQ ID NO: 3463883 - DNA, 20 bp, Homo sapiens
aaaaggtgtaggcctgcctt

SEQ ID NO: 3463884 - DNA, 13 bp, Homo sapiens
aaaaggtttacag

SEQ ID NO: 3463885 - DNA, 14 bp, Homo sapiens
aaaaggtttacaga

SEQ ID NO: 3463886 - DNA, 20 bp, Homo sapiens
aaaagtattcgttacatctt

SEQ ID NO: 3463887 - DNA, 19 bp, Homo sapiens
aaaagtcaccattctgcat

SEQ ID NO: 3463888 - DNA, 13 bp, Homo sapiens
aaaagtccaattt

SEQ ID NO: 3463889 - DNA, 16 bp, Homo sapiens
aaaagttaatgcttaa

SEQ ID NO: 3463890 - DNA, 17 bp, Homo sapiens
aaaagttctgacttgac

SEQ ID NO: 3463891 - DNA, 14 bp, Homo sapiens
aaaagttgaaatta

SEQ ID NO: 3463892 - DNA, 15 bp, Homo sapiens
aaaagtttagaactt

SEQ ID NO: 3463893 - DNA, 11 bp, Homo sapiens
aaaataaaaac

SEQ ID NO: 3463894 - DNA, 13 bp, Homo sapiens
aaaataaaacaaa

SEQ ID NO: 3463895 - DNA, 13 bp, Homo sapiens
aaaataaactgta

SEQ ID NO: 3463896 - DNA, 11 bp, Homo sapiens
aaaataaatat

SEQ ID NO: 3463897 - DNA, 14 bp, Homo sapiens
aaaataaatatata

SEQ ID NO: 3463898 - DNA, 14 bp, Homo sapiens
aaaataacacacat

SEQ ID NO: 3463899 - DNA, 16 bp, Homo sapiens
aaaataagaatagaaa

SEQ ID NO: 3463900 - DNA, 16 bp, Homo sapiens
aaaataatactgctga

SEQ ID NO: 3463901 - DNA, 16 bp, Homo sapiens
aaaatacaaaaatttg

SEQ ID NO: 3463902 - DNA, 17 bp, Homo sapiens
aaaatacaaaaatttgc

SEQ ID NO: 3463903 - DNA, 12 bp, Homo sapiens
aaaatactccaa

SEQ ID NO: 3463904 - DNA, 16 bp, Homo sapiens
aaaatactccaaagat

SEQ ID NO: 3463905 - DNA, 21 bp, Homo sapiens
aaaatactccaaagatgactt

SEQ ID NO: 3463906 - DNA, 15 bp, Homo sapiens
aaaatagaaaagtta

SEQ ID NO: 3463907 - DNA, 16 bp, Homo sapiens
aaaatagaatatagca

SEQ ID NO: 3463908 - DNA, 17 bp, Homo sapiens
aaaatagaatatagcat

SEQ ID NO: 3463909 - DNA, 22 bp, Homo sapiens
aaaatagataagagtagaaact

SEQ ID NO: 3463910 - DNA, 12 bp, Homo sapiens
aaaatagcctgc

SEQ ID NO: 3463911 - DNA, 16 bp, Homo sapiens
aaaatataagtaaagt

SEQ ID NO: 3463912 - DNA, 13 bp, Homo sapiens
aaaatatatgtat

SEQ ID NO: 3463913 - DNA, 15 bp, Homo sapiens
aaaatatatgtattt

SEQ ID NO: 3463914 - DNA, 12 bp, Homo sapiens
aaaatatttaaa

SEQ ID NO: 3463915 - DNA, 20 bp, Homo sapiens
aaaatatttaaaaatgtctt

SEQ ID NO: 3463916 - DNA, 16 bp, Homo sapiens
aaaatattttcctgcc

SEQ ID NO: 3463917 - DNA, 12 bp, Homo sapiens
aaaatattttgg

SEQ ID NO: 3463918 - DNA, 13 bp, Homo sapiens
aaaatcaactttt

SEQ ID NO: 3463919 - DNA, 23 bp, Homo sapiens
aaaatcacactgtaaatatgaat

SEQ ID NO: 3463920 - DNA, 14 bp, Homo sapiens
aaaatcagccaatt

SEQ ID NO: 3463921 - DNA, 17 bp, Homo sapiens
aaaatcagccaattatg

SEQ ID NO: 3463922 - DNA, 21 bp, Homo sapiens
aaaatcagccaattatgttaa

SEQ ID NO: 3463923 - DNA, 24 bp, Homo sapiens
aaaatcagccaattatgttaaact

SEQ ID NO: 3463924 - DNA, 21 bp, Homo sapiens
aaaatcagcctgctccagctg

SEQ ID NO: 3463925 - DNA, 13 bp, Homo sapiens
aaaatcatattgc

SEQ ID NO: 3463926 - DNA, 14 bp, Homo sapiens
aaaatcatattgct

SEQ ID NO: 3463927 - DNA, 18 bp, Homo sapiens
aaaatcatattgcttctt

SEQ ID NO: 3463928 - DNA, 20 bp, Homo sapiens
aaaatcatcaagaagggctg

SEQ ID NO: 3463929 - DNA, 17 bp, Homo sapiens
aaaatctttctttctta

SEQ ID NO: 3463930 - DNA, 21 bp, Homo sapiens
aaaatctttctttcttagaaa

SEQ ID NO: 3463931 - DNA, 21 bp, Homo sapiens
aaaatgagcctggcaagaatg

SEQ ID NO: 3463932 - DNA, 23 bp, Homo sapiens
aaaatgatgtgtacccaaacgtg

SEQ ID NO: 3463933 - DNA, 20 bp, Homo sapiens
aaaatgcaaatcctatgtga

SEQ ID NO: 3463934 - DNA, 17 bp, Homo sapiens
aaaatgcccttaaatca

SEQ ID NO: 3463935 - DNA, 22 bp, Homo sapiens
aaaatgcctcagtgtatttgta

SEQ ID NO: 3463936 - DNA, 18 bp, Homo sapiens
aaaatgctttttatttct

SEQ ID NO: 3463937 - DNA, 23 bp, Homo sapiens
aaaatggatgccttgaataataa

SEQ ID NO: 3463938 - DNA, 20 bp, Homo sapiens
aaaatggcagtgatgaattt

SEQ ID NO: 3463939 - DNA, 17 bp, Homo sapiens
aaaatgtatatgcactt

SEQ ID NO: 3463940 - DNA, 23 bp, Homo sapiens
aaaattataggaatatcaatata

SEQ ID NO: 3463941 - DNA, 14 bp, Homo sapiens
aaaattcaattgta

SEQ ID NO: 3463942 - DNA, 18 bp, Homo sapiens
aaaattcagcaaaccatt

SEQ ID NO: 3463943 - DNA, 21 bp, Homo sapiens
aaaattcagcaaaccattttt

SEQ ID NO: 3463944 - DNA, 13 bp, Homo sapiens
aaaattctgaatt

SEQ ID NO: 3463945 - DNA, 15 bp, Homo sapiens
aaaattctgaatttt

SEQ ID NO: 3463946 - DNA, 20 bp, Homo sapiens
aaaattgatttccatatttt

SEQ ID NO: 3463947 - DNA, 15 bp, Homo sapiens
aaaattgcaaatctt

SEQ ID NO: 3463948 - DNA, 13 bp, Homo sapiens
aaaattgccatat

SEQ ID NO: 3463949 - DNA, 14 bp, Homo sapiens
aaaattgccatatt

SEQ ID NO: 3463950 - DNA, 18 bp, Homo sapiens
aaaattgccatattgcac

SEQ ID NO: 3463951 - DNA, 19 bp, Homo sapiens
aaaattgccatattgcaca

SEQ ID NO: 3463952 - DNA, 19 bp, Homo sapiens
aaaattttgtcccatctct

SEQ ID NO: 3463953 - DNA, 20 bp, Homo sapiens
aaaattttgtgacattcctt

SEQ ID NO: 3463954 - DNA, 18 bp, Homo sapiens
aaaattttttttcatgtt

SEQ ID NO: 3463955 - DNA, 16 bp, Homo sapiens
aaacaaaaagaacaaa

SEQ ID NO: 3463956 - DNA, 14 bp, Homo sapiens
aaacaaaaagcagg

SEQ ID NO: 3463957 - DNA, 19 bp, Homo sapiens
aaacaaaaattaaaatcct

SEQ ID NO: 3463958 - DNA, 21 bp, Homo sapiens
aaacaaaaattaggtattttg

SEQ ID NO: 3463959 - DNA, 17 bp, Homo sapiens
aaacaaaaccagctgct

SEQ ID NO: 3463960 - DNA, 17 bp, Homo sapiens
aaacaaaatggcttcag

SEQ ID NO: 3463961 - DNA, 15 bp, Homo sapiens
aaacaaaatttctat

SEQ ID NO: 3463962 - DNA, 15 bp, Homo sapiens
aaacaaaatttgact

SEQ ID NO: 3463963 - DNA, 17 bp, Homo sapiens
aaacaaaatttgactaa

SEQ ID NO: 3463964 - DNA, 17 bp, Homo sapiens
aaacaaagttactaggt

SEQ ID NO: 3463965 - DNA, 13 bp, Homo sapiens
aaacaaatatgca

SEQ ID NO: 3463966 - DNA, 14 bp, Homo sapiens
aaacaaatatgcaa

SEQ ID NO: 3463967 - DNA, 16 bp, Homo sapiens
aaacaacaatttctac

SEQ ID NO: 3463968 - DNA, 22 bp, Homo sapiens
aaacaacaatttctactttgaa

SEQ ID NO: 3463969 - DNA, 19 bp, Homo sapiens
aaacaacattttgagaaca

SEQ ID NO: 3463970 - DNA, 16 bp, Homo sapiens
aaacaatattgtttct

SEQ ID NO: 3463971 - DNA, 15 bp, Homo sapiens
aaacacactgaggca

SEQ ID NO: 3463972 - DNA, 21 bp, Homo sapiens
aaacacagacattctgccagg

SEQ ID NO: 3463973 - DNA, 13 bp, Homo sapiens
aaacaccattttt

SEQ ID NO: 3463974 - DNA, 21 bp, Homo sapiens
aaacacgcacttagtctctaa

SEQ ID NO: 3463975 - DNA, 14 bp, Homo sapiens
aaacactgcaggca

SEQ ID NO: 3463976 - DNA, 15 bp, Homo sapiens
aaacactgcaggcat

SEQ ID NO: 3463977 - DNA, 13 bp, Homo sapiens
aaacactgtgcac

SEQ ID NO: 3463978 - DNA, 12 bp, Homo sapiens
aaacagaagcct

SEQ ID NO: 3463979 - DNA, 21 bp, Homo sapiens
aaacagcgctgggtccacccc

SEQ ID NO: 3463980 - DNA, 13 bp, Homo sapiens
aaacagctgcctt

SEQ ID NO: 3463981 - DNA, 17 bp, Homo sapiens
aaacagctgccttagct

SEQ ID NO: 3463982 - DNA, 19 bp, Homo sapiens
aaacagctgccttagcttc

SEQ ID NO: 3463983 - DNA, 11 bp, Homo sapiens
aaacaggcagt

SEQ ID NO: 3463984 - DNA, 14 bp, Homo sapiens
aaacagtatctctt

SEQ ID NO: 3463985 - DNA, 14 bp, Homo sapiens
aaacatatgcacat

SEQ ID NO: 3463986 - DNA, 13 bp, Homo sapiens
aaacatctagaaa

SEQ ID NO: 3463987 - DNA, 16 bp, Homo sapiens
aaacatgggtttagtt

SEQ ID NO: 3463988 - DNA, 17 bp, Homo sapiens
aaacatgttagaagcaa

SEQ ID NO: 3463989 - DNA, 15 bp, Homo sapiens
aaacattaagaaaat

SEQ ID NO: 3463990 - DNA, 19 bp, Homo sapiens
aaacattaagaaaatcata

SEQ ID NO: 3463991 - DNA, 19 bp, Homo sapiens
aaacattcagaggaagaca

SEQ ID NO: 3463992 - DNA, 19 bp, Homo sapiens
aaacattttcagaaatatt

SEQ ID NO: 3463993 - DNA, 18 bp, Homo sapiens
aaaccaaaatactccaaa

SEQ ID NO: 3463994 - DNA, 23 bp, Homo sapiens
aaaccaagtcaagtgaaaaagga

SEQ ID NO: 3463995 - DNA, 14 bp, Homo sapiens
aaaccacagctgct

SEQ ID NO: 3463996 - DNA, 20 bp, Homo sapiens
aaaccactttttgcagcttt

SEQ ID NO: 3463997 - DNA, 19 bp, Homo sapiens
aaaccagtgttagggaagg

SEQ ID NO: 3463998 - DNA, 23 bp, Homo sapiens
aaaccatccagtgacaaaccatc

SEQ ID NO: 3463999 - DNA, 13 bp, Homo sapiens
aaaccatgtagaa

SEQ ID NO: 3464000 - DNA, 17 bp, Homo sapiens
aaaccatttttaaagta

SEQ ID NO: 3464001 - DNA, 16 bp, Homo sapiens
aaacccaaaaaagaac

SEQ ID NO: 3464002 - DNA, 19 bp, Homo sapiens
aaacccaagattattaaaa

SEQ ID NO: 3464003 - DNA, 15 bp, Homo sapiens
aaacccaatccaaat

SEQ ID NO: 3464004 - DNA, 14 bp, Homo sapiens
aaacccaccagcct

SEQ ID NO: 3464005 - DNA, 14 bp, Homo sapiens
aaacccagactgtc

SEQ ID NO: 3464006 - DNA, 14 bp, Homo sapiens
aaacccatggctct

SEQ ID NO: 3464007 - DNA, 18 bp, Homo sapiens
aaacccgacagagggaag

SEQ ID NO: 3464008 - DNA, 14 bp, Homo sapiens
aaaccctatatgct

SEQ ID NO: 3464009 - DNA, 22 bp, Homo sapiens
aaacctctcctcatgttctgct

SEQ ID NO: 3464010 - DNA, 13 bp, Homo sapiens
aaacgatgttgtg

SEQ ID NO: 3464011 - DNA, 13 bp, Homo sapiens
aaacgctacctct

SEQ ID NO: 3464012 - DNA, 14 bp, Homo sapiens
aaacgctgcctgcc

SEQ ID NO: 3464013 - DNA, 15 bp, Homo sapiens
aaacgggctcagcaa

SEQ ID NO: 3464014 - DNA, 13 bp, Homo sapiens
aaactaaggtgct

SEQ ID NO: 3464015 - DNA, 16 bp, Homo sapiens
aaactaaggtgctaaa

SEQ ID NO: 3464016 - DNA, 16 bp, Homo sapiens
aaactacatcttgaaa

SEQ ID NO: 3464017 - DNA, 19 bp, Homo sapiens
aaactactgcctttagaaa

SEQ ID NO: 3464018 - DNA, 20 bp, Homo sapiens
aaactacttgattttattgt

SEQ ID NO: 3464019 - DNA, 14 bp, Homo sapiens
aaactagcatatct

SEQ ID NO: 3464020 - DNA, 21 bp, Homo sapiens
aaactagcatatctgccttta

SEQ ID NO: 3464021 - DNA, 13 bp, Homo sapiens
aaactcatctcat

SEQ ID NO: 3464022 - DNA, 15 bp, Homo sapiens
aaactcatttcctat

SEQ ID NO: 3464023 - DNA, 20 bp, Homo sapiens
aaactccttcctggcctgag

SEQ ID NO: 3464024 - DNA, 17 bp, Homo sapiens
aaactctgcatccagag

SEQ ID NO: 3464025 - DNA, 19 bp, Homo sapiens
aaactctgttgcaagtgca

SEQ ID NO: 3464026 - DNA, 20 bp, Homo sapiens
aaactctgttgcaagtgcaa

SEQ ID NO: 3464027 - DNA, 14 bp, Homo sapiens
aaactgaagcaact

SEQ ID NO: 3464028 - DNA, 18 bp, Homo sapiens
aaactgaagcagcctctc

SEQ ID NO: 3464029 - DNA, 13 bp, Homo sapiens
aaactgcagtcct

SEQ ID NO: 3464030 - DNA, 17 bp, Homo sapiens
aaactgcgttaaaggct

SEQ ID NO: 3464031 - DNA, 20 bp, Homo sapiens
aaactggggcctccagaact

SEQ ID NO: 3464032 - DNA, 12 bp, Homo sapiens
aaactgtgcacc

SEQ ID NO: 3464033 - DNA, 14 bp, Homo sapiens
aaactgtgcttctc

SEQ ID NO: 3464034 - DNA, 23 bp, Homo sapiens
aaactgtgcttctctatgataat

SEQ ID NO: 3464035 - DNA, 19 bp, Homo sapiens
aaactgttaatagttcagg

SEQ ID NO: 3464036 - DNA, 17 bp, Homo sapiens
aaacttccccatcttct

SEQ ID NO: 3464037 - DNA, 24 bp, Homo sapiens
aaacttggctcgaatctctgtgcc

SEQ ID NO: 3464038 - DNA, 12 bp, Homo sapiens
aaacttgggcac

SEQ ID NO: 3464039 - DNA, 23 bp, Homo sapiens
aaactttgaggataactttttaa

SEQ ID NO: 3464040 - DNA, 15 bp, Homo sapiens
aaactttgattcttt

SEQ ID NO: 3464041 - DNA, 16 bp, Homo sapiens
aaacttttaaacatga

SEQ ID NO: 3464042 - DNA, 20 bp, Homo sapiens
aaagaaaagtattgtttgga

SEQ ID NO: 3464043 - DNA, 15 bp, Homo sapiens
aaagaaaccacttct

SEQ ID NO: 3464044 - DNA, 14 bp, Homo sapiens
aaagaaataaccac

SEQ ID NO: 3464045 - DNA, 20 bp, Homo sapiens
aaagaacatgcagtttgaaa

SEQ ID NO: 3464046 - DNA, 21 bp, Homo sapiens
aaagaacatgcagtttgaaat

SEQ ID NO: 3464047 - DNA, 20 bp, Homo sapiens
aaagaagcccaatattataa

SEQ ID NO: 3464048 - DNA, 16 bp, Homo sapiens
aaagaagcccccagct

SEQ ID NO: 3464049 - DNA, 18 bp, Homo sapiens
aaagaagttattttccag

SEQ ID NO: 3464050 - DNA, 15 bp, Homo sapiens
aaagaatacttgaac

SEQ ID NO: 3464051 - DNA, 18 bp, Homo sapiens
aaagaattccaaagcaaa

SEQ ID NO: 3464052 - DNA, 16 bp, Homo sapiens
aaagacaaatcaaagc

SEQ ID NO: 3464053 - DNA, 19 bp, Homo sapiens
aaagacaaatcaaagcaga

SEQ ID NO: 3464054 - DNA, 22 bp, Homo sapiens
aaagacaaattctgtttcttga

SEQ ID NO: 3464055 - DNA, 13 bp, Homo sapiens
aaagacagtgaaa

SEQ ID NO: 3464056 - DNA, 15 bp, Homo sapiens
aaagaccaaaatgaa

SEQ ID NO: 3464057 - DNA, 18 bp, Homo sapiens
aaagactgtgaacagctt

SEQ ID NO: 3464058 - DNA, 21 bp, Homo sapiens
aaagagaattgggggcttagg

SEQ ID NO: 3464059 - DNA, 18 bp, Homo sapiens
aaagagagaacaggacta

SEQ ID NO: 3464060 - DNA, 11 bp, Homo sapiens
aaagagagaga

SEQ ID NO: 3464061 - DNA, 20 bp, Homo sapiens
aaagagagagagagaaaaaa

SEQ ID NO: 3464062 - DNA, 17 bp, Homo sapiens
aaagagatatgggaaca

SEQ ID NO: 3464063 - DNA, 20 bp, Homo sapiens
aaagagctcagacattttct

SEQ ID NO: 3464064 - DNA, 21 bp, Homo sapiens
aaagataatattttacataca

SEQ ID NO: 3464065 - DNA, 21 bp, Homo sapiens
aaagatacagaactctttcaa

SEQ ID NO: 3464066 - DNA, 22 bp, Homo sapiens
aaagatataagtgctgtataaa

SEQ ID NO: 3464067 - DNA, 20 bp, Homo sapiens
aaagatatattaaaaatata

SEQ ID NO: 3464068 - DNA, 20 bp, Homo sapiens
aaagatctgtcctcagcctt

SEQ ID NO: 3464069 - DNA, 13 bp, Homo sapiens
aaagatctgtttt

SEQ ID NO: 3464070 - DNA, 20 bp, Homo sapiens
aaagatgacttcccctgcct

SEQ ID NO: 3464071 - DNA, 19 bp, Homo sapiens
aaagatgagaggggctcag

SEQ ID NO: 3464072 - DNA, 22 bp, Homo sapiens
aaagatgccgggttttatattt

SEQ ID NO: 3464073 - DNA, 21 bp, Homo sapiens
aaagatggggtctgtaaaatc

SEQ ID NO: 3464074 - DNA, 15 bp, Homo sapiens
aaagattttaatcaa

SEQ ID NO: 3464075 - DNA, 20 bp, Homo sapiens
aaagcaaggaaactatgtaa

SEQ ID NO: 3464076 - DNA, 13 bp, Homo sapiens
aaagcaaggcaca

SEQ ID NO: 3464077 - DNA, 22 bp, Homo sapiens
aaagcaagtgattgggacagag

SEQ ID NO: 3464078 - DNA, 22 bp, Homo sapiens
aaagcacaggtgggcttcccag

SEQ ID NO: 3464079 - DNA, 20 bp, Homo sapiens
aaagcaggggagtatgcaaa

SEQ ID NO: 3464080 - DNA, 22 bp, Homo sapiens
aaagcagtagaaataatatgca

SEQ ID NO: 3464081 - DNA, 21 bp, Homo sapiens
aaagcagttctgatgcttaca

SEQ ID NO: 3464082 - DNA, 18 bp, Homo sapiens
aaagcataaaaacatttt

SEQ ID NO: 3464083 - DNA, 12 bp, Homo sapiens
aaagcatttata

SEQ ID NO: 3464084 - DNA, 14 bp, Homo sapiens
aaagccagaagctg

SEQ ID NO: 3464085 - DNA, 18 bp, Homo sapiens
aaagccttcttttggggg

SEQ ID NO: 3464086 - DNA, 13 bp, Homo sapiens
aaagcggctgcct

SEQ ID NO: 3464087 - DNA, 14 bp, Homo sapiens
aaagctaggcctgg

SEQ ID NO: 3464088 - DNA, 22 bp, Homo sapiens
aaagctagtgtacctcctctca

SEQ ID NO: 3464089 - DNA, 20 bp, Homo sapiens
aaagctggtggcagagtcct

SEQ ID NO: 3464090 - DNA, 19 bp, Homo sapiens
aaagctgttctcattcctg

SEQ ID NO: 3464091 - DNA, 15 bp, Homo sapiens
aaagcttttagaaat

SEQ ID NO: 3464092 - DNA, 15 bp, Homo sapiens
aaaggaagccaaaga

SEQ ID NO: 3464093 - DNA, 17 bp, Homo sapiens
aaaggaatcatttctat

SEQ ID NO: 3464094 - DNA, 21 bp, Homo sapiens
aaaggactctggaagattttc

SEQ ID NO: 3464095 - DNA, 23 bp, Homo sapiens
aaaggactctggaagattttcat

SEQ ID NO: 3464096 - DNA, 15 bp, Homo sapiens
aaaggagagcatcgg

SEQ ID NO: 3464097 - DNA, 21 bp, Homo sapiens
aaaggagagctagcagcaggg

SEQ ID NO: 3464098 - DNA, 13 bp, Homo sapiens
aaaggatgtgatt

SEQ ID NO: 3464099 - DNA, 15 bp, Homo sapiens
aaaggcaagccagca

SEQ ID NO: 3464100 - DNA, 21 bp, Homo sapiens
aaaggcacctataaaacaggt

SEQ ID NO: 3464101 - DNA, 18 bp, Homo sapiens
aaaggcattctctgaaga

SEQ ID NO: 3464102 - DNA, 17 bp, Homo sapiens
aaaggccaaacctctgt

SEQ ID NO: 3464103 - DNA, 18 bp, Homo sapiens
aaaggctcgtttggatct

SEQ ID NO: 3464104 - DNA, 15 bp, Homo sapiens
aaaggctgaaaagaa

SEQ ID NO: 3464105 - DNA, 23 bp, Homo sapiens
aaagggagcactgggttgacttt

SEQ ID NO: 3464106 - DNA, 21 bp, Homo sapiens
aaagggcatgggtcgggagag

SEQ ID NO: 3464107 - DNA, 17 bp, Homo sapiens
aaaggggaaagaacata

SEQ ID NO: 3464108 - DNA, 21 bp, Homo sapiens
aaaggtgaaggaatatatggc

SEQ ID NO: 3464109 - DNA, 13 bp, Homo sapiens
aaaggtgccatgg

SEQ ID NO: 3464110 - DNA, 14 bp, Homo sapiens
aaaggtgttgtccc

SEQ ID NO: 3464111 - DNA, 17 bp, Homo sapiens
aaaggttcactaaagca

SEQ ID NO: 3464112 - DNA, 15 bp, Homo sapiens
aaaggtttacagaat

SEQ ID NO: 3464113 - DNA, 23 bp, Homo sapiens
aaagtacttctccaccctgctct

SEQ ID NO: 3464114 - DNA, 16 bp, Homo sapiens
aaagtattattttcca

SEQ ID NO: 3464115 - DNA, 14 bp, Homo sapiens
aaagtattcgttac

SEQ ID NO: 3464116 - DNA, 23 bp, Homo sapiens
aaagtattcgttacatcttgtag

SEQ ID NO: 3464117 - DNA, 17 bp, Homo sapiens
aaagtatttaattagtg

SEQ ID NO: 3464118 - DNA, 18 bp, Homo sapiens
aaagtcagtatcatatta

SEQ ID NO: 3464119 - DNA, 19 bp, Homo sapiens
aaagtcatgcaaaggctgg

SEQ ID NO: 3464120 - DNA, 20 bp, Homo sapiens
aaagtcatgcaaaggctggg

SEQ ID NO: 3464121 - DNA, 23 bp, Homo sapiens
aaagtcattggctttatcctctt

SEQ ID NO: 3464122 - DNA, 16 bp, Homo sapiens
aaagtcctttttttcc

SEQ ID NO: 3464123 - DNA, 21 bp, Homo sapiens
aaagtctgtatggcatgacaa

SEQ ID NO: 3464124 - DNA, 19 bp, Homo sapiens
aaagtgattgacttgactt
